United States Patent 10,233,495 (METHODS AND COMPOSITIONS FOR SCREENING AND TREATING DEVELOPMENTAL DISORDERS) - sequence listing, part 188

SEQ ID NO: 1264 - DNA, 966346 bp, Homo sapiens
tgagagtgtgtgtgcgtgtgtgtgtgtgtgtgtgcccgcgcgcgtgtgttgtagctctgtcaatccttggattagaaccaatgattgcagcttgtaggagggctgtccagggccagattgtacaatgtgtctcagtgccagagtatgagtggagataattacggagaagtcatactctctcacaccctcggctttcttgttgtgtccttcagcaaaacagtggatttaaatctccttgcacaagcttgagagcaacacaatctatcaggaaagaaagaaagaaaaaaaccgaacctgacaaaaaagaagaaaaagaagaagaaaaaaaatcatgaaaaccatccagccaaaaatgcacaattctatctcttgggcaatcttcacggggctggctgctctgtgtctcttccaaggtaagagcttgctattgatttgccttcggtagacccaggaattgtacagtgtgctttataagatttgcagactccccgagtcggctgtgctgcgctgtttgcaggtggaggagagagcgtttagacagcatggctgggacttcattctcccgactaggctgtgagaatattgatttgattctggctgctaccggaatgggggaatatgtatgtgcataagtaaaatgtgtttggtgctcctgttaggactgtgcttgtgtgcaaggctccctggcttcatgcacattcttgcacacatacacaacggagcacacatgtaagcagggggaaatgacagattcggagggcaacagggttgctaatgtgttgcttatgcgactgggaagaaattacaagaggaaactttaaatatcggccagcgaacttgcaaagcttttaaaaggagcaaaggggaaaatgcaggctagaaagaatcaggtgcttcctgtgaggttctggtcagcgatccagctgcaagggatgagtcaatttgcagcagtgggggacaactgtattagttttaaatgtgttcgggggtgtgtttgtggctggggtcggaggtgtggaagcgaggggagccggggctctgaaattctaaaaagcttttcgaagttgaagggagagaggcaataagagtcgaatgctaattttctgtttatttatcggctgagccgggagccctgggggctgcagttgagtgcaagctttgatgtccccagtgctgtgttctgtgcatttggaatcggcctccaccttgagtccatttgctgcaccgtgcctccccacaccccatcccggctctcacgtctgttcgttccagcaacagaattatccactaatcttcttgctcccacctgccctgtcctttggggtaactagtttgcctcttttatattaaacacagctaaaactcgtaaggatcgagacaagctgagaaactttcccagggtggcccagcagggctccgggaggaggagccctctcttgggaggtgaggctcagtcctatgcagttgtattcccagaggaaagttccctctgacccggtgaaaaacgatggggagtcccaccccctcgccctcttctccccctgcaatatggagttctcctgatctggactgagtcctgagctgtagtcctgctggctcttctccgaggttaggatttagggattgctgctgtcctcttgacataggttgcagtggctgcagtgtggatccacgtaaggtgggcagagagaccaggctggaaggatcaaatgtgtacacccttgactggggctcgatgaagaaggcaaggggtggggacaggagggatctgtgtcgggtgataaggaagtccaaggtggtgaatcttgcagggatgtccatgatgtcgtctgctgcacccaaccccaggaggcatgggcctcaggattccctgctgtcccctaggggctttggtgggtgtttgagtgaagggaatcaacttggaggcatcctcgattgactcctcttatataatatgaagcagtatcagtgtgtgtgtgtgtgcgtgcgtgtgtgtgcacccctgcttgttctgggtgcacaagaatgaagtggggaagctgagttcaggatcgggcagtttcggaaaagcagtttctgtgggggttgacagcaaaaatgaaaactaagcaggcaaggggtagggtgaggggtcagaggtagggagagggaaggtcccaagccctcagtcatttctatctgtcccgagatccatgtctcttctgcctgtaacatcaaactggagacaatgaccaaacttccaccatcaacagccctgctggctgcatgccaggagccccagggccatactgaatttacatataaattagcatacgtgattttttttttcatcagaataaatgcagggaagcataatatttgctcatactttgaatcatctctgaatagatgagtagcaaagtggtggtgccaatttctctaaggtgccatctgactttgtggtcttgttcctaacttggggtaggggtggtggcgacagcactatctcagaccttatcacattctaccgaatccggaatttctcaaaaagaatgatggccttatttgtgctaccctcacccagtcagccctgaacaggcttcagtggtcgtaatagaacaaggttgcccaattttaacgcagaacgacccccaaagacccgcatattgcatgccagtcagatgtggcaaaggtgatgtctgttttctctttcagaggaaggaagctgaagtctgccagctatctcttatcaaacttgcagaattactgaggcagcccaggtcttgcctgcaataatccacccctattgcattgacccagtgggactagttagaatgcagcacacattccaaggcgattttttcttctcctctgtttttgttttaagctggttcttcctagagctgctgcttcctgtgcctcctgcctcttgaaaaggtgtctggtgctaatggcaggttaggaacccctccctgacctgctcctccccacaacccaaccagcaaccaagatccagcttaggtagggaggggggtttctgagggaatcagcactgattagtgacgctgacaggaggggggattagctccctggggctctggccctaagatacaccagggttgattaagtggaggcatctcgttgccgggagcagacgctacagaactggatcaggcgctgtcccttgcagaacacccaccgcccaccttctgccactgagagcctctgaaaggaatggctgcttgtgctgcagcttcctctttctagaaaaccgaccatttctccttcgaaggattattgtttcttttaacaccttcagatttgcttggctaggttcctctcttacctttctcatttcctcacctctcctcacatcccgcatccgcttagcagctagcctgagacacagacagggcagaggagaaggaaaaggtgcctcggcaaagttcacactccccttcgcgcagcacccgggaggtgggcggtgggcgccgttcggctgggcaggccggccaggttcctgccatgcacagtacacacgtggtgccagcagcagcttgagctgggcaatgcttctgatattcaggggtggcagacgagaccatagcaatatctactggcaaagtggaaacatcagcctgggatgatgggaccctgggcctgacataggcattgtgggctcttggaagcatggcagtaaggggagggcgtcagggagcctcatcgaatggaacctgcctgccaggcttggggctgccaacttgaggcaagttcctggcaaggcgtgcacagtggcacaaatgtagctcacctccgccctttgtattaggaggccaccccaccaatggggatggccgtctgagcattcgctcaagcgtgcctggagagtgtctgccctggccggcaggtctcgctgcatgaagaccattcttgaaactgcagctttagttaccaggcacagagcctggtcctggtcctgattcttcccttttttggttcccttaaagccaaatataagcccccagatctcgtcttatcagctgcaatgtacagtccctgacttctgttctttctcagtaacctccttccatagcgctggttttaattcaggcgtcctgcgtagtgtcttcaggtgtgtctcttggttccctgcctgaggtgatagggtctagattgcctcctggcagttccctgggttctgctctctgcctgcgtactgtctgccaggctgatagtggctccttttcttgatgggccaaacaacctggtgttgattttagccaaaacttgtcccttgggatgaagtgagctctctcaacatcccaagaaatggcagaatttctgaatcaatatggggcacatgattctgacgtgtacagaaaacacatgctggagagatttgtaatgctcttgccattcaatcatagtagaggcacactttgggtaggatgaacaggtctgtgatttggcttttttcctagtattttggattcaagctcatgatctgcttctgctcacaaactagaatgctaaagattaacaaacaaacaaacaaaaaacccacattgctctctctcttgctgcagcagagatcctacaaatgcttcacacacccaatatgcgtggtctccaggtttcaagccatttctagtggtctgaacatagctccatgggggacatgtacatctaagctcaaatttctctgttttctgtagggaaaaatctctccctctgcgggcctatctccccacctgcccaccaggccggggagcgactcccctgggtgttgtaaggactcattaatgcttgtaacactccaaacatgtggtgctaagtggaactccatgctgagattatatttatgcagtttacttcctttctgctctattgtcttgttacatgtttactttatgtctatagtcatttgaaattcaataaaaccaattaaacataaaaaaagaaagcatgcagtaataaagaagtcgatggcatacagtttggaagggtcaaagggtaccatcctagtgttcctagaagcatcacctccccattgccggagggtgcttcatcttatcagagagtgcactggggaagggcagaagggctttagaaggcacttgcagggagcatgcctcccatccctttgcaaaaggaggcttcagtgtgggactgcagcgtgaatggtggagagggggagcactagggaggatggagctggaggtaggagtttcagaaaaaatagctctaatctggattggcaaagggtgggaaaaaaagagctctggcttctgctttgactgattttggtcggtaacctctgagaactttattttttctttcatgtatgtatgtatgtatgtctttatttatgcaaccctctggattaagcctgctcttgctaccactgcttaaactgaaaagatataggactgcatccattttccttcccattctctctccctccttccctccttctctccttctgcccactccccctacttctctgttcttcaccttctctttttctctttccctttttctgttttcctttcatttttccttctcctctatgggaaaaataattgatcagttgacagatctaggtcaagctggcaggggttgctctgcttcatgcaggcttgcctaggagaaggaggggagagcctgtcttcacagttcacaaggagcccagctgatgggatggaagcggggagggaggccaacggaccatgggcgagttcagccctccccaaaaggttctctgggatcctattaattacagagtcttccattatttggtatctctcacactctaattttccatatcaaatttatctttgcctatttcctgctttttttctcagcttctataagctgtctgtttcggtttttcttgttcttctttctacttgcccctcctttctcttctccttttctactgcttctaaaatcatgacaggagatcacagaatctcccctacttaagtcatattagagaaatggccttttgtttatttgcaagtggagaaacagaaaccctgccagaagagctctgtaagtcatttgcaaactgcaaaacaaaccaacaaagattcacattttcattgcggagaagagcgtatttcaagagagactgtcaagctaagaaatcaaatattggaaaacacattcttcagctctgttactaaggacatcttaggttactaaatttgatttttttttttttttttagcttcagtgagagtattgccctttgcgataagaaaagactgatcaaaagactgctggttttggctttacttcctcattcaaattcactcgctagtggtgcttcctttgctcatcttggaagcgccaccaaactctcaccctaacaccaaatccatctggttgtttatttgcccacgggttcaatcacatccaagtgtttattgagtgtctactacgttcggtgcactgttttaggtgctggagataaaacagcgatgaaaaagcaactaacggataagaccaaagacctagttgggtctctcagatttggtttggcttggcatcctttgtcataaacggaaagcaacaacagcagtaccggaagcaagggtggagacttcatggcacagcctctggcctcctgtgcaaatgatgatggatggcagggaagtaaccagccctcaatccttgttttgagacaggggtttgggaagaggaggtgcacaccctggctctgggttctcataacacagagatgctgcctttgctactccacacaacctcttgtagaaaaggagctcatggatgcctttggtgtatataggatggggaatgctgctgtgagttcactgtctttgtggtcattgtcttgtgtgtttgagttactggttgatgctgaacatcactgtcacctctctggcctctccacttcctttatgccctgacttctgcacagaactggagggccaagaagataaaaggagaataccagataaggccagggaagaatttgcctcagacagcttttgtggatgaggcaaatactattcttctgacctgtgggagggattcagaattcagggtagagctaagataacctcctctatgagaacccttttaatttgctatccaatcatcacatcttaatttagagttcctggaataatacaaatgcattattaacaaaaggaatttctttgttttcttctgatggaatacagtgttttgggcgtcacattgtgtagttgttctcctacacacccatcttctttcaatccatggattgtgtttgcagcactgtgtgtacagaggtaacaaagctgctctggcactcacactgtgtactctagctgcaccctgaatgctttgggagggctgctgctatctgcatttccatcacggtggtggtgatcatgcctaggttttctcatgaacaagaacaggtaattacctttctcataaacccatgattcttccaagtccagtggtctagaccaattatacattgcccaacttgatctcagaagtcagaatgatcctcagtgggtaggtgcaatctgcatttatttgcaatactctgtctgaaagccagtggtttgcaaacttgccataccatagaatcacctgggaaactttataaaaataccaatgtctggaccctatcacagaccaattaaatcagaatccctttgaatgggaccctacactgatatttttaagagctctccaagaaggcctaatctgcagtcaggttgaaaagtgtacctctaaagccatctgaacatgttcaaagaccttgggtaagacacatcccctatataggcttcagttttctcactctaaaataaaacacttggactaagagattttcaagtctcattccaagttcaacatttggcaatactgcaaatagtctttttgagtatagttattgataggtagtggttctaaaagaaaatactcagcaccagcctctgcctgcaggaaggtaagaatataaacagcatcacagacgaatgaacagagtcagaacatgtaaatggtgtgtgtgcgtgcaaactctacgtgctatctcatatatatgatgttgtgtattcatatatgcatgcatttatttacctataaagcatccttagaatggaaggaaaggattaacttgtcatgggtagggggaatagaactgataatgactctcaattgatcaattcctaagccttcctgcaagagaaattcagaaggcatttgattgagggtcaaaaaggaatgtgattgagctggattggagagtgctcagcaatgacaagccttagaagaagctccatccttagatgtgagaattacatatttctcttctacctagcctccctgcccctccccaggaatcagttatccagctgcattgcttccactgctccctccttctcatggtcaataaagactcatgctcagaacctcaatgacaattttgcagcttcatatgttaggtagaagtgatgctggctccactcacatggccaggacagctcctgtggtgtatgccggagtgaaaacttgtttgttttctgatggagtcagcagatctaagaggcacattagaacagggctactggcagatttgtgccaagtttagtctctgggtaacccacacacccacctggctccccagagtgttcatactgctgtgccagacaacccctgattcacaaccagctcaggctgggagggaggctcagagggactttcaagatactttatttcagttcctcttttgggctctgacccctcaacaatgcagctgcagtggtcctccagcctctatctccagtgataggaacttgcatctcttcagaagtccattgcatctgtcagatttcaggaagacaggaggatgggaagaagaggcaggggaagaggaaggagaaggagattctgccttcttatagaatccagccacatgtcctatatctggagagtgattataacgtagcggctcctaacacagcggctccaggaccagattgccttgagccaaacctgggtctgcctctttctggtttgaggtctgtggcaattgaatcaacctctgtacaactcagctcctcttcaataagatagagataattataggacttaccttgtaaggttattataaggaataaataagttaatgcaaataaagtgtttgaatactgccttgtacataggaagctctcaataaatattacctaattctactacccacaggactggtctagtttttctacatgactgttttcaaatatttgaaactgtgatttcctccctttctcccctggatctcctctttactaggttaaatattccaaggtttgcctcctattttctataaaatcatccattaacagagtgctggtggttcttctctagagttgttctgcttcctctgcatccttcttccagtcttctcccagtatgtcctggtagcccagcatattagagcccagcatattatagcttctcctgattccaaatccaagtagaatgaagtctcagctctctgccaaggcatgtgaaatcctaagggtctgtcctcagtttgcctctctcctaaactgaggcactccctgctccatggcctctttggggtttcctgttgctccctctgtaaagcacacgagcatgctgttcctttggcttatgctcaggccctaccctgcccctctctacctagaaaatgcttttgatattttcagactgaattcaaagttcagtaccctttcctttgagtcttttttttttttttttttgagatggagtctcctgcctaggcttcagatgcaatggtgccatctcagctcacctcaacctccgcctcccgggttcaagcgattctcctgcttcagcctccaaagtagctgggattacaggcatgtgccaccatgcccagctaattttttttctatttttactagagatgggatttctccatgttggtcaggctggtcttgaactcctgacatcaggtgatccgcccgcctcagcctctcaaagtgctgggattacaggcgtgagctaccgtgcccaactgagtcttcttactgcttctcttatgcttgccttgcactttttcttacctttactgttcatatccacaacctgttagtgtaggtgacctatttacatgtctatctccccttcccaggctgtgggctccagaagggccaggacaatcttatttatctttatatacctagtacacatagcacagcccctgggacaaatgtgacactcagtgtttatggatgaaaggaagggaggaagacctgagatcccactaggtatttcagctgccctgtaactctgtcgactcaaggtgagctattgttcattcaactcttccttatcgtttgcctgagttgtttcaataggtatgcaagagcctgacctcagaacttaccctttctattataaagccattttcttagattcaactcatctcttctttctgacaaatattttttttagatcctaaatcttttttcccgtatattagtaatccctcctggctgtaatcaataataaaccggatgttatggatacctatgtagtagtacttgtggagctcagtatttcaggctaaactgacccaagagtggaaaagtcattctaatggtgaactgctcagatcagtaggggaagggggaagaacctacgctctacatctaggtgaggtgctggcatcagagggaagaatggggacagggaaggttgaacctaagaaaagaggaaaatgactggatgaattcatctagttggagaaggtgaagtggtccagtgttttttagctgtttctccaaatctagtctctcttccacaaagctgtccactagagtacttgactttcttcctgaacagtcaagaggaaactcagcccagtcatggaatggattaatcaacagctttttttctcaatgcaactggtgatacacgaatatttatagttggataaaccattttgctaattctgaagacaaataagaattaactaatcattctacatttcctcttccttttccatgaaaacttcctaataaaaggatctaaatgccatattgtcattttttttccgttattttttcatactgctaactccttgtccaaggtcaaataatttaataattaaatccagaagctttttcatggactcctagagttgtgagataccgtggcatttcacttgccctgtctcctccccaaggcaacaatgccatctgaactgtgttgattaattcctgctcaagaactccagagatttctagtgaccagacactcactacctgagttgtggctctcagttctggctgcctatcagaatcacctctggagattgttataaagcagatgcccaggtctgactctcaaaaattctcctggcacaggtcagaatagggcaagttcatctctattccaaaagaacagcagatgattctattgggaggtacagctaagcataactgatgttaacactctttttcatagctgataaactatgtgagaaagcactttgcaattctggcaggcattcttgatgcctcctcaatatcaattctatcctttctcttttgaaatagtactctaaattttttcatagtaagaatatgcccatttaaaatactcaacttccagattctgttatgacatatggtcatatactgcggttcaggccaatgggatacaagcataagatgactgggtacagtgtggagggttgtacttggatggcctgtgcttttcggactttattattttcccttcttgactgggagactgggatccttcctggaggtgcaggatcccacttacaaacaggaggacaaagaacacatatcaagaatgacagagaaggatgcttgtaggtcaaaccacatggacttgctgtttgggtaaataaaaaaataattgagtataggtaatttcatatatctcaaactgatagggggaactcaggttcaagatgacatagcagttgtaccagctctagaatgcatagttataaagttatcatcacttgtgaaaaaaaaaatctccatttaattagttttcttttccttgcagctgaatacaatcctaatgaatctatgtggaacaaaactttgcccctccctaagttttgcctttagagctatcaggatagaagtaaaagtgtatgatccactttctaagagatgactatcatagaccctacttatcttatcgtggcatccttcgttctttcttgtgatcatcgcatggcacagtttctggagcactaatcatcctgatcattatctttgaaacatgaccagtttgataatgatcaactgaaaaggttttgccagagcagactctgccagctgtagtctgactggcaaagtagaaagtgaactgttacttagcagattttggactttatagttacataggttcattcaattattgtgttagtttcattctttttttttggatatgccacatccttggctcattttgaggctgtatttgttcctctcacaaaataactgattccataagaccttgcctatccttgctcacaggtgatcttctctaaatgatctttttaaacacttaaaactttattgcccctgtgtccattgtttaaatccattgagattatttttcgatcccgatgagatgtcttcatcagctttttgttatctccaaatgatacagacatgacatctccacatcattgaatctaatgataaaagaacaacataatcgatctgaaagcatggccaggtgcttacttacatttatatttcatccacttcagaattatttgttcagaccatactaggtattaggcatacacaacaacaaggcaggcatagttcctgcactcagttagatagacaagtgactaccacgtggtaagtgctagaataaaagcaggtaagtttgctatggcagcatttgggagacttttcaggacaggaaagttctctggaaggaagatatgttaaagctgagagataaaggtgaatagatttaaccaggtgagaagagagatgagtgttacaagtggaagaaattgcatatgctaacgtctacagggaagagagcatggtaggagttcagaattctgaaatcaaatatggctagattgagtgtgtttgtatggggtgatgggaggaggaatgtaggtggaaagacaagaggtatatgtagagaggtaggtagaggtcagggctagaattgttttcattgaagattttatactgagggaaaagggtgcattgaagcgttgtatgcctgagagtaacatgaccacatttgcagttgtagtggccaaacaacatgatttgggttcgttgaaaatggtaatgtgtcactctagttacaatatgggaaatgaattgaagttgggcaagactagaggaaagggagcctcctaagggacgttgcaaccagttaggcatgaggtcaccagagtgacagttgcagagaaggagagacatgggggtattcaaaagttgtggaggtagaagggttaagacttggagatggacggggaagaagaggataagtaataaagaaagtgtaagaggacttccgttttctaagtgaatggcttagaggtgggttttagagagatagtaattaatgcaatttgggtcatgatgggtttaacagtagctttccaatatgaggttagctagatggatctgaaactctgggtatgaaaaaagacagtcttcaacacagatacaactaattacccagggagagagtaaggaatacataaaaaagaattgagggcaaacactagtctttaaaggctgggaggagaagggatctggaaaagcagattgacaaaaagtggacaaatacataggagaaaaatctggaaagcatgaggccatcaaggccaaatggtgtaaatttgaggaaggcaggaatgtcagcagtgtcaaatgtttctaaaggatcaagggagattatacttagttgcaataatctcttccatgttcttggggataacagttttgtggggcggaacaatggggtggggatacaaatagaaagaagaagtggagtcagaaaatgagtgtaattatttcaaaaggttttctaatttaaagagagagagagagagtgagtgagatgggcaggggccagggaaggagaggcaagaaggaggatgtggtgatggctggccaggtgaggccctcagggaatacaaacaggtgggaggagtggcgaatcctgagaataggtacagaaagaagtcttgaaaagaagaagaaagactgcttccattactctttaaagtgaggaaggagagaagtgtttgagaatatgcattatgattagattcagctgcaaatgacaaaaatgatgcaattagagtggcttaaataacgtaatctgtatccctctggttatggaaatactctactttgtctgttcatggctagtgaggtgttccccaaactcaggcacccaggcctttctgccatctggacctgttgcacatggccttgcctccacagtctaaggcggcagcatctgtgtgccagagtggaatgagggagagatgaagaagaagcaggaggtacccgggcattgccccctgcagatgctcctggaggccatcatgtggcatccttgctcacctcctcttgtccaggactcagccacattgccatacctaagtagaagagcatgtgggagactcacaatcccctgtggatgatcacatgcccagacaaagtcaggggcctaccaccatggaaagagggatggacattaagaaactattcgtgtgtcacatgaaaggaggaaaaagtagtattcccttgataaggatggaagaggccctctagtccatagggtacacatatggttaaggcaattctaccataaaaccatgatgtttcaatatcactagtcattagggaaccacaaatgaaaaccacaacgaggtacaacttcacacccattaggatatcgctgatgaaataaaaaaggaaaataaatattggtgaggatgtggagaaactgaaacccttgtgcgttgctggtgggaatgtaaagtgatgcaaccacagtggaaagagtttgggggtttctcaaaaagctaaacaggctgggctcagtggttcctgcctatagtcctagcactctgggaggctgaagctggaggattgcttaagcccaagagttcatgaccagcctgggcaatacagaaaaatctcatctctacaaaaaaatttttttaaaattatccaggcgcagaggtgcacacctgtagtcccatctactcagggggctgaagtgagaagattgccttgaacccaaaaattcaaggctacagtgagctatgattgcaccaccgcactccagcctgcacagcagagcaagactcagtgtctaaacgaaacaaaataaaacagaacaacattaaacatactaaatcagtcagtgaattggaaaaaaataagctaaacatggaattaccatatgactcagcaattctactcctgggtatatattcaacagaatggaaagcagggcctcaaacaggtatttatacatgaatgttcatagcagcattattcacaatagtgaaggtagaaacaacccaagtgtccatcatcaacaaatagataaacacaatgaggtctatgcataaatgggtattactcagttttaaaagggaaggcaattctgacacatgctgcagcatggatgaactttgaaaccattatgctaagtgaaatgagccagacaccaaaggaccgataaggtatgattccactttcacgaagtacctagggtaggcaaattcatggagaggctatcaggggcttgtgggaggagggaaacagggagtgatttaatggtcacagagtttctgtttgggatgctgagaaagttctggaaatgaatggcagtgatagttacataatattgtgaacatactcaatgtcacttaatggtacacttagaaatggttaaaagggtgaattttatttcatgcgtattttactagaatagacaaatgaaaattaacagaagagataatcagctgtctgtggtgtaggaaggaggcaggtaaatgtgtaagcttggtggcaggaagttaaaggagttcgcatttgctggcttttatttgccctgagtatattgcagggaaaatagtgtgtgtttgcacacacctatgtccaggtccacatgtttgtgtccatatacctgcagcctggtttttccaagagagcaaaaaggactaagctagttgcttgtgtaatgggagagacagctgatgagtgaaccagagaatcctgtgcagtattaatcacttttccctcatgccactgtcttttctctggactttaactaaaaatataatctaccccagtcttctttctttatccctttttttgattctgctcctaccatttagggccatctcccaaacatatccagagctcaccacttactcctttcttgcattgcctttttaaggaattaaaaagatatgtttttatctttacaaattacaaagcttattatatcaaatacatttcttaatctccacatcaatcagaatatcctttctcagcccagtctatcattaactttaggggctgagttttttccccgagcccttattttcaccatctttcaaataggatatttgaatttccttggaagatagttttcacatttaactgaattaactgtgtgaaaactttcggcactcaattcatattgcaaaattaaaagccaatgtttttgaagctcactgacagcacaggtactcgtgactggacctccctatcaaagtcatctgcttccctttcttggagctctctctctctctctctctccctctctctctcactctgtccccagcactcccctcttcactctgctccatcgccccaccaaacactgaacactggtgcccttgcacagctccatacctttgcaggagctgctctctaacgggaatgttcttcctgcaggatcaggacagtggaacactgtacattcccatcttagttatgagtgatgatggagtaaataagaccaggaaaagaatttaagaggctgagaaaggagaacaacaatagcagaagagggtgcctttagttaacaacaaagtattatatatttcaaaacagctagaaggcttgaaatgtttctcccacgtaggaccattgtttgaggtgatggatatccctagcaccttgatttggccattacacattctatgcatgtagcaaaatatcacaggtaccccataaatacacacaaatattatgtatcaataaaaacatttgtaaaaagaaaatacatctgaaacccactccccccttaaaaaaaaaggagaacaaaagtttgtcaagactgactccaacccatcatttttataattagccttcctggggaccccggtttctaatctgccctgggaaaagagaaaggagtctgtgacatctagcatcattagaccaggactctccaagcgtggtctccaaatcagaaagtatggggccagaccccagcaatctgtgtgtcaagaagcccttcaggatattcatcctaaaatttgagaaccattgatttaaaggagtgtgaagactgaatgttgggagctctttctggaagggccactcccagggctggacatgtggaaaaggaagcagcagcatggaccctgcctcctgggaggggcctcagtgtctctcgaatactctcaccttagaaaaaaatcctttaagccaccgggacagaggaggcttggtggtgtgtaagccgtataaatatgtacattcacttatctatgtaagtacatatagattccctttggctagggctgccagatttagcaaataaaaatccaggacaccagatatatttaaattcctgatcaacaaatgatttttattatgcagagcacatactaatactaaaagacatttgggttttgggttttttttttttttttttgcaattcaaatttaattgggcatctttttcttgtttttagcaggcaggatatcctaccttttgcccgtaagtattaggtacttagtggaaatagcctgatcagaatcagtgtctaaaaggtagaagtgggttttaatggcctatttatttacattttaataggaatgtgtatgagttggcagggaagaaaaagaatgctgctctttctggctcattgtattattttaagatctgtatttggggaaagagaaagcaaggaagagaatatagggagaaagatggtggttggcctggagtggtggctcctgcctgtaatcccagcacttcgggaggtcgaggcgggcgaatcacttgaggtcaggagtttgagaccagcctggccaacatggtgaaacctcatctctactaaaaatataaaaattatccaggtatggtggcacgtgcctgtaatcccagctaattgggaggctgaggcaggagaattgctggaacatggcaggcagaggttgcagtgagacaagatcatgccaatgcactccagcctgggcgacaagagcaagacttcatcacaaaaaaaaaaaaaaaagaaaagaaaagaaaagaaaaggaaaaagaaagatggtggttgaaagtagcctatatgccagcaagtcctccctctagtcaagtaactgagcacctattatgggccaggccctgattcacatgaccctgagtgagatgagcagcaacgctctaggaggttgagctccctgcctcgggcctggctcctgggcaggttccctgcagccaccccttacctgccccaggtgacaggatgccacctcagagggtgggaccttgatgctgtggctgggcagtgaatgacaagcttcctaatgagatggagctgggggagcggcttgctgacagaacaatttgccggtgcccagaatatctgcccagcctcggcaaagcggcagcctggcgggcggcagaagaaatttcaggatttatcattcgccttggtggcaggtgtgccgtgagccgccctacttcccgctgtgcttctctagacctgcagactggatgggcaatccacccaggcttctagagcctcgggaagaacgtgtaaaactatttcctattttttcctcctcctgatcagcttgtgttgatgtaaatgactggaaaagcagttttcggcttattttcacagcttaagggcttcgtgagaagcttattattgaaaaattagaaactgaaaacaacttcttagacaatgaaatagcaacccagagactgtgtgtgtaaggctgggtgtgctgtaactggctgcgttacaaataggaactcccctgggattcagtaatcaaacacgtggcaacaggttgtctgtttcaacagagagtgagtaatcaaaggagatttgcagttaatccaaatataacagcaaagcatccaagggaagcccggggaaaggagaccagaagggtgaggggtggatgaggccactggtttggagttccagatgcaacagagagaactgggagaggggcagaaggttgatctctctgggtgcttgtgttggtccatttgcattgctatgaaggaatacctgagactgggcaatgtacaaagaaaagaggtttatttggctcatggttctgcaggctgtattagtgtggcacaagcacctgctcagttttgggtgaggcctcaggaagcttttagtcatggccaaagagaaggggcgctttcatgtcacatggtaaaagagggagtaagaaagagaggagagggaggtgccacggtcttttaaacaaccaactttcgagtgaatgagaatccattactttgaggaggggaccaagccattcatgagggatctgcccccacgacccgaacacctcccaccaggcctcacctccaatactggaaatcacgtttcaatatgagatttggagggaacagactatcagcaatggaggaacaagctgcacagaggaaggggaaactgagtcttggctacacattgaagcaaaccagaaaaataacctgagcacttggcccctacacttgaccagtgatgtaaaatttgggaggaattaattagcattcagtgatttacttcaaaatcctgagtcctacacaggattgaggtcggggtggagaaggacttgctccaactcgatgggctagaaagaagaaagtggtgcaggcctgggaaacagtggtaaccatcagcatttcagggagacacttcagtttgcatgtgtatctccatggttctcaaagtgtggtccctggctggcagcatcagggtcccctggcacttgttagcaatatgaattctcaagccccacccccagagagccctctgactctggacctctgagaggaggcccagccatctgtggatcaagaagccctctgcatgattttgttgcatacttcagtttgagaaccaccagcagacctggttacctggccagaggtaccaggaggtgctcactcagggttcgtatgtgggcttgtgtgtgaactactacgcccagtcccaggtgaggtcctggagcaattctgtgctgacccatctgtcctgatcttcctaaccacacggggctgcggggaaaggcacacttactacacgtgtgctactaccatgtgccaggcactgctaaatgttttatgtgtgatattttatttaatctttccctgaaccttgtgaggtaggggttgtagatagcattttagtgctgagaatatttgagttcagaaaggccaacttgcccaggtctctatgtttcctgagtctgtacccttattcattctcacgcagcctctccgccacatacttctctgtccccacatgctttgggtgccacctacacaaagcaactaccagcctggcagggccccagctctccactgccaagcttggccctccccgccccactccttgcctcatgttaatttcccacctgagtactgagtactttataaatagcaaatctaaaatgaattttctaccagcgatcattagctcccttgacatccattaaacattctcgcaagcagagcgaagtgacaaaagggattgatttttacagtatgtttaataggggaaaagaaagaaaggtgttgacaagtctttttttttttttttttctgtcctgatatcaccaggaatttgaaatcagtcaaatgacttttatctgggaaaaaaaaaaaaaaaaaaagaaaagaaaagaagaaggctaggattgggtgcgggaggagagggtcgggagacagaaacaggctcccagcaccctgtgcggctcatttctacacccgtgacaggtaaacataaagttagttacctagtgccagccaccaagatgaatatgtcagatttaatgcttcaaaatatatagggtccaagccagggagggagtagcggggagtggaggaggaaagaaggctgtattaagggagagggaaaataaccaatcttctgctgaaactattggaagaataaatgtgttgatgcaatagttgaagtcagagaaggctggcatatgaggcactgtagctgaaaatttaactttgatttcaattttcatatttgtcagcgataattagattcaagaaatgttttgccactgctctaaaatactaataagtagaggcctttgtagtttggttaatggagtcttttttcctagtggtctaggaaaattccattaaagcaaaaagtcatactatattacagtgtttcaatacgcattgactctgctgccgcggtgatatcatcccagggatgggagtcctgtgtgcaaccacagagcccctgaagggatgggagtcctgtgtgcaaccacagagcccctgaagggatggtagtcctgtgtgcaaccacagagcccctgaagggatgggagtcctgtgtgcaaccacagagcccctgaagggatgggagtcctgtgtgcaaccatagagcccctgaagggatgggagtcctctgtgcaaccacagagcccctgaagggatggggttgggcttcataggccttagctgtctatcatttcagacctgcacagacctccctggctcatgggtgagggtaggggagagagaagagcaaattcaataaagcctcgccttgagaaggatgtgttttataagcttcgcctcctggagcaggttgaagagagggcaggaggagttgatgggcacctgcctgaggagaggaagcactttccctgctctccccagtctggacgcctgttgcctgttcctttaatgaagaagctccacccagtggcagaatctacatgcactcctcctcccaagcctcagcctgctctgaaagtctggaaggttgctttctcttgagatcagaatttgattaagagaaccaaggtctattatttttgactggcttttccctggagtgcctgtgcatctctgatatcccaggtaactccctgcagggcaatatggggtggattgggcttcacctgctttaatgtagaggtaagtgaagggttaagtgtattgtgcccacacactccagagagttcctgtggatgagggaaggcctagggcatcctcatctcccttctaccctactttccacaccactcccctgccgtcagggattaataatcacatgctgggcttattcagacgggctctctctgtctggaacgccctctcgtaagcagactgctgctgcagccacctgttagcccatctccctgagcccagggacctcacggaccctgctctcaattgtccttcccaaaactctgaagtggatccccagactgggatgccagtccttgccaaaagaaagccccatgggcctgtgtgatctcacccacctccccacacatgggctccttcatgtcaaattgtgctcttcttgacatagtagtagagagacttggaatttactaatcctaaaccacaaatgggaagtgatggaggaatggacagatggcaggtaaggggaggagggtcccaccaggattgccacctaggcctggataaagatgacttgcagaagccacacgaagcaaaagggagatcacgcccattccattagtgcagggcagcagcaaccgcccatccttccctgtgcccatcctgggtgcttctttcctggccccgtgccctcctcctactgcccccaccaccacctcccagggtgaacagagagggagggcctgtacttcttcccaacagcgcaaagacctacctttggcccatgcctctctctctccgcccctccttccttccctctttccccaccaatcgctgcctagctgcagcttcacttttctctagtggcatgtgccagatcttatccctgtgaagcacttgaggatgaaagaaggaaggggatattaaatccaccagtgatacgtgcaattgggagaggcttttgttgtgtcatttcctacctccttcagcctattaagcaaacaaaagtgcttgtggaatgagaaatgtaaatggccaatgcaagccgattaatcctagatgtacaattccattaataaggccgctttttaataggcggctctggcagcaacagcaggcaggccaggaattgatgtattctctgtaattgtattgcaactaataggatatgaagaaaattgtaccggagaagcaggtctttcaacacgattttccaatcagctgaaataatgacttgcaggggaaagccttgaaaaggaatgacacacacaaaaatacaacatcgtccagaagtgtccatgattcccagtcccagcttgaagcttctttctttctttttcccctggcttccctcatttctctctctactccactctcgttcttcatctcttcttccccataggtaatgccaagacccagaagagtctggtcacctgtggagggcctcccagggagattccccacccctgccccccagccttttgcctgtctaggccccctcactggctgagattgcttggtccaccttttgagaagtcagagcgagaaggagagaggctgggtgctctatggagagaagactgagtagggactcagtgtcggcccttctactaatgctagttgttgagtgactttggagccatgccttcacctctctggattcttatctgaacgaaccttccagccccagaatgcagcagctctgagtgcattttcaaagatcaggctaggagaaaagctggcatcctttcacttcaggaccaacgaaggctatctaagaagaagagcccttttctaaaggggtgtcctcattatctgaacatccatctactgagaggccctgcagaactcaggcatctcagcgtcgagctcagctttggaaatcaggcctgtgtgcatacttaatcatggataagttggtcaattcactccttccttcaacaaatatttgcggggtgtcaatggtgcactaaggcactgttctaggttctgggaatgaaacagtaaataaagcaggtgaaacagaaatcaatccttgccctcatggtgcttgcagtctatccagtcagcaacacttttggtgagcctaacagctggggtgttaggtacgggacctttctctgagactacttagggatgggaactaaaagcccctctgctgttgtttacttggccaaggtggcagtgggagccaggctgccttcacatgacccctgccagcacctctcagtcctgctctcagcctctcctggtcactgggtctctgtcctgcccatttgtgtgtggactctgacccttccttggtcacaggctggagagtagatataaaaagaaaaggcaaagcacatttcagttgaagtccccaaggaaactgatatgattgctgaacagaaatggttccaataagggcagagaggaatattgcttttatagcttttgagacataaaacatttagaaaatgtgattgactggcagggtctaatttatcatttatctcattccctctgctctcacactctgtcttgctccccacaacacccaggcagacactcatgtgcaaacttttttctctcttttttctttcctttcttcttctctttctgagacttggatttatcatcattccattaagcaggagaactcctgtggctatttataattaatgctcagaaacctgccaatccatttaatgacactaacaggtcatggcccccttatagctctccattaatcatcattagaaccgctctgagtttttacattccttttaaatgttaattcacctctgtaatgctccttttagttaaaactgtgaagggagaagtggctggtgtctccatgctgcctgcctgggaatggcgtggtggggttgatgaagtctggctgatttcctctgttctttttctcctctgacccctgtccctgctaccagatgtcaacccagtttattctttggttgtctagatttatcttctaaaaaacacccagtggcttaaagttctgggcaaataaagatatttgaatacctttggcctcccaaggctcaagcaacaacctgtgagaagttcttggcttacccactaagacccagggtcctgacgtggcagtgcagctcctagaggtgagggggcagaaagggttctggaggtgagcagggtctagaactgttcatgcaatgtcccagcactcaagggcaggctccagaaaagcaggtaaaaagcagtcaggtaaagaattatctttctttctatcaagagagctgaccacttgcttcatttttgctactgatgggcaatgagactgggcaaaacattcaacctccttcctcacctacaaaacggggtccatatctgtcatttccaaggataagggttaaatctataaaatattaactggcattgaaatcatcctggacttttaaaaccgatctcagtgccaggcgtagtatcagtgtcatttcttgagcttctctgccactttcctacgcacagcttgacctcctgctctgcagccttcatccccgtggatgtgtacaccttcacacctctcggtctgttgcttttagatcatatttcaccagccataaaagtatattttgaatcattaaaacaaatatggtgaaagaagttaaattaagaatgggtaacacatggctgggcgcggtggctcacacctgtaatcccagcactttgggaggccgtggcagggcaggtggattacttgaggtcaggagttcgagaccaaccgggctaagatggtgaaaccctgtctccactaaaaacacaaaaattagtcaggcactgtggtgggcaactgtaatcccagctactcgagaggctgaggcaggagaattgcttgaacacgggggacggaagttgcagtgagctgagattgtgccactgcactccagcccgggcaacagagtgaaattctgtctcaaaaaaaaaaaatggggaacataaatgtgaacaccaattctgttattgattagctgtgcaactctgggaagctcacgtcacctctctgggcctcatttcccttacttctggactctatatttttaagacgccatgatctagtaaatcctgtgattttattgctttcctgtgagtcttcccaaggggctaagacagtcactcaggaataactgggaaaaagtggtcctgttttgaccatctgagctcttaatttttcttgtcttgtcaagtgacatgccccagagttgagtgctctaacaaaagcaaacacaaatatatgaggaaaatagacaaaacatttttaattcatttttgactcactgtctcatttttctaggcataatccatcttcatgttaggcctttggaaccatacacttgaatttactttcaaggctgcctgaaatctacatgttcagctgagaggatccctcagggccaactagatagcagatgcctcatcaattttatcattttacctttttaagtactccttcagaatagcttaacctcattttatacaggggtaaactgaggctttaagaggtaatgtggctagtccaaggctgatgtattttgtagttttcaaggtcatgagtcaagcctagctctcctgaattgaagcccagcttctaattttgtattatttcatcttgctttgcccactcccatagctttctttgggcgggcatgaggcaatacaccttgaatgaaataaagacgtgtcctatcagttctcctgttctggcatgagttataactagtgacctctgatttggactagcaacctcctttcctgagtttattcttcattgtgttcaagttcccttcggcatcaggatgtataaatgggcttcctgggggttttctataagaaagcccaccagccatgccttctcttttccagtctttgtacgtgtccccagttcttacagggacagccatactcatctctcccttccctgcagagcaccgctgatagtctaagtagacaccagtccccaggctgggctttggccatctgtctgcccttcacttgagaatgcaataaaatctgcttgacaattatgtcagtacaaagggcagagaggactgcatgtcaaaaagctgtgtaaaatttattctttcaaaggttgtatcaagaatattctggccaaaaagagctctaatagcaactgatcactgtgtcatctgattctttttcacatggctactttcccctattagtggatttgtgttagttctgcttgggaccaagttaataacgataagaccttatcataatgtagcactgcatatgtttgaaagggctttcacgaatcgattatatcatcaaatcttcatgactgcagttggattttagaaccgaaagggctttggaaaacacttaacccaacattctcagttgattattattgatgtattttgtttagcttaagtaatgtatctttattaaatataatttggaaaccatacaaaggaagctttaaaaagatttaaagtcactcatgcacaattacatttaatgtatttttttctaattttttcttattctctgccatggttttcattatgtagttataatcatatcatttatatctcatttttttcttttaagaatagatcagaaacaattttccatgtcgttacatagtattagtgagcatcgttttaattggtttcattatattacatcaagtagatgtacaataccactgcactgtgtttggacatttatgttgttctaattttttgctgttgtaaataatgtttcagtgaacatctccatgattatggccttattccactgttatgattatttccttacacacgatcactatacattctattaccaccaatactcttactttactcaggggaaactgaggcatggaaaaacaaagtgatcccagaccccgcatccagttagtaaaacaacacagaccccaagtgaggtcttttgtctcttggtttcacattacttctattatataatatagtggttttcagaatttctaaataaaaggcttgaacattacatgaaagtaattttatttttagtacccagtggttgagaaaaaattacaataaaaactgcaataaatattgtagcacctgtaaacaacgtgtatgcaattaaacacagcagcattcatatgtacttggaagtggtgcaaacagtgcacttggagagaaatgcattgaagctgccgacaacacttcatgtgcatatggaccctaaatcccttttaaaactcccctcttctcctcgcaccccaaactcaggtccattgttctttaaaaagaaagcatccttagtttgctgccaggatgttcattccaagctggagtccatgggtccatagttatctccctttgaacctctcctgccctgaatttacagggatagcaagcatggtagaagagagatggactcacgattctgaatattgagagctggaatagtcctgcagtgagattaatgtacagacttcagggctctacaacccaaaagaagagtctccagtaataacagtagtttaaatttgctgactgccttctaggtgctaggtacaaccccagttgctatgtatggattgtatctgttcatttttacaagattgctgtatttgtcacagtttcacagatgaggagactgaagaggatagttgaactgacacagaaactgagtgatagggtggggctttgagtcctggaagtgtggttgctaatcctatactcttaccctcagcacacagagcccctcactcagtgtccccagacatttgagaagagatgtgatgaggccggccatggttctcttgtggtcagctcttgttctaatccttagcgcccatttggaaaccagttatggggaaagcacaatgtaggactcttgggactctgcacctgactggctggctttccaagatcactgagatggctcttcctccagcatagaaattgatggctggttatccagacagcaacctcttttgcccatgtgcttggtgctctgtcatggcgggaaaagtaactatgcacagatcatgattatggtattagattgggtacacatgaaattgctagtatgcacctattttgatgtatgaaaatatcattttcatgagattcatcctaatttatgctatgtatggggcctgattgccctaacagctcatcattgattggtagcatgttgtaataatgaaagagagatggatatctagctaccctacccaccccccatcagcataaggaagccgagaagggccccagtaaagctgagaacattggaggatgacaaggctgtaaatgaatagacaggacgtcacctgtcctttctctccaatctctctttgtgtcccctcagtttaccagctgtcccgaagcaattgcagctcagtgtctgttcccactagcttttgtgagggctctgctggggcttttatcccttgtgctgaagaccatgctcattttctcaaacacaaagcaccagaggagctccatccaaatgcacaatctttattcccggaccgtgtctctagtttaaattcctggagtgttggtcaaaagcatgggattgagaactagagggaccttggcttgaatcctgatgctaccacttactgtgtgaccttcaacaatttatttactgtctctcccagctttggttttgtcaactattagatgattttgataattaaagtccagaatagatgtaaatgtgttgatgggcattgtcgacatggaacacattgttacctccttcttttctgaatctggtgactagaatagataccagaaaagaaaatctgaagtttctgttttcacagagaaaccctatgtactgaactgtaagctgatacctaagttccagtaagtattgatatgcttatgtggacaatgtaccaaagcatttgaaatgaggaatgttttagaaaatctaggatatgtgttatcatttgatcactctcccttccttgagctttgaataaaaccacttttcttcctgctttctttgggtctaacattgggccttctatgtttctggagtctgatactgaacttcttcagcaataccttccctgccacccctgccacctgccacacacacacacacacacacacacacacacagaaatagaaaaaaaaaaggagagtgaggcatgcatagacagacagaaaatttgagacaaacagagagagacaggagaagtggaaaggagaaagcaagagatagatcaaaacacaaccacaaaacctaaaaatatttagcctttaattaaaaaataacaacaaaaaaacacctagaggccttaaaaagcatacccacaccacacaaagaatacactctcaggtcatctagctcatcccaccagagggccacatcccatcaagagagctgtagcatttgagaaggtgtcttttttcatggtagactattgggaagtctcttcttagttgtttccttgggtgaaaacatggattttgaaaacaggtagacaagggttcaaatccctgatgggccctctactggatatatgatctgagcaagttatttaacctgattaaatggaactgtaataccttctcttaatgttgttataagcgtaagtgcagtaatatgtagccatacttgatacatagtagatactcagtaaagacatgattttaatttctggaattcagatgtcctagtagtgattacttctttctctgtcttccattggatatcctttatacccacctgtgcccctctactctctgaagatactaggcatttgaaaaagatgttctacttgagactattagaatggtaaactattagaaatcataaagaatttcctccagataaattttaccattgaaaacttcttcattaccccataattatcctcatcattatgtgagtcaggccactggaaatatatatatatatatatatatatatatatatatatatatatatatatatatatatatatattttaatttaaactaggaccttcaccaagagagagactaaattatgactaatggccattccttggcctcttagttacagatgtaggagagattgttagccatgtcttgctcagccatcaaagtcttggcagaagacaccttgctcttgtggaatagcatgccctgtgagcagggagttattctaagagagtttctagatgtagtgccaattttggaaagacagctggcaggaattgggcaaagggtcgtcattgacctatatgggtgggagcatttggcttcacagagccctaagcatagattatattccaaaaataatgttatggatgcaacaccatgaaaatcacatgtcatgtcataaccaccatgatgaaatgttggatccatatttagcaattattgtggtctctgctataatactcagttccttacacaagaacttgtctaggattcagcagtttatactgaggtgttcagaggagcatggttaatggagaaaattgcttatctccccaagaaaaagaaaactaagtcataaaaaaaaaaaaacaaatattggagaatcctgcttgcccagtggccaaataggggttagcagattagtttccatgggaagtgtcaaagaaacaagaaactaagagaaaaaaaggagtcacacagaagatggaccacattaatggggcctataggaaaacagcacaagccaaccaatggagagagccagtccagccatcagctccctcgtgcgtgcccactcagaatggaaagatatacagagactaccaagaaccaacataagcctgcaagagaatgctactgtctaaaaagtaattcttaaagcatataatccagaatgaaaagtccaggcagaatgacatatcctctggccatataagtactattgaatctttaccagaactcttattagaattttacagcgtctgctgtagtaccctagagatgctccataggaatgatcaaagggctgtatcatagggcctgtgaggactgtcataaggtaatggtgttgtccagaaggagaaagaaatttaaggggtgacttaataaatttcacaattaaaataaaggatactccatgtggatgacaagcagctgctcttcattaggctttggggactgaagaagtcgaaatccaatttaattgcagtagaaaaagcttagactgcataaaaggaacagataaccaatctgcttacaactttttccagattctgagatttttaggcctcctgaattgtcactgttccctgagaggagacaccgtttacttacaatccagtcacagacagactcacctctttgctggaggtgtccctagtagtgaccatgtaaaataatgagacattcaactgagtgagcaatggctcaagtccacctctgtgtcccaaatgttacagcacatcacctacacataaacccccagtttttcactccattcctattttcacttcactccttactttctatagatgctttggtcctatgatcactcttgcagacactctcaactctctggttctctttccttctattgtatttttctggcaaaaatctcaagtctgcttgacaccacctatccactttctctgatcctgaaccttcataactagatattgctggcagaaagaaagaaacaaacaaacaaacaacaagatcaacaacaaaaaacccaatgtggtctgtgtcattttaaaatctcagagtaacaaattgcaaatgggtgtttactactgcccaggaatcccactatgcactcttaggaggtttgcttttctttcttcagagacatctaattcgtatcttctccccctcctcaaaagttttataatcttccaaaaatctccttattcccacttggagtgaatgactcatatttcattgagaaaacagaagcaatcaggaactaacttatcttccagataccaaatctcagtatacctgcctttcatttgtagggcccgaaattcactcctgttataatggaaaaaaatatttctcctcattttagagttcaacatctcaatttatgctctggggcctctcctctctcccctcaaggatttcaatcctgcaattatcttcctctttcttctacatcattgcatatttcctctccactcggtcactttcataagcacataaatctcaccaagtatctcccatatttaaaatggcaactgcaacatcaacaatctctcttgacctcccttcttcctttagctacaaacacgtttctgctcttcttctcggtaaagcttcttacaataaagatcttcatgtacagtcttcactttttcagcactcgcacttccgctttccagcctggcgttggtccacaccaccccactaaagctactctcatcaaggtcatcagcaacatttataatgccaagtgcagtgctcaatttccaatctttaatctacctctcagcagcgcttgacatagatgaccctttctgtctttgtgaaattgttcctcttggcctccctggcatcgcgccgtcctggctttcttcttacctcactaaaccctactctgtttcttttgtttccatcttcttctctgtatgctgggtctgcaaggtcttggtcttcaggcacttcctctgtcgatccacttctccgggagatctcatccagtcctgtggtttccagtgacctctatatactggtgactgccaattttacatcactgcccagaccttccccatgaactccagattaataaagacatcccacacttaatatgtgattttgttcattggttcatccatattttcatgtctctgaaattgggacacatccttcaattgatagcatcttataatctgcacctgcccaatggagaggtttagttgccattgcctgaacaagcaccgacttagtcacattcccttcccttcattgagtgataggcattgctggtactacatgtgttagggttaattgccatttaaaattccttcaaaaatgattctttgaatcacacagtgattcgccattgaaataaaaatgatcacatacacagcaatgcatagaaagggaacagcagggtgtaaatttgataacagggaagtgcatatctgtctatggaagaatgaccacaattccgtattcccctgcaaaacaacaattaagggctttatgggaccaaagacagaaagaacatccacagctgacaatttttttgttgagacacatgaaaggttgtctgttacgcttcaacctaaggcagggagaaatgggcaaatcccttggaatagcagaagagttctgatcaagggaggctggtatgaccaattgaaagtgtccctcactctttcttggtgacatttaagttaattacacaccttagaatagattacatctgttgactgccaattttatatcaatgcccagaccttccccatgaacttcattgcatccatttgatgcaatatgtgtttcaaatggaaattgtagtccaactatcttctgccccagtgagaggctgtttttccctgagtctcccctaacttagttaagggcacacttctaaacttattgcccaaaccaaaacctaagatttttccttgtccttccctttccttcacccttaacatcaaatccattagcatttcttgttagttctacctataaatatatctccaatccatatttattcacgtttgcgccaataccttcatgaaaggcaccttgcctgaactcctgcagttgcctccaggtgggttttgctgcctgctcattttcaacccatcctttatctcatgcctcctacaatccattcttcaaacagtaacctacatactttccaagcatacatccaattttgtcactcggctttatacttggaatgaaatccacacccctcctctgtggtctgttggcctccacttgcctcttagagaccctcatacatccccatcttcctcagtgagtatgctccactaaccctgtccctccttctggttcttaaacttgccaagtttggtcttacttcagggactgcacacttgccatgtcttcttcctggaaggttttccctccagatctgctgctgctggctgcattccacaattcaactctcagagagccctttctctttcaccctatttacttgcactccgtccttctctatcaggtattctgtgtaacttcctgcaactttctgaaactgtcctgttaatttgtttacttgcatattgtttatttcctccaactaaggtattaattcaaaatgacagggtattgtcttgttcatcactgatctttaagacttaaggtggtatttggtaaatagtagataattgctcaataatgtcagagttaaaaagggaaagaaaatttctttattattactgggaagtgatatatgaatgtaagagcatcatccctccaaaacatgaaatatacctcctttctatctagaaactgggacaagttgtttaacttcatttactttctggtcacttattaatttagtggccatattaaaatccttatctctctgagggattttaagaatatattgaaacaatttacacaaacaaatatcttgccacacagtcaagtcaaccttactacagcagccctgccttatcctcacgggataagttctaagatccccagtggatgtctgaaactcttggataacaccaaaacctatatatgctatttttcctcttatacatcctatatataacatatgataatgtttaatttataaattaggcacactaagaggttaataacaaaaactaataataaaataaaacaattatagcaacatactgtaataaaagtaatatacatgtgatcttgatctctctcacaaaatatcacactgtactgtatttaactatttttggacttcaattgactgcaggtaactgaaatgtggataagggagaatgactgtatatcactctgagaagtggataaaagctctttccctcctcccagagtgcacaaatgtgctctagggaaatggataaatgtacatgcataagtaacttttcattgagcagctccaaagaccacaggtaaaggcactttcctcatacaaacattggttcacattaagtctcttttcaaggtgattaaaacgactcagaaagttaagatgttccctttttgcagttaagaccacagagtagcatttacgttttaaatattgaagacgcaagtctgtctctagccacaggcactggcttactattttcttggtcccagagccagaccaactaactccacttaccatttctatcagtggcttgagggtgtccagagaatatagttacaagactggatttttaaaaggaaggaagaaacccaaggctctcaggagaggaccgaagtgactcaatgtgcctgtcatgagattcagtaagttttcacctaagcagatctattatgtggccagaaaaaacagtgtcacaaaagacagccctctgcactggcactgtcctttgcttgtcagtttgtatacaagagctacatacaatgccctggaaaacagcacttcgtggaattgtgtaatattttatagcagcatccagtctgcagactcaaaatcccagtgactaagaacaaaggtgggacatgcagaacatatgtgggaaacattcctcggacccaggggtgggacaggtcagccaggggaggaggaggctgaagaaagggaagagccacagaaaggctgaaagtggggacaaaaggcttccagcacctcccttgcactctatttgggctttgtcatactttctgccttaactcaaatactacagggtcatccctgatgggtataaaggggaaggagtcatgggtcagaaagagttcctaggacattcttgccctcgaggtttcctggctttgcagctggaaccagggctggctcccgggcagggagaggagacgcttcctgatgaagttcgggcccacccctttctctgagcaaatatgccagtagcatttgggttaatgaactgtgccttttaataaatggttcttatctcaccagagtggtgctaaattgtcaggattttaaattaacttaatagtttcgtggatggtacttattcactggttactccgaaagtagcgcggcccccagccaggacttcttattgaattatgcaacagttagttatttcatttaggtttaaggggaagtgtttaggattaatgtgcaatgcctcagtgccccccttaatgggcatttccaggcctcccctaaactaaaagccagttattaatcactgggtcactcagttgttctgtcgattgagagaagtgattgctctggtccaggaatggccaacaccctccccggccaaaagagggagacaaaacgcctgtcttctcttgctcacgtttgcaaaatatttgctgagatgtgcaaacccctatcctgcctgtaagaagcttacgtaagttagaaagtggaagtactatgacagaggcagctgtgaaatccttggacttttgaagaggaagaaaaatgaattctgtggagaggagaggcagagtaggggtgaagcatctagaaggtgctaacatttgaaaactgtataacatttatgtgattgaaaatatgaagagcattctaggtaaaattttaatcttgtgcctctctaccagataatgatcagcctttgggcaaaaagaattgccacttttgagtatttactttgaggctggtgtgagttcattgcagaaccttatgaggtatcaaccagtttgttttcaccttgcagatgagaaaactggggctccgagatggtagatgccttgtccaaagctccaggatttttggcacacaaagattctaactcaagcccaagttcatcagtgacattgttttctcgtattctcagctaaatcactcctgccctgcagacatcacatcggcactcagatcatctgcaaaacttttgtcagggattccattctgtcacaccacaaacctgactttattgttcagtggagggtgaggcaattcctttaatttactccagaggcatcatatcatcccaaagcaggttcacccatcatgcatcagaaactacctttggagaaacagaaatcaggtagcatgtggcaagtatcaatgttgtgccaagcaccgtgccaggcagggactgcagcaggcaagaggttgctaagacattatctgcaccctccaaagctgtcagggcctacataggaggaacactgtccccactaactggagatatgcaagccatgacagaaatcattgatgtcagcaaacaactaacaggcaggtgtacagccaaatactaactgtgaagcgaaatctagttaagactgcaaagtattagcatcaaacacttgtttgagaagcagaaggaagcaggagggtgtataatggagattgagaatggacatttacccctttgcactttgagtcctcattgaagctgcccctgagagcccccatctgggctacaaagaggtgttggagggaggaaacctggagaagcttaggcacagccttctggctgccttccacagagaggtgcaggagtcccacggtagttaactgggaccgccctgctgggaacttcaggtgtctctgcccccgggcaaggactctactgagactgaggagaaacagaaaacaaaacctggccctttcagcttctctgctggtccctgggagaggcacaaggggcctgctgagtggagtgaccttgagaaggtcgagcaggcctctgaagtggtgcagcggcacgggggcaggggagcggcatgagccataaaggaaatattgtctataaaagccccgttttccctttcttctggagcaggcacaaggcactgacttcattttgcattcataaagcctgcctttggaagcgcctttaagaactgctgcaggaagcctgaagaaacatgttggagggtcaaacacacatctccttgggctttctttcatctgtcttaaaaacaaaaatctctccttttttaatcatctcctcctgtaaaaagggctaatcttttgttagcagcagcctcccatggcacagcatctcagcaattaatacaaaaaagcaaggaagatgcaggtagaggagggggcctctagctgaacaggaagagggcctgggagtcaggaaggaagggtgaaggatgggagaggggaagctgaccggctttccctggagcagggagcaacagatggcagctgcaaggcaggccaggcacgggtctcagagaaaacgtcctattgggttcagggtttggatgcagatctataaatgtggccagaaaatccaaactagttccatcaaggagggtgcagaagccaggtgtggtagctcacacctgtattctccgaggtaagtggattgcttgaggcaaggagttcaagaccagcctgggcaatacagcaagacaccatctctatcaaaactaaaataaataaattaataaattagccaggcctggtggtgcatacccgtggtcccagccatttaggaggctgaggtgggaggctcacttgaacccaggagtttgaggttgtagtgagctatgagctgtgattgtaccactgcactccagcctaggtgacagagtgagaccctgtctcagaaacaaacaaacaaacaataaccaaaaaaaaaaaaaaaaaaaaaaaaaacagagaaggacagaggaagtcatttcggtgggccatgtctgttggatctcttcttcctggacacttccctgatttcttgcgtcaatctttttttgtaattatgtcgccttaacggaagaatatatccttcaactctgttgtaaacaaattggtattttctttatttctgattacggcctttgctttaggattgtatttctaaaaatatactattaccctgcttaaaacccatttatgcctggtgttccattattggaacgctaaacatgtgggagttatttatatcctactgctcgagggcatcagcaaggtctacatcttcacactgaaaaaattgtaaccacaggcataaatgggttaaaagcctcccaggatgccccatttttcctaggctaaaactccaaacactacagcgttggttaaggcttttgagccctgagttctataaacatttcaccctcatttgctgccagacacttataccacatacttctatcctcatatccatgacttggccatgttctgatgcagttttgtccctgggggttcccacctggcaaatccctcctcgatcattaaaactctgctaaaatatcactttccttgtgagggtttcatggactcctcctgggggttttaatcattttctcccagctgcttgagtggaagtccatgtgcatcacttataacgtgcttatgaaattgtaatgcaatgatttgtttatatggataattttaacctccagattttcaaaagcacggagaatgacttacccttctttctagcacaatgcctggttcctagttggcactgagcacacgtctaagctaaagattgctaaggatgtaacaatataagacaataatctaccctcaacactcaaaggtaagatgagaaagaggagaaaaaggcttccggattgaggtgattttatttcaccagacaagactaaggggatggagagaaaaggcctcctgaagtatttagggggggccgtgtgtgtgtgtgtgtgtgtgtgtgtgtgtgtgtgtgtgtgtgtgtgtacttgagagctggggaagccaagtaacattgagatgactgcagtctacaactcttaggggtcctgaaatcaggggaaggtgatattcttctcccaaacttggaggaggaaacccccggtgtccccacatcgcagttgtacgtggggatgcctttccgcccaccatgccagatttgcagagcacaaagagcattccgggcatatcagagcacatggctgtcacttctttgtacttctttcccaattatgtgtttggaacagagccctaaggacagttttatgcagcaaagggaacaaaactataagcagcatttgtcttacttgtgtgaaaagagctgttgcaaaaccccttgcatggttagatgagaaaacatagctgggcccctctgttctcaagcctgggattcctggacccagacctacgtggacccttgtcttgcagactgaggcccgggtgccagcctggcaaagtgtttttcagtgtcaatgcaattctaagagcaaatttcctttcattgtattgaaccctaagagctatacattttcctcaccctttcctgttctgtgttagcctggaaactcctgccagaagggatgtgagagctgagaaggcaagaacagcatttgtttggggctcatgggcctgtaagttctcatcatgaaacaatgacggactcagcaggttaggacctgtgaaatttaccaggatagaccaagccccaggctcagcatgtatcatgttttggggcatttcagttccatggaaatgatactgtgcagaagaaaggaaggagcaaactaaggaatgggatggaaaataaaagcaaacagttgtttatcatgtgttttcaacccaaagcatagatttgtgactcttatattcacctgcataatctctatcacttcaatttctacatattctagaatattaagacaaaactgtcctcctctctcctccccaccatatcaaattagacatttagataacatagcaaaagtaaaaaagtttgttgattcgcccaagtaattgacagtaatgaatttgttgctgagtgatgtggtttattgatggcactcgtatctcatctgctgtctgtgcttataagtacagtattggtgcttagcttgttgagttaataaaatctacaaagtggtttttaaaaaataatatgtactctaaagcaattctcagcaaaagcaactcccttcttacggggcgtgtgtgtgtgtgtatgtttcttaatcatcactaataacaagaaagggaaaatgtctgctttctgctgaatcgtttaagtggagaaacctacactaggagaaccttttgtcatcaatggttttagattctgggtggagcctggcccagttactgaggtcttagggcaaaggataacattaaacctttaagacccagcaagaccttacactgccttggggtgaagacgaggcagaccttctgtacctggttttgtgaggttcacacaactctttggtccccttcctgcctcaactcttcccttgtgcccatagaatagataacggctgttctttcaaaggatagagtcaggtgccagaatagagttggtgccactttgtaacctcctcggagaagtcacagcttgcaaaaatattgttatccatgttagtgaagtaattaaaatgaactaatcattttccaaaatatttatgtattgaaagcaattccaactgattgcctttaaatagcattttattctgttttcagtaataaacaggagcgtgcttccttttgctttctggagcgccagcccacccactgtggtgaagccgccggagtggtgtgagttgagtacaagttgcgaacagtgctgatcaatggcacggcccaaccttccaaccctgaaagagccccttggctgctcttgtcctcaggccagagccgttttgtcaggagctttgggaagagctaccattctgcagttactgtggaattttctccccaagtgggaatctttgtcagctcagtgctatttcctttatatcacagtctgagagaaccagtcgtctgattaaattaaggcaggcacacagacagttgggttgccaaacctagggatgttattaaaaataatagtgtttatggctgtgttgtctttgaaggtgcaagtgagacacatgttcctgccgtgtgggcagcaggttcctggcagtccaaacccgtggggacaagcaggacaagttatggagatgaaaaggcaggaaaaatgagtccacatggttactgtgttgatctggctgtgaggagggcaggggagacgaggagggcaggggagaccatgaggacaaggcctcctgtggcgaaaggcagagggaaggtgcagggacaatctctggtagagtaatagaatcctggttcttagacccagcttgaccctaactagctatgtaattttgggcaagcctgcaactgaacctcaattcatcggccttacctgtgaacaatagatctttaaggtttcttccaccagtgtcgctcctgaactcttgaaaaagaatccacaggcagagaaaaggaggagcagggtattctggtgaaaggtggggcagcatgaagcaggtaaactctagagacacatgttacactgtggctctgtccaccaattctgggagatgaagcaaacccatgtcctgggggcatggattttctttgagcagaggctggagagctgaggtctcttccttccctctccaggactgagtggacagtctgcctgctgcctttgcctctggcctgcccattgctgagcttacactctgctgggaccccagtctctgatccctctaaaggggccagtgctagaggttggacccaagtttctcccatgatgagtgctgctgtgtgcagatcagggcagcaggtccgggactgccacttccatcagacaggttctttctgaagttcaggagcattcgggagtgaatggagtcctttggaggagaaaggatcaagggcaacactctgtgaggttctttggatgcatataccatggtctcccatgctctgccctggctgttttcccagcatccctggtttttgcaagtactggcatgtgatggactgctgccagtgatggacagagatccttaattggttcctcattccttctttaactttgtccaaatcagcctgcctatttcttcatttacaatgtcctgccttcctgtcaatgtacttgcatttttctaagttcttgcaggttctttccaacccttcagaagcttgcatgttagtccttccattgccaaacagggttgtctatacagtgctgctacccaggcctttggaaagcaaattgtgcatccctaagccctaagccccaaacccaacagattccagtctccccacttgcttctgactcctagtgtgaacaattgtgatgacgctggtgtgcatcaggcaaaagccaggtcagattcttcccttgagactgataggaccatttattattagtgaatccaatagcaggccatctggagagataataaaggatggaattggaatggggttgagctgtaattgcagactcttaaaaaggatcctaggtgtgattttctaagtcaatgggttttgaacttaaaaaattagtggcacctttctacaaagagaatctcctcgcagtgcccaatatataaagcagatgaagtgagtttgctctggaagaaactgggtcggcctgatgcctggtgtgccacagctcttcccagaagcttttggaaccccctctgagccctggctgtggtgagcacacactgaatgctattcgtctaagctgacaaactcttctccaggcaaggtcattatgggaaatgcttagctaatttatatccatattgcttgagaatataatcatataccacattattaagcataaacaaaataaccctaaatcagttattcaaaattgcacatctagtaaagagtagaacagaaaccaggactgtgggcacctgacttttaggccaggactccttctcctaaaccagtagcccagacagtagccacctatcaccaggaatctgtcagaaagcagattcccaggctcaactccaggcctactggatctgaaaatgtgggggtgaggcccagaaatctgtattttaagaaggtctccaggtgattctgatgtatgctgaagaacaactgtcatggcctaaaccacgatgactcttgaatttccccattaatttataattttcttagtggtacatgggttaatatcttggaggtttttgccctcattgtctttatgtgtttattttggtagtgggcacaggaggtagtagggaagacttaaacatatacacaatgtccttcattatttactttgggactaaggttgtcagacttggaaaatgaaaatacagaatgtccagttatatttgttgtttggataaacaatgaaaactattttagtacaagtatgctccagaaaatatttgggacataattacactcaaaaataatttgcttttttatctgaggttcaaattcaactgggtatcctgtattttatctggcaactatatttggtacagatcatgaattaggaagtttcttcttttcatgtttttttttttcttcccttttctacacccaaagccagggacatatctcaatattgtgttcttatttccaaacccctttctatgttggtaagaaaaccagggggagagaggaactagagggtacgaatggtaaatgaacttaaccttcaaactcatcattttttaccattattatttcacttacacatttgctgcgttacaggaactgctgagtaagaagccatgaaaatctttgtcaaacacacggttgcctctccctgaactcccttctacccatcaaacaccatagcctgtctgccaccttcaacattggctgatgacttcttattttctactcactatgcttggggagccaactagacttaccagcaaaatcaggtgcatgtgtataagacacagttagactcaataaacagattcagtctaaacttccattgtgtgtggggacagggatggggaacatcttgggtgaggcaaagaaaggaccactggtcttaccataagattttccaaacaaacttgaacttttaaaataacttgatttaaaaatcaaaggaacagatttaaagtcttgtttttgatataatgtccttttaaacagaatttgaattaaagagtgggttggaagattgggaggaatgttagcagagaagtgcaagtggaaaaaaagataaaaataaatgttgttctcattatatccttttctgattgcatttggtggcgaaatgatcagtagacttgttttccagtctcaattcaatttcaatattagcacgtaaccttgggggagtcacaaagcctttcttattgtcaatcttttcatttgtacaatgaggatatttgtagaattagacaacctctagtttaatggctaatgaattgtatcatttttctcaggatctactaaactctcagatctttccattaatctgaatcacagcttaaactcatagttatcctgacaacctcatgacaagcaaaatatcagctgatcaaataccatttgtttcatctataggactgttcattaaacacaaaaaataatttcccccttatcttctacagcgaaaacctacccaaactgtgggctcagggctaactctaataaaataccatgttggactcagacccctctgatctaattagtataacctgtatttgatgtggaatgctttcctggctccagaaagaattgtattttgttagatattaagagacttgttatttagtattagtgggaactggagagataagttaattggtctagagcaaacttgaaggcagtgtgtagccctataggtatagggaagggtctagcccttagttctgacctggagtttgggttattctgaatactgtaaactctccagggaatttatattaaggaaaattagggctactgttgctggatgaaattattgatttagacggaaaatgacacgttcattattttaattgaggtgttcagtttggcaatttaagtaagggttgtaaaaatgatcaagaaataaggatcaaagaacctaaactatcataactctccaaaatccatctggaccagctctcttcctctaggaagatggggcctaatccccaagaaggaagtcagtcaatgattttctttcccttgatccacaacatgtactgctagaaagttgtattttatgtctcacctagaagtccctttggcagtgtaagcattttggaaaacagtccatggtggaaagtgtcctgggcttttggcagtttcctgacaagttttgttacaggtttcatttgctcttttaatgggatttttctctgagctattggcagtcagagaggttcagacaactggctgaacaggaggcatcataggatcatagaattgtagagctggaaggaactcctgggcttgccattcagacagcaatcattttgtcttaggttcagctaggaggtagcgaggccgggatgattgtatccaatcctttttgccacatgactagactgatagagacctttaaatgtcaacaaagcaattttgaatgggattcagagctcactaggaagctggtatcaaagctgtgatgttagaggactcatagaaaccaaacgccttgctgcatcccaaaggcagcgttttgcatgggcttcaggctgccacagctttatcggcatgtctgcatttgcagtgatgcatgctagaagctatggtgcagatctctgtcgccacatctgtgaaggtcagacgccacctagagatattcaagtctcctttgtttcccatcttccactcacagggattggtaacagttctttcaaagactgggctttaaggaattgacagcaggtagagagggaacaaacagcatgtgaatgcagagcaagtggtggaggccggcacagggattaggggcaccatgattaaattggcctcgaaagcccacacatccactcacagactagacatgattatgttcctgtttgtctctgtgcaaagccaactacttctaccctggtaggagtcactggagaggttaggagagataaaaccaaaatctagatttccctggtcagtctattgattctctattaaattgcaagaaatcaaaacagatcaccaaggttttgtctgtcagctgatgtttgtgtatcatatgtatgcaaagtctcagagccaggagggcctgtactccacaccaaatctcctatgcattaaaatcagggtggcgcctcatgaacacttcacctattgttctttcattgccaagtggggagagataatcaccaaggtacgcacttacaagaccagtctagagacctcacaagtcagggtgagtcgagcaactcacttgggtaagctttcatagatccacccatcttcccatttacccacccatctgttcattcatttatccatccctcaaaaaaatggctcagcctaccatgaactgagttgaagctaagtataccttggttaaaaacaaacaaacaaacaaacaaacaaacaaaaacagacctgggcttcatccttgccattattttatagtctagtaatggagtctagtcctcagtcttagagagaacagctaaactgctggtaaattatttgtctgattttcttaccttatatgtgtatgaaaatctgttattaggtgcaagtaaattggtgagtactaccacagtgcacatgatgaaataacggagaataagacaggggtagagggaggtttccataggtagaatgatccagagaagggcttctggagagaggacacctaggctgaggcctgaaggataagaagggaccagggatgaaaagagcagacagaagagcatttcaggcagagggagcagaatgaggggaggcagtgaggtgggggaatagctcagcatgtttcaagggactgaaagaagccatcgtggctgggctgggtaggtgagggaaagagtgaaatggaatgaaagggaaggggacagaagccacatcatgtaggtggttgaaggccataataaaaagtgggattttattttaagtgcaatggcaagacattggagggagggatggaggtataaaggattctttgagctgctgtgcccagaggaaattggaggagggcagtagcagatgtcgggaggccattacactcaaataaagtgagaaatgctggcggcttagactggagtgaatgtggggcagagctggctgcccaccatttttggagcactcagcctgagccatctgtgcccacgaatgctgttggaggattctgctaggcagccatcatcaacctgccccttcctttggttgttgggagtcaggtgatcagcaccaggtaccgtgtcctcctctcacgtagcaattgctcaatggcgtttcacgagtgatggtatagcaggctgcataatgagggaccatttgtccctaagggtgtctaggccctagtctctgggacctgcaaacaagatgccgcctatggagaaaggaactttgctgatgtggttaagaatcctcagatggggagttatcctggattatccagatgaacctgatgcaatggcaaaggtccttataagtcaaaggcaggagcaggagacctgatgatgggagaaagaggttggacagctgctatgaggggccacgagacaaagcatgcaggcagcctctggaggctgagaaaagggaggaaacagactctctagaacctgcaggtagaaccagctccgcagcaccttgaccttagcctaggaagactgctttggtcctcggcatttcagaaccgtaaggtcatagatttatgttgtttaaggccactacgtctgtggtgatctgttacagcggcagtaggaaactaacatagacagcaatgctgagtacattgtggaggcttaaggcccacttcactggcaagatctttctcttcacctccaaaactccatgttctagacccactgggagctagagactggctcccattctcatgcatccctggctctttcccttctgcagagcagccattgagggaattcaaggcttgggcatctggaagtgggtgggctcaggagacataaccaagaaaagcaaacaaaaaatgcatttgttttatttctttttcattttttataaaagtccattttagtcagtctagggaacaatggtgagagtgtcatgtctttagaaccagcatttgttggcaaatgcctggtctggttctcctccatgatgtaatgcctcctctgcttcacgcagaccacactctggagcttcccacccattctctagccttggcctttctcccttgccctctcatctctttctccagtctttcttcatcccaagcagatggagtgtgtacccttagacctggagtccagcacgcaggcccctgcgggtgtgagatgggctggaagcttgaagagaattcgacccggagggagaagcatgccatcttattaactgcaactttacttcaagaaatcacgcatttgacctgagatcagtatgtcctgtatctggctgcaatctgcctcctcccctggagcctagggaatggctgactctcatgcttcttgccctggatgaccaaaggcccttggctaatattttttctgtgaagcgacagggttcacctgtgcaagagaggacagaggcatctaagaagatttccaatcccgcctgcacatggcccttctcctgcctggaggccggtgtgcagccctgcctggggggagaggaggcatcagagggatgctgaaggttcctttggatcctttgaccttttcccacatagactctttttttgataccaagactaatgatctggtaaccctccagaaaggcatccaggaacaggggcttaattaggactcatttataggaagctactgcatatgcagttccagccggtttccctaagggcccatggaggagatgacggggaggtgacgtgggtcaagatttagactctccctttctcagaactgtctcctatatcctacctggttcatgcttcccatgctccacctcaaattttaaacaaagcaactgctgactaacctacatatctttattaagaactacccaccttagcctagggagatgcatatttagcattgtgattatttggggttagctattttcttcttatgaatacacatgaggattttccttttcctcgtaactttgttatggtggctgccttgctaataagggttgtgcctgtaaatgcattttacttccataattattgggggatttacatgctctctggagatattaactgttctgatgtcctgtgagtaggcagtggtcaggagcacaagcccgtgaagaatccgtggatggaataacactgagagtttgcaagttcaaatctgagccctgcattttgtccacaacgtagttaacttgatgtaggcatcccgtctactttgcctgatggaggaagggaaggggtgtggtttattttgtctgagcacaggagagctcaggattctgataggctgttgcagggatagctgggacatctgagaacagtcacatttgaatgtttcagaatatttcagaacttgatgcctggccaacttcaatctgctgcctgccttcttcctcctctgccagattctccatcacacccttgccggggtctgaatgtgtatctcctccccacaaggtttcccatcttcagtctgattacagaatattaccactggaaccaggtgcttggaagtcagtgttagattgagaaatgtatgtcacgtacctgagtctttaagggagccattagtttttgatcaggcgcaaattaagtagaaaatcagaagcggcaaagtccttctggaatctgctctgtgacaaatttcttgggcaaatctcagaatcccccaaattaacaagcatctttcaaagtaaattgggccatcctccccgctccaaatcatacagaacctgagcacttctagacaactatctgggcaggaaattgtatgagagcacttttccctctcccgcccttccaaggaatgtataccagtataaatcaagacgtcagcatgcaggaagtcattgcagatggctaattttactccttcctcctacacttcaaatccacttgcttatctgatgcattttacatgtgagatttatttttccttctaaattttaaatagttgttgaatattgagggaatcatcagcttaagatcagggactatatatcttcctgctcttgtttctactttataaccatgaatgaagtagtctgcaaacagaaaataatcaataacaagatctacttttgctgagcatttattatgtgccaggaattgtattagatgccctacatctttgctacacaaagtgtggtgccaggactatcagcattttcatcacatgggagctttttagaaaggcagactctcaggccccatctcaaagttgaacaagattcaacatttgaacaagatccttagattatacatatgcatattatagcttcaaaggtgctgctttgcatcctttcacttattacttagagtaactctaggatgtaggacctattgcaccactttatagatgagaaaactaaggctctggaaaattaaacaagttgcctaagatctcaccaactaagtgtctgataggggatttaaattcaattttctgtttctccatattccatgcctttctagttctgctatgatgagttagaggagaatccattcatagtaaagattcagcacccccaaacatctgcattctctaagttttgaagttttctagaataaggctgatgtcgttaaactgtttaaaggtgtggacctgtaggacctctactagtgtgtgtagttcatttattcattcacacaaaacatgctgttgttgctgagcttcttcctattggtaagtggtggcatgataggtgcttccaggggcacaaagtcgactaaagggcttggtgcttgcctggaaagatgtttgttgctgacagtcgtgaaaaagctagcagccccgagaccatgagcgctttctgatgtcaactcagaatccgcaaaagaggcaggctgcctggaggtcaacaaatccaaactgacttgcaggtaataaagtatctcgttctgtctgcattgtcagtcagggtgcagcaccttccatctcttatctaggaagggaactgtagacagcaattccagttcctccagtgacatcagcagccagactctgcattccagcacacattgctcataagtagggtgtttccatttccccgaggcttctttaggaggaggctacaagtggtgcccacctgaccagctggttagggaggtaaccctgtgtgtttaacttccacttcaccctcccttctgagtggagaatgagcttgaagctgccatgcaaataaactctaatgactttcttcttgcatttacattattaggcgttcctttgactgacgttatgatgataaatgaaaaatgccttgcaccattacatcaagcactaatgcagaataggaagaatttctgctctctcacttattttagggaaagaaaggaaaaaaaagaaagaaaatagcagatgggaaatcaattggatccctatgtcctgctaaggtatttgcatacaggctgccaggagctcagtgccactcacactgcactggagacagggtctgtgtctcttccttgcctcttctgtactgcaaagtctgtgccagctgaatttcagtttctcagggatgtacgaaccacttagacccatttgacaggcaggcaaactgagttatgcaccttcctcaagttatttcagataaatgcctggaggatctgattgacctgtgaagcagcatgtttatctcagcaggagcatgctgataagttaccgtctagtttgcaattgcttagttgttttttatttcttttcttttcttttttttttttttttttggcgcaatcttggctcactgcaagttccgcctcctgggttcatgccattctcctgcctcagcctccaagtagctgggactgcaggcacccaccaccatgcctggctaattttttttttttttttgtatttttagtagagacagggtttcaccgtgttagccaggaaggtctggatcttctgacctcgtgatctgcctgccttggcctcccaaagtgctgggattataggcgtgagccaccacgcccagctttttttttttttatttttttattttttttgagacagagtctcgctctgtcacccaggttggaatgcggtggctcgatcttggctcattgaaacctccgcctcctgggttcaagcaattcttctgcatcagcctcccaagtagctgggattacaggcacctgccaccatgcctggctaatccttttgtatttttagtggagacagggtttcatcatgttggccaggctggttttgaacatctggcctcaagtgatccacctgccttggcctcccaaagtgctgagattacaggtgttagccattgcgcctggctagttgtctccttttaatgtgatatttgatacctcttggagtgtttgtttttggtttaggtgggctgagaaataattcaaatgaaataactgatgtgcaagtttctgtgcaatctctggccatagtttcccaaaaacgccctatagttcctgccgcgagttacaaaccctcacacctaaacagtttggcttcaggtgcctcaatcaatagcagctctttgatgttaaggctcaaagacactaaagcaaataatatacacattaaaagcccaacaacatgataacgggaacttagaactctgagagaggaaaaagtccaaaggcttccctgaagccagggtcgaatattggctatccttcacaatcactaaaacaacatattgataagacacagccaagttcatggtttctggcactaaggaaagccccacacctgcatagtgtcagtagtgcctttgagggagaagggcaaagcaggatcacttaggagattttgaagcctggtttaaggcaagtctctcaatgcaggagctagggagggggctgatcagtatctataggaatcatgatgtaatcatgtaggatcactggatataaagagtttgggggtagaaactgtcctttaattttttttttcttttttggtagcttaatgggtctttcggtaagttcttgggaggaacaataaagttatttgcaactgttatcttcctgggcagtagtagagttgtgttgaggaagacagtaaaatagtcaagacttgttaatgtagctggtaatgtgtgcagaaatcttggactctcaccaggcgagacatgaggctgatagtggtggagatgctttctggaggtggtgaccaatggccacgcctgctgggaggttgccagtgtcccactttgggaggcatcactgagggctggggggtctttgaggcgtatgcttcaagctccttgtcctcattaggccaagaggtcatctttcccttcagattcttctcaaccttgctgaagactcctagtggccataatctgggtgtcaggatgaagtctgggaactgagtgcacatccctgattccatacacacatttctttgtggaccccttgagtgaggaggacagaaatcctgctccaggacagtggtgggaagggtggctgcacaggggttaagagccatgggaagccagtgcatccccacaagggcacgaccctgagctcctccacacacccgaggaaccctgcttttagctcaaaggagccccgtatgctgtggagaattcctctgctaccagcctctgagaagttgtactgagcaactgtgaataagaaacaattaaatttgctaaaggtctgcgaaatcagatctaatctctttggggacttggaaaaaacaagcaaacaaaagagctgagttatcgattgctgcatttcggcggctcttaatctgaaatgaaatcaggacccaaaggccagagaccccgatatccattctgcacttgtcggaaggcccacctgtcagagcccgaacttctgctcaatggctaaattagtaggcaagtggcaggttgcagagagctgtggccattgggctttcttggggcacgaaagcggaggaagagctggcatattttcttaagtgtaaagcagtggagtaaattgagttcactgggtcaacattcctcctcctctatccacagaagcacctcacccaatcagcagactttctctccagccttagatctccctcttatgagatgctgtcattctattatcctcccccaagttggtctttacccctttgaccttcagaggtggagagggcaggagggcaatggttctggtggtcaggggcttgccaggaaggagaaagatgctgaccttgaataaacgacatatgtagctttcctgagttaggttgcatctgggatgcagtgaaaggtagcagcagtctcgctgtggctgtccagtccagaagcagaagaccggcacctgagatatcaaggtatccaatttgggaatgctttttctgtgggtgtgtagaattgcaggaaagaccatagcatattccctgaagtgaacccaaataaggtctgggataaaaaatctgaatctttaggcattaactgtgaaaatgtctagtcagaatgtctttaaaatggcagcttctcttatcagtgtatttgtgctgagaaaaaaaaataagtatagcttctcagtttaccttctctgatccagggacaagaaagaagaaaatgaccactacctcttcttaataagaccccttgatctctacactctccagaaaaccacatcaggatttacctcacagggtggacaaatctgaaacattctaaataaaagtttgaaattcccattttgcagtaaatgtgactgggcctcccttaatgcctcctgtccctcggtgttctacctgtacttcccacttcacctggtgtctcagctaaacttcttgaaagtgggtctctaagttttcagttatcgtgtattacacagttcattgcaaatcaacttccatcaggacatgtgtcaaggtcaaccatgaccttaccattgactcatcttttcatttcttcaacacagttgctttgaagggttggcatgatgggcctccatccttgaagtgctttgcaatcttgacccccaggtcgctgtattcctctgctcctccttctgcctccgtgaaaacccatgtttgcttttcttcttttctctgagctaatatcgatatctgttgaggtttcatccttgtctctcttttacatgtcgacataccatctgggtgatctctttattacatgacttctactctcagtttcacaaagatgactctgaaatttacatctttcaccagatctctcccctgggatcgaggttcatgtttccacctacccattaaacatgtggacttgaatatgcaagaggcctctcaaactcagtatgtagaaaacgttattctcaaaccttctcctccccttgatgttattattgggatcgatagcatctcaaccacctggcggcccaagctgaaactgttggtacgcctgtcactcttctctctgcccacctccttattcagtgtaagttcacacttcttagctgagcacgtgaacatcaccgtaagttggccaaaactgcctttccaggctgcacctgcatccaacctgggccagttttctacacttgcatatttcctccctacttcttgatttatctacatatatctactatgtgtggcctctttcctcttccatgccctcagtgccttatcctatgagacctgctttggatggtggccctcttgcatgccctctctattctcctcaatggacctggccacctcctcgtggtcactcccacacgacatgcttccccctctttgtgtcacactgtgtgtgacacatctgtcttcatcccctagacttgaggaaagaacaggaagaaattaatactttaatctttgtatcatttcaacctcttagcacaatttctgacacatagtagagcctcaaaaaaacctggcctgataattgaataaatgcttggattagaaataaattctgggggtgatggctcacgcctataatcccagcactttgggaggctgaggcgggtggaacatttgaggtcagaagttcaagaccagcaaggcccacatggtgaaaccccatctctactaaaaatacaaaaaaaaaaaaaaaaaaaaaaaaattagccaggcctggtggtggttacctgtaatcccagctacttgggagcctgaagcaggagaattgttcgaacccaggaggtggaggttgcagtaagccgagatcgtgcagctgcactccagcctgggtgacagagtgagactctgactcaaaataaataaagaaattctgctccagactaggtgagtcataaaagtatatatggttctaccacagagccctcacctgagaactggaaggtggtgatgctttgcgtctgatttttaagggattgagggatggtgacaagaaaactgaaaatgaacgttgtgattccctaagcctctcaggagagagatgccaagggagggggtagctgccttgtaaaagagttcaaagagcataggagaaatggggagaacacctgggttctccattccttcacagtgtgcacaaggaccccccgcccagcctcagggttctatttgtaaatagggtcaagagacccactctaccaggttgttgcgagaactcagtgagtgccctaagtgttttcacagtcatttaggaacccagatttgagtgtcattactttttagagcaatcatctgtgatgctaatgataatgatgcttgtgaaaaaaataagaataataaggacaaaaagtgacacacaaataaatagctgtttatctcgcataggagtggggaaacaaatgaaaatattggagaacaccagagccacttaaattgacaactctggtgtttccatatatgctatttgaacacatccagctgggggtctctcgtgcaaacaaatggtaaagaatgcatttttttcctgtctccatatcaccagggttttctgctcacacagtgttgcgctaattgcatattcagtaggatttataatgcaattatgaattcataccataaacgtttcctggtctcctgaaatagcttgcatttccttcagatgtgtcccaaggcactctgatcttacccttattatggcactgacattgtaattgttggtttacttctcagtctgtcccaaatattattggagctttaggacaggaactgtatcttgttcagtatactcctgttacctagtgtcgaatgaagcacttaagttttgctccaaagctatttgctggcctttactcattcattaaatacctatttgtggagtgcctgtcactgtgctgggcgctgggatatggcagcatcaaccatgttcactcacagagactatagccaggaagggagtggccatacagaattatttaatgaacgctgtaataattgcaataaaacaaaaatacaacatgcttaaggcatgtacaagggtcccaaccatgtgtgaaggcataggtagttctttgagaaaagtatatttttaaactatgaggaagacttatccatacaaagagttccagggatgggggtggagctaggtgggtgaaaggaagaatccagaatgactgaagagcagaaaatctaggatgggaaggtatatggactgctgtgatggccacacatctgaaatccagggaggtatgaggacttgctttctccaggttccaagtccattaatagcagaataaggactggaatccacagctttttctcctgggccacactgtaaacatacagctgtggttaggaaaacgagaggaagccttgagtgatgagagagtgacagtgggcaaagatccagactgattacacaaagggaagaggcaagttcaccctgaaagttgcatcatgttcagtggcactccatgcttcttcctgagccctggcacttgtgctgtaccttatcacagcactccagcagggctgacaggtcctctgccccccaccatgggccttgcctgttttcctctgttggagggtctccctgcaggctacagcagccaggacctttctgggccacacagtctgaatgacctgctcttcctgaatgctctctcctggcagcgttctgcgggctgccgccctaatagcctgtctccccacaggccccaaacatgttgctggatcagagttagtatctttcccacccgccaggctgtcccccgagggactgccgtctcctgcaagctgtagggagatatgctacggtgattcatattagcttgatttgcagccgttccacacagtgtcgcagagacctgcaaaatccccacagtcttgattaggtttgccttttgctgtttatcagtggtacctgtctatttttatagccacccttcagccaaattcaggattgcagctttcacggtgggaatcattccctggtcatgtgcatctctcattcgggtgtcttgtgggcagtgggagaggaaaggaaagcagaaaggatgcccgaggggaaggtatttgacattgtgagggctgcttttctggtgagggcaccggtccttggtattctcttcctggccaaaacatctccctccttagacccctcacatacttaaacttagttgagttggtgggtggacaagatgacaggcagatgatgagataaaaagataacattaagcgcattcccaaaatgccagaatctctaggcagaatgccaagttgtcctctcacccagtgcccacctctgcatctcaggttaagagagtagcccaggccagtgatctgcttacctgcttccctccacaaggaagaagctctgggcagcagagactctcgtgctcatgagccatccccagcccccgtgtggctggcccaacatcactcatgattgcagtaaatatttaccttctcatctgttgctcacaaccaccctggatctggataaagtcattttggcttctatgcccatttcacagatggagaggtgaccctctcaaggttacacagagcctggagccaagcgtgcatctcctaatgtcacagccactgggtgagggtctccttgttatcccaacccagctcccagggagtttcctcacagtccagcaaagaatcccactccctacccctccccatcagacactcccccacacccaaccaccacgcaaacttccctgtttggagtggtagagggagggatgataaaaggtataaaagaatgaaacattcttatgtttgatgattcctatttgatgaatgaaaacaatatttaatgagtgcaggaggttttgaacctacctaaaatggagggaagatttagccctctgcatttccaagacctcatctttgtcctgtgtgaattcttaccattaatagcaaaattgcagacagggggagtactacattcctccttaagaagagaatgccattgttgacatgggaagatggttcttgagaaggggttggaggtaggcaagctcatttgttctttattccccgccagtccgtgaggaaatgtcagacaacaagacctatcccttcatggactccatagtttagtgagggaaaaggatattaagtaaataattatctcattacaaattgtgatgagtgctcagtagaataagtttctgtgtgagaaactgacagaggatcttctttacattggaggatgttggggaagacacctttgaggaagtgacagttaacctgagatgacaaagatcaacgctgcctggttaagtctggctaatgaattgttcaagaccacatggttaggacaactgagacacagtacagtggggctgcggggactaggggtcagaggacctcaagtctgaaacttaaaaaatcgtgtattttttgtgaaaataattaaatatcaatagtactacaagtgtaattttcaaaagaaaattgactttactctcctcatccaagaattccattctccaaaggcaaccattttcagctctcacctgtttatttggatatttacctccagatttctcagtaatgtgtttatagagttacttcataaattctagacattcatctactacaaaagatgaagatttagcattcttttttttttttttttttttttttttttttttgagacggagtctcactctgtttgcccaggctggagtgcggtggcgcgatcacagctcactgcaagctccgcctccctggttcatgccattctcctgcctcagcctcccaagtagctgggactgcaggcgcccgccaccacgcccggctaattttttgtattctttttagtagagacagggtttcaccatgttaggcaggatgttctcgatctcctgacctcgtgatccccccgtctcggcctcccaaagtgctgggattacaggcgtgagccactgcgcccagcctagcattcttaaacctgtcccatcacatttaattcttccattttcctaatagatagttttacatgacaattattctttgaatcaattgtcagtattcaaattataaatattaatgcaaataaaaccaagtgaattatgattacattgactttcctatacaacattctgtttttcctggagttacgtattttctgtgtatgtctattttttccccacagttttcccattttcctgctgccatctggaactcccatcaccactaaccaggcctctctcctattttggaatccctgcctccagggcctcatgactttttatttatttattattatgattatctttaaatttctcttgtgttttggaagagtgtacttttcagttacttcctgaggaaagggtaagcaacttgcttcacacatgactgttagtttgattgggtttagaattttcacctcagagtagttttccttcagaatgtcctctattctctaacttccatggtggctctttagaaatgtgcctctctgattcctacatctttgtatgagttctagatatttttttttccttaggaagattttaggccactctttttatccctgctattttggagttttcttaggtatacaaggtgttgatacagactttttaaaaaattatactttaagttctagggtacatgtgcacaacgtgcaggttgttacataggtatacacgtgccatgttggtttgctgcacccattaactcgtcatttacattaggtatttctcctaatgctatccctctccctatccccaaccccacaataggcaccggggtggtaggttccccgccctgtttccaaatgtctccattgttcagttcccacctatgagtgagaacatgcggtgtttggttttctgtccttgtgatagtttgctcagaatgatggtttccagctgcatccatgtccctacaaaggacatgaactcatcctttttatggctgcataatattccatggagtatatgtgccacatgttctctatcatcgatggacatttgtgttggttccaagtctttgctatcatgaatagtgccgcagtaaacatacgtgtgcatgtgtctttatactagcatgatttataatcctttgggtatatacccagtaatgggattgctgggtcaaatggtatttctagttctagatccttgaggaattgccacactgtcttccacaatggctgaactaatttacactcccaccaacagtgtaaaagcattcctatttctccacatcctttccagcatctgttgtttcctgactttttaatgattgccattctaactggtgtgagatagtatctcattgtggttttgatttgcatttctctgatgaccagtgatgatgagtgtttttttcatgtgtttgttgactgcataaatatcttcttttgagaagtgtctgttcatatcctttgcgcacttttcgatgaggttgtttgttcttttcttgtaaatttgtttaagttctttgtagattctggatattagccctttgtcagatggttagattgcaaaaattttctcccattctgtaggttgcctattcactctgatggtagtttatttcactgtgaagaagctctttagtttaattagatcccatttgtcaattttggcttttgttgccattgcttttggtgttttagtcatgaagtcctcgcccatgcctatgtcctgaatggtattgcctaggatttcttctagagtttttatggttttaggtctaacatttaagtctttaatccatcttgaatttatttttgtctaaggcgtaaggaagggatccagtttcagctttctacatatgactagccagttttcccagcaccatttattaaatagggagtccttttcccctttcttgtttttctcaggtttgttaaagatcagatggttgtagatgtgtggtgttatttctgaggcctctgttctgttccattggtctatatatctgttttggtaccagtaccatgctgttttggttactgtagccttgtattatagtttgaagtcaggtagtgtgatgcctccagctttgttctttttgcttaggattgtcttggcaatgcgggctcttttttggttccatatgaaccttaaagtagttttttccaattctgtgaagaaagtcattgggagcttgatggggatggaattgaatctataaattaccttgggcagtatggccattttcacaatgttgattcttcctatccatgagcatggaatgttcttccatttgtttgtgccctcttttatttcattgagcagtgatttgtagttctccttgaagaggtccctcacatcccttgtaagttggattcctagttatttgattctctttgtagcaattctgaatgggagttcactcatgatttggctctctgtctgttattggtgcataggaatgcttgtgatttttgcacattgattttgtatcctgagattttgctgaagttgcttatcagcttaaggatattttgggctgagatgatggggttttctaaatatacaatcatgtcatctgcaaacagggacaatttgacttcttcttttcctaattgaataccctttatttctttctcttgcctgattgccctggccagaatttccagcactatgttgaataggagtggtgaaagagggcatccctgccttgtgccagttttcaaagggaatgcttccagtttttgcccattcagtatgatattggctctaggtttgtcataaatagcttttattattttaagatacgttccgtcagtacctaggttactgagagtttttagcatgaagggctgttcaattttgtcaaaggctttttctgcatctattgagataatcatgtggtttttaacgttggatctgtttatgtgatggattatgtttattgatttgcatatgttcaaccagacttgcatcccagggatgaagctgaattgatcgtggtggataagctttttgatgtgctgctagattcgatttgccagtattttattgaggattttagcattgatgttcatcagggatattggtctaaaattctcttttttttgttgcgtctctgccaggctttgctatcaggatgatgctggcctcatgagttagggaggattccctctttttctactgagtggaatagtttcagaaggaatggtaccagctcctttttgtacctccggtaggattcggctatgaatccgtctggtcctggactttttttggttggtgggctattaattattgcctcaatttcagagcctgttattggtctactcagggattcaacttcttcctggtttagtattgggagggtgtatgtgtccagaaatttatccgtttcttctagattttctagtttatttgcgtagagatgtttatagtattctctgatggtagtttgtatttctgtgggatcggtggtgatatcccatttatcattttttattgcatctatttgattcttctctcttttcttctttattagtcttgctagcagtctatcaattttgttgatattttcaaaaaaccagctcctagattcattgatttttttgaaggggttttgtgtttctatctccttcagttctgctctgatcttagttatttcttgccttctgctagcttttgaatttgtttgctctcgcttctctagttcttttaattgtgatgttagggtgtcaattttagatctttcctgctttctcttgtgggcatttagtggtataaacttccctctacacactgctttaaatgtgtcccagagattcaggtacgttgtgtctttgttctcattggtttcaaataacatctttatttctgcttcatttcgttattttacacagtagtcattcaggagcaggttgttcagtttccatgtagttgtgtagttttgagtgagtttctgaatcccgagttctaatttgattgcactgtggtctgagagacagtttgttgtgatttctgttctttcacatttgctgaggagtgctttactttcaactatgtggtcaattttggaataagtgcgatgtggtgctgagaagaatgtatattctgttgatttggggtggagagttctgtagatgtctattaggtccacttggtgcagaactgagttcaagtcctggatatccttgttaaccttctgtctcgtcggtctgtctaatattgagagtggggtgttaaagtctcccattattgttgtgtgggagtctaagtctcttagtaggtctctaaggacttgctttatgaatctgagtgctcctgtgttgggtgcatatatatttaggatagttagctcttcttgttgaattgatccctttatcattatgtaatggccttctttgtctctttttatctttgttggtttgaagtctgttttatcagagactaagattgcaacctctgctttttatttgctttccatttgcttggtagatcttcctccatcccttaattttgagcctatgtatgtctctgcatgtgagatgggtctcctgaatagagcatactgatgggtcttgactctttatccaatttgccagtgtgtgccttttaagtggggcatttagcccatttacatttaaggttaatattgttacatgtgaatttgatcctgtcaatatgtcagctggttattttgcccgttagttgatgcagtttcttcctagcattgatggtctttacaatctggcatgtttttgcagtggctggtaccagtttttcctttccatgtttagtgttccttcaggagctcttgtaaggcaggcctggtggtgagaaaatctctcagcatttgcttgtctgtaaaggattttatttctccttcacttatgaagcttagtttggctggatatgaaattgtgggttgaaaattcttttctttaagaatgttgagtattagcccccactctcttctgacttgtagagtttctgccgagggatcctctgtagtctgatgggcttccatttgctgttaacctgacctttctctctggctgcccttaaaattttttccttcatttcaaccttggtgaatctgacaattatgtgtcttggggttgctcttcttgaggagtatctttgtggtgtcctctgtatttcctgaatttgaatgttggcctgccttgctaggttggggaagttctcctggataatgtcctgaagagtgttttccaacttggttccattctccctgtcactttcaggtacaccagtcagacgtagatttggtcttttcacatagtcccatatttcttggagactttgttcgtttccttttactcttttttctctaaactttgcttcttgctttatttcgttaatttgaccttcaatcaccgataccctttcttccacttgatcgaatcggctgttgaagtttgtgcatgtgtcacgtagttctcatgccatggttttcagctccgttgggtcatttaaggtcttcttcacactgtttattgtagttagccattcgtctaatcttttttcaaggtttttagcttccttgtgatggattcgaacatcctcctttagcttggagaagtttgttattactgaccttctgaaggctacttctgtcagctcatcaaagtcattctccatccagctttgttccattgctggagaggaactgcagtcctttggaggagaagagacgctctggtttttagaatttttagcttttctgctctggtttctcctcatctttgtggtctttatctacctttactctttgatgatggtgacctatagatggggttttggtatggatgtcctttttgttgatgctgatgctattcttttctgtttgttagttttccttctaacagtgaggtccctcagctgcaggtctgttggagtttgctggaggtccactccagaccctcttttcctgggtatcaccagcggaggctgcagaatagcagatattgcagaacagcgaatattgcttcctgatccttcctctggaagcttcatcccagagggtcatctgcctgtatgaggtgtcagtcggcccctactgggaggtgtctcccagttaggctactcgggggtcagggactcacttggggaggcagtctgtccgttctccaagctcaaacaccatgctgggagaaccactgctctcttcagagctgtcagtcagggttgtttaagtctgcagaagtttctgctgccttttgttcagctatgccctacccacaaaggtagagactacagaggcagttggtctttctgagctatggtgggctccacccagttcgagcttcccaggatgctttgtttacctactcaagtctcagcaatggtggatgcccctccccctgccaggctgctgccttgcaggttgatctcagactgctgtgctagcagcgagcaaagctctgtgggcatgggaccggcctagtcatgcacgggatataatctcctggtgtgctgtttgctaagaccattggaaaagtgcagtatttgggagggagtgtcccgtttttccaggtaccatctgtcatggcttcccttggctaggaaaggaaaatcccctgaccccttgagcttctcaggtgaggcgatgccctgccctgtttcagctcaccctccatgggctgcacccactgtccaactagtcccagtgagatgaaccaagtacctcagttggaaatgcagaagtcacccatcttctgcattgattacgctgggcactgcagaccagagctgttcctattcggccatcttaggcttttttttttttttttaactactctcctttgtacttaatacatttctcttctatcagttttgaaaatgtatcttgtggtatttattttttaattttctcctcttattttcttgttttctttctggcagttttttaaaaagatgttttattattttctgtcatttatattttctatattttttgttctgatttctaggagagttctccaactttatcctcctatatttaaaattaatgttccttaaaaaaatttaacctataacttcttttaatttctaggagttctttattattctctgcttattgttatttatttatttttctgttgagaggtgggtgctaaaaagccctttggaagctctacacataagtttgttgactcaagggcttctctttaggttaagtgggagctacacattttggtgaagatccctcaagtgtcagtaattttttctgtattcttgtgggtggctttttcagagaaaacttccaatctgcttaagttcctccttttctgactctaccatgctttattaccaagtggttctcaaacttagacatgcatcagaatccctggggagcctgggacaacacagtctgctaggtccctgccccttcacactttctgattctgtaggtcttggatggcccctgaaagtgcatctctaacaagttcctgggtgatgatgattctgttggtttgggaactacatttttgaaaaccactactctagagaataagctctctatctcttcccaggaaagcagtttagctctcaggttccacagatgagtgacggaatgtaactcttcctcatacagactttcaacagttgtcttgttttttgtgccacccctcaccacagcctccataaaaaaaaaaaaaaaaaaaaaaaaaaaaaaaaaaaaaaaaaaaaaaaattcatgcccgtgtctgggggtttgcagcctgaatcagcttgcttctcctccccaggcatttcagtttttgctttccctgctttgctgaatcagttaccattcattcatctgctttccatcctatacaattttgccaacgtgtttcatctgctgatgttttctctcattttatttgtctatatagattgtttaaaccattgttttaaaggggtattgggaggaagtagaagttaatccagttcttcaggccactgtaattagtcatgtcaggaattattttgattgcaagccattgtctttctttcctatattaagcacagctctttttggtcatgcagttagaatgagctgatgcgtctccaaccaaagcccagagaccgtgaatgtgccattatcctaatcatgcaaagcactctcatttctattcttgctgagggaggaatgcttcccagaactaaattcctaactacggaaagaagaaaaggcagtttgagaatttcttgactgtttggaaattttttctagcacaacaagctgtttatcctttactctgattcttattgaattaaggaaggagaaaagaaatcaattcactctccatatgctgcacagcaaaaaccaccactcacaacactatggaatatgtagggaaggggaaaagaagataaatccatcaactaacaagataagtgccttgttcctccatctgttactgctgtgtccttatctaggattggagcatggcagctccgatatatctcgtgtcaggtattatattccaaacccatatgaatgaattttcatgctagtaaccatccatgatctagcccagccacagctaaatttgtcctaaggcaccaactgtcttttgcatttggaagtccattgaattcacagactggaatagggttgtctgctgctgccagaggatggtatctctctgtagcttttccagcacggctgtctctgttgtgctagagctggtgctgatgacttacttgattcactcctgaggaagtgctgatgttcttccaggagatagggaaaacactggaggcctggagaaaatgtctatagaaggcccatagatgggtacatcaacaagagattgaatcattatttaggtgattgattagatgcaccactcctcagatcacagggtaaaaattcagaagactgttcaattggaatgatatctcacgctcttcagcagccccaattatgcggagatgatttcctcattcacaaacagtttattttcaggactgagccttaactgagcatccaggtgcagaagcggagatgatgacatgtggcatgggaacccgtgattgtggcatttttgacaagggctgaaagtcgcagtagacagataaaacttgtttgcatccgtggttgagactgagactcacattttattatagcaattgtgtgatccatctatgttaacatcactgtcttcatcatcctcctcatcgatgacagcaatagcagcagcagcagcagcagcaatacaacagaggggacatgacagctttcagtgcatggtcaaattctttttattttattttagattggggttgtacccatgcaggtttgtgtcatgggtatattacataatgacagggattgggcttctagtgtacccatcaaccaaatagtgaacactgtacccaataggtaagttttcaaccctcatccctttcccatcttccccccttttggagtcccaagtctctattagttctgtctttatgtccatgtgtacccattgcttagctcccacttataagtgagaacatgcagcatttgactttctgtttccgagttatttcacttaggataatggcctccaggtcatccatgtcactacaaaggacataatttcatcgttttatggctttatagtattccgttatatatatacgtgtatatattatatatatgtgtgtgtatatatatatatacacacacagacacacacaaacaccacattttctttatgcaatcaatcattggtggacacttaggttgattctgtgcctttactattgtgagtagtgttgtgataaacacacacgtgcaggtatcttttctatatataataatttcttttcctttggtagatgcccagtagtgggaatgctgggttgaatggtagttctatttttagttctttgagaaatacccatactattttccatagaaggagatattcttacctgtttccatctccgtcttcagaacttgagggcatctaatacacagtacgtgtggtgagctgaacagggtaagctagatttgctgcagtgtttaaagagagatacaatgagtaactcaactttataagtggtagagcactggaaagaagggaaatgggttgaaaatatttagtaacaaaattcaacaatgaagactggccatattgtaacagaataaagaagagggaaagaagaagcttgtcttttccatttcaagctagaatgcctgggtgtatggttgtatcatatttggagaataagagaaaagtcggtcatattgcagaagaaaatatattttcttggaatatactgagattgaggtgcctgtgaatcatccagagaagcctgtcctgcaagtagtgagtacatgagtcaaactcaagggagatgcccaaggctggaaatatatgcatcgagccatcagtgcacaggtggtgtggtaggtcacccctaagacagtccccagtggtccccattgactgatctccatgccctgtgttattccctttcctaactgtgggctggacttatttattcaattttaatgagtagaccacagaagcagctatgggaactcacttccaaggttatgttataaaagaagagtgacttccatcttaagatgtctttatctgtccttcttgaatcacttgccttggtgaatgccaacttccatggcatgaggtgtcactgtgcagagacccacccacctgccaaggaaacaaggcctgtaagaagcatgtgaataagcttggaggaagatacctccatacctacatttgagtcttcagataaaactatagttccagatgacatctttgctgcaacctcataagagatcttgaccagagacactcagctaagcctcattctgcttcccgacctacagaatctgtgagatagaaaatgtttgcgttattaaattgcaagttttacagtgatccgttacaaagtaatagaaaacttacatagttagttaaaagaatgagaatagttgagagttgagctcatttaagaaaaggtggtagagaaagggaagtcaaaccctgatgctcaacagtggctaaaggttagaaccaaaaaaaaaaaaaaaaaaaaaaaaatagaagccaatatgggggacagaaagaagaaatggaagaaacaataagaatgaaatgagaaaaagcaggggcaacttgacattataaaagtccaaggagtgcgtcttatggaaagagaaagaaaagggatcagattgctcatatcaaatgctgcagatggttcgagtaatacaaggtttgaaatgacctacaaattttgcagttaggaggtcttgggtgatctgactaaaagcagtttcaatagaatagggaggatagaaactagagagttggggcttgagaaatagaaagggaaagagatcatggactatgttttgagaagaatgaattgaggaaggaaggagaaagattggatggtgaagaaggtcatggcataaattgagggctttgcatggaaggttcttgaatgtgtttatgactatactagagccttaagaagtgtggttgtggggggtgtggcacagaacatttaggttaggttaaagatgaccaacagaagaaagccatgatacagaaagagtggagaagttggggtcaaggatacaagtggaatcagttgatctaacagggctttctgttggctaagactggagagaagatgtaagagaaggttatatgtgggtacaaatgtgtttcctggaaggatgatgagaaatagtgagattacattagaccttgattttctcataaaatcaggaaaggggtacgtatcaaatcagtgcttctcaaacttttccataagtaaatatcttaatgagagagaaaagtaagtgcatatccatagcaacctgaagtcatagtataataccaagaagtcagcagcaatattggaatttcacatcaattattaatctatcctatttgtatgatgatccttattatagccatttttaatataaaacattttgaattagtgataatatttaactttcctcccaaatgattagagcacactgcatgcttctgagagctgcattgtatttctcctgtggcatttgtatctccgtacactgccctgtacccctaagggtatgtatacagccatgcagagacccagctttacactatcagcacccactgacacatttgcacattcagatttgagattcatttagttctcattggtcaccttaggaagcacagtgcatcatctgaatgcatgaatgagaaaaggaaaattcacttttagttgaagagatgaggtgagaaagcagataggcaaagaagacaagacctggggatcactgtctaaactgggtagacctgtttagcataccagagatagggctgtgaccttgtggggtgtgacagatgagctaaccaactttgaggtcagagatggcttgtggtaatcagtcccagagtgtgggagcaggagagagagacatggaagtgtttagaggtgtactagtgtaagtgaccaggacacatgtgacttgcttgtttttccaaatgatgagcctggcaagcattcacaattcctgcaagatgagatttatccaagtaccatccaaccacctttgcttttggggtgcactctattgtgagcccaattatttttttctttgaggtcaagggttagcaaactcagcaaaacccaccggtcaaatgcagcctgccacttattagtttctactggagcataacggtgctcattaattgacatactgtctatggctgcttcttccctacaaggatagatctgagtaattgtgacaaagacttgatggcctgcaaaggctaacatagttactatccagttatttatagaaatcaattgcccaccccattctagtttgacctatctcagcaactaaaacttccagataatttctgcagagttttcaaatatccaacttaagacatcacacgtcttaagtccaacccaattccccaagcctactggaggaagggctatcttatagatcagagatttcccagccttcatctgagccccacttaagtttggtgttgtgaggctatggaaatgttctgtgctgaaatacaatttgcattctggacaactgttcctattaccgtccctaggagagaacttcccaggcccggctcagcctcagggtgttttcccaaattcaccagcctgcagatggaaaccgcctgtgcattgtctcctttcacccttcccagctgttcttctcccaaatttcccttttctttccttttagaatttccaaaagagcacactcagagttttagacaaactctgttctctctttcttctgtgatgctcagtagagatgataaacagtactagttagaacattaaaaaaaatgaattcttcatataaaagggtttattccatccatcccacctaggcgcacattcgccttcctctgcctcccctttgaaatccagagcttcctggagtcaactgaaacaagagctcatggcctcacccacagcacttggatcccatgtagaagtcgtaagttcttctctgactcaaggtttgggatcaagtcaactctaagtacacatatgtatggccattgctgactacatgtgattcatgagggttaatgcagtttgtaagacccagatgacttataatgctcagcatacttggaggcctccatccttactgctatctagagtatttctaggacacatgtcatcatttgaataggtcccagctaaaagctggctgtggtccttcacagcgatcagaggagaggctgatggaaagcacatacttttaactgttagcctaactgaaaagaatgtcagaaaggaaagatagaaatggaatatgcatatgactgtgttaagacacaccaaagctggaaattatttttgctttgatagtctcctaatttacatgacccaggctaaggctgctgcttattagcatgggtcattgagctgtctgtatctgcagggagatgaatattctcctttagagcaacttccaggctttcaggaattgtatacggggatagaaccacatggttttgcgatggccaagagggctggttggagtgcctcggatgtgattttggacccccaaggttaggggagttacctcctctctgaccttttcctagccgctgcttctgtttatcattttatcttgtcagagttcacgtgctaaccatgaaataaagagaccccccttccctttgcttcccacttgggccctgatgaattttggttgcctcttcagaggctccgaaatccctgctctaatttcaattagagcgctccctgtggccgtgcaggctggggctgcagaatcaattcctaatccccacattagcactgattcatctctttcctgagctctagcaccggcagctctcgggagagggagggagtgagaattgagcaatctttcagaagaataaatatggtttgtttgtatttgtatttgtttccacgctgcattctgattgcatcccatgccttgacaccacaattattattaatttccccgtctgctcttcaattcttgctgccacaaagacgagatgatggataatgttagatgtggtaattggatgagttgggggaagggagagaagaggggagacagatgtttcattatgagattttgcatctccatttgggcctccagcacagaggcctgaaccgcagccgccatcatgcaccgcagatgagggctcccgtttggggcaggtctggcctagttctgcatctctgctccacttcctcgccttgtacttctgcgtcttgggcagtcggatttcacatccatttctggtgaacgctggaaagccagtaagatgaaacctagaaagctggacctggtggcttggagggttgcacccccaccctgccctgctgccagaccacatctgtcctgtgccacctctcagcacgtgtgcttccacgtgcgagtgtggtagccccgggtgagtgcccactctcagagatgaggaggctgggctacacgaggaaggagctcaacagactgtcctgcgctgaagccgctgcctttgtcctcccaccttgccctgagtgaggggttggagcagctgtcacagctgcaccatcttcttctctgcatggcatccagcctctctgttcaataatctgtcatccccaccaataatttttctgcccccatggactcatccccagggggttcactgtccctgccccacacaggccagcctcctgtccaacatgatgcaggctggcaggagcagtcctggctcttgaatacacacctaagcatgcagcctggcccttccagggaggccaggtggagtatttgctaggatgagatgatagacctgcggaccaggaagaccttatgggtgctcatggaactctcattcatgagaaaaccagcagaggctgcctcacttccaatttcttcttctctgaacagttctcagtccatcagtgcagagcacatggaaggaagaggctacctcaggccagagacaccgaccctgtccttgaggcactcctccaggttgcaggagagaaggctgcaggctggagaaggcctcgaagtccagcctctctgtctagggctgatgctgcctgtggcggccccaaccaacaggccagtgatgttggtgacccggaagtcacgacaagcctgctgcattccagtggctttcgacttcagctggactgtaatagagtgggaggaatggtggtctaagtcattttggggagttttgcagggggcatctctaaagcccctgcttctgtttaggaggaagcttttgtccatccactgagaaccctctaggagacagcagcaatggcctacaataggcacattcaaagagcaggggcaaaatgtggtggtgaagaagaagaatttggaaaacagagtcctgtgtgctcccagggaaggggaagaagggagggtctctggtgcttctgagctataaattggctcagtcaggttaggtgcttacatttatttttcttctcatcagcacggacaccgtggctggtaatggagctgccgtgcagtaactcatgcatgagattagcaacacagaaggacagccggggactgctggctgtaggcgggcatgggtgagaggaactggagggtgaccaggtgtggctgctcactcaggtggactcccacaggggcatggaggtgggggcttacattccgaatttctaggcaaggaggggaccctggagatcattacagtccagcttcctcgttgtgcagataaggagcagaggtccagtttgaggaagggacttgcccaggggtgcacagcaggctggtggcagagtgtgggctaggcctgagtcctgtcgtcttgcctgcagagggattatgctgtagggaggagagtgcctgtgatggctgcacagccagatggtgattccagcaccggccagatctgtgctgcgttcatctctctcatcaaaccctctcttctaattcctccgtgctctctctgttcttgtggtaatttccaccagctggcccttcagagaagcgtgtgtgtgtccagaagcatggaggccgcaggtgtactagctgatcctgtcctccccatgcaggactggagaggccttggaagcccagctcatgtcccacctgtgcactgcctgtgcagaagcctgtccctacgaacaggctccactgtcaacccactctgcttgccagatgaaaactgggtgagtcaagaaaaggcagcttctacctactcactccacttgttcgttccaggcaatgtccccatgtttactcacgcacgcattggattaggagacctggaatctgagatgtcccagcaagctttagctaaggtcatggttacctccatgaaactgctgctgtaagtgccacagctggagttataacgatttctctcctttcctgcaggtccctgcaggtaggctgctttcttttgtctcttaagtcactgccacttactttgtcctgcaaaataacttcccaaagactacactcccatgtgggccagtcttcccaggtcccaccttccctccttgtatttgctaactcctttcttggtcctcagcttcattgctattcatccagtagatgaggaagaaagacaatgtttatgcatggggtgaggaagtgggggagtcataacccgaagtggctcgtggcttccacccaccatctattggccagaactcagtcaaagaagagctgctattacccttgacagttccttgcagctgtcacttctccctgagcccattccgcctgggacccttctcccttttttatttgatgaatccccactctgacagcttccaagtcaggtcttggtttgaccccagggaagcctccctgaagtccttgtcctgggctgcttggccaaccatgtgcacgtaaaccctggactgcccttggtgccttcacactcttatgcatgctcctcatccatttttctgattagaccaccggcttctcaaggtcaaggtctcagttacatcttttattttctttaattttagtttttaacacagcacttcgtataatagatcagtggttcttaatagagattataacttacaatcactagtaggccttctaaaatatctgtgctgggctctacctctaaataattaaattgaaatctgtgaatgtagagtctagattttttatagcccaaatattcattcagggttatgaatcgtagtagatgccacagaaatgtttgttgaataaataaacctttttttttctccagaacttaggagtgcaaaggagacagggcagggcaatgggactctttctggggtcctcaaactctcttggacaagttatgcccatttcacacagtctatagacatcaaaattgatattaaccatttaaaagaatctttcaaatttgtcctgggtgctttaaatggaacagaacaaaatttccttcttctagtttcagaattagaaaaaaaaaggtatacatgccaagaaagaaaaataactaacaaatattttatcataagcacttatggaccaccaactctatgcctatatccaagtgggaccgtgagcagcatatgacatatagaggcttagattttcgagcttagccaggaaaccaagcatatgcacaaaagagaactgtatagatgagtattttctctggatattttaaagacacattacttagtacagataattagaaaagaagacagcataccatcaggtgctaattatgcagtgcagaaaataatgcaaaaggagtgagaggagggagaaattcctctgggctcatgtcttagagaaggctttgtggaagagcgagactgggggtgcagctggaagggggtcccatgcaggaactgctgtgggcagagggaagccttcccaggccagaggactctcatgtgcagattcagaaatgggcatggtcatctggacattttgtaagagatgggtatggctggaacaggtgtttagaggaaggaacatgaagtccaggtgtttgtggatgatagaccaaatgacagggaggctctagcggcagaggtgagatctttgctggagccacgagaactagtgctggtgtgtgatctggagaccctggggtcccccagggcttggagagctgactctgacaagggcatgagtgaaggagagatgtgaggaggagcacacacagtggcctgcaaggagaccatttgggctaccagggcatgaaggcatcaggctctggcccatgatggcagtggagggaggggcatgaggctgtgagagcctggccacctccagtagaacagccggcaaagcctgagacaccctcccgctctccgatgaccctggctcctctgggctgccgcccccttccctgcaccctgagcatcctctcctcacctgatcagaggccatttggaccctggatttgcacctggggcacagcttcctcgaaaagaagtggggggagggattgatgctattttatcaccatcaaggacttctgaatgtgtggagttttctgagtttaacgggctgagaaatggaaaggcatttgttggcagtgcctggactcccaaactgctgtgctgccgagcgccccgtggcctcccggctgcaggccccactttctctctgagctttgctgtggcacagacacactctttgctcacccacagtccattggtggtctcaggcagggagttcacctttgaaggcatcctctttttaaagcttgggaaaagacatttcccgtttcccgagctcagcacctccacagatggctacttctttctagagtgttctgaattaaaacaggccaggaggaagccttctgaaccaactgacatgtgtgtgctcatttgtaggaagaagttaatgataacttttttgccatcttgtaaagctatgtgatgatatgggaaaatgtcctctgcatgacaggtgctttgtttggagagccactatcgacatagacgtgtattttagtccctatgaagacactgaggctgaagggcttcttggctttcccaagactccacaactagttatggttcttggtatgagcccagcttctctgagattcctgagagctcctgcacccttctcctgcagtgcagacaatacttagaatcaggccacacaggtgctggtactgcctttgggtgggatttttatcgctcagatgactgaggctgctactttatttaataaactttcagcaggtgtgcagggctgggggcaagggaatggccatcttcatggcttggcagtcctttgggactgtggaattgtcaatgtcctgggtgataaaagcatgcacgactctggtttctttttctctggggccaattctcccaaaaccgtatttccaatggctccagctcagcagagctgtctgtccaaaaagcagagatatttcagggccatggatgctttctgaatctctaagtcctcccttcttgcccacaatgtcatctcaggaccaatggttgaggacagggattcagatcatcagcccccaactatcataggcagaggagaatccctcaaatttatgacagcaggagctcctctcagagatgggaggttgggacataggagaagaagaaagaaatgtcttctgtagaaaactcaacctctgcaacttccccgtatgtgccttcaaagagaggagaactcttgtgatgataatgagtaacagtgagtagtctgaattttttcatttttaggaggcttggggaacagtaactacttggtaccaacaaccctattatgaattaggccacaagtattattccctgcatgaagaatagagactacttttctctagaggtgggaaaagaaagagactacaaagcgacaagtacaacggaaagactttcattaaaaaaaaataacaaagaaaacacaagcaaacaaaagaagagtttatccaggaattagcaagtccacaaggagccttctggaatacccaccttcctggtgtattggtatattgtatgttggtataaaatatgcaatctaagtgaaagggaactgtctaaagttcccaaacctcagcttccacgtccatatggaaagcaggagccatttgccatctctaatgtttgctcagcattggctgcaggtatctgcctggggaggacggtgtgataactccaacatccacatgtccctcccacaccagcaggctcggggaaggagggctgaagagcctttaggtgtggggttcccacagggatgagcctgcagtagtgggctgggaagtgcaagctgggctgaacctgtctcccgtgcaaccttccagcatcatttccatctgggaccttctcatcaaacatcgctcccagtctctaagcacgtttatttcctcaatgttttataatcagatagagctcagctcacctgtaaaaggattacagcatctccccttatctgcagttttattttccatagtttcagttacctgcagtacagtataataagatcttttgagagggagatcaaattcacctttattacagactatgttataatcattctattttattatgagttattgttgttaatctcttactatgcctaatttataaattaagctttatcataggtatgtatgtataagaaaaaacatattaacctatgtggggttctgtactatccactgtttcacacacccagtggaagctgtggaacacatcccccttgagtaaggggggactactgtattcccttttctctcttaaaaacaaaatatttcctttcctccctatccttgtctctgaaaggccacgtgtggcaatggcaggcgtcccccaacacacctttacccactttaagtggagagcagagtccctacacactgctgcttcctgcgctttacagagctaggagagctagggccatactcagggattttgtcagtcaaggtaagggaggcagagaggcagagagcttatatccatcccacaaagcacacgtttgccggtgctataaatttaaggaagttgtcttcacaggcagtgtgtttgcatggagtgatggggagaggggcgggagcagtggagaaaggggcttgacttagaaattaatgacagctgcattacatcctgatctgtggacatcctccacaccctgatttgatattacgctggggccacagagagaagaaaaatcacctgaatatataaagcctgtatttggcatagtgtaaataattttaaatgaaactgtcaggcttaagccctgaaatgtgcctccagcaaaagataaacacacagaggagaaaggggttctatagggaggggggaagacatcacaatctttaatatttttaatcagtctgtcatctccaaacaggacacattgttgcagatacccttgtagactatacatttgctgattttgtgtgcgtgctgttcaacgcaagcatgatagttccatttcagaggctcagcaagacttaaaatctgcttggcagcagctgggccagtaaaagcatcaggtgctgtcaatgggtgactcagtaatcgacctgaaatctgcaactgtaatgcaacagctgcagccagccccgtgggttcataaggcttggccacaggtttagatgcaggaggtgttacgagtagacggcccaagcggaggctcaccccagaggctgtgcagctctctgaaggctgcagccccacctccgcacgatgaggctgctgctggcattcccactgtcagaccactgagctcaagttctggcttcaagcgctaaaaccttcctgagggcctgaccacaaaggagtagaacgatgaatcagtaagttttatcattttctcaaaggaattgttacatagaagacaatgggtccactgaggtagggggagaggctgagaagaatggagggagggtctcgaaaagcttagggagaaaggtttagcagtggcgttcaaagtcaaatagagatttgctaaagtccaggctcaaatagaggtctgagcccagggctggacagaggaattgtattatacgaggggtctggatgtgatccaacaggtctaagttctgaagcaaagcagctcaaggctggtggacatgctgggagtggtggaggccttgcaaggaggactgtcagcaaggcagcgggcatacctcaacttggcacgtcacctctgttgaagtcgaataaatatagagatgaatgtcttaatttgaaacattttatctgggaaacaagaattgcgttttgaggccgacatacagtgtggatggtctttggtatgtctgatgaacaaagagaaagttggaagttttataaaaaggagaaatgttattcattgttctgaaagaaagttcattggcactagcaaagtcttgacccatttgtgcctaggttgcaaattttgtgtgtgtgaaaaataagaccttggcggtgaccttgagcagtaggatataaataactactagcttagcgttccaatagtggagcactaggcataagttgattaaggagctggcaagctctgactggtgagtgacaatggtaggtaaaactggtctcagagtttgtttcagtagcagcaggttgtttcagtcgctgttagataaaactggttttcaattacactaggcagttccagaaaccaggctagcagagaattatatttctgaagcaatgttatgtgtcctgagtgctttttcccttggcctcttgattctgttttggttgagtatgacaggaatgacccaatttgtataatcaacattcacaccttctctgcttcagaactgagctgggactgccctccctccttcgttctcatcaagccagctaaagtcgagtgccccagcatggctcccaaaacagacaggcccagaaagccagtgtggctctttgcctcagggaggggtgctgcagggtaagcagcttgcaaagagggggttcagctcagctctaagagaaatgggactgagaagggaaaggggagcccgaaaggaaaccttgatatcatgaataatgttaatttggagccaaagaacctccttgccgatagagaaaatcctgtctactcgtaagggcttgtgcatgcctacattttgagttggggctagagttgatgacactagcatgttcctttgaggtttacaattctattttttctcttatatggacggatctctgcttcagctaaattggattatttgctggacctaagcttcctgtgctttcctatctctatgattttcatgcttttctgactcttgaaatgtctcctcagttcacgcaacaccatgtgtgaggtcctatgctggatgacggaggtccagcatcatataagatgcttcagtgtgctcaaggggtgcaatgtttatttcagggaaatggacttgtaacatattacaaatcaataattcaatgaatatctatcaagcatactttctgtgccaggagctgtacttggtgctagggatatggtgttgaaccatgagagagttgctctcctccaggatccaagtgacaacagaaggcaaaactaactagcaaacatataacatgaagaaaaacaaagaagactaagtccaagagagtgtgtcctgtatctttagatagggtggatgggagtagcttctcagatgcagtgccatttaagcagagacatgaagtgagagcacacagatggccagaaaggaggccccctgcatgcagtagagaggtgagcacaagccgagaagccacaggaacccaaaagaggggtgggggaagggaggagagcagcaggtcagagagaggctggcagagagagactttggccagccacgaagaagcatttgtatcttcctctgaggaagatgggaagccactgggggttattccatttgccgaaaggaagatgattaagggaagaggaagtatgccagaaatgatactgcggcatggtaagtttacatacagtgcctgtgaggtagcaaaacggatacgttaagtaggtgtttgtgtgtgaaatccggagttcaggaagagatttggaccaaaaattttggaatcatatgtgcaatgcactaaatgtttttgtcctccccccccaaatttatgtgttaaaattttaactcataatttgatagtattacaaggtagtgtctgtgagcagtgattagtttatgaagatggagacctcatggatgggaccactgtctttataaaggtggcccccgagagctctctttttggccaatgagaaggcagtgatctgcaacccagaagagagccctcacagaagccagacatgctgacaccatcagctctgacttccagcctccagaactgtgagaaatgcatttctgttgttcataagccactcactccacagtattctgttatagaagcccaaatggactgagggtatgcaatgcatgcatttgagactggatcactaggggatgagtgtgagtagagagggaagaagtttgattactgagcctggagttactccaatactcagcagagaaggaagagcctggaggcaggaggatgaaaagaagagagtgggttcttggtttacaggtgccttatgcaggagagcaatcaacagtacaagtgctgctggcaggtggagtgagctgagaactaagaagagactgctgggtttggctatgccgagatcacctgtgacctgacaaaagccttcctgatgcagtgatggagacacacagatgtgcacatttggaggggaaagcccatagtcgaagcatttatagggcacagaggagagtggtcaagaacacctgcggagctccttccccagcctctgcctaccaaaatcccaccatcacaaaattcatctgttctcatttaccttccctcagcctctctccctacccaactggactgattttctttctccttctaacacccagcaggattttcatgacgtgtgttactgtctgtcacttaggataggggctctgggtgatgtgttactcacatttgtgtcttatctctagcacctagcacaaggccttcggcagaataaacactacagaaaacatttgctgaattaaattttgagagtagttaccaatctcaggccacccattcccagggctgtctaaactgggttgtcaaatgctggagcaatggtttgcaaacttagttcacatcaagtcacctggagggcttattcaaacagttttctgggttccactcaagagcttgtgtttccgtaggtttgtagtccaagcatttacatttctaacaaggtcctaattgatactgagacttctagttcaggagttgcacttggatacccactgccctagggcaaaaacatgatttcattcaatcatgtccattacttggcttccctggagaagctagctcttgtttctttgtacataaaggcatctggccagattgcacaggataatgtgaataccacctctccatgcagttaaaatgccttcatggatctgtgcataagcctcccacatgggggtgcagacatctacgccactctcagaaagtagatcagacagctgccattcaggacctactgcgtccaggggccacaggcctcttgctctcaccagcaaggtgctgaataaacaggtgcccattgtcctcacctgcttctctacagttgtatcacccaggttcagaaagggcttggtgtcttccaaaaatatttttaaactatcttatagatgtgttcattgcacatcactgaaagtctaaattctatgttcatctataggattgatgagaataagaagtaatacgataatacagtattatcagtatttattatgaatgttcagaatttcaacttacacattgccagcttttagaaagaaagactatagaaaaaaaagaattaataggatgattatgagtgcttagaaaggaaaaccgcattcactggaaacaagcattgattcactatgagtaagtcctattaacctaactcatttcctttttctacctagttacttgtgaagaaatttagtaaatttcatgttttaaatctaagcacggtcctgggtggtgggtgaatttgtacctagttgaatgacagtcctgatagtgttgagtagtgggtctgtgtcaacctggaggaaggccttagtcttcaactctgtcctgtttaacctatttatcagcataagatagagctactgaagacatgcagatcatactttcacctgattcaaggctggggtggattagttattagcatgacagaattggatttcaaaggatgttgacaagcttaggaagtgggccaggttttgtatttttttaaaaaaataaaacaattgtctcaaagcagtaaaagaaaataaggctccgtggcagaacttaaaaaaaatgcttaggaattttagttgccagaaagtatgatgtgtcgttagtgtgtgtaatttcccgaaaagttgagatatgggactgtattaacagaccaacagtgtccagaacaaactttatttccagcattataagcagtcagggattcatagacagcgtaatgccctgcatggcccagatgatgaatagactaggtcatgtcttctgatgaggaatagaaggaacagagggagcctagccttcagtctggagagaagaatgaagatttcaaatattttgaaatctctcacttggttctcatttattttgaatggccccaaaggccaaaagtaagatcaataaatgaagtaataggattacagattttggcttagtatacaagtaaaatttttagtattcggaattatctatagatgacataatgacaacaataatgatgatgatgaagaaagcaaaacctgtagcaactcatgcagtttcataaagcacttcttaatccaaatactatgctcgattcatcacaccaggagagtgctttctttcttttttcttttttttccttctgagatggagtctcgctctgtcgcccagactagagtgcagtggcgcgatctcagctcactgcaacctctgcctcccgggttcaagcgattctcctgcctcaacctcctgagtagctgggattacaggcacccaccaccacgcctggctaattctttgtatttttaatagagacggggtttcaccatgttggccaggctggtctcaaactcctgacctcaaatgatccgcccgcttgggcctcccaaagtgctggaattacaggcgtgaaccaccgcgccctgccaagagagtgcttttgatgtcactggggaaattcagcccttggctgagcaacagtgttgcagaggatattcaagtattgatagaaagttgaacaaggtgaccttatattatgaaaatactgtgattctgagctttcttaagcttgtgcacagtcagaacaatcagtacaaaatatttgtattcttcaaatagtttagatcatttcctctggatgttttcaagtataagggaaattgtgaagatgagggtatcggttgcaaaagctaccttgctctacatctgagagagggattgcctgtgaaccagaatctacgggtatgcctgtgggcaatcactgttactttatagccaatcttctgacaataagacttgggttggccagtgcattataatcccaactcccttattgttgcaaagtagaatgtctactactcagcagattgggtgccatagagatacagaaatctcagaaaagcatctcatgaattcttgtaacttccatgtctgtatagtgactgatacctaccgatatttaacaattttgagttggtgaaaagaaaattaaaagacagctaaagaaaagtatctgtggaaatgacattaagagatgggagagacctatgaacatgcagaagctaaagaagttgaactcagagaaaagagattagaagggtgcataccaggggtagcggggtggaggaaatggggagatgatgggcaaaggatacaaacttgtagctgtaagaggaataagttatgaagacaaatgcagagaacagtaactatggttaataataatgcattgtatatttgacatttttgaggagagcagatcttaagtatttttaccacaaaaaaagataactctgaggcaatgggtatattatctaccttgattatgataataatttcacaatgtgtatgcaaaccaaaatgtcacattgtacactttgaatatatataatttttctttgtcaattatacctcaataaagctgaaaaaagagagatgtgggagatacaaagcagggacattcaaattaaacatgcctttatctgaaatcccagcaagaccaagagaaacaaaaacataggtttatgcacacacaaaactgcatgcaaatttttgcaacagctttattcgtacttttcaaaaactggaaacaacccaaatgtctctcaactagtgagtgggtaaaaaaaaactgaagaacaccacacagcaaaatactactcagcaataaagaagaaagagttgctgatattgttacatgttttgtggctgagccttaaatgcagatccaagaggctgaatactgtattattccattcacagaacattctggaaaaggcaaaactattgtgacagaaaacagatcgggtctggggttgtgggatgaattgactataaatgggcacaagagaattttttggatgatggaaatgtcttatatcttgattatggaggtggctacataactatatgtttgttcaaacacataaaactatgcactcaaaatggtgacttttactggatgtcaatcatacatccgttttaaaaaacaaacagtgacccaacatttaaaaatacaaaaatgacaaaatcaagaggctagtgagggctggggtcagccttataagaaggaaggatgcaaatggcacgttgaagttagtgaattcggttcagcagagaagaaaggttgaagattgtcagctaaatgctgcttttctttgtcctgagttccctcttccttggttgagagtggccactgtttcagttgaggggatctgattctgtttcagtggtttcctttcatcctgcatggatcctggcaaactccaacatgtcctgccctcttcctagcattgtacagcaacttccaggaagggcctggcagcaaaactgccttctccctagagcgggcccacctagggtggtccaccaccttctccctagagcaggcccacctagggtggtccaccaccttctcactagagtaggcccacctagggtggtccaccatggcttgtgcctcccagctgaaaggtgacaaacaaaaggctaacctggaactaggaagggtcacttatctactcatgaaaaaaaaaaaaagaagatataggtaagaataggttatttggaagattcaaatacaacctctccacatcttctttgcatgcagtgcagcaattgccggccctttagagagctgccctctggcccaggtctgccctgaggtcagtgactttacctcttggaccttcagctttctcttctggaaaaagattataaaaaggttacaggagcaacattccatcctattgccctcctgtcccatggtggaaagcagccggagattgtaggatctgagcacaagccttgctctccatccacagctcctggtgctgccttaaacgacaacagcaggtgcacatggcaggatcctggaagcaggggcacgtgcatcaccaggaggtcctagaccacagcagagaggcatgggtgagggtagcacccagctctgccccccagtgcgtgacctgggcacagctgagccaaacgcttgactgccattttcacagctgagaggtgcagcttgtcatctgtaccttgctgtgtggccgctggggccccaggcttggggattagcatatcagccaggcacatggtgaatatttagtcaatgacagctgctagtattattatttaatgtatttgtattaaatatcctattacatacttattaatacatttatcaaaaataaatctattgaatttattatgcattattattactgttatcgtgaactagctttacattgtcctacctttataaacctggcccctgcaaatactctgcttcctgacgcttcttcattgctgaaatagtccatgtggaatccatgctggggcatcggcgcctctcagactcagcccgaagccgcagtgccaggctgcatgctaatcaggcggtggctccaggagaacgggcccaggaaggagagaggatggggcctggaggcggcagcctgccctggcagcttctggctcccagagattggtttatcaccaggtttctgatgaatgtgtgagaaacgggactggcgataaagcagcacgagccataattaaagtaacagctcttgtttcttaaaccctgtttatgtggtgcttggctttctaggcagtttccccgtctcccacttgaggaccgcgagtttcctctctctggagattgtggatgaggggctgctgagggaggagggtgcagaggggccagcaggaagagcggtggacgtggctgcaggaagctggccccttggttcttcatgaaagtgtcaggcaaagcaagtccctggagaccaagcaccatatggaaactttctgggaatgcggcagggagttgcaaacacaccatggagccctggaactttagaagaccggagaatgatctgtcaggacacctggccccaccctcactacacccgcagcaacgcagggaaagctggggggggggcagcaacaagggaaagggggccccgtcatacattcatgactgaaccgctctctggcagccgtctctaacctgggtggtacattcacaggttataaattaacggaggctcctcaacagatttgcctccctaacaggattcccaccctctctgtttccttctctcttcctggctccctcctcttccttttcactctccttttccttactgccccctccccaactcccaatttggcaaatattctacatactcaggcagtctgacacctcgaacaagctcacaaatcagagatgtcttccgccccagtcctgggaaccagcagtgccccgaggggccaggacgcccttctgccggctgagaaccacattctgtggaattctggctgatttccatctgtcagtgtccaagcgggtctgcgagggatctaggagagccacaagcaatgcttagaaagttggtcggatcctccaggtacttttcctaaaatccccaaacctctgaatgtgccggtctgggttgatagctctgctggacaagaccccctgttttcattttgactccatgtttctagaactgtgatttaggagtggaggccattaaagcctttggaaaaatcacacatgtaaacacacacgttttacacgtatacacatgtatactgcactgagtttagctgtttcccaattctccccaatggtggataaattccaagaatggatgaccccagaatgatttatatttggctttgctgtatgttaggcaattaatgcacagtggcatgaccctcccatttgggctttgctggtgacaaatgagtttgcatttcttgaatactaaccagctgggtggcgaggtggagctgcttagggataagctttgcacagatgagccgccccatgggtgacctgcgggtgcctccgtcctctaggatggttggccccacacacgtaccatagcccattgcttctctgcagcccagactggaaaagggagctgtaaactctgaatcacactacaatctgagaaaaatccaggtttctttttttttaaactagaagtactagactggtgaaggcaggaggctccatggcccactgggagaaggtcattcctatgactgcccaggttgccagcttactatgtcttctcttccaaccattaaagttcttgtcatacctggggtctttcaccccaggccctgaggcctaagcccctgggatctgtgtactcctctgaggtatcctgcgacctgtgattttacagagcagagcacaaacttggattgaaagtcaataaagtattgaattccacagcgaacagtcttttcttttgtcagaattccaaattgggccattgttagcacagacagacaggactagatactcccctgaatgcaccagagccattcccaaagctcggttctgcagggccatgtggcaggaattatacctagcttcatagaaaaggtctgtggttgtcccttggctgtgccctggagccgtgagacccctctctgtcctccaaagccacagcagggtaacctgatacttgctaatgaccaccagatggctgatgaccacaagggggcatggccctttgagcgccccttcagggtagaagctatcactctgcaggagtgtcaggcaaagcaggatgtgtgtctatgaggaacctacaagcttttgcccaaagccatcagccttcagcagggagaagagcagcatgtgagcaggtgcgtgatctattctggatcctctcagagcctgcccgaccctgacagccaaggattgtgcccgtcgaaggagcccacaagataaatcaaggggcagagagaagaaaacagcaaagaggagtgggaagacggagaaggagatgttaaccgagagatgagcggaggaattcaagctacaaatgcagcccagatttattgacttcttcttaagggtcaggcctcgtgcaaagtgcattttatttaatccttaccacaatcttattacaacaggtgctattattatctccatcttagagctaaggaaacttggactgtaagcatttaagtaacctgatctaagatgcacaaacttgcataaggcttaagcagttgtggaggtttgggaaaagtgacaactaaggtcagctcttggaactaacccctccctggggttgtgcaggctgtgtgctagcccttcctcagtttctctttgaaatgagaatcattctgctaatctctctccctagcatgttatgccgcacaagttatatgtattaatttgcggcatcactagcctctcagtaattatctccatgaattccctcctttccattgaaattaggtagctgggtatatcatggttccaaatcactacagttgttgatagagcaaatagaatcaagtatataactactatacttggaaaggagacagcttttttgaaatcaaaatcacaatttttttctcttcttttaatttatttttattgtgttggaaatttgcagacttattcctcactcggtcacactttcacaactgcaaggacaaggggaatgaaattactggcctgctttccagctcactgcacactcactgacacacacgtgtgcacacatgtgcatacacgtacacacacgcacatgcaaacacaccatacaggctcccaatccaatccttagttttctggcgtacagggactctgaagaattgcttcagtagtttgagaatgatgaatgacaatgtttttaaaatatatatttactgttggtaaaggaaagctaaggaagggagagagtagacgagaaaagaagagaatgtaagaggaactaaagacaaaaaggtggggacagatgggccaagaggggtaagaaggagagggatcccaggaggaaatgaattgtaactcagagaagcccttgctcctgacaatcatgcccttgcctgtctgcatttccacgggagatgagtaaatttctctcattcccataactcatcagtagtggtcaggagggagcccacctcccaccaggagggctctggacttcatcagcccagttaccctgcctccagacattggttttacacaaactaaaaaattcaactgcacttcagaactctattatctggccaagtggagagctggccatgatgaaagctaccccagacattctggtagtgattcttcaaggtagaaacctgctctggctatgtatctgcttatgttcacagccctgagatacctgagtgttggactaaaccagtgttactcaaactgcaggctgcaatccatgagaggttattaaataatttagtggcctccacttatgatttttaaaaaaataaaatagaattactgaaatgctcaacatatagaaaggatattttatgaacagtttattttggtggagtgtgtgctgtgtgggtcacagtctagacaggctaaaagccacaggattgaatgacctgggaagtttccagagagtctgtgacctctgagtgagctgttcccccagccacttaaatcttgaaaatatgggccaggatgtcttctgataacaagctccctcatgtttcctctgtctatgggattctgtatttaagaagattctaacacatcgtgggcatccgaaacgttccaaaacttcttgagtcacctctttggacagctcccgaagagtgcagtgggggaaagggatgacgtagggtcagtgtgaactgatctcacaggaagggcatttagtacggtggcttccacactgcagagcccccttggctggcaggtgcacagcctgcccactcgcactttgcctgccccccttcctgtctgtctgctccagcccatctgattgactggctggctcaggccacctaatgagaggcaacaccccatatgacaaagcccatgctgtgtaatgggttgattgacatcctcaggacgtgattccgcatgcagcctcacttgcagataatgtgaatggttgaggaattaaaatgttgctcggtgcttaatgaatgcagcatgagcctcatgttagcacatgccagctgcatctctgagaaccaggaagcagcaacaatttctaaattatttatcaattcccttacctccaccccaaaagaaagtcagcttatgcatttatttatttcatgggccgatatgcagagtaattgctttggtttttttgtgagttttttttctatagattttatttttctgatgctacagtgaaaaaagagagaaaatatcatgtcaatgtcatttgaatcataatagctacaaattcactctcctgaataaatagagaagcttatttatcaaacacagacaagatgtctgtcgagttgttaacagaggaagagagatttgagtgggcaggagcaattgcaaaagtttgcatatcttcaaaactccctagggaggtgcaagcagctttttccccagctaggaactttctgttttgacagctgattggccagcaaaattggctgttccaccttcacagggtgaaaaggggcaggtggtttgggcatcctagctgagcctggacctggcaggtacgagagtgcttgtccccatgcagattcttgtccatttaaggcagaacaattggatgaaataccaaggcaataagcagatggaaagcgttggttgttcttacccatggcctgtggctctagcttttttattctgctttattttttcatcttatcctggcagagctggctgctgctctctgttgcaaatccaagctccgtttcatcctttccctgggtttccccacccacaaccagcgcctctgcatctcccctccccacccactgccactgtgaggccacctctgctaacgtgtgtgggctctgtgaatgcttctgtaagaagcagcacaatgtaactacaatggctactatctttggagtagggcatcttctaagggttttacatatattatctcacttaattctcaggatacatatattatctcattttattcttatatcttcctcagctatgaggaagataaactgtttttatgacacttgggtataaatgagaaaaccacattccaggaaggctgatgacttgcccaaggtcattcccaggatttgagctcaaagtcttgtccactacattatactgccatcacagatagacagataactgactgcagatcaggagacctggaggccatccctgacagctgagttgccttgggcgctgcctatacctctctgggagtcagttgctaggcagctgataggctcagtgtcataatgatagggtgggtttaggacaagattgcctggggctaaacccatgtactaccactgagctatcttgggtaggttacttgagcttagttttctcatctataaagtagaaaaatgatcatagtacctccctcactggaatgattttgatgattaaataagttcctacatgtagaataatgagagccaagcttggagcatcgtaagcagtccatgttcattatcactatatagattttgtctgtgtgtccatctttatagcatgaggggattcaatgcaatgatattctaaagtctaatttggtttggaaatcctatgaatctggtctgcatttacatttccttagagctctgtagctctttatggtattattccaatgagaacaaaattagaggtgaaagctggagtgactgagccatggaatagcttgcacctgtgtgtctcatctacatggacactgcccgtcctcttctgtgactcatttcatatgatagtatgaccctcacgttatctgccatgggcaggacatggttactttctctgttttaaagacctgttctgctattagcccggggttagaaagttagtgggaaagtaggactctaatccatatgtaccgcttccaagagagttctcagttgtctgaaaggcaaagggatttgagccttctgagttcaactcccagcaaggaggtgccctagaaaagaagcttttgtctaactgtattagccatttttcactccaaaataaaagactgggcaaagcattctggctgtatttcaccagctcatttttctctaaacaccaacatttaccagctttcctttttctgatgagagagtaattaatcttgtctcctctagaccctcacactggcacacgttgctactgtcttgaaggcagatggttctctgggagaggaaagtgagatagtccagagcagcaggaaggcttgaaagttcaaatcctggccaatggggaccagcacaagttgccccaaaggctccccgagttacttcgaggctctcctctgggagccagctttgcacctggacatgctctcttggctcacaggcacatgagcaggtcagaccgtgaaagcagccctggtcttcatttgcatgcagtgggactatcaaaggtcctgaggggaagggagaggtgagagactcctgaacttaaaagggaaagcagccagcttctgggagcttttgtcaagccagaggcagagaagtgatgcctatgaacacttgcatttccacgctccaagcctttattatctagaccatgtaatccatttctgagctacactgtgctcgccgagtagaaatttcatctttctcaggagatcataagctcaaacttgacaggaaaccttcctgccatacatttttacagcctctgcagcctaacatcaagctgggaacatattagatgctcagtgaattcctgaacaatcaaatgcgattgaccaaactgaagctcacagacatgttattcatacatgagtattgtcagctcttactaactcagactggggagggcagcctcaacccagataactccacaagaatgtctaatccccaagataattctatctgtgatttctctaaacacaatgcacagttctgtttacctatttgccttcccaaggaagttttccttggttaatccaatcgctcattcaaccagtttttacggagtgctctctgtcaggcactgtcctaggagattcaagggtgatgaaggcagccctcatctctgcccacttgggatctatcacgtatggggaaaagacagataggacaccatcatcacatgagttattttgttgtaatagttacatgtgctactgagggatggtgagtgttttaagagtgtgtaacggaaagcccacttagagctgcctgagaggcagggtggccgtgagggaattagtcttatatttatattaaaacttagggaatgagtgtgagaattccaggggcattggaggttgaggtaacaaggttaagatgagttctcatttctgattatgagaatatctgcacagaagcatgccggtaaattcactctgtccaaaaggcaaatgcttactccagggtctccagcatagcctgccttgttcatgaatgagagggtggaagagctgctcctggaggttctgtctggggactggggttgtagggatttactccgatcaccagctgcttgtctttccaccctgagtgttctgtggagtcagtctggaaatgagctcttcttgccaatgactcaaagtaggaaaaataaaaatttgcttatgggagagattccagtgggagcatggatatgctatctggtgcataatggctgtgaattccaaccagcctcctgaaaccaagacgtttcaattaacaggaggcacttcaaacctgaacatctctctttcctggctttccagtcagaatgctgttgtataaataacaataagctggccccctcagaggctgtaattgagtctcttctttctgctggcatcagcgggattcccttgagtgatttactgtgtggctatttaattgggtgacacatgaggaagtcagccctgctttgtttaattacactgggtatcccccctgcatggtgtcagcccccactctctggaagggctctccggtaccactcttgcccaggaaatgattgcaaaggtgtttgggaagaccagggacagagagaaatggctagatgtttgaaaaaggaagggaatgtggatagaaaagaagactgatcccatgaacagaatagttacctggtttacagatttaacttgttctgaacctaaataacattgagtgtctgtgtgagtatgtgtgtgaatgtgtgtgtgtgagtgtgtatgtgtgttggatgtggctgttaaaggaggggaaagagcgttagaaagtgcacataatcacaaaatacaagttagcaaatgttaggtgccttaagaaagacacagttatttttccaaacaatttcagcactactttcttcctgggtaaaggcaatgaggagaagggggtaagtgtaaaaaagctgatgggtgtttgacaatgaataaatgtaattttataccttataatagccctctgaggtagtatttagcatacccacttgatagataaagaaactgaggctgaaagacacagctagtaagaggtagacattcaatccagcctcatgcctgtctgactccgaagcccacattacttccactaccccccagagattgagtcatcccttgatctttcttcaagctgcttgtataccacattgactaattactccgtgaaatattaattgattttccacggtgtacatagaataggttttggtctcgtaagaatatgaggatcaataataatactaataacaatgaaaataatagccaatatttccagggtggttactattttctaggctttgttcagaatattttataaatattgactcatttaataagatacttgcacttagataactggacttcaaacacatcccaccaggcccttgaacagtgagcctctcacccctcattatttggggcttggtagcaggcaggagcagagaggaggctgtaatccactatggagcccaaggcaggcaggggtaccttgggctgtggcatggcagctccatgtccaaacacaaatctcccatgctttgacaactgctccaagagggtttcctaagggagtccatgagcagaatgtatggatcctgatggggagggagagcctgtgaatcaataggtgaaggcgtattcatcagacacaaactcatgcatttttttaagctcattcataggggctcaattttcctctgctcctggcaataccacacgtaaagatagcttttctcctctcagcaaagaggcagggataagcaggctttcaataatattagaagaactagagagtggacattacttagaatttcctagctgcaaggtttttgagaagcttggaagcataactgagctaggagagggaaaatggaagccaatgaggcgtggccatcccaggtataacagctccatggtggagagggaggggctcactctctctcctgttccctctgtttatttcaaacagaaccactctcccagccaaatcacatggacagctccagccttccttctctcagaggatgaggtagccctctccctgctaagagctgattctgccccatctattccttccatctctggcgtcttcaatctctccttccttttgactaccttttcttgatctacttttctttttcaaactattgagttttcccttaaaattaagaataaaaataaaccctgaacatgtcttcttctgacaatggtcttatctttctccttccattctcatccaactttctttaaaaagtagttcacacccccactgtcttcacctcattctctcattttcactcctcagtcaactgcaatctggcccctagtcttactttttcattgaaattactcttattcaagtcagaaataatgacctcctgtccagcaaaaactacaaaacgctttcagcatgctctgatctttctctgaacatatccacatctctcacctttgtaacagttgacacagttaacccacctcctccatctggaaactcttcttcctcagctcctgtggcccattcccctttcccagttttcctcttacagggttggtttctttgggctctaactgtagctcacctcttgctctacatcttctccttggcaatttcatttacactcatgtcttaaagtctcatttacatactagtaattccccaatcttgatctccagtccatgagttccacccctacatgcccacctgtctgccaaacagagtcacctggatggttcccaggtaccatatgcctcaggctctttatatccagcatctcattcatcatctatagctcctgctctgctttcttctgaattctctttcttgatttgtagcatctccatctgctcagctgcctagccaggaacctggacttttcaacattcatctcttcccgtgctccattctccagtcttgaaatttttatttcaaatataggcccatcttatcattcctgatatcactctcttagttatagggtatcattatatccttcttggactatcgcaatagcccctattctccttacgccacccaaacctatcctccatactgctcccaaagcaatgtttccaaaatgtggagcgggccatattagtacccatatttgaccagacaaagtccaagctgctttatgtcacaacgaaaggcttaatatatgtgatgctgggctttctctctagcctcattgcctgcccttgctctttaaggaataacaatgtcatgccacttgtaattaccccaaacaatcaaggccaaatgttttctagctgtctgctcagagtgttccttctgcctgaaacatctctcttcctctttcctccaccatctcattgactacatcatctctgtagtctgttctcccagttggctgggcccggttggttatagatatgaggaagtaacttttgcaaaccaagcccaaccttttaagcagacagagtagatatctgcccacatggtttgaatggtggggcttgaggaagctgataactaattatcttttattatttaaaattatttcattatagggttattcctctgattttctttgcatttttgttcttggagaggtttctatatatttttctgagaagagtttaatcccctaaacctttgtgagctcccacacatgagaagggggccatgacaggtacagagggtgtacctgtccctctcggcaaaatgggacatgaaataaaaaattgccctgaggaggaggaggaggaggattgaaatgcagggagctgataaactgctacatatcacagtcaacatcacacatcttgcttgggtaaatcatgtgggatgatctagtaagttaggattcaagttaatatttagatcacttaaaatgaggaaatataaatatttttcctgaataatgtagaattatcacccacgaagccctacattcattttcttaaaggaaaaaactgccaaagatagattgtttgtttaatgggattttatgagatgagccaaagtataactgggctttagaaatgaaagacaaagataatgaactcaataccttacaggtcatgggagacacagtgaggaaaaaatgatgttactgtgaaaagattgggaagagaaaaaaagaggcaggaagataaagacacattcaaaatatgtattgaccacctattatgcagacactgagatatgggcataatccttgccttgggtatttacctggaacttggcaggtactcaggataaatatttgtggaaggaaggaaggagtgaaggaaggaaaaaaggaagaaaggaaggaggcagggagggaagaaatgaggaaaggagggaggaaagcctgtgtattcttcttagtctgtgcaaggtgggtgaagttaactaaatctatacttactctttagcttttcacccattttatgttcttgcctagggtatgttcttctagaaaattcataatccattctccactaaggttagggagcactcttccatgctatctacagactacatatcaactcaccgtgttaaatgtgatgagttatttaatagacaagtgagtggcagggttggggtctaaaaccaggtagcagcaggaccccagctaatcatgtacctgggccctgtggccatgcttaggattggagaaggtctccctgctcgtctagactgctagctaggccagccatctgttacttgtctggaagggggaagagaggtggcatggtgctcagggctgtggcagatccagtcttggtttcctaatcagtctattatttacaggctccaaagtaatgggaggaggggcaggcttataacctgtgatgagaggggtttatgtgtgttctgggccagttttgtaagacagctgcccctataaaggatttatcaagacaataaaagaaaaaggagagagcctaaagacactctagtgaaaatagcctttttatggtatgagagtttaagagggaacactttgaaaagaagccacacttcccctgcccaccccacccaccccttctcctactcagcccacataggcggaaaagctctctaatctttatctcaggggctaaatactataagcatttaaagtttatttttgtcttatgatgacgtccagccttcaccaccataccccggataagttttcctttaattaggaatgtctttcctctttgggctattcttgtggatgaaagtgaggaacttagggggcacttgctatgcataccccgcaccccgtgttttaacagagtgataatagattcagctcgataggcatgtcttaggcctcagtgatggtttgacccagactctgggagggtagcacagcttggaggagaaagggtaatgcttggaggagaaaggcgaatgcagaaccccagatgatccaagatgatccatgtaagaatcacatctatttgtatcagtgtgatcacaagcagcaattataagaatcctagtcataacaaatctccatctcagagatgaaaaaaaacagatttatgaagtcagaatacagcggaagcagtgaagaaacccatccagattccacagctatcaaggaacagtgcagggaccctaactcacgtctcccaactccaagtcttgtccattctcttctaccccacttctgcatttgggttgatgttgccattctcggtggccagagcatctaatatgaaccaggtcctcttctagtgaatgtggctgaccactgagtgggagggagaggaggagagagtacagaggagagggttcattgtgattccaggacacagaggatgcgccctctgcttcctatatcagcttgaatgttggtgtccagtaaatcatatccaccctgttctccttactctcttctacctccctgaataatctcttacaacctctttgacttcataaaaccatttactgatgagtctcaaaatactatttcccagagagatatattttctagatatctattcccagatgtatcaaaactccctaaaatgcatgtgataaaactgcatgtatcagtctactccctgctctccatcctgttccttgtccatcagaagtccaactttatagcctgtgggtcatactagatttcttccctatccttacctacaacgtttagcaggccaccaggttctgacaattgctgttccttaggacagtggaacctgctctctaccttccttccattcccttgggttacacacagtgactttctggcccacgctgcactagagacccaaagctgacctttctgcttccacttatttcttctctcactgctttcataataattcttcttaaagaaacaaattcaatcagatcactcccctttgtaaaataatctttcagggcaagtattttgacttttcatggcccggtcagtatctgccattcacatttcatttcttgtggcacctaacttttcagccttacagtttccttcatggaaacttcctttatcttgtttttgaactcaaaattttgcatatcgtgctttcactgccttgattaatttgcctttctctttgttacgtggctacttcaaatttgggaattaccccctacagggcacacatcaggaattaactcttctagagagcatttatggacaccttgcctaagaggtaggtagcataccagggtaccatgcgcatatttctgtcatagtggttattacattgtagtgtaattctacattcagccagctttatctgcctcatccacataactaggagactcttgttttctacatcttgtatgtctagtatctagagaaatgcctgagggtaggagtgtttagcaacaccattgctaaatgaatgaaggcaagcttcatatggactagtagcctctgtggttatccaagcacattcataatcagagactctgaccacggtggttataattgttaaaagtgatgttcccattgaatttcttcaccacacagctctataggaagagactcaaaactctgatgttcctacccagaaatggttacatttcgaagatgtctagttttatccaatgaagttgttttaaaattgaaactaggcatctcagctctgtgaaagcagcaaagtgcttcttcgcatagcccagcacctacatttcaatccagtctggttctttacttggtcctgccctatgcctgtgttgggtgttgggaataaaatgtgggttccacgcagctccaggacttgaggagcttggtgaacactcactcgcccagggcagcactgattcctagtgccccgcacgccaccttgcaaagccaggggcttaataaagccttgtttatgagcattctggccatgatgactcaattatccaattattcataattcacttaaataaccactaaacttgttttgagtacctgctatatgccttttgtatagagataaattagagacattctctctgcccttgtgaagcattttagggcttggagacagagaaaaatgtacaacaggcaattataatacaatggaaaatgtgctaatagaagtctccatacagggcaggttttccagactgaaggaagagagaagaatattccagacagacagaaccacatgtataaaatttgagaagggtgggagagagcatgagaggttcgaagaactgttagagagcagctgggattcatcacaacatgagagcagatgggttatttggggagcccggaagaaggaatggtgagaaaggagattgcagaggcaaactaagggtcgcctaaggtggaaggaagagaaaaaggaggctgcagccagactaaaatttggaactcctcaccttgggccctagagagcaccatatggctctggaacagccagaaaagtgggctctgcaattttccaggaaaagaatggttctggaaatctgtggaccaaatagagaactgttgaattaatgtaagaaagggacgatgaggaaatgatctggggctgtggcagcagggatggagggaagggagtgattctaaggtcattgggaggtaaaggtgcaggtgatatgcaattgtgtgtgagaacgtcagcacagaaagcaagtcaggcactcagctgcatgctgaattaaagcaggtgtgaaagcttgagaagaaatattaacattttgataaatttttttttaaaaaaatcaaaatcaatgttaaaaaagtattaacaaaatatcaaaatttcaaatagaggcaggatcagtattactgatttttcctttggcctgtggctctgctatggcttgacctggtactctactgatcctagctttatttaaacttttgatctgtcattcatcataggttttttgcattgatttcattttgaaaaaaatactgcattcaattattgtttatcttgattactttttttttttttttttgcactttcttaaatttcgtactgagtcaagtgcttcaacctactcctggccttggaacagagtagtagcaagagagagggtgatttatcaggaatgattgcaagggtaatgtcaagcaggatgcattgatgtaccagcacaatgccttatgccactgaaggacaactctgtctgttccttaaagtgacttttcttggatagcaggatactacctttcctctacccaccaaaagctgtcgcttgatactaggcattttcaccaaatgaagacatcatacagaccccccacctccaccttgacttcctccctctgagcaaactgagtttgggtctcccatgacgaaactcacgtgcagcttgtgtacaacttccctaaatgccacaaatgcttcagaacaagtgtggaaattggtttctaagctccagcagtttctaaaataggggtggtttaaaataaagcagtatgataaaagggattcctatagagcagattgtgggaaatagcagtgagcctccaaaacagaaaacctggggaaaaagtcagaaagggcatctagccattcctgagtaagggggcgtgggaggtaaccgtggtcttccaggaagagtggccagctctgtctccattaacttcagtctgggtggtgggggtgggggaaactcatttctttccatcccctgaagcttcttttcactttatatcctggcttgatgcagatgtaatatattctgtcggtgaaaaatttgggctgaaaaatattgtggcctttgaaaattgaggagggaattgggtgggggttttccaaattaatggcaatgtgcagatgaatccactgggcacagtggggtagaagtagggagggtggtagaagtgtatttctagaccgatgactgcatataaagcaatgcttgagtgaagaaaacagtagagtaggtagaaatggacatcgatatagagaatttgatactgatggattgtgaatggaaatttgagcttcaatttccttagatgagtgggagagaaggttgtcttgtaagaatatgggcttgaggtgaatatttagcagaatattgaaggtcaagagaagtagagattgaattagccaaagatatcgaacgcacttggaaaagtcctagaagatcccctgaacgtggagacggtgaaagtgtgtggctcccatctccacaattacatgatttgtgtctctggctgtgctcagctttctgggcaaaggcttggagaaggtgagtcataggactgaccccagtttgggaagacgcaaggcctgtgaagtgtggagggtactggatggtggagaagaagggggagaacttcagatgtggttaatgtcagggcagtgtctgatgtggccagcaatggcaaacatgagccgtgctgctaagcctcaagcttccaagtattatgcaaccttttcataacactagaaagagctgagggagctgtgtggttgcagggccctgttgcagggaagcaccctaggtcagcataggcagccacacagccagtgctttctagcaactagggcctctttggtcctcttggcctccccttaccatcactatgagctctgcattgttaacagtacaatctctgcttttgaaatgtagccacacagccccaccttaggttaaaaaaaattaaaaaataaaaaatccttatttacttctctgggacacatttaggaacaggcctgttatagaagacattgcctttgtagcatgttaagttcccactagtcctcctactcataatgaaaatgctcatatatgggaaccaatgatgagggcataatcctcaggttgataattaagatagatgccgctaacatttcttaaaccatgctgcatacagctgtcagggcaggagggaatttgagaaggcggtatataattaacctagttggaattgggccaagggacccaaggttaatggccctgggaatgggagcattaatgaccattaatggtcaagccctttttcatgtcgtactcattagagctaccttttatattctgtaagatcatggcctttggcctcaggaccaagggtaatggagagttgccactcccccagacaatgtgttctgcattctgacagcttctgtccagctcttgattccccccacccatcacaatcttcaggtgtagtgtatagcagatctcaacacactccagccatctgctgagccctgctgatgagagctgagacatatacatcatgcatattcatgggcaaaaattgtttcaggtttttattcaacagatcgacaaaagcgtgacatcctcttgcttttacctgtttggctctggtgttcctttctctatacagtccctgggtgagctggaatagaatctttaaccactctgggatgtgtcctccctccatcatatttgatggccacaggaatcattaacgtgaatcttcacaggcttgcacgctgccttgattgacaaagaaactgctatttttgtccactctgtttatcctttccctatacctccaaaagagatttaacctccaaaagagatttctacctcataagctaatcttctgtgataagcttttatgatgcaaatttgggagagtggatagacagagacagaactagagtaaaggagatgagggtacagatgcatgggagagaagaaaaggcagaaacagagcaaaagagaatgagaaagtaaaattcactatgggtgtgatttgtgtgggggagtcgagcatgggtcctgggaaaaaggaagcttcaggcagctgtgttgtatgtgagagaagaagcacacgcagaggaaagttaattttaagaagtctagctgatggttatcaagcagatctcttttaatcttcttagagggctacaggtaaacactggtattagttttaattgcatcaggttgttgaagcattttcctttgcatggaaaccctcaacactgggtcatatggggttctgggatgacatgagtttccacatttaactggaaggctgaagtcaaagcttcgagagaagctcaaacagggagagtggctttgcctcctccttcaccttagtattggaaatacattctgtggttccaactttcctaatgagttttaaaaactggagtgtgttgaatattgccaaagaccaagaagtcccctactctctgtggtgagaagactgtcagggttacacattcgtttcaatcctcacatcaagtctcaagagtgggcattacaaacccatttgtaaacgtgcaaactgaggcctagtgccatagagcgacttactcctttgtggtcatgaagttaataagaagcagctccactcggagtaggagtctgaatttttataataaaaggaatggtgaagaaaggagagacactgaaagtggaaattaagttcttaaggagaggcgggaattcaatgaaagctacagggctcttctccagctccccttgccaggctcatctggaggattctctaacactcagtgactttgagtctttgttgggggagtgagaaaaccagcagcagcgaagaagagccgctgtccctccgctgcgtttcaccctgcgtgaaagcctcagctggctgctggcctctgcccctgcctaggctctttctttggacccaacaaaagggcagtgggggaagcagagcctgtcttctgcccttggcaattaaggtccaggtagaggcaggacaaggaagacttctgcctggcgctgccggccttggcatttcctccacgaacctgcaagagaattcatgccattgaatcacccataatcagatgcagtgactatcatttttttgtgtgtgaacatctcactggctgaacacaaacatctcaatagccatggcgccctaattttctttgtcggagacaacaaaaccaaaggtaatgagcaggaggagggactgagtcccagggggcacattgtctggaggagtctcctgggcttaaatacatctaaagtagatccaaaagaaagcagtgattacaggctaattttctgcctgcattatgttaagtgtcctgtctctacacaaatggcaattgctttatgccagaaatcttttactgaattcctcttattggtaaattttgtattaaaaaaagagagagagacagactaaagaaaggtttttttcaatttaaaggtgagactatgaggatgccagtaaaagatacaagactggcacatccccaagagttgattttccttttcaaatgcaagtattggagaaggcaaaatggtccttcctttgaatttgccagttaaagggtggaggctcccaacttgagctggaggaggacacagcgctgcttcgggcagcacacagggttctttgctgagacagctgagggggctgaggcaaggggcagaggtgaagagaggctgatgcatttggcccttccttagtcatcagatggccatccacaggagagtgagacggacacctgagaccctcttcctcctgcgtagacactgcccctttcccaggagcaatgagagtcagcccagccatgtcactgactgcctcttcctcttccagtctgggtctgaagtcctaaagacatttttttgcatgctcttccttcattcactcctcattcgtgctgtgaatacctcctaagcatcttctatgttgcagacagtgggccacaccctgagaattcaaaatataattataagaaggaagtggaaattatgatagtcaaacagaaatggaacataagcattgaaatcagagagatctgaatggaaaattccaccaaacccctccttgccttgaataaataccaagattttatacttgaaaaatggagtgggaggaggggactgctgactcctgcctcagagagttgtggaaaggattaaataatatctttaaagcaattagcatagagtctgtagtattcaatgcccaataaccacttgttgtttctgcccttatttgaaattctcagttggtaccagagccttcccctatcccagagatgcatctgactcacaaccaccagggcatcaggccctccaggccaagaggcacgtaccttccctaagtaaaatgcaaacctatggtcctcttgacaggaggctgggaggaaggatgaaggatgaaggctgtgacatggccacctggtggggcaggggaaatttgggatcagttccaagtgaaggcaatggagatgcgagagaggcccttctgtgccagctaccacagcaggcattttgtatagattattttgcaggtgtgtgtgaggggtgggactccccatccaatctaatctcaacaactccaggtgaatgttcgaggtgaggtcaaaagacaaatacaaaagtgcaatgtcccagagcccctgaaaaagctaagccttggtctttggccaccaaggcatgtctatttctgaggatgtgtggcaggaccattcattccaaaaagaaatgaagatttatgttacatctgagaataagtagtaaattagcaataagtcaacttttcatccaatatcccctgcagacagggtattgataccaggaaggatcagattattctccaaccatcccgaatgggaaactgggacttaatttatgcttgtctgtatgtgccacatgccagtgctgaaatgggtattgtgattttcttgactggttacctccagtgttgaatgcagcctcaaggacatgactgtgaggaagagaaggaggatattggtcttcatttctcgagatcctaggcagggaatgcagtccacacttcacctatgatgagctatgtgaccttgggcaaattatttctttgagcatgctatagcctctataaaatggggattgtgacatctgacagagttgtcgtgaggttcaatttagataacacaatttaaataccaagcagaggaaccgccatttactggacactcagttgatattagttctctgacacagaatacagaatgaaggacacttggcaagggtttagtgtttgatgatgatgataatgataatagcagcattactgtgggtgttcagaaaagaagacaaacacgggactctattgcctccagaacttggcagggagttgagtgctagaagtggaaatgggggtggttgtagctttgctgattcatgctaccagaaaggcactgaagtcccagttccaggcagcagagtcatctacggcatgcaggacaccacgttgtacaagaatgtaggttcattgtgctgcttggtcactcagctcaatcttctccatctcaggttacccagggccaactttcaattcatctcctttcccagcagtgaggatgctcttcaatggggatgtctctcagctccctgacctacagccacctagcatcacctcttatgaaccctttggagcctggcagaaattgattcccagattgagtttttctggtcaggaataagcagggatgtgaaataactgaactccatacaattccgccttttggatccactggactttggagcaagtttcctaagacactggattatctcatggtcaaggtgaacatctcccatcaccctggcagcctgtcaccttcttcctttccttcttttcctttctaaccacattcttctccagcttctctttctcctttatctgctcatttctctctcatttagtcttgctcaaaattgctctcaaagattctttttcctgccatccctcttaggaagcagacgaatagcgggatgccagccctggatggaccataaataatgcataatgcccagaaagagccagagtggccctctgattacaaagagaatatcttttgataacacattatcctatttactctttgtaatgccaccagttcttcattcagtagcaccacgcacccacttgctcaccaatttgaaaccccagcaaaaaaaacagtgttcctgctgctgtctgatcctggctccaccaccaggagggcctgtcagacatcctcttctgatgcctatgctgccatccctgggcccctggaagcctgccagaaaggtggtcagtctcttctccattcaaagcatatgtttatcttaaactcttgttatagcctcgtgttttgattcttgctgaactctggagaatataaaggcctctaactcagccccctgatgtatacaaacatagtactgaataagttccatattcaggacccagggcttaatgaatactggatgccccaaacataaccctgcagattattattatttccagtttcaatgaaggaaattatgactcagataagctaattgattggttaaaggttaccaagctagtaaattataaacccccaattgaaatccagtagccatgacttcctgttctgttatcattctttctttctatgggttaggatttagaatttggagacaaggataggtgagtatattagccagggtaacaatagaaaacagaattttattttattcaagtgaagatatggtattgaggagacagtttacagaggttacagatagggtaaagaacacctaaaaggaatgtggagacactcagtggtttgtaaacaagaaagctcttgctacccctaggcttaaagaaaaagggggaagggataatgttttggagctgaggggaaggctggagccatggaggaaggtccgcctgccggatctctagcttggaaggcttaaacactgacaggtgcagctctggagaagggacggaatggggaagaggaccactttctttgttcaggcatttgccaagttcaactagaaatagccagtgagggagaaggtgatagagttggtggggtctacatttcctggcacagaccagagctggtagtggggaagagtttggaaagcagtcaacacatagcaccagtgcctggtccttcttcacagggctgtgggtaaaagagccactgccttcctacccagactctatacctacagggggaatcaccatgaatccaagaaaactcaggcttcaggggcttttcccattatgtattgcttcaaaatactccaccccaaaacttggggggttcaaacaagaatgacttatgatttcttatgtttctgtaggttggccgggtggtctttctgctttttcgtggtgtcagctggagtcactcacacagctgcattcagctcggagctcagctgggtctgaaacatacaagccagccccactcacactctaggcttttcagttctctggcacagaaccctgatctctgcacatgatcttgtgtcattttatttcctagcctgaacttttttttatggtggctggcttccagaagggcaaaagccgtcaggcctcaaaagacctatgtcactgcctgacacagcattgcctctgcctcattttattggtcagagaaacttgcagcccagcccagattcaagaaaaagggatatagtttccacttcacgatggcaagtgcagcatgtgcatacagggtgggaggaattcttggaggcctttttttggccagtccaccacagtctgccttctcactatagcaattcatgcccttcttatgtggaaaatatattccccctcacacatccagaattttcatcccattattacatcaaaccaaaatccaataatctgtattgggctgagatgtgactgtggcacttcttgggctaaagaactgtgagctgaaaatacaaggtaaatcccactatatccagcatatgatggtgatataatgctaatacaagcgcaggatatttgcaataaacactggaatttaaaaaggcaaagaacaggaagcacatcacagttactggcccataacaattctaaaatccaggaaggcattcattcactgtgcattaagccttcctgggagcaaagaattttctgtgattagcatcaagctctgcctctgtgagggttcttgattcaagccagagatccagcaggtggaccttcctccgtggctccagctctccccttggttccaaacattatctcttctccctttttctttaactgtcattttcaacttttggttgattccaccttctggcctctttgctatgccctcagattcattcttcctttttcataagaaatggcccatgtttgcagctgaataactttctcagcttgcttttttccccgtagaaagcttgtgactcaaatgcctcttttcactttgaacttccttatccctttattcaacccggtagttctcccatcatgataattctctttaaaatattatgtgccattcattgacctcaccaagggttcactctgtgctccatgccctagcataattctttcagcaactaacctctcgctactttgcgtgtgtaaagcaacatcgctatgatttccaggacttcttttgtctgacttggaaggtctaggaaacattgccttgaatcttctagaattcttaagaaggtatccttcagccacagctttgatttgatctttacccgaaggcccatattttgtgaatctttgccacctggaaaactatgctgggggcccttacgttttcttcattttttcttgaaaattggccaattctttggctcctctctcctttgcaatgcctcaacatacattactaaaagaagccacttagcattttcaattttacctggccttagccaagttcacaatgtattcacttacctctccattctccgagcctctcctctttactctctgccttagtctttttctgttgctataaaggaatatctgaggctgggtaatttacagagaaaaaaggcttatttggcttatggttctgcaacataaacaagaagcatggccccagcatctgcttctgctgagagcatcaggctgcttccactcatggtagaagatgaaagggagctggtgtgcagagattgcatggcgagagaggaagcaagggttgggggaggtgccagtctctttctaacaacaagttctcacagaaactaatagtgaggattcactcactaccgggagaatgacaccaagtcattcatgagggaaccatccctatgaaccaaacacctcctaccaggccccacttctaaccctggaaatcaaatgtcaacatgaggcgtggtggggccaaacaaaccatatccagaccagagctccccctaacctgctacatgagctcaaagccaataccacaagtcttagacttttgtcatgacagcatgacacatctaataaaatttcattgtctgttgttttcattatctattgctgggcagaaaatcttccaaaaacttagtggctgaaaacaacaacaagtatttccttgctcatgattttgcaatttgtgcaaggctcagcagggttgacccaatgctgctccacatggtgacagttggagtcatttccatggctgaattcagctgggtgcgcctctgaagttgaagcatccagaaaggccttatctgcttatgttttgggatggtctagtgcaaaaagagctaagagaaacagggcctgtcacttgaactgtctgcttgcaagattgtggaagaggcactaagaagatagtcacctggtcatgttttgtaaactactaaagtgagacattttaactgcaatcaatcaggacttccattgcttttaacctgacataacattcatcatattgcaggtggcattgcgatggcaaaaagcatttttgggattcacctgagagaaatttgagttgggatgccttgagtttgcatttaatcaaatgtactttatgtaccacacatcctgtctatgcatattacattcttgctagctgttctgctgtagggatggctttcagaaatgtgtctactgcctacaatgcagacacaagtgtctcccagaagtcacatggtacaataagaacatgtctcatgtggcccagtattggggatatgtgaagagtggaagaaatttgaaactagtctgtggaaagttctaccaagtatcatagaccttgaaagaaactcaaagtttttcaagaccaacatcctaagaatttctataacgttaccaatcatgatttgggaagctgaaagaaactgtcttgagctatcaatttaaaaaaatcagtcaactatgccagagtttataccgaattatctttctattctttctataggaaatggtaacataaaattctttgcatctgaagatgtgataaaaagtatatagctaagaatataggaaaatattacagaagtgcattggggagatatttaataacaatattattttcctggagtttctgatgtttgtgggtatattttagcctttaaaaaattattacttgtgatttctcattttaattaaatactcacatccatacctaattttatatttgtaattgcatattcttttcttaaagagcacctcaaaatggcataatattcaagccccactgatctgggcccatgttcatacctagaccagaggcttcactctgaaaggcaatgtgaacatattaactaataaagtactggagttggtattatctcccagcatgaagaaatcacgttcagtgtaaaatgactcatctgtgttgcaattctggggaggatagggaatcagaggataccagagcgagataagacaagatgaggaatgagaacagctaagatgaatgtcaccttcttcagtggcttcagagacacatatgggaatggtaactttaggccacaggacacgctcagatctggtgaagatctggggacacagggagagcaatgctgcttataatccgacaataataacataactcattttcctgattattttgtattcggcactagcttgagcactttatatgtattaacgcatatgatctgcctaacaactctgcaaggcagttttgattgccatatccattttggaaatggaaagaaggcatggagacattcaagaatttgccctaggtcactctgctggcacctgctggaactggggttccatgagtccatctgctccagaggctgctggcttaacaactcacacctttgcatttgtatagcactgtgcagtttatcaagcaattttacatacagcatctcacttacagtcctaatagccctgaaaagttggcagggcagttactgttactctcattttgtgagtgattaattgaaatctaaaattgcaaagtgacttattcatcatcacccagctatcagtggtggtattagagctgaaagccaacccttgagtgcatttcattttctcacattgtgtattaataaatttcagctatagttatcttcaaagacatctttatgtataacgctaacacagtaccttccacaacttcataaaaaggcattgttattatcccaatgttaccaaagaaaaatatgtagcttagagaaacaagtcctggtggtatggctccaaattcacaagccacactctctcctgcacaagcagccatggccccggtctacctgctaaatcccacacaggacttggcccttccgatgctaggggaacagaagatggattcaacacctcaagacttcaaagtgcacagtgggttcaggggacattaaatagatccatgtgtctggagcatgaatatcaagttgaaaaaaatgggaccagatgatgggggctttgagtaccatgatgtgaacgttaatttgcagggagtgagcactgagtatacgcagatctgtactagattctgtgaacaaactgaatacataaaagtgtagtcttaagctgcaaactgtttggcctcttgtctaggaataacaaacctgtatgagagaagcaggaaaagaagcaacttagggccaggtgtggtggctcatgcctgtagtcctagcactttgagaaactgaggcaggcagatcgcttgagcccagaagctcaagaccagcctgggcaacacggtgaacctcgtcactaccaaaaaaaagaaaaaaatacaaaaattagctgggcttggtggcacatgtctgtagtccctaggctggggctggggtgggggtgctcaagtgggaggatcacctgagtccagggaggttgatgccgtagtgagccgtgatcacaccactgcactccagcctgggtggcagagtgagacactgtctcaaataaagcaaattagaagtatttatgaaagaacagataaatgacttaaaagacaattattataatgtccaccgtgttttaagatcatggaaccatacattaaagggaataatcataaccataatacttaaaatggccccaagacccatggaaaaaaagagccctgctttctctgtgtgtttcgttttaaggtgactgagcaggtgatccaggttgcagcttctctggtggccattcataaaggggaaaattctctttgaacccacagctctttggattaatttttcttcagctcctgaatggacaacaaccacaacaacagtgctgatagctgccattggctcatggcttactgtattgggtaactcacgtgtattacatctgatctgaagccactctgcaagttagatactggtacccccatttcacagatggggcagtgaagcccagagacattaagtgacttttccaaaggataaatcacagttaaacacaggtatagaagaatgtaagccccagaaactttttgctacactgtacctccctattcctttacccagaaaccagtactagaatttcattttctattccatcaaggctgagaactcactatcatgttcacagcatccacaactgagctgcacctccatagccagcctatgtttttctctgtagcctcttatttcaattctgctttcatgccaaatttattatcatttctcctcaaataccttttattcttatactgctaaatatctgtcattcagcaagtcctatttacctagattttatcaagtactgtactcaacatgtacaaaattctccctctctagaatgcactttcccctgtctctacccttcaagatcttatatatcctttaaggttatactcttacaggtcagacacatagaaaatgtaaacaaattgttactattgttattattattattttcatcatcagttttccaataaaactttgagctcctacaatgtctaagctctgtgaggtagcagagataaaattaccaataagccatgatattgacccccaggagctatgatcaggttgtgggaggagagggctatttggcatgagcaggtggtaacacacaatagagtacggtaggaacagctaaacgtgccatggaatataaaatccattttggcattctggtagaaggctttccagaggagatactagctcatgcctaatgaatatggtgaagttagccaggcaaatacaacttccatgttatggtaaccaattgaacccatttgctggggctgggagtttttgtgagatatggaactttcagagctataactgggacagtctggggcaaactcagatgattggtcactccattgcatgtgcaaagatgataaccatggtctggcaaaatatcttgaatgaacgcataaataaatggatgaatgtttcatctatccatgaaaaaaaaatatctcctaccaactgacctccttccaaatatttgctagccaacttgacctgagtctatgtagctctgccctgcaagttcccgtccactgtgaacattcattctggggtttatgtcatagcaagattttaacaatgaagatgcagctgtcaccagaaggtgggtggaggcagctctgggaaatcactttctctctccctctcttcctcccaagtctgtgtgcttcattaaaatatgtatgacaacatttctcctcatattattgtatcacaccatccttaattgcataattcaacattttcaagggtatttggaggaaatttggatggttcattgactattatttgaaggaagctgagaattaaatttaaaaacatgagggaaaattagtagtagaagagactgattgaagggctgacatgggcagactctgagcttttgggtcctgccccctctccactttcactgtttttgggtctttgggcctacacatagccgctagttcccagcatggtcccaggggacagccagcacaacctgccacttgccattcaaagaatcctgctgtcggtagtcctctctcccacactcccccgcccctgttgtttctgttgtccttgtttgtgatttttgacatgcgctttgcagattgcgtgtttttgcttgctctgttgaatgcacacgtccttggctgattgcaatcatgctgattgggagctgtggcccaggggccaggaaagctctgcactgcctgtgctgcggtggggcttgcttttgcctctctgccccactaactttcctctcccatgatggtttcctggagcttctttctggccgcctatgcggtgctgggccagtgtggtcgatacttgggagtaggctgccctccttctcttggctcaggtgctgagatcatgtgctgcagcctgggagtgcggccagaagaagccggcctggaaacagggttgagcagggtgtgggttgctcagggcctccaaggcccagggcaaacattcaagccccagactgcttcaagctggggagggggattgggccctccttgaggctcagcagaaggccccaggttaaagtcagcttcttgctcttgctcccagccaaccctaactgattgcttccgcagggaatgtgcacaatgatacatttgacttcattggtgggatggatttgctagcaaaagagactgctggagggtgaaagaggtgtcagtttatcaaaaggatgttgagggtttgaaaaatgattgcaagaaatctgaattcttttccaactctgccgaacttgagatgtttggctaaattcaaagctgaactcattaggattgaaggaaagatgacttctgtggaagccagtgaatgtcccttgatgaagagctcagaaggaaacagatctctctcttcccacatctcccctgccactgggattttctgggtgcagttcccacagtgtggctagagagtaagaagcattttagggttctttccagttctggaatctagaagtcatagctgagaataacctagacagcagcttttacacccccttcacctcaaaggatgatgcattcaaggtcctgcggacagtcagctggagttcagccccatgtctggtgatgctgcatctgtgcacctgtcccttggcagcacttctgcaaaccctacctttctctctgggtgatgatgctcacctgaaaaaggtccaccctttgtgatagcactcagcgtcttgctgcagacaaagcagtgggaaaaatccctgggcaggccagggccggcacaaccgcagccaaatgtaaaggccacaggggccacagacatacctcatccccttcattgctcccccgaagggtccaccagcagctctgggagccataggctgagtgagtgaagaagagcaaagcccccttcactgggaaagtcattctgacccagcatcttcatcagcttatttgggggcatttagcttgttccagttcaataatgcattcaataaaaccgttagtgcctgacatgaatcccaaatgggtgtgtggctgccaggcatgctggcccagacagcacctcctccccctatctccttcaaatgaaagccaggtgatattaacatgattagcatggataatacgaaaaatgacagcaacttgggaacaggcacggagagattttgaggcctcagaagacagcacaaccaaccacagaactcaaaccagcactggaacctcaggcctctccctctggcttcctactgaacctagatgggaggtgctgttactgcattctctctagcaggaggtcgataattcagggattgggctttgcttcacagtgaggctgttcaggttttggaagagaaagtcagctctatgtgatcttctgtccacagaggaaacccctatgaaatggggcctccatctcctgcctgtctatccgtgcccctagccctcaagtttgcaccatagattactatttcttttatttatttattttttcaagaccgagtcttgctctgtcacccagcctggagtgcagaggtgcgatctcggcccactgcatcctctgcctcccaggttcaagcaattctcctgcctcagcctcccgagtagctgggattacaggctcctgccaccatgcctggctaacttttgtatttttagtagagacggggtttcaccatgttgcccaggctggtcttgaactcctgacctcgtgatctgcccgccttggccttccaaagtgctgggattacagacttgagccaccgtgcctagcccataggttactatttctaagaggccctttctgagagtctacatgatgtgtggtgcccatgttgggagtacaaccacattaaaaagtgcctgtgggcaggagcagctttgaccagagtgtaggatacagtaagttcctcttcaaagcttagcctgttaatttcctttaaaattcaagagggagaaaattgttaagtaccatgagttctgagtcttctctccaaagaaccaatgtatcagtatgttcagcttccctgttctttgttcttcattttaaagcttgacttccttgttctttatgtctccttgcccctagtttcagtaaacaaccccctcctagcctgtatcacctgctctgtccttagtcatccttagtcacctgttctgtaaccatccctcctgccaaaactactcacctcgccactccggctcatacccttgctctctttaaaatagccagtcagaattagcttagactgtgtggtccaaccctagccaacagaggaaagactcagcagtagggactagctgcgttaggaataagacctccttcccctcccttgtcaggtgtgttctctccgtttctccatcgctccatctgcgagatgtacccttctacagaagtaaattgccttgctgataaacttttgcctgactgctattttcacttggcggcaccaagcatttgcttccaacgggaggttggaagtaagggctctgcagtcagacagacccaagttcaaactctggctctaccacgtactggtaatgggacttcagacagaactgagctttagttcctgtattctgtaaaagagaggtaaggatattacccaccttccagagtggctgggaagaagaatacacacttggcttggcatgtagctaacatttattgaatgcttattaacattactgaaatcatacttttttgtactgttactttattgatttttttattatgatggttagaagtttcttctgaatcctgcaaatggctctgacctctactcttgcctatgacctttccttccttttcttccaaacatacacacacgcacacactcacacacatacacagagcaagttattgcccattacatctgctctttccctctgatcttgtttcattaaaaatgctaattcccccagcctgccttccatcttggcatttgcatatacatgagcagctcattcctattctggaatggtggcctctgggctgatctggggcctgaaagggagctctgttgggaagggctggggggaagccaggcccaaagctgccaggagggggtggccacttgctgggctcctcatttgatctcctttattcttgcttgccctctcctggaggcacctgctggtaagcaggaggatgccagctcatgccacggggacttctgcctggcattgtcttgccagtgtcagttccaggcaggagatgtgacctatgcaccctacagtggcaggaggctggtgctggcactgccttctggggaggcagcatcacttggccaagcatcccccgggacattcttttccagcacttggaggcacactctggagtccagtcgcgttaaacaataaagcacagtgattatgacagctctcggagcctggaagacattatgaccactaagcgggtgtccataattcgataggaaaatgtcaggaaacatagattcgatggttctacacattcattttggagtgagtgatgtggcagacaaagaaagcattcttgagatccatgcagtaggttcaaatactatcttgtcacttaatagctagatagcctaggtactcattggctcagagcctcggcttcctaatctttgatataagtgtaatgatgactccttcatagagtgagaggatgttgcaacaggaacagtgcctgctcacacatccgccccccactccccgtcatctccgctgtccccagcccggtctgagccactttcctatccggacacttcaactgcctgcagaaggtctccccacacttcacttttgcttctttccaatccactttccacaccatgacgaaggtgcttgtaaaaacacaaatcggatcatatcattttttcctgctttaaacactaacctggctttcccttcttcttgaggaaaaaagttcaaatatccctaactcgtcccctgtgactcctccagtctcatctcactcactcctcccctgctaacaattctccaccacacagaccttctccagtgttattaatacgctaagtttcttctgcatcagagcaaaaaaatcccctgagctcccaagccagattaggttccccttcacccgcgtcaatgcgctctgcatttaccctgtgggtttagtgtgtacttctgtgtcagttgtatctacacgtctattattttgtttatcttttattattttaggaataatttcttctctttgagaagccacatcactgccaagaaaacccctgggtgatgtgtgttccggcacaaaccaagggacaggagggctgtgtgtcactgcaaatgctgggtgcagtgtgtggtccccccatgcctgccctgcaagtgtgttgccctaggtctcaggctgtatggacctggccctgtgggccttctcactcccacgtgacatcagtggccacgggctccaaaccccacagtccctgaagcagaagttctctctcattttttcagaggaggcgggagagaggataagcaccctccagctgagaagtacgcggactcaagctcagagcagcttccactccttcctttctctctttgaacaggttgtacattttactggcacagattagaactttattcccagaatcattaggatctaagatgtatttattctataaatatttatgaagtaattcttctcaatgaaccctgttccctgtgctttatttttatctgcttattatctcctttaagtctcacaacagtcctgctaggtaagtaagtatgctgactattaccttcattttacagatgagataactgaggcatagaaaggtgaagtcatttgcttcagaccctatagttatttattatatatatatatatatatatatatatatatatatattttttttttttttttttgtattatactttaagttctagggtacatgggcacaacgtgcaggtttgttacatatggatacatgcaccatgctggtgtgctgcacccattaactcatcatttacattagctatatctcctaatgctatccctcccccctccccccaccccacaacaggcctcggtgtatgatgttccccttcctgtgtccaagtgttctcattgttcaattcccacctatgagtgagtgagaacatgcggtgtttggttttttgtccttgtgatagcttgctgagaatgatggtttccagcttcatccatgtctctacaaaggacatgaactcatcattttttatggctgcatagtattctatggtgtatatgtgccacattttcttaatcctggattaagaaaatgtgaccctatagttattaagtggtggagctagaagtcaaattcagatggtctgacttccagacctgcctagttacataaccacaatccaaattcagatggtctgacttccggacctgcctagatacgtaaccacaatccaaccagagggcagcaaaatctctgccttcaaggggtttgcattctggggagggtaacagacagcttaagggtgaataaaggcaggaagcaaatcctgtctgtcaaagagtggtgagtgttgtgaagaatgtaaaggcaggaggggcagcctgggggctttggcagaggaggcgatagctgttggtagggtggccaatgaaggcccctctgaggaggtgagtttggggcagatgaaaaggagctgtctgtgtaaagagccaggggagaatgttccagccaggagaaggggttgaggacatgtttgagaattgctcctgggctggagcctgggtgtgaggaggaacatgcaggagatgatgcttagagacctcaggctctattctgagcatactgggagctactggagggtcttcaggagagggaagctgtgatctgatttatatgttcaaaaggtcaggctggctgctttttagagagaccaatgacaatatttctgctagtccaagtaagaaacgatggcaaagggggctgttgcagtgaaagcaatgcaaaattgggtagatcttgagtgtgctgtaaaggtccagttacaacagcatttgttgcagagttggatatggagggagttagagaaagcaaaatcactggcgattgcaagggttttggcctgagcaactggttggatggtgacaccatttattaagatggagaataccagaggaagagaaggtatgtatgtgtgtgtgagtgtgtgtgtgtgtgtgcacatgtgatcaatggatgagcctggaatcaacagttctggtatgaaagtgttaagtttgagacatctgttagacttccaacagagatgtcacagaggtgactgggtctatgagtttggagttcaagggaatggtgaggctggaaacatcagcctgtagatggtattaaagtgcccaactagatgagtgctcacagagagagtgtggagacagggcgtgctgctgaggtcccaatgtctgtgtcccctcaacattcccatgttgaaatcctcaccccccagaggatggagtttggaggtgtggtctttaggaggtgattaggtcatggcagagaggcctcatgaaggcatcatgattgctgcccttatgaaggagcctcgagagagagagagtccttgctgcttgaaccaggacgtgggatctcactggacatggaatctgttggcaccttaatcatggacctctagccttcagaactaggagaaatcagtttctgttgttgaagacacacaggttatggcatttggttagagcagccaaaactgaccaagacctggagatctgggaaaaaagggagaagagaccagaaaatgaggctgaggggaggcaggagctgggagcgggggaaagtgctatcacagaggcaagttgacgaggggtgcaagagagtgaggagtcggggcccatgctgctgcattccccggcgtctctggcatcctgacccacaccccaggctgacgtggatgcatatcgctcattgcctgctcacacatgtcaggcatttgcttgttgttgaagtcatcgtctgtaactaaaacgtagcctccaaaaggcaaggacttttgcctcccttgtttattgacagatagatgtatccttggcacccaggaccagcccggcacatcagagctgtgtaacacagcatctgatcgaatgcttttgttgcctgagtgcagggtggaggacgagagacctgagatcaaccttggctttggcagggcagaagtcatcatatccatggcgagatgtgattccctctggctgatggagatcaaatcctcactggattctgttcaggagacaagggaagatgaggaagtacagacagaggaaacagacaactttctcagggaggtttatgggtcagagaggagagggactgcagtcagggtcagggaggccttggctgttgcctctttatctccagatgagaggaaataaagacatttgtgtgcagagtgtgcatgcccacaggaactctccagtaaggggagccgttgatgatgagggtacaaaggaatgagagctgatgtcctgtgcctgggggaaggtgtggaggactatgcaatcctgtgcacaggtaaggggctgtctgcaggtagaccagcttcactcagcagaaataagaggagaggttagagcaggaacatgcagggtagatctggggaggataaggttgagtgttgcagtttccatctgattgtttctggctctgcagtaatgtaagaagtgaggtcctcaccgaggagggtcagagacagcagaaggtggaggaaaggagagcaggtgcaccaggaaaacggactgggatcattgggtcgtgtcaagtccacttcatatttgaggttacaatttttttttttttgagacaaggtcttactctgttgctcaggctggagtgcagtggcacagtcatggctcactgtagccttaacctcccagactcaagcaattttcccacctcagcctcccaaatagctgggaccacaggcacactccactatgcctggctaattgtttctcttttttttgtagagagagtctcactgtgttgctcagcctgggctcaagtgatcctccttccttggcctcctaaagtgttaggactacaggtgcgagccaccacgccccactgaggttatacatttaaacttaagctaagtggcagggttgtgcgtgtttctttaatccatttggcttctctattagaggtgaagttaactggggtaggaattaactcagatgccatcaccaacccctacactgactacctttgttagggtcattagtgctttaaggccaggcgggtcagagcatgaagtccaaagacatggccttataagaattggattccagaaaaggtgctgatccagctgtctctgacccacacttctgaggactgctcatccagggctccctggccccaccagcttcctccaggcccctgcttctggacactgtggcttgtccctccacatccccctgccagtcccctttgagccccaccagccacctctgtcctcacccttcctatctctgtctcgcacagcgcatgcctgaattcagcctgtttgggttgcctgttcccactctgacttgcaaatgcagaccccttgggctcacattctggagaaaacataaacacctctcctctgttggcatggggataccctcaaatttggtggctctcggctgcccccacctgccataaatcagataggaccgcagctacccagctcagccctggtaaaccccttggggcttggcaggaatggctttcccggatcgaatttcttggcagagaattggaagggatttaaaataactgagcacaccataccacccgtttccagctccaaatagaatttggagtccatttcacacagcgctggggttctctcacccacagatggtgttaccaaaattgtgtgtgctgctgctctgtttgtctctaggcttgtctacctcgacctgcactgctggcctttccaaactcttcctggcctgcgtgctccatggccatctgggtgtcagcgtgccctcacatgtctgtcagctgccagactccctggatctctgtctattgattgatctgtaaatttcccgcactgtgcatccatcagccgtccaccccctccactcctcctgcatgcacatatgcctgcctgcaccccgctccagcctggaggaagctttctctcctcttttggcaattggcggtcatgtctcagaatccacaatatgttgattcttttcagaatcaacacaccctctcctccgcactatctgacctggctggacaacaggcagaggctgttgacatgagttgagggtgctgctctataccacagtggggtatactgcaggggaaagaggtgtggtctcagagtcatgaaacctaccttctacttgaccattgggaagtcacgaatctctgagtcattctcctcatctaagaaataggggtaatattacctgtcccacaggagtggtttgaggatttgatgatgtctctgtgaagctcagctcacagcacaaagtagggatttaaaaatgctctttaatctgtggtctatggtaactatcaaacaagtaatgctaacaacgatcatttattgaataattattctcagtgtgttaaggactttatatatttcattgtgtttaatttttgtaagacttaatgactttgatcatcaaagtatggttccccaaacagcagcctcagcattacctgggaatagttacaaatgctgaatctcagtctccatcaccaagcgttttccatcagaattggcattttaacaagattcccaagatgttgaaagtgacatcctgcgattatttacccccttttcacaggtgaggacactgagacctaaactgggtgcataatttgtcctggatcacacagcaggcagctggcaaatctaggttctaaaactggcttcccagatatcagtccttcaccaccatggcagagtgtgttaatcagtgttcacactcacgcacatgctcacacccacggaaaggacacggtggccactcagcaggttcggagcccatgatccgaaatgcccagggtgcagaagacccaacccagttgagaactatcttctccttccccagaaggaagtgcagcagcaggaacatgagaatgcaggcttctgtttaactagctgtgtgatcccgcgcaagttacttcacctctctgggcctctatttcttagatttacaaagtgggatgatttgcccagatgtaacagtgtgcctctgttattgcccttttgtctcgttggtgattctgttttgacaatcatacccataagaagcctgttggtgtttctgtctgatgtcagttatcactccgggaatggagttaggatgagggggagagagaagaggatgtaagaggttgtaagggaatggttgaattaaacctggctttccttaaaatgactcattctcaagcatagacaaatcagggaggcctgtgtcaattactccttgtgattattcccgagcctatttgtggaactccaggccctttccgtacctcattcggagggcttttctcagggggtttatggaccaaggacatctggtgcctgaggctttatgtctgttggtgtgatcatccaaactggggaagggcctataacactccaaatgctggtgcccgaatatctttaattccttctgaagggtcggggttatttctccatcgggagcactaatgggattctaataccctggcaaatgggattttttacaactgccattctgcagttactgagatggcgtgtcgctgggacagccctataaatcctgtcaactcactctgaggaggaggcggccacagggagaggtggctgcttccagtgctggcagcctggggggccctctgaggggtgtccaggttctagttctcaggatgagttactatctttgccagggagagatggtaaatcatgggaatggggcagggcacagccctagggcctcagagaagccacaggagtttgatgggaaggaggcagtaggcccctgggaaaagtgctcttcacttcctctccttttgcagtttggttttccaaggcctctgtctctgagggctcatggacacaagacctaaggatatctaccaaaagcaggtacctctgtccttttaattccaggggaacagggcccagagaaaaactcacggtagatattaaggaaaaggaaaatgcaatacagcccatctttatgttggagttaaacttgatgccccagggtattgttcccaaagacagatatttacatagatatctcatgtgcagatgaatgactctctaagcctgggttctctgtgaagccacgtcccttatatcggtacactgtttacagacaacctctcattttgatcactagaataaatcagaaggattgaagggcaagattattttctttccacttcagggatgaaaaataacatggcaggccttaaacaacttgttgcagggaacctaagttgaaatttgctcagtttttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgcggcgttatttctgagggctctgttctgttccattgatctatatctctgttttggtaccagtaccatgctgttttggttactgtagccttgtagtatagtttgaagtcaggtagcgtgatgccgccagctttgttcttttggtttaggattgacttggtgatgcgggctcttttttggttccgtatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttgtttgtatcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttgttggtgtataagaatgcttgtgatttttgtacattgattttgttagacctaaaaccataaaaaccctagaagaaaacctaggcattaccattcaggacataggcacgggcaaggacttcatgtctaaaacacaaaaagcaatggcaacaaaagccaaaattgacaaatgggatctaattaaactaaagagcttctgcacagcaaaagaaactaccatcagagtgaacaggcaacctacaaaatgggagaaaattttcgcaacctactcatctgacaaagggctaatatccagaatctacaatgaactcaaacaaatttccaagaaaaaacaaacaaccccatcaaaaagtgggcgaaggacatgaacagacacttctcaaaagaagacatttatgcagccaaaaaacacatgaaaaaatgctcatcatcactggccatcagagaaatgcaaatcaaaaccacaatgagataccatctcacaccagttagaatggcaatcattaaaaagtcaggaaacaacaggtgctaaagaggatgtggagaaataggaacacttttacactgttggtgggactgtaaactagttcaaccattgtggaagtcagtgtggcgattcctcagggatctagaactggaaataccatttgacccagccatcccattactgggtatatacccaaaggactataaatcatgctgctataaagacacatgcacacgtatgtttattgtggcattattcacaatagcaaagacttggaaccaacccaaatgtccaacaatgatagactggatgaagaaaatgtggcacatatacaccatggaatactatgcagccataaaaaaagatgagttcatgtcctttgtagggacatggatgaaattggaaatcatcattctcagtaaactatcgcaagaacaaaaaaccaaacaccgcatattctcactcataggtgggaattgaacaatgagatcccatggacacaggaaggggaatatcacactctggggactgttgtggggttgggggaggggggagggatagcactgggagatatacctaatgctagatgacgagttactgggtgcagcgcaccaacatggcacatgtatacatatgtaactaacctgcacaatgtgcacatgtaccctagaacttaaagtataataataaaaaataataataataaaaaagaaatttgctcagttaatactcaaccccaaaattttgtaatttttaaaccccatttgtccccttgcctctacaccatgtcaaatcttccaggaggatgccagctgatgctcctttcctcctcaaggtcacactacctcagatggaaagcttccctaatgactgttctgaagttggggctttggggttgcttatgggctagaggtttccccaaagaccacttggttttggtgccactctgcatgggctcactcccaataactccgctttggtctccctttactctgtcggtgtccaatgtctgtaaattctcactggttttgcatttcttttcctaacttcagctgccttcttctcccagatacaggcagattcttccctggccttacaatgtattaatacaatgagcacctcttatccttaccagaatgtaaacttcctgaaggcaaatcttaagcaagcagttgctgagtgaataatgcttgcctaactagaccctgtgagagacaggaagacatagaagacccagttctagtttttgaggaacttacacatttcttggtgagacagtttatctccatacgttaaaaatctaagtgatttcttactgttttctagttctttaccacacacaacagtttcaccgcagtgtcttagtccatccttccattaatcatgagaggaggttgggattctaattctttctttagagataagaaaatagagctcaaagaggtaaaggagacctgtgtaactagaaaactgtttaactgaaggttcatgttcctcagcccattgcttcaagtagcataagactggtagaataagatgatgccaattttcatgatataaagacacatatctcagggcatcaaagcaagaaggaaatgactgagcagaaggattagaaaaggctttctgaaggaggtgatctcgggggtgggccagaggccagtttcccacgtctctagagtttcttctccttgtctcagtagctgagctcctggcggtgcctgtggaggaaaggtcatgggcctggaggccgcatagccatcatcaggttgaaatttacatgcgggatgaagcaacacaaactgtcccacttagggggaaagctgtgtggctccatttcggagaatgagccctacactgtgtggttcttgtcactctcgcatccctccgcctgccttgcagctcatccgcagcgggctttctactcatcaccctggctccctggccctgtacttcccaccacttcagcccagagcagcagggaatctgccaggtgaaagcaaaacctgctccaagcccagtaaagtacctctgtctgtgttttctcagcatagatggagagtggatgggtctgcttaccaactgccctttcatgtttcctagccatccaaaggacggtgcttggagccagacagatttcagttcaaatccagctccaactcttacctgttacaagactgtggtcaaactactaacttcttctaagtgtccaataacttcagccttaattttttaaaaattctaaaaaccaatttctatctatcatatcacttttatgatcatttgatgattgttgcttttattttatgaccactagacgtttataaaagtcctgggggcctttgtaactggatgaacaaatgctcagctcatcctgtgcccatctctttctgtctgctcatttccccagttttgcagtcaaggtttgtgccccagttggagtccaccgggtctgtgggggtgctggtgcagagctcggccttctgccccgtcctggcttgggtgggtctgcacggccccctgggccgtgggaagagctccctctgcagcagccagtgcctcttgattctctggaaggagccagcagccatctgtgtggaaggacagggccatactgtgtcctaaccttggttctgcctccaacttaaagtgcggtttgaggaagtcaccctctcgggaactccagttcttcaggttaaaaaaatggattttgaagagactaagacctcttcagggctgttggccaaattgagggggacagtgtcctgtgctccaggccacgtgatgagtggtgcttctaggagctcatcgtacactcctctgagacctacaccacatacagaggcatctgagcagggaagcaggtggttggtacacacgggttccttggaccagagcagagattcaggaggagccaagccatcccctcaggccccagccaggccatgagcccagcaggtaaggctgggacaccagccagtgggaagagtgcagcagtgccatgccctaattgaatcaaagtctgactgccagagaccctctgtcttcgcctgccgctggccagggctctcatgggattcatgctattaccctgtcaactccagcacaccccctcatttccctccctgcttaagaatggtttaaatcagcaatgctagtgcctccaaacttcaatctgaagcctaaggtctcatgtaagctagactttgtgcttgcacttgacaaacaaaacagaaaccccgaggttatacatattacgtgactgggtctcatctctgcttaggattgattttcctccattcccagttgcaggacaccagaatgatgggattattgtcttgggcaatcacactgtggcacctggcagctgcgtcctccacctcctttctgtgcatactgctaaataggcaacatctagttccattcggaccccagaatcctcagctcttacagcacaaatggggcatttgctcaatcccattgtaactgaaagcactttgcaaagccaatctctgtgtcagagggcgacctttcaaaatatgaaagcggaagagcctgtccacacctgggatggcaggtgcagggcccggcccctattctatggtccagaatttccagccatagtgaagccagcgccacctgctgtctagacagatcgccactgatagtggaagggaaaagaaacagcacagggtctagacaggtaagcacctactcaagtaccgagacccacaagttccaaattgcgcattccacttgctaattccaggcctaatcaccaaagctctcctgcatggaccatgagccttggggacacgagtggatgaaactgctcgacttcttgttgtgtgccagtgggtgcatgcacacggtggcatgtactgaattgattacggaaaaatcatttttgagttggttcttttgtctctcatttgttcactttctgaatatatttaaaatctttgtccatgtccttgctgccagctcctactgcaaggcctcagtagaccacgtctgctccccttgctctgtgctgcccttgctctgccagcccaggcaggggctgtcctcaaaccagagcctggagacaggcccatgtgatctcacctggatggaaagcccagaggccgactcccacagctgggtgcctcctggaggattcccacccaccagggcagaagccaaagtcaaatgccagggctgtgctcctccctctctactgccctcagtttctctcagctaggcttctcctgttccccccacagcagactcagcccagttctgagctcctgagctgatggcagcagggagggatggagaaaacagagcaggccgtggaatcctctcccagccccagcatgtgctggctgggccacgggatgcctggccttctcgcttccactctctcgtctccttagccaccttccagaccaagatccatgacgaggatgcaggcagacccccagacacctgtgtggttcctgaagggacagccccatgccccccaccctctccctgtcttgactcaaagttgcttctgcaaagtttttcctcccttggtcttgatcaatggctcaatttagcacccgattattcagtcctacgcttggcaccactgagatctcgggacatttcctcttgttcttcccagccccttcttctccagctgcacttaataccttgttttgctccgtgactggatcatttcagcctgtgacactgcatcctcctcacattctccaggaaggctccatggctccccgtccctgagcttcacaaccttcactgtgtgaacgcgtaagctgtggcccttccgtggctgaaggcctgaacccaaagtgcaaagtgagatcaattctttccaccagtagatcctgctttccagacaaaacaatataaactatcattgctgttgccaggaagcctcccttcacccacagtttggaggagacattgtgtcaagccctcagagtaggagttacaggctctgcacccatcctctggggtttccataggaggcacccaagaggtccacagaccacagagatggccaagccagctagaccggaaatactgaccaaagacagaaaaaaaaagtcctttgaaaacaagtcaatgtcagctcctccctgagcctgtgacatgaggggaaggtgcaggaatttcaagtttcttggagacaggattaaggactgagagcggcttccttcccaagtccttcttccactgtcagatacagggaagacagaatgaaaagactgatatgaaagcgctttgaacttttttaggctcaaaggagctttaaggatctaaagcattatgattatcttttagcagtgtgataatattgattatacaggggcctggtggagtgtccctggctgcatccacagagtccttgggagctgaaaatatttataagtattgttgtgtaaaggtccctggcagactgagattcagaaggagattcataaaggtagtgcaaggccccgaggttaagttttatcttaattatgtgttgggaagtggctttccagggtcagagccccaggggaagagaagcaaatgtcccttcccagcagaccctcaccctcctgacagaagcatgctctgtgtcatctttaccttggcttctgcctctggaatttatgcttctaagccttggcctaaggcttcaccaggagaaattattattaatgataataataataatggtaagtcagctgacagcgtcgctaatgtcccaggggagaaagcataagaaaattgcctctcacataaacactttctgctatagctgctgaggtgggaagagcacagatttcagagtcagagaaaatggggtgcaagtatccgccctgatatgtccagtctctggctaggcccttgacttttttaagttctcaagttccttatctgtaaatgtaggtaatacaaacatctacttgatagtgttgtaaaattccaaggagaaggaacattcagctgagtgcccagcacgtaatggccgtcaagtgacattaggtattattaatattggccttattggcagtctttagaaagcctcagagtcacctctcaataattttaaaaggcagatacgggagcccacacccaagatgaatgaatccaaatctttaggaaggtggaattcaggtatctgtattttccttactgtattatgtgttacttttttaaaaaaattaaatttgttttgtgatttatttatttatttatttaattatttgagacagggtctcactctttctcccaggctggagtgcagtgacacaatttcgggtcactgcagcctgaactcccaggctcaagcaatcctcccacctcagcctcccaagtagctgagactacaggtccctacaggtccatgctaccacgcctgactaagttttgtattctttttgtagaggtggggtttctctatgttacccatgctggtattgaactcctaaggctcaaacgatcctactgccttggcttcccaagatgctgggattacaggcatgagcccccatgcccggccttgtattttatatatacacataaagagagagggagagagacaaggtcttcctctgtcactcaggctggagtgcatggcatgatcacagttcactgtagccttgacgtcttgggaacaagcgatcctcctgcctcaacctcctgagtagctggaactactaccagcatgtgccactatgcctggctaagttttataaatttttttgtagagatgaggtctccctatgttgccctggctggtctcaaactcctgggttcaagcagtcctcccaccttggcttcccaaagtgttgggattataggcatgagccactgcacacggtgagtgttacttctgattctggatttgtaccaagaatcagaaccacttggcctcacccacagtgtttgcaaggctgcacgtagatggtgcttgtcaattacctagagtggtgcccagaactcagcgtggggaaatcgtggcattagagaatgttctcggagcccagtcctctccctgtggtagatggcctttcctgcctccatgtgagcagttaatcacctgcagcagcaacttggtgctctatcctcccccagcatgaacatgagccgttacatgttggggataattgaaggtgaactacagagctggatggactcccctgtccagaaaacaagtaaccaatgaggtaggagttctacatgggttcaaggcgagaattgtaaagatcgttttctgctggtgctagggacattattttagggatgtgtgattctggccttggaagccaaccctggttcaaagcaataactcacatgtaataaacttacagagttatgaccctaggatcggagattttctcttgctcatctggctactttagctgcatcaggtgtttaagtgtagaaatgagaaacgtttcagggagattgcacatacaaagcttcctgtggatgcccagcctaatttacagtcatttttgttaaattatcatatgtactaccatggtaaggctggaaaacgagtccattctctgcttagcttctaggtggagaaatagtcacaaagataaggcttttgcatgtggacttatatggaattagggtttagaaaatataaacaacttgctaaactttgtcacttttccaatgagctaaatggaacttattcatccccttaataatgatgtgtatttgttggggttttaaaagtaaatacactagctatagagaaagcattacttgagtgaatggatgtcctctaatcaatgtttgatttctgaagtatgcttttaatttctcaaagtgcttttacatatattatctcatcgatttacacaatggtcctgtgtagcagagaagcaggtattatgtaattcctatattctatacatagaacagatgcttagtttattaattcaggggcgtgtagtacatttctagggcttctgaattcagtcttctgaatctcaagcctgtgccctttgtgcaagttgaccctgacccttttctttttatttttttattagatggagtttcacttttgttgcccaggctggagagcagtggcgcgatctcggctcacgcaatctccgcctcccgggttcaagagattctcctgcctcagcctcccaagtagctgggaatacaggcacgtaccaccatgcccagctaatttatctagcagagacggggtttcaccatgttggccaggccagtttcgaactcctgacctcaggtaatccacccacctcggcttctgaaagtgctgagattacaggcatgagccaccacaattggccccctgaccctttaaaaaagttacacctccattgtgagaaaatatgtattgtattaattgggcattggaggtggaggactggaaaagcataaaagcgtttcttgtgtgactgctcagagagaaggtcgtttctttgtctctgtctctctctgtttcactctcatccttagtggtaacgaatctttgtgcatcctcttgggctcttttaagtggtttccacagtagatatagggccactttagattgcatttcaagattggttgctggagcaggaaaagagaatatgacatatagagtggctatctctactgataaaataagatgggcatgggggaagggtcaccaatgggagtggctctaggcatgcttcaaggaagaataaacagcctgactgggaagtctttcccagttttgcagcagacttgaatctttttggtgtgatcacaatgtctgacttctcattgcctatgctgtgtgcaaggtctgagctgctgattgggtctcattttacagatatcccaatcatgacctccaaatggatgcctgattgtgtctacacccaagacattggcaaaagattctgaataatgtgtgggaaattcagaatctggctgcctgaatcagatgtgaaacaaagactccagggtctctgtactgaggaccacagactcagaaactccctttcctttttactgtcacctccatccttggttacggcatggcctgaatatcagcactgagtgcatcccgatgttataattacaagaggaattattatgaggcaaaacaataggcaggctggaaaatgggggagtagaggcctgaatgagtcctgcttctttctgcttacttgtcaaatcctgtgtctcagatatgccctctccacagccatcctaattgataactcaagcatcactcttttttttcccttcttttgtttttaagctgataagtgtggaatccagactctggtctagtttcttctttgtgtctgctctggctcaggcagaatagccttctagtccgcagcatggtctttgaagagactttacaagattcctgtacctgtattgacctgccttcagatgttggatctaactagttcattttccagccagcccccactcttttgaacttcccttgcttgctttctcattacccacccctccctctagctcagatacccaatgttgcatggtccatctgtaccactcaatattctggatatcagcttagccattcaacttagcactaatgcaaacatcctcatttacatggaatgcacagaaggtgacattctgtctgtaacaataggttataattatcatgtctctcatttgtattccattttatagcttcttgaattgttttcacacgcataaccccatttgattattctcagagtgttgagaggtgggcaaatattctttcattccttcactcaccaaatattgattgaggggctggggaagccaaggtgatgaagacaggcaggcatgattcctgtcctagtggagcttatattctagacaaaatggattttgatttgacagcgaaacggaggctcagggaagttaaaagactcgagtcacccatgcagtaagtgcaagaatggggactggaacctggatcttcagatgcttaccccagggctccctctaagtctccttgctgtttctcagaggatgcaggaagtcctcattctgcacgtgggctgtagttcagaagtcctttttttaagctgagtacttagaattcagtacacattttcccatagaaattatgttataaatggttactatgctacaaggccatccaacaaaagcccagttaacccattgaacccataatgtagctgaagcatgctattaataggacaattccttccactgctacaccattggggaggaatttcactggactcattcaaaattgatgctgtgtgaataaattcactctttggcctttggatttcctcagtgactcactgtaggcatgacactgtgctggtgtaaggggctctctttcctccatttgcatactttcctcatctttcctgctttctctatttttgtatgtgttgcaagaagctaatgtgtataagcaccaggcttcatttgtatggattgcatgctactaaatgagtaagtgcttgtctggcttaaggacaaatatatggctgtttccatagatacccgaccttaataactaattaggacaacaacacattttccaaagcctatttcagggcatctcagatacagcatcccacaaatgtcctgtattgtaggtgcattttcctttttatttctctgcagaagtatcaataaacaaactataatgcctttagtagagactaaatgaatagaaatgagttttacctggtgatgtcttgaagtagtgctagataaatagattatgcctcacctgctcttctgaacaagaatcagatgcgctctcctcagggccacttcatgaggagaagccctgagtttcaaattgagagccaggggacatatctcttctctcttattcccttccactgccctcttctcccatttgaggcttcactgggacctagaacctgcttgttagggagctgtagagttagttatgaccagcccaactcttctttactttcaggtcttcataggaggctgcatctttagttttatttctgggttagcacctgagaggtgaacctgcttgttagggagctgtggagttagttaagaccagcccaactcttctttactttcagatcttcataggaggctgcatctttagttttatttctgggttagcacctgagaggtgaacctgcttgttagggagctgtggagttagttatgaccaacccaactcttctttactttcaggtcttcataggaggctgcatctttagttttatttctgggttagcacctgagaggtgaacctgcttgttagggagctgtggagttagttatgaccagcccaactcttctttactttcaggtcttcataggaggctgcatctttagttttatttctgggttagaacccgagaggtgaacctgcttgttagggagctgtggagttagttatgaccagcccaactcttctttactttcaggtcttcataggaggctgcatctttagttttatttctgggttagcacccgagaggtgaacctgcttgttagggagctgtggagttagttatgaccagcccaactcttctttactttcaggtcttcataggaggctgcatctttagttttatttcttggttagcacctaagaggtgaacctgcttgttagggagctgtggaggtagttatgaccagcccaactcttctttactttcaggtcttcataggaggctgcacctttagttttatttctgggttagtacctaaaaggtggtgaatagagtcttcaacttctatcgtcgtcaacagttgcattatagaatctccagataataaaacatcacatttctaagtgacctagaattcctttagcgctggcaaagaagggacttccaaaaataataatatatattaaacatctagcacatggaggcatagttctaggtgctttataaagattcttttaagtctacctgataatcagatattaaaacttttgagatattatcaataaagatattatcaattttaaggtaaacaaactaagctgaaaagtttaggtgatttttctaagatcaaaaagattgtaagtggtagaggtgggtcttggaaccaggagtccactgggcggcattacaccaagaagttcaaaggactctgggaaacaacaaatgtctcatctctttgatgtctgtccagcatacttctgtggtgtccaggatagccacgcaatttgatttatgaacatccttagatcttgaccctttcttagaaacttggggagcaggaagagctttttaaaaatccttccaaatacagttgatctatgatggttaactttgattctatcctttgtgtcttatgacagctgccagtcattgttggcatgaaatggattcctactttatctctacgacttagaagctttatatgtacactacccttaaaagaaaaaaaaaaatctccaaaacctacctactcagcattctttttttcaagtacatatgtctcagtccattttggtgtttctataaaggaataactgaggttgagtaatttataaatagaagaggtttatttggctcatgattttgtgggctgtacaagagcatggcatcagcattggcttccgttgaggtctcaggaagcttccgatcatgatggaaggggaagggaaaccagtgtgtgcagagatcacgggtaagaagaaggaagcaagagaaagaagcaaggtgcttggccaggcgtggtggctcatgcctgtaatcctggcactttgggaggctgaggtgggtggatcacgaggtcaggagtttgaggccagcctggccaatatggtgaaaccccatctttactaaaaataagccgggcatggtagcatgtgcctgtagtcccagctacttgggaggctgaggcagaagaatcacttggacccgggaagtggaggttgcagtgagccaagatcgtgccactgtactccagcctgggtgacagagtgagactccatctcagaaataaataaataaataaataaataaataaataaataaataaatgcagaagaagcaaggtgccagtctttttttttttttttttttttttttttttttttttttttgagacgggagtctcgctctgtcgcccaggctggagtgcagtggcggcgcaatctcggctcactgcaagctccgcctcccaggttcaagccattctcctgcctcagcctcccgagtagctgggactgcaagggcccgaggtgccaggcttatttaaatgaccagcccgtagggggactcttgtgggaactaacagcaagaactcactcattactgtgaggacagcaccaaaacattcaagagggatccaccttcatgacccacacacctctcattaggctcccctcccactaggctcccctcccatactgaggatcacatttgaacatgaggtttggagggtcagctgtccaaactagagcagcattccaaaaggactctgtgcatatatgagttgaaacatgctgccctgtcctcagaatgtaattaagaccccctgtttccattcctctctactatctgcttccccctttgtaattgctgaagacctttatgcctggatttttcataaattcatgtttctctcatttctaatataataataggtcaaacatcctttgaaattataagcaaattaaaatttaaattgacgtgatttatatgaaaggatcgccaggcagatatatgaaaagactacagtggaaagtgactctgggttcctggattagagagatgtataattttatgactgctaatcagcttcgtcaacgtatgttaatttactgcttgggtcatccgggatctcttcccctcccagacttagcatccccggctgacttttgagtgagttcaaatttccttgggaccattgattactgcaattactgggagaatgagaaaagattttggagagctaagtcaagccctgtacgctctcagttggcttgtaagtcaggtgaccaaatgcattgctaacagtatttgcagaacaacaagaaaaaaaaaaaagcctccttgttgatatttgtggtgtttcatttttagctaatgtaagtctagaaataaaatggtctgctgagatctttactgatatgtatttcataacaaccactgagcaattcacagttgaattgatgagctatcagggttatgtgtttctgtaaaacagagacatctaccttggaaaagctttctccagggaaacagacctatttgagctaaagtaaaacaagattaaagtgtgattaaagtgctgcaaatacgacctacgtggaaaggttggaagaactgggattatttaacctgggacagaaaagctgcaaagagatttcaggaaaacttcaagtgtccaaaaccctgactccactcagtgctttccttggcctccatagattatagagcagcaagcatgatcttaagctgtattattagggttttaggtcagtcaatggccttcaagccccagctgctgcacgttaaaatcacttagcagccatttaaaacatgctaatgcctgggttctactctagactgatgaatatccagaggtgacgaccaagcattagtatttcttaaaagctctgctggtgattttaatatgtaaccagagctatgagttactgggttaactagaggaaaacagttcctgaccacacatgcctcagaaacatgaaagcatctaccacatttttaaaatctgagtgcatcatctttgagatggattgcttgtggttgtaccagccgacttagtgtccctttttctggattggccattctttctgctaagtggccagggagcatgagatcacagatagtatctcagtgtaggttctagaaagatatttgttgaatgaatgagtgaacaaataaatgtcaagagaactcctaggacattagctgacagtttgtaatactagttgtcagaggtgggtttcgagaatggcttcccaaaagcaaatgatggttaaagtaagaaagtgtcaccagattttatgattcaaaaataacagctaaacttcaagactttcataacaaaacatggtaaagatagcagtcagaattcaaaagtgaacaaggaaggcagtaatgtagaagtgttggtagtgtatgttgatcactcctttatgaagtttagaagaaaaggaagggtcaggcgcagtggctgattcctgtaatcccagcactttgggaggccgaagtgggcagatcacttaaggtcaggagttcagggccagcctggccaacatggtgaaaaccccatctctactaaaaacacaaaaattagccaggtgtgtggcacatgtctgtaataccagctactcaggaggctgagacagaagaatagcttgaacccaggtggcagaggttgcagtgagccaagccactgcactctagcctggctgacagagcgagactccatctcaaaaaaaaaaaaaaaaaaaaaaagaataagaagaagaaaaggaaggaagaagagacattaaggtatatctggaagtgaaagaattctctgtgcagtttgaaaatagagaaatggggtgggtggggagagtaagatgctgaacagggtagcatagctgagggaggaagactgcagaggggacaaggttgagaacactgcagaggacttctcccataattcagcaataattcgggtagtgtgcctttggtctagttagcttctgttgtgtaagaaaccatcctgatttgtggatggggaatttgggcagaactcagcttggtgatcctcccactccatgtggtctcagttaggcctagcaatgacatttgcctggtgactgggctggtctaggggatccaagacagcttcgctctcacgccttgctgctgtggaaggccatgcccacatgggctccttcttctctgtggtgtctcaagatgtttctacacgatctttccagtaggaatgctgggccttcagtggcagcatcaagctccaagagacgaaggtgggggctctcggtcctcccaggctgggcctggtgctgacatgtgatcccttctgctgcactctgttagtatagcaaggcaccaagcccagcccagactcagagaaaggggaaatgtaatccacctctcagcgacaggactatcaaacaactcatagtcatctttaatccaccagggtcatgctctagaaaggataagcacagaagaacagttttgaagtagaaaatagtaaaagtgactagccatagccgctgattaaccaattaatcttgaactgttttctcctctgtaaagtgtggttaatagtaagacctgcctgagtctgagactgggttttccaggagacagaatctgagacgtaatttagcaaataagttgctgattggggagtgcccttgaaatcagcacctgtggaaaggtggaagaggaagcaggaatgaacagagggacaattcagactatgacactgatcagtggcggccgggaccagccccacagcaggggctggagtgaggatgacctaactctttgggcccttggtttctctgagcctgggttgccttagctgtgaaaggggtcaatagttcttgcctaatggcactgtcatgaggattgagtgagagcacacatgcacctgcacacaggaaacctggtacaggggatgcctgataaatgtttaaggtgatgggatgtatcctaagtaatttctgaatggagtaagggggcagtaattactcatcagagtaattctcagggggcgggtattgccagacctctacgcttaatcttgaatgtggccacctggggaagggacatggccccagagaggtctctctccagcaggattgatccccaaaagggctgagagccataaccacctgtctgccaagggcactctgggcagctgagcaacaatctctctctgaagtgggacgtgggtgctgaccccggtgcccatcacagggcattggcaatgcttataatgcgccggaaatcgcatcctgtacattggaagctctgtttgaatgtcagctgctgttgaccagtggttgccataaagggtttgcaggcgagacaagggaagtggtttgctgaatgatgatgtggagaaggaccagaagatagctagtgcttctgtgcaggggccacaccagcatttagcacagtcggggtgggccaggagtcaaaggtagccagaaggagcctagctaatggactgggcaaatttggaaaattgctaatacattcacagactggtgtcagtaaggtggcgctctcttcactgtgtgaatgaatgaaaaggtcatccgactacactgctttgctttcccgtgattattcagcatcactggggcatgaggtaatgggaagataatgggctctgggttcagatcccagctttgctgtttcctagatgtatgaactttggcaaggtaattaatctctctgatcttcagctccctcattttaaaatggagatcacaataacaaacttgtagggttacttaacagtaatgtgtgtgtgtgtgtgcatgtatatatacatacactttgcctggaaagaaatgcctgagatcaacaagtaaacgtttctatgctacgtggagttacttgcaaactgtctcatggctccattcagaaattacctaggctgcatcccacggtgttgagattcaacgtaaacatttatcaagcatccattgtaccaggctccctgttgtacaggtgcaggtgtgctctggctcaatcctcacaacagtgccattaggcaagaactattgacccatttcacagtgaaggcaactgagactcagagaagccaagagcccaaggtgtgagttagcacataaatgacacagtcagaatatgagcccatgtctttggactcccagtctgacccccactttactgcagcgcagtagaaaagacagtcaccctaaattgaggcacaggttaagtatttctctgcaccccagctggggatggctgattgggcaggtgtgggtccacagtggtactcacagtaggacaggtcaggtgtgtgtttcaggtgggctaatcaccatagatgggagcgtgcatctccaatgtccgcttggattgtcagctttctttggaataattaagagaaggtaaaggaagaggaaaaggagtaaagaaatcatctttgtacattttaatctgagctgttttcgagcagtgtgataaggtaggttgtcgaaatgtcagcttctccttatctctaattgacttaagtagaggcagctctaatccttgtgtgcacaggagcctggaatggagagatgaggccaattgattcctactttttaattaacaggtgagctgcttaaaaacaatagtatattgggggcaggttgggaacaggaaggaatgtgagggagggtcatctccaccacagtggcatttagagaaatattaacaagtgtcagcatttgatttgaatcaggggctggagcagagggaaaagttatgtcttatgcatgggtgtggtcacaaaagactgctgccaaagtgacaaaaaatatttatacttctctccatacacaaatggaaagacccttcgatttttgaagtatcatgagggagacctcgaggtattcccttgtgcaaattgctcctcatactgtccccccatgttgcagccaggagcagtttagttggtgatttcagtcctatctagtccgagcaatgacaagtcagcctggcaacctcttacaagtctcacccagccagtgcatcaaatctggaggaactttgcccacactgtgtctgatgtacctatgtgtaacccccctggtctcccagagctgactagctattctcgtcgtatgtgctggttctaaatggctaaggctcctgtcctcattcccttgggtctccttattctgaacccaacctgtttggctgatgccctcattccctacaaaacagtttttattcccccacccctgggggctggattttatattctggacccttctccccttacttcatctctagttctataaccaacagcttggtgacatctatgatcacagttctcttctgcattcactgcacatgaccaccacctggatattcttatcaccatgcctcttccatttcccaaattagtttcctggcatactcttacctggatggattacactgagatttgctctatttcctggatataggccattgaactctgttctgccttagttggggatagagaaggaggaaaaagcctcattattgaatttgcttcccaagacccatccttggaaaaagccatcttatgtaatttctttctttcctgctatttctaacatcccagagttcttcagagccaagcaaccatggatcatgatgcttacaacgttatgggagcatgcactcaaatacacgggacttttaactagtgttcttagtatattaatagatgagaggcaggggtgtggactagacggtctctgaatattttcctttccaggatttaacaatctgactctttggtagatttggaaagcgataaatcaaataactattgaggatgttcagcccattgatcatgtactagttgagtatccctaacctaaaaatctgaaatctgaaatgttccaaaatctgaaatgttttgagcatcaacagaaggctcaaaggaaatgctcattgtgacccttcaagttttcagatgagaaatgctcaactggtataatgcaaatgttccaaatttttttaaaaaatctaaaacctggaagacttctggtcccaaggattgcagataaggtgtaactttcacctctctatctttatgcttgttttcattttgtctgtttttatttaacttcttaaaatcttccccaaagttctgttatcagggagacatcttggtctgggaatatgccttccctcttcaatagaattcatgtaagtttcctgaggattggcactgtgtttgatccattgagatagctccgtaataaaaataactggcatttattaagcacttactttgtgtctgaaattgtgctgtgccctttacatgtttagttcccttaatgctcacatctgttctatgagagaggtgttcttcttatctgcattttataattaaggaaatagaagctaggggatgttaagaaactttcacaggttcacacagctactcagtgccacagatgcttcaccaatatgcaatacagtcttcctgcagctatcccggtgcccatgatgacttcttattctgtgtttgttgaatgaatgttgtgttaaggcatggattctgtttccagttctgctgctaactggagtaatctcctcgaaataattgagctcattctttttatctaccgcctcccacagatcccagtacagagtaagtattcagtaagtatttaataaatgcatgctaaataaatgggtgaatgagtgcttgatcccagaattctcttctacatctaacagcctatgactgtagcttatatggatctcctcttccctgacctctcatagcacacttgatgtttagacatttgatttgatttgatttcatcttttgttggttctaactgtttagtgtgtgtgttttgtatttccgaatagattacattttatttccttggtattccccacagtgcctagcccagtgcctagatgtcatgagtgctcagtaaatatatattgcaatgggattgagtatcgcttcagcacacttcaagccagaagaaacactgaaattagtcacctcctgggctattgttttcctctttagagaagctgtcatgcagtttctgctaaacagatgttttggacaggtcagggagcagaatccaggctgcggctaatggcacaatttgacatcctgccacagtttacccacccatctgcccataagggctggtccccagatagaaagggtatttacgaagctcttagtaaatccagaggacaatcatgtaaaagatagactcttagataattgataaaatttctctgagtgagtggaacccttaggttgttgtaaacatgtgtacatgcttgcacgtgcacacacaagactcaactttgaaccttgagggaaaaattagactctcaaccttgctcctttctgatgaatgggaacaaaaccaattctcagagggtaaataggatggggaaatgcagacaggctcatcagtgcccaaggaaaccaagaagggccaccggagtgtcaaggctctccagggaaaatgtgggtttctacagcatgggagactccagagactttaacacgcaccaactgaaatcaaggctgctcggtgcatgtgttggtttcatggcatggatatttatacaagaaagataaaccctctaggaagtgattaagagaaaaatcaaaagaaagactgaaaagcctgggcctggagtgacgcccacctacccttagatacctcccctgtacctaatggacttgatattctttgcaaataggcataatcactactgttttgcaatttcgtgaataatctacccttggagggaatgaagtttcttatcctattctgccagcctcctcagccaccctccctctcccccagcctataatctaaggactccacctctccccctcacacactattacagagtttgtttgaggagtgtacaagtgccttctagaaagaggcagactgggtattcgtttactctagtgctatcatccctccccattggatgcatctgaggaaggtgaattacttggggctgcctctatatcttaaaatccttccacacgtcagatagaaaatcactttgcaattatatttttaccaggcactttaaggcaaggacagtgtccccttcatctgagaccctctggtgcctggcacagggcatggtgcttagtaggtatttaataaatacttgctgagtgcatgaatgaaagaaattctaggaaggtttgagatatacctagactagtgtggtggatgttttatatcctttttaaatctactttctaccctatgagaatgttgagcatatgagaattcaagggcaaaaagaaaaaagaatgaatttactgtgaaagtcatctagtaaagttgagtgcctttctcaaaaaaaaaaaaaaaaaagactgaccagttcttttactgggggacttgaaagcttacaaaagagaaaggagggtgggaaaaaggagggaagggaaaacactttccccactatagggagggctggaactgtgaacaaaagccctatgattcacccaagaatagaagcttaaaggactccaactacatgccaaggcgccagaggtcctgccagcctcagctcatgtggggcatttgccctttgatgcagccaagaaagggatttcagcagcaaatggtgaccttagaacagctgtgctggagggccaacgacccccttaacctcaccctgaccctaactccctcccctcctaaatgctaaagggagcaaatgaaagagttaatgattagactagaaaaatcaagactgtgttgtccatagaattacttatcagaaaaaaatacggaggcaattaaggaagaaatgtaaactataccttgctagaggtgggagagaagggagaacagtagtgggaggtagggatgaccagtgagcacagagatgatggaggcttctgcaatagatggctcagcacacactcagtgcctgccacgagcaacggcttctctggccaccatttaaagggaacctgttatttccacttcatagatgagaaagctgaggctttggcaaagccgagtgacaagaccaaggctccactgccagaccagagccagaatttttaattcttttagacaggatctcactttgttgccaaggctagatgcaatggtgtgattatggctcactgcagccttgatctcctgagctcaagtgatcctcctacctcagcctcctgagaaatagctgggactataggtgcatgccaccatgctctgctaattttttttgggggggaggtgggggtaaagatagggtttcaccttgttgcccaggtggatctcaaacttctggactcaagtgatcctcctgcctcagactcctgaagtgccgggattacaggcatgaactgctgtgctcttcccagaatcaggatttaatgctaagtgtgtcagatgtcattgcaaagtgtagtgaagtggaacttaaggagggaaggaaacactttcttttatctttcttgatgtttctctttcactattgcaattgtaacagctttctctgagctgttaagactgcctgttctcttggcatagaactaaaataaaactaaacataagccaacctgaataattaaatatttatcgaatttctactatgagttaggagtgttactctgagctggggatacaaagtgagtaaaacaccgaggtagagggttttcataagatggaggtgaaatgctttaagaaagcaagtatgggaacattaagtcttctgataggaggggaattaactgaagcttctgcaataagctgttattttggagggcaagatagggaacggcatttcagacagaaggaaccgcatgcacagaagtgtggagtctgacagctcctgcatttcaagtgcagggattcctccaggctgtttgctggggagaaaggaaaggtcatagtcagcctgcaagatctgctgccttcatgtatgtgtgttgcttggtttttggagtagtggtgtttgtggtgattttcatttattgtagtaaaatatacataacatcaaatttaccactttaaccattttaaacgtaaaatttactggcattaactacgttcacagtgttgcacaactattacaaccatctccagaattttttttaaatcatcccaaacagaaaatacatccccattaaacaagaactccccattctccaccccactcctccagctcctggtaactttctgtttctctgaatttgcctattctaggcattttatggaagtgaaatcattcattcgtcatttttagctggcttgtttcatttagcgtaaggttttcaagatgtatctatgttgtagcgggtatcggaactctactcctttttgtggctgaaaactcctccagtgtatgcatatatcacattgtgatcacccactcctctgtcatagacactgggttgtttccactttggggctactgtgaataatgctgctatgagcactggtctacatgtatctgttcaagtccctgctttctattcctttaggtgtatacccagaagtggaagagcagggtcaaatggtaacttgacgtttcatttatttgaggaactgctaagctgtcttccacagcaactgcaccattgtacattctcaccaacagtgtacaagggttctggtttctcgacatcctcagtagcactgactgttttctatttttctttttacataacacattctaatgggtgtgaagcactatcttattgtggttttgatttgcatttctctaatgatcagtgatgctgaatgttattttcatgtgtttatggcctggtatgtatcttttttggagaaacgtctattcaagtcctttcctcttttttaagttgagtttttcattgttgttttgttgttgaatatataagttgtgactaccaggagatctagtattggaacaaaatgtcaccactaaaggtgcaggcttatttttgtttaagtttaataaaacacagctctgccttgctgagatgtgagactgaaaaaaatatttaaataatttttattgttgttgttcttgttcttgttcttatacattttcctgaataagtgactcttctagactcccccatggccaaaagtaataaaactcatagcagaagtgggaatggcaagctaaataacaacccaggaaaaccactgcaaaatcgtctgcagatgtaaatcatactttgtgaaagccattggattagaaacacattatccttgtctgattcgctcacacccacatgttcctagtaagcgtcgagcgtgatttacaccctgacatttaaggaactgggaaagggtgatgctgcgcggccttgataaatgcctttctctgtgtctgttacaccagcccaggagagaatggggtagacgtctccatcactgaaatggggggcctgggccttctgcttaaatggcttctctgcccagccctgactcaatcaggaaaagcaaagtagctgcttggcccaatgactatagcccaggattggaagatcagaatttctggcttcaaatcctcacctgcccgtgtcattgaggtgggcttagagcatcccttctgtgaaatgggggcaggagtcgtggctacaggattgttttatgcttcctgtgaaataaggcaggttctacatgcatagtcaatctgccaggaaatacagttggagagatagatgctgcaggaggaaagaaagctcacaacaaggggagaagaggctacaagcagccacgcagacattgaaaaacaaaccgcaggttttgtccagcaacaaaagccaatgatatctaagaactagaagtgtatttgctgtgttttcccatagatttgaagccccctgtcccacgacacagtcttccccacccagggagggatccagggacgcgtgtatttctccgttcacctctcattccttactgggccttggcatttccaggcagtgctgctccataaacactcatcctaatggctcctctggggtctggaggggggcggttagctgcattcgtgaattcagcattcagtccctcatatccttcaattcaagtgaacagctggcagtagatagtgatagcaaggaaagaagccatcactttgttggatgtttccctgaataataagtgaactgcttacgacatttctgagagcatccaaacagccatcacccagccacggccacgaccaggctactcagcagggggagcagcctctctagagtttgaaacatgggtgaagtggaagctctcctgatgctcatggatatgaacactaagacatcagaccagacacacatgcacacatgcatgcacacacatgcacacacacacacgcaccccacacactttagaattaagttttagttattagcttgtgaagcatccctgaatcttggtcccctcctctttaagatgggggtaacaccttaccaacgatctcctggtaacattaaatagggcaggatgtgagacagtctctggtacatcataggttttcaaaaatgtttagtcctttagctcctcacccaacataaaagaaaatcttgcgcttgttcctttgcccagataacaaaccttattctgatattttggggacagcacaggactggaagaaaaaaagaaacttttctaaccgtcacattgatttcccttttgggcacacagagccattactgaaaagtcacttgctgaagtggttgtactgtggcctcttcaggaagggggatgtgctaaggccaagccaggctgctggagtgcctggagcacaaagcccttctgagcatgctgagcccttgatgactggcgtggactcggcccccactccctgcacaatcatgcagcacaaatccctgtattttcaatggaaggagccgctccagtggcgctgaagaaagatggaaaaaatccttttcttgcaggcaggtttgctctgcaaccaccactgaaggtgttttaaaattcaccttgagtttgcctctcaggtccttgatgctgctcgcggagggaaggtagacgaaggaggctcgttcgtctgcgtgccattgtgtctagggtggtcccggggacaggtgttagctctctgggacagccaaaggacgatgggccctcagcagaaggaggacttaattaatcggtgcattgattgcctactgtgagtcaggtgctgtgctagtggaggcaggggaacaaggcactatcttgtcttccggcatcttaaattctagccaagggtgtaaacagttatatggcaataaaagaaataaataacaactcaaatcaataatatgggaaatgtcacactatactctggtccatgattgaaacggagaggacattaggggctatgggaagagatcagttattagctgcttcctgcaggcctctgaccataaaacaagcaaatatttctaaggacccctatgctcatcgcctcgtctgatgctattttgaaattcttgtcagtctgttaactgctatacaaatggcataaaggttcttatgagaatccctgtcccctcccattccaggtgcacaggcttcacacttaagtcctcaaaggaaagaaggcaaacattgcaattaccccaagaggagcttagcatgccacatgctctgtgtgtatctcccttggaacagttatcacagagccttgattctcacctgcctccctcatgggaccacagactattcaaagaaagggcctggtcgaatctgcttctgtagcttctccttggccaccgcttgggataatgactgacacatagaaaccacgccgaaaacatggttgaacgagtgcttatagaatgctactgacttactgtgttgccactggcatataggtctgatatccgtggaagaactgctaagagtggacaatgttttgccagaaagaatgaatgcttccttgtcaaaaagccagtattgtaacagaggtgtgggttgggtggttgggtagtagcactcaccttatttccacttttcctcaatagaataacttgcggggtggggtctgtgtttaaccgtatcttccctaaggcagttccaataggcaaatgggtacttgcaccccaacagccataggaggagggttcttgttcttgttcaggttgggcagaagagatgggcaggggtacaaggtggtaaagtgcaaggtacttgtacccctaaaatttcccaagcctgctatgtgaatgctgtccagccctgatggcaaatcagaaaagtggatgcccaggagagagcaaaccaatggcacatgagcagacagcaccaacaatgagcgattatttgtggagcacgcattacatttactcagcatcaccctggttactgggggacatgcacatagagtatggagcccacaggtagtaagtgctttattagagtttgttaagtaaacatgtaattacatagaagataaactaaagtttttattatttttatatgaaagttatcaaacatacagaaaagatgaaagatttttacagttaagacccataaacccatcactagattctacaattaacacttaatttaattctctttatcagaaatttacctgctactcatccatcaatctgacacttttgattgtataaaggtagattctacttgaggaaacatgatgtatacgcatgaaacaattactcagtattttctaggacaacgctaaatagtgagacagaggcacacgtctggatggagttaagaaggtgatcatccgtgaggaataatatgttcagagactgtgtcatggagggaagtgggcctggaagaatgtacaagatttgcgtaggaaaagggagaaagggtggtctttaggtgtgcggagtcatataaataatgcccggggggacccagcccagaggaaaggtgagtggcatccctctgcccagtgttacacctggcttccagccagcctgaggctgttctggtgcccgtgaactcagaccaccctcatcatcctaaacatcaccgacctgggggatgaaagctcagtatgaatacctccgaggcactgcagaccttgagggagctgggtgcctctcttgctgagtgactcatagtaggcattcaagagaaaggtccacagggatgagcttcttcatctagagtgaagtttaaaaaaaaaaaaaaaacaattgagttggatatgtgtgaaacatgggaaattgaaaaacaaaaaggaaatgagtgaatttgaggccccatcttgacaacccctgataaagaccagagagcttgtctgcctgtctcccaagcaggggcagtaacatagacctgactgaaagcaacacgtgagcctgaggaagagctgccaccttccggtggggcacccacaatagacagctgcgcagggtataagcaacttgtgcgtccggggctgacagagccgctaaacaaccacacctcctcccaggtgccatcttgggaagaggcttctgaagatcagcttcaaaaggctcttattacttaaggtccttcctgggacatttgctggtaatgggagtcagatgcaatcctcgcttgtgcttaaaaggcagacaagatggtgcagagcaattactgagtatgtctgcacaattttgaaaaccagctacctgtcccttggcaggagaggctttggctgcctgcagctggaatgctctaccttgcctttgtttttctcttttcttccgctgtctcccggcactgccctcccaattcacctgcattgtttctacctccttccagtcactgcactaagcatggattccatctgttcggggctccctggagaaggaacacacaccttcactctgcagtagtcacccagtgctgcgctggtcagcacacaagcaggggaccctgtactgacagaacaaaggacagctgtcctgtgagtggtccagccatgctcgggccgggaggaattcatgcagcacacaagagggataagcacattcattttgtgacgcagcctctgtgtactttgtcagcaaaatggagaacactcactattttctctggcttttaggatttccatatttattgcttgtttgctaccactggggagaagggaagaggagaaaacaacaactttcttcatttgaaattttaaaacatgaacatgtgaggtttaccctccctcccctgttcccctgcaattccagcaatgcacaggactgtagaatgttacagctggaagcccttgagaaatctaaacaatagtgcctcattttacacgcgagaaaatcacggacaggaggtgaaggggcatggtcaaagtcacatacctagttagtggcagccctgagactagcattggtgtctgcagaatcttatttttcttattgctgtgctatgtgggttctgtttctattcaagtcaagaatcctaccacgtgtaggagatcctactctgtatatggtactgtgcaagacgctatccactacctgctttaatcctgccagtgccccgctggggtaggatttacttccatcggttcagttgttatagttagtgcctgatcacggggctggaggagctctggagcagagctcaggcaaaggctgttggttctctctggactgtcctgtcctgtaaaggtggacatacaggataaacacgaagcagtaaggagcaaagtgcctggctggcaggaacacactagttgtttgttaaagggcaaggtgggaatgatgttggtcaatgggtacaaaatttcagctagagggaataagtttttgagctctattgtacagcatggggactacagttaataatgtgttgcacatttcaaaattgctaagagagtaaatttcaaatgttctcaccataaaaataagtatgtgaagggattgggcatgttaacttagcttttttttttttttttttttaatttttttgagaaaaggtcttgctctgtttcccaggctggagtgcagtgatgtaatcacagctcaccgcagtctctacctcccagtatcaagcaatcctcccacctcagcctccttagtagctgggacttcaagcgcatgccaccatacccagctaatttttgtttgtttgtttgtttttgcagagatgacgttctacaatgttgctcaggttggtcttgcactcctgggctcaagcaatcctcctgcctcagcttcccaaagtggtaggattacaggcataagccaaaaagccaatccatcaaggagccaggaaggctttgcagaagttccttctggaagaatttcagccaatagccaatattgaaggaattagagggaaggtatttcaggcagaatggagaggaagaatcaggatgtgttcagggaagagcatgtaggcgaatgtgaatggggatgaacgcttgtgcaccaatagagaaaagtggggctggaaaggggttcagtaatttatgggatgatattaattggggcccatcatgtttggggcactcttgtaggcctgtgacttagcagacaaggatgggaagcacctactcacacacagatagtgccgtgatggccagggcctgagagcctaattccatgggaccatttgaggtaagacctgaatgacaagaagaagtgggctctgagaataatcagggccagagagctctccaggcaaagaaaaggaaagcaaagggctttgaggcaagaactagagaccctgtggaatgaatagaggtggacttaccagcaggagaggagctggggcatgggagtggaggtgagaccaggcagagcctgcagtgcactgcaggaggttgaactctatctgagctactaggagaatgagaggccctatgttatctggcctctgcctctatcctggacctcatctccatgggaaaaactcatctctgtttgtgcccaagactcttccagttttagcactgaaagtctcaaatccaaggaacacacgaagttccaggcaggcgggcagttggtcaccttagctcccacctcatccttgctcactacggtcctgtcacaacaatgtgggaacatgctgtggagtcccttaaaaagctctggctgattcattagaaaatgcatagcaactcaacatttctgaaaacaggactaacataattaaagctatttaagcttgttttttttttttttttttttttttttttgagacggagtctccctctgttgcccaggaaggagtgcagtggcataatcttggctcactgcaacatccgcctcctcagttcaactgattctcctgcctcaacctcccaagtagctgggactacaggcgcatgccaccatggccagctagttgttttgtattcttagtagagatggggtttcaccgtatcagccaggctggtctcaaactcctgacctcatgattcatctgcctcggcctcctaaagtattgggattacaggtgtgagccaccatggccagccagctatttaagcattttttaaagatactgacgacctccaaggccattcaacttacataaaaatgcctttctgtggaaatttgggcattcctttggctatggagagggtagtaggtcaattggcatggctgaatataaaaaagatcttctccgtccagatgtttctgttcacatcctcttgtgcagcatagtttggaatatttcatcttcattcttcaagacttaaaggtgtatcactacagtaaacagaacttaaaggaacaggcctttgcatggcagcccagctgaatctgcacaaggcccttatctaaagccagttgtgagagaaatacagtagcctctgtgctcattacctctagaattgcattttctagcttctcattaggaagcggtgacatcagaataggaccctgcccctttaagagtctttcccaagataatgggattcatgatctcacaatcacataaatcactgccagcccccttgagtcaattcatacttctgtagttcgttagtggcacgagaggaaattgcatttattataattgcctctaattgcaccagattagtgattacaattattgatggcagctgattattcattaggcatcaaatcaatccccgtgcttcttcattactcgaaacagtaactctgatgagaggtctaaaggaggccatgtccaccctttccactaaatggcaggctgcctccccgtcctgcctcgaaacaaacacctgaaaataatttaggacttaaagtgacagagaaccatccctcgccttccgccatgtaatgcctcatcccgaacccagcactaactgatgaaattacggaggctgttaaacatcaccaaagactatttggaggtcccagaacgctccagaattgctagcttttcctggatgcccttcttggttgcaaaatgaaaatttcagagtttcctgggttacttctggaatatatgttacctacaatacataaagagagtagaccttacagccacacaggccagacttaaatgagctatgtaaacctagtcgattttgtgagctatgtaaagtcagtcaattttgtgagctatgtaaagccagtcaattcgtgtgtgaatttttgggagctatgtaaagccagtcaattcacgtgtcctgtctgaactgtagaatagttgctagattgtgtataaacaagcaatgagatctctgcttctcttgttcaccatcagagtctatcatctaaaatagggcctgtagagaaaagaatacaatagccatctaaggagttaaatacctacctgcaggggttgtgatgatggctgaattagataacatatttaagactttgtgttgtaccaggtaaaaactagttgctcaattagcgtcatttcctctctcccctacttcctccatgctataacatctaaatttatatcctttatccagtgtgtctctttatacacaggctcaatgttaactaaatttatctttttggtgtgttcttcttggtgaacatcagtatatgtgtaatagaagtgcagcttccagaagactgttgcctcatttactggtagctacagcatgccaggcaccagatctagagggttagagagatcaacagagcataagtattgaccttgaacagctgacaactaaatgggaatgattgtccattctatttccatgtgttgtttgcattaaaggaatatccaagttctaatgagcccacaggggatggagagacccggcacagctcggaaggtcaagaaggcctcagagttagcttttgagatgagccttgaagctgcataaatttttccaagtgcctaacaggtcactagccttccaacacaccatgtagcacctgaagagacaagaagagagaaatgagcatgtcttcagaactgcactgtgaacttctaggtgcttgatacatgaagacagtgacaatgttaagtgccattttccagacgctcccatgggtaaaacttctgtaactaagcaatcttttcttctcttagctgctgacatctcagaaatgtggcgacatcttgaggttttcttctatgaacttctgtgaaaccttatgctgcctttggtgacacagaaccctaacctatcctttcctcaaattcccagctgacccaaatgtaccccctattttagcacccacatttatcagctccctctacttctcacaatcccccctacttccactagtgagttagttcaagagcctaagtgtctccaggtagcagagacattcagagcacaccattgtctatatcaatgcaggatttcctgaaaaccagggagggagggaaggaagaaagagcctctgggtgaggaggtgtgcagcctggctctttgtcaagtctttgtcccacgtgagagtcggtgctaatttccctggttgcttaggcttgagccctgtagtatgtctgacctacacccagatcctctagggatgtaagcacagtgattcccaaaacaatccaaaatacgaggcccatagcctggagaacatgtccctggtgccccttcctctggacgccttccttgcccacatggttgccagttacgctgcctcccagggagctgaggatgaacacgtgacttctcttagcagagtgaacgtatctcctaccttaagtctcttgtgtgtcctacttgtgagccagttgaaacgctgccattttctccagagactcctctctacatcaagaccatgtaaccatgcaggaagaaatcaatcttcttttctagctaacatgttccattacctcccctgttttcaaaacttcccataaagtggcagtctcctctctgaaggctactcttttagacaggaaatacgcagggatagcatcacttccagagaaacaagagaacagactgatagatcagaacaccagataatgtcttccctttcttggcaacggtacatatccctaacctctttcccaagacccacagaagagcagggtctctcctgaagggcaacaggacactgatccactgtcttgtaaaggaagttgtgttcagtgattttctgattagggagaaagttgctacaaccagcaccagaggaaagctgtctggtgatcaaagaccttgggggtttgcctgggctacttttggaggctgcccaaagcctgctagcagctcccacatgagctggggagaggctctgcttccctctactccagcacagcttcccctaattctgaactttcagagaagcacaggttcgagcgctctcccttgcccagtccttcatcagctggtgcccgtagccctgcatcatcctggtaacagttggtaaacgagtcccagtctagccgcttatgcaggatggttgtgcagtaagaaccttcatccttatggcaggcacattaatgccaagtttgctcattctaattaataacagttagtaaacaccaaagagagctaatgatgattacaggccacagctcctgcgtgttagcaaacacaccaggcaggtggcctctcgtctcttcccaggaaagaggctaggtcctcttcttgcagagatgtcttgcctcctcaaggcccctaccaccatatttagcaaatcttgggttacttctcagcctggaaaagaccaagatgcatgcaggtcagtcccatggaatggatcatgggctgacttcaagattagaggactaaagaagcaggacctttgatcttttagggtttccagacatctctttctggcacttggaataaaacaaatttttcttatttaaaaaatattttttccaatttcaaagtaatacaatttgcttcaaaaaattaaaatactacagaagcatataagaagaaagggtgagtctcccttcgtcctctggggaagtgggattcagtgcctggttcgtttgtctacagttctcatctcccctacctcctcttctttctccagctcatatttctattcctggtacacaaagcttcccattctactaccaaattatccctgttgtgaatcctttattccccatttggctaagcctttactcatcctctatccctagatattttttttttctgactcaaggattctgcctatggtaatattttctgtgaccctgaaggcaaaatgagagttcaactccatggtggcactaggatatctcatcttggaatgttttcttctctgagttccaggggttgtggcagttaaacataattacatccacttcccgtcattcagatatgaacctaaagttggagaatgttttatttcctgctccgcagccctgggcatacaaggacctgtgaagagtggacgtgtgagtctgacagagcctcctgggggcgccgcttgctctatgttttgagccctccaggcgaatctctggtcatcgaatcagataacttgatagcagtgggtggaggtggtttgaggaataggacaggccacggtggtttcagaatcttaccaatagcttgatcattttcggaaggaccccagacccctctcaatctgtcattatttttgttgttcttgttaatcccatccttctttttacgaaaatttagcccacggggctgcaagggtaatatgtcttctatcactgtcactgcaattcaggtaatattttctttctcgctggactattaactgtatcccactggaacccattctctgagagtttaagaatgaaaagaatgtaaataaacagtgaaaatgggtatcatttctaaggatgtttataaagtgatccaagcagatactcaggtataaccagaatggcttatcttaccatctttttaaatgcatgataccttttccctctgtttctttgtctttttctttttcttttttcttgagtctgtctccttttctgtgtattagcttttcctccatttttttctccttgatgactttttttctctcagctttctcattctctttcctttccttttagtcacaataaagaattgaagggcattttcaagtttggtttggttcattaaatgcatacatccagatgtatggatttattcatccatacatctatccatccacccatttattccaccagcattcactgagcatcagtcttcttgacatcagtctctttgctaggttctcagaatagagagctgaacagttgatccctgctctcaagccatactgaatcaacaaagggagagagacatgaaatcaaagaaactattaaatccatgaaggacacaatgggagttttaagaaggtgatgagcaggtctatggggacatattagcgaaacttcctaaagcaagtgacctttgggctaaatatgaaactgagttgaaggtgtcgtcaagtagaggaggggcaggggcctggggagaagatagatttttcggcagagggacctgcagtgccttcatgcaaagaacatttgaatatccgagcattatctaacctggctgggagggttacagtgacgcttgactcagggaataactgctgactttgttcatcagaacccagctgtttatgggtagtcagcttagaaagtgggagggggacctttacatgttacctaatacactgctgtggaatttgaatttttatactgtgagcatcatttacttttatcgaaagaaacactaataatttatagcctcatgcaccatgttccagtgtcaggtcttttccttttagcaagcagagagataggaaaggtttgaagcggggcaattgcatgcttcaagttttgtgactgaagctttgtttcctatcccttcgctttaaaataggttgagtataagctttctgtatgcatctgtaacaaactaaacccggttcttctttgcctcaaaataaccctggattgattttatctttctcttggtccgtgatccttgatacaaacaaggttcccacggccccgttagccattccactctatccctggccactgtcctgtttccctggcatcccatcgcaagagacctgcttttactttcacattctgcacagcagggatttctgcaaaaactgaaaaattgcctatcaatccctggtcaaagtcaactatgtcatgttctgggactcaggaggacagcctgtgcttaccttcctgcactccactggtgcaccaagctgtcctgctcctctccttcagagcttttccatttgacttcaccttgttcccgagcagtgagagagacccagcagcctctgcagctgcctggaccactgggggaatgtaaatggagcaaccacataaacgaggagtgacaagcaccacgctgagctctctgcaaagctgcccagtgaccctaggagggaatgagaaataaattagccttggggtttgtgaggaaagcaggaggcccggaaaactcttcctctttctttccattgcttctcaaactgtaccttttgtgtccttctaaatccatctaccaggcctcaggagcccgcaggtgttcccccaggctaggctgtcttttccttgtccctaaaccccctgagttccttccctccctttccatcatgcctctgagttactgttctatggtgccctcctccaacctcctcttccaagaagccctctgtggtgaccagagcaaggtcagagacagaaccagatccatgcacatatgtgactttccacaggtcagaattttattgatgttatttcagccatgacctacatggagtttccaaggtggtaattattcttactatgtctcattcactgggtagtcagaggcgtgagcacacaggccctagctgacccacaagtcagtgaatgttgcaaactatatatagtaggatacttaatcattatataaatgttatagattaacatttccacatcaaacaaagtaacatttaacaaaaagagaaaagggggtaggaaaaaggggttaatgagccaatcccaggagagcgccttggacagagagagaatgctggcctgatccagacgatcttcaacgtcttgcacgggaagagactttgaggtgggcagagccttcggtggcagatgccaggcgctaaccgtgggtgacagtgggatggcgttcagtgaaatggttttgtggacggtgaagtcctgctcttcttagagtccttgtcctctctggtaagaggtgatgtaaagtgtgtgtctggttatgcccttgtcaggttgaggtagtttctgttgattaggtgaatgtctggtcctgttggtatgaagccttttgagatgtaagatggagttcttttctaagatggagtcacttacgtcaagagtgactatactatacaccctctcaaagagttcgcttttagttctctcctagtcccctcctagtccccgcaactccaacagacttggatcctgcacatcaatcttatctccctttttgaaaatccttgaaggggagccaggattgataaatctttggcatctctcaaacctcatagcacagtgctaggcagtaggtggctgattagccaatgcctaggaggcgtccgaataagattgcaagcttgttttcaatcataccaagaagagcaggaacttgcaaggagacagaggagctcaaactcatcatctaccacatactaattaggtgaccttaggcaagttcctgaatttcaatgagctgctgtttccagaactgtgaaatagggataataatacttctctgggaattttagtcactgttaaattagatatgcaaagcaagtaacacagggcttagattttacttggtagttaataaatcttagtttcttttccttctttaatcttagcaagaatttttccctttggccacaagcatgttttgcctccaccaccactctccccttgtgcatttttccaagtcgatcttatccaggaaaaaaacatcccccaggcagtacatccaggtgatgcctcaaggaatgagtcaagaaaggcataaaaattattatttttttaaaaagcctatctccctagaaaggaggggtgaagcctgatcatcttttttttatattcagagttctttcttctccccagagactcagagctatataaatgtaaagttataataattatgataacatttacattaaatgtgatgctgacaaggctttatgagatacaaaagtttgctgattcccactggaatggatagagcagagtctgccttccccatcctgacttctttctattccgatccagaaagactgcctgtggggagggtgagggagaaggtgtgagactgacaagtgttgctttatttatttatgtgatatctatcaaatgcacccattgcctccaggtctcttagtatatctaaatccagcagttagcacgtacatggaatgaaaagaaacaagcccacagcaaacttccactatgaaccaaatatttaaggtcagttaccaaatacctgggaattggggacactgagacagaaaggatagcaatgaggaaactacaataataaagaactttatagccagtgacaagattacactcaaacctgggggtcctgggaggcagaattcacagcttatacatccttattttatgtagggtgtttgtgcatatgccatcagtaaaagtaggaatgaatgaatgaatgaacgaactacagacagaaaagctcctcatctccaccatttactacactttttagttccccacaagcgatatcaagaaaacatagaaacagtttagaggccggctggggaagaaagctgtatctttttctggaatatcctcagatcccattctggagtttgacagcagaagcatggaggcatagaagctgaggccactattgggaagggaccttgtgtttatctgagatggtacctgtgagaacttgactcagcatattgcaataaattgagtcagcaaaaattatgtctagggtcacaccctatatagaagaaaccccaggcacaaaattttttttaatttttgaattaaatttttttaaaaattgtaattaaaattaaaaattttttagacagaaggagagaaagagtcaaagggttgtcaactgcctacaagatgtggggcactaaactaaatctttcatacatattatcccacaatgacaccatggagtaatgattatatctttaatttctctggaaaacatcaacaacaaaacaaaacgccctgtgctccaaggaagggaactagcccgcccaagccacaaggggctgtgctttctgggacccacagctctttgccccatgtgttcaggtgtcttcgatcctcagaaagggttttcagtcagagatagattcattgtattggaggttattcaaagctattacatgcagcctttaaaagatcttcattagtggagaggctggggaaaaaataaaatattcacatgaggaaattaaattctgccccaaagatgattaacatcctaacacttagttccatctttcaagtgacaaaccacgattcgaggtgatgtctctttcccgtgcccacgtgtgcatatctgtattatgctagtacagctaagggtgtggtgacttgcatttcacgtcctgcagggcggactcaggcacaaacactcagtgtttacattgctcaggggaggcatgaggctctgggatgagaatcgcatgagaatcatggcatgagaatcaaggatctgtactggcaaaagaagctggaataataacaggatgacaagaagaacaatagataacgacattaaatgtttactatgtgccaagcacagttctgaacaccttacgtgaaatgtgttaattaagcctcaaaaattgggaggattgcttgagcccaggagtttgagaccagctggccaacatagcaagaccccacctctacaaaaaatttaaaaattagctgagtgtggtggcatgcacctgtagtcctggtgacagggtttgagactgtgtcgctgcccaaatctcatgtcaaattggaatccccagtgttggaagtggggtctgctgaaaggtaattggatcatagaggtgaatttcccccttggtgctgttcttggcatagtgggtgcgttatcatgagatctgtttgtttcaaggtatgcagcacctccttctctctcttcctcctgctctggccatgcaagacctgccttcttccccttcgccttctgccatgattgttaattttctgaatcctccttggccatgcttcctgtacagcctgtggaaccatgagccaattaaccctttttttctttataaattacccagtttcaggtatttcttcatagcattgtgaaaacagactaatacacctagctattccagaggctgagatgagacgatcctttgagcccaggagcttgaagctgtaataagctaagatcatgccactgcattttagcctgggcaatagagcaataccctgtctatttaaaaaaataccctcaaaaaacagcccttaacagacactgttctgcctcttttctacacgaagttaccgagacttccaagtgttacgtagtttgttaatgctgttgccctgctggctgtggatgagcctagatgcagacccgctgactctccaccatttgcatttaattttttttaaatttaagttgtattttatgttattttatttgttttttgtagagaaatgatctcactatgttgcccaggctggacttgagctcctaggctcaagcaatccttttgcctctgcctctgcagtagcagggaccacaggtgtgacactggtcccagctcagcccttgcttttagtctgcactctactttgtaccatttcatggagaggagaaaatgggaggacccaaggtgacctttagagagcagagcaatcagcaatcactttagaaagaagataatagctcctaaaggaaaacttctcaggtagccaagagaacatggtgatcagttggaagtaagcaaaagaagaagaatggactttgagggtgaagggagcacatctagtgtggaaacactgggagaggttcctccaaaaaaaaaaaaaacgcacgattgcaatgaacctggtatctactatgatctccctcttggaattcaattctcagtgtacacagagactccaggaagccttgcagctgaaaacccaatttagcattggtaaaaccagtgtgtttcagacacatgaaatcatgaacccactggtccaccattttctctttatacctctgtgaacatccttgtgtatgttcaagcatcctttacccaggagactgccctgttgataaatcacttatccacacgggctttcttctgcccttgagaggatcgacacatgtttttgtggagaattcaggtgattgcagagaagcatgcaggcccaaagttatggccacaacagcaaaccctagtcctcaggtaacttagaaggcagccacatgatgaactatagcaaaaaattcctttttgaggtgaaactgtcacatcccacgtcaaggctaccacacactgggcatggcagaaaagaggcgcagacctctttggccatccaacacagttccacagttggtaaggtccctacaagcaccattagacaatgcagcagactgcagcaagcaaaagatctacatgtgcattttataaaagaggacccaaaaggccaagtcaccatcactaggtaacacagagaggcaagttaagaccacagtggaataaaaaggcacacccaccagaatgaggaaggaaagaaggaaaagagctggaagggagagagacagggtcaggaaagaagaggaaaagagagagagaggaagagagaacagaaaataaccctgccaacatcgagtgttgataacgacgtcatgtcatggtaagtatcacgcacggctggagatggtgtaaaagtgatgctgtcagtttggaaaacagtttgcctttatctaccaaaacttaagatatgcatgccatatggcccagaaattatactcctggttgaaagaaatgtgtgtacataggtacaaggggaccagggcaggaatgtttctggtaaccttgtttaaagcagcctcaagaggccactgcacctccagcctgggcgacagagcgagactccgtctcaaaaaaaaaaaaaaaaaataccctcaagaggccgagcgcggtggctcacaactgtaatcccagcactttgggaggctgaggcaggtgaatcatgaggtcaggagatcgagaccatcctggctaacatggtgaaacaccgtctctactaaaaaaaatacaaaaaattagccgggcatggtggcgggcgcctgtagtcccagcaacataggaggctgaggcaggagaatggtgtgaacccgggaggcggagcttgcagtgagccgagattgtgccactgcactccagcctgggcaacagagcaagactccgtctcaaaaaaaaaaaaaataatagcctcaaggtagaaacagtgccaatgtccatcatagaatgaagacagaggttgtggtgtattcattcaacggaacgtcaaacagcattgaaaattagtacattcaaactacgtatcacaaaaaagactcacacaatccaaaccaagctacagtggccagaaaaagaacacatattgcttgacattccataacaggcaaaattaaactcttatgttcaggaatggatgcttaggtggtaaaactttaaaaaggaaaaatcgagggcatggttataataaaagtgagcacaggagttatgctttgtaaggaaggggaatgtttgatggggaaggggcaggagaggccatgaggtcttctgggagctggcaatattctatttcttgtctgggtggtggttacaaggatcttcagtttacaataatccatcaagctgcacatctatattgtgtgcacttttgatgtagtgtatattctaccggtttttaaaaagacttaagcaacctggatgagaacacagaccaactgcactctccagagcacgagatgtgtgctggtcatgacttaccacgcagcttcacctgaggacccacagattcctggcctgcatgtctgttccttctcttgtgtttcctagtttaatgaatgacagcaccatcccattctagaaaccagggaggcattttgtctcttcctgctcccaggtgttctgtattccattagtttctaagcccagtttatttccacctcctacacattttggaaacttatcttcacccttcacgcccactaccaaaaccttagaactgtgtaatctttaacctatattacggcaacatttccccatgttttttggttgttattggtggtgtttctactctcccgtctatataattttatttgcttcactgttctcagagggaccctcccgaaatgcaaagcaagttatatcatagttgtaagatcatcatcatttccccatcacctgtaaagtcaagttcttacctctccatgtggcacacacggtcatctacaacccgttgcccatatatattttcactctcatttcccgtaaacgtgaccacttgatacctcaagccctcttaacctatgaacctgttattccctgggctgtcaatacctttgttcctcctctttgcctggtcaatcccactcatttatcaactgttcaaggaccagatcaaatgaatcttcctctacgaatgcttctcttccagcctttaaatcctgtaagagttgactcttccctccttaggtttgtttagttcttatgtactaacacaggttcatgctcttttgctataatgtgttgtcatttctatctccctttcgagatcatgtggctccttcatggctttgtcatagtgatgcccatagttcctaggacaatgcttggcccaaagtatgctcttgatgaaacttattgaacaagctgaatgaagactaaatgatttcagtgatgaacctgtgatggtttgaggcttaaggcataccctgaagaaagcaagctcctccaatatttagtggcatatcagctgatcaaaaatacagtatttaatcacatgagacttttggcaggaaaaattaagatcctcagggatgtaacaatttataaataagtattgctgcaaataatctttctttatatataaaggtcacctgcaaacacacacacacacacacacatctacaaaaaaaaaaaaaaactcatgggtacaaggaatgatagaatgctatttcttagcactctggtctactgcatcctcctgggttcttcattgctgttgactgccatctcagataattcacaggtgggacgcaaaggaatccctgaggttcaaattgtatattagcacaactttgaggtatatcaaaagtaattaggttgcaacaatgttttttgaaatcacctggatttttccatcccttcctttttggagaacctcagcctctgcttggatgcactttgctttgccttctgaagacatcatctcccagctctgctcctgagtgggggatggaggctattgatggcagggcacctgtcctagctgtctattttaattaaacttttcaagctgtctctgggtggccagataagcaaaacaaaagaccttaggtcttttaaaaaagctatacactttctaaatcaccattatgggccatgtgtggtggcttgtgccagtaatcccagtgctttgggagtatgaggtggaacaattacttgagctcaggaatttgaagctgcagtgagctatggtcgtgccactgcactccaggctgggcagtggagtgagacccagtctcaaaaacaaaaaccaaaaaacaaaaatcactagtatgtgttcaatacagtaaattccatacacatcctaaacataacataaatgcaaacgttgttctcaatctgtggcaagatatatttatactttgtgttatttggtttggttcctttttgtctggttcttaggaggaagacaggataacagagcagaattccattggacagggttgtcattgggtccttgtgattaaatctatattgagggcagtctttcaaaggtgaaaatcatggaaacccataagtagtttccgggtctcttcttggtgtgtattgtagaacagagccctccactgcaggagcatcaactaatggtcctgaattgcctacacattcccaaagtctgcagcctgtggcatacccaatgacaggtagatttggagtaagtaaaatatggagcagtctgggagcattttgttggctccttcttcgatttcatcagatggtcccagctcagttatcagctttgatttttagatggtgtctggggagaagaacatttctagctcttgctcaggcaggaatggcccagctcctgccttcccctttctttgccagcattgtcctctaggaggatgacaaccccgtggggcacagaaccgcttctctgataggatctcttccccagggcagctactcccctagggaactgactgagtagagacatcctaaatgccgaggagtgatggcaccatgaagcccccagatatgggccccatgggtggcaaacaaggaaatgttccagatgccaacggtgctgcccttgtttatgaccgagaggaagttaacccatctccaagggaacagagtcaatggaaagtttcttgcgtttgccagaaaatgatagtttcatatcttgtggatgaaagtttgtgttctgagagctgtcatggtggagacatgcccttggaaccgaagacagacagacagaagatttgaaaaaagagtgaaaatgaacacaagtgacaagattagaaaggaggatgcctctaatgtcaaattcttatccagtccccaagtcaccttcccctggcaagaattaggcccttataactggaagttacaactacctctccccttcccccaaacagagggaagcaggtagacagaatattgtcaagagtgtacatttagaagaacaatctcctctatacagattacatgaaaagcagagtattataacttaatgcttcaggttacacttttactggaaatgatatttaataattaataagtcagagtacccaagtttaaagcctggttctgctactttcaagttgtgaattcttagacaaattacttaaagtttctgtgcctcagtattctgctctgtaaaaagaccacataatagcacctaacacataggaattttttttttttttttttttttgaggtggagtctcactctgtcagccaggctagagtgcagtggtgtgatctcggctcattgaaaccttcgcctcccaggtttaagtgattcttctgcctcagcctcccaagtagctgggactacaggcatgcgccaccacacccagctaatttttgtatttttagtagagacgggttttcaccgtattggccaacctgatctcgaactcctgacctcgtgactcacctgcctcagcctcccaaagtgctgccattacaggcgtgagccaccgcacccagccttgggaatttttataattaagagaaaaaccatatctgaggaaattatgttgtgaatgttagctattattgttgcatactatctgggacagaaacctaatgataggtgtacacactgtcttggtgtctgtgcatgcgtgtgtgtttgtgtgtgtgtgtgtctgcaaaggggaatttcaggtgatttgtaactttttttctttttttaacagtgtgtcatgacagccagaggcaggcgattccagtattttaaagcaaacatagagatgaatattatctctccagttaagccaatggaagaagttgggcttaaagttgagtaactaaagtagggtaactaggttgctatgtatgtctcagtggccaggacatgctctgtaatcaatgagttgttttgtgagttgggtaagctggtcagaggaatgaaaaaacagaacatgattcagaaagcaatggccttcacctccacctgatcattgacgccccgaccctgtgaaagacacttgacattttgtacttcaagctcctcctgtaaaagtagagacgtggacaagagtccatttttaaagtgcagaggtggtttaaatcctttcctcatcatgactgagtgatactgccaagatctttcaacattaagtgcctattaagcgctctcctttctggaagtctaggttcctgggcctaaaactagtaataaacttatcttacttctaacctggaagacacatttttaaattaatatgactatgctgtatcaactctgtgatgtgccgcacagggatgtgtgggtctttgtgtttggctgcaggaggcactgttgttgatcctatggtgccttactcaattagatgcttcttggagcatttgaatgaggggctagcagggggtgtgggggtatggggtgggagtggagggtgagtagtggtctgtcatggctgtatctctgagaaaatgggcaatgtcagcttacaattggaatatcaaaagaactaagctccagagtcaatcatataactcactttgcagcatgcagctcagcttttgaggggtggtatctctgctgctgtctagaaattctgcatcaaggtaactgaaaagaaaaacagttacctaccaatgaaatgttgtcccctacagccttccattaacatgttctgtttagtactgacatacgaaaccaggaagcgccttaatgaacttgccgagccttttgtgctatgacattgctccctttgagcccagcctcttgagaaacagacaccattctgtgcaaggcggatgcttgaggttgatgtgggcctgtactgaagttgccttctttcctttggaagttcttctgcgtgcttccttgggagcagcacagagcccctgcagccctccctagtgctaacccctccagcctggacactctgcacagccctcctcatacctgacacactcattctgattagcttacgatacagagacctgggaatatccatacccatccagcagcccgtcatgattcagattgtcagggaattggaggacagacagggaggcctgttttctaatcctcagggttttatataatcctcctggttttatgatttctaatcctcctggttttatgattccaaagggttcaaccacctctgttctttttcttagagctacaagtctgtttggttctcaagtggttaggatttcctacctttttggtatacgcgcattctatattaaaacagctccaaggtgatcccctgagaagtttagactattctttgctaatggggttggcaatgtcctagtaacccaggcagtgtatgccttggcctaaatagtagggagctggaaagtcaaacaaatgttatcggaatagctacacataaggttcacgtctttgagaggatagtgtcagctggaggagaaggggtgccatcccctaccctcgctggatctctgcgagtggcttcatgacgactgaacaggacttgagcctgtaggagatggaagattgatttcaggtttcttatgtaccattctacagagtgtgactcacgctgatctcagaaaatgaaaaagaaagaaagaaagaaaacaaagctaagcaaattcagcaaaacttaataattagtgaatttcaataatagacatatgggtttattttaccatgtttctgtgatgcttgaatattttcttaataaaaaatcaaattcaatatcgaattgaaggattcattatggaagacccgcaaggaggttttaaaagaacaagcaggaggaagtttgcgtttgtttacttcccacggccagcgtgttttgcggctgacttggatttctcctggtgaggcagactccaggatcacacatttccagccatgtgcccaaggcctggtctaaaactcttctttttattctctttagtaaaacatatggctattccgaacagtatttattgtgttacacacaaaaaaacttatctacgactgctggtatttcaatcgagtgtttcttgacagttctctggtaaagtgattaaccagctgtctttttacttttaagaatatgctttgcttctccactccttttttcccattcacatccttcatatccatcaggaaaagctaggtatattcaccacacagtctcaaatttgttagataaaattcctgacccttaagaattttgtctttaaaatagaggcaaaacacataaaataatgtctcagtttcaaaggtcattatacctgagttctatatgagtcaaaatataggttaagacgctgtaatcaggcctctcccaaaacagtggcttaatcaaggtagaaatgtatttctctttcaaatagtggtctagggctagtggagcaaccttgacagccacagctttgactctagctccaaagtggctgcttcagcacttaccatcacacctatgacccaaacaacagggaggagtaagggaacatgagaggctcactttcgttccttcttaagacttggccttaaagtgtatacatcccttctgctgtcatcccattgcccacctaactgcaaaggtgggtgggaaatgcagtctctagcatggaaaacagggagagatattggtgaaagctagaactgtctgcctcaaccagctagtgacacatcaggactcaaattcgactgttttgactctgcaattggtgctatttaaaacaggaaacagcaagttaaaaaatgatttgttcacaaagacaaaggagcacaattgctgccccacgtgtcttcaggagattctgcaggtaaaagttttgaaccaatcctgtgaagtaactggcctttgcaactcacagacagaagtgactctccctattcagtcacactttttgcttggctttatctttcacggaaggctaggaggttttccagctttctacatggaagatcccgttcttcctcactttgagattgcagagatagctacctgaacgcagatccccgtagtcataaacgcagtcaaagaaattttgattcaaaaatacactatacaaggtcgtagccagaatatatgttccaacatgccatcaattctctagtaatcatatgctacttagaaaaaaatcaataccatgaggttggctgcagtataacacacaaggaagagaaccttttgtggaatttattttccattagattcttgtccagtgctctaaattccagaagtgattggcttcctacatgctttattcattctgctgactcctcccttcctcctttcttccagtcacatcttttgaatatgaaaaagccatattcaaagcttaatgtattcttcatgaaaaacctttaaggccatctcaataagcacaaccatttcttatttaataaacaatcgctctctcattaaatgtaaattagttctttatccttagctgtatttgttgaatctattacttactgtgtttaccaattttgtttcctttggctccagagctttctgtaaactactcataaatatgaagttgaaaggaaggccctttctctgtgtgtaagcacctgcacaagccactttgaacagccctcttcttcaagtcagctctgtctttcccatgcccccaggctgaccatcccggctacctacacatagggcagcaagattccgggtggcgtgcaagatcaccctggaccttcgtctctcagaaaagccagtgtccaccttcctagttctgtgttgcaaaagtcagaagtggctgcaggtgcaatctgaagggaacaagcgcagtcaggcttttaccgaggagaaatgggttatttcggtggcagcagcatttggcgcttccattcactgggccccaacatgtccaagtttcctggcttagaagggcacagtgtaaggcccatctgttccagcaggctttccctgattagataggatgcttggcaaacagaatcccagataatggatatttgaatatttttgtaatttccaggcttgtgcctaacagcttagcagttggccctatgtttaaagaaaatgggtaataatcatgactaatgtggcaatttccattcaaaaatttccaatggtgcttaattaaatcttccaataacatttggaaacaaaagttcccccatccattgtatccatgaagaagacagagtgaaaggatagtgggtggactcttgagacactcattgtggccaaacccaaccaaggcaaaaaactgtggccattcacttagttacagatcccagaggatcccctacaacccagccctttaaatggaactggtctattttcattccttcagtctccgctgggggacaggcaggaggtggagtgagagaacaatttgttagtatcccagatactctgttattcccaccgcagagacacaactactgcattgccccacactttcctttcctggcccgagaaagcctcattccttcggccttcatcatcatccttcttcttcacctccttttgtttcctttgcctcatctatgaaatcaggcaaacaggactcaccctttaccctctagggatgttggaagattgataacatgtcaagaaacagactggatttatttgaatttcacaatgtcctatttaaagagagaagaggcgactgaataaagaaatttggaagccactctctgtgattttatttttaagtcatttttctctctgttattactattttttattttttaggatttttttggtctggttctactgcaattcaaagtgttttataagggtcccaactggtgctgggaagcaggccacgcactgaagcagggcagagagaaggaggatgcagccagtcaggcctggggaccgacagccctgtcacgctgacttatgatggatgagggaaaagtctatttctcatccgcagtgggggaggtgaagtgtaaagaaagatgctcccagagtctctgggcgattcatcttgcagcagataaactctagaagctacagagttgtgaaggagagagaggaagaattgaagaatcaaattcattatgtgaagtataatctcatgaggaaatatcaaaatatgtcagcagcacccaagacgggaaggtggggagagggtggggaattcgctgatggtatttgtcagttgctaagccaggcgtggaggggagagttcctgggttccactgctctcctgcaaacagccttccccaccaaattcccaaggaggcccggcagagaccatggcatgtcatgatggatgaagccaggagatgcagccagcacacaggagacctctttgaaggcgctcttcccctgtctaaaattcactttcgctacttttccttcgtgtttcttaaatttagactctgcagaaggctaacatagaggttagatatgcataagtaatcccattaacagtggtacagggtgctttctttctggaacattttgtaattatgtctttcctaaccacttcctgtttgttcccaaattttagcagagctctacctggcgacaaacagcccgaaccttgcaaatgaaaataatttggggacccatttcctgcccctttaaccatgcttagtggactggaattctctgagtcctgcatatgcatgaggtctgcagacctgggccctccatggccccagggggagaagatgcagaaagcttctctgactctgggcatggggcaggctctgtcatttccatctctgtcccgcttctcattcccagagtgaccttgggcaaatcactttcacctccttgagactcagtttccacatctggaaagctgagataatagctacctgcctcctgggggaaactgcaaggcttaattaattaatgtttggcaaagcttcctagacctttgcttgaaagaatccatgcaagtgcaaattattattattatatcactggagccttagctccaattttgcttctgaggctaatgattatttcttttctgaaggaaaatattaattttaactccaagtaatttatcgggtagtgggaaaaaaaattaccatttgtcaaggacggcactctctaaatggaagttctagcagcccctctctggggaagactgcaagaaaaatcttcctattttaccatcatccctgggcatcttctctacaaggctcgtccctgctcccctttcttcactttcttcccaccgggtgatgggtgttagcctgggcgggccagggccagaccttagctgaacttgctttctatttctcctgtgacagctccagacactttttttttttttttttttttttggctcagcacagaaaccaaataccacatatttttaagaaacaatacttagtacaatacccttggattgatttcaaataactaggcaccctctctcttaaaagtttcaaactaatttactgtgtcaaatgaacccccttccctaagacaatggcctgtgctttttatggtgataaaaatagtgcaaggcattggtggtcattttctcctttttgattttctgtccatgaggcttaatgaatggcctggctctctatgctaggttcccaatggcccctagagcaaaccatctctaccgttccttcgctgtttttaaaacagcctgcaagtgcttatgtggctgcgttgccaaagagagacctgactctgctccccagaccttgtcctggtcctgcaacctgaggccaccaagaaagtaaaattagtctttgcttcactaggaacactgtaattgcttatcagcttcaactgcagaagcagacattttgtgcaaggctttctctgccagtggtttatgccccttgattcctgcaggttcttttggaattagtcagtatctactccattttactaagggaggaactgactaaccatgaggtccttttcactccctctttctttcatcctggtgcagatagtccctatgccaccctatttatttatgccaccttatttatttgtttgtttttaaacaaaggaaaattatttcccataattctggaggctggaagtctgagatcagagtgccaccatggtctggttttggtgaggactctcttcctggcttgcagacagccaccttcccactgtgtgctcacatagtagagggatagggtgggtagggggagagagagagggagggagagagagagagcaggctctttagtgtctcttctttttcaattttttttttatttttccagcttttttgaggtattgttgatatacaaaaatggcacataattattgtatacaacatggtgagtttggacatttgtgtatactcatgttatcatcactaccatcaaggtaacaaatatatccatcacctccaagagtttcttcatgtccattcattttacttcttttattttaaattttaatttcttatggcaagagcacgtaccatgagatctagccccttaacaattgtgactttaatattcattttcctctttgagccttcttcagacgttgctccctgcaagaatattcttacaacacacatgctcagacacatgctcacatgcacacacatacacacacatacacacacacacacctttcttctgtaagtgaagcccttcgcttcctctacgtctgcccatgtgtgcactgcccaggccgcaaagccctttcccttgctgtgtttctagtacctgtcacctacaccgccatgcggtatgggacaggacgacatactccttctttggtccttctcacatcgcagatgcttgcggtacctccccctgcatgagaagaacagcacttctgagggagctgcagacaccctggcgcgcatgttggtggtctgctcaccccaacactgtcccctgtgaacacagggagcagcccccttcctgcagctgacccttcaccgcctctccagggacctcctgcctctctgtccacctccagcctcaaccaaacaccagtagcttcctgaacactttgtttctcattgtctgtgcccttatccatgcttgtctctctgcctggcatggcatgaactcttctttctgtccagaaaaatccaaccaatattgttggcccaggtagagcgtctcctcgtgaggtttccaggtctcctcctgcctcgctgctgcctcccaggcggtgagagcggggttggttctgttctcatgccattgccacaccttgtacacagctcggttgctggcattctccatgctgggctgaacatctttgttgtcatggctccttccccttccagccgcagggcattgtgagagcagtgtctggactttgtatggtactcaataaatattggatgcataattgagtgagcaagtaagtgcctttatgttctccatttttagagcaaaaatttatcatacatttgagccattctgcagttgagctagaaagatgtctgagaaatctgcaaagggccctgagatcctgtggggactctgccccgtgacttctgaacaccctggacctggggcacctcactggagtcatctagagcccccatgtcctcagcacaaccatgtaactcagttgcccgtcttttgcctagcattctcaagggagaatcgtggtccttgtgcggacccatctacatagtcaggaagttctatttctgttctacctgaagtcctatcagccccaaactagaaaacactgggttttagaaaaggatgggtaacctgtgtgcacctcaagcctgaagtggttaggaatgaaaatgtgatgtcgatatgagatgatattattagaaacctgttaaatggactcctgacttgtgctcttaacgtctctcccttccagaaaactgccccacacccggtctcattttgtgcagtcaatataatcctgataagatctatcacggcgcttatggtgcgagaagaaattaaacatttaggggactcctccagcgccacactgattgagctcaaatgatgctgctaagttgacagatgcatttgtctgttcttgctcgccagtaagtctcccttgcagaatgtacaaattcctttacaaggatgtaaaaacaaatcaggaactcctttatgctgctttctccaggagggagtctccccgtacctgccactggtgcatgtgtgtgtgtgtgtctcgatgtgcgtgtgtgtgtgtgtgtgtctgtgtgtgtgtgcacgtgtgctagatgcaaggggcatgcagaaggagagccaaactgctgctcgactcatcatccacgcagtgtgagtctcgagccttccaaggctgaccctcttttccccgccattctgttaattgagccacccgtgccaactcctgaaatgcaaggacagtcttgtcagcaggggaaggcaccttgcacctcttagccaaatgcggcacaactttaaaccgattaataaaactcttaaaaggataatattgttgggcaaagtgctaaggtttcctgctttcgcttgggttgtatttttattaagctgtaagccttgttctgaaaaagagagagggggaagagggagtgagaaacagagacttttatagcctgcagcctcttgtttgcagattattttccaaagatgctcagtagaatatcaattgcctgtgattagaagtcctgcccggtactaccttgaacagaagaggctttagaagtgaaagcagttcctcagagaagccacacattttagtcttggaaaaatctctcagctggaatttgaccctcaaggtggtcagagctaggatgtgggggtggagcttagggggttgggtgtaagctggggagatgggcacgtttggaagctcccgttctatttcacctaaggaacatgtcttttcctcatcaccagagagaccctgtgggggactggggaagagaggggctgggagatgcttggtgggaaacctaaaaaaaccctagaggccgggcacagtggctcacgcatgtaattccagcacttagagaggtcaaggtggatcacttgaggtcagaagtttgagaccagcctggccaacatggtgaaaccccttctctactaaaaatacaaaaattagccgggcgtgatggcacacacccgtgatcccggctacttgggaggctgaggcagggcaatggcttgaacctgggaggcagagtttggcagtgaggcaagattgcaccactgcactccagcctgggcaatagagcaagaatctgtctgaaaaaaaagacccaaaaatctagagtctggccagagatacctgggaaagctctgacctggaaagcctaaaagacgtgtcctattggaagcattgctgctcagggcccatcctgttaactcttccagttcatgaggaatacaacttaccacaaacattaaaaaatcttctttccattttaataaatagtgataatttctaaatggaagtatgagcctgcatcagctcagttgtgtaaatgttaaagtcctgcgtctttcttccccaaattatttcacaaagatgctacttgaatccattccacttgcccatcaaaatgagaagatggcaccagtgaaggcagaacagatgggagagatggaacatcacctgggttcccagggacccaaattcttacagacatttgtagtgacagaggtgcaatcatagcacatggtatgtgcccagtaattacttgctgaataaataaattcataaacagtaatgatggcatccttattattactactagagcatagcaaacactactgaaaccgcatcatcagctgagagcacagtcctatgtgttttacatatagtaagtcacagaatcctctcgacagccgaaggaggaaaaatctctctgtttcagtggtaaggaaagtaagttcaatttgcctaaatcattattaattattcataaatgaactatcctccaatcataaacagtaaacaaaaaagatgtggcaaaagtggccagcatctctagggcattgaccacataccgggctcagtcctggactatacctcagtaaatcttcacagtcctcttgcaagacagtgaatattagatccattctacagagaaagaaactcactgacctgttaaccttcacttgatatggtattgtcatttcacaagtggggaagctaaggcttagaaaagctaagctctttgcccaaagtcacattgcaaatgccaggagttagattctagcctagaaaagaagagtgagaaattctcctagtctcatatgacgtcatagcaactgtccatctagagacctttgcatagttttgattggtcagatgtgaaaagagggtagtcttcccccaacacaggctgcacccacacttctcatgggagtctttcaacaccaccactgagacaatccaacatggtgggaagagatttcttctgcacatactgggcctagaatccacagcctaggtccactcacctctctgatggtttctcattccaccacggccagttgagtatggagcaccagcacgcattcaaagtcagccttgctaattagaatatgagggggccttagtaatgttggggaggattacaaatatatcagttcacattactgagcttggcccagctgtatacttaatagctcccagatgctctctctctctctttttcaacagctttatagagatacaattccagaacatatcattcacctgtttgaagtatccacacacttggcttttagtatatccatagaattttgcatccattactgcaatcaactttagaacattttcgttatccagaaagaaaccctgaattccttaggcatctactcctgaatcctaccgttgctccagtcctaggcaacccctaatctgctttctttttattgctgtttttgttttcgttttcatttttttttttttttgagacagagtttcgctctcgtcacccaggctggtgtgcaatggcacaatcttggctcactgcaacctctgactcccgggttcaagtgattcttctgcctcagcctcctgagtagctgagattacaggtgtccaccactatgcctggctaatttttgtatgttttagtagagacagggtttaaccatgttggccaggctggtctcgaactcctgacctcaggtgatccacttgccttggcctcccaaagtgctgggtttacaggcgtaagccactgtgcctggcccctaatctgctttctgtctttataaatttacctgtcctggacatttcatatgtcttttaatgacattttttattcctacttttacactcaggtttttctctatcttaacttttctttttttcttctctctttttttttttttttttctttgatacagggttttactctgttgcccaggctggactacagtagggtgatcacagctcactacattctcaaactcctgggctcaagcaatcttccctcctcagccacctgagagctgggactacaggtgcccaccactatgcctggctaacttttaaaaagttttttttgtagacactggtcttgctacattgctcaagctggtttcaaactcttggcctcaagtaattctcccaccacagcttcccaaagctctgggataataggcataggccaccacgtccggcctgtatctctgttttctaggcctaagaaagacctgggccttcttgactccagctgcatgctcacactttccagcctcagaaatgtcactttagaatgggctgaagttctgctctggcctgtggtccccactcagggaagctcctaggagcttgtctttttcttttaatttctgcattcttcccagatatcatttattctgtctatatcagtcttccttttcctctggtctttgctcttaagacttctaagtctgtgctcccataactgaaaactgcacagaatcactcgaagcttattgaaaaggcagattcttggacctcagcttcagaggccttcattcagttcatgggaatcagcattatttgtaaggcccccaggaagttctgaagtgggtggtcctttgatttcactttgtaaagctctaactgtcctctagtaatactcctcggccgcgttccaggaacattctccattccttggttctggctctgctctagaattgattcacaaatcctaaaattttctaaaacctagaagcaataaatgaaccttgaaagagatgcttttagaacaaattaaaaggagtgacttagtagatcacaaattggtagagtgtttacccgtaggaaacagtgcaggctataataataattcaaaaacaaggccaggcgcggtggctcacgcctgtaatcccagcactttgggagtctgacgtgggtggatcatgaagtcaagagatcgagagtatcctggccaacatggtgaaacctcgtctctaataaaaatacaaatattagccaggcgtggtggtgcgtgccagtagtcccagccacgcaggagcctgaggcacgagaatcacttgaacccaggaggcaggtgttgcagtgagccaagatggcgccactgcactccagcctggcaacagagggagactccgtctcaaaagtagataaataaatacaaaataataaaaattattcagtaaacagaattgcctattacatgctaggcactgcagactcagaaaggaacaagaatcatacacccctggctctccagagggaagagagtggcggagaagacagccatggaagagctgattaaggcagcatggcagtgcagagtggtagttaagagcaatggctttccagccagttgtgctgaatcccagttctgctgtgcggcctcgggcaagtcacttagctgctctgtgcctcaaattattgatttgaaatggggataatagtggctcctcatggcattgctgtgagaagtgcttcagacaaggaggtgctcaggaagtattaactattaggtaactaattaaccatgcttttttataaatgctggagttggggaggggaagtgcagttagtagcttggccggagctgctcacttggtctgaaagactctgatgaagtgacattgcagtggctccaagcgccgtacttgacgatttacatatattaacacgaatccccaaaatcctgtagagtaggtattatgcctgtgttaatctacccaggagaaaactgagctttccaggaagtttaagcatcttgcccaaggtcatagaactggaaatggcgccagctcccaggcaagctcttagcatgacaggccagcaaagatgcaattctgggaggaaagctccattattagttattgggggaaaccaaaacattttaaaataactgtgccctctcacaggctgcctcttggcaccacagtcaaagaagaatgctgagctggaaaaacgttgtgtttagggagacaattcttctgtccttctgtttatgttctttgttaaagagcacggtgtaaaaagacaaaagagatgtcggatttccttctctgaaacagatcccacagcacagaaggctgcagtctgaatcctgtactatttaattaaggcaatacaggacttgtcctttcagaactaggtcacaagtgtgcctcagcacagagactcctttttggtaatatgggctttgggaggaagagagcacatatgaaaaaaagtgaaatctgtcttccaagataccagctttctgtcttgggcagggtacagtgggctaggcgaacaatttgaaacaacaaccacagcaatctgagaccctggttgggccaatttaaaagaaatttgacccatgctcagacatttcataaactcccattgaaatgcacaaaaacatgcacatcaggtcaacccacggtgcttggctggtgggtcagtgtgtagccgggtgccctctcgcatgcagagaaggacataggcacacacagggcagcctttctctttcagaaaggatatcactggccacagtgcttcctagggaggccacggggtcagaccatcagaggtgccctgatgtacaaggggagcctggctaaaaggtacagtgatctgtgacaagattcccatcccagaacccaggatccttctgatacagagaacaatttaagatatttgccccctaaggacactcttaggcattattcttctccagaattaaaagaaccaaaactggaccatccgtgactcctgtcccaatcttcccatccaggctggatgttaccattttccccatccctgcttccttccctttgtcttcctttacctggctatgccttttgacctttggtgtgacaaatttcagctgccactaatgttcatgtagagcatgtttctctttcccttggatgactgtgcgcgcattgaaagactttgcagagacggctccctgaatagaaatgcatgccagacaaacaacgcgagcagctcagacatccccacagaggctctgggagcttaaaaagcccacgtcaccctagaaaagaggctattaaggtgtggcgtgatttgcactttcaggcagaagctttttaagctgctgcagagcccaatcacagggagatgaagacttcagtttctcaagatatgcaactcttctgctgatgaaggagaatgttcccgggtgcaggtggagtgagaacgggttcctggcacacattcagcaacctggtgaggagagctcggaccatgtcgccgtcacctcttgtctgtctgctccccatttccctgcagcctccagagccagcataaggggctggagaggaggctcaggaccatgtaaagatctcagtggagctgagcagaacaccactgactctgcactccctcctcttgacaaggccctggagaatccctaaacaagaagcagtagcagccgaagcccaggagcatgtgctggagagggtttgggagcaactggtaaagtctgacctgctgcccggagcccatgtcatcttctatcattcctaggaggaaaattagacccagaagcctggctttggaacagggaagactggggtttacattttggctctgcttatttgtcattgtgtccctaagccacagtttgctcatttgcaagatttctgtttttcaatactgtagaaaggaacagatgaaaagtcttgcataaagtgcctcacagtagaaaaccaacataaactagcctatgtgatattttcaaatggcaagaaaacgaagacagggactcccaaccagcaggggacaattcagttcaactgaaagtaacttcagttttctcccattgttgggtagaaacagaatttctactctctctcaaagtcttacccggtaggtgaccacctctcccaggcacatcccgctcctccaaggcctcgtcttctgaaacagttccccctcctatgattgccggggagaagctggaagaaaaagaaatagagattattttcgttaacaagtgccttctatccagatgacatttttctgctcccaaatctctcctgaattggagtcgtaccccgtactgtctctccatggaaagatcgggccctttctcttgaagagtgagaaactgaaggcaggctactcagtcatctctcgagttggtgaccaaaatgtgcctgtccccacatggatttcttctagggggctggagcactgtccacctgcgggcactggaatctccaggagtttcttcttttgctcaccagacacagccccatcacatgagccacagcagcctcatgctagcttaggggataaaggcctgcaggctcttttccttatttttaaagcaaattgctctattccctctcatggcttcagcacgtgggtgttggggaggagttcggctgtgcaggtgtgggagctagacgcccagtgtggtgtctggggagggttgatggacagcagctctaacgtgcttagagagtcaaggctggctcggcctttggaaatccaaataatctttaaatgccaactttatgcttcatagttatagtgaaccattcaggggtggctgcaattcaggaaatgatatcactgcactccccagtccagttagtgacccattagctaaaagctgccctgagtgtccacaagcccccattctcaaagccccctcaggtgccccactccctttaattctttcaacatctaggaaaaaggcgttgttcatactctattttacagaggcataaattgagacccagatggtggtgatgtgacttgtcccaggttatgcagtgtgtgaggggctttcagagtcccaggcctaaggtatccccactgggctacactgacacactcaagaaatgcaaactagagtgtgtgtatgtgcttgagtgtgtgtgtgtgtgtgtgtgtgtgtctacacatgcacctttacattcacttaggtagggatggctgggatcctgtccagtgatctacagtcaatgccagtcccagagttccttgggtgaagaagaaagagaagttaggagaacagtggaaggaagaggtgtggcctacaccttgtaaaggaagcaatattattcctcctgggaagtcacttgtctccccaggctttgaatggaaagcagcctcaaagtcccttggcatcgacgggggctgctccctccccactccccactgttacctctgggaagacctatgcctggtgctgaggggacctttggggctatttgaatagcagcaatcctcctgatttgcttctctccaaaaaaccccctacttggctgtggcctgagctctctcaggcttggaagagactttagacagcaagcacttcaatctatgtttagtgcaataatctcctattcagcaggaattctcaaaatttttctcagaaaaccagtccgtttggatgactctttaataaaatggggataaaggctccataattcgccagtttaggaaattgctggatacctaccctcctctgaaagagtcacagtgaacttcagcatacaaaggctctgagaagtcctgcaacaaggaaaccagtttaacattgttaaattatggtaagactaataggcttttatatagacacactttaaacatcttctgtgacagggagccccccgtcacattaaacctttcttccaaaagtacacttacagtatatgtctttgggcctatatattttaatttctcttctggttgaaatgtttctggagtataagaactacataccctattatttatatggcagtacacaacatatagagatgttcagtactgctctttccaataggacatctaaggaaaccgaagcataggaagtggcacagtctaactgaggagcatagttaatgaaattagggtgttttcttgttagatcgctataacttttagagttgagatgaccgaatgggaatctacctttctgcaattcccagcctgatctttctactttcactctatttccttctactgtttagctgaatatcttcaagaaagtagtttaatggtagggaagggagtggaaataataaaaataatggcttatccttccccaattcaaaaagacttcgaagtgcagatgatttttcacctgcagcgcttggatggcatttacctctaacgaactaacatactctccctggctcctggaagctcctgctctctccaggctcactgggtgctctgtggattccagatgaattatctcaagtggcaaatataccttaaaaggagcagaagtgcaatgcgtcttctaataccagggttaaaatttcattttattccttgtctgatgctattcaggactgttatcttccttcgtgctcaataggcaatagaaatatatatgtcggcagaaagccaggctcagacacggtatctagagaaggtgggctggaaaaagggagtcagtatgatttgtgctcccttccttcctctctgctcctaccaattagagaagggaaggacccagcccccagaccataaataacagctcgcccctgaagtaatatggctttgctcacattggctgcatattctataggtttgcatccttttcaactcttctccagcacagctgaacaaatacaagaggaaacagcaggatgtggatatttgagggctcttctttcaaaagaaccaggattggtccatctaaatgcacagaagataaagctcttcctagcatcctctttcctccttttctggttccccattccttacttcttagggtcacagccctgacctgccttcacccattgtcttatacttttgctcgattctccacccccaagattatcagagcttacctgtctttccgcttcttcctttcaatgttctctcaactagacacactggagaggctctagttcacaccaacccttcaacgactggcaaagactgcctccatgtaaacataagaaaatgcctaactcaaaagaaaaatataatctctaatggtagattcacataggagagctcatgagaatagtttccaagacccttccaagaatggccaaagggcatctgcctgcatcaaatttgataataagatgatccctgacgtaaataataacataatcattaatggcaaagtttctggagtctgactacctggattgaatcttggctctgtcagtttcttactgtgtgaccctgaggaacttcttaatttttttccacaaaatgtggtgcaataatatcaccaatgatatggttattgcaagattaaataagttaatctttgcaaatgtttagcactgtgcctagcccattgtaaatactcaaaaatattacctctcaatacatggatactaagataaagtcatgtggtatacaggcacatttcaaggactttggggtcaataaaacttgagtttgaattttggctcttctgattactggctgtgtgatcacagccaatttatttaacctccttttagcatcagtttcctcattggtaaacaggaataattgcatttccctcattaacactgttgtgaaggttgaagaaatcatgtatttgaacataccttgtagctagaaggcatcaataaatatttgaggatggggaaaacatcctctgagcagatagcttgaaaaaaatgacaaggattctttggggcatttagatgtgtgcatttcagtaatggacttacttagtcgctctgtcctgaggctatctatcaactcttatagcacttctgtgaggcacagagcaaatgtggataatggtgtcttgattttattaacaaagtgagtgtcccaagaaccagtcaatatagcacaatcaaatacaactccagacaggcagattgcttccttcctctaaagcagtagttttcaaattgtattttgcatttcactttttcaagaaggatctaaaataggacattattataatatataaaatagtaacatttcttggaacgaaagtggctagagttgtgcctgctctgtttctccttcatatcccgcggtggtgtctgcagtacctctaaggaaatctaagtctctgcaggatgcagcttcaaaaccaatgctctaaagccatggaattttcttcagactcttacagtgtgcagtatggattaatagtgatttcctactgtcttagatttattaagattaagtcatgtcagacaaacctcatttcctactttgacagtattctccagggaaatgtagtgaattggtatttcaggaaggcattttacaaagccttttgtaatagctttattgcaatgacaaagaagtttacactgaataccagtaaaattaagtgtattagtaagtagatgaacaactatagctaacaggtactgaacaactaactgatcaatgtcaagcggcaggctgctaggacacctaggacactggctgtgtcctgtatcattaaatatctccatcagcaagttggatgaagacatagagatgacacttatcaaatttgtgcatgacatgaaattgggaggaaaagcaaatttatcaggtgatcgaatccagaaagatcttgtcaggctgacagaatgggccatatctaagataatggaatttcacagggaaaaaatgcaatattttataattaggtcccccaagcaaattattcaaatataggtttatgtcatatctgatgtcagattcagttatgatctatctaacggcaggaagtagaggctctttgaaagagtctttcaggtagatttgagcagtagataatgggatagagaaaaaaggccagtgcatttagggacaaggtggataccacaggggagagctgcagggaagtggggtgggtcagagtgggtaagtattccagtgagaacagagacaggggagctacatacataaaataactctttcattcattctttctgaatatattcatcatgaggccagagagtatggcttttaagggcataggctctagactcaaactatatgaaattcaaaattggctttgttacttcccagctgtgaacccttatgcaagttacttaacttctctgtgtctcaatatctgcatctatggactatatttgtaactatctccctcatagggtgatggtgaggatccagttcccttatgcttatgtagtatttattattttgacagtttttcactaagtacacagcctgattgaggaggaggaatgagatacattacttcttgtgaagaaaggctgataaggttcaagcagagtatcccatgcaggaggttcacaaggcctggaagcttagcaagatagtcacaggaaaaagacagaaagccaggaatcagaactgcataacatggaggaaaccggacttggggactaaaatagaatttaggcaatcaaaagaaatgcaaggtctgagtccagctaacaattgatggggagcttgaggtgttgggctgctgttctttaaatctcttgtgtttgagatcaggattgattacagaggcaaaatcagggtggagactgctgtagggtcacatggaccctgctctgaggagcaatgggaaacagaggctggaaactaggaagagcctcacagattggagaagcagagcttagtcatagcagggcagcaaaagaagacagagagaaaacaaaacaaagcaaaacaaaaacagaaatataaactatctgttttgctgattgtaagtttcccacaagttacaagagtgaggttccctctcccttttatagtatataaaacaaaatattcaagagttctgcattactgtaaaccagtcaggcagtcccctagagtactgtctaatcattgcatcccatttttaaaaggtttgagaggccccacgtcggcctggaggataatattacaggaccccataatatgtgagcaaacaaaatagagcttttaatgtccctgtgggggaaccaaagccacgtccatgcatgggaggaagacctcttacagtatttgcaaggctatcttctgaaggaagagtggttgatccttgctcattttgctgccaaggaccagagaatggaagctccaggaagagaacttttacatccaaagtcaatgcaagggcagagatgcagggcttcacctggggaagggcatacctcccacggctgggaaaatgtgctcaggagtattccagcattgcttgaatgggttagatggaaatgttgaaaacctttccccaacatggcattctatatttctataaaaactactatgagacagttgagtgagccccatgattttggcatgcatcaatgccatatttagaatggctgccctgagcaacatttttctctgccatcttcgcagtcattcctgggaagcaagctgtagttctctgccgagccaggaggtggagatggcctataatgtacccagagagcctgcagggagggctgcgtgatgaggttgagcagtggggctatctgtgtggattggcagccataaaggaatccgagagctcatcggccgccatctgtcttcattttgctaaccccctctattggatgccacaagcagctcacttcctatatttataaacatccccaatcagtcatttctctgcccactgtcacatatttgtggcattaatgctggctgctttatcacagattggacttcatttcaggcataactctcatatactgtggttctgagatctttatagccacattacggtatatggctgagttgtgattacacatcagtactgtgaggccactgacagcgatttggccctctcccaccacctgccacacctgccctctgagggcagctatagatcatgctagagacacaggaaaatgggatctgtgagggagagagagagagaacaaaggttaaggcacacactctccaggatttagggtaggccagggctattccgtagggctgagaacccacagaactgtctcctattggcaaagtgacctgacagatggagagagctaatgggaggggatgggagttgagaaggagtagtctataattgaactgacctttctggttgcccctgatctcaaagccgacagtgggtggtagacttccttttctgatgtctgaaatcaggaatgtaagttagcatttcttcgtattcccttgcatcatgcttgtcccattcataagattgctctccttgtagagatgaaaaaagaatcttttttagtcccactgtgtttgggttcttgtagctgtcatgcacggatcccaggaaccacagtcgcaggggaagtcgcaaaagttctctctcatggaagtcacagtggccaccaaaaggtcaaaagtaagagctatgcttggtcagtagacaacaaaagagcttggaggcaggaagcaataaaattttagggaattatgaggccctgggttattgctaaaagggtgtggggtatggggtttgccacactcatcttcagagagagtattttttttattctggaataaaacaactttttcaagtcttcttggtcatggcttctccttacaactcagagagacagaagagctcttttccccttggtgggcggagcccactgctcttgcgggttgctggcagtcttcctggctcctgactagccttccacctctattttcctcttgctctccaaatgtgtagatactgttcttttcctcggtccccagggaggcatggaccacaagatattactgaagattgagcggtaacagaggagagttgcttcaaggagagggaggaagtctaacagagtcagatgacgaaattacaacgaatttagttgaaagctccatttggattttacttttgattttaggatcggtaaaataaaatgagtgttcctatgagctgagggtgttggctttataggcaaaaaagggctgaggaaagcagaaacagagaacaaaaagcaaattggcctttttaaggggtactttatagagttcagacaaggggacttcctcgttattctgactctggctgaccagaattgcctgctttttggaaaactggtccatttcaaagtttggtttgattactgaacacttaacacaagtgactccgttctggttttggtctgttctgcctgggcccagggcaggagactgatcccctaaaatggcctcccatgcactttgtttaataagagatttccgacttcacttatgaaacccagcacttgcagcctttccctgacatccacactctgctggtgccctgattcttccaattccagggcccgagactgcccctcactctcccccctcttctcaagggaaacaaactggctttcctaatagttctaatttcccagagagggtgccctgctcacagaggaacaggctttgccatgactatgcagagctttttcatcctgatgatctcaaaatccccttctagaggggctctcagccttcactctgcagatcaagaagcccaccagtcctcacccacccgactcccaccttccctgcccctgggagccagctttacccagacgagttctgctcccagcctctaaaatgcagaacgggctgctgctttcaaagctatacttcgatggagtttcctatactagtgaaatctgttttaaatgaacatcaagaatagccttgaaagggaaaatatggactcgaatctacgccgactggcaccaagcggcatgtgagaaacgtgaggaaaaaaagtccagctcttcctgctcgtcagctgggccctcccccttccagaaagctaactgtatgtaaatgaatcccttcatctttttttagacccatagcagttgccgcgcttccaaatttaagtaatatatgctaaagttaacttagtagttaaactatgctttggagttaaactgcctgcattttaaatccaagacttaccacttattagtttttatgtttgttttgctttgttaattttttttaactctagatgagtctccatgttcttgcttaaaaaaaaaaaatattatttactcctgcatcggcaagaggagaaatcaatggatgccttcaaaacactcaggacaatttgtggtgcatagttaacacgcaatacttaacaaagttaatgctcaataattgtcaatgtcacattccccacgtccattacttttctgttagacaaacaacaacccccacgcccccttcccccaccaaaaaaacccagccccttctgagatttactggcgtttggggtaatgccatcgcagcagagctgggcactgtgagtcccacggaatcccgctctgtctgccatccctctctatccagcctgtggcttcatggcctgtactttcttttaactgaggttttcaggaaatcaaatagaagggatttctgtaggacgatggctccgaatgctgcttggatcttctagatgttcctcttttcacacacgggtagcgtctccctggctctctttgatgatccaaatgcatcactaacctatttccacagtgctggggacactgtaccaggaagctgcctctgagtcctcagtaccaacagagcagattatgttccatgttcttccaattggattcaggtccctaagctgaataccagcctgctggccctagagagtagagaagcctctctgcaccttgaatttttcactcatttcagagaaatccgtagcctcatagcagtaccttccccatccacctccccaatatactgcacacatttcattatctagttctttagctcttgtggcaaatagatattaaaatattaaatctgtctaagatatcttcttcataaaatattaagagaaaatgtctgtgttaacaatgttttaacatgaaatcataaacaaactgctgtaattgggtatttttcttctgaaggtcatatgcctccagaaaaatcaccctggcaagtgtgcaattcagaagagtaatcgcgccttaccttcagacactgtgcttttttgtgttcaaagagcattctttaaacattaattagttattccaccaaatatcctaggaggtgcggattaatatctgctaaacacagatggtgactcaaagggagagggaggctgaatcctgcctcacatcacacaacgaattggaggcaggactctttagtttaatccctgcgaatggactagcaataaatcacaaactggggccaaggaaccaaggagtatttattctaaatttcttatggatttcttctattcttggatttgtatgaaacccatagatgaacccctgagaagtaccttcatggatatgagtccactatcaatggaccccttaaatcagatagtcactgtcccaaggatctgcagctaggcactgttagaatgaagctctctcctcctgtctaacaagatgggaactgcttgcttttgagtccattttagctacaagtgatgttttatgaatgctgaacagtagaaaaaagagacgtgctggcatcttcctgggatcccaatacactaggactactacaggcaaaaagctcagaggttaactggctgacaaccctctttgctgacaccagccatgagtgagtgtctctcagtccctgccctgtgcttttcctaaggacttacgacgtccccatcgcataaaaccacttgcaaccattcccaataattgcagtgtgaaaagtgagctgatcagcatccgacttttatggccggctactaacccagccagcattttctaataatactttgcctttatatcccaggatcgcagagcaatttacgaagattaattagaagcgcctcagaactctccttcttggtggaggcaggggcggaggccatgagaggggagttaaatgagcctccctggagtgtgggaagtgagaattttaagtgagggctcctctggttcaagccgggactatatgtgagaataaaacgctgggtcccattagtagtcaacagagaaacaatctgtcatctgatattccaaaaggattcaattgggaggaagtaacgagcgtgtatttgtttattttttatttgaaaaatgatgtaaatacccaaatttgttactacccctggggtttcggcaagatgcccaagatatctgcaattttgtgagattacagcctgtgtcaatcaccctggacggagccatttcactctttgcccttcagtgcccacagcctgcagtctctggttcgccgagaggccgagggcgagctgggatccatgtgaccctttgatgtctgatgggacggaggctggccctctccgggcctccccctctcagtgctgcatcgggcctggtgctgccaggatccgcttggcaaagaatagggaacgatggtggagaaaggactctatcaggccattgaagaagcgcagctgctgagaggccaaggggggtgcagtgggggggaagctgcagtgacgttctgttttgttcttgcaaccaaggcacaaattaaggcaaaattagagactttctttgggctattggacggatgggaggaggaggaagacggggaagcagagcttttaaggacagcaatttgagaacatctgagacaaatctgtggctgattctttttttgtgtgaattagttagtgactttctttttggattccggaggggtttttccccccttcctttccctttttgcaccatgcacatgtaaatgtgattgagaattctttcgtcagatctgctgccttggcagccttcctgccagctggcctggctgggggaacccacgctggcggctgattgcgattgacaagtccgggtttggtgggaggaagttcaccatgggagacactcctcaggccctcctttggggcttggttcctgcaggaaaggagggtagaggggaccccccagcaggactgaactcctcctctctgcccgcagagggcgcccaagccaacaccaccatgttgtgtgaccacctagcaagcacagttgtgagtgcagacggtggctactctcgccggggcaccatctgatgcagaatcactgatgcccagagtcgagtagagtttgaaaggccatggagtttacatcctccttctctatctcatttcatgcctctatgtagggcatttcatcaaaacaccgagatagaagtaagtgtaaaaatcttgcctgccccaaatggttgtagtgtgtggtttgtcctattttttgcttctctgtttcagctcattttctctttgtgtcctttcctttttcccactgtggctccaggccatgttgatttgctagtgtttttccttaccatctttcctttcttctccctgcccacgcagattctcaccaatttgccagaacctaactcaaggcttccatccccacaagttctctctgctaactaaatgggattgtgtttacaactgttgagcacagaaacttacctgtcgtaactggtctctaaaagttcagtgaaattacacactgtcataggtaatctcgtgtgtgtgtatgagtgtgttagccttttaaaacaatattttagtttttcctttttttttggatacaggttctctctctgtcacccaggctagagtgcagtggtgcaatcacagttcattgaagcctcaacctcccaggctcaagcaatcctcccatctcagcctcccaagtagctgggaccacaggcatgcagagacaaagtcttactatgtagcctcatgtgatcctctcctccttgagtatgggttatgcttattctattattcttacaaatagaatacagccgtagtgatgggatgccacttccacaattaagttacaaaaagcccatggatttcctcttgggcaagctctctcactccctctgggattactcacccagggagccagctgccatgttgtgaggaagccctgtgcagagacccctaacctgttaatggtcatatgagtgagcttgaggcagatctgctcctcctcctaggcaagactttagatgagaccacagctctggcccacagactgactgtaaccttaggaggaaccctgagccagaggtacccagcaaagctctttccagatttttgaccccagaaactgtgagataataacagtttgttgttttaggctgctttgtttgttacacagcaacagataattaatacaatgggttttctataagactcttttctcctcttaaggtgctttaaagaaaaagacggtaggttttcaaaaagaaaatggacaagcttcagcatgaagagactgctttttaagtgttttcaactctttggaaagaacaatctatatcacttatctcacactaaccgtttctgaacctagagcaacttcagctattgaaagaggtatcaggcaatctactatatcaaattaattttagttaacttaaaaaataagtgatgctcaattgggaggctacggagcaagcagaagtactcagaaaagagaaggacactaaccagtactaactacacccagtcattactccacgtgacttgcattgtattatctcattttatttacccattcatgctctggagtgagttctgttattatctccattttacagataaggtagctaaggcacagaaagtttaattacatttcccaatgttgtatagctttgataggctgaggtgggcagatcacgaggtcaggagatcgagaccatcctggataacgtggtgaaaccccatctctactgaaaatacaaaacattagccaggcatggtggcaggtgcctatagtcctagctactcgggaggctgaggcaggagaatggcatgaacccaggaggtggagcttgcagtgagcagagatcgcaccactgcactctagcctgggagacggagcgagactctgtccaaaaaaaaaaaaataggccttacttcgaagtccatactcttgaccacaaattattctgccttaccatttcagacaaattcaaattattaaatacaatcccattttagaactcacaaatattggctaattgaaaaattgatgaataatatagatgtagaatgaaattgatactatattatatattttttaattttatcctatataggcaaagcttatttcaccagtcataacacacacctgcatgagtggaattgtatcttaaatgctccactgcacccagtccaggactctattctttcatgactgtgcatcagaaacaactggaggaagtaagtaagacaggggccagcacagagagaattacagtagttgacagcatgaaagaagaggtggtcagagatcaaaacaagttcagggctggtggaatacaaagtgagagagagaaaaaccaaatcatcatctttaggatgaggctgatgaggaagagtgacccatagctgagcatcaagtaagccaaggtcacagaaagacaactagtaataaagcatgtgtggaatgcttgctatgtgccaggcactgttctaaatgattgtcatgtattgtctcctttaattttacatcaccatatgaggtggttactaaaagcgtccccatttcacagatgaagaaaccgaggcacagattattgttaactcccagccacaattagcaaataaaagggttaagacacaatgagagatctgctgcaagctcactcaaatgactgttggcaggttttggtcccttgccaagcaggcgtctgcacagggcttcctcacaacatggcagctggccacccccagtgagcaacccaagagacagtgagagcttgccccagagcaaagccacaggctttgtataacttaattttgaaagtgacatcacattatttccaagatggcctgaaacaaaaatcctttctcttgaccactactgtaaattttcttggcaatgtagtttaagtcagtactagtgtgccatggttatgaagcaaatttgaattaaggaatggggatatttaccttttgctatattttatagatgctggatctgggtagggcaaggacacaaaaaccagtgatagccagagggatttgccatcttggtaacttgagtctacctagaaccaaaacagacaatcaaaagaaaaagcctggaataattatttagtcctgctataattttactgaacatcatcaaatttttaacacttgtaatcaacctactatggggaatggcatcaggctagttgggtatagaaaactacgtcagacaaggtctccatctgcttatgaagacattacatgtaaatattaactctgggcaatgtgtacttattgttaaatggggtaaagacattaactgcttgatgattctgagagaactcactgtgagctcatgtgctgtgatttgggttttgaacaagagaaagaaagagaaatggcattaacaggtgtggctcatgcaatgtgaaagtggagggtttatatgggagagtagtggagcctcacgctgcagaggactcatgcctgagcatgctaggggagaggttggtcttcgtcctgtaggttgtgggtggacactaaggtttgtgagaagacaggtggcatgataaattagtatttaagtgagattaacacagcagttatacaggaaaccatgccactcttaacctggaaaaatgtgtgtgtgtgtgtgtgtgtgtgtgtgtgtgtgtaggctctggttgtagtgggaaggcacgaggctagaagtcagaagacccagtttcttgtaaatatcttaccattaataatacacatgaatttaagcagggcttttttctcttccctgggacacacattcttcattataaagtgatgggattggagactctcctaaagtcctcccagcactagcattctggatttttcacactgccatccccctcaattagtgctgtaattaaaagctgactacacatccattctccatccagaaactgcagtccagggcttcccacaggagcttctgcagaggcaaaacaaccctgtcctcttctttcttacacatgatgatgaaaccaaagtgtttttctcccctctggcttatttaaccccaaatcattatttgtttttttgtatcttatgcctttcatgtcctaggtttgaaggtgatgtgtacatggcagagagacaccatcccaccccttcctcgtcacttttgttgaaaaatgttcctgcatccacacatacacacatgcgcacacacatgtgacaccaggtcactgcctggcctcactgctgaggagatgaaagcaaagtttccagggcacttattgtgcctcacctggtgtcccttagctggaggtgtgaggcttatatcaggtaatacagagtggagggctcgatccccatataagtagtacatttcagaaagtagcaaagaatatttcttctgcgctaaaacccaacaaagcagcaagggatacgctcttccccagccacatgccaggatcctcctaaatgcagatattcaccaaggaactggaacgttctcactccaaggctggaaaaatgactcccaggataatctgtggatgtaatttgtctttcagtctattttgatcaatctcttccctgcacccagccctcgaccttgctgctactgggaggctcattctcatggagacagggagaacctctgtcccctccccagtcaaaagtcatctgtgtcctttctgttttttagaaccaggactgtctgacagcagtgatgaccctgggggcttgtgtcatcattcaattcccatggtgggggagcaggtgggagcagagatacctgaagcacccagaagtgagtgggtttgcccaagagctgagtgttcattagactgaaaacagcaaacaggttgataccagaggagaagaaccaagcgacatgctggaagcccaaagtaacagcctcagagtttaagaacaggggcagaaaacagtgcaaagcagatcccagagatagggccagaggaagtgcactggactggtctctggtgtccaagcaaagtgccaagccaggtgtcccctgcacgacaagaggacaattggatggcttcttaatgtcccaatatcaggccactggcagcatttacaagttattataacaacaacattccttctttgaatgcttgctcacggccagacactgtgtaagggctttagaatactattaaaactcatctgcatggcaattgatgtgaaggctcttttctccatcttgtaggtgaggtaacgggcttcctaagagaacttatgggacttgtccaagctgtactgtataaatggccgatgtaaggtttaacccaggtctggccccaaatccaatgctcttaattactgaactttgctgtccccacacaactccaaagggatagcatgcgagtggatacccagtcatcatttgggcagtgctcagtggccctgaagtgaggtgggctggagacaggactgcactcccaggagaagggctccgggtaacctgaggtgacaggagcagcaagcaggctggatgaaccaaatgaaatccttgggcgtagtttcagtgcatccattctgggagagtcagcagcactgattcagccagagcttcaacttcttagggaaatttcttgccagctcagctgttaagactcaaattcctcacctcctcccagcccccaccgcagggttctctgctcgctgctctcatcttccccatgtcactcactcatcgcagaaccagaaggctcagccagcactgaaaggtccctggggaaaggggggccctcctggggggcccagatctgtaacaaatgacttcccgcagagacaagctgtgctgtgctcagaggccctgctggggagggacgaagcctcccgtgggcctgcttggtctatctgctgctgacagtccatggagctgagctgggggagatggaaggggggcacaccctggctccccactgggtttaggacccagcctgctgagattcgtcccatctgacaaccctgcacggagatgcatggattccctgcctaacaagactatctactggtgagctgagctgggtagttcccagctcaaatgagccaaggcttgagatttgctccccgaaagggtcactgataaagaaaaccccaactctgttgccttcagtgtgtctttcaccaggtagataggttctgtcagtcacatggaggaagcttgagagtgtggatggctcagccctgctcatcacagccactgggaaaatacccagagcgctaatgtgcccagcagcaggcaccagcatgaatgggaagggggcagttcattcacagctgaaatgcacttccctgtgtctaacctgaattcctcctgctgcaaggtaaacctcccttcgtttctgattttattagagaaacagttcttgtgttatgctctgggtaagaactactcagttgttggaagcccatcccacagcctcacctgctggaaatcagtcacctcttcttttcctccctttatacaaatagagcacttttgcccctggttggataatgatgttcctcataacaggttaagtcaatggttaagtcagtgatgaggggtaggaaactatttttattgggcatccactacgcactcaccccacttaatcctatttaacttagtatttgtcaaaggatcagaggaacagctctgactatgggaggcagaattactgggctctgctaaaaaatgtggtagagcatgctgggccttcaggcctagactggagtcctcacactgctactaactgagaagctttgagcatgtaacttcacctctctgagactcaatgtcctcgtctgcaaaatggctttgagcagcagctatagccttttaacctaagatccacgaagtctagcccagggcctggaaatcacacatgctcagtaatgacttgtttagtaaacagggcagtgcttgaatgattctggtacagatcattcaaataacatatttaaaatgccttacaaagcttggcatataataggtctttcaaaaaaaaaaaaaaaaagctagtttcttttgtcctgcagtagtgatgaaagccaaacaaccacgacctgaaatttcctctctcctattcacctccccaacacaaatacacacacacaccccaaacacacacacacacacacacacacacacacacacacacaccatagttcaaagttgacctttaggggctgtttcctcctccttccccaccactgcttgctccctctctctacctggtctccttgccagccctggcctgccacactccccaagctgcagtcccccaggtcccctctccctggcccctgcctccccacaatgctgggctcagagcagatgtgcagcagcctgccatcatctctgatgctgcccttccctgccaatctccggccacgtctggcagctggaattgcagttctccttgtttacaatgcattgtaattgcagacacaggctatgctgtcatttgtaattttctcttgtcctgttctccctgcacactcccttgcctaagtgtcaagcagttgcccttgtgagtggtactattggcaggaaatgtgctccaacatgcagcaaaaagcaaactattatttatttctcattctctccctctccactcaatagatgaaataggcaaagagcagtcctgtccctcctgcagcccccacccatccctacacctctccttccccagtgccattagttcctctaattgctaggtctcctctttcagtttggattttgcttcaggatgtctggagattacagggagaattgccttccctgctacagttgtctttcaacaagtgagggagcaattgcctggcttagctctcagcaggtggggtacgagcatcttctggagacaggctgctggctgggacttcccaacccatcgtgtcaggcaggggactgagcctcaccagggtccatgggctcaaggcaactctgcctgtggatctcaaacaagccaagtgtaaaggctcccctgccccgcccccctgccatagcatgcactgttctaagtggatgacacgttaccccatttattccccattagagctttgtaaaagccgttatcacctctgcttcatagatgagaaaactgaacccaagtacctagtcaaaggtcattcagctgatagtacgtgggcaaagctgagatttaaaattcactcaatctagttctaaaacctcttgtattttgttgtattttcttttgcgccacattctgtggcctcacgaggatcatgtttgtctgtgtctctggacatatcagtttctgcacttggcaggttgctttatgattatctgtttgtctgtcttctgtctgctactagactgtaagcactctgaaagcaaggcctgtatttcattttatttcccccttgtggtgcctgcatggtgcccagtggatcttttacatggatttgttaggatgaatgcattcagaggcaatatttggtcaggttgctgcccagagattgctaaattctgtgcaccagccttatatagtcttgtttctgaggaacatggatgattgtttgcctctaaatgcataaggatggttgttctagacaaagttagaagtcaggaaaactcagtatgtatctcatgacaattggattcaaggaaagtaatacacactaataggtctaattcatttgtcatttgtaataatttggcactggggaggacctgggaaagaatttatgctaagtcctgtagattttttgaaatccaatacaactgtcctgtaccaagaactgagtgcttgcattagttgagtatattaggagttggttctctttagctcctttcccccaaaatcttatgtaacattctcatattacatttataacaaaaggaaagtttaccaattttttttaagacagggtcttgctctgtcacccaggctggaatgcagtggtgagatttcagctcactgcaacctccgcctcccaagctcaagtgattctcccacctcagcctcccaagtagctgtgactacagtgcagaccaccgcgcccagctaaattaaaaaaaaaaaaattcttgagatggggtcttactatattgcccaggctgttctccaactacggggctcaagccgtcctcttacctcagcctcccagagtgctgggatttataggcatgagccaccatgcctgaaagtttactaatttaatattggtaacaattctccttctgatgaaaatattgcaacatcttgcagggaggtagaaggaaggaaatgagctctggcttgttcacctgcattgagacctagagaagttgacagggaggacaggagagtagggcgccatgtactctaaatattgcagtaatttctcctctcttcctcacatccctactcagccactcagtagccatgtgtctttaagccacttgctcaatctctctgggctctgttctcttacttataaaactggtctaaagatccatctgcttcataatattttgttggcttaagtcatataatgtatgcagaatgcttagcccagtgtctaatgcacctgcgtctttaattaagggggaattccacatcatagctgttttgccatttggggaggaaaggcagtgacttgaaggaggtgggatggctgtagctgagtctcagcatggggcttgctgctctgtctagggctcatccagccacagcaaaatcctaggcgtggtccaccagtgaatcacctgctggtgtctctaccctccctccacatcaccatgcgcctccaccagctgaaggcaacagaaagctttgatgagatccaattaggaataaagactgtacattcaagagggctgagcagttcacacggaggggaaaaaagaccctgaaattactgcaagtgctcagcttatgtgtcctcacaagctaaatagtgaagaaagatgtgtcatttagaaggactgactcctggtggaggtttgcctctcatcagctgagaaactattattttgcaaatgacatctccatcccaagcaattgtgtttcccccttattctaaaacacacataaataaatgatatttagagagctgctgactgtggagaaggcttgcctgagatgaaagaaaggaagcttgtatttgccggaacggactcttcacaaacctctgggatgggctgtgtacagatgaaggttttgggctgacagtgaaggcatatcaagcttctgtgcctcctattgggaactactgaggactttggaaaattagagggatttgcaggaaggcaagagtagcccaggaagacctcaaaagcaaaccttaaatacttcagagcagattcagggacagctagacagagaatggtttacttctgttgaacaaaaagcagtagaaagaagccaggggttcttgtcaacaggacataaaatacgggagcccatgcctggattgattgacatgctttgtttaggagctaggtcctattgcagtcaccatctgcatggcaggctggaagaatgccctgagtcctcatcaacatttgctaacagtgtgaccgggacagtgtttttcttgtttgtaacatgaagctaatacctcccttgtggctgaacctacctcacggtatttagctggaagacattctattaaactccgaggtgctgttgacctgacttttcattcccccttgatgataggaaaccttgatctggatgccttctagtatcttcagttcgatctaatgtctgtcttccttttgttgtcaaattcaagattattatttaagtgagagtctagggatcagcaaatatatttagtaaagagtgagacagtgaatattttaggctttggggaccataaggtctccactgcaaataccagactctggcatcacggcatcgtaggtaaacaaatggcagtggctgtgctccagtcaaatgtcatttacaaaagcaggtggccggcggaatctggcccaaggcccatggtctgcagacccctgacatactccatctgggttttcctcctctgccgacctcctcatgccatcccctctctagccttcctttctgctgagctaggcaggcagtggggacagcattcatttagggttcgggtaaatctgcgggagcagaaagcatgtctaaggacaccatggaggcccaagccctcgaaggtcttctacccgtgtccctgtctggagccctgtactccaacagacatccctggggctggaactcagactgattctcccagttaatgtgatactcagtgtattagtcagggttctctagagggacagaactaatggaatatatatacgtatatgagtttattaagtattaactcacacgatcacaaggtcccacaataggccatctgcaggctgaggagcaaagagagccaggccaagctccaaaactgaagaacttgggtctgatgttccagggcaggaagcatccagcacaggagaaagatggaggctgggaggctatcaggatctcttttcacattttcctgcctgcttgtattctagctttgctggcagctgattagatggtgcccatccagattaagggagggtctgcctttcccagcccactgactcaaatgttaatctcctttggcaacgccctcacacacacacccaggatcaatactttgtatcctttaatccaatcaagttgacactcagcgttaaccatcacactcaggttgggcccttaggaaacttaggggcccctttaatgccacgtgggaggttcaagctgtctgtggcacttgctctgtcttcctctgtctacccctttgtgtctgcttctgtctctctgtctctctctgtctctcctcccctttccccctcaccctgcctccacttgcgctgctttccccaccactttggcggggaagcacctgcagaggctgcactcagcaaattccagctgggaaacacaattccagcttcccacctcccctgtccacttcagattccgcattctgggccaaggtcctcttttatcctacccggacatatcaaggcctaaggcgcgcaagttcctgttcctatttctgctgcactgcactgccctctacccttacccctgggaaggagggacctttgagggcaatggtcctgtccctgagctttgtgctcagtgtctccacagaaatcaccccttttcaggtgccccagagtgagggggaggcaaaagcaaatggagagaacattcaattaaaatcttcaatttcctaccgtcggtctgtggatcaagggagtgcacatctcccagcaccaagcagctccttgttatctttattatctttgttaagccttattagctttaggaaaagttcacccagaagaattcaacagagtcctttttgcccagggtgaaaagaagtccatcaggagtccatagcccattagaaaatcccaaagagagaccagccacaaaactggaaacgtggccagtctgagtggcccaggccccagggacaggagccacaggcctccagcccttacgctgggatccaattggctctgctccttcaggctccatggaggagcagggcaaggggtcccctggggactgagctcagaccctgccctttccaggctggaaggggaggatacaagggagcagacaccagtgtatggggacacaactcacagtttatcagaggtgggagaattccccctgaaaatcacttttgcaagagatgcctcaagggaatattaaggctgggtcacattttcagaatttcagaaacttttccagaactgttttatcttctagttgtggtgccagatggtaatgttctggtaaatttccgtgttcccaagtggaagggtttggaaatgataaacaaaacaaggtaacaacaacaaatcccttgtactacacgcttgtctttctacactgtccttgttatgtagattctgttagtcaggattctgtgtggctttaacaaaacaaaggtctattgctcccacactgcacagagggagcacaggtcactgtgtgtgtcacatgtgtgcactcggggcggagagctcccccctccattagtcactggggtcccaggctgatgggaactccaccacctcaaaagctgcaccatccgaacactggcttccaccagcactacagcagcaaagagaactactactctcttctcatttgttttctttctttctttctttctttctttctttctttctttctttctttctttctttctttctttctttctttcttctttctttttttctttctttctttcttctttctttctttctttttctttctttcttctttctttctttcttctttctttctttctttctttcttccttccttccttccttccttccttcttccttccttccttccttccttccttccttccttccttccttccttctttcctttcagacagagtctcgctcttgtcacccaggtagagtgcaatggcacaatctcagctcacttcaacctctgcctcccaggttcaagcaactctcttgcctcagcctcccctagtagctgggattacaggcgtgtgccaccacgcctggctagtttttgtatttgtagtagagatggggtttcaccttgttggccaggctggtcttgaactcctgacctcaggtgatgcacccacctcagcctcccaaagttctgggattacaggcttgagccaccgcacctggcctgttttctcattttgatgcatcggcccgagtgtgccatgccctgtctacccagtctccagcagatgccctgtctacccagtctccggcagatgccctgtctacccagtctccggcagatgccctgtctacccagtctccggcagatgccctgtctacccagtctccggcagagctagtcacatggccctgtataaccctatataacctcaaggggacggaagggagaatctgtcggagtgcatggatatttgatgagcagtaaacggctctgccacatcgatctcagcaccttttagaccctgttaacagctgctttagagagaaacattttattggccatattatttatgtatccattcattcattctaaataattattgaatacctctgtgctaaatatacttccagtcattgaggtcataatggtgagcaggagagaacctgcccctccctcttatggctcacaacaatgaaatattgtcatgtgacagatgctgtgataggcaagggacagggcaccccagaagcacagaaaaagtttaagtgcctggagtatgtcaggaaaggcttcccagagaagtcaagtctgcagctgacccatgaagaatggttggggatttctcccagtcagacctagatctgtagcagaaaatgcaagtcaggaatcctgcctccctgggcagagttagaccctgcgggtgactcccttctggagtaaggacagttaaggagtagacaacaattgttataaacagagactaccttaggctgattgttttccttgccttctccaaaagagtacacatcacctctccgaggcggctcacctctggggtctgaagttgagccacgtggaggaacttgctcaatcggcttctgttatagatatgaaattattaataactgggatgtagctgtgcatgttcggaccctcctcccagcagccctctctggggatctggggtgagggttgtagggagacaccttgctgtttaataaataatagaagagattcataaagtgtctgggaagcacattcctcatgcagaaatgttacggaataacacaggatgaataatagaaaaggttattgaaaaattcataatttccaagtgccagtgaagggcagctcctgtgcagtctatttgcctgtagaaaagtgattaaaatatatattattgtcctgtctataggaaaatgtattattaagtggatactagcatgacatttggaaaatccatttcattccatttagcagcaatgggcttttggctgctgctttgtgcagcaggtttcacaagcattttaataagccttttaaaaaacaaaaaggggattttaattatggcccctgcctcccagccatgctattgctttgcatttaccgttcctctgccaaagaaattttaaaacatataatggggaatgtaaatatcctgcctacgtttagcaggtccactgccaagaaaggaacctgaccgctggccaggaggtacttatgggctgcaggaaggcagaatgggagataggtttgcctgtccagacacaacaagaagcaaagcctcagtgtaagaggcccataatccctgccaagccttacgtgtcactactcttctgtataaacattcactttttttttttccatatgaaaccaggagttacttttgaggtctaatgagaaacagttcctatttctgaataatgaattgagtcaggatcagggatcatctgatttgcccatctgcttcttggcaaaatgcatctcctcagcttgaagatcatatgcccagtactgctcggagctggattctgaatagattcaggtttggagtttgggatggggcacctctccatgccttgctcagtattcaaattctcctataagttgggtaagggccaggaggcaggatgggatctgagaggggtgggccacgccctttcaacctcaacctctgatttggcttggacagctctgtggtctgatggtctttcggggagcatacagatggacagtggtggcagcgaggtcaccccagcaggtggtgtaggaactgaggcagaaggagcatgatggaccagagcaccatcacagtcccagtctcttccctactaactgcataagtttggcagagtcatctgacctctctgggtctctctgcattttaataatgaacaaaacctctttgggttttaatgacaaaaatagagcaatttacatcacatcatagttttaaacattttgtttaagacacttttgaataattaaatcatttgttttaatgaaatctcatttggacgcagataaaattgtttctctagttgaagagggattagggactaaaatgctcccacctcaaacccccttccctctccttttttttttttaaggcagccccaggaagcctgtagttctgattccacagggattcctggagcacagtatgaaaaccaatgcatttaatgatacagaagttcccttctgactacaagtttctcaaattgaattgtggcctgtgtctgactcattgggatgagagagaatggcttttctgtcctcatttttactcctgtttatttagtcatcatatatttatccatttattcaacaaacatttactgagaactgcacatgtgttgcatttattctagaatactggagtgagcactgtctgaatatggatcatgagcaagacatactccttgttctctctgatgaagcaacaggcacctaaacagggtgccatatggttcaaaacacaggaaataagagttatattgggggcacaaacagattttttactagtaaaaattatgaattaggtttaaaaagaaactaaatatctctctagtttattttttaggccagtttattaattaaaagtacttatttcatccctgtatggatggcagattgctactcaggcaggctgtaccaggatggtgcctcagctgctgaaatactgaaatagttcatttgggttggtgaatagatcctgccaaaattccctgaatggcctttgctgttctgttaccttaaacccacctatctccaacattttcttgattcaactattctcctaaactgtgttagtaaggacaggggtttccatcgccatgcagtgcggtgttcagagcctggtctgggtggttaataccagtatcttaccacttattaaataagtcgaaaatatccttctcaaaaagtcggtctcctcaatgcttccttttgattccaagttcccagaagactggttgtacttaatattcactccccatagagttcccagtgttttcctggcttgacaatcagatagtgaaactaacatccctctttggcattttaaaattgcttcagattctctacactctccctaggtgatctcatttaaatggcatctttatgttaatgactctcaaatttatatcttcagcccaaacatctctgagttctagactcacacatccatctgtctacttgacatctccacttggacacctttcagaaagctcaaacttaacattctccaaattgagctccctttttatgtgatgctatatatctgtccccatcgattgtccctatgtcagtaaatgaaccgccattgactcaagagctcatgctaaatgcccaagagtcatccctgaagcttttctttcacttaccacctatatttaattgtcagcaagtcctgtcaattctacctgcaaaatatgtcttgtaatcaaactttcctcttcatctccactactgccatcttagttcaagacacaaatgtatttctatccagcaactaaccagtctttcaacttctactcttgatctggctcaattaatattccatacagcagcaattgtgatagtgtcactcctttgctcgatccttttaatcttcctccattgcaataaaatccaaacttcattccctagaccctaagccctgcacctgtgtcccatgcttgcctctccccactaactcggtgccatttatcattttattcatgctaaaccacgtgggtcctctccatccctccaacatacccacttcagagtcttgactttatcctctctctgcttgggccagtgcttctcaattataatgtgcatatgaataactgggaatcttattaatatgaaaaataccattccacagatttagggtatgggccaaaatttgcattcctaataagctctcaagtgatgctaacactgttggtccatggactatagtttgagtagcgtggcttccgttactgccatcccagatttattgcttggctacttcctcctcattttaaaaaatcagcttgattgagatataattcacacaacttgcaattcacaagcttaaattgtgaaatgtattggtgtttagtatattgacagagttgtgcacctataaccacagttaattctaaaacattttcaagaccccacgaggaaattatgtgcccattaacaagcactcttgacattgtcccgtacactcagcactgggcaaccgttaatctgctaatgttcccacagatttgcctattttggacattgaatatcaatggactcatataccatgtggtcttatgtgacttatttcttccacttagcatcgtttttcaaagttcatgtgtgttgtagcatgcaggtttcataccccatttctttttatggtcaaataatatcccattgtgtagatctgctacattttgtttatccattcatcatttaatagacatgtggattgtttttactttttacctgttataaataatgctgctttgaacatgcttgtacaagttttagtgtagacatatatttttatatctctttagtatttgactaggagtgggtcatatgataactgtgtttaaaatttataggaaccaccaaactgtttttcaaaatgtggacacaccatttgacagccacatcagcagtgtgtgagggttccaattcttcgaatcctcctcaatccttgttatgatctgtctttttttactataaccttcctcgtgggtgtgaagtggtatctcactgtggttttgatttgcatttccctaatgagtaatgatgcatattttcgtgtggttattggccatttgtatgtatttgtataactttggaggtaggactattcagatcctgtgaccattttttaaattgagtatttgccttattattgagttgtaagagttcttcatatatgtgggatactagtcctttattaactatattgtttgcaaatattttcttccactctgtagcttctttcacttcctcaatagtgtcttttgaatcataaaagttttaattttgatgagattcaattaatctaggttttcttttgtcactagtgcttttgttgtcatatctaagaagctatttcatagcacaaggttgcaaagatttacccatatatattcttctaaaaggttttttttttttttttaaatttagctattatgtcaaggtccatggtaaaatttaaggtctttttttctttcctttttttggggggagggggtgggggagtaagaatcccacttctttcctttgtatgtggatctccagttgtcctagcatcagtttttaacaaactattctttctcccattgaattttcttggcacacttgtcaaaaatcaattgatcatatattatatatgtgagggtttttttttctggactctattctatttcattggtctatatgtctgcctttatgtcaaaacccacactgttttgattactgtaggctactaatacgttttgaaatcaggaaatgtgaggcctccaactttgttcttatttttcaaaactattgtgtctattgtgggtttcttgatttccttattaattttaggatcatcttgtcaatttctgcaaaaaaaaaagccacattgagatttagataaggatcatggtgaatcaatcaatacatttagaagttcaacatctactcttccaatctatgttcacagaatgacttttcatttacttgggtcttttaaactttctttcagtaatgttttatagttttcagagtggaagttttgcaattattttgttaaaattatccctgagtactttactctttttgatgttgttgtaaatgaaatgattttcttgatttcacttttggattgttaattgctagtgtagaaaagtgtgatttatttttgtatatttattgtgtaccccgcacatttactgaatgtatttcttagttctaatactttcttagtggtttccttggaatcttctctgtatgggattatgtcatctgcagacagtgatagctttaattcttcctctccaatctggatgcattttatttatcttttttgcctaactgccagtgctatgctgaatgcaagtggcaagagtgaacatcctagtacagttcctaatcttacagggaacgttttactctctccccagtaagtatgatgttaaccctgggtggtttgtatgtgccctttatcagggtgaggacgtttctttctattcctagcttgttgagtgtttgtatcatttaaagtttgaaaaaaataaataaaggtgccctattcaatttgaagtcagcttcaacagttccttggtagacagccctatttctaactgcctggaagcctcttcttggactatctcacctgaggcagcttcaccaccccactctattaatcattgtttcaattctgtgctttctcttttatgttacttatttaaaattgtaaatattctttcactattcttttcttttttctttctctgcctctctgctcccaaggacagtgagggaccaagtttgtccagttcactgctgtgttttttgtttgtttgtttgtttttgagatagggtctgtctctgtcattcaggctggagtgcagtggtgccatcgcagttcactgtagcctcaacctccctggctaaagtgatttgcctacctcagccaccctggctcaagtgatttacccaccttcaggcacacaccaccatgctggtgtatttaaaaaaatttgttttgtagagataggctctcagcatgttgtgcaaactggtcccgaactcttggcctcaagcgatcctcctgtctaggcctcccaaagtgctgggattacaggtgtgagccaccacacctggctgacggctgtattttctgcatctaccactgttcctggaatataacagttgatcagtcaatgaatatttgttaaataactgaataaataagtgcattattgatgtcctaggtagatagatgctgagtgattcctcattaaatagatgcagaagagactgatggccagtgactggacagcgatgacagtaatgggtttggaaaatagtagaaaaacttttacgatggaggatttcagtggccaagacaaaacaaaataacacatgggaacttgggaactaactgcaaaaagtgttctgtcaagggggtgggcacactcacaccccacctgacatcaggatatgttgtgttcagtagtctgagttgttagcaagtacattttgtttctttgtagggcaacaaagagcaataatagctattaaactctccctggcagtctaaaatcctaggcaatgggccagtgtgctttagtgagttttcctaccccagcacaaaaaaaagaggccgtggtttaagagaccacatgtggctggctaaatagacctctaaatgtatctttatcatcagtttcatctcatttcttttaccaccctggagttaagtctgtccatttctcagcctcctcctcctgagcccccatcgtgatcatctgaattaaaatctgttatcggtttctgggtaatcccctttgatgccctgagtaccgcaggatctgtgttgctcaaacctagcatgcaagtgctgatagcttttgagcagctaaaatggctttgtgtatctcacacaaatgtctgcatcacttgcgaccagccaggagctggcaaaaaagacacaatttatggctggagattttatgaaatggtgagcaaaattgcctttgagggtgactcaggaggcctgaagctgctggccttcttgccattctttgttcactcccttagagagaagaggaatggggcccccatgcctctctgctgttttgcggttatagtcctccctgtgctgtgttttgtttgtttgtttttataataaatcttgcttcagtaggttatccttgggtcacatccgtggccaaagtagaaattaaaattttgcatgaacaagtaataacttcacctgggccaattaatcccaatcatgacatgacccataattgcaactttgtcatttttccatttctttcttccctcaatgatggcctctctctcctggggtaggggagtatgtatgaaagagcttggggtcagggttagcagagcctgcctgtaatgaacactagttgcaaaatgctagaccagctgtgtgaaccctccaacactcatgcttttgtctataaaacaaggtctctaattttcatgtagcatttattaaaagagaatgaaattgatgattgttgtacgtatttaccatcactctccatgctagattgtaaactggactgtagactccaggaaggcaggtgatgattctattttgttttctgtattgccaaaccttgtacgcacggtttgatcggtagacatttttggttttttgtgttttttttttgttttataattattattattatactttaagttctagggtacatgtgcacaacgtgcaggtttgttacatatgcatacgtgtgccatgttggtgtgctgcacccattaactcgtcatttacattaggtatatctcctaatgctatccctcccccaaccccacaacagtccccagtgtgtgatgttccccttcctgtgtccatgtgttctcattgttcaattcccacctatgagtgagaacatgcagtgtgtggttttttatccttgcgatagtttgctgagaatgatggtttccagcttcatccatgtccctgcaaaggacatgaactcatccttttttatggctgcatagtattccatggcgtatatgtgccacattttcttaatccagtctaccatcgttggacatttgggttacatttttgaatgagtgcatgagatgacttgataggaaagaactcagtgctcaggctgtcatagaataggtgttcaggaaatcatccttcctttaccagtttgaatgtttctcagatgcttcatatcaactgacagtttagaaaaacctcaattaagaaagaaagttcttttttttggagctttgtccatgtgaggatgtcccatcatttcttatggtgacaggccctgacagcctcatgcctcctgaccccagaggctgtgccttaatcagatgtgcatgaagccacggccctcgattctaggccttgctcctgggaacatgtccattcccgcctttcttttcagcctatcaattattcctcgctctttttgtctttctctctctcccttttttacatcccctctctctctttcccgttttccctgtctctattgctctctctctttaaatgtgccctgtttgtagagctttctctgatattttctggcccagttggttcatttattaaagataagatatcttcagggacgctggattcaatggtgtcctacagtgagttgacgatggagtcatgatgaaatatcaaacttggaagctcgaccctataggctttcctgtgtttatgctactgacagtagatgcaaatagtagttaaaataataatgtaaaatgttttcttaaacaccaggggagctcatttatggaaataggcctattcgcatgcccaacagttaaaaataacaaaactgggggtgcatgggtcaggatgtggacaggaaacatccaccacagttttctctgaacctcgggaggctgagctgggcgaaggcgtgggccctgcacggctctctgcttctgtgctctggatgggagagatctgactgccagggttcctttccctgaggcacgcaggcactaccttcctgacaggtttttctcagccacactgagagcttaggcctgggttgcttgagatggtgtgctgtttgcattgttacgcctggcttaatgataaagcttagaagtgtggtcaaagtcctattattaaagtcatttaaacccagacaggactgagtctgagagaatgcactgcagggaagcaccttgcccacactcagtagtggaagctgtgacctaagccttctccatctcttatttcaatttccccatgtctgctttcatgctgtgtggtttcctgactgtgactcagtctgggtttccatcgcaggcttggacttaatcccgagaagatcgaagacgtcttgatggggcaaggcattggaaaagcagactgtggtttgcatttgagctggatttatctctggtgctttttgtatgagtaacaatgccaagccctgggtctgacccttaatagattcttatttgcagaatgtgtaaataactactctcctttattcactcctcttgaagagccaaacatgcttctgtcttcaacccttctacccagtccctagttcacttaatataaatgctaattaggatgtgggtttaaggtcactcttccctctcagggagaagggaccaaacacaggctttccatctgcagaggttggcagagctcaggttacctgtttttcttttgcttctaccccttcatctagtaaagaaggtgggtatccctgctctttgtaacaggagaaacacatttctttgtttgagtcatttgcacagttctggcaaaatcaccctagcagcatcttgtggaaaacaaaaatgcaaaggcacagatgactccagcttcccacagtgggtagccctaaataggacacttgccaatggcaccaaaacaatcgttaaactgtccaacaacgagctgggtaaactgagagaaaataaacctagttcaagcaaagaaacaaaactagggactccagcaagggcggagtaaatggagtgcctcctccacagggcaggatgctgcaagcccctcatgggtccagaatcaaaggctttggattaaaccatggcaggaaacccagctctttccacccaaaacaactgctgaaccagaagaggaagaaagaaacccattaaaaactttgttcctggggcttttattggggcttttggcccacggaattcattagtaaataagtgcagaattcttctcctatgtagaatagtgggctcaacccagctgggcaggcgagatccacagtttcatttagaagaagactgttgttcagaaagctctgcaccaggagcaaggagagcttggttttaacacaagcttacacaatggggccaaggagcagagtagatgataacctgacttagggtttaagtgaggaagcattcaggagaagctccagcccctgagaagtgttctaggaggctgtggagcacccgcagatcgatagcatctgggcaggcagggggtaagaccacactgggaatggaggagggcgtgagtagtagcatgagatgaggatgcttgagttggtgggagtgaaacatatgtggggatatgctatgaaatgaacgctgaggatcctaaatgctggaccaaggagtttagacttgatcctgacatcagtggagaaatgctgaaaggattttagagcagaagagtgaaatgaaagtggcatttaagaaaaattgatctggtgaaagcgtgcagaatcgattggattggaggcattagaggtggccagacaaagagatgctgatgtaaataatgggatgggagctgaggggaacctggactgaggtgtttataagaatgggaaagaggcgtggaggagggaagcagttcaacatccatctctgagtgtaggaagaggcatcggggaccaaggaagctgaagtgacgctttgggtttttagcctttgcacctgaggagggaaaaggtggaaatatggtcaaaaaaatgtgagtcaggaagaggagctggctttaggaggatgatgaatgtggcttttcttaaacttgttaagtatgaggtaatagcacgatatcctaggataggaaggtagagaaactcaattagaacttgagcttcaaataacaccttggatctgtgcagaactaattcctggctcctgcatgtatgatagcattttataatcacacgctacacgctgcatatgaacatgaatgtggtaattacaggataaatcctccggctctctgcctctccggctcctctgtgtggaatcagattgctctgggactgagagaacaatagatcaaaggggaatccacttacataaagaaggaggaaaagcacaaggaagaaagacaaaagatttttaattcaaaaggagctgaggacctaaacacacatcactcctattgctaatagcaaggaactgcagctagaagcagaacggaactaatgagaaagtagaggcattaggaaggaagacctcgtgctggaactgggctgcaattcggtggtggaacagaagttgccagagctaatgtaatgtgtgaaacatgtcaaccaaggtgggaaagaccagactttccccacacagagctatggtgatttacttacatatctgtgttcgtgaacacatgtttctgaagatggtcagaagtagattctgaagattaattgctaactgtggcagccatccttcaaggatgacttcagggaccctcacctcctggtacacacacccttggatagctcctttccacagtctgtgaataatagaaaatggcagaggtgatggcatgtgacttcagagaccaggtcatagacagtattatcacatttgccaccacatcctaaggggaaagccagccaccacatcctaaggacatttgagcagctccttagagaagccctcagtcatcaccagcactgatttgccagccatgtacatgggccaccttggaagtggatccacccacagcagtcaaacccctgcctgcaaccccagtctacctctgacttcaacctcataagagaccctgaagcagaactgctcagccaggctgctgctgaatgcctgccccacagaaactgtgagcagtagcaaagtgtcatggtagcttaggctatggcctgctttgttatacagcaacagataactaatacgctagttccacaaaatgtactagaactgtggagagtgctcctcgcaatttttattgtgaagaatatttgggctgctgtgatgcgtcaccaatctattgaaatgtatgaataaaatgttttcagccaaagtctatccaaaagggtgcaaagcctcatggagggaagcaaagctcagaaaaagaaatggatgcatattagatgtcaaacatgtgcttattgagttaaattgaattgaaattgcagacagttacagatgaagcactttacattgttacctcacatgtttatcgaatgctgaactactgacgacagcgtgctagtggaaggcttctgtggttaaacttagcacagtggaacaccagttggcccagccacaccagttggcagatgtgctgcagggccccactaagagcagcctctctggctgagtctctgggcactgaacagcaggaagcctgtccccaaatccctacccgggtccctctgtggcctggttgtcatcgctccctctgcctctgctgcaggagctggcagttttgtaatagtcacagtgcagcctcccctcatgtaaagcaggtggaattatccatagctgctaccatttgaggcagaagcttagttccctggggccaggcacatttgaggacactcatgtgtgctgcacttccgtgtgcctccctggtctgtcctcctcattcaagcttctcttcctccattcccacttcccttacagaactttttccttttccatctagcacacttcttgcaggaaagcatgggcagggagcttttccctggtggctggccatcaaccctcaggtctgggcactctcctcgccctggaagctcataggccactccgacaagcagaccctgatgccctccccacccatcccactgaccagggacacccgcctgacttcgtagtttgcccaagcctgggcccccgcccaagttctctgaaatcgtattttacagttattccaaagcccccatggtcctcggtgaggagcacatttttcttccagctggtgcaatgaggaggtttcagcccccatcctcaggtggctcctggggacaagctgtcccctcctttctgatattgattcccaaatgccagacagaggagggaatctatgataagacgggcgcttctttcaaacctagtaaatattataaatctactatgactcaagttcaaccgtctcattttaaaatgtgactaattccagcttctgctggtgtgccttgctgaagagccaggcgcgatgctgagaacagggcgtgtgtggtcacctttcatccttacccactactgagaggtggaaccagctctcccggttcacaggagacgtggagactccgagaagttaagtcactagcccaaagccacacagcccgtaagatctgagacctttttatgccccactctcctaaagctggcgggagcctgggaacaccacgtacctgccttgctttggtggctgaggaaacagaggaaccctggtctctggttcctcactcctggcttcctcctactcccggctgcctccctttgtctgtgaaattctctttctacacgcagacatgcaccatgtttttccctccctgctctgcagaaaacctcaaatagtggtgtcatagaaggacttatgagtagcctctcaatacctgggtgcaccatggggcggagatgcccaggacttgcaaggttcactgagatctggggcgatgggctaccgacagccttgaactagaagcacagactttaaggagctgcctccctcagcgggagctcccttctcatgatgcagaaaacaggcctctaaagagggaccgtgagcgcagtggacagggctctacttctaggatcatccctgtgtgacctgaggagggaagtggttcccataaatgccccatgcccagaagggccgtgcagagttcggaaggaatcctgccccatgctccatggagacccaccctggctgcagctctgttattagcaattacagctctacgaaggaaaataaacactttccccaaaatgggtctgttctttttgttttaagctcttattcttcccaaaggggacaaaagtgctgatgatctgcaaagctgtgaggggactagacaggagggcagtgacccagagaaagcccatggggcaggggtgcaggattattccttaaggccagagctagtctgcagctcttctgtgccatttggcccagttttctggggccagctctgggtgactttttctctgccatcgtcactgctttgtcagttcttgttcaaaggtcccctgagttgtacaactgccattgtctgtctcagacagttcttacactctcaggtctcagagcacataaaactgttgcagctgcatattgtccatcaagactatgaaattggaaaacatgcttggatttagaatgtgttcagttgaaagtgagacactggagatgcctccctcacgtgaccagcagcactggccctgcccgcctggctttgattccagctgtttctctcacattctctggctggctcgccaagctcatgccccctccattctgccctcgcctcctcccacccttgacctttgtggtgtggtagaagcagatggtcttgcagccagacagaggtttttccccttgaagttgctctccatcccaaaaagctggtgagcagatacatttctagacaaagcaatattctatcttaatcaaggcagcacacacaatggcgaaacacttggactgagaaattgggctctgagagacctgggtgctagttctgtctcttttgaacataacacagtctgggactacagtccagttactgggtctctcagcctcagattcctctgtggcaatatagagatgtcacagtatctgcatcatggggttggcaggcgaagtgaaggggccttcaaagtttagcactgtgcgtggctcatagcaagttctctctctctctctctcatttttttttatttagacggagtctctctcttgtcacccaggctggagtgcagtggtgcaatctcggttcactgaaacctctgcctcccaggttcaaacaattatcctgtcttagcctcttgagtagctgggattacaggcacccaccacaatgcctggctaatttttttgtaattttattggagagatgggatttgatcttgttggccaggctggtctcaaactcctgacctcaagtgatccaccctcctcagcctcccgaagtgctgggatcacaggcgtgagccaccgcacccggccgtagcaagttcttaatgaacaggggcctctgttgtgttatgggatgttcaggacatggctcccgtcagctcccagctcccagacagcagggatttttgtaccatgattattttgtgaaccctctggcccctaaggctgtgctgagcctgtgcatcccagggagcttactgagtcactgtggaatctgctgctgaatggacagcccatggttgaggccagtgaacacggcaggacctctgcttcccttgggcagcggctggggcgtagcctagagtccttcccagagccgaatgtaagaagcaaggctaagcgtggctgggtgagtatattcagcatgttagctgctgcttcacatccttgcgtggccctcaagagaatcctcaggacacgctatccagggctctgtgctgttctcagctgatgcctctgttcctgcaattgcatggactctttcatcaagaggtagcaaatcatctacaaataagggttacaggctctgtacaggggacagagatgaaggacaaattgcatcctctgcgcagcactggggagactgcacctgtcccgtgccacctcccagggcaggtccctttctccttcctcacccaagacaacctgctcaacatccctatcacccagaaatggggcttgggagttggaggacagaggaaaaagaaacatttatcaaactggagagtgggaaatgaccgcggacggaggcaagggagagagccaggcctccacaaagcagagaggaagcaatttgacaacgaggtgaaaattgccactgctgattctcctgacactctgagctttacccatgggcccagggaaatctgtcactggctcagggaaacgtctgcaaggaactggtaatagtttagcaatggcctagtgacttagaatgagatggaggctgcggcggcaccaggggacatacctcctgtttttaacccaagatgatgagatacggagacagttctcttccccacccggctcctctggtgactgagccaatcagctcaaaaagccacagggacagagagaacatgcggtcaggaggaaactcagattgagacagggttttacaagcacactgtcttgagggggtgtgtgtgtgtgtgtgtgtgtgtgtgtgtgtgttgtttggtttggttttcctacagctgttttaatgaatgcaccttcccttcatgcagccctcctcctctgtagcatatctctgctttatggcaaatgggttttgattctgaagcaaattgaccttgaaataagttccaggatttgagttcttacaccccagatgctgggtttggaatgcagactgctcaatcagcagattccagctccaactcctgcatctggagggggacactgcattttgtcaaactattaggcaaagtcagaattgtggggctggacgctgcgaggctggggcaggcagaccctaggtgtgctgccgatgtcagggttccctcggtccttctctctgatggcgtgtgtgtactcctgtgtaactgaggccgcttgggaatgttgcagagagtgctgagagtggagggctgcaagaatctagggtgacgtggctacagagctctgatcacaaacccatcatgtcacagggaaactgagtacactttgcggaaagaaaacgtgtgcttcgtacgtgcatatgtttaagaagatcatcttcatcttagttttgctgagttcccgattctactgcgattgtgattcagggattttgttgtaacagacccaaaaacagcaagtatttattgagcatctactgtgtgcctggccatggagcaactatctttaaagtgaaagtatgagctgagctgagtcccctcgtgactgcctgtgctcagcatgaggcaagcgtgtgctcaaggctggtgtctgagtgctgagcagtatgggtgatggatttaatttaaaggagattctggtggctttaatgtgtccaagcgttatgttgttctgagctgaaagatgaatggaactggcaatataggggctcgtgtgaacagaactaaaatgtcctccaccaattttcagcttccacaacacaaaggattgttgaaactcagttctttcccctggggtttttgtttttgaggctgaagcaatgaaacagatcactgcaaagacaaccagaagccttttgtagatgataggggtgaatctagaccagaaggcagataggcagggggttgggagggcgagccacccagtgtgccgtctgaccttgagatggacagggagggggctgtcttagaagaaccagagcctctgggccagcgccgggctactctgatgtggcctgggctacagcctttgggatgagagccaggcagagaaataggtagggagttggtgttaaaaaagcaatcccagaaaggcttgaggctgctcatttgcaagctgtgcatttcttttccagtaagggagacctttgggagtgatttttacagaagaagcagttaggtataactctggttacagcagaaattcagcacatccaagacctcaaaaggcctccagaggttgcttagtgcagccccttcccccaagcaggtctgcgcctacagccattccagaacaatagtgtttcattttaaatatttctcaggaagggtatttcgtaaactccctgatgcactggtaccaaaacaaagcctagcagaaaaagaaccaaattttctctggactatggccaagtgcaatccaagatggatacagatgttgcaaaagcagccagttagtcagcaaatgtgccaatatacctcttctctgtgccctctggtgacatgctatccgaattaaattagttcagtattgcttggggctcctatttgactctgattcattccggtgggagcagcgttttaagttcaaggaagagaggtgggcagaagactttgctcccagtaacatcaggatgtgagcccactttaaaacctcccctatgctcagataagatggaaattgagcttaaatgctagttacacacgttctataattgtcttgcattttagcaaattcagggataagtaagtattgaaaagccaacgtgttctggaagcagaaggcttagaacatgttctatgcatggatagacaggaacatgttccgatgagctagaagttgtgtgcagtagaagactgcccatgtgtatccatcaccaactatttacgccaccaatgcaagatggtattcctgaagaaatgagagtgaagacatagaaaatcataattgtctggcatgttttcagagcatatgtagagtgattaggtaggacaaaaatcctgtgaataaaaatatgatgagaatggaagaactagtgctaggctcgagaggtatgcgaaaacaaacaacaacaatagcaacaaaaagatgtgaagagctctgcctttggagggcgtagctggagtttctgagatgcagtagcactccacagcgaataagcccatgagagaatgcacagacatacagtctgacgacaagggaagcatgctgggcattgagtggcaaagcccgaataaggaaagtggaggcagtcaaatggaaacctgccatggttatcaaggaagtttcctttctccttgcaccataaaataatagggggaggcagccaagacttgccagtctcccaaatgctcccactctaactttatgtaaaacacttgacacagtcagaaaaacctggaacacatatatctctagtaacactgaggctaggacacacaccaaaggctgtgggagtacagaggatgagcaactcttttgcagtagctgaaggtcaggaaggaaaagcagaaagaaagaaattgaaagtagatatggatttagtactacgttgcagcattttgtctttaaaaccatagtttatcagactaaaatggtggggcattggcaacagacagaacacactcaagaaagagggaagaaagaacacaattggccacaaagtgaaagagtcaagacgcaaatttttcatgaaaaggagagatagagccaaatggaattaacattagattttatgaagagcagcagacgtggtgtagaaaaaatgtaacagataagtcacccagtaaaatagcaaataaggatatgggggtaacatctaccgctaaacatcttctttttttttttttttccttgctctgtcacccaggctggagtgcagtagcatgatcttggctcactgcaacctctgcctcgtgggttcaagtgattctcctgcctcagcctcctgagtagctgggattacaggcacacactaccaagcccagctaatttttgtatttttagtagagatggggtttcaccatgttggccaggatggtcttgatctcctgaccttatgatctgcctgcctcagcctcccaaagtgttgggattataggcatgagccactgcacttggcaccactgaacatctcatatactaaagcacacaataaaaatagccagtaaaggtactacgagactatatccaagagggcaagttctatgactctaagtttgaaataaagttttctttacagacattttccctgatttctaagcctcttcagctgcaccaagggtctcctcatgtctacagctaaaaccattttcaagtcatcatcttctttaaaatccctttcctggtcttcctacctcttcccatctcccttcctattcactactcatgaggcagaatgatccttttcaaacataattagaccacatcactccccacttatatctcccagtgacttctcattccatgtagaaaacaattcaaatgccccatctggctcacaaatcatcccacatcctggctggcccatgatcccattcctgtcacctccccttgctcactcagccccagctacatgggcttcttgctgtccctcaaacacaccaggcataatcctgcctcagggccttggcacctgctgttccctctgcctgaaatgctcttgcccctgaaatacatatgggctgctcgctgacttcactcaagtctatgctcccacgctatttcctaatggagtgggtccaccacctgcaggcctgcactgtccttcttcataacacgtagtgctctgggattgtagatcacatatctgcttgttattgtctattatctgtcacttaggctaatatgtactttctatgatagcagcagttttgtctgtcggtccactaatatattctccatgcctagaagagtacttggcacatagtagatgtccaatagctacttcttaaatgaatgaatgaatgaatcataacgataaattacgctaaccggtgcagcactagccactaactaatgtgatgctgccagacacaaagcttgtaattgtatgttgaaagaaaacagaaacctgaatgatgtagcatgtgagagcaggaagagaattcagggttaattgagctcactccctgttaaggtaatgaaactcaaaatgtctaataatttattaatgttcacataactagtaaatggtggcccaggtattaatttacgtctgtgtattcactggccagagtcttgcttgtttacactacccagctaggtatttatcccctaaaaactaggattctaatagaaaaagccaaatgtactaagttgacaataatttaagaacaggtgtaaagcatcactttttttgccaagtggtcaggagatgaagaggggagaggagagatgttcctgggggcatctccggagaaagctttgtctgtatgcttctaaatgacggtcatggccaaatacaagggcaagtgtgctgtctgtctctaaatgcagaccacacatcaagtgccaccctgtcaaagaggaagctacaggcctggattagtggtgtgtgcctataatcccagcaccttgggaggctgagacaggagaattgcttgagtccaggagttcaagaccaggctgggcaacatagtaacaccctatctttacaaaaaaaaaaaaaaaaaaaaaaaaagttttctttaattagctgagcatggtggcctgtgcctgtagtcccagctactgaagaggctgaggtggaatgatggcttgagtctgggaggttgaggctgcagtaagctgtgattataccactgcattccagcctgggcaacagagcaagacctcaactcaaagaaaaaaaaaaaaaaaaaaggaagctacagacaagtggggaaagaattatttctatgtggaagctttcgagaaacagggccaatatttgggggcctagataacaaagaaccatatagaatcaggggcaaaatgtcctttcagtctctctttggaagtctctcctttgggaaagtacatgagccaggaaagccacattcctgagaagggtcccgtggctgtggtccaggcaggcccacactggagaaatgtgtgggcagaagacattagcaaagggcctgagtgggaggatgggggggaccatccacaggaagccaaactattccatggggaaaatggaacagaagataaagttcctgtaattaggtaaaagtgctaaaaagccagcaagtttcatctattaaatataatgtgacctgacgggtacccgtgagctggtaagaacagaggaaagatgtataaaaataaaataggtgaatatatgtttcatttacttcttagtttgcataatcataagtaaacaagcatgaaagtgatgcctcgggccccgggccatgtccatcctcggctccacagttcagggacagccgctcatttgtatgctccgtgtcgccaagattcaacagcatttggggaaagaatgaacaaataatttatttcttacttgaaaagttaattcatttctattaatatttcatttattacctctaaattgaccagattattaaattaaccactatttggtagccaaaattttgctgtacacacagaatataaattgatgatatctactccgtgaccacacagttaagaaagcactgaagtcaaaggaagaaaaacggcgtaaatctgcttcagttctgcccctaggccactgttttcggtcatgttctgttgcaggcaggatgagacagtagagatgtgtcctgatgttcccctccctgacaagagcaccccagcaactctcctgttggcccttgagctaacaagctgagcaatcgcaccgaccctccaggagtgctccttgggtggcattcatctgccaacatcatgattttgcatttgtcactaacacactggttgccttccgtccaggtgctctcattggtacactagacttcaaattggcgttctcctgaataaaacagaaaaagagaaagaggaagaggaagggaaatagctctgaagaaacaacttatctcaaacgatctcagaaactcacctgcttaggagacccacagcaatcatggggtgcccatagacacaggggcttctctataccggagttttactttataagcccaccatgcagtggagagactaccttaagtggcagtgtgggtgtgaagtttgcaatcagactatcaaggctgacttttgattctcttgtgtgatcgctgggtgaccttgagaaagtcactttccttctctgggcctgagccccttccttggcagcatggatggacatcctacctcccaggactgttttgagaatccagtggaaatatatgtgagaaagatttgcacccagtaaaaatcgtatacaaatatgagatatcattagaatgagttccttttgattattccataactaaagcccttggctcaagtccgagacagatgccatgctgtccaccgaattccattttataccaaatcatgttagagagtccaaagtatttccattttaaaatcccatcttcggctgcttgcatgtttaaatgaaaattcatttggatagcagcatgctaggagcaagacagcagtaactaaataaacaactaatcagcgatgggttaggcctctctatagggacgcggatggaggacacttgcagtgcgcctgcctggagtgacccccgcagatggttttgggctccagtgtgtccccctctgggccaggcccactctccctcccttgggaggaagcacacagcccaatttaagcacccaatgtgtaggctgggaatggaaaggagataatggtgtgtgtttgctttgttaacttatccattttgtatcctgcttttcttccactgttagccaaggaaaaacctcggggctgccgtagctgggcaggaggaaatgaagggcctaccctggccgctccgaccttgagtctcctcatccactctcacccacaaaggcagttgctctgaccgaggtcactaaaggctcttaattctttctgtgaaagacagtgatggagccatgtcagggggtttttgccccagtcatttcctggggcaccttgtactctgtgcagaggctgtgtcctcacatttgtgattgaaggcacaggcagacaatagggttcagattccattttcttggctcataagggcgattctctggcaggtcccttagtgcggtccggcctgggtatcctgtccctctgcgtcctgcccttattcaaggaccagcgtttccagcacatcattcagtggcaacatggcatcgtgtctctgcatttagagggccactgatcagcactgtgatctcaggcagctgatctcagatcatggcagcacagtggtctcattagcgtcctcatctgtagaacgggcacagcactatctactgcacagagcagtcctaaatattaattgtggtcctgcaggtacagagctaagcaagtgtctgtggcctcataagccagggacatcacaggaggtcttcccagtggctcccacccagagctcatcctgctacaagttctgagccattggagagctccttctattatttgctgattcattagggcctgcctttgacagtaggactcatggccactcatagtgttgtattactcatagcacttaacattttactaagcataggatggacatttaacaaatgattgttttgtgctttgtgaagtcagatgtgcccatccacgctaatcacggaggaatccacagcctgtgcacagggcgagtccctctatctttggttcatgcttcagtttgctggagccattcattcattctttcctggagtatgtctcacatgcctaccgcatgccaggaatccaggaggtggtgatgatcaggcagccaggatttctgtctccacagagcatacagtttagttggctgcattcatatacctaaagcatttttgctccctcaaaaaagaaattatcaatgattccaagtacttaaaaatcaccataacctgaaaagcttgctgggttgtaagtaacaacctcaccttattctgtttatctgtcactgagctggaaacagttacaaagtaggatgtgctacactgcctattgagtttattttgtcttttatacagaaatcaaccttgtagaggaaaccacatcatttaaaaaaatactcaagctctattttaagggtgtaaagtgatcacattttctggagatgaatgtgtccctttgaaagcacctgactacatcagaggccgaaatgcagatgtggggggccaccctgataaggtccccccatgatggtctttatggacccctctgagcaaggggagactctcttgttccatttctgaaaagtggcagaggaaggaacaggtgccttcgggattcagagttaatcaaatccacaaaaggcaatccagtcgcttcttgggattaatagaaattagtccactggagacttcttagagaaagaaaagcagagagagagacaaagacagagagacagacagacacagagagagactgaaaagatgaaggagggaggatagaagaaaggcttcatttttttttttcagataacgttccccaataacatacatatagcctggtgcacagaatgtcagctcaatgaattgtcacaaactaaacacactcaaataaccagcatgccaataaagacacagaatgaagcatgcaggaatcaccaggccctgttgtgctcacagctgccctcttccacaggttaacctccaacttgatgccagcctccctagataagtgtgcctgctttacaactcacatgagtgagatcacagagattcttctcctctgtggctggcttcctctgttccacatgtgtttgtgagatccaagcatgttgtggcctatatttgtggttgtcactctcattgctgtgtagtgttccattgtgtgaatatgctacacattattttatgtactgtactttcgaagggcatctgggtagtttgcagcttttatctgtggcacgtggctacagtgcacatttttgtacaaggcttttttttgtgaatatatgcccttatttttataagggatgagataaattcaatttatttattaaaataaatttaattttaagaatccaagtaactttatagatgttgaaattattacataaagagtcatagaagagaagtcttcaatgttcaaacacacatggagaatatacctattaaatagtactgaggaagatatttaagtgtactgagacacttcttcaaatatctctttgtagtgattagtaactgctgtagtgttaataattactaatactacaaacgtatatgatatacgtaattactaatatacaaacgtatattcattattataaatgctaatgcttggttgtttgggtaaagagttctattttgtccctaagatgagtgaggacctgtgtgaaatacatagtagttgctgattcacacttatagggaagttgtctcttcttccaaagggtggcagcttacctcagttgcaggcaaaggattcctcaataggagatgatcagctttaaaatactggtcttgcaactcctcacgtgtaaagcaacaacaaacattgcaaaccaggacgtgatgggcaaaaggggaaaacaggcattaatttgaagacatttacactcactcaaatgattgaactggaacccaagaatctgcaaggaggcgaaggctcctagacgatctctacttattctccatctgtgacctgcagctagacttcttccatggcccagttctccccaacaaaacgattgccatcctctgcttcttaatgtgccaagaaagcaaaaactaactaaatgaatgagtaaagaaaaagagcccagcccttgttccccgaattgcttcctccacctgctcctaatagggaagccaccttatgaattacagctgcctgggcaaagctctgaggaacctgtaggctatctcacttccctttcacccgctgtagggtaatgagatgcgaggatctggcgtgtttgacaagctggttgctccagcgggctcaggcgctggaatgggagattaattgatgctaaaagacacagtttgatgtggcaatgaaatttcgattataataatctctaattatcttgtacctcgagtgccctggctctcccaggtgtttcttcttggttggaaattgctatttgtgcatgaataaagcaggcggcttttatttatttattttttttgtgggtttgggggtatggggaaggacgtaaataggagtggaaaaagaatatacactgccacgtttgagagcagaggaatgtctgaggtagagtgtctctgaggaaagtatagcattcgaggaaagtaaagttcacattactttatagcaaatgttactaagacaagataaaggcaaacgtaataaagatagtagactaaactggaattcttatatcttgactattgatggccaggcaaggacctccatgactagattataccatctctaagactattggagaaaaagggtcaaagacaaaattaaacctcatctgggcgggcaaggtggctcatgcctataatcccagcattttgggaggctgaggaaggtggatcgcttgagtccaggagtttgagaccagctaggcaacatacttacaccccatctctacaaaaaataaaaaattaacacaggcatgctggtgcatgcctgtggtcccacctaccctggatgctgaggtaggaggattacttgaccccaggaggtcaaggctgcagtgagctatgattgtaccactgcattccagcttggacgacagagtaagactctgtcttaacaaatgtatatataaagcctcatctttccaggtgccattaggagtcctctttataatagggattccactctagaaaacgaattcaggtttccatgttttagtgcttggacaaaggaaatagaacttccatagaggagaagaaggatttctcactcccatctctgacagtgtatgccctaagtcccctgcaacttaaatgtctatggtaattgtcatgtttgcaaagacaatgtggactattccaggctgtgaaactcaaattcttcaagattgcttagaaagttgggaggacccacgaagccactaagggaattgacagagtccaccttctggaagaacacagagggaggatgtgaggagacaatctcccacactccacacactctgcaaagcatcagacttattcacagatctttcacgggtgaccccttcctcccagtaattaattaacttctctaaatctgtttttctcatttgcaaaatgtggaaaagttattaatagtttatgaagattatcttcctgtgataataggcccggcccagtatttggcatgtaataaatgcttaataaacacagttatcaccaagaatattttaaacattctcaagccctttgcccaagcgcacagacattttacaagattttaggtagaatcacgagtgtgtgtctgtgtgcatgtgtgtgtgcacgccagcatattggaactaactgcccttcaactttattttgggcctgtctggcagccaagagtcagacaccaaatggtactcatgtctctctcatcctcactcccagtactaattatcttgctctctaagaaaatgtctgcctgcccctgagccttcttacctgtcaggagtattggtggtgcctccagaccaagggacacctgagttgaaaactggaaaggaccttcctcactgtaagacactaaacggtgggctgaagtgctaaagtgctgttcatgtttttaaagaccgaaagggggccctgaggaactgctgcagctctggggcagaggcagatgtccagttggggtgatgggccatgagcccaagagccagggctgtggagtacaggcggagagtgtggcaggagatgggcatggtcctgcccagaggcaggtgctttgctcattttggggcatctgtgcatggtgtggtgtgggtggggaccaagttgaaggaatcggcaataagccgtgtctgtccgatctgttttctgctctatgttagtgcatggattaggaatagggagatttgggacagtgcccttgtgcagcttgtggctgagggtttgaggaatttttctatcatccctttaaatgaagatgacagaggtcttcccagggacttaataatagattcaattaagagtaaggccatgtggctgcaaatacattaaagattttttttttccattctgtagaacaagtacagaatgtctatgtcatttcaaaccaggctctcttaatctgattatgtccagttgtgatagaatggagtcaggctttgacctgagcccaaagaagctgtcctgtacccacccaccactgttcccagcttgcatggctgctcaggccctggaagggtcttacacttagaaaagctttatatccttacatgaaggacagaacaggcagctatatggtgaagaaatgtacagacacaaatatccatatattgaataattggctggctggggagaatggaacactctgttgcctcttactcacacttatctgcttaaaatggcttctactgatggaagccccaggaagaaggcagcttgcttacaaggatcaccctggaggatgcatggctacatgcacacaatttcgaaacgagagtatttacattcggttggtgcagctgaacagaggacagaacctcatttgctttccattacactcacacttggtgtgtaagggtaaaggactcaaactggtattttgctaaaggagtgtatctgttaggactaggtttccttgcaagtaatggaaacctggaaagtaaacacttaaataatacagacatccatttttcacatgcaaaattctgaagatagggagtcagggctggtgtgctgcctctgtaatctcccaggatctgtgctcctctgcaccatccctggtgtgatgcttgacctcatggtctcagccagagccacagccatcccagaattctcctttcaagcagtacaaagggaggaggaaaggtcaaagagcataagccaactgttttaggaaaattattggaagctcccacacaaccctcctgctagctggagcttaatcacacggctccatctaccggcaaaggaggtcgggccatggtctattgaaaatcaatgattctatgaaggtgagaatggatattggcatagaaagttagcaatctctgccttggatcaggagaaatccattacatttaatatctaaaaatctgatattcccaggagtagatgcttctcaaatatatattgttttctctctgccaagccgtaacttaatctcttgtgactaatcctagcttcaaagatttggacaagctctttagattgaatctagggaaaaccttggaaatattcaagtttgctttgacttttctgtgttctcagtgtttcttttttgcattctacttgaattaaagaagaatctttgcatgataagagtttactgatactggtgatcggtcccacaaagtatttcctcttccctctgcattcattcactttgcatagtctgtacagcccagtaatggaaatgtgatctacagtcagaggacaagtcaaaagttgaagactcttttagaagatcaaatcaagatccgataggctcttttagaaacttggatttcctctttgctgtatccctcccaggtcaaatcatgattatcaccgcctgcactgggatctcttggaggttaattagttatctgtattgcagctccagtcttttattgaatagttttctctccttatctttggcatactacatgaaattttaactaggctttttagggatttagaattttttccctgtgaaaacttaattttgaatggtgtctttgtgatattattcttggataaactaacactaaaactgtgctttcaaaaaacaaagcttttctcaattattattgtctcatatgtcccacaatggccagccagcttttcattaccatccagtgaactctgttctgttgatcagagtgaaatcaaataactgaggaagtacggcatagcagttaggcactcaggcatggattcagaaatacgtggaattcagtagggctctggcacctactaacaatttggttactctccctggctttcagatttgcacccgttaaatgacaacaatacctactgtgaggtgttgtgaagagtttatgggacaatgtatgaaaagcacgtagcttactaagtgttcagtaactgcagtgtgtgtgtatgtatctcaggcagagaaaaccacgcaaataacagaaagcacctgaactaaaaaaagttttcaatcaacctaacttgtcaatttcagattctgtttcctgtccataatattgctagaaattatcaaagcaaggtagatttttaaataataatgtattctgctctctaaaagtcctgtcttatgttaataaaaaaaatgaaagccactaagagactgaaatatttttaaaactacgttttcaatacagacagtagcaattgactcacaacaaaaaagatgtggaattaagcactgtagtacttcctcccacgttcccattaattatgtcattatttttccattggcattcactttcatttctacaatttccataactgtttggtcctaattttaaatgttaatgcattaaaattttacaatcaaaggagtctgttgcctccttttcctccactgtgattggcgcatgcattcttgtatatttcagaatgtctgccctgtatctttcaggcaactcggctgccgtaatgttttgggatgacattttatttctttcaaattctggtaaacactgctctaatatcatctagcattgaatgttaccttggagaagtctgagattatcttttatttatattattttatttatttccggggacttctctttattttttccctagatgctagatattttttactttatcctcaatgctagattacttagtatgcatatgtttcagcacccattattctgaaacaatttttcaaggaatatagagtactttttagatctgcagatgtggtgatttcttaatttcaaggccattcttctgtattatgtacttgaatatttttcactgtatttatttggtgctgaagctctttgtgtcagggatagcatttttttaagttggatttgctctatattaatgattttctccctaattgcttgagtcatgttgtgttgtttttctcggcactgactaacaatatctcaaatctcccctttatgccagtgtttgacttgtcccttgtgcccgtcttttattactggcttccaatttgttagtcctaaaatggtccccacttaggtcttggatccatagtcttacttcttcatctcagtctgaaggtttataacttttctttaagtcttgttttatatttacacccatgttttttgttacataattgtacaggacaaagctctcatggacaatggtcttagaccattttcaccttagcttttcttccagatagggttcttcctttgacatttgaaagcagagtttcttttttatttcttatttattcttttccccccttttctggaatatgtttgtagagctgccatagcactacttttcatcttggtcatgctcgggcagctttttttttttttttttttgagacggagtttcgctctgtcgcccaggctggagtgcagtggcgcgatctccactcactgcaagctccgcctcccgggttcacgccattctcctgcctcagcctcccgtgtagctgggactacaggcacgtgccaccatgcccggctaatttttgtatttttagtagagacggggtttcaccgtgttagccaggatggtctcgatctcctgacctcgtgatccgcccatctcagcctcccaaagtgctaggattacaggcgtgagccaccgcgccactcgggcagctttgttcagaccatctatttgttcagatggtctcttcctgctgcatccaaaagctactcagagatgcaggtgtttgccattctaatccactttgccaaagcctgaggctccaaagtgggggacacatcagctgagcctgtttgaagcacatcttaatgactgggttctgatttatcatttttgttgttgttaaatgctgactccccaaaatctagcatgaactggggagtatttcccccatttcattttggaacactgaagaccacatcagtcagcaggaaaccaaacctctgtcgatgattttcccttcctttttcacatattttacccatcccttatgtcccattgactctaaatggaacttaatgtcttgtgtactgaattgaaagtgaggctctacaaaattaattatcatggcttgattcagtctccaatctctgaaacttagagttttctataaagttttgaaggttgttctgtcttctagtcttcaaaggagtttcagtttgctgcatatccttttcactgtttgaatcagggttctgtctctctctctctctctctatctctatctctccctctctctctctctacctctccatctctctccctctctcactccctccctctctcactctctccctctctctatctctgcctctctctccctctctctccctctctctccctctctccctccctctctctctctctccctccctctctccttctctccctccctctctctctctctctctccctccctctctctccctccctctctctccctctctctctctctctctctctcacacacacacacacacagccatacaatttagaagagcaaacagctggacataaaacctattttggtcttcttaatgaatcagaactcctaccacagagagtgatttctgaatcaaattttatagggaggggttctgtttctcatggtatattacgctcagacaatgcatattagggcagagagagaaaatgagacagcccaaaatcatgaatatccaaagcagcccaactctatctcttcaaggctatgttgaaccaaaacccccttgtgagctgttctgagttgcagatctgtttgcacatgagcttggagcatactgggtaaacaggagtggttggtaaattctatttcacttcaccagtgagctgaaaaagcattgggtaatatgttatgagttgtagatctgtttgattgcattgttgcaaagtgggaattgttttgcaacatagattcttaatcacggaggcatctatgattgaatgcgtcgaaaattggctgaaattgaaagttaactatactgcagacggcttattctggtgtataattgaaaataaattctaataactcttcttgaaagagctgctcagaggaaatttcaagccccctggaaaaaaaaaaaaagtgctttctcaaagagactgtctctctgcataatacagtaatgaaaataaagctctcttctaagcctaaactagcttctccatgacgctaatgcactgaccaaaatatgtcgatgttgaacgcttgcagacttattttgtaatgtgcctcccaagcctttatgctggagaggccttatcatttctctttgaagtaactttaggatgattttatacaaggacaacccactagaaaaaagaaaaaagagtgagcttctttaatcaaacagtctttagtttgaattcttgctccagtctttgtgaactttgtgacttcagcaatatttttgttgttgttgtttctgagcttctgtttctgtctttgtaaaatgggtttaataatataatttaatttcctctgttttgcatacttgtaaatattacaaataatatatttacatgaatagtactttgtatataattggtattcaacaccttgtaggagttagatttggatatgatacgtgtatatatacagaagctgcatattcatttcaatatcattcacatatgcatattcttgcttagatttagtcttgcaacaaataatgaccttttggtcaacaacaagccgcatattccacggtgatttcctaggattataaaagagctgaaaacttgctattgcctagtgctgttgtaaccatcgtaacgtcatagtgcaatgcattacttacgtatttgtcctgatgctactgtaaacatttctccctagagactgactgctacctctaggtgaaaatgagactttttaaaagagtgacaccttctcaagaagagccttaggcaggtccttcaggagggattccagaataaggcattgctatcacaggagatgacatctcctgcgtgttactgcccctgaaaaccttccagtgggatgagacgtggaggaggcagacagtgatattgatgatcctgaccccatgtaggtctcagctaatgtgtgtgtttgtgtcttagtttttaacaaaacagttttaaaagtaaaacacaaagaaaatttaaaaatagaaaaaaacttacagaataaggatataaagaaagataatgtttttgtacaactgtatgacgtgtgtactaagtactaatattactataaaagagtttaaaagtttaaaaaataaaaaagcttgtcaagtaaaaaagttgtaatacaagttgagctaaagttaatttattattgaataaagacttttttattaatttagtgtatttaatttttattaatttagtgtatttattaatttagtgtatcccaagtgtacagtgtttataatgtgtacagtaatgtcctaggccttcatattccctcgcctcttctcactgactcacccagaggaacttccagtcctgcaaactccattcatagtaagtgccctatacaggggcactagtttttcttttatactctatttttactgtacctttcctctgttttgttatatttagatacatgaatatttgccattatgttacaattatctgtagtatttagtaccgtcacatgctgcacaggtctgtggcttaggacccctacgctccacggtctaccatcgaggttcgtgtaagtgctctatgatgttcatacaatggggagatggccataggatgcatttgttagaatgtattctgtggttaagtgacaagaggctgtatttaagcccctaacctcctccatttctgcacgcctatgggcaacaattgagtaggagaatcagaaggagacacagagccccaccacggaggactgaacactccagtctcggatgcagaaaaactagagttccgaatctggctcaaggttaacctctctacggctacattttttccgtctgtacaactgaagtaacagctttatatatagctgtctcttggtatctgcagcagattcgttccaggacccccacaaataccaaaattcaaggctactcaggcccagcgttcctccctgcggaaccctcggaaaccaaatgagctctccctatccacaggcgtggcatcctgaaaacaccttgctttccatccatggttggtcgaatcctgagttcgggagctgtggacacggagggtcaactgaactccagtgcactgcgttgtaacataaaacgatgcagactgcctggcatctgtgaagttcttttgaaacgtgtgcttgcagtcgcccctgcagacgcagcggctgcgctgtttgtgcgctgctccagagcccacggaaggagaatgggcttcagaacgaaacagatctggactcctcccgactcttcctctaacaggctatgaaaccttgagcaagtgactgtatgtctgtgaggccacattcccacgtaaaatagagattataacacctttcagtggaaggaggaagctttattgagatggcgaacaccatgggcactaaccatgttagctttctccttaactcctctccgcttgttgtcagcctagttttgagcagcagtggactttagtgttgcttttttcatggtggcttccgctcaggaatggctagatagattgtcatctttgagatgaggaagaacccagattgcccttaaagctggttctttctgtgtccagagaagtcccctgtttccctcttgtcttctaaatgaaacatctgcttcttagtccaagtcagcagatgccaacctgggtacacaagctgtctactccatttcccggtcagctccaacaatgctgtgctcacttcccttccaaaaataagtccagtgaagtctgcgatgcatagccaggacatccatcctcggctggctatggtgaatgtggcccctgagctcgtcttctccttggaaggccagagtcaccctctgtagagaaagcaactaaatcacaagaaaagagacactccaggtgccagggcagtactctttaaggaatgtttgtgcatattgagggtgatttggaagtgctctgcatacaaccacatcacatctccctcccttgttctcaaactgggttcaaggcccacccacctgtattcgtaggtcttttccagatggcccactgtctagatcatactgcctaggtgtgcactacttttaacacgccaggtgctctctacttgtaataatcctgtctcttctgcttgtgagtgaagcctggcctacccccaaggctgataagtggcaactatatatctgacctcctcataccattattgagggtagtaattatctgctcatctctgctcccgttcctcaccaccaaccgtctttccagttcctgtggtgcccaagccaaaagaacaaaaccacaccaatcttaagtagatattttgcatgaaatttgatctactgaaagccaggctggctcatcaacctggtggtgcacaagagaaggtatctcgcagagatgttacaaggattagacattaattaaagttcttgggataaatgtgctctcaacaatggtagaattttctatttgctttgcagactctgattctagtctcttcctataaatcagtttctctgtggactgatgactaacaaagcaaaatatcctccatagccccatgtcctcagtagccgtatttaaccaggtcacatggctacaccaagcgtaacacaagccttaatgttgtgaccacagttattttaggagctcctttagtttgacaaatcccagttcttctgcagcataaccttttctgggatgaagagcatagtagttaccaatcacaggaaaaatgtaccttattgataaggttaggagcattattttcatataagagagggcagtctatagacagttttttaaatttaagtttaaaaaacttttaaaaacttaatttgaaaacatgctaacaaggaggcagggtgtggtggctcatgtctgtaatcccagcactttgggaggccgagacgggcagatcacctgaggtcaggagttcaagaccagcctggccaacatgctgaaaccctgtctctacaaaaacacaaaaattagccgggcatgatggcgggtgcctgtaatcccagctactggggaggttgaggcagcagaatcgcctgaacccaggaggcggaggttgtggtgagctgagattgcaccattgcattccagcctaggtgacacagcgagactccttcaaaaaaaaaaaaaaaaaaaaaaaaagatgcctaataggtaaatcacataaagaaaacttttctggaattgctctgataaaatgaaatgggctggcttcaagtcataccattatgacatcccatttctacccccttctaaggataacgatagcattctgaaaacctagattttagtcccagactttgccactaaatagccaggaaatcttggacaatctgtttggtctcaggtatttttggtttgttttgtttttttaatttctaaaatagaaacagtatacttctccctgtacaccatatgaaaaaaaaaaagtttaaatttagaataataacaacaacaataatagcttagactcattaagtgcttacaggtattcttctgaaaaactttgtataaataaaccaattcaatcttcacagcaccttcatcggccagctgctactattatactcatttgatatatgagaatactgagacacagagaggtcaagtaacttgcctaaagtcacacagctgttgagtgtcaaagctgagagttcaaacctggccacgtgagctcacactggtacaactatctcatattgcctttgtaacaaataagacagtggtagtcacagcagtgtgtattctagaatgttaagacgtcttttagcatagaaataattgtagacataccatttggaatggaaagtgatactactactttggatctgttttttgtttgtttttctttcggtttggggatttactaagaagttgttgactgtgccttcctctctttgctgatagcatttattttccagagaaaatggcaatttctcagataagaatttgatagttgaaatggaagtgccactttcaataaagaaatcttagaaaactaaaaaaattacacgtgctgtctttgatatcacaccacagacatcctacctcgtaggtcagatatagttctgcatagttgggaactgcaagacctaactattttctgtttaactaaggggtagaagaatctctttctgaagcacaaccgttgcctctgccccaccatgcaaagacctctcgggccctgtcttgggagaggctggtaacctttcaaaaagtgagtggccctggcccggcgcggtggctcacgcctgtaatcccagcactttgggaggccgaggcaggcagatcacaaggtcaggagttcgagaccagcctggccaacatggtgaaaccccatctttactaaaaatacaaaaattagccgggtgtggtggcgggcgcctgtagtcccagctacttgagaggctgaggcaggagaatcacttgaacccgggaggcggaggttgcagtgagccaagatcacaccactgcactccagcctgggtgacagagcgagactccgtgtcaaaaaataaaaataaaaataaataataaaataaaaataaataaataaaaaaaaagtgaatggcccaatttctcttctggttctattgagctaggaagacatgggggcgtccatcccggaggaggatggtggcagagaagctccaattctgagaacgtctttttgttttctttcttctgtgatcttgtgctggttctgtaacctccttgcagctgggaagaatataatcttcaaagggtttccttaagcctaagcaaaggatgagaccaaaccggaggaaacagtacttcctgatgctggaaggataaatatgtgcaacctgttcttatgagaataagacaaagactaagagcaaaaatgggttcaataaaggttgagatgcatatatcctgaaaaagattattcacaaaggaagacgcagcctttgttcgttcttacctgtggaaagtaaagcccagggaggactcattcctcccgtcagaggcttcctgcaggctctcatcagccgtattttggtgttgcctgaaccatgagattgacctaatttgccatctttttttcttgctaatgaggctggctctaccctactgcttagagaaagatcttgtgttactttcctagtgaaatgtgagacttcgagtccagaggccacacttgcaggatgtctcactccacaggtgatttcaattaagtgctgtgcctgctaagccagtcacctcacccttcttaatatgggaattacccatgaagggtttaaaaaacctgtagatgtccttgtcccacccactctaaaactactgaagcagaatctcaaggagggacctaaacattaaaattgtttaaaatcttcctaggccatttgggataagaatgactgtatctggcgcacagtgtctccacatcaataactaaaggcaactgatctctgtcttttctttgctcaccaggctacagaattaagcaagttactcgtattttccagacaggaatatcagcactctatatttgctgtcagtaccaatacaaagggaatcatagggatgacattgctcaagagacccgaaattggtctacacaagcaaccgcatattcttaggagcagtctctctgtgctcatttgctacttgaggacaattaatggctgtcgacactgacactggttcctaatccctctggtcagacttgcattctttacccaggtcaatgtgataatgacaacgatcatgttttccttgttcactacactgaggagttctgtaaaatggcagcatgactttgaatgggaagtcggagttttacttgatattctgctgctgtgatcttagaaagccactaatgttgctcagccttagttttcattgttttgttttctcattgataaaaagaggggagttagactacattggtggttttcaaaatctgtttcacattggaacactttaaaatagaccagactgaagggatcgtctctggttgcagcagatcttaggtggtagagctgcgacctacctctacgaagcctctctgagacctccatggatccctggtctggtgaggtcaaatgaagagaaagtctgaaggtcattcactgatacctgtctggggttttgaactgtcagcctgcctgccatttccaagggggggaagctatgggttgccaacctcttttctttgagaggaaaagactagataattggcagtggccacaaaaggtgcactacttgcaaattaattcagtggataactgagtttctttaaagctctaatagtctagattttttttttttttttttgatggagtctccctctgttcccaggctggagtgcagtagcatgatctcggctcactgcaacctccaactcccgggttcaagtgattctcctgcttcagcctccccagtagctgggactacgggcacatgccaccacgctcagttaatttttgtatttttagtagagatggggtttcaccatgttggcgaggatggtctcgatctcctgacctcatgatccacctgccttggcctccctaagtgctaggattacaggcatgagccactgtgcccggccccaatattctagattttaagacatccaatctttaaaatgactctttagtgaagaggagaacaaaaggagatactcactaaaattctggtattgtttaggagggccatttcctgacacacggcagccacttggagcagttggtcaggctggataaacagtgctaagcaggcaacatggagcctcacagacatgaaggtgtgggaagcaagctctagcttgtgaagaccaccaggaacctgactcccaggcatcctccacacattagagagccaaagcagtgtgaagttgagtcagtacttcattctggaaactggagagagatccagatagttgcttgtcaaaagaataacaatttggggaagtgggagaagcaactttgaaacagatgaaacaatataaaactccaataaactcaggtatcactctggaattaatggaggacaaattggatttgctgttaagttaaacacccatctgctcacatccctggagcccataaatttgtggggctgattagttgttgccatccttagagcagcagggggctaaccacgttccctggagttttgctacagacatggcccattccctgatgcctgtccagacacccaagctacaggggaaggaaaagaaatggagttgacccaacctggggtcatccaaaaagtttggaggacatagtgacacctcatcttgacctttctgaaagatggtgttgaggaatctccaaaccaatttaaatttcacccactatttttttcattactacaacaaacattgctttttctcatctatccaattatcgtcctgtcttttcctcagtccccctctgctacctgacttgactcctctaacagcaattctctctgtacccaaaacgtgaagccttaatataggctcttcagcataatcgcttcttaattaagtcaggctgtggctccgtttcccagaatcgtttccagagggcttaattttacttctgctcagaattaatattttacattctacacttaaaggaaaaagaatgaaaaaaaaaaaaaactcagaaggggggaatgagaaaatggttgaggggaaaagagagatcatatttcaattcctattacagaagcatccgagcccctgtcgttattttcagcaagtaacactcaatttgtgacattcactttagcaaaacaaagcatggatcaaggtaattaaatggcacagctcagagtgagttaagggatgattctatcaacaggagactcctgctgatatgacactttccatgtgcctgctttgttctggccgtgccagtcgtggcccagagggctgcaggaagcctgctgacggttccagcacatggtgtacccgggtgtgcgcggagcggcccagcatgagcactgtgtactcgtcatgtcagtagaagacccaggggatgaaggctgttagtgacattaaggccccttcctcaagagctggccaactcttgtcctttgccctggatcagtagtccctagggctctactcaactctctctctctctctcgtgtcgcacagaagcttatggatacatttatcctgagattgcagtgagcctaatcatctagaggggagtgcaggacccctagtcctactgaaccaccctgtctatcatccattcaactgtttaaaaaatacgcattgacttcctactatgtgctgtctggttgctggagctacaataacacagtgcagaaacgtgtgctgccattaccgagcctgcagatctgtgggtcacagaatacagggccaggctgagagttcacttggacaaactcagtactgtgagagagttgtaaaagaagactgagaggtctccagacctgagaccagaggtgtgtcctgagggtacacactaccacaacatgggttctgctttggattttggcaatatgggcataatcatgtatgcacagacattctgaacttctttgatcatcattcattataagacgacttctgcagaatctcccaggagaatacagagtggtgtcaggggaatggattcagaggccatggagctggaactctggtggtatggcttcggctgaatgtgcaggaggttgcatgcgacctccccaagagattccttcccttcatcttcagcttcccttcctctctgcctcctagctgagactgatactgtcattaggggaggagcaaagagccaagggaggttgaagatgctcagagggacccattagactgagtatctatttacctactcatgtggaatacatgaatatatgtgattatacctaaataggtgatcatacctgaacttctcgctccagtggctgtggtgggatgttgacaagctgcattctaggacctgtgactggggctgccccagggagtttcccattctgttcttttgattattagccagatagtcccatcagtccagtctcatggccagcaaaccgtaccaacgaagggggactcctactacttagcctgctcttgctgagggactgcccaaattcattactcgccacagaagtttattttctaaacaccacataagataacaatgcggtataccagcaggaattgagaaatcctttcatatttggattttcttcatcatggtatataactcttagaaacatacttatgataaggggcttaggttgtagaatttctcaatttccttccctaaatattttatcaacatgatggatttttcttaagaagattgaaagatacattttttttttcctttggccaatttgggtaagaagggaatttagttttgttttgttttgttttgttttcctaaaaaaagaatttaggatgctggcagtgagcccatgtatgttcaggtgttttataatgggaattagaacctcttcatttatctcattttgttacacttgctaccaaactccatcaagtgctccttcgacaacaggcaggctcacagcattgccaagcgtgtactctgtcaagcttctctgggtccacgtttggggatccttgtaccctgtgtccacataaaaatgtaccacagattgagccctgaccagactctaggccctattttaagtgcattatttatagtaagtatacctcacaataatcacatgaggtcaataatattattaaccatttcatagctggaaaattgaggcatagagaagtaaagtaaccaccccaaggtgataagaaagcagcagggtttagttttaatgacaaggccctgcacttgaaaatcgtatgaggctgctgctttgtgaggccttcccagtaagaggggtctcctttctcctcgccgtgcgtttgctcttcccagcctttctgcaatgctcccagtcctcctgagtcagacaccagtggctggagagcaagcagaggcagcagacgtgctggggaaaggagtgaaagggcattgcctttcagtcacgtcagacaccttcagacctacatgctaaatagggaaaggagttctgggtattaaaccaaaccacaggaaatctattctttcccctcaagtgaaatcttactcttttacagacactagttttaaaaattcacctcttctatgaagccttcatctaaatatgtactttggcattcttctagttcttacgcctttatgtccatttttttttacttattagtacattgtatcttttaaaatatgtgtgtatatatgttttttgttttctccatttgattggaagttctccttcggagtgtcaaatgttctgcctttcatacttctttcaatgggatcttggataggtctgtggacatggggttatatggagcatatggaatggatgcacagctaatgttggggttgaatcaagatcctaacatcactctataccattagaaacgttcatgacgtttggcttttgcaaagtgagataccaaggctttgcgtctaaccaagaatctaaagtatgaaacctaatatcaaccttagctatagacatgtcagtacggagcacaggtgtgaaagatttagaagctgcatgtatgtgcatggttagcacagagatattgataagaggataagcccacttcctgggcaggcttcaagggcaaatacgcaattgatcatctaagacggggtcagcaaactgtgcccatgggcccgatctaacccattgcttcttttcataaataaagtgtcataaaaacacagccacactcattctttctcatatggtctgtggttgctatcatgagacaacagcagagctgaatagttgaatcagagaatagagggcctgctagcctgaagatctactacctggcccttttctctatttctatttttgatgcgtataaagaaaaaagtggatcctttcttctaaactcacaaagaaaaaaaattctacaagtccagctttcttccccaggccctaacccatttcttttctcttctactagtatcagtttgaaaaggagatcccctgaacttctgtttctgcaagtcaattatttctttagaatattcagtgccatggtctatttatatgcagattttagatgaagttccagattttttattgtgctctacctttttagaggacattttagcatacgtggtactaaaattttttgtgtattgtctcacacttagaatcgttttttttcaaatcttgcaatttagccaggaacttctagggagatgtaataaccgtcagatacctccaacagaaacgtatagtggggaactgagaaaaacatgaactctaaagggggtttcaatctcagccttatcaacatttggagttttgttccgattttaacctactattcccagtgagacatatttcccagttttcagtattgatttttatattatagaagacatacaaggacgtgctcactatttctcggccacattcacactataaagtgcttgctaaagagcatgtaaagctctaggtccagaattaaatgtggacagaacacgcaaaaggggagattaaaataatgcactgccttgcagggctcccaggccttcggctgtgtgtgaaaagtttactcttcgtaccctggctgtgccacctgataactcggggtgaactcatcttaaatcccacacgttttctcagtgggattatatcccccaccaactttccttaactaaaggtcaaggggatcgtggagaggggtccagaaatagcaaggcaagtcctggagactcagaagcatttgatgcagggaaaatatgaaccctgagcaaagaaagaaattcagggcttacttcagacttgaaagtcgcaccatcaaggatttttgtagctgcgcggatggacatcaataggtgattaaagagtgccaggcatggaacagtgcatctctaaccttcggggatggcttcgcaatgggcagccctacactgcctgtgggctactctgtaaaatattgtggagggaggtcatctggggagtcccttagcaaacaaggggaccctgaagaagggcaagtgatgagaaaaacttgggggtgtgtgatctgacatacaatcagctgcacagcctgccaggtaatttttatattttatctcatttgattcttgccaaagttgtgaattctataaatcatgtccatttaataaacgagagaattaagccttagcagagttaaacaatttttccaaaattatatgatttgtaaatgatggaactggggtataaattcatatgtgatttttatattataccatgctgggtcaaaatattactgccccaggatttttcagggacccaaaacagaagaaaaagttaatgtatgtgtactttatagatatgttttatttaactatccagaaaggatagtctttttgttaacttttgttttgggttaaggggtacatgtgcaggtttgttaataggtaaactcgtgtcatgggggtttgttggacagattattttgttacctaggtgacaaagcctagtacccaatagttattttcttctgctcctctttctcctctcaccctctatctcctgataggtcccagtgtctgtggttcccttctttgtgtccatgtgttctcatcacttagctcccacttataagtgagagcatgtggtatttggctgtctgttcctgcattagtttgctaagggtgatggcctccagctccatccatgttgccgcaaaggatgggattttgttcttttttatggctgcatagtgttccattgtgtggatgtaccatgttttctttatccagtccaccattgattccatgtctttgctattgtgagtcatgctggagtgaacatgcatgtgaatatgtctttatgatagaatgatttatattcctctgggtatgtatatatacccaacagtgggtttgctgggtcaaatggtagttttgttttcagctctttgaggaatcaccacactgtttttcacaatgtttgaactaatttacactcccaccaatagtgtataagtgttccattttctccccaacctcaccagcatttattttttgaattttaatagtagccattctgactggaatgagatggtatctcattgtgctttagaaaagatgatttcaattcttaatttaggtaatttcctttaggcatatattgtgtcctgcgacaagtacagcttcagacctagtttcttttgataacatatattcttacaaaccccatttctttgtaataccaacatgcctttattattcatactatgaaaaaagaggcagtaacagtgagtagatggtgggatgtaaactatcgtcacactcttgtttcctcactatacttactaaagggtgggaagatatagaatctatcatatattgcatatttctctgggaggcctttttaaggaatattcaggaactacttttggtggcacatccagaaagaagacatagaagaataaaaaccacccagggttacatgaattcaaaggtaaagtaaggacttgacaaagagcaaagcatgagcctgagaaaaaagcaggccccctgaggtccgctgatgttgtgcccgtgttttccctctcatcgagcactatgacaggtgcacgggggaaggttggtcactcgaacaactacgtttgttcagataatcactggcactcaagccataacattgtagtggaagatggcaagctcagatcaagtgacacctttccccagatcctaagcaataatgatagtaattgaaacactgtgcgtggcacccatgaatggtaaacaggggatttacttacatcaattaaatctaaaagttattgctgtgataatcatatccaagtaaagggtagaaagggcaccatggtgcgtccagaaacagaatgcagtgtctgtttatgcatatcggggagggagtatgggaataagtattgaacgggataaaaagtggtctgaacgttcccaaggcctttccatcacctggagagagctccattattcataatcctaaaatgcatgggctgataattgccttaatcaccagagaaacatggctgagatgtactgaaataagccataaaactcattacaagataacaagattctatctattctccgaggtcacactagagttccataaggtcaaggagttaatcgcctcgttcagcagaaacaccgtagatagtaaactctgtatgtgtgtgtttgggtggggggaggcggtgcatgtagtttaagcctttctaggttctcagccaatacacatggtgaccagataggtgaaagggaagtggatgatagtccatgaataaccaataattttgtgctttttttcttcttaacttttggggtgaacacttcttgtatgctagtaattgttaaataggcttgttttgcaaagttagcatttcccagactgacccccttcccaccttacgatctattcaattctaatgacctgcccataggtcaacagtggtgccagggcagttgctctagactttgagcagacacgcttctttcccgtttatctgatgaagcacaccacagacagttacacaggaaggaagcaggaagcttaggcatcacccttctcactgcctctggtttctggaggagggaacaaggcccagggaggtgtaatgctgtctaacaccacacagactattcatggtatagcaggaccgtgaggcagtcccaggtaccatttcactaagacaccatgttctctgataggcaacgctgcaagcaaatgttctttcttgaagatgaaatctctggattccccagtgattctaaaagcaatgccctcctaaatttggggggtacatcctcacaggtgtgctagtcaagaggtgtggacttagagtaacattggttcactgtggcgaggggccattgcttctcctacattactgacctcattggatgatgttggtctgcatttgtcttctcttctctgccagacctctgctccaacatggctcctcattctttgccagagcttttgaaagttcggtccagccttcagattttgacttccctggtttctcagtaaagactattttactatgaaaaacagtaaaaataacaagactgctgagaagatgtttgtgaagataaaatgagattatgtgcctggctcacagaaagttctcaataaacagccatcatcatcatcaccatcatcatctatgtaagaagggctctgttgagggatataggaacagtaatttactatttcccattattactatgccctccccagaggaaatgagcttaaactacatcagaaaaaaaaataccaaatttaaaaaaattactgggaaattctgttatataatttcaagaaaatatcgagaaatctcttggcctccttcttcttcaggggttggtaaatgagtcattgtttggagactgggtgactccagtgctagctccacatgttttctaggcatttagatactattaatcttcaataagttacatataaatttaatctattgaccaagatttctagttttttgctcagttctttgtttttggtgcatgtggtttacaaatatgtagatacaaaagaccaagaatgctgtcatttttagttgagtgaacaacaaaccttagatcctgacttttgcaactaccgactgttctcaaaagtatttttttaagtttgcttcataaaaacaatttaaattaagctcctcaaatatgcatttgttgaggatttactttgacagatactgtgtaggtggttattgcagaattaatcctcagtaaatgtttttaataatcatttgattttcatttaacacacagtaagcaccacataaattctagttgtgtatagctagtcaaaaaacaagttgaataaataccaaccagttattaaaaacatttatggagaattagctactcattgttatctgcattcaaatcaattgcacatcttccatagtaaactttaagcaagattccctggcagatgctgtggaataaagctcattcaccagcactggtaggattcttggtcatacattcagctcgggactagtgcatttaaatctttgtctcctaggctggggataaaaagatcataaaggccgggcacagtgtctcacgcctgtaatcccagcattttgagagaccgaggcaggtggatcatgaggtcaagagatagagaccatcctggcgaacatggtgaaaccctgttttttactaaaaatacaaaaattagctgggcatggtggcccactcctgtactcccagctacttgggaggctgaggcaggagaatcgcttgaacgcaggaggcggaggctgcagtgagctgagatcacgccactacgctacagtctggaaacaatgtgagactccgtccccgcccccccgacccaaaaaaagaaaaaaaaaaatatcataaaaagcaaaatggattccactccgggggaagcttaggtcagctcatccgctgtgctgttctgaggtcagggaacagatagatacaggcccaaacagcctgaggtggcccccagcagagctgctctttgtcctggaagcagacactctcccatcagagaatgcttagaatacagacacaggattgggagcatgtcactcgagttctagacttatgagttaacttgtgaccttaagaaaatgacagccttcccaatatccatgtcctcttgtgtaaaatggaaatgtaaaagaagattggccccataaggcttctgtgaggatcaaagagcctaagaatggaggtaaatggctatacacatggagcagcacctgaatagagacatgatcattgtgttttttttctatgagaaaaggcttgagataacactcacagttcctgatgaggcttccttggcaaccagatatatttactgggaaaatcgatgtactcagatttccagtggccacaaaccagaacaaagcaaggtggtgccccaggccttgttcccttggcctggggcccagacccaaggtcatgcacagctgacagaagaacgagaggcttcagggacccaggctcatctcctgacatgctcaactcactctcacagttgatgtttttggaagtttgctgctcagcactgttgtcaaatacttagcagcccaacttggggcaagacagcagctggctcaccctacctgtggacagaggcagagcgggttctggagtgggcagggggatttgtcagcatctggattgtgactggtccagcatgccctcccctgcctgttgggcagcgggacttagacctgctttctcaatgaaaacaagcaaaccaatgagaatagacacaataggattgctccacgctgcagcagggcaggaatctgagcaagtcggggcactccagaccctccgatcaggaagtacgccctggcacaggtggccatgggtggcggtcactccgccttcagaaagccacttggaatgcaacctgcacaattgccttcatcctttaccgccctgccagattgttgacggaagcaaccttattaccagtctccaaaacatctccataaaacccaccgatcacagactgtagcatgattacagccaccccgctatttgacgagctgctgcaatttctcccagggactggatgatgcaggcttccttcaccaggttcccatgggtgtgccctgtgtggaccacagagccagctccagaaaggagaaggcaggaaagaagagacttcggtccctgctttgtagtcttcctttcttagggaccttttttttgaggttatcttttttttttcttcctttgttctttcagtctcacatgtctccctccacctgctgtctctcttagccttcagaaacagatgtggcccactggaaagacaacctcacagtcttccttgcttccaggggaggacggacatcagccggagggccctgggggaggggaaggctcaggcctcgctgcctgcagctgcggaagaaatctctgatgaatttcaaaacctgcctttgctttggatgtgatcaacagtcacagtggggcctctgtgttttactatatgaacaagctcagagggagggagaaatgcagccccctggctctgcctctcccctgccacagtggctgagtggagggcaatcctcatctgtgcaaactgtgagatgtttagcaggatgcaaagctggagccagcttgctgctcctacccgagtgcctggagctgagagtgtagggcacccctgcgtgtggggtcctggtggagcttccagtatgagaacacaggtggggaccacaccaaagcaccccctcagagggctccccccgcggcctcttttctaggctgtcctttggaggagtggctttcggaatgaccaggatacattggtgataattgggctggaaattatataatttcatgcaagtaaaattcctgtctcaggttgttacagcctccagccttatcaggaaggtgggcaggtgctcattgaaggtgtttgctcaatatttgtcgattaagctcaacaataccttcttctccatcagcaacaatgtgactgtctcttggcttccctgcccgtcagatggagagttcattcattgattaattcaacagacagctctcatgtgtacaggactgtaaccggtgatggtgggagaagacaaccttgttcctgtcctcaggaggaggtttggtgggatcgtggggttcatttttaaaggcataaagtcagaatcctctgtcagcaggagaggcaggaagaaaggaggtcgtctgccttttctttcagtggttgaagcccctttcacctaaggcttcctttccaggcgcagccctagaatgtcaaggaaaagccatgtgacccatccacccccaccgccaaaggcagggccggtgtccttctgtgtgtcccagggaagcctgggaggaggtgaggggacctcacggccacaagaaccgcagttgtattgaaaagcaactcgtccagtcccgacaggttttttttttccgggagtctcagggttccatctaatgcagagcttctcagagtccggtctctgccaatagcagtgtcatcacccagtcatatagttgggtgtttgtcccttccaaatctcatgctgaaatgtgacccccaaggttggaggtgaggcctggtgggaggtgttgggtaatgggagcggattcttcgtgagtggcttgatggggtcctggcagtaatgagtgagttctggctctgttagttcgcctgagatctggttgttaaaaagggcctggcacctcccacgcttgctcttgttccctctctcaccatgtgacacacccactccccttgccttttgccatgagtggaagctccctgaggcctcaccagaagctggcattggagccacgctacttatacagcctgcagaactgtgagccaaatacacctcttttctttataaattacccagtctcaagtattcttttatagcaatgcaaaatggattaatccacccagctactcagaaatgaaaaatctcaggccacatgcacatgtactcaatcggaaatgctgggcctggggctcgcacctgtgttttaccaaccccgcccccgccactccgccggtcctcgggcacgctgtagcacactgcttcccacatttggctgcatgttggaatcactcagagagtttttagaaacaggagtgcagggtcccattctcaaggattctgaggtgatggggttgggatacgacttgagtatgcgggtttttcaagtcttctgaagtcattcttgtgtgcagacaaagttgagaactactggcttagtatctgagagcttagctgttaagaaaacagaggctcccatccttaccctacaccagagctatcctttgtgttttctggaattcttagcaatttccagacacttgctccatcatccgggagaagatgctaattagtagcatttaatctggtaccttcctccttcctttttggcaacacctcagagaaaaacaggaaacctgaaaaaaggcaaggtcagcaacaacctccagggcttccagaaacacagagaagtctctggctcggttgtttctgtgcagggggctgctctcagctgctttgctgtaaaagacacgtatgggaggctgtgggcttggcctgctggtgagctgggaccacagcccctgccgggtccattccccactcagaagtggtggagaaaggacggtggactggcagggaggacaattgagatcccctagatgtttagcacattgttcgatctgactgtggaaattaataaatatgctcactggaatgaaaagaaacatctcctacccagccaagctctgtgtgaggcaatgaagggaaagtaaaagtgctgctcagagaaattctagtctccactggaagacccagagcagcatagaagcagtgcctttctgaagtgctgggaccaaatcgattggccatctgggcacctgccctatcccaccattgaacctgtgccctaggtcctgggaggacctcctccctcagcctgggaaggaatgggagggcagatgagggacagcctagaccagtggtcagttccccctgcttttccttcatttccctcaaatccaccagatcctcatctgccattttcctgggcctcagtactcccaccagcaaagtgttagtgccagacctcacgctctagggcatagaggagacatgggtaggtaaagggagaaggctttgcattccagtagtgttttatgcaaggaaagaaaagacctcaggaaaaaaagtgtaagagattcgtctccataccaccaccatcccagttacgggggtggctggagaaaagattttaaatccacccacacagtcctttaaaaagacttgcctaaaaatactgcacctctagatgaccccacttcatttccccacctaaaaagacacagaagcaactctcgctttcttttccttcctgcgatgcagcatgggctgtgaggaggcacttctgaatccagtgaataactgcaggcattgggaaccatcctcccaaccacatggatagacttgggacttgacataggtccttgagagatgctaaggagaaggagttggaggcttggctacctgtagcctgtgtcacagatatactgctgcaggtcacaggaggcagagctcctgctgatgggttttccggttctggtttggacaaaggaggagggcggggcataagagctggggaggaggaggaaggggcactacctcgttctgcccctgcgcgctgagctctggctttttcaccctgtttttcttttcttggaggcccagaagtcttcagagagggtgtttgagacagagctagtctaggtccaagtttggagtaggtatgcaactgtcactataaacacttcccaagaagatgacctacttctgcagaaagcacttgaattgcacgtggaatctgctctttttaagtttgaccgagtcatctgtgctccgtgagccaccgtggtggtctggcgctgttgctcagctctcggaggctgaggagtgtccctggctctggaactgagggggttaaccaagtgcttctctgcattgttagcggggaggaaggcgggcctggagaaggtcaagcccttcagatgaaaccctctttgagcagttgagctgtttccacttgtggttttacaatggccctatgaagaccagcccaaaaaaaaaaaaatcatcgaaatgggtcaggtgaggggacccttgagtggaggcccagcatcaagcgctggcccagtctgagagttagctgctgtctagggttctgagccctttggagaggaaagcatctgaggccagccttcgatttgggaaaggtcagtggggaattccatggcagaagaactatgccgtgcaggaagggagaaaaacaagtcaagctttccctggcgtggaagaataaagggcagagggtggaccagtgtttttaatgccacatgtcagcaggtagctgctcgcaaagggccagcctcttcttcgaagtttttgttgatggtctccaccaattccagtttgtttttcctttgtattgttattagcaccaaaatagaagacacttctccactgtctcctcagaacaccccatgcctacctctgtcttgtcaataggatgctatattacagctcagcacctacttatctgtgtgccttgccaggatataagaaggcaggcatcatatctcttatcgctggaatcccagcactatctcagcatatcacagtagtgtgtatagacccacaatcttttatctgcaaattccacattcacaaaggtctggaaacctcgagctttcttacaactcattttgcagaaaaccctgggctagatgttgtcagggttgcaaagtcaaaatgtaggagcagagtggaaacagcagactcaaatacatggcaaaacagaacagaaccacagggcaaggcaggcagcaagctgttgagtatgaggggaagagtgagatgtgagtgacacattctgaagtgagctctgaagagacctgaggggccaggtggcacttaagctgggtttcaattgtagataaggtttgcaaagataaaggggtggggtggggagataatcgtgggacaacatggttttctatttccctaactttttatgggcatattgctctctttccattaagttttcagtctctcccagggctaggatcttagttccatttcttccattctgtccaccgtacacagaaaatgcagtcatctctcagaattctcctattcaataagaaattattctgggacttacacatagaatgtgcttgagaagattttcttgaatgaataagaacttaagggcctgtaatttgttttcattcataaactttatttttggagcagttttaggttccagtaaaataaggggaaaatacagagcattcccatagaccccttttcccactgccccagcctccccaactgttaacattccacacccacgtggtgcagctcttacattcgtgaacctacatggacacgtcactatgctgatgcccgtttgtcctcgcattctctcttattcaagagtaatagaggatgcagacgaggacggcatgccttgctctgattcagcgacctctctttcctcccccgacttagaggttcctggtctgcggagaaacttgcccagatgcaaagccacagagcagagacagcagaatcagaagctttaaaaggtgtaagcggccggacgcggtggctcacgcctgtaattccagcactttgggaggccgaggtgggcggatcaccagaggtcaggagttagagaacagcctggacagcatggcaaaaccctgtctctaataaaaatacaaaaaattagctgggcatggtggcaggcacctgtaatcccagcttctcgggaggctgaggcacgagaatcgcttgaaccagggcatcagaggttggcagtgagctgatatcgcgccactgctctccagcctgggtgacagagcgagactccaaaaagaaaaaaacaaatagatgtaagcactgagaaggcagagagagcatccctgtgcaatagaggaagacatgtaggtatagatactaaagatagaaaagacctctggtatcagttccctccctcagggtccagagcaggggaaatattcaaggaactgctgcctctgatgtctcattggcagaccacagtcaaaaccacacatttttcaccagctcccagggcagctgaggccaagtgatctcttctcccatgagtgtggcctcaagaacagaggtactgacaccacagacccttaaagtgttgtgctctttacagtttgcaaagcacatttaaagtattgttgcagcctgaccacatcctagtgtgcagggtgcttcggggtcctcctgtctcacaggtgagagagctgcagggagcaaggggatggccctccatcacactgggtgagggagttgagccagaccctgtatgctgagccctcagcccaagctttctatagggcatggtggccgggccatcgacttcaaggtcctctggccactgcttgtgataataccaactcaattgtatttagttttacattcataatgagagaaaaagtagtcatccttctgaagtacggtgttttagtttatatatagcaagaaacatttctgagtcaaataccgttaggaaaagtttcagcatagatctttacctcgaaccctctccaagtctttaacataccaatgtgatcgggatgcaatatttgaccgtaattccatttctggcagagcatcttggttggaaatctctttgggggatgcagcaacagaatcgggggacacgtggctgcttttctctccagggcttagctctgagctgtcctccacggagggtctcagaggagcttggaggaggaaagatggaaaactgaaacctttaagaagagtctaaaaggaaatgagttattcaggcataagaagaagaagacactggcaggaccctgaagccaattttccaatatgtgagcacgtgaaggatccgctacatagcgtggtgggtgaggggctgttcttgcaagtagaatgctcagagcctggcttccttacagccgacagaaccgaatcagtcggccacaaggagcttgttgcatgaagacagggagcctctgcggccaggagccgggcaaggcggggactcagtatctcagggttctcaaagtgtcccgtaggactcgggtgggccagtttgcatcatgtattgaggcaggggactgaacacaatgacccattcaggtggttgttggcctcagggtgctgcaataatgaggttttctgtagaagcaggtctgaaagacagatgctgcaggatgaagagggggatggagaccttgggtgaattcattcacacccaaaccaggagggcggagggggtgagggtgagggagggagagaggaggaagactcagagcagagtcatttgaaagagcccagaagccaccaggtggaaaatcaccctgcagggagctgaccttcctccctcctcccgagaggcaccagccggcactgaccctgggtcccatctctgtggcctgtgagaaaagaggtgaaaagcggctcctcatgcctcgaaaccttgctgcccacatctgagggctggccttgatctctgggtctgtgcacccctccccccttattccttcctgacctttcatccatgaagcggggacagagggtgtggggctagggtggtgaagagggacggaggaggcaaagaaacaaaaggaaaatcacgaagggagactgggccctggggataggctacttgcgaactcctgagtttcattaaatatagaaaggtaggatgaaaaaataatattcactcattgttacagtttcaaagtcggaagctggccttgatttcaaagaacttgtgtgtaatgtgatgcatggctttctcttctgtctctttttataggtaagtgacatttcattctgctcatccccaaggcaaagttggatgtttttaaagtggaaaaaaaaatgaacggaaaaagaaacggggaaggtgggaagaggtggaaatggaagggcacaggtaggtgcatactcaattcttcatcttttgcacagactggtgggggggtcttccccctagattcggtggagattcctttcctcaggacggaaggtccaggtggtgactgtggcttttgagatgatgatggctttgttctttgaaaggggtttgtcctgtgacacaatggccagcacttttgctagaggtctttcctgggtgaagttccaagtcagaaaggatttgaggttttgcacgctaatgctatgtgtcagctacattgctgtgagtagggcctagaagaagtagggaaaagtgttctggagaggcaggattaaaacattccaggaaggaaaatcaagaacaaggaagaacgtcattcctgacatgatcaggcagtaaatggcatggaaatttctggacagaaaggaggtttgtgggaaaactgagatcttgtatattaagaaatttttacttaattttaaggtctatccaactactgtcaatgtatttttctattcctgcctggtcgccgaggctgaaacatcacttactttctctttagcatgaggcagggtagatttctaaaagagctgggggctggtttgtcattgtagtcactgtaccttttcttggtcagtcaagaaaggcgttttgaagttccaggctagttttggctttctactgctcttaaatataattgctttcccctaagagtagagtgaaaatgctcttttttttccccctgtgagttgccaacaatccactgatataattgactgatggctctgtcccacacgtatttgttattttctttgcgagagagagaaacgtaaaacattctatttaacagtctataaatccagactggaaacataaaactcaattcaataaaaatattgaacatactcagtcttatcttaagtccaattaaaggagattaacagaatgaagtgggggctgggttaacagaaaggggaaaaagacaaaaaccatttcaacttcaacactatgtctaaggtctcagaggaaatgctctcacaaacacgagagaaatctataggcttcggaaatctttgaaagagacaaaaatactagaacttgtttttgaaagtgtataattctatttctatcatttgaatacacagatgttctttaaatcttctttctcttgcttttaacaaagagggaggataaaagaaaactcaaaacccagcttccccctctaaattaggaaaagtgtcaccatatgttgaaaatcacaaagcatcttttttcatgatgccatgtccccgtcctgtggtctttcatttcctccgaagacactgtgactcatgtcacattttcacggctgcagacacacctgggaattcttcttggtatttgtcctgcataatggggaaaattaagctgccacgtatctggctcctagcccgagcaagggctttacaccacccccaccctgctttgaaagggaagaaaatctgaaaccaggaagcactcctagaaactgcccaacatggtaataagaaggtgggttctcagccacgtggcttcctgcagtccctctgccacagccaaggcctgtggatcaaggttgatggagtcactgatttagcgggaacattcgtgtgtttttgagcgtgttcacagaagaagggctgcaacataatcgcttcttggtcttgaggtcctcccttttctgcatagtgtaggcattgcatggatgaaaagagacggccttccctcctggctccctgtggacctcagaacttgccttgtcagcttggggcggggaacgctgaggggcccagcttattgtgatggatgaaggcagtccctcagaatttcccattaataaggaggtaatagagtatatgttaattttacaagaacatgttccacagagcatataagtacatgggatatatttgaatagttttaatatgctatgattctcagaaccatgggaatgaaattctatttgcacctacctaataaacaacacattccccagcactactgggccctggtggaataagaggacaaaggtgtagtgtttacaggcacccctcccccaacacacaaacactggcacgtgctcacacacacattcatattcctacatgcatactcacagagctgtgattttgcctttgaaaggtgacaaggagcaaagacatttttcagaaccagatctggcctctcagtgttgtttcccaagatatatgtgtcctgtttcatcaccctcatcgctcaccaaacgcctggccccgtcgctgtgtttaacttcacagcttggctgccgaatgcgccaggctcttcatttgcttggaatccatcgatctgaccatctccctagcgccagtgccccaggttggcacgttaatcatcttgggtccagcattgatctctctcactccattcctctctctgcctctggtcctgaggccttccttgaccgctctgtctgtctgcagcacgggccaggccactgagagggtttctgcttctcagctctggttctctagctttgagggagcagcagtgagtgcgagggggactgtgtgcaccgcttctagcagagatggaaacaaagaactctgtggtcttcaacagcaagtcacgcccttggcagccctggcaaagccggctgtgaggaatgctggggttcccactctctctttggacaaggatgtttttgttaccttttttttcttttttagctaaggcttaccaagtgtcagacgtcttactaaacaatacacacacacacacagagatttcttattttcaaagtaattctatgatactggttttatcatcctcttcttacaaacaagaaaatccaggcttaaagcgatgagataatttgcccaaggtcacatgaccttgaagcttgaattagagcttgtgtctatctgactacagtatttgtgcacttaactgctttgggatgaaaattctatcccaaaagagcagaaggtgacaggaaaggaaagtctttggaccaccctgggctcgctcccctctagctgtgcagagcaaccaaattcttgactgctaggcctctctggacagggctccagtgcagccagcacagggaggtgacaaagagctgggcccagatttagaagaacccagtttgaggcctgcatctgttaccaatttgctgtgtgcccttgggcaatttattaagttctctggacctctcaacatgggacagaagcatggtagtgtaatactgcataagcttaaccagagaccaagtacctataaaaggatgctctgacaatatttaataattatcattacttgaaaaatcccctctcatcatagccttccaaatttctgaatctagttcttgatttttctaatgaggtctagaatttttgccaatacaaggaacagtttttggcagctttctgcatcttcacttcctttcaataccaagcctagtggagagcaaaattagcctgccaatcactcagaggcgtatgggccccaggaaattaaattccccctctctccagctgtctatccccagtgccaggtaccaaatgaacacgcgccatacgttgcggttcccgtgtcttcttcctatatgttaatttgataattttagtaaaataaaccaagtagatttgagatgtagttcattatccccaaagtcaagagattatagaatgccgtgagtcagaagggggccactgctctcttccattgttttttttttttttttttttttttttagattttaatatttcctttttctggcaacatttaaaagccactcttttacatctgttgccatcctttaatgacagacagaataaagggatgattgttactcagagaagctaaacaaagggactaggatcacttggcacatcctcgtgtgtggctgactttgaactcctggagcccatatcctccgcgcttctgctgggcaccagaggcagaacccgcggaactgcttcctgcagccacggatgggtacccaccaagccttagggagaaccgtgctctaaatgccatctgtgtttgccagtggcattcacgcgtcccctcctgtcctgcagggaaattaagaagggatctcctctcaaggctgacacctggagacagcggcttcctcttacacatccttcccacgcctcatctctggagtgagttatcttaatcctgacatttgcccagccattcagaatgtaaacctttttgtactacagggtaacaaatattttgggtaaacagtgattgcattgatgtggaaagccaagtagagatccctggcaagtgaaggataaagagctttgtccatactgtttggtcactgttatgagctgaacagggtctttccaaaatttacatgttgaagtcctgacctccagtaattcagaaggtgactgtattgggagatacttaaagaggtgattagggcaaaaagaggtcatatggctaggaccgaatccaatatgacgaatgtccttatagaaagcgattgggacacagcacacagggaggagagttcatgtgaagacacagagacgcctaagaggaaactgacactgctgacacattgatcttgaacttctaacctgcagagtgtgaggaaataaatttctgttgtctaagctacccagtctatggtattttattatggcagctctagcaaactaacaaagtcacaaaatgcattcatctagactcagtcccaatgtctgggaacaagcagaactggccgtgggccacggaaaagaggcaggcttgtgagacaaattcccaccccaccgtattttgcctgacttttgtcaagttcccatgttgatccccagtttccttatctgtacaatgggtatgatatatatctcattgctgttttgaaaattaactgagataaggaataataaatattttaagacacgcattgctcagtatccagttttgctgactcaatttctcttaatggtcataggaataaaaatacacagtaaatgtgatgttgtaatgtgtggtatatattaggctacatattcactaaagtcactgcatcagtctgttgtatttttttcttctggtaattggagacaacacatctattctgaggattcagtgcccagggctattgaattcctcaacccatggtcaagtgactgagtgaggccagcccttcacccttcaccctgcctatcactcctttgctctcagccttactgctgtgggagaagcagtgccatagaatatggctcatgagatgtccacaccctgcccctggccctgcctcctgtcttataattgccagagggttcctttatttcaatgaaacttacagttacaaacagctacggccagactcatggattcacttctaatgactagcttcactgaggaggagatcattgaccataatataccacaaatgcacaaggcgttgcgagggcaggagaccacctgactgcccccagcctggcctaccccattggagccatgcctacaaccacccctcacagaacagaggatcccagaatgaagagacatactcgacaaacacatgcatttctgacatcctgagatgggagatgcctatgatctctgggcagaggttgactgaaagccaagtagccctggatgacgttcccagagtccccgacccacaacagagtcctcagcctctctggtccacaaatggataagatcagtgcaacagagacgtccagggtcctggtgaaggactcacaaagctgcactcactaaaggctgatgacacactaccattccagtgggatgacttaccagggaggggggcattcttttccagctgtggctgggatcaacatttctggaagctgagctattgatctgtggctgggtgagtaaagatccaggtctcacatctgagcgattcagccccatgcactggggtctggggccgtgcagtgttctctaaggaactgacttggaggcctaggggaccctagcagaaggggagtgctttggctggccctttgctccattgccatggccttggtcctcacaattatgctgcaaggaagtaagtgggtttcagggctggcttattggatcttgccatcccacctctgtgccctacctgggattccttcatttaaaagcttctttttcccttaaagaggaggaccccaattctgggcagaatctacaaagcctgtggatcctggcctctgcttgctctccaactctgctcttccgtgggttgttcttgttccagccacctgggctttgccgtagtccttactccttctgcctagaaagcacttctgatccctctgttactgggtgaccctcagtacctttaataattcaaccgaagacccttccttgggaaagccttcctgatccccaggctgggtgctcacccttgaatccaccctttttcttctatgcatttgttttgctttgtatgtaagcattcattggtgctctgattccagctccccagtaggggagcagccccatgacagcaggtgatacaccttcttttgcccccagtgagcttcccagaacctggaaccatgtgagtactaatcctggtcatggagggacccagagaaagtttcctgccttacagcagtgagcaagtgttcagcctcgtgcttctctcaacaggaatagcccaggagtgaaacgtccctgagcagaccttgagactttgagggcttctcaccctgatctcaccttagaaccacccaggaacttttaaacccatggacgccctccccacatgcctgagattccaactcaaacagcctgggtgggcctgggcatccgcaggtgtctcctctgtgctaccaggattgggacccactgcctggagacaccctctcttcccactgctgggttttgattagttgaactccaagggcacctctcttccaagttaatagtcatagttgccacacactgtgcaatccacttctggtgccttgtgcggcttgagcttcataatgatgagagatagcttttgtcgttcctattttgtggttgagaagctgcagccaggggaggttaagtatcttgaacaaggccttgcaactcacatgagaagaagcaggatttgaactcatgccaatggaacacgagcctgggctgttagtgtctatattatatcaccttacgttcttgtggcagaggactttggaagcactttgtgtcatgcatatatgtgtgcatgtatatctacctctatctatctatctatctatctatctatctatctatctatctgtaaataaatatcttctacagcacttactatcagcaatgcctggatattcctaagtattcccaggtagtactactaattgtgagtggagattttaaaaaaaaaacaaaaaccttgattatatgttacaagtccctaagtggttgggctgtggcccctcacctgcttgtagctttgagtggagaaaggacagcacccgcgtggccaccgaaacaagctctcctggccctttcccctgttggataggaacaaggggcaggatataatgagtctaaagcagagacttaagatgactcctttcttcccccttctaatccccaatttcagacaaacatggggcccagaagtgagtgagggaattaaattaaggaacacaatttctccctgtcattgaactctgactaatgagtctatttctgggtaataagaaggagcaggaagtgacaaggcagtgtaatgaattagtggcccagaacctcgttagtcagaataatctttccacgaaaggtaaatgatgcaaacgttaattataaagccagggtggaaatgcatcccattatttggcttcctaagaaatctatcccagttattatgaggcatttcaaacaacaataacaataataataaagtaaggctcagtgagaactttagtccttggggagacttgttccactggtggtggccggtagggggagcacagctttctgctttcaaaaggggctggagcttggggaagccaccacgcccctctgggttttgtaccaggaaagatgcggtagagtccctgtcccggtttctctgtgccccgtagggttggtcattcagggctgtccactctagtcatccagatccagatgaggtgaggagtttaactagaagtttcccccatccaaagagagagagagagagagagaacaaggctgaggattttgcaggaactctggcatgttaaagggggtcagagatcaaaaccatggaggaaatagaggttaagaggtcaggctctggaatcagccaagctgaaaccctggctcgccatgattggaaaagtcccgtagcctggtttcctgctctgagaactggtggctaccagaagcatctgtttaaggaggtttttatgagcattaagtgaggtgtgcatgtgagatacttagcatccattaagtgcttcatagatgccactgataatgtgttttgaatgcagagtgaaggttgtagagctggaaggcatgttaggggcatgttaggggcattgaaggaggctaccttgttgcacaggtgaggggggagggcaacgtcactcagcaattcagcggtgggggcaccgaggcttccggctccaggctcaggtgaggctctgtcatctcaggctgtttgtcatagcctgggtttttggccacagcatagaagggaggcagcaggggaaagacaggaagctaaatcagtctcaagaaatgcagttgctgagaccattcctcaggagagcaaataaaccatattaaaactataaaaaagtatcctgcagctccgtggtaataaacttgtctgtgacttcacggcttagaaggtcccagcttctgaagatttgagcgatctcttgcccacaaaggggccggataagtcatttgctgaagggagagaagtttgaagcaaagatgctggcactctccggagcctccttccaggtggcgtccgattgaagcggaggctgggagctgcttttgttttgaaggctttgtcggtgtctgactggcaactcttggtaatgagagaagaaaaaacaattaattggaaatgaattttaattgtctctgactcctcatttgtaggctattaaaatgagttccctattaaaatatcacatcagctgcctcactccaagataacagaaggcgccccaaaagctcttctcctgccacgtccagtacccactccaccctcatcccctttggcaaaaagtgggctcggaggttttaagcaaaatgaaccaaagaaggaaaaatagaaaaaaattgctctcaaatctttcctttctttctttctttctttctctccctctctctcttactttcttccttccttccttcctttctttctttttctttctttcttctttctttcttatacatttatttatttttgctaaggaatacatgtctgcattcatgtagtattctgtggctgtctgtttcgttcccatttctgagtgctgtggcaacgtgggttggaaagcagggctccgctggagctgggccttctctgccagctgctcagtctctacctggaatggaggctgtagtggggctggggtgaggccaagggaaatggacatgtggtactggggcaggagacaaggctaggaggcctgacagtcgagggctaggactactgtgtccccttctcctccctgcctcacttgctcctctaccccactgggtcagggaggttcatttctcgacatggatgctgtccgagaggcgtagcccttcttggaggcctcagatctaggctaaaaccacctctgatgctgcccggcgaggtggctgtgtgatcagagccagccccttcccctctgctccctctgtgagcaatcctaggtattcactcagtagatgctaaaggcctggggcccaggaggctcccagggaatgtggcccccagccccttctgaaaacagacgtccttccctctgcttcactgtcggcagaggctcccctcttcctcctgctctgtcctttctcactccatcctcccttctctgtttcctgcccccatcatctttcttctgacccttcctcccagccctgtttctctccaagcaaaagcgccaggaattcctgcccaacaggctctgctcaagaacttgctaggaggcttttggcccttgcctttctaggtaaggtctgcactcagcaactttatggatgccaggagggagccattcctatctcccccaggcagaggcataatcagcctagaaggccagttccacccctagcctccctggggcgctatctggcgtctatactcatcctccccgcccaaccccatcactgcacactttatttatggaaggccagggacacctgtctccatccttctacattacctgcatattcacaggatccaccacagctcctgcttgcctgggccttgtcagctctgggcttgcagagaatgtggttgaatcagtgttagccctgggctggcagggcctaccggtggctgccctcaccctcctctgggctggcagggcctaccggtggctaccctcaccctcctctggagcccacgctgggctgggcatatctgcgacttggcagaggtggcaaatggctcagagccctgtgagaaccaccaagactcagcggtataggaagcagacgccttgggctaattcacaggccactggagagtgacaaagcgcccatcgacagtggtcgatcaaagaagtggcatcgaaagtggcaaagagaagtgtgtcccctgagctcgcctcagagtaatgacctggacgctggtggaggcaatgatatttgttggtttgagagctaaggcccctctgaaggccaagtcaaggtttgggggctccaaaccttggacagcagcaggtgcttggctccgggacaaagaggcctctgtcccggctccacctgagagcactgggctggctgttggctgccccctggctgcaccgcctctcagcagcagatggccaggggcccgcagcgtgccctcgctgtgttcctctccacgtgcacatccctttctctttgtctttctacacaaattgcctgtttctggagtggactcggctttccacaccatgggtccgggaggaccggccttcttggcaggtgtgggaggaacaagcctgcgtggtgctgtccctccctccccaccaggagcagagcagcaaggggacccttgaacatttcccctctggggaggcctcaaagcatagcacaggcccgaatgcattgagggttcaggcagggatgccagcgagccaggcttctggggccaggtgaaggcagaggcggcgacttgagcaaatgagcctcctttgaaggcaccgcacccccaccgaggacactgggcctgcttcacgaagcacgcgtgggcgtgtttggatgagcgctgtgtggctctgcagctccgaggaaaccgcatcagacaccccgacagctggagtgcctcaccctttcagtctccctgggattccaggccattctcttcggcctggcctcttcctattcacccatcagaccaggctcaaacccaccttgtcttgttcatggtgctgtaggctggcattaattgtatgacagaatgtttattcatatatatattttcccactagactctggtgccaataggaaagggacacaattctacttaggtatttagtactcctggtacatagtagggcctctgtggaggcttatggaattcaaatacccatggaccagccttggcctcttctttctggccttcaaaagaaaggctttgcgataagttctcccttaaaacagagaagaccacggtgccggggtgggggtggggtgtgaccgtgttccttgcctatttcccttacaacagagaagaccacggtgccggggtgggggtggggtgtgaccgtgttccttgcctatttcccttacaacagagaagaccacggtgccggggtgggggtggggagtgaccgtgttccttgtctatttcccttaaaacagagaagaccacggtgccggggtgggggtggggagtgacctcgttccttgtctattttaggctttagcctaaaaatagatggggatggagagggctagggagggcaggagggtcagaaaactcctgaggtttctggtggtaaattgtgagtacaacaatggatcaagaaggtgaccccagaacccttgctgtgtgcccactggggtacagctggtgaccaggaggatgctcagggctgcctgtgggctcctgagtggagagacttgaggttgaccagtccatttccactaactttgtaggatgcctaccttagaggacaaaggaggctggtggccttctctgagcagggcattatggtggccccaaaaggatcacagggccctttctgccagcccccaggcctgtactttgtaagaactgcaaattgtgtcctcattgtctgtgtgtatgtgtttcagtgtgtgtgtctttcttcttatctcttcatcatctgggtcacctgcccacctctggacaaagcttgcatttaaatatggtgccagacagtgacgtgatacagttagcgggtgatgcttgctgctctaattttgtctgcttttgggaactctgcaaaaatgctcttccatccctcactgggagcactgctggacaaatggtactaaagggacctgtaccttggggggcccaggtgacacctgagaccctctgtagacagcatggcagccctccactctctcggctctccttcctgaggctggagaacagagatctcacgtttgcagaagtccttttaaaacaaagtgccagaacaaggatttgacatcaccagtgagaaaaaataaattcatttttgcccacacctccactcccccgtctgttggtgtcagactctgatgggttgaaaggcggcacaaagagaaagagggtagggagatgatggcaactcggggagataattgacttcagaaatgctatgtcttggatgtaggaagaaaacaagtgaaaatatgttattttacaaccttgatacttctgacctcatggaaaaaacatacacacacagcgtagggtgagcaggtaggcaggaggaagggtcctagcacggggtgcgggcgccctcgcgtggccatgagaagtagtgccacacgcacacgttctctttcccagagaagcagacgtgctgcacaagtgcttggccaccgcctacactgaaactggaaagagctcactgaaaaggaatgcagttcataaaaagtcttccttctctacccaagacattcttgtcactcctagggctgtcattcttgaaaaggagaggctggtatagtaggaagaaagctcaatcctaaagctcagtttggtgtttgtggcttagcggctggacgtccttagtgtgtcttggcttgtcgcctgtaaagtgatcagcatgacctggatggtgcttctgcttccctgcagctgggatgctctggccttgaggatgctgaaacaccagagagctggccactcgctggtatcagtcgggcaagcgaactctttgtgtgggattgcttcatttcatttgaagtcattcattgctatgattgtagtctttttctggttcccatgaatctggtgttggctcagtgtaacagaaccagccttattgttcccatttgcagttacaagaatattgccattgttatttgcaagcctgatttccctgtctggttacctgtaatgctgcttctctgaaattctctgaaagacagaaaaaccttccccgcgggatataggttatcaggcacctaaactcattgcagctccaagacatgcatggattagggaccaagatgtggggctcatagtttacagaatttggtcttatattctccctttcatctggatcttcatacagctactcacttgctgctagaaaagaaagctcccagtgtgccagatggattccaaagtcccatttcctgcattcatcccaccatatttgaagactcttttcttttcaaatgcttagcccgggtgagcagacctcaaccttcgcctagcacccatcttcctgatcctgcctgagcttccagatccccagttccatctttactttggttcttgtataagacgaagagagcatttatcttttctgtttaaacccttgggatatttctgtttagcaagacagcaatttcgggcagctacactgttttattaagtatattaaacagcagagtagctcatctgttgtcgactggctttcttggctcaaacccaatatatcacgggtggttttcccaacacatttttaaattcttattactggctaggatatgatttcacaaatgttattataataattcattagtatcttacataaccagtaatacagactgaacctttgccaaatgcattgttataactttttggaatggtggccgcattaattaatcattgcttgttgagtgcctactatgagcaagagaatttgcatttttgttctttcatttctcatgacagcccaataagggaggtaggattatctcattttaaccaaaggagactctgaggccgagggaggctgagcggcttactcgagttctcgcagctgctatatcctagaggagaccaaattcacacccagcttggactccaaagcttgtacatttctcatcatgtgaccctccacccacagactgtctgagtacaaaattccacagagggccttgacttagaagaccctctgccagcattttgtctgtggttttgtgtgtcgtctcagatgaaggtgactcaagacttcaggcagaggatgttttccatttaaatcccctaaaagaaaatggccctgtttctagaagagagaaaagcccagacgtctgcttgactttgcttccaggggcaaggactggggtccagatccataatctgggagagtcttttatggctttcacctttggtgttgaagaggactggcaagcaaaccccttggaccaatggtttcacccttggaaacttagctgggtaggtccatgtcaccatgggactggactgacatttagccagattttgaaatgagagacttgaacctgaacccttgcttttctcttctggataatttgatttttagcaagaggctgttggaagacacaaaggtccattttgtctcaaaacaggtgaacatagggaagagaaactgaaaagggaggctttgggagcacataactgttttcagatatttaagtgctgtttggtagaaaaggaatgagatgttttctgtataattacataaaacaaaaccaagactgatggacagaagttatttgggagcaatctgttcaatataaaggaaattttaagggtctaagctacccaaagaagtgaagggctgcgttggagtttttctagcactgagggtgtgtgtatctgtgtgtgtgtgtgtgtctgtgcctgtgtacatgcgtgtgcgggggtatgcctgtgtgtgcgcatgcatgcgtgactgtgaacctgcatatgcacatagtggagggagcacataagagacagaaggttttatcagacgaccttcacaattccatattttcaggaagtctataattaaatgttttaacatgggccttcaggcaccacaattagccattggagagacagatttgctcaagaagtctgcctggtgcactttttcttcgttgaaaattttaaaccttcaaaaatgtaataaaagtagtgtattgaacagcttccctccatatttactatgcaccttctaagaacaaggcgtcttcttccacagccacaacacaaggtatgaattccagagacttagcccagatccacttcagcctctggagtagtctgaataatgtccgttattacagtcgcctcacgacggacctgtccacttagctgcgttctgttgccatatctctttagactcttcgtatctggagcagtgctgttgcctttgtctttcctgacactgacatttttgatgatgacagactgattggtagtgttgggcacttttcagatgttgcccaaatcaccagcagctagatctgcctctggcatctaatacatatggaaaccgcacggtgggataggaggaactctgtgccctggtggcctcaggtccccgagccctgccctgcttgcaagcacaacttatgtgggaggcagtgagtgccaggaatggatgctcaaggcctgaagtctgtcctgccacttcaggccatttgagtttgcgcagatcacccgcctcccgtggaggtccacttcctcttctctgcagtgaggacctttcgtggcagtgttgggaatgacatggcatattacaggtagaagtccttaataaactctagcaaagtgctagaccaatgcaatcgtttattatttatttttaacatatcagcgaggtgcctgaagctagaactgcatagtgagattgaaaaacttgtgaggaaaactatggggaaagatgaaagccaggctggccaggcaggacggctgcatacgcagccatacatgaccctgagctcctctccagttgtcaagtggtgatccctctgtgcccacttccaaagcctctggtaccagcaatgtccatggcttattgagcatttactgagggtcaagcgctttgccaagagaagcccaaattctcataagaacccagaaagttcctatgagcaatatgttaagatgcagagatagagtttcagagaggttacgccatttgctcaacctcatgcagtcaggaaatgtcaggactgaacagcacattaccagcgccctgcagaggcctggcatccttgtcccctccactcctcctatgccatccttggtggccctataacacagagccttgtgacacacagctggtcagcaagccctactataaagtcacagggttgatttgaatctgcaagtgatcagctctcctgaagcaggaccttgtctcttcactgatatgcagatgtatgctaataggctccagagtcacccttccctccaccaccttctcagctttatttatttactgacttgatgaagtgaagaggctggagaactaaggaattcatgagcattgcagcttccggggcccctggtaacaaactccctgtctcccttttcctgcctggggcccagactggaccggggtttgagggaggagagaacacaggtgcctgaccatgtgctgatgaggccctggacagccttctaagggcacaccctgggcactcgtgagttgtctccatgtgggtttcagtggggtctggtggctggatggcctgaccatcacaggggtaggtggctcagccctctggctctgggcagtgcccaggtctggcccagcgctgaccactcagctttctgctctctggtatttctgctctattcaacacagaagccatgagggcagctgaggccccaagggcaaggtcttctgagtcctgcttgatcatggcagagaaagaggagcatttgaaacagatgcccttcctcctgtactccctctcccagtgtggagctgtgagatgcaggaaaggcctgactactggggctaggagttttagacattctactgcccaatgctgctacatgtcacagttcctcaagggcattgctcttttcttccttctctctctcttcctcttctcccatctctttctttggcaagagctcttggagctcctgtttcttttccaccttggggaagaggttgtcactggatctgtccactttctatgactgagcctctcgtgtctggacttctgacgctccgtgtgaagcagaggcatggccagaagcgaggctagaacaaggctgtccgggacggggcctgcacatcggtgcatggagagagagtggttcaggagccccacaagcagctaccttcggctaacacgtccgtcttcttgcacacagcttcctctgacatcattttatcatagttattgcagctatcatgttacatgattgcttttaaaataaaaaatatctcatttctggagaaagtgctcacagagagcagctgctgcccctgtccactctcttctccattcatgctctgtgcccactcagggctggaatcccctctaggccaccgtcgtttgctccatgatctgctcacagatggaagtcagcccccctgacatttgggaatctgctgcctcccacatcagaacctgctccctccagctcttcacccatctcctcccctgtgcttgagtccagatagcctccatgtgcaaagacacagaagggcgttccatgcatgaaaagaagaaagtgcaatggaaagaagtagggagggggtgcctgtggagtcaagcccaaactctagatcaaatggaggaaagggttgtcatcgtgcctgccaatcccaatcatttttacggcctttagaaggtactgggttgagaaggattccaaagccaagtctgggctccacaagataggcagccgtgattgattgataatgtccacttctgggcgtggacacagaagtgcgggcatgctgcctgcccagctttcagcggtgcctttcccaggagctgatcgctgtgcctctgattatgcttcttcctctgccatttgtgtccagtttctcccatttccctctgatggcttctagataactagtgccccctagtaaggtagtaagaaatattgtaaaaatgttacagcatctgtatcgcttgaaacttctttgaaatgtaaaatcttgggtctcaccacagataatactgacttggaaactctggggtgagctccagagagctgggttctgacggccctcccagtcaccctgatgcaggctgacattgagaaccactgtttgttaggagaattttgaggcatgggctttccgatggagaaggctagtgctgatgtttgactaactccttttttgtttttaacaaagtcatgcaaaggtgaatctactagtttaggattctctgagtgaagcgccttgagaaagaatgatattttatagcaatattcagcggcagatttttatcgagcttcagtaaatccctcctggacaaggggagatgaggctctctgggtgactgcaagatgtgaacccagacaaagacagtccaggagccctgaccccccatccttctctggtatttacgtctctgtgttggccgtcacagcaccttgccctccctcaccaagggctggcctgctcatgaaattgacattttggattttaccaaaatgaatcggaaaagataccagatatgggctgttagagaaacatgggaatacctaataacatgaacttttctgtggatttgagcacatctatgtatgtgtctatgtacttgtctgtgtatgtgtgtttctgtgtctgtgagtgcctgtgtgtgtgtgcgtctgtgtaggcatgtgtgcctctgtgtctgtgtgtgagatcatatctgtgtctgtgtctgtgagtgcctgtgtgtgtgcacgtctgtgtaggcatgtgtgcctctgtgtctgtgtgagatcatggctgtgtctgtgtctgtgagtgcctgtgtgtgtgtctgtgtaggcatgtgtgcctctgtgtctgtgtgtgagatcatgcctgtgtctgtgtctgtgagtgcctgtgtgtgtgtctgtgtaggcatgtgtgcctctgtgtctgtgtgtgagatcatgcctgtgtctgtgtctgtgagtgcctgtgtgtgtgtgcatatgtttgcataggcatgtgtgcctctgtgtctgtgtgtgagatcatgcctatgtctatgtgagtgcctgtgtgtgtgtgtgtgtgtgtgtgtatgtgagcttgtttctgtgtctgtgtgtatgtctccctgtgtgtgtgagcgtgtgtgtttctgtgtctgtgtgtgtgtctccctgtgtgtgtgagcatgtgtgtttctgtgtctgtatgtctccctgtgtgtgtgagcgtgtgtgtttctgtgtctgtatgtctccctgtgtgtgtgagcgtgtgtgtttctgtgtctgtatgtctccctgtgtgtgtgagcgtgtgtgtttctgtgtctgtatgtctccctgtgtgagcgtgtgtgtttctgtgtctgtgtgtatgtctccctgtgtgtgtgagcgtgtgtgtttctgtgtatgtatgtttccctgtgtgtgtgagcatgtgtgtttctgtgtctgtatgtctccctgtgtatgtgagtgtgtgtttctgtgtctgtgtgtatgtctccctgtgtatgtgagcgtgtgtttctgtgtctgtgtgtatgtctccctgtgtgtgtgagcgtgtgtgtttctgtgtctgtatgtctgtgtgtgtgagcgtgtgtgtttctgtgtctgtgtgtatgtctccctgtgtgtgtgagcatgtgtgtttctgtgtctgtgtgtatgtctccctgtgtgtgtgagcgtgtgtgtttctgtgtctgtatgtctgtgtgtgtgagcgtgtgtgtttctgtgtctgtgtgtatgtctccttgtgtgtgtgagcatgtgtttctgtgtctgtgtgtatgtctccctgtgtatgtgagcgtgtgtatttctgtgtctgtgtgtatgtctccctgtgtatgtgagcttgtttctgtgtctgtgcgtatgtctccctgtgtgtgtgagcgtgtgtgtttctgtgtctgtgtgtatgtctccctgtgtgtgtgagcgtgtgtgtttctgtgtctgtgtgtgtatctccctgtgtatgtgagcttgtttctgtgtctgtgtgtatgtctccctgtgtgtgtgagcgtgtgtgtttctgtgtctgtgtgtatgtctccctgtgtgtgtgagcgtgtgtgtttctgtgtctgtgtgtatgtctccctgtgtgtgtgagcgtgtgtgcgtctgtgtctgtgtgtctccttgcgtgtgtctgtgtgtgtgtcgtgtgtgtgtgtgtgttctcaccctcaccctgtggctagagaacccggctaagtgaaaagcaattggtaggctgagctgaccagtccttccaatctcaagtgctgtctctggaaaaagtacaccgaggacccagcccctagggctgcaggcagaaccgacgcacctagtgacacctttcacccgccctccacgggcagtggctgggtcatcactgggtcatctccctggcacgagggatgcctggctgactcctgcaaggtctcacccgttcctgatctgaacgccttcctctgtgagctactgatggaggcagccctgctggcatgctgtatagctgaggagcctctggtttccttcctggaaaatggggcaatacctgcctggaaggctgctgtgaggactaatctaagaatctctgtacaaaaacagcagctgtggttgcaggccacagggggtgttctgcaaggaccccgaaggacccattcagaagagccttcacctgctcctgctatcctaaccccatcggctgcagggagtcctgggaggctgagggccctccctcctcgtggcacgcatgcagctgcagagctggagagcggagccctctcctctgccagcctgctcaggactgtgaccctgggtggggaccagggagcctgccggccttaaaccctgcaaagtagaggagcccagcatgagcccggttctcacttcccctgcaggccactgacacggagagcgggtccttccttgttactgcaccctgagcgcatctctgctgcaatttgctctcagcgcctccactgaaagttgcctgcatccattcagttctgacagccatatccgaaatcagctccctctcggtgctggatcccctttggctcctggaggcccaagagaggggccgacccagtacctactggatcacggtggcagccgctgtttcctgggaagcatgttgcgcccacactccctctgcacattttacctaccagccgggactgagatgtgaaatgggatgagctggaaaaggcaggtagatgtcgtacacatcccaacaccagctccccaccgttctctctctatcacgcaagcacgtgcaaggacgcaggcccataccactttctaggaattctgtggcgaaaataacaacccacagtcatctgcacagcaattattattcattataactgaactttccctctaaaaccgaagcttccctttcttactgcaaaacccaaccagaaggtctgcatgctttattcctaatcaaaagaagaatgctaacacctccctggcagagcatcactctccgcgcttcagcagcccctggctttgtttctctggtttttgctcctctgaagtgaggtgagaaagggactggggatgtgcacatcacaggagccccttcggcagggctgtctgcagcggggcactgtgcagggtgcacgggaggaggggaaacaacctctgccctccagctctggtacctaagtcccctcttgggaaatgaagggataatgcaataggctccagaaggaatctgaccaggttgatgccttaggagctgagagtggaggtgaaggggaggaggcacatcaagggggctgatggaccctaattgtgcatgatagggtgggtttgtagttgcagaaatagaccctggatgtgtccgaggttcactctgtcaatgtattcacactaaacctgccctgcagagggctggaacgtgaataaaaaatcctatcatgattgctctggagggggctggcacgagtgaggcgacctgatccccacgtcagcattcatgctcatattttggggtgatgcagggcgatgccaaagagcaggtggctggaagttttagaggaaggtcccctggggggcactctgggttgtcctttgtcattggagctgatggcgtcctaggctgacttctccccggggtcttcccagccctggtgcgtgttgctttgtgaggcgctgatctgctggagggtgggatgtacttgcacttagaaagggcgttctgaagggcaggcggtggcaagaggttattgggactgaatcaaaccccacttgctttggagttcagcagagttgggttctaattctaactctactacttactggctggccgtgtgaggagaattcaagatcacttaacctcgcctaacttcattgcttcattctgtctgtggaattgggagaaccccctctggattttgctgtgggagtgaaatgagctcctgtgtgtggggctctgaggcacgggccccggggagagcaacgtggggtgagcagccttcaccacgaggacgtcctgacgacagtgactctctctggctctgccaacctgaccacagcgatccagggaggatcctcctggctgggtggcaagtgacgtctctgagattataaagctatagtcacacaccccctccccacctggaaactatagaaaggcagttcccccacactccctagtgggtagcctgctccactctgcctggaaaccttttctcaacagcctctgagctgctggcagcatcccctggtgccctccccagcctgcagcttccagggagctgggaggagcatgcccttggactgtctctgtcctctggctgacacagccgcttcctttatgtaggacactggcccctcatttgctcagctttgggacctgcaggtggacatttggcccagtcccaggctggaggccctgcggctttcccaggccagctcatcatgccacctccctgcctctgtttgagaagcctcctttccctaacattcctgcattcctagagagcagagggcctctggaggcagcagtgcataccctggccctggagatgacccgtgcaagatacaggctgggccaactccttgggactccatgtctccagctgtgtaggacaacgacactcccagccccaccatggtgaagagcctgagttggaggtgggcaagaagaccaagggcatgagtgagcctcaggggtgagtgagcccccactagggtgaacgtgaatctgttctgtggacgctggcccagagcccagaaggaagacccactccgagctgctcagggctgggataggaccatctaggtggaaggctcaacccaagaatgagctttctagaaattctaagttggagtgaatttttaaaacaatagcttccataggtgtcatgtgtaattgttacaaagcccctgggaagagggattaatggtggccctttgagatccttgcagaagcccagcagttgggcccttgacaagaacaatcagcttggggggcagctagcactgcccaaccccagtcagtccttcctgatgcactcctcaagccagatgaggctccccagccagcatccatgggaagcagctgggggctcatggagagtcgggcatccatgggaagcagctgggggctcatggagagtcgggcaggcaggctgacagcactcagacttccccagaactgaatggcaatgtggggtcatggcagtttgtctctgatcccgtctgtttctgaccctctatttactctgctgcaaacacattggcctccatcttcagctggtcccctgtacgccaagcacattcctgcctcagggcctttgtgctttctacttttctgctggcagtgctccgccccctcgtagcaagtgaatagctccttcacttcttatcagaaatgcccgccaatcgccctatttcagtagacacagagccacagcacactctctccttacctttttttaaaaaaatcattttgcttaaggatttcaatgtgacatagtagcattcacttgtttatttgtttagtgtcaatctacctccacaaaaatagaagttccacacgagcagggacattgttttgttcactttttcacccatagtgtctagaatatcggcataaagaagacactcaatatataagtttttagaatcaagtcatggtaactagagggtttttccagctctgacatcccacagccttgtcctacataagaagtgctatcctgggctcaggatgcttacaaagaagtctggagttggccctgcctcccaggatcttcccatgtcaaaggagtgggaggaggaacacataaggggctaaacagacaggggctgatgagggtcccctccccagtccccaccagagagctacaggccacaggccacagaccacggtctcccaggaggcctctctcagagcaggctgggcctgggaacttgctcaccatcctgtcaggaactacagttgaccctcaaataatgcggtggttgggggtgccgaccccttgcttagttgaaaattcatgtataacttttgacttctcaaaaatttaagtcctaataatttactgttgcccagaagccttgctgagaacatgaactgtcaattaacatggattttgcatgttatgtgttatataccataatctcacaataaagtaagctagaggaaagaaaatggtattaagaaaatagtaaggaagggaaaatgtatttactattaatcaaatggaagtggaccatcataaaggtcttcatcctcgccatgttcaccatgagtaggctgaggaggaagaggaggaggaggaaggagaatcggtcctgctgtctcaagggtggcggaggcagaagaggaggaggcaggaagtgcaggcactcttggtgtaacttttactttatgtggatccacgtataagtggatccgtgcagttcaaatcatgttgttcaagggtcaaccgcatctggttcagaaactcctctatgtgcccctcatggctcagtcccacctgaatacggccataacgaggctggccgagaggcacagatcggaatggggtcatttcctttgatttcctttgatgttttcaaaggtagaaaataatttcgggccttttctaagaagcacttagctgtgggctggaggttggagaatgttccatctgctggaaatgctaattagaggcaatcataacccagacttgacctgccagggcacactggagtgaagcggcgccctggtgggagggtgtgggggcagcggagcccaggccgcagggccacgttctgccccagttcgggacaacctgaactgctggactcagagacagcagggactgagctgggaaacactcacctcacttgcgggtcaggactcaggggcaggtcagggctcagtcccagggcccctccacgtcatgcaatgcttcccactgctgttagaaagtagcaaatgatttcactaaccccatgttccaggggagaaggaaaattgtacctgcatgaaacgtgacaacaccgtcacgcgtggtgtcagctggttgacagccatttgcaccctcccagcgcccctcccaccccagttgcttgaatgtgatctcgctacccagagggatgcctgccccttccaattgcggcttcgggcagggacacgggacatcagtgctgggtgactctaatgagggctgtaaggtttgcgacccgctgtggcctgggccttccagggtcccggcagagccctctgctcctcagaccatcaccggcctggccccaggctaggggccttcatgggcgtcagcgtggggccggcgtcccgccttgcctgtcttccctgtccacctcaccttcgcccccgggggtggctgccgagtggggcagccacaagttacttgaattagtgccgcccaagtgcctcgggtgggagtgggggatgctgcaagggacgcaccgaaatatgaatgtccaaggtttgtgctcctcaaagaacaaaaccattccacaggagtgccactgggagagggacaggcggccacaggcgagggggcccctgggtctggtggcggaagggctgtgaagtcccgctgctcctccctggcctctgctgtagatctttggatggtttccaccccgctcccaccccacgtatcctccagccccacactcacatccccttggtgccgaatgtgtcctagcaaagcaatcagtggacgtatttttaaaagaaaactcatttaccacgcaggcctctggagtcgttgatggaatagccctcctctgaatggaaatagtggtgtgatagcctcccaggagttattattgcactgacactgcagcaggctaataaaccccggaggggtgcgacgcgcgctgccaggcagttctcacatctggatgaggagccgcagatgccgcgggggcgcgcctgcagctccccagaacggccaccggagggcacccgcgccccccgagccgcgaggctgcctccaccgagctggagaacaggctcccggggcgggggagggcccctctcagcggactccagacaggggggaaagcagcttgcccgtcctccttccgtgcccctcctgggtttctgaaagcgggtttcaaagcagggttggaaggagcttggatagcacacgccactaactcagaaaaaccttgttaatggttactttgaaagtccatgaaaaatgccttccaaacacatcagaatgggatggcacatgtcatttctcttttggagaagtcagtgagtttagctccaaaaccccaaaggcgttaagagtcgcggctcctccctccgcctgctgctcccaggcacacgctgggcaggctcttctctggctgccccctctgtgccccgggttgctcttgccctgcggcagcgcctggcctgtcggcttcacacccccagtgactgtccagcatctaccaggcagcagggcccagttcatgctgtgggttgagcttgatgctgcttcttcaggggtgggggtgatgcgtgtgtggaagacaccagctgctcctagagatcagacacccaaaccgtcagtcctgctgtctggagcaccattttgaaacagaaactaggaccctcagaaaatattaccatcttgcagaccaatgggcaggtgtcccatccccgtctgagatggtgtcacccctgctcagaggcctgtgaagccccacacattgtagaggtgtttccttaggattgttagagccctggtgcgttctgcaggacacactcttagttagctagttggtttttaaaaatgcatttagttagttttaattttacacgtgcatgccttcagtgaaaacgagagctaccaataaattggatgtttgttaaggaaaatccccgcagcccccgaggaaggaaggaacactctccaaggatgtctccctacccggagctctgctttttacttgtgaggaccgagccccttctcctgggagccagtgcactgcctgtggctcagcatgaggcagcggggagggcccaggaccagagccaggcaggaacacaggtggcccggcagggaaggctgctctggccctgccttgcctccccacccagtattgcccagcccctcagaagctagccatggtaaaaaggcttggctcaggaggggctggaaggactgagaaaggagaagggtcagagccagggcagagtgaatctgtgtctcttctgatcccagcacaggacaaaagctctttagaaaaacaactttcaggggtttaattcaacactatctcagtccctaggccagactcatgagattcatcccctggaattcagtttccccacagatgttgcttttggccccattgccctggaagcactcagtccttcacagatgttctgaggacaggtggaggtgaagtcctttaggaggggctggctgggcctcagcagccttctgagaggacggaaaacggaaggccagcaagggtgccatggatcttgggtcctctctgtcccatctcccctcccataccgcaggcttggactgcactcctcagaaggtggggtcaaagctgttctcacccttcctgctggcagctggcaccccaggccacctcctcccactcttgccacctgccagccttccagagagactcagcaataccagttattactggtcgtatacctattacctgggtagagggattctcatttacacagttggctccctcgtccacatatgatgaaattctatgggataaccctatgctgttgtgttggcaatgacagcagagaggacatgaacctggtggtctcacaggcagagacccatgttgctgaattcatgatgagatctcatgatcactcatgatgagatcagcacgtctctcccctcacacgtctgtccctgagctcacctatttgtggaactgggtagaggagcacaccaagatggcagagaaggcctggaatccagatgagaggagagaaaagtatgacacgcagcgaggcttccctgaacaccttggtgcaactcacacattcacagatatttcattaggaatatgaacaaaactgtcagaattccagaaatcgaggggcaggcattctcccagggggatgcatgtagcaggtagagatgtgaaccccagtaccagaagaggtgggcatgacacacaaacaccccgagatcagatggcagaaacccggcccaagccagcccagcgcacctagtcagttcccggggactgtggagatgctgcacgggctcagcgcgaaccttgctgcacgggctcagcatgggctcacggcagaacccaagcacccaggggactccacgcttacccggaagggaaagcgttctctgccctcagaaacatacaccgtggacgctgccttgtacggaaatacagaacacacttcccatctgcaaggtgtcagagcgcggggcgcggggcctgagtgcgggagaatggctggaagcagtgagaagcagcctggggtccaaggaaggcaggacgtgggtgctaagcgtaggccgtggcccacatccttggggaacaaaatgggaggattcctccttacagtttgggatcatggagcagagccagcctgaggcacacggcgggtgaagacggggctcagaaggaagctgtttgtcctgtccaccccgtcacttccccatcagagcggagagaaatgtcaaggggcgggtggaagtggaagctgccttgatcgaaacccagggaggagaaggggaaatcctcagcgagggcccttggagcgggtggggagcaaggggctttgatcactcagcggggccttgccctttctggaagggtgtgcggtctgggtgggcgagtctcagaccgcagaggatccggcgcctgccccactctggagccggggagccctgggctgtgctctaagcaaagcctgcagcccccggagggcgcaccaggggcccaggccacccccggccctgcacccacagcctacggcccgtccccccgcagtgccagggcggttccttcagtccttgaccttcgcagaacgtagttcagatcctcaggcccagcaagcgcccctctgttggcggccgggggccgcggggagttcgcccctgtgggtctgggcccaaggcgctgcccggatgataaggcagcttcttcggcggccgctccttttccgccccgtgcgcccagggagtccacgtcacgaggagctccgggtccaggctggccgagccgagagccgcggggcgtgggcaggcgtggaccccacaccaccttgctccctcctggccccccgccaaggcgatgtcgtcgcctggactccatccccttgtcttccctgaaagcccccccccgacttcccttccatgtccttcactgttttctctcctccttctcttccatgttgtcttctgctgaatataaaccccacagcgggtaaagatggcaaccccagggcgcagccaccccgcgctcccgctcggccccgccaggtggcgctggcgcgttctttccgcggcgcggggctgagcggagcggggctgggctgggcgcagcggtcccggggctgggagggaggcggcgcatccacacagctccgccaggtgccaggcgtctttcgtgtgtcatgttactcattactcataacacgaacaaaacaagactgctgggcgaggtaaatatcgttagcttttctaaatgaagaagttgaacactatggcatctgatcgagaaaaaagagggagctggaccccctcctggatgggactgcgggcaggcgtgggaactgtcatcaaggcatcccacatggcccctaggtaagcacgagtgaaaagtctcaaagggaagggaggaaaaacagaggaaacgggcagggagtcacaggctgacacttcgcggttctttacaacctcggtctttctcttgtccttccactctagggcttgaaaccttccctccaggattgactctgatgcccctagaccctgcctacaagaggtgccacctcccatgcagacctctgggtgatgctggcacagggctagtccatctcccatgcagatctctgagtgatgctgacacagggctagcctatctcccatgcagatctctgggtgatgctgacacagggctagcctatctcccatgcacatctctgagtgatgctgacacagggctagcctatctcccatgcagatctctgagtgatgctgacacagggctagcctacctcccatgcagatctctgggtgatgctgacacaagcctagaccatctcccaggcagatctctgaataatgctaggtcctttttgaagaaactgagagagaaagagaggggatagagaggagacagaatgagagtagacagaggaaagagagagcgtttccattttggcatctgggccaagaaatgcagccatataaaactgttcttacctaagctttgatgtggcatcagggatgaaagtgccttccctagcttcataaaggatgtcacacaaatgcagagaatcaggcaagaacccaagaaaccaaatcacccaaacctctgtgtgactccttcagggttatagaccctgaaagtaaagtcagaggcaaaaaaggggttaaaaaggagactcgattgcctagtgattccaggaaagaatcaaaggggtgaatgtcactgagcattcagggttagtgtcagatgcttcagccaagaaatcgcacggcaggtcattaaatgaatttagctgggattctgggttttacattgtggttaattaatctatgtaagtatttatagtagtaatggcagagcagggaccatcagccaagacaagtcattagaaggccaagttgggcaggcctgcagatgggtggggagggttgggactgggagtttggccttgcagggaatcactgtgttctgggcatgggggtcagggcagaggtgggctggggaaattcacaaacaatcccagagctcaggagtcaacaccctgggcaggctgactgcgagtggggcagaggctgattcaggggattgctttcctctttcttagttgttctgtctctgtgagggatgaggaaaaaaatctccagctgaaaaatgtcaccttcaacctgacactggagccagaacatttacaaatctgcctgtcaccatgacagcctgacggatagcaaccttagccgggacggagttaaatcgccaggataagtcttgcaaaaagttttggctcttaagatttttatcatcaagacaggttaaggaatggggggcatggcttccaaacacgaaggagactcaggccccgtgcctgacttcccaggaaatccagcagctgcaggattatctattacctgaggggaggtgacaggagaaaattacccagcaccagccccatctgttgctgagcaccgtttatttcaccttcacttaattcacttggtttgtcatttttcctttgtctcagtgtcatccacccaaatcctatgtatatatgccctggtgttcccagctgggcattgtggctgcagagacaaagcctcgggtatcttttcaatgagctgcagtcactatggagtgtctctctcctcccctctccactgtcatttcctccataattgattagaaactggaagcgagagaggagaagctgcttttacagcctgggtctgcaggtggaagcacattcctgtgtttgacttcgtctctggagacctgtctctttcaggaagaggtggaagagtatacatgaagtatagcagacttgtgtcactaggagagagattgcaaaatctgggctctcacactattcttggatgcttggtcacccacctctccccgactttcgttttctcctctgtcacatggatctaacacttgttctcctccctgccaaggttgctgtgaaggctcaatgagacagtatttgcagatgctcactacatcatatagaggcctattcaatgagaacatgcatttaaagcagttaatggtgcctcgcataggagaattgttcaataaggaccattattattagtgagaatgtaagtaatagtgatgacttgttacccttgcagcatctactcttcctctagttctcaagctacagaccattttcattcaacatttattcagtctccacgggcagcactgtattctgtcttagggctatggtgattttttaaaatgcaaacaaaatgccattgctgggtctagaagctgagtctggtgggaaaggcctgtgacagagtgggaagcagggcttaggtctgcacccagctcagagtagggggagttgccggagaagtcctgatggagaaagtgacatccctctgggttctgaagagcttaagccacctgctcggtggcgggaaagggcgtgcaaggctgaagcgggaagtgcagtgaatgagctcaggcaggacagggagctgggcctgggaaccacgggctggcagtacctccgaaggacggctccagagccgagactggacgtgtggacagaggagctctcgctgaaggagcagatttggttttatgccaagaccatgagctttgcggaagggcataaaggcttttaaacaggatcaggtgagcctgatgatcactcaggattgggtggggcgtgaatgcagaggaaagatcagctgacaatgtaggaatctggaactcgcagagaaactgcctgcccttgggactcgctcagcgccctcgcagccggaatggggcctgggaagggaggagccccagcagaggggcagtcggagagccatgaaattgcgacctgctgccaccagagggcagtgttggacgggctgggaggagcgccgccgccgccgggagggtgcaggagagagctgtctgccaggggaaacgcacgatgcgttgtccaggacattctcacctgaaaatgctctgggccacggacaggctgaggattttagtacccacccccccgccctgaaaagaaaaatctctgtgacgagataggcactgggtttgtataagaattcagagtgtggccttagtgtcttggccaggcacccagatgccacctgcacacctctggcttggtgttggttttattgtgcttgtcctaaacctagcagctccccctgagatgatgtcaaagactggactgggctagctcagaaaggtttcctgaacgaatgactttacgcaaaccttcatgccggcacatgttttcatacagattgtctcattgaatttttagagtgatccgatgaggcacatattcaggttttataaatgcaattcagagaagttacatgattttccaggaaatgaggttgtcgggttttgatccaatagctcagactctttcctctgtacccaacaaaccttgtcagtctcctttgtcctttgaagtggggtgtttttctcctccacaagtgtcaaatctgtgaatagagcatgtttaggagcaacttcaccggcatgcccaccttgagaactaggggatggagcagcgggtcggatggagaaccagaaagattgagcatttattgtaacagaggtcttacatggacgtttcccacgtaatccttaaggcaaccccatgggtaggattatcatcccaatattccattgaggaaagaggctcagagaggcaaactttcccaaggaaacacagctagtatatatcagaggtctatgtcccttcactcctgcgctctggactctgatcctgtcccaagagtgacagcagctgcagtatgtgtgccgctcaaaggacagggctggagtgcatgagaaaaactggacgtgtggtgcagaaaggtgcatgtctaattatcattgcaaacaactagcctctcaacagaaagtgttgttgatgtgacagacatgaaagaacccacagccaaagggagccggcccccaggggaaggagggcgaattgtacttgggacaaaaagagctaacagcctcggagagaacaaatgtccttggtagtatggggtgtggggtgatgttgggtgttcattgtcacgtgatgactgtggaaggatgacacagcacaggacgcacccggggaggccagcaggaaggagagttgagtgcaagtccgggaaaacaaggcttgatgatatgcttttgtatgggagtctcaagttgcttgagttaaggttgtctgggagacatgagttacaccagcacccagcaccattacttactaggctccaaagaggaagacatatcaagttgtaggggccttcccttctgcccacaagcctggatcagaccacacaacattgtgtttccattttccatatggattctggactctttccagagagtcattctttctctattagtccttttctttcgtacaccctgtagctaagtgaccctccactgtacctaacctctctgagcctgattctcatgtgataaatgtggatgatactgctctcctaatgtgactgctatgagaagggaaagaattggcataaataatagcaattagctgaggcaatggcccatgttaaagccaaataaatgttggttttatctcttgtttcacctttgtgtctcaaacaggcacacccacgcatgcacacacacacacacacacacacacaaggcaaaccacaacccttgccaataaatctatgctaagtcagagttaacttagaaaatcaacatggtgcagaggcttttaaaggactgacattcctcgggttatggaaaacaataataataaatcttaaggaatgtcaccttgcccctggcactgaagacaagaacccgtttcgttagtggaatagccctgagtatatggagaaaagcgacagagatgatctgttcacagcaaggagagagtggcagtttttagacgaagccggctgggggcacggtggaattgccatgtaattgtcaggctctttgcttattaatttctcagatttcctttcaagataaggacacaaggtaagatggatgtgaatataataagcacagagattacagtcattacaattttagaatgaactggaaaatgtggacacatcagtctgcagccagtcggatgggtctctcagagcctcttggagaccactgagggctgcggcctgtgccataagtgtggggcaattttgaaagccttacttgatctaccgttgcagcttcatccagagtactgtctgattgttttacatattggctgattattttccatgcccaggacctttggtaaccttggaaaattgttggccctccattatctcctcaagtatcacttctcagccctctttctgaagctcctgttaggcatgcgttgggtcttctcactcttaactgctattccatagtccccatttctgtatttctgggtgactttccgggatttatcttccaattcagtaattttattttttctgacaatgtttaaccattccttgagattttgaaattttcctgacttgattttttattttcaaaactctatatactaggaatgtacttttcaatgtcctttaatttatgtatttgattcttacgtatttccacatgaattcctgcatagtccctcttgcgttatttaattacttgccatccacaggagcctaagaaggtgtggtttgtgatttttcctcatgatcagttgttttctcctgtgcttggtaatttggactatgagaacaacttcaggaggaaaacgtgggaactagaactcgtgtgtggcctgggaaagagcatgttcctccaaaaatagttctatatttgcctctgtcaggggctccaggagtgaatccacataggaagtatatatctgaatcccaaattcacctgcagcacagacctgcaattacacattccctgcagagacacagctgcttcatccagagctcaggtcaagacagacaaagttcttattgcccccatgttaatattgggatcttttttctaattcaacttttagaggctctctaaggttccaaccttatggaacattccacaaccttccagagtgaaagtgtcattcagttccttgccttaggttcctgctataccctggccacctagggcacaggaacagaaggtgtaccccccaccctaccccagtgctcacacactcactactctatttcatgactcctttgtgtcctgggtccttggagaattcccttgttctcttgcaatcataatcatcactagcgacatcatcatcatcatgattgacattgactgagcccttgtgctacatgcgtgctctgctctaaccactttccatgaatgcctcatttcacccgcataacaacacgatgaggcagatgctgtaattattcccattttacagatgagggaattgtgatttcctttaaaaaccagacatttcccattggaaaaaaaaagtcctaaagatttagctaataattttataagaggactaggagaaagccaaggaggagaaggataaggagttcacaaaggaaaaggattttccaaggtgtacatggcgagttcgcatcaaagtcagaaccagcgccctccgtccttgctctcagcccagtgccaggcttccttgttaggagtattcttctcatgaaattctactgatttcttacattgtagcccagatatgatttgctgagggatatctgagagaaagcctatgtgtcctttccataaagcgtaccttgactgcttttttcaaatctctctcttgctactgatctttctaacttaccttgatattgggaagtgtggtctttggagccatgaatggagaattagggaattagggaaacatgagaggtggtggaattaattcattgtatcttgattatggtggcgactatgcaggaatatgtgattgtcaaaattcattgacttgttcacctaatgtgtgttcatcttaatgcttgtaaattataccttaacaacgttaactaaagaagtaattaaactcccacattggacaaggagggatctagagcactgaatctgcacagattctctgagctcagtctaggaagagaagtggggctgaactatacagaagatgttgaaattagaaacgtactttccaggaataaattaaaaattgagtttttgtccacctacaataatcaggcactgtgccaggtcctaggactgtaaagaaaactatctctgatataagcttataatctaacagagaagacaaaaagtagaaagcttaaattcagtgagtaagtgctatgatagaggcaggagtgggttgcaaaggagaagcatcaaatacagatgaatggcacaaaaggctttctgtaggacattcatatagagcctgagaaatcaggagaactcctccaggatcactagctgtattagttcattctcatgctgctaataaagacaaacccaagactgggtaacttataaaggaaagaggtttagttgactcacagttcagcagggctggggaggcctcaggcagcttacaatcatggaggaaggggaagcaaacgcgtcctccttcacatgaaggcaggaaagagaagtgccaagcaaaaggggggaaaagtcccttataaaaccatcagatctcatgagaacagcatgaaggtaaccacccccatgattaaattacctcccaccaggtccctcccactacacctggagattataggaactacaattcaagatagatttgggtggggacacagtcaaaccatatcactagccaaagcagcaggtgtgtgtgtgtgtgtgtgtgtgtgtgtgtgtgtgtgtgtgtgtgtgtgtgtgtattcagtatcttgaactagaccactgctcttgaagatctcttgaccatgtagaagccaggataacacatttagctggaagctaattgtgaagctgggaaattatgcatgtatagtgatgttgggcacaaactcatgttatgttcaggtaacaagcagagcattttgggttcctttctttaggagttgtctaattttacttcatttgttatttctgattatattggttaccagccaaaaaattgtctttcttggccagagattcaatgccttattctaaatgtaaggaaaatccttccttttgttgaaacttcagaaactttctaattacctgcctttattcaatacctcaaaatcaattgtatgcctgtcataatgtttgcatcctaacactctcttctcctcattccacactttgtctctaagagatccccctttctcccatagttttagctacctataagttcacaactgttcattctatatctctcgccaagacctgtcttcttagctccacttgacccagttgcttactgggttgttatgatcttctagcttcatgatgacctacttgtttattgggttacaataatggcaaagacttacactgtgcttactgtgtgccaggcacatattaatccatttaatccttacagcaaccctttcaggaaggtgctagtattgtatagcatcctgttggatgccttccaggcacctcatcctcagtgtgtgcagaactgatgtaacccttattcccctgaaacctgcaactcaaccttctgtacttcacattttattgacaccatcttttaaccaggtgctcaaacatgaaacctagaaattgtccttgatcttttccatacgcaaccaataatttaccaccaaaagttttcccttcaacttttcttaggagaagtagcatcatgtagtggctgcaggttttgtctctggagtcagacagcttagatgtgaatcctggttctgccatttaatagctgtgagtccttacagaagtttcttaaagtttctgaaccctagttttcttgtgataattaaacaagttaaagcatgtaatatgtttaggacagtgctcgggaaaaagtaataaaatatttctttgtctttctcagtttccagttggtggacagtataatatactaaaagaacaaaaagcaacaagggttttgctaaagaacaaaacaattggtgacatacagacctgggattatgtcaactttttaccaccacctatatgcatgacttgggcaagttggtgaatccactgagcctggtttctttatctataaaataaagataatgccacctacccacagggccattgccaggaataaatgagaaactgtatgtaaatcgcctagaaccatgcctggcctatgaggacagtatatgttattccttttctcctccaatcactgctcttgaattccctcatctactactaagaaggaaataattggctgccctagaagcaactgggcatggtagatgggcaaaaagaagggagccactcaatgcatttgtcagttttgccaggagctacaggatccagaggcacgggcaaggattctgcctctgccatccctagctctctagctttataaatcatggcttatgtgtttattcttcaccaatgtccaatactcatatttctggaaaagtatattcctcaaccttaccatcctcattacagcaagtagtgggctccttaatgctgagggccttgttatttcttcatttaatggtgtgtccatggggtcctagggcatgagggcctagacaaatgcaaggctgtctctactccatcagatggaaggccaggaaagccaagggaggggtggaaataggggtggaggggtagatgtgtcatggttggaccccagtgcaaaatgaaaatgtaccaccctggttttaaaagtatcaagtatttcatgatggcaatagcagagcattaaaccaaacatgggcccttctgagcttgaggccctatgcaactgtgtgtgtcacacaaccatggctcctgtccttggtgggaaagacgtggctccctttcccacagtttcctgctgccttctctcagatgctcacaaatagcccaaaccgccctcagacatggctttgtcttctttcctctctactcaacttggacattgggagactaccttacaaagcagagttcctgacccacatcttccatctcactttcaccagggatcggcccacacttggaactcctgatctatcagggtctgcttttccaatgagctttactccttctctctaaaaagaaaaaaaagtacggtagtgatgaagtgccgattcttaaaagtcaacatatagtgagtgctagtttaattccacataaactgcttttagcataaattcctatttcatctttaaaatgatctcatcatcacaacagtagctactgtaataactccatcttacagataacatacagatttggagagacccagcatcttgtccaaggtcacacaacgagcaggtggtggtattgggtttagaactcactctccactctggactcctgagtgagggaagagtgcccagagcatggagaggtgcatcatgggatgaaacagagagcagcagcaccagacaaacaggaagaaatgaaccatctctctaataggaagattaaatactattgagataccatgctttcccaagtgactattgttttaaggcaattttaaacaaaatagtgataattttgtttggttttgttggaatggctttctgagagaataatgttgatttttagctacaggcaagaaaactgtaaaattgaaaaataatacaggataggacgaatagccccgactattttgaaacatttcacaaagctgcaataatataaacggtgagttttaggcataagagttgatagactgatgtgtataacagaatagattgccctgaaacactcttatacaatataggatttttttgtatgaatatgacaatctgagaaatcagttaggggagaagaggatagtcataattgttgtagcaatcactgattaactattagtgaaaaatctacatagatcccaactcttggattatagagaagaaagtaaaaaagcaaagccattaacattagaagtattgagttagataggaggaataagttctggtgttccatttcacaacacagctgagtatacttcataattatgtgttgtatatttcaaaatagccaaaagacagtatgtaaaatactctcttcacaaagagatgataaacattttaggcgattgatatgttaattactttgatttgatcactccagaatatatacatgtgtcataataccaccactttgtatcccataaatatatacagtgattgtttttcaattaaatgtttttaaaaatgtagaagtaaatacaaataaatatacatcaggattttggaaggagaaagtctgtgtacgcccaaagcaatgacataaataatggatgaaagactgatgaatttggctgcattaagatcaaatctctctgaatgtcaaacatcataaaatttaaaaacagttatgtcaaccagatggcagaacaggaaatcccagctcttgtctcctcacagaaacactgcttggaacaatgcacacacaaaaacactttcacaggagccaaagaatccagatgagaggccacagcaccttggtggagcacagaaataagaaaagctgcattgaagagagtaagaaggagtttcacattactgatgtcaccaccacccaaacgtcactcagcctagtgtgaagaaagatagccttgcatgaggggaagagagcgaagtgagtagcatacgttgctgcagacccaacaccaggacagctccagtggaccccaattccaggcctatagccccagtttccaggcctgcctcgatggccccgggccccagacccacttccataccaagccagcccccacagctccagcctctagggttgcatccacagaaccaggctttagacccacttcagcacccgatcagcactagtgactccagactccaggttggctcatgtggttccaggctctaggccagcccttacaacccccctggttccaagctggtctatattgacttaggatccctgaggactcaaagcctaggataactcaatcaccaggctggttcccacagaacctggctctaggttcatctccatagacccagtctccaggcccataccaggggaccccagtgccaggccagctcctgtggattcagaatggagtcccacacctgtggatgcaagcccgaggctcatccatggggaccaaggctctagtcttgccctcacagatccaggcactgggctggctcctgtagacccaagttccaggctcattcatccactgacccagacacagccccctccagcatgaggacttcaatagcaagcctcactatggacctcattagatggccccacccaaaatctctgtagaagctgactggtgaaggactttacataacaaggcaataagtaaaaactggaaaagatgcctaatttttaaaatgcagacaccagtgcaaagccacaaggatcacaaataatcaggagaatatgacatgaccaaaggaacaaaatgaaacactagtaactgaccccatagaaatggagatctacaaacttcctgacaaagcatttaaaataataatcttaaagaagtgcagtgagctacaaagagcataaaaagataactaaaaatcaggaaaataacgcatgaacaaaataataagttcaacaaaaagaaaccattttaaaaaacagaaatccggagatgaagaacatactgactgaactgaaaagttccatagagaacttcaacaacagatttgataaagcagaaaggagaatcagtgagctcaaagacaggtcatttgaaattacccaggcagaagaataaagagaaaaaaagattgagaaacagtgacaaaaccctctaggacttacaggacacaatcaaggaaccaatatacacattataggagtttaagaaggatcagacaaagagaatggggcagcaaggtcatttaaagacataatgacaaaaaacttccaacatctggagagggaaatgaacatccaaatccatgattccaaaacaaccccaaataggttaaacagaaagagattgtcatgaggcacattatagttaaatttgaaaaaatcaaaaacctagaaaatttcagaagcagtaagagaaaagtgacttgtattcaagggaaacttccctgtaggactatcagcagatttctcagcagaaatcttgcaggtaaggagagaggggatgatatattcaaagtgctaaaaggaaaaacactgtcaagcaagaatacttcactcggcaaagctatcctatacaaatgtaaaagactaaagacttacccagacaaatgaaagctgagggcactcaacaccactagatttgcctttcaagaaatgctcaaataagttcttcaagttgaaatgaaaggagactaacaatataaatgaataaaactcattataaaggtaagattcagaatactacaatgctgtaatgatggtgtataaattacctctaattctgctatagaagttaaaagataaaatcattaaaaataaccatagctacaataatttgttaataaatacacaatataaaaaagacataaattgtcacatcaataacatataatgtgggaagaagagaagttaaagtgtagaatttatgtatgcagtttaagttaggttgttttcagattaaaataggtttataactataagatattttatagaagcctcatgataaccacaaagaaaaaacctgtgtgagatacacgaaagagaaagtaattaaagcatactattactacaaaaaaatcaaatcacagaggaagacagaaagagaggaagaaaggagaacaatgcagtcagaaaacaattaacaaaatagccagaacaagtccttatctatcaataattactttaaatgtaaatggattaaaatctcgaatcaaaagccatataatgactgaacaaattataaaagaagatccaactgcatgctacctttaagagactcatattagctttaaggacagatgtaggcagagagtgaaggaatagaagaagataatacatgcagatggtagccaaacaagaataggagtggctatacttatactggaaaaaatagactttaagtcaaaaattgtcagaagagaccaaaaaaggccattataaaatgaaaaagggatcaattcatgaagaggatataacaattttaaatatggatgtacccagtattggagcacctagatacataaacattaacaaaacaaaaaggagaaatagacagcaatgccgtaatagtaagggactcaaatacctcatttacaataatgtatagcttactcagacagaaaaatcaataaggaaacaatggatttgagcagcataatagattaaagggatcctaacctaaaaaacataaagaacattccatccaacagcagcaaaatacatactattttcaagtgcacatataacattctccaggattgatcatatactaggccttcaatcaagtcttaaacaacttaagatttaaattttatcaagttcttttataaccataatggtatgaaactagcaatcaataacaggaggaaaatgggaaaatttacaaatatgtagaaattaaacaacccatttctgaacaattaatgtgtcaaggaagaaataaaagggaaaattttttaaaatcttaaaacaaacaaacatgaaaacataacataccaaaacacatagcatgcagcaagagtaatcttttttatattactttatttttaactgacataataattatatacatttatgaggtacaatgtgatgttgtgatatatgtacacattgtgagatgattgaatcaagctaattaacatattttaacctcactacttatcatttctttgtgatgataacttttaaattttactttttaataacttcaaaatatacattattattaactatagtcaccatgctatgtaatagatcactaaaacataattcttctgtgtaaatgaaatattcttcctgttgaactaaaactttgaatactttggccagcatctccccttaccccatcaccccacccctgagtccctcaaaactactattctactctttacaagttcaactttttaagattccacatgcagtaagatcatgcagtatttgtctttctttgcctggcttatttaacttagcataatgtccttcaggttcattcatattgttacgaatgaagaatttcccctttttaaaggctgaatagtatttcattgtgtgcatatgtcacattttctttattcattcatccattgatggacacttagttgcttctgtatcttgattactatgaataattctgcaaagaacatgagattgcaggtatctcttcaatataccaatgtcaattcctgtggatatattcccagaagtggaattggtggatcatattgtaattttatttttagttttgaaagggacctcaatattgttttttataatggttatactaattaacattcccactgacagtgttcaagtgttctcttttctacacattctttccagcactgtttatcttttattttttaataagtcattctaacaggtctgagcatttgcttttgacaaaattcaatatctcttcattagaaaaacctctcaataaattaggtacagaaagaatgtacttcaacataataaaggtgacaagtccatagctaacatcatactcaatggtgaaaagctgaaaacttttcctctaaggtcgtgaataagacaggatgcccactgccaccacttctactcaatgtaggactgaaagttttagacagagcaattaggcaagaaaaataaataaaaagcatccaaattgaaaaagaagtaaaattgcctctctttgtattgaagggatcttacacagaggaaactctaaagactgactctaccaaaaaagctggtaagactaatatttgaattcactgaagttacaggccacaaaatcaacatacaaaaattagtgagaactaacagtaagctatctgaaaaataaatgaattaagaaaacaatcaatgtgggtaaatattttaagcaatataacaaaccgttaatacccttatatataaagaacttcctaataagaaaaaacatgaattcttcaatagtaaaataaactgaaaatatgaagagctagttaaaatacatgaatgttcaagaaacataacaaacttctaatcactttttatcaaataatttaaattaatataaaatttagatgggcctctgtttgtctcatgaattggtcaaggttagaaaaatattgacttcattttggcagtaagtattcctaaacattaacattagagatgtaagacaaaaagcaatttggctgcatgaaacaaatatatgaaaatacacctgtgttcccattaataggattatttcctagggtgattaaaaaataactgagaaaaatatttttgtaaaagactttattgtagtgttttaggaaatagaaaaatagtggaagcaacctaaatacccaagggaatgattacacacagtcaatataatacaaatcatgaaataacagaaatttatacatttcatttattcatgaaaaatatattgagggccttctatatgtttttatgggcataaatcctgaaataccaatgaaccaaacaacaaaagcctttgctcttcagaaacttacatttttgctgggagaaaatgggtaagaagcataacgtaaacccccaattttagcaaatgttgaaagatgataaatgctaagaagaaaactatgtctgggtaggtgatggggcagatcagggaatgaggaggtggggttgcaattttaaagtgaattgtaacggtcctcacttggaaggtgtcctttgaacaaatgcgtgaaagccacaatggagcaagttctgtggggagagaagaaaacattctatacagggaaaaaaaggtgcaaagttctctttgcagatatgagcattgctggtgtgttcaagaacaggaaggaggtcaatgtggctggtacagagtgagcggcagggaaggacaggataataagagtaaggtggggaggaggggaagagaggtaactacctaagtgtggggttgtgggggccattctagaaacttctgcttttactctaggtaaaaggaaatctattggcagcttctgagcagaagaatgacacgaaataactcatgttttaaacagatccctgtggttgcactggtgtttttaggctccagggggcaagagtggaagcaggcagacttgttgggaggctattttgcaataatgcaagaaataaatgacagtggaagcagtagaggtgacaagacaggattagtttgaatgcaaaggcaacaagatttcctgatggattggttgtcagatgtaaaaataaggtaggagtcaagattaacctaaaagtttttggccttggcacttgaaaggatggagttggataacagagatgaggataaccttggttagggaagaccagcagtcatttctggacatgttaacttcaagatgtctgctagccttgttgactagacagttgcagcttagggcaggtgtcttgcacaggattgacccacttgagagttatcagtatataaacagtgtttaaagccataaaccttgaataagatcctaaaatggagcgaatatagatacaaaagagagttcgcccaaggtgtgagccttaggcactccagcactgacaggaaggagggaagaagaggaatctgcaaagaggtcaagaggaaagagtcctcgtgatggaaggaaaaaataagacaaaacaggagagtgtgctatcctggaagctgaaggaagagagtgtactgtaaagaggaaatgcttagcagtgcagaatgctgctactaagtccgtgtgttgactgagaacacacactggattagcaatgcagaggtcattttgaccttgacaagaacaatgtgagtgcactggtggggtcaaagagggggtggagcagaaagccatgagagacagaaaggctgaacaaacccattcactggtgccagataccagattctttcaccaactcaggacaactctcaactctttctatggcctctatcttctgctttccctagatcactcttgtcagcgtacaaatattctacaatttctcttatctatttttcaaaactacttaatgacatggaaaaatacccatgatatcttgttgtatgcagtgcataacaccaagaatatttaaggtgatgcctccgtccccaccaacaaaagcctcaccaagcgggtccatgttccccatggctgaagagagtaggggcagggaggaaagagttgctctcccagagtcttctctggctctagtgtttctccagctctgtactgaaatcttattattggtttcgattcaggtagttattttatttctgtcatgatatctactcaaacatgagagtcagtcccttgcctttaattcactaatggagtggttttcaaagtgtaatacccaaaccagcaccattaacagcaactgagaagttgtaaaaaaaatgcagactctctggttccacccaagactcagtgaatcagaaactcttgggttgggacacagagtctgcggtttgcaagcctttggagtcattctgattcactactccaaaccctccacaaatccaaagctgtgctaggtaggaaatgttttcatagaggcatttgtgggttacctagaaggatcacacctcatgccaccctgcaaacaaataaaacataatggatggacattcctccttgtagaaatgccttttccctgcccctgtccccaccaaggagtatttctggctactgcactggtttgcttctctccaaggcctcctttttacccccttcttctctctccttattctctcaaaaaaccctagaagaaaacctaggcattaccattcaggacataggcatgggcaaggacttcatgtctaaaacaccaaaagcaatggcaataaaagacaaaattgacaaatgggatctaattaaactaaagcgcttctgcaccgcaaaagaaactaccatcagagtgaacaggcaacctacaaaatcggagaaaatttttgcaacctactcatctgacaaagggctaatatccagaatctacaatgaacccaaacaaatttacaagaaaaaaacaaacaaccccatcaaaaagtgggcgaagtacatgaacagacacttctcaaaagaagacatttatgcagccaaaaaacacatgaaaaaatgctcaccatcactggctatcagagaaatgcaaatcaaaaccacaatgagatacaatctcacaccagttagaatggcaatcattaaaaagtcaggaaacaacaggtgctggagaggatgtggagaaataggaacacttttacactgttggtgggatcgtaaactaattcaaccattgtggaagtcagtgtggcgattcctcagggatctagaactagaaataccatttgacccagccatcccattactgggtatatacccaaaggactataaatcatgctgctataaagacacatgcacacatatgtttattgcggcactattcacaatagcaaagacttggaaccaacccaaatgtccaacaatgatagactggattaagaaaatgtggcacatatccaccatggaatactatgcagccataaaaaatgacgagttcatgtcctttgtagggacatggatgaaattggaaatcatcattctcagtaaactatcgcaaggacaaaaaaaccaaacaccgcatgttctcactcataggtgggaattgaacaatgagaacacatggacacaggaaggggaacatcacactctggggactgtggtggggtggggggaggggggagggatagcattaggaggtatacctaatgctaaatgacgagttaacgggtgcagcacaccagcatggcacatgtatacatatgtaactaacctgcacattgtgcacatgtaccctaaaacttaaagtataataataataaaataaaaaataaaaaaataaaaattaaaaaattaaaaaaaaaaacaaaaaaaaaccccaaaacaaacaaaaagaagaaggaatgtttccaattgtctttggaagagcaatttagttgcacataacctttgttgtcttttctctttacaatgcttgtaccctcaagaacagcctccaaatacggaaaaacagttgttaagaggaggagtgctgctgttagctgtaagaactaccttctcggaaacttctgtgtatatatttatagatctaaatatctgtatgtgtatacatacactagagataaatagtaatcatcatatgtatacacatatgtattaataaaatgaaatgtgagcagttacccataactagtgggataatagatggcttaggttttcttccccttctcttcctacttctttgcattttcaaaatttcctgcagtagatacattttactcatagagacaagtgatttttttttttttaagacaggatctcactctgtcactcaggctggagtgccttggcacgatctcagctcaagtgatcctcccacctcagcctcccaagtagctgggactacagatgcatgccaccacaccagcctaatttttgtattttttgtagagacggggtttttccatgttgcccagtacgtctcaaactcctgagttcaaacaatccacccacctcaggctcccaaattcctgggagccatggtgcccggccaagacaagtgaaaaccaaggaagaaagaaaggaagaaagcaggaagggaagaaaagaatgaaaaagaaggaaggaagaagtagagaaaagaaaagagcagcaagctagtagcagagagggagccccggttggtcaggggtggaggttgcaggcctgctcatggtggtgtgtatgtctccagtattgtgtctcaccctctgctgctgccaggtgtctccatagaacaacataaggctaggaatttagtctctcattgtaggaaaaacaaggatgtcatgctatacaccgggtgtgtaatgataaagaaatgcaaatgtttagagcaacaaaacggaaacatggttaagtacatgttctaaatataaacgacacaatgccgtaatacaagtaaaagaaagggaaggaaaacataacaatctggtgaggtacaaaagggtcttgttgtcccttagctgtgataaagttctctctccaaccatttcctttttgtcttcttcctagctacatggtccagcctagtctgtctcaatttatcctcagctattaaatgatgttaagtgtctcattaacacttcttgccaccaggagcaattgtgtcctaagcgattttcttaacttctctgggcccaattcattcttttctatttctttggagaactagtatctgaaaaacctttcctctcttcctttcagtatgttttcctttcctgtttatctccacaaagtatatgtttatactacaagtaggcaatcatatcatttttcctctgtatttctaagtcttactcaggccagcttctcttatttcagagtcaagttcagtatgctgtgttgttagcgtggcaaatctggacaggtctgcagcaacctcaatttttgcctcctcagaagaaagacttagactgaggggcataaggcaggagagaccgatgcaagttttacagcaggagtgaaagtttattaaaaagttttagagcaggaatgaaaggaagtaaagtacatttggaagagggccaagcgggtgacttgagagattttagtgcacagcttgacctttgacttggactttgttacgttggcattccgcacgggcagtggcctgccagctcctgggaggggctgcgtgtgcagtctttactgaagttttgcacatgctcacttgaggctttcttcccttactggtcgagtatttctagaggaagatcatgtaccagttaaactctgccattttgcctcatagggcacatgcttaagcccactcacccaactcctgatatcgtacctggaagctgctgatcaccagcttcagatttttatttatttatttatttattttaagacagagtctcactctgtcactcaggctagagtacagtggcgtgatcttggctcactgcaacctccacctccagggttcaagcgattctctgactttagcctcccaagtagctgggacttcaggcatgcactaccatgcctggctaatttttttgtatttttagtagagaaggagtttcaccatgttggccaggctcgtcttgaactcctgacttcaggtgatacacccaccttggcctcccaaattgttgggattacagatgtgagccaccacaaccagccaagattttttctatctattgggagactcccattccctggcgctggctgaaaccaatgatcattttagagaaacagtgtaacaactacttggccatctcctgatggtcacctgacattcctgccgtagggagtccttttctaccttgctcatgtctgactaactacttactgtaacagtgtcataggctaaacacatgccactatttggagtagcacagtgtaagtcatgtgtcccatctcttcatgtacagttgtcctctattccactctcgccagcctttaccgagtgtcatccatgcggcatttgacaccaccttcctcccattctacagaggcatgcccagtgtccacagcctttgcagtttcccgtggctaagaaacaaggcattatatggtttgagtggtgctattttacctggcaaatgctcactgacatttattgaaattgatgccttagttttacaagccaaagtggtcatacagtcacacttgcttaattaatgcttcctaataaagaagcaaaatctgtttgtgcctgaaattgtgcttggtgctccaggaatagtcaccataacaaacactaggaccttgtgatacaaaaccagaaaagggtgagtattagatgtggttattagatgggggccaggccacctcagatatggtggcttaaacaagatggaattctgttcccttctcacctgacagttcagattatacaagagaaagaggcagtgcataaatagaaggagctacagaattactattcctatttatagcaagattgaaccagataaatcataagtttcttgtgtaatgagtccagcaatacttcccaaaggcaagtcaatttgcagaggttggtgaaacctggatcagaggtgagaacgggacaaataagaggaagaattttgtttagcattttagactatttcatctgccaatcactgtttgccatttttatgtatatgtttaacagctttattgaggtataactgatatataataaagaacaaatatttaaagtgtgcaatttgataagttttgacatttcgtgcacatttgtgcaatcatcacaatgatcatagtgaacgtatccatcaatccaaaagtttcctcatttctttttgtaatctgttcctcctgtcagcctcctttcctcctccttctatcccctcccccagcttcaggaaatcactgatctcccttctgtcaccatagattcatttgcattttctagaatttcatatatttggaatcacacaatatgtactcacttttgtctggcttccttcactcagtataattatttagagattgatccatgttgttgcatgtattagtagttcatttttattgctgaaaagtattccacagtatgcatatatcatgtgtttatgcattcaatgattggtgtacatttaggttgtttccagtttttcattagttaaaataaagctcctatgagcattcataaaccagtctttgcatggtgtcttagtcctttcaagctgctgtaacaaaacattattaacagagcagcttgtaaacaacagaagttgttctcacagttccaaagttcaagaagtccaagatcaagacaccagccaattcacttacggtgaggacccactttctggtttatggatggcactttctagctatgtctttacatggtggaaggggacgaacaagttcgcctgggccttttttataagagcactaatcccattcatgagagctctgccctcatgacctacctaattacctcccaaaagaccctaccttctaataccatcaccttgagagttagaattcctttcaacatgaattttggagggacacaaatattcagaccatagcctaaggtcatatggttttacttcttttgagttactacctaggagtggaatagctgaatcatatcgtaggtgtatatttagcttttaagaaattccctgttttccaaaatggttgtaccatttttcattcccaccagcagtatatgacagtttaatttcttccgtatcatttccaactttggaattttcatcacagcaattctaattctgatagtgttatctcactgtggttttaatttgcatttccctgatgactgataatattcagcacctctttgtctgcttactttccaaccatgtgtcttttttggtgaagtgcctgttcaaatattttcattgcttttcttttctccattgacttgctgtatcatctttatcaaaaatcagttatctttgtcagtatggatgcatttctgaactctgttttatttcactggcctatttttcagtatttatgctaatacgatactgttgattactaaagctttttgttgttgttgttgttgtttgaaatggagtctcattatgtcacctagtctgcagtgcagtggcacaatcatagctctctgcagcctttacctcttgggcttaagcaatcctcctgcctcagcctcctaagtagttgggactacaggcacataccactacacccagctaatttaaaattgttttctagagatgaggttttcttatgtttcccaggagtttcttgaactcctgggttcaagcaatcctcctgtctcaccctcccaaagtgctgggactacaagcgtgagccacctcaatcagcctttaaaccaagtcttcaaatcagatagtggtaggcctccaacattttctttttcaaaattgttttgactattctgtatcttttgcacttccatatagatttttaaattagcttgccaatttctactaaaaaatttcctggttttggattgaaattgtattgaatttatacattaatatggagaaaatgacattttaacaatattgagtctcatgactgattagtttagtatatgtctctatttatataggtctttaatttctttcactgcaattttgtagccttcaacgtacagatcttggatatcccttgtcaaatttacctctaagtatttaaatttttaatgacccttttgaatgacattttaaacatttcaatttcacgttgctcattactagtgtatagaaatacaactgatttttgcatagaatttcttgtcttgtaacaatgctactcttgtttgttctagtagtttttattgatttcatcagatattctatatggcaatcaagtaatctgcaaatgacagttttacttcttcctttccagcatgaatgccttttatttcttcttcttgcgttattgtattagctagattctccagtacaatgttgaatagaactcatgtgaatggagattcttgtcttgttcctgatttcacagggaaagctttcagtcttttatctttagatatgctgatagctgtaggttttctatacatgctctttatcagtttgagaaagttctcttaatttgctgagaggtttataaaaattaggaacagatgttacagtttgtcaaatgctttcgtctttattaagataatcatatgtttttcttattttagtttgttaatatgatgaagtacattggttgattatttttaatgttaaactagccttgtattcctgggatagattacatggccctgatgtatactttttatagatttttgaattcaatttactaacagtatgttttttagaatttttgcatatctatttatggaaaataatggtctgtagttttagtttttcataatgtctttttccagttttgtttttaaggtaatgctgaccttatagaatgaattgggaattattccttcctcttcaattttcttgaaagagtttatatatagctgatatgatttcttccttcactgtttggtagcatttaccagtgaagccagctgagcttacaagtgcctttgtggaaggacttttttctacaaattcaatgtgttttggctcttgctcttaatatctatttggtgagatcagaacaatgtttactgtctggccccatcactgacacaagatactcatgcgtacccaattcaatgcctcatgaattattgggttaatcaagttttccattctgtctggtaggaacaggcaagcatccctggccccgtgtgagtgctgggcactgttccttccaatcttctgggaaggttctttgcccggcctttgggaagttttattgcacacatgccctgatcagtcctctgctggatgctcaagggaaccctctgcagatctcaggagttctctgtgcagatttctcctcccctggtattctattctgagcactctaatgttcttgatcttccagggctttcagttgctcaactctgggagtcctctagcctccacctgattacctctccctgcaccactcctggaaatgctctccaggaagtcagctgggatgaatgctgtgctcctctcgttttccatctctcaggagtaattatatttcattgcctggtatcagtgtcttgaaaaccactgcttctagtgtttttgttttcagattgggtatccctttgtccactgcttatagcagcctcagcctcccaggttcaggtcatcttcccagctcagcctcctgagtagctggaactacaggcacgtgccaccacacccggctaatttttgtatttttagtagagatgaggttttgccatgtcactcaggctggtttcaagctcctggactccagctatctgcccgtcccaccctcctgaagtgctgggattacagacgtaagcccgcgcccagtgcttccagtgttttgtctctcttgttgttcctaatcttgttgttgtttccagtgggaaggtaatcaggtcccttttactccctcttggtcagaaacagaagtccaccctttgttcttgaatatataagaaattgtgcataaatcctccttgagagacaactgtttctcttggtcacctccataatgtcagagagaacattcaaagagaggggtgaagatagcgcttctaaaaaatgcatagctgtgagagctggaataaaatgtgcaagggtcatgaggaggtgcttgtaacaaaagcaggagaccccatagccttgcaggcttactgtggtagagggagcaatgcctcaggaaggccaagtcagagaaatattgactttctggatggtcctctgggtgttgtaggaacttgacaacaagctgtttcatgcctgtgattccaagctaaatgtgctacatatttgctaagtgtggaggcatttatgaaggccaaggggaccccacttattttaagcgtcctgttgtgctccatcagtggtaatgggggttgagcagccaaatcatcatgcattacctccgctgggaaattcactctccaggatctaagtggaaaagtaacaacagtttcaactttaggcgaaactcacaagggtgcaagttggagataattggaaattactttggtctgactgtgcccagatggtggacttcctttgttgcaaggtgtcattctcacactgatgtttatgctcactacgtgtgtatttttgctgtaagctgccttaagatcctttgtgggagggaatataggcccaccaccctacaggttccggggttgcttcctcagagcaaagaaaccatgatccaaaaaaggagatggtcaaaacaggctacagatactactgttttgcttgatacctcttttacaaagcaattgaaaagttaataattgtacacatacattgtgccaggtagtgtgctaggtgcttgacataaggtactgcatttaactctcataacaagcatatatgataaaatggtctcaaatttatgagaagcaaatgaagactcagaaaagccatatgccttgatagatacagtgtgtttacgttcgaatcccaggatttgtgattatgctgcctagagaatctttacctttggacagggctataattagtgtattctgtgaggttgccctggaaaacagaaagctcttgggctttggaatgcaacacacatagtttagaagactggttcaacctggaaaagtcatccatttttccattcaacagatacatattgtaggtgatgaaagaggcaggagaatagatcagatgagattcttactccaataaaactgcagcctagtaatggtggcaatgttgagattcaaaaccaactttgcccagcacctagacttgaactctttctatgacatcattctgccttcctgataaaatttagcattatactgacttccattaggctaatggactattttggctccagaggcagcgtgttatagtggttacaacttccaactgtgaaacaggctgcataagttctcattccgtctctaccacttactatctgtaagatcttgggtaaattacctagcctctctctgcctcaagtgtttcattgatcaaataaaggtaatgataaggacttaccaggtaggggttttctgagggctaaatgactagagaacttagatgaatgtttgatccatcataaatactaaattattattattatcatccttgccttccttgcttatacctagaaataccttcttatctagagttaatggggattgttttactttcctatgaaaaactattgcacattaaatcaatgattttagaactagaaagagcaatagaaaaacatatttttaaatacttaatattatctctacaaaaaaaaaaaatctcctgacaaattaggataagtgaccccgggaaaccagagtaactcagctaattagtagcagtgttattactggaacccaggagactgcaagatttctctttcctttatgttacaatgctacccttattccgctcagattttatcttagcacaattgctttggtgtcaagaagatatgggataaattcctggttcctctagcttctggctggaaggcctgtgcaagttaccaaaccattcagagtctcagttttttcatctgtagcatggggataagagtgcctccttcattaggtttttgtgatcataaaatgagataatgcttatactagattaagcacagtggctgacatcctaagagctttgtaaatattaaatatgcatggtgactgacagcactggctttggagtcaaatatgagtagatttgagctccacgtccatctaccagacttgtgtgaatttggtcaagttacttaacttccctaatcctcaccttcatctcatgatctgtacattaaggattgtattgccaatatcttagggtttctgtgaggattagatgaaataatgcgggccaggagcagtggctcacacctgtaatcccagcactttcggaggtcaaggtgggaggatcgtctgaggtcgggagtttgagaccagcctgaccaacatggagaaaccccatctctactaaaaatgcaaaaaaattagctaggcgtggtcgtgggcgcctgtaatttcagctacttgagagactgaggcaggagaattacttgaacccaggaggtggagattgcagtgagccgagatcgtgccattgcactccagccaggacaagagtgaaactctgtctcaaaaaaaaaaaaaaaaaaaaaaaaaagagagaaagaaagaaaataatgcttgtaaagcaacaaacacaatgcttggcataaagaaaataatgcttgtaaagcaacaaacacaatgcttggcatacagtcagtatccaacaaataataacacatgcaaatatcattataattactgtcattattattcttttattcatctggtctctatcaaaaccactgtgtgattaaataatgttctcaaaggttccggacctgtaaaccatctcactacacttagataggggactattctgcatctctagtcagccattttcccccagaccataatcagtaagagtgaactatttggcttgcaaaatggcagccttcctgttgcctgacggccaaaaggcaacttttggtgagactgctttcatatgaactcgtaaccatagaaccagtttgtcagggaattcttcaagcacataaatgattgaacacttactttaattcagaaacatgcagaactcaagatctttgctaatctctacggagggtgaaggaggaagatgaagtttaatccactgatgagagtaagtacgctgttagggcttcattttctgctttctgatagatcctgttgatggagaggaccacagtgacaatcacagtggaacacttggctcatccggagtagctttaacacacttggtgtgagctgcagggccactagagaagtgacagccacagacactgtctcccatgatgattagctggcctggaacaccagctcttccttatctattgttggtatggcacaagtacaaaatatataatatgtatctttgatctctaactttcccaatgagaacagagtgacccagaaacattgtgtgaaatatctaaagtctcatacttggttcatggagaggagggaccagattccaacttctgggctgcaattgatattattactttcttatgatttccacagttactgcttttgttattatttcttgctttttcagatgagttagtactctgcacagacgggttaaatggtgtgccatccagggccacatagccagttgatggctgatctgagacagatccagttcttctgatcctcattttgccgttctttccactacacaatggcaatacaaaaatcctccttctggagtctagccgttgaaagttatgaagcattatctctgccgttcacatcatccagtggtgttttaagcttgtttgccatggcaaccatcaacatattaagcccttcaaagcagggttggaaaggcaactgcagcccgctattgttcctgatgatggatgggagagtgtagagccaaggatcagttactacagatcctcttccgctcaagcgatgtagattacgcagcagctggaccagaattcagtcttctccatggaggtttcctatatggtatgtgcagcatggagggtttatgttaaacacgtagcaaataaaaacagaaataaagatggtaaaaggtcactcctttgtccttccctccctcccttccttatttccttccttcctttttctttccttccatccatctttctttccttcatttatttctatgcaaaggatagcagagtcctaaattccatgttaagaatatgtcagtgaagcagataaacttgggccatcatctcccaagcatctaagaaaacagacactaaacttgatgggaaatataactagatagtttgcttcttgtgtctttcctttttcatcttgtttgccctcccctaatatattcaacaaagaagtgtgcatgtgcgtgtgcatttctgtgtgtatctgtttgtgtgtgtgtgcatgtgtgtgtgtgtgcatgagaaagagagacagacaagaggagagagaaaaagaaagggaaagagagatttgtaaagatattgcgtctatctgctaagaaggcctagaggccaatgtaatttctttgaaccgaataaagaattcatggtcatgtgaagtttcaaaataatttcccagtttaccgttccttttcaggcagtgcatctttttaaaaagaggttattcagaacaagtcagaggagggagggacaacacttttcaaaaaccagggctgtaattagtgctaagcagacacacgtgctagaagggagtgctcaggtacctgggccacggctttgttctcctgtccagatgctgagccagctgcagggtggccagggcgcctgcacccctcaccttctctgcttgtctgatacgtagctggaggcttctctctttgtctgcccatctggctcctggcaccaggaagtaaaattattattattttttccaaatgaaaggctttgaatcacagctgttaattaccagatgattattaaaaacacatattgcctactgaggtttgagaagacaactcaagcgtgctgtctggccctactctcaggggctctcagcctcaagtcatgtacacatttctttaaagaacacaatgtggttttattatacccgcagacaaatgcaaataagaacggaagtgaggagagcccagaaccctgttgaaagttaataaagacttttcccgctgcacctcacaccccagaatctcaagtagtttatcgtagcccactacaggtcttggattacctccatttcaaaacccgcagcccctccgatggtgctaaggcctgtgccccagtgatgcctgagaaaagaaaggaacgacaaggcccggcagaagggcactcataaattatagacctcagctgtcatgctggggtgctggatctcgggtgaaggacagatggaggctgcctgagcaggcacagcctggggtggggagagcagccagtgagaggtggattctttgcatgtcaggggaaatgactggaaattatggctgggcaaggaaaaggcagcaggcttggagcttggactgtgtgttggagtcaggggagtgaggggctccggatgttcaggagccatggggtaggtttactgtctgggaactcaggtccagggacaacaagttcaggcctatgatcaaggagtatcttgttcttcctgaattctcatcgtgatgcaaggcactgtggggaaaaaagacgtcaaagatgggggatgcctgttcatggggtttacaatctgttggcaatgaaggccatgatggatgcagtacttcaccaacaagggaggacagaaaccttagtgctaaacttacacattcaacaaatatttattggatactcatcacggcatgtgtgaagtactatattaatgaacaaaatagaaaaatataaaataaaatctttgctctttttgggcttatattctagcacagtgagacaggcaatatacaatttgaggaagtaaaataggcctgatatagacaaataaattctatggagagaagtcagagaacaggaagggtagccttggtgagggtgagcctgattagaagtaatatgatcagagcaggctccagagaagaaatgacttgaaggaggcgagggaatgagccatgtcgacatctcagatagaggaagcatcccaggcagaggaggcagccccaaaaaggtgttgagttagaaggaaaacttgcaggttccagaaacatcaaggacgtcacagtagctggaggggagtaagaggaagggacagtgagggccactgggtcagagaggaaaacggggaagcaatgcacctatagggccttgaaggctgttacaaatatttagctcttcgttaggagtgagatgggaacacactggatggtgttgagctgaagaaggacagaatctgactctcattctaacaagatgcctctggtttgcgtgatggctctcaaacttcagcgtgaatcagaaccacctggagagcttgtggagcgacagaccactgagtgttgaggcctctcgctagattcagtgggtctagggtaaggcctgggaatgtgcgttactaaccagtctctggggatgattctgctaccagtcttgaggaccacactttaagatttgctctaagagaaacaataggaagcaaagagggataaagcatcctggactccctcccagaggaggtagattggtttgaggccccaaagaaaaggtaggattttgaacaggaaaaaattacatgagaaaagcagactggttgtgtttcttctctcccactctacctgctgctggaaagaatataaagaggtctatacaacatctatttacacagttatctgcctagagctctctctagcgaccctatcttttttgtggcaagttctagcctccctatgcaccttttcaaggtttacctcttcctattaagcttaaaaaaatggtggttgcacaagtcagtgtctgtccttggttctccctgtggtccacttgcttcctctgtctcctggcccctctcacacttggattgctgccatcctctaatggcatctagagacaccagccctttactctactggcaaaataagccctaacccatggctactggaagtgacaggcttttactgaaggcttgttggttctggagagtgatcgcacagcacagaacagaaaatggcttaaaattggctaccaaccatcacagccctaaaatctcctcagccatccatgactctaggaatttccttgttggctcctcttcccaagcctcagtttcctgccttgtaaataggctcattacgtttccaagaacccagtcaccccattgctcttttttgtttgttttgtttttgagacagagtcttgcttggtcatcaaggctggagtgcagtggtgcaatcacagctcattgcagcctaaacctaatgggctcaagtgatccttctgcctcagcctcattagtagctgggaatacaggtgtgcaccaccatgcatggctatttttttccacagagacggggctggtcgtcaacttctgggctcaagcacttctccctccttggcctcccaaagcactgggattacaggcgcaagccacagcacccagcccatgccattgctcttgaagctgattcccctgtcaaccagtcaggctgcagcccctaacccctcttacacagccaagtggagcagctcctctctgttgcctcctaacacttcttcctccagtccatgcctttatgggatttgcattttccaaccccaaacagctaacaacctttgtgtaaggaaaagcagagttctgttaggaagacaaattgtgtggtcctcttggagcatctggcttcaaaagcaacaagtttatatagaaatgctttcttcatccttctaattacacatatgatgtagcataatcaaaagtattttaaatatatcttaaaagtgggggacaaaaggaaatgaaaggagaaaaataaggtgaagccaatacacaaagcaaataccttttcatcccaacagctgctgggacagctacaaatttggctttccctgggttttcaattaaaagggagcctgcttgtgaacttgtgagagccgcttcctgcagcaggaggagtaatgctgattaggtgagttagaggggccagcctaccaatatgccaggaaaggagtttagactaagtaagaaaaaacccatttaaggtttttgttcaaaggcagacagtctatgacaacatctaaggacaatcactctggcaacagtcttcaagacagactgtggaatggagaatatggaaccaggaaagtcagtcccaggctgacactgatgagagaatccagaagaggtctgcattgctctcctttacccattttttaggctaatctgctgtcatacagctcattatgcaaagcccagtttccatgcaaccacctccattgtctttctgactacccaaaatgcaagaaatccctctgtcttctgcatgttttagaacatgatatatagcatgcgttaaatccttattgtataatttttgtaggtgtttattagaaaataagctgcatgagagcagggccagcttgtataccatgttgcctaatgtagagtcgaggtcagagtaataacaacaataatgatagcagcaaacacttactaagaacttacctgctcagccaggatccctctttaggtgttcattagtatagtggaatgtaaagacgtgagtggaaaaaaccaacaagcaagcaaccaattgcacagcagacaccagctgggtggcatccaatccaatttcattctgaccaccatctacctggagatagagtcagatcctacctgttgagggctctcagtcccacaagactgtttccccacttctaatgcccgtggcaagcctatgcatctgaccaacctgctacaaatcaggaattccatgaccttgtccttgggtttgattgttttgctactatggctcacagaactcaatgaaacatttacttgcatttaccagtttattataaagggtattgcaaaggatacaggtgaagcaatgcataggatgaggtacaggggaagaggcatggagataccattccctccctgggtgatccaccctccaggaacatatccagaagctctttgaacctatctttttggatttttgtggaggcttcattacataggcatggctgattaaaacccatttatgccagtgttccattattggaacactaagcatgtgggggttatttatgtcctgctgctcaaggtcatcgccaaggcctgatttttcaaattcgaaaaattgcaacctcaggcataaatgggttaagccattggccaattcgtgatcaacttaaccttgagcccctctgtccttcccagagaaagaggggtagggctgaacgtcccaactctttcatcctgccttggtcttacaggtgacaagtccctatactgaagctacttagggacttccaaccaccagtcaactcattagtgtacaaaaagacaccattttggagattctaaagactttaggagttgtatgtcaggaaacagggttgaagaccaaatatctattttacaatatcacaaatgatatatggtataagataatgcatcatagggttgagatacagtgtgtaatgataagaaagaactattgatttaggagtcaggctatatggatttgaaatctaaaatgtccaggcatgtactaaaaatgtgaccttgggcaacttatataacttctctgtcctgagttttttttatctgctcaaagggattgccaatgaagattaaatgagttaatacacgtaaaagatgccaaagagcttctggaatgacctgagtgttcgataagggttagccttagccctcagggccattagacacaacgggtatttgagaaatattggtacagtgcactctgagttcacacctgtgtacctgggttattgtggactgctaatgaagatgggatgtcgaaaacaagagttgttctgtgaaaacaagttaattttcacagtatataagtttgtttgtaattgagatataattcatgctgcaaaaaacacccttttaaagtgcataatatgatgttttttagtagttgcaaagtcaagcaaccactaccactatctaattccagaacgatttttatcacccccaaaagaaaccctgtacccattagcaatcacttcccattccccgtcctcccagcccctggaaactgccaatctactttctgtctctatggatttgtctattctgtatatttcacaaatatgaaattaatcaatatgtggccttttgtttctggcttcttcatttagcattttgttcatgttgtagcataaaaagcactttttttccttttatggctgaataatatttccttgtgtggatatgccatattttctttatccatttatcatctatcaattgaaattgttatcagttgatagaaatttggaatagttctactttttagctatcattaagaaagcatctatgaacatttacatacagagtttttttttggataatgttttaatttctctcgggcatatatgtaggagtaaaattgctaggtcagatggtaattctatatttaacatttcaaagaactgccaatctgtttttcaaagtggcttcaccattttgccttcccaccagcaatgtaggagggtctccacatccttgccagcacttgttagtgtctgtcatcttgatgatcaccatcctagtgggtgtaaagtggtatctcactgtgagtttgacttccatttccctaatgactaatgatgttgtgcatcttttcatatgcttaccagccatttgcatatctttagcaattaattttaatatgatgtatttgagattgagatagcagacttaagtaaaattgactaagaagtaatatatgccacataaagacatggacacatatgtggagcagataaggctggggttagagattttgtagtagtgaacatgcagatgggcactgaagtcataaaggggagaaatgtctagtaggaagacaaggccaggttcggtggctcacatctatagctccagcacttcgggagaaaaagacaggaggataggttgaacccgggagtttgggaccagcctgagtaatatagtgagtgaggcctggtctttagaaaaaaaatttaaatcagctgggcacagcgatgcttgcctgtagtcccagctactcaagaggctgaggctgggggattgttcgagcctaggagcttaaggctgtaatgagctgtgatcacaccactgcactccaacctgggtgccacagtagaccctatctgttaaaagaagaagaagagaagaagacgaagaaaagagcagggaatctacaaaagtcaggaatggatctggggtgcctctttgagagcaaaattcggatttcaaggagttctgttagaatcaacaacctgcccagggtcagtagtttctctctgatataaaacagtccatagaaaggtcattgccagctccaggagccagacagtaagatctcaccaagtttcactataaaaaaagaattctagttagagggctgttgcccaatgcttcagtgcatagaactacgaggctgcttttttttcttactctgatgaaatacttttaagtttaagaatatcgaattgttttctcttatgattttttatgctataaaaaccctacaatttgatggaactgatctgactgttggttctaacattttgtgtggcgcacctcctcctcctcctcccgtgtggggtcttcccttatctctccacatccaatctcttgactctaattttgctctacttagaggactcaaaaggaaaatcacaagcattgtgtaccttctcttcattatgttcacctgttttctttagatctaacatatgtaggtcagctcccattttcatattgcttaaaataactcgtttagtctccttgggcaggtcaacacttagtcttgatgctgatcttccacttgtgagtgagatcaaagcatttccttgtatatgatgttatttaatcagctccaaattcctctagaaaaggccttaaatgctcctgtttattcctcttatttcagttcattttatgcagcttcaaacacaactgacactcatccaggtccatcagtggacaataaaggtcatggccggggcaccaatcatcacctttccagtcctccacgtggacctgggcctgcatacgttaatcttttcaattttcttcttgatttagtggaagcagtcagagcaaaactggcctgaacattggctgcaaagcttcctcacagaagttcaactatagtgggcaagtggctgcctggactccacggctcagttcaccaaaatccgtttacaggagaaagggcctcctcagcgcagtctcagagatggagaatctcccttatgcagaaaagacttcctgagctgggtatgctggttattgttggcatctgttccatgcattggtgctgctgggcggacctctcccccaagcctctatctgtacacgctattgtgtatctgaagccctactagtcttggtagagcagagtggttatgaagaggcaggagctttcaaattcaactatctctggcactttttaactgggtgattgatcttgggcgcatttaactcaaactctctggacccccacgtattcatctataaactgaagataattaaagaacctgttttatagggctgtcatgagaattaatgagataagctacagcaagttcttgttacaatagaaagtacaaaatccagcttgcattttgttacttactaacccaatttgttatttattcacccaattgtctgagctaacttctgaacctctgtaaatattcgcttctctcttcattcctgctctatttatctaattgtccctattttctgttcatctttatcatagaaaatctctgtaatccatcacctttttaccactgggtgggaatcaggcctcaccatgtctgtgggtcctgccttccaccctctaccccttctctgtcctgtctttctcagcctcattggagttgttttctaaaacacagaattggtcatgccgaattggacaacaaactttctcactgtgagatttcagaaggggaaattggaaggcaatttaccaattgttattttgatgaaacgcccccaaacttttgatttccacgggtgtttcattcacagaaagtctcattatctcaagcctagtgtactactgttggatgcatgttacctttatgtattatgttatccaacaacaatgcaccgggcttgagataatgggttttatgtattcctagagggtactggagtaattcttagcggagtctatttgtgttgacacttgtcttttgctaggatacagaatctacagatgagacatacattttctggagtcatatatactttctcacgtgcttttgtcatttgttcccaatgatatctttcagtatttttattgattttgttggtataatagaatgttttacattaatattatgtcagtgattattatttattaatttatataattagtatgatgtacacatataattagtatgatgcataataatctatcatatggatgtgccataatttttttaacattaccatattgttgatcattaagataatttcagattacctgatattatgataatgttgtaaatagtagtgttgttcataattttttgtctatgttaatgattattttcggaataacttattgacaaatattaaccaaatatttaaaccttggtttaatgaaaaaattatttcatgtcagctaacagtcatgttactctcctaggtagaatgttgatatccttttcatcaccatgaactaaatccagggcccattaacatggcgtccaaggtgtgttatgatggatagtccagtcctctctttcatcatttcactaacgaggacttttctttcttgttcatttcctggattttcccccatttaacatcatgacattttcctatgccattaaaatttattgtaaaatgtcttttccttccttccttccttctttccttccttccttccttccttccttccttccttccttccttccttccttccttcctttctttctttctttcgttgttttttgatggagagtctcactcggtcacccaggctagagtgcagtggtgcgatctcagctcactggctcactgcaacctctgcctaccaggttcaagtgattctcctgcctaagcctcccaagtggctgggattacaggcacacgccactatgcctggctaatttttgtatctttagtagagatgggggggtttgccatgatggccaggctgctctcgaacccctgacctcaagtgatccacctgcctcggccttccaaagtgcaggaattacaggcatgagccattgtgcccgacctgaaatgttattttcatagctgcataataatctatcatatggatatgtcataattttttaacattaccatattgttgatcattaagataatttcagattacctgatattatgataatgttgtaaagagtagtgttgttcataattttttgtctacgttaataattatttttggaataacttattgacaaacaaataattcttacaatagcaactgatggcagactgcagtggggcacagatgtatctgacaacaaagagaccctccagtggggccatgcaggaggagagacaagagaagacaggggacaagtctgtgtcaatagcttcccacccataattctaccccctcatcccccatccctgaagctgagttcctaggtgaactgaggctgtcctttcagtggtcactccagaaacgaacctggttttggagtggctgaatggccgctgccatggtctcatactgaaggatttgatggggccactgtgagatccagtacattgcccttgaccctttctgactctgatttacatttttctacttagtgagtcttttcttccttcccttcttcctttcctccttttctgcctcctggtctccctacccccatccttttaacaaacatggacctaataagtgcttagcagtgtgctaggtagaggaacccagatataaataagacacagcccctgccgagaggggtgagcctcatcactggcaggacgcagtcaagaatgcctgcttccacccctgactcccagctatccctgtgctcgtatcgccctatgtcctcttcctttggggtagctacactatcaataccccagctcttcccctttgctttactccaagatgagtgagtatccaagttattgttgccactatgaacatcattattaataaactaaataactatatcagcattaccaacagtgcaatatccccctctgccacatctcacagtcattattatacctccttttattatttctccacccaggagctgttcagacaattaaaatccagtaataagaacaaagaataattaaaataacaccaagaacaacagaaatgtgatgacaaatactgaaaaatctgaggaaacataaccaaggggctaacttcacagtgacaggtgctaacaagatcaacgaggaatatgtgacaaaatccttcctgagaacttgaaaattctttccatctgactcaatggcctttttgccactgaggtctccagaggtgctagattgtataacaacttatttagctgatcctgccaaaaacgtgttgcaaggcggaggggggaaagatgaggaaaagcaaacgttttcataatgaaagccaaactgaaaactatttctcctctggctagatgttggcaaagctccaaggcactcttcacagctgcccaggtcctggagaaagctttgtggtatttaaatggggttcccacttcatttcccccatcttctatgctcgcttataggttttgaccctcagtgcctccatcggaaacatagatgtaatgttcagtatacagttcacgagaaaagccaagtacaatgtgtttttatatccaaaatatgcaatagagaagtgacagtcattgtggtgtagttaaagtcattgtgatgaaacacacaggtgtgaaaaaccagggggatgtgtggggttgtattgtctgaaacaaaatcaggtggaacaaataagaaagagctagaataggctagtcttgttccacatatgccccgacaaagtgtttttgagtttgagcaagaatacatcactgagttctacctttgatagatgctaaaccgccacctgtgtttccatggtgttctgtggttttgttgggtgcttccatgccccttagctcagtcgctctttccatggttccttcagcaaagatcgatgtgtccaggcccacactgtggtggaaagaacacaggagtgggagtcagaagcctgtgccgttccttagatttccattcataaggtgtgtgtgtgtgtgtgtgtgtgtgtgtgtgtgtgtgtgtataaaaaaatatatggagtcttgctttgtctcactgcaacctccacctccctgttaaagagattcacgtgcctcagcctcccgagtagctgggattagaggtgcacaccaacacacctggctactttttgtatttttagtagagacagggttttgccatgttggccaggctggtctcaaactcctggcctcaagtgatcctcccgtctcagtttcccaaagtgctgagattacaggtgtgagccaccacacccagcctcatgagataaatattaagaaacaaaggcctaagaaggtgacttgtccaaagtcacctgcctcagtggccctggactccccgaaccttctacagctagtactagaatccagtgttagttctacgccatcaagctacttggtatccaaaatgtcatggaagtagtcacagctctccttcacacagtcatgggcacctctccctgccttccagtaaccctccaggcttcttctactgctggggaaaatgttcacacattcaaaagtccttagcaaacacagtatagtaggtgcctctaaaaaccacattatctgtctgaggtccaaactcttctccacttacaaagctctgtggtgcccggtgggaggcgtagccctttctgccctttctgccaatcagcccaaattcagctgcttctcaaatggatctcactttctgttccatcttatttgacacttcatcagctggagatggctcagagatggtttaatgttagctccatatctgccaaaaacctctcactccttggcaaggcagccaaggacacaataagagagaaaaagaggtagatgatgagcgtaactcaactttggtaaaaatagtgcagacatttccgcagcttctcttagggtggcataaggggagacgagggagacagaaagggaaggatgaatgaggagagaggtgtcatccctgcttccagcctggaaggagcttcatttatctgcgttgagaattcagtgttgatccatcacatttgcacatgttattgtcacatacgtttactttaaaacatgccatccttaatggaggatgactatgcagggagcaatgccattgcaagagtctcatacagtgactctcctcagggggcttagaatcatgcctgctccttcataggcatggcggtgctgtacatttatttagcacgctgctacttctggatgtcaagctgtcaggctaatggtgtcaagggcagggagggaatggacagttactgggttctgatggatctggcatcttgtgaggcatcccacatagaagagctcatttaacggaagagaattggtcttgtgaggtgagctccaaccactctgtgcaataaaggctgaggaaggaaacaaagtggctggaatgattccaagtgaattggaagggtcgaagcagagccacagatgcagggatggtggatctcacctctctgtcttaaaagaaccaccttcagcctggaccacaagcagcagagatcaagaagaacctttgttctgaagttcagttagcacatttgttccacttcccttctcagtagaagagaaaccattcatgttatttgttttactgtatgtctatttttatctggtataaactgtgttgatttttcggcattttcttatttgttatttcatttgccctccagaactcagcagagggcaccaaacatcattttacttcctcctccctgtttctgggggaagatgaatagatctgggttttgcaatgtccgtgctctctgctccgtctcccttctctctttcgccttctttatgtgcctctgccttctcgcctaaccttgcctctgcaaatatcttccgcttggaatccgactcttgatttctgccctggagtgagcaggaggcaggatgggggtgggtagaaaatattcccactctcctcaaactctgtcaaaaatataaatgcccagtacaaggttgacaccgcgggccccaggttgccattctctatattttccttcctttgtcctatttggtttctgaagttaaatggtctcttttttgatatgaaaattaatttctggacaaaaagaaatatgcctgcacaggggccaaatttgtgttgtctcccagcacggctgtaattacactgtagatcaaactgacgccttagttttcagtggcttttttccctctccgatgtccctgaagttgccaggctcaccaagagcagcagttttcattagcagcaaagccaggggatggggatggatggccggggccagccctcactcctgggtttctctcctcaaattcttcttttggatggacatgtgcaatccaggccaatgcagagaactgcaggactcagggtcctgagttgcttgccacagtgtgggggtgaatggcggtggctctggggtacccctcatcctatgggtttcaccctgtggaacaggcactaccaggcttctcttttaagtgtcagacacaagaagggtctcacacatttcccatggtctctacacatttcccattacctttgtgcccagcagaaatctgtgttcacctgctaaaaatggtcactgtgaattagtatcaagctaagaacttgtgaaatagggcagaaccaatgcaaaattttccggagtcatgaaagtgaagtggcttttacactgcattcaatattgtgagttctagaggaattttcagggaaactgtggctcccttcttatcctaactttcatagtcaattctcgattgcccatacatagctccactattgtttgttgggtataattagacactatgttctgtggccctcaggtggacatctatgctttgccaataagccatgaattactccccagagaagcttatgtgattttgacatctacaaggtgaatgcaaactatttattcacaatgtgatgggcattccttcaatttccctataatatgttgaatgtaaatgatttgtacgtggagagaggagtgcttggtcagacttcatatgtcagaaagtcaacctgggtggtgtgaacaactcccgtcaaatgagtcaaagccccagaatgagattctatggtctcttggattgaacttggggccaagggatgtgggctttgatccctgcagctttgtcactggccctgagtggccattcatctaatttttccatctgccaagtgaagcaacaatccctcccactgccaagcttacagtcacattataaagatgattgagattccatgcctcagtggacttcaggaggaaaagtgttaccctctaaatccttcctcacactcccacacccacaagttttctttttttttttttaaagagtccagtgttaatagtgttttgactgctttcaagatatcaaaacagcttttgttggaatgaaataaacaaaagaagatgggttttggaacagagcattttaaggttcaaatttcaactttatcacgtatgagtattataagtcagttactcacactcttggaactttattttcctcatctgaaaagtgaggataataatggctcccttgaaaggccgcagggataatgagctgccattattgcatcagtgcaattccagcatagtgagaaaggtttgtgtctcttagctgctttctgaccggatggcaagcctctcctcaccccacactggccgccgttggcatacctatgtgcatgctctgtcctccgcggttcctgtggagaactctaaaagtcagggaagctcagtgccacgttttggaacttgtcagccatagagcaacctacctatttacttccagtggatgaatgggaaggtattgctgtatcacataaggactctcctagggagggcagtgttagcagcatgaaaagagggacattccagtgtcacacaaagtcccagatgggaaacggcagttgccaaaggcagcctgaagtgctgcgttctcttcgctcttcaaatgcagacaggtctatagcagcagcttgaagatgaagaccctggaaaaccatgagcaagggggcctcaaaatgacagggaaacaccaacaatgaggagggagctaaacgcacagtctcttacacccaggagtgtgattatctgacattttggtttaatgaaaaaatcaatagttttggagccaagcgtgggtttgaagcttcgctctgacactttactgcgcagattgctgagtaagttactttggtcaccgactctcagttttcttatttacaatactgggataatgcctcactcgcagggctgatgaatgagatcacagtggtgtggtggaaagcatgggctacgttgtaagagtgtattcaattcccagcctcactggttacacttctgggtctttaggagagctgccggcatccatgtgcctcgatttccacattgtaaaataagggtaataactgttgcctgtctcaaggggtgttgtgagggttatgtatggagcacataaggagtctaaggtgcacaaaatgaatactcacaatgaacgctcaacaaatagttccatttttaaattaataaatggctgttagtaatattattattttattagttttagcttattatccacaaaatagttcttacctactaattggacaagggtaggacactaattaaacgatgtgtgtcatttttgatggctcacactaaaatccatagaaaagtgtttattttcttcaattttttttcttgactctggggtttctgtccttctaatccatgagtctctctctgtctctgtctggggtttctgtccttctaatccatgagtctctctctgtctctgtctgtctccttctttcctctccatgcagtaaaacagagctgcaggcagtcaatttcgagtcagtgggctgtgaaaagcagttagaataatagtttattgaccctgaatgtggcagctggaactgagggtcggctgggctcaggcacagtgtaatggtcacaatagaagtttgatcatctttgatcatttccttggactttaagagagaaggtgttgccaggcatggtggctcacgcctgtaatcccagcactttgggaggccgaggcgtacagatcacaggtcaggagtttcagactagcccgaccaacatggtaaaaccccgtctctgctaaaactagaaaaattaaccgggcatggtggcaagtgcctgtaatcccagctacttgggaggctgaggcaggagaattgtttgaacccgggaggcggaggctgcagtgagaagagattgcaccactgcactccagcctgggcaacagagcaagaccccgttgagagagagagagagagagagagagagagagagagagagagagagatgttttttggagcctgggagcacctccaaatagcccaagtccaggggcggtagcctacccagaaggggctgggtttggttggaaggagataagtggaggagggcaggatgagggcctgagttctgtaccacttgtgggagtggagccttcatcactgggggtctgagtgcctgagcacgagggatgctgatccccatttcaaatgtgtcccaagcatagacatgcgctctgttttctcagattacctttggaagctggacttttctcctaagcactgcagtgatatgccttcttattcactctggtgatcatggattttccggtagaaatgtaattataaataaaaagtacatcttcaaactactttaatacttccatattagaagcaatttgtttgtaagtggaattattaataaaaacatagttgaaagcagagactaaggaaattcaaagagaaagaggagaacatgaatatataaataaaggatggcctatatttttacataatttgtgaattaaaaaatagaaatgtattgtcatagactgtataaactcatgcttccttcgatagctcagctggtagagcagaggactgtcgaagacacggaatcaacctaaacgtccatcagtggtagattggataaagaaaatgtggtacatacgcaccatagaatactatgtagccataataaggactgagatcatgtcctttgccggaccatcaatggagctggaggccattatccttagcaagctaacacaggaacagaaaaccaaataccgcatgttttcacgtatgagtaggagctaaatgatgagaacacagagacacagaagagaacaacacacactggggcctattggagggtggaggctgggaggtgggtgaggaccaggaaaaataactaatggataccaggcttaatacctgggtgttgaagtaatctgtacaaccaatccccatgacacaagtttacctatgtaacagagctgtgcatgcacccctgaacttaaaagtcaaaagataaaaaataaaagaatacataaactcaaaatgtgtaaattctgggcaaattttgtcatggcctttggaaaacatttccaaacaataacttgttactttattttacaagtcacatgtttatttcattgctcgtgttggaatttattcattttatgatcctttggttctatttatattgtgataaagactataaaaatgactttttttttctttttgaaagaaatcaccaatacagataaaaagcatacaaatatcatttggtatttgtaatctgaattatgatacagtttttctattggactggaaaaataacctttgtgaattacatagaatctatgattttaggcaagctgtttccagtattaaagagcacttatgtcaattgtaatatgttgtgagttatttgttttcatttaatgtctttttatttaaaatagggaaagtctggtaaacaagctgctcaactaaaattaaaaaattttcttattaaataaccaatgtaaatagaatcaaatgctatgggagaaacagaaagaaagcataatgcatttaagaagaaaagaatctaggtgaagggcaagaatatagaaataaaatcatattttgtttttcagaacaacaatgcagcaagtgtacacattaaatctgcatgaactgaatgtggaaacgcttgtctactgaggagataagtgaaggggggcctcttaaggttgacatgagcgcccaatagattcaacttcacttttatcagctgttcatgcatttatgtcaaccacctgaggtctttagctttgtttgattgttcagttcaattattgcaagaaaggagttcagaaaataagctttatttatttttctctctcataatgtatgccattgtctcaacaaaagttgggactttagacatatatttaacagacctgaacacaaagacttaacaagttgtttctttattattaaccctttcctaattgtgcatttcactggttattgttaatggttttttttttttcaaattttagagataataattcttgattaagatatgtccatttccagtgtctggtagttatttaagaaataattttgatagagataatatagaagtggaaataaaatgtagaagcctattgtgaagtttatctttagaaagttttcattaaaaaacttattttccagaaatcagatgtggtgtgtttctgcaagaattatgaaacaaaataaaaccaaataaattataccactagaaccttcatagtactcttcctaaaaggaataattcaccatgcatattttaaaagtgttcaggatcatagattcaattaaatttaattgccatatgtggagttcctactaagtggtcggccagaatgaaggcatatcaggcagagttatgacttaccaactctgcaaatacacctgcaagctactgcacctgtggctttccttccatagctcaaggaaaataggcaaaaagcaataagaataggaggtcgtgtgaaacagtgaaagcagccattcttattcttttgaaattgtgtacatccttcagcataatacagacaaactagagttttgatgtatccagtacttgggagaagagctattgtatccagtacaattccccaatgcatattttaccatttagtctattcattctggaacctggaccaaatgtatactttgtggttatttccatttttcttatggcatattgtgataccaataatctatcatcaaattagttcttaagatgagacccaaatgaccatttatgctagaaactcttgatattccaaaattagcccatacttgagaagcaggtcctattttgcttcctgtctttggggacagcaactttctctgtaacttgaagcatgtctcttaacctttcctgatttccccatctgtgaattagaggtaattattcctaattttaaggagccattgagaggattaatttgttagtgtttgtaaagtactttagatatgtaaagtgctaagtattactaaattccatacaaataatttgcaatttaacatctaaagggactgaataattgactttattcttgtagactatattcttataatattttagcaaatctgcaaatacatgtttttcccatctaacatttgtacagagattattattgtttgtaatacagaacatgcaaatcaacccctccttcctactcaagttaataaaaacataaaaggaatgactgtcattagaagcaaagtatcctgggggaaagtatctcccaattttaaaaattgctggcaattcccttttcaagcagtctgcggaaaagctgtcaggagaggtaaaaggaagaaagaagaagtctattaaggaattggatatgggttagaaaattaatgttttttttaaaaaaaagatgaatttcctaattgtgttgttcctggactctgaaacaattttagtaaacaagcacaagtgtcctctgcagttatttaaggacagactacatacttaccctcaaacccagtttattcaggatgcaggaatagaatatggaactaactggactctccttagccccaaagatgctcaaatcccagttgttgtgtattcctctgacataatcccaccacaccggtgtgtcagtgcagcgttcgtatcacatctgaatcgctggataccgactaaatattagacagttgtgggctgctagctgcatctgcatttacctcctgggcaaatgcaagcactttgagtgctgacgcagaagggttagacagagctgcaaatggtgattcaactggagccgcttgtggtgtttataaagggatgtcagtcctaaaacaaactctgacacacagaggcctggacttccactggggttgtgctgacttgctctctgattgatggtgctaccagaaaccactttatggagttatagccttgggtgacaatgattatggcttgtaatactggggctgtatttcctcgagctttccctgtaggacttggagggattcctaaagagaacagaatgcctgtcccctacacagggaatgaggaggtgccattcagggaggctgagccgggacaggtgaagggcactgctctcagtctcctcatcttttaactggggagggttatcaaaacctgccttgcaagatgaggccaaagtgatggaataacttggaaggtgttgaaaagtgtaaaagccctgtgcaaacattgtagtatcagaatcgctatttttgcttgatcggagccttttccctggcttagtacagctttcggccccatcattccgccctcatcttccttggtttccgaattactagaacaaggggtcagtgacacatattgaaaggatcagaggactggagttgaagtcctgactcatcacttcctgagttgctctcgtggccttagccaagtcacttcatcttagaaattccattttgttacttgtaaaattggggcaaaatatctaacctatagtaggtggtgagaaaaaaaaatgagacaaatgagacatctattttattataaagcattatacaaatatgttaggatgattataaatatttcttgggaaatatttctagctcttagggaagctaactcctttacagagaataagagaagttgtagcactaaaataaatccttttcagtctgcaaaaaacccctgtttaattcaccgaaagaagcatttcaaggaaatatgctcattctccagcctgtgtccctctttctgctgccccctttatcacgtgcgctggtgggaggctgccaacaaaagaacagggccctgtgaggggaggcaggggtgttcccaaccctcagcctggccatcgtccgtctgtccaggaatgtttcctttaccctctttgtgggagtcgtcatcctctcctactgccatggatataatcagaaggaccgtgaaggtagatgtggtggggaaaacaacaacaaaaatcctcccgccgaaggtgactttcagggctggtgagatttaattcatttccctgtggcaaccatcagggacggacatctttcacgggctggttgggtacatttcttacatgctggcgggatttggacgcatgctgtgccgctctttttcaacgccggaaaagtaaaacattgcccaatggggagctctccactgacttgtgtgtaggaaaatgatgtagccaaattggtgtggcggaagttttacagagaggaaagcaggaagcggcaaagagaaggaagacagatgctcatgaatacgtttttccattatgttcccaggcactaagtttgcctttcttgatccttacggtataattttccagatcaagataagcattaagcatgttgtctgtctcctcctgtacaatttgcagtttcaggttatgctcagattgatagaactgtgagtatgcagagacattaataagcctatgcatttaaataacctttatcttccaaggagctcagttttataaatgatgggacattgctatttttttttcctgcttcatatgcttggcatttttataaaactttgaatttcagtatcatccttcatgagtctagtgtaccctccgaaaaaggcagcgatgtcaacaaattattataacaatgagtcagtgataccgaaaagaatcagaggactggagctgaggtcctcacatgtcacttatcaatttgctgtagtagtcatagccatgttacttaatcttagaaactcaattttgatacctgtaaaattggtgtaaaaatatctaacatatacctttgtggtgaagaagaaaaatgacatacatattttttaataaagcattctgttatacatatatgttaagattatgataagcctttcttagaagccactgcataccttaggagcaatttattttttatactaatatgctagagggaaactaaggcacagatggaaaatgtgcttctcactactacaatctataaatcaacaactccccaaactctatgtgcagtcaaactgtcctatgaacttacaactcactctttgaattgccagctgaataacccacgagcacccaagcttagcatctcttctgaatttcctcacaatcctcctcctccacctgagtctttctgcagaagctgttctctcttccagttgctagcacacatatctgtgcctttgggttgtgtctcctaaatctttctcccatcagccttttgcttgccattcaagctaccaacatcttaatgaagttcctcctgtgtccctattaaatgcaatagctttgtagctggactctcggccttcgttgttctccttccatacccctgaaatcatcttccacatctgagatgagtggtgtaaataaaatgcaaaataaaccatgttgcttctaaatgtcaaacagttctgtggggccacatggaccataggatgatctcaagcttttctggatcttgggatccagagagccttgtatcacatgacttcttaaatgtctgccactgccagtcctgcctctcactggaactgccagcaacagcaagggaatttcctgaaagctccatgcaattttttcatgtctctgccattgacattgtattgtctttgcatagaatcccctccccgtgttccttagcttgacaagctcctcgttatcctgtgatcccaggaatgtctccaccaggacacaaccaacacatcaccaccgtgtcaccatgactgacaacaggccctccactgtactcgccgggcaccacatagcacctgccattgtgcattgtgacttcagtattacctgatacatctttcttagcagaatccattacttgtgtacaagaagcgttgatggtactgttcatatgagataaaggtgccataagctaaatgtgttcaattaggtattagaattgtacatgcttggtcatatagtcactcaaccaagtctgttaagggtttactatgtgccttatattctagtaggttctgggtattgtagtggcaaagtggttcttggttaggcgtccaggtcatgtatcatgtagtacatgacggtggacacacacttgccacgcagtcaccaggactgtggacattgtctgaaaatagtggcagagcagcagataattctggattctcaccggcaggggtcagtgcagctaagcagacgccgcacagccggctaacttggaaagacattaggagcttggtcttgaattaataccattctaaacgttttctatttatatgtgaaaattcacatttctttgccttttgggaccaggctagatctattcattctcctttaatggctttgtaaacactgtgccttccatgacctgccccctcctccctgtgcccatccactgcctcttactccatgaagtgattttattttgaatgtattcgtttcctataagaagagagcctctgagtgaatcacacatcggttcaaatgaccttctgttttgagaatgttcccaggggggtgcaattcttttaatttatttaatccgatgtgctttttcagaatggctctcctctgcaaaacagatgggaggggactgcctggcactacttctctttctctccactaccctggaggcttggcctctgggcagaaagcttgcaggagtgtatgggactggacggttcccagtgccaggcggccctgctttcctcacagcatgggggcttttgacatcagaggggccccggctcggcctttctcttgggtgtacctctgtggcctgcctcctcattttgttcacacagaaaagaaaggacatagagtagcatatgtcctcagcacttagatcatgaccattgcacttaaataatcaacactctttgggcactgtgataaatcaacagttgaaacaggagtgggcactggagaagctacaacagatgcagccaactttacttccggatgaagttgttctgaatcaactcagtactggaaatcataaagtgatcaggagtgtggcagtacagatcacagggacctgggtttcaaccctggcttagccacttcctaagaatgtgagcttggaccgatgaagatgtataagccacactttcctggcatgtaataagggaatgatacagatatccactcccagggctgctatgaagaggaaatgacatagagcttacaaagtgctcagagctgtgtctggcacagagtgagcatctaaaaatggcaagaagaatgcatgtcattatgacatttacaggctatatgctacaggcaaatcattatttttcttttaataattgaaggaatttgacttgttaggtggtccctaccttgatcccttagcccctgggacacacctctgttgttgacgtatgtccctgcattgtcactgtttttttgtttgttttcttttgttttgtttgacatggaattttgctcttgtcacccaggctggagtgcaatggcatggtctcagctcactgcaacctctgccttccaggttcaagagattctcctgcttcagcctcccaagtagctgggatgacaggtgcccaccaccatgctcagataattttttctatttttagtagagacagggtttcactatgctggtcaggctggtctcaaactcctaacctcaggtgatttgccctcctcagcctcccaaagtgctgggattacaggcatcatcgttttatgtagaggataccaggacatttccctgtcagctgtgcagggcagacaccgaatcttaaacatttctgtgtttctcgcattgggcagagttcctggatgcagcagttgctccgagaatgccagatgaaagcaagctgggcatgctgtctgggaaccctgtgagccttgggtttcccctgaccttaggtggaaagccattaggcacctgcttacactcaacggagagaaagcactcatcccctaacgttatcatttctctctaagtctgtctttccaaatacttaccttgcatttattttagagagagaactctttttattttattcctgagattgggtgttgccacctttgtccaggatctacacatctgtgtgtggtgtccctggatcctccttggtgtctccttagagactctaagttatggccttcagtcacatgtacattgccacatacccatgtgttttcattgccaggcaaagtgtcattctggcaacaagctcctcacctccttccccagagcttgccacactggcctgccataacagttactggagccactgcagggtgcctggttccaaccaccatacaggtcttttttctctccacttggtgcctccatcagaccaattgctcaagccagagaccaagtggcctcctgaccaccccctttgctacaatcctggcatctaagtcattattaaatcctgttgatttcatctccaaaatgcatcttgaattttttcatttccgctttccaccacagcccaccacttggtcatttctgtgtaaccacagcaatagactctgactagcatctcactctgccatcatctcagtcactctcattgctggagcctaggtgagattttgaaagcctgaatgagcctgtgcttctcctgtttacctagcggtgactttctattccactttggatccaatcctaagcgcttcccaggccttgtggagctctgtggtgtccggggatgcctgctctctctcctcaccacaggcctcctcccctgcctcggtgtttccaatcccaggggcctgcatccaggctgagaggacagcattagcccacctccaccctgagactcccacatggggctttttctccatctggaagaagcctccactcaccccacggccactttctcccaccctcctaatcactcttcaggccatttgggatgcccttcttattgcctatcccctgatatcctctctcagtgtgatctatttattttttaaattatacttatgggccaggcaaggtggctcacacttgtaatcccagcactttggcaggccaaggcaggcggatcacaagttcaggagattgagaccatcctggccaacatggtgaaaccccgtctctactaaaataaaaaataaataaataaataaataaaaaggctgggcacggtggctcacgccaccgtgtaatcccagcacttcgggaggctgaggtgggcggatcacgaggtcaggggatcgagaccatcctggctaacacggtgaaaccccgtctccattaaaaatacaaaaaattagccgggcgcggtggcgggcacctgtagtcccagctactcgggaggctgaggcaggagaatggcgtgaacctgggaggcggagcttgcagtgggccgagatactgccactgcactctggcctgggcaaaagagcaagactccgtctcaaaaaaaaaaaaaaaagaaaattagctggacatggtggcatgtgccagtagtcctagctactcgagaggctgaggcaggaaaatcgcttgaacccgggaggcagaggttgcagtgagccaagatggcactgctgcactccagcctgctgacagagcaagattccgtccccccctcacccccccccaaaatatatacttattaccatttgtagctatataattatactcatgtgtttgtttaacatctgcctcacacatttgattataagctccataacgggccaagatcatatctgtgacttatatctgtgacttgccattttagactcagtggctgtagtgtgatacctgacacgacactgatgctcaaaaaattgcttcataaatgcagaagccaacattgacgtaattttccagaatattttaatactcaattgacctcagggaaatgcaaaccaaaaccactaagataccattgcacacctatgataatggctagaagttgaaagattgatggtaaccaactgttggggaggatatagagccactgtaactgtcacacactgatggtaagaatggaaaatgctagaaccactttgaaaagttgtatgttttaaccccatcaaaaagtgggcgaaggatatgaacagacacttctctaaagaagacatttatgcagccaaaagacacatgaaaaaatgctcatcatcactgaccatcagagaaatgcaaatcaaaaccacaatgagataccatctcacaccagttagaatgacgatcattaaaaagtcaggaaacaacaggtgctggagaggatgtggagaaataggaacacttttacatcgctggtgggactgtaaactagttcaaccattgtggaagtcagtgtggcgattcctcagggatctagagctagaaataccatttgattcagcaatcccattactgggtatatacccaaaggattataaatcacgttgctataaagacacatgcacatgtatgtttattgcagcactattcacaatagcaaagacttggaaccaacccaaatgtccaacaatgatagactggattaagaaaatgtggcacatacatatgtagaaagctgaaactggatcccttccttacaccttatacaaaaattaattcaagattgattaaagacttaaacgttagccctaaaaccacaaaaaccctagaagaaaaccgcgcattaccattcagggcataggcatgagcaaggacttcatgtctaaaacaccaaaagcaatggcaacaaaagacaaaattgacaaatgggatctaattaaactaaagagcttctgcacagcaaaagaaactaccatcagagtgaacaggcaacctacaaaatgggagaaaattttctcaacctacccatctgacaaagggctaatatccagaatctacaatgagcacaaacaaatttacaagaaaaaaacaaacaaccccatcaaaaagtgggcaaaggacatgaacagacacttctcaaaagaagacatttatgcagccaaaaaacacatgaaaaaatgctcaccatcactggccatcagagaaatgcaaatcaaaacaacaatgagataccatctcacaccagttagaatggcaatcattaaaaagtcaggtaacaacaggtgctggagaggatatggagaaataggaacacttttacactgttggtgggactgtaaactagttcaaccattgtggaagtcagtgtggcgattcctcagggatctagaactagaaataccatttgacccagccatcccattactgggtatataaccaaaaggactataaatcatgctgctataaagacacatgcacacctatatttattgcagctctattcacaatagcaaagacttggaaccaacccaaatgtccaacaatgatagactggattaagaaaatgtggcacatatacaccatggaatactatgcagccataaaaagtgatgagttcatgtcctttgtagggacatggatgaaattggaaatcatcattctcagtaaactatcccaagaacaaaaaaccaaacactgcatattctcactcataggtgggaattgaacaatgagaacacatggacacaggaaggggaacatcacactctggggactgttgtggggtggttggaggggtgagggatagcattaggagatatacctaatgctaaatgacgaattaatgggtgcagcacaccagcatggcacatgtatacatatgtaactaacctgcacattgtgcacatgtaccctaaaacttaaagtataataataataaaattaaaaaaagaaaatgtggcacatatacaccatggaatactatgcagccataaaaagtgatgagttcttgtcctttgtagtgacttggatgaagctggaaaccatcattctcagcaaactactgcaaggacaaaaaaccaaacaccgcatgttctcactcataggtgggaattgaacaatgagaacacatggacacaggaaggggaatatcacacaccggggcctgttgtggggtggggggagggggaagggatagcatttggaaatatacctaatgttaaatgacgagttactgggtgcagcacaccaacatgacacatgtatacatatgtaactaacctgcacgttgtgcacatgtaccctaaaacttaaagtataatttaaaaaaaaaagaaaaaagaaaagttgtatgttttttccttataaagttaaatacatggggctgggcgtggtggtgtgtgcctgtaatcccagcactttgggaggccaaggcaggcagatcacttgaggtcaggagttcgagaccagcctggccaacatggcgaaaccccgtctccactaaacatacaaaaattagctgggcatagtggcgcatatctgtaatcccagctacttgggaggctgaggcaagagaattgcttgaacctggaagacagaggttgcagtgagccgagattgcaccactgcactccagcctgggcaacagagtgagaccccaactccaaaaaaaaaaaaatgctaaacacacaactaccatataacccaaccatttcacatcttggtatttgtctaagacagataaaatcatatgtctacatagagacttgtacacaaatgttcatagcagctttatttatattagccaaatttgaaaacaatccatgttcatcaacagatgagtggataaacaattaacagtaaatccaaacaatgaaatatgactcagcagtaaaaaggaatgcgctattgatacaagcaacaatgtagatgaactcacaccatcacgatgagaggaaaaggccagatccagaagagtacagatggcaaaactctacgattccatttttatgaaattctaggaaaggcaaaactaatctaaagtgacagaaagcagaaatgtgaaggtctggggctaaagagccttgggtattgatggcaggaagcatgaggtaactttctgggacagtgagagtgtcattctgatgagggtagtggttacacagatgtaatattcatcaaaacttattgagccacatcactaaatggatacattttattgtatataagttatacaataaaaattggtttaaaaacctcagttgaacacagcatggcacacaagttttgagtgtgtatgtatactgaatatttatatatgaaaggtacaatgtttcactcttggcctagcaggaatcccaatgaccctgggggtgaagactggcaagggagtggaagggagaacaatgaccttccccttgactgtattttcagtttaccaaagcaaagtgaagcttgggctcaagacattaagatacagatggaccgcatgcagggccaaaaaatactggatgaccagctaaattctaatttctgaataaacaataagtagttttagtataagtatgtcccatgcaatatttgggacatatatttttattaaaatatttagccatctgaaattcaaatttaactgggcatcctgtatttttatttccaaaacttggcaacttttccagcatggtgtattatcaccaggatgttcaaattcatgtgtggaaggattttcttttgaacatgttttgcattttataaagctattcacatagaaaatagggagcaacactctatagtgaaagtaatgtggattttagagtaaatcagaccttgattctaactccaactttgtctcctaattcattctgaagctttggccaaattgcttaacatgtctgcaaagtaagcataataacctctaactcaaaattttattcgaggagaggcaatagaagcattagcttccttgaatcaggaggactgtctgtctcctttcccactgcttctctgcattggccaggagatatcactgtcctaacttctggaaacaatttaaaattgtgaggcctggacaggagacaagagaagctccttgccagcattggctctaattctgaaagggctcctgggttgcatctgagctatcaccatcaataccccacactctcattggtgttagtgaagggcaggtgttatgtcagtggtggtaggaagggggaagtcatgtcatttttactgtctgctaatgcttcttaaggaaaagaaaggaggcacagaagtgaggaagaatagcggtggaggtactccagacaaattggaagggatctcctcttgttaaagaattgcaggcggggcgtggtgacacacctgtaattccagcattttgggaggccaaggcaagaggaccacttgagcccgggagttcaagaccagcctgggcaacatagaaagaccttgtctgggaggctgaggcaggtcaattgcttgaactctggagacggaggttgcagtgagccgagatcacgccactgcactccagcctgggcaacagagtgagactccatctcaaaaaaaaaaaaaaattagctgagtctggtggtatgcacttgtggtcccagctactggggaggctgaggtgggaggttggcttgagtcctggagatccaggcggtggtgagctgtgatcacagcactgcactccaacttgggtggtgacagagcaagacctctgtctcacacacaaaaaattgctataatcagggattatctcatctcaggaaaaagaggaaattatgttcaagatgaagagagaaaacgggctagtcatctgatttactttacctgaccataacacatagtcctagggtactgggtgaaatttatggccagtaaattcccagctattaaaaggaaacgcttctttgtctgctatgcagttgacctccgaggaagatcagtgaagcagaatcagggactatgtttagaaacgggatccagcaattttatgattcataaaaacttggctgatgatgtggcttagagcaagggcctcaaatgccacctcagagccctgagccacatcccatgccttcagcaggggcagcctgtctttgggatgctgctcctaattccatacattatctccttcaaggaaaggggcgtcatctccgaaacagctacatctcctttgtgattccagtttccacccaataggcccagtgcagtgactccagctccttccaggtagctgcagctcttgccaccagaaagatcacttctttctttggttcttcagtcttaggcctgatggagatgtcctgtcattgctaatctctgtgtagtctcatcatctctttcacttctctggaggctttgtaaccaattctcttaccaaattccttctactggagtcatgcatggactccaactgtctagctcttcaacgatataccaggtcacaccgttttcccaaggggttttaacctgtcaccctaaataggactgatatgtagctgcacagtctaggcaaacatgagtgaaagaagatttgggcactgattctcttcctgcccttctagaacccatttccaggcgtgttaggtccatattcaatgccaggtgagacggggctgagtaaacagaggtttccattagctcaggggaagtggaaagtatcaagccctgacatcgtccactggagacactgatgtgagttgaagttaaatcctcagatggttattattattatgtttgtttttttcttaacaggatgctattcccaaggtatacatataaaagcaggattcaaagtcatctaattattatacaaagaaacaaccagagtaaaagtagtgggatgaagattagtaaaatgtgccagaattgaggaaagaaacccaccccaacattagaatgcaaagaacgttttaaaaatgccattatggaaagtatattctagggataaaatggataagtagataaaagatttaatgtttagctattattctactaacttcaaattttcaacagaactccattgaatagtctatgtttctaaatggagcatatttcgaagaatctccagatggtcaccggacactacagggctccgctgagagcaagtagccttacttaagcaacaactagggaagcccaagatttaagttcaacagagactattttagtcagtttcactctatcctcgtcggtggccagtagtaagcttcatttaaatatatagctacaaatcataccattcttttcattttcttttttgatcctttaatacaacttctgtcttccccctcccccccgccaaccccgctagctaattgtagcaaactctgatgatgtgggctagtgatatggccatatttcatttctggcaaatggatgttatttacatttgaaaaagtgaaccatacttcactttcattatgaaacactgtcttcaaagcaacatccccaaagctcttttaatgagagaggagagggagtgagagactgtttcttcagcaggaaataactgtccccaaacttaccagtttggtatacttacagttttctgcctattttcttttctctctttctttctttcttctttctttccttccttccttcctttttttctttctttctttcttttctttcttttgagacaaactttcactgtgttgcccaggttagagtgcagtggtgcaatcttggctcactgcaacctcagcctcccaggttcaaatgattctcctgtctctgcctcccgagtagctgggattacaggcacacaccaccgtcccagctcacttttgtatttttagtagagaaggggtttcaccatgttggccaggctggtctcaaactcctgacctcaagtaatccacctgcctcggcctcccaaattgcgaggattacaggcatgacccaccgtgtccagccgtctgcatattttcttaaagcctgtaccggcctagatgattcatcaaagaagccgtgactctttgaacatgagtgggtcacccatttttactaagagaaggaaccaccctcaataactccatttcatctttgagaagtttggtctagagtcatccaaagaaaataaagcatacacttctatggatattatttggattaaattctttgaaaaccttcacacctttatgattccacttagaacatgctgccattatgagaaggttgacagctgcacacccctgtgcataggcaggattggagtcacacatcttactgtgctctccatactctggtactgttcacaggcatatttataagacctctaaagaactgcttcaggctttcagggaatgagaaattaattccgtgttcatcgttccaagagaagtatttctggggctgcaaaaccaataccacagaggatatgattgcctggtgttctggaacctgagagcaaacaaaagacaatatgccatttacacagctttgcagagcttattcaaacatgcattgggacatggacattttcattaagcttaccaacttttctttcctctctctttccttacctcttctctcttcctccttttttttcaactcatttggagaacacactaatatttgtaacaatgctattttcctggagtaagaaattcacaaccacatgaaacacacttgtaagaggttagagagaagccagctcttccgtgggaagctagttgcctgaaagtgctcaagattttttttttttttaatgattttattacttggcttgttagggcttattttcatagctgctaccaaactttataagaatattctttatccaggtcattaatttaccttgctgaaattgataatctaggaagccagaatccattgaaatcttgatcccaaatggatttatctcttcaggaagggatccaagtttcattttatttttagtgctttttaaggtattcttcacaggagggagagaacgatgtgagagtgttaatgaaaaaactaaataactttcctaacatgaacccatcatctgaaaagcagaacctaattttgaattattaaaggaggctggatcacaactcaccactgagaaatcgagggagggaaaatggtgtttgggaagtccaattatttctgaaccagagacagtcttattaagttgggcagaaaattaattaggctaattagaaaacctcattggaattcagcaaggagttatgagaagaagcatgacaacactggaagtgttgatagagggagaaggttctatgggagagaaatgagtttttccggaagcagatgcagggtgattcatgcatattgcggttgatcattgggtcacttcggatggaagcagcagcgtttttatagactttctgttcccagtggtgggtcttcactgagtattaaaaatgatgtctggtgtatgttgtaagggaaaaaagaaaaaaatccctgagatttattccaaggcttcagtgggattttatatttattttggtatttccgatatgctggttcatcagcatggcgcattgttaaaaagtgctgggtgggtggttttttatcttcacggatttatggagtccttaaaacatctgttccgttctgattcccccgctcagtacaaagacgttagtcaggggaagcatctcacactgcactgtttccacgcactgacgttggcagcggctaatagagataaccctgctgagacagtcagtgctgtgtgggggccggggaggggccggggttccatctccgggaagaatctcatgggatctgggccctgcaacacaagggcctttgaagtgagacgaggaggagcctcaggaagggtcgccggggtgactaaagaaacctgcggagggagctaaggaaacctgttccaggggacgttggagcgtaggaagaggactgtgcccacgatgctggagaatgatctccacgtccctcctaagcccctgtgacagtgacgtcttcctttctggggctctagggaaaggaggagccttcctagctcctgggagagaattatcagggctgctgttgtttttgagaaaatagctgcaacccagccaaaaccaccgggatggagggactcttaaataagatgtttctcatgtggggtgggcagggcaggggaagcggggaggacagaactcttgatgaaaactggtgccagactaaatcagagacgccgtgaaagtggcaagaggcagggaggagaatcgactttgcaggacctgttatgcgttacggctttttctgtgtgaacacatcctattcctcacagcagttcagtgtagtaggcttattagtcacattttacaggtgcggtaactgaaattcagagggctgaagtcatttaggatccacacctaacaagaagctgaaattaaaacccaagggttacagatggaatgttttatatccccctccccaaattcctatgttgaaggcctaacttttagcatctgaataatggtgtttggagatggggcctttgagaggtaattagggctaaatatagtgatgagggtgaggcctgcgtgattggaattagtgccctcataagaggagaaagccgggcacggtggctcacgcctgttatccctgcactttgggcggctgaggtgggcagatcacctgaggtcgggagttggagactatcctcctgaccaacatagagaaaccccatctctactaaaaacacaaaaaaattagccaggcgtggtggcgcatccctgtaatcccagctactcaggtggctggggcaggggaatcgcttgaacctggcaggcggaggttgtggtgagcagagatagcgccattgcactccagcctgggcaataagagcgaaactctgtctcaataaataaataaataaataaataaataaataaataaataaataaataaataataaatgcagaggaggaagagcgcgcatgctctctctgtctcctctctctgtctctctcttcactatgtgaggatacaatgggaaggcagctgtctgcaagccagggagagatccctgatcagagcccagccatgctggcatggcaccttgatcttggacttccagccttcagaactataagaaaatgaatttttgttgttgaagccaacctgtggttggctattgtgttttgctatagcagcccaggcggactaatacaccaggttcatttgttatcaaagccccagcactttcggcagcaccctagcgcctcaggagcgccctctttggtatctgaaggaaatggacactctttgcctaggttcccatgtggctcaatagaaaaatagtacaaagagcccttagaaaagttcctatggtcccaggattgtgggaattgtctctgcttatttggagaaggaccctattttcaccctcttctggggcaagataaaaaggatcacaggattaaagttgggatacccaggggtggagacaaaatgacgacagagggtttgagttctacatgttcttcatccccgtagcatagggacatggacagatgggcagtgtgggctgcatgcaggccaagggcaggttggcgctgaatactggaaaatgacgacccgagctggaggacctgaagccgggcagtctgctccagctccccaagtccagcaggtgtgacggccctgtcgcccttccccttccttggcgtgggcctctcctgaggccgtccttttccaatcaccaggtttgcctgtcaagttgagccaagtaacaagacaggagtcaatttgttctccccaatagactgctcctctgtctattcccagactcccaggtgaccccattatgataatgcccagcctgactgctcttagaacaggcctgatggagaactgagagcttccttgaaatgtgaatcacagagaggctggcagcccatggctctgtcccctgctggctctggacaggagccttctgcctccccattgtcaccgctgagcgatgccatgtgcttattcatgctgcctgctgctggcagcccgggaatgtcgcatcatgccatccattcaaacaacgggctcggttctgctgacacccagggagacaggcggattcagggtgtgaagtgtgttgccatcactttggcatcccaatctgaactcagtctttagagcaggggctggttttatggtcctcaggtaggggatggtgcccccacaccagatctccataaacacacctttacataaaacccaggcagcctgactgccaagctttggtataaaaaattagcaagtcagtcagtcaactggatatttgatttaacatcaaatattttagtctttccaaatatttggatatgttaatattatgataacccaaccaaagaaatgtggtgatgcaagattgagtgtctgaataattttcaaaacagtaatattctctaccctggcaagaactccaccccacgtgcacccactagtcattgaatcaatgcaggtcgttgaagagtagttatataacacttagccaagactaaagctaaattttgagataatttaaaacacagagattaaatgtatgccacacatgataagctgttcagtttaggggattatattatccaagtgatttatagccttacacaacttactttgtgtttcgggagtgataaaatccctatacatgtctgaatctagaatgggaagctgaagagctctgggtactacaaaccccagggatcctcattcccaggcccatgctgctctgcttcttatccacaggcccatctctctctcttttttttttttttttttttttttttggcattgcttaatgatttccttttcccctccattctgtacgctgctttatatagtgcatgtccctgtagttccaggataatttattatttaattatgtaaccattacataattcttcagctttagccttcaatgttttcattgttgttaatataactgctatcaagacatgtaagttttatttatcgtttccattgaggagcaataattatgtaactctgcaattctgcaacgattatttctatttgtttaattacataactataacaatattaaacctctaaaacatttggtgatagatttatggtgaagatgctaggagacagcaataataatgatgtatcagagtaataataaaactaaataatagcattaatattaatattaatggccataacagtaataagcggcaacattaccacttgctttttgttcacactgtatttggtctctttaatagatttcttcccaaatctctgtggttaattagctatataacatttggtactcagcagtgggtgcaacttcatttccagactttacctggcaaagctgtgctttatagaacaccagatggaaccggtctcttttgtccttttttatcaggcttggagagggcagatttccttcttcctcatgtcacctggggacttccatagacaggataccctgtgttgagagacacaggtgttgtagaatcccaagaacccgagatgtgtttggaaagcagctgtcgaactgttggatgagccgttatggtggagagagcatggggtttggattccaacagatctggactgaattttggctctgccactaactgggtgaccttgagcaaattacctaacctctgtggactacaattttctgatatcaaaaaaggggataattatataatacagtaatgtctgcattgcaagactattgtgagaattaaatacaatcatgtgtgcaattacatggggtataattgatgcctgttgacagctatgttttggagctaccagttgatgagattaatgggagaacatgactcgaagttgctccttcctataaatcaccttgtcctcaccctcccaggagctcccttctcacagatgccccagagacatcataacagttaaagagagctaacctctaacacaatgagtgatcactatgtgctggacaagtcacacacatcatctgattaaatcatcacagctatcctataagggagctgtgattatttcatccaggtgaggcttgagaaccaggaaccttagaagacatgccaaagttcttgccgctcactggtagtggaacccagccggcgcttctccagttacactgtgtactccctgcaggcgcacatcctgaaagccacttaaagaatgctctgtatgagagccgtcctcctgggacaaatccactccctgcttctcctggtgcccataccaatccattctccacagagcagccagcccgatcaccttaaaatgcaaagctgatgccattattgcccttcttcaaccctccaatggctttccgttgctctgaaagtaaaaccaacctcctaaatctaaatacctttatgatttgacttctgcatatcaaactcccctcctctcactcttcattacagaccagggcgccacaccttctgaggctacgccaggttcaacccccatctctctagggcctttgcactcagtttcctcttcctggaaatctttctatcttatcatgtagtatgtattttctatcttatccgcttatgtataatctcttctaggaaaattcccctcaaagcttcatgtaaatcaacccagccccatgtcctgtattcattagtacatgtcctacttatctcatgtataacatggaccatgtatacagccatcttccttattcttctgatcatttggctttatgtcttgtgtccttcaccaaaatataatcttcatgaggccaggcaccgggcccggcttcacagtcataccccatccacagctcagcacctgcagcaaagcagacactcaggaaacatttgctcatgtcaatctaaaaagaattaatctaagtagagcgtttacttgggccaagatcgaggactgcaaccccagagcatagaatcaagaagccctgagtatacactcccattagctgcagttacaagtggattcttaaaggaaaagaagaggcagtttctgagttgattaccaataatttacattaaaataacataaactattgactagctgtacattgttctttgtatcacaaattctagggacctgaatataatgggtgaggcagctggttaggaacaaaatgactaaacaattgccctgggcatggagggggctgactgaggtcccatactcttgtctttttagacctgcatacctcacacagctcagacggcagccagctgtttctctttcctcacttaagggaagaatgaccacttgctctcatgtgtccatatatgccctttgggtttaaatagttcctgtgtgatgggaagcaaagcaggttgcattttcacttgaggagttgatgaccagcatccaagtgacatagcacccatctccagaagcttaggtctgatgctgggtgttcggggatcaggggccaggagctgagagtgcagcaggactaggctgtagtcagcccaggtgcagagggcgatgcgacagaatggcagcaaaatcagatgcaccgaggagcgagggagagccagcttgtcacctcgccacacacgggaggtacgtcaaggctgtcattataaactggtatttgagcaggaactctggggctcattcataacactgacatttccaggggtcacacagcaggccccccccttctgctgagaatctttcatttgtacaattatcaaccgcagaactcagacagagcagcctccattattccacctgtccttgagttattattattttattgaagcattttccttccttgggttatatatatgtgtgattttaaaaatataaatgacattatttatagcaaggcgttctctctcctttccactgacgattttccttttcaatcagattctcttcattcttacacatcccatttgagtcactgccacgtgagtaacggggcccgtaaatattcagccacagcctcttgatccctttcttaatcccatttttctcctcacttcaccttcactaggatatttcccgtccttttttcccagtggctttgttaccacaaccatatcttttttgctttgtcttagcgcctattttttaatgtttaaattattcactaatataaccaagtaaatgtcagttaaatatttcagtcatctctctgtgtgtgtctgcttttgtacctagaactctggacaaggcagtaagtaagtctcatgtaaggatcaacagttcaggctccagattcccgatttactaaattctcaaagacaaattacttaaccaaatatggtttcttcaaatccaaaaagagttaaacaatcttacctcataggattgttgtaagaattaaacaagaatatccatgctttggccaggcacagtggctcatgcctggaaccccagcagcttgggaggctgaggcaggaggattgcatgaggccaggagtttgaaaccagtttaggcaacatagcaagatcctgtccctacaaaaagaaaaaaagaaaatctacatgctgtggactacatatttgtgtctcccccaaatttatattgaaaccctaacccaacccccagtgggaaagtcttaggagggggactctgggaggagattaagttttgatgaggtcaagagggagaagcacccatggcaggatttgtgagtcataagaaaagacagaggttagagcaatgtgaggacacaaaggaaagaaaagcctctgcaaaccaggaaatgagtcctcgccagacacagaatccaccggcactgtgacctcaactttccagcatccagaactgtgagaaacaaatttgggaaacaaattttcttcttttaagcccctcagcctttttgctgaaccagacccatttgcccgacacatggcaagccaatccctgagccttcgagatttgcagcagagaaaggctttattcatgagacatccaagcgaggagacaggagagcaagtctcaaatccacctcccgatgggtcatttgtaaggtagttttaggataggaccaatgggatggggagtgggtgatgagaggtcatgtgttgattggctgggatggaggaaattccggtgtccatggatcaggctatttgaggaattccttttttttttaagtttttaatttttttattttttggtccatgattagagtttcagccttctgacatcaaatgttcatccattgaacacttgcaaaaacttattttttttttttttttttgagacggagtcttgctcttgtcgcccaggctggagtgcaatggtgtgatctcgactacaacctccgcctcctgggttcaagcaattctcctgcctcagcctcccaagtagctgggattataggcatgcgccaccatgcccggctaattttgtatttttagtacagacggggtttctccatgttggtcaagctggtctcgaactcccaacctcaggtgatccacctgcctcggcctctcaaagtgctgggattacaggcgtgagccactgtgcttggctgtgaaaatgtaattcaggactagtttgagctgaattcggagctgagtcttgagttacggaaaaacagcttagccagcgtcctgtgatccatacatcagggtgaaatgctatctataggatcattgcggaaactgaggtgaggcagtgcagctgagtaagcaggacagctaacaatgggtaaacaaacagctaaagtcaataactgcctagagaaacttcagctactggctacctcatcattaatggctatctggccactggttttaagcccatggtatcttgttatagcaacatgaactaggtgtcacgtaaaatgcttcgcaatgtcttgatacatgggaactctattgttattattattcgttgctatagcaaaagtggaagcatttatgccaccaatagcaccagtagagagtaagccatgacttctaatccgtgggtccagagtccaggccagtgtagactggacaaataatatgccctagacatttttgtattacttttgaaaatgtgcagttgccattatgtttaatagtataaaatgatttaagtgctattgatattatcagataatagtaaaccttaataggggaggtatagggtcttcatgtctgtaaaagcaggtaaacattgacctgaattaccatcaagtatgaagaccaggcatagagcatgtgctgcaggcagttccctcccagggcaacaggctattaagcatccattggcttcttttctgatgcccctgcacttacctcacagagattatctcctaaggttttcctaggtttaacattttattcccacctcaaaatccattactttgttttcctccattctttcagttcttattttattctctaatgatttggttttctcatttttttttgaggctaaaatatctcctactgaagctactctttcaattagggagaaaagcactcaaagcctcttcaagcttctgcctctgaaactgctagcagggaaactccagtgcaaaaagatgagagtggatgcaaacagggaggaaagaaaaagaaactaaagaacaaagaaggaaaataagtgttcatgaggaactaattattctggtatttataaagaagttattgtttcgtttccttttttttctggaagatcaaaatatgtgtatctcattaatcacagacatttggataatgctgtcctgcatgagctccacacaatcctgcctgtggagcagatagcatgagctcgcttttacagacgaggcaaccgggagattcagagcattggtgagaagcacacaaggcggcacagccagtgacttggatcaaggcctttggtgtcaaatgctgtgctttttccacctctccttgagggaaggcttgaggagaaagaagcacttagcacacatctctgcctgcatattccaaaccaatggagaaacacaccaggaagccacatgaaggatgacaacatcagctttgccgctggtaatgaatagtatctattccaggcccttctttcattggcaggctgctcgccaccttttgcctgagccctggacctcacatgctcaggaagtcccccaggctgaccagtcaggcagatctctccttccctctgaagaagagccagtgagagggagaagagggccagtgtatgtttccaactcacattctttcactgacataggagggctgatcaacaggttcctcccaaaccatccatgttactgttttgtgtgctcatttgttttattaaatcctttatccagctaaccaggtagcaggattctagtcactcgatttgcctgtcccctgacagaggagaccagaagtccccgctgagcagcccagacctttgctttcttctccttttacaaaaaaggtggaaaactcagggtgttaatgtcaaagggaagacgaggagctgtagctctagacctagtgtaggcttagagagctggagtcatcagcacagttgactttgtctcttccttctatcagccacaaaagtactcacatttcaaatgacaaaacacaagtctcaggcttccaagagcagtcacttcagctatcctgcctgagttcttaggcaagtctgagaggaattaggtgtttcctttccaggcaccagggttatgaccacttcagagccttgccttcactgagttataaaatttttttaataagaaatgtctggtaaattaaatcaacagtctgttgatgaagatgatagctcccacgtgcagaaatccctaaattctgagcttcacgaaactgagctagatctgtttgaagtcttccattgtttttttctctctcccagttgggaacactggcacttcccgaatttgctttacagtttcaacgtcagcctcgttagcatcaccaccagcttcctcactctcatttgccactgtttcttgagtcaactggatcagaaacatcaatcattgaacagacaccctatgcgtctgtccctgttttcaaagtctgcagcttttggtgtggtgctgttgctctttctgctgctcttctgtgacccaaacagtggttttttgcagatcttcagattcaggatgatgtcgcctttcacatttaccgtagcactggtgactcacaagaaaagtcctctaagcatatgcctagaaaaacttgagatccacctctcagaatgagctgtaaaatgcaaacaccacaaccgtaaaacttataaaaaaaaagttcggccataaaaaaaatatagtctcctgatccatggcatcttggaaattctcaaactcctgcctccatctcaccataaagcttttatcaattatgttattcttgttcatgactgcagtaaaatgcagtttggtttttatgcaattctgtaagtgtactgctggatgggaaggtctcaggctttgtgctttgttctgtgtccattacacagatgataggtttggaaatgaagatgccagggttttagtcataattgtcacagaatatgtgacagaatattgtggctaataccacaatctattcaggtacaccattcaggatttaagggagcatgttctgggccttaatcatcttcatcatctgattaaacccagtagcagcttaaggttaccaggcctcctttgggcccaaatctgtattttagagtcagaaattttcagtattttcaagaacggtgaagctgtgattgaatcactaaaagtgattgtctcagatccagccatgccaagcaccagctgtgtacacactggatctcagtgttctcctcctcagaggtcttccttagctcctcctctctcctgtggaacacacttggagctctgtgaccaggagggagtacagtatagagcctgatccctgcatttctgagacagtcaggttgtttctctttgatttaaaatgatatcagaagaaatttaacagtctattggtagtagtgtgaaatagtacatgctttatgaagaagtctggatgaaacatgacaagctgaattggccccatcgtgagaagacgtcatccataattcccaggattttttccccttcctttttctatcttctgatgccattttcaaatctatttttcattattcctcccaacctaatcccaagtttcactgttgtttgtttatgttgcttttctactgccatttaacttaaaagttattgaatttctactatattttgagctcatgctagttgctgattatcaagctcctgatttgagtagacacagtctctgccctcagggagcttgtgatctgaagagactgtgtatgcatgcatattttctagccacaatagacatggggatataacacacgttcattgttatagagtataggaggccgaattctaagataaccctctagtccatccgcctacccctgtatacaccctgtataatctccccaacttgaatgtgggaggcaccaacaagcgtcatgagatatcacccctgtgactagattcctaatcaattgcctttaatcaaaaaggagattatcctgggtgggcctgacctaatcaggtcaaccctgttaaaggggaggtatcagagagaccttcttctgctggcctggaagcagcctatgggaaaggaccacatgtctagaactgaaggacaaccagcaagaaaacaggacttcagccttgcaggtgcaaggaaatagttctgccagcagccagagggagcttgaaagcagatacttccttacttccaagtctctagatgaagatgtggccagctcacaccttgactttagccttgtgagattctgaggagaccccccagcctgaacataaggactcctaatccatggaaactgcgagataacaaatttgtgttgctttaagatgttaaattggtgataatttgttttgcaacagtataaagttcacacatggaatttaaaccaaatgcaagaggatgagaaaggaggaaacaggtcattctatctgagaagtggtggaaatatgatagagaggaaggcattatctgaggtgagacttaactgatgagtagacattttttagacagacaaagagaagagacatttatggctgcgacatcatccacaatatgtttgtagaactgatgtactgacataaataaaggataggcattttaatctgtccctgatgttagaacaaaatatcatagactgagtatcttataaataaaagaaattcatttctcatagttctggaagctgggaagtccaaggtcaaggtgccagcaggtcagtgtctggtgaggacctggtctctgcttccaaggtggtgccttgttgctgtgtcctccggaggggccaaggctgtgtcctcacatggtgtaagggatggtggggcaaaaaagggccaagcacctttctgaaggctcttttggagccctcgtgaactaatcacatccccaaagccccactgcttaataccattattttggtgattatgtttcaatacatacagttgagagtgacacatatgttcaaaccatagcactagggtgcctatacttacatttctttttccttaagacaacagttttaaaattttatttatgaactttccgtgggtaaagaagtgaagtgagcctttcttagtttcccatatcattaatggcccccatatatgttgttgtccagcattttctgtagctccttttcagcattagtctcatattgatgcatttttaaatcagaaataaattatgaatgcacacagcaaaaagttgaatggatttctttgccatatcttttaacattttcttttcttcctgactgcttacattctggtatggctaatacgttgcttcaaactcataacctagccatctaaagtcacatactgtcttgtgaaatacaatgtctttatccaggagtggttagtaacctgactgtgttccaacttcattttgccctgcactttcacttagggtgactaagcagcgcatgatcttccatcgttttattgcatggtctgggtccttgtgcatcattctgtcagctacgactgctggactcactgtacaattcccacaagtgtgttaaagcccaaatccaatagtgttaaggacctccaattcctgacatcttccgtcgtctcatttttaaacaaaatagtcaatagccttggtgtcattgactttgccttcctctgttgttccaatgttgttccaaaattgctctgaaaccttccaccaagcttacagtacttaatcatcagcgaattcttcataaatgtcagtgggaaacccatcagctctaagagattttctttatctccatagcctttatgaggcttcttacccctcaggcactgatttttgccccttacaacctcaatttcttcttcttagtagcatctcaggcagaacagggatgggcttctccatttcttctttgctcctcatgtctgtcttccccttggggaagcccattcttatcattcacagtaatccttgacttttcacacaattaacatactttcttagggagctggaaaaatcactgtcaaaagtccctttgccataattctttttggtaaaatagtacacatttttgtattgttttctttctgaaatagtcttctccactgtgtatcattccacctaggtcaattgagcatctatttgtcagagatttattgatggcatgcggaatacatgaggagtgtaagattttttggctccaaatataatttttctccttgttttaggcaattgtgaggtcacaaaaaattgtagaaagagtttattctacaacttgccattaagggatgccctcagagcagttctctttgtggtttccaggaatgcattaagcttaaggtgaagataatctgcctcagcattcaatataagagtatcattaacactctgagtgctgctgtgggctcttcctagatgcatgtgcctttcagaacagactgggatttcagaactgctgagagaacctcaggctgctggagaaattctgtaatgtctcatgagaaacagagtgcacaagctcctttcccctttctcttcctctccgttccctgcagtggtttccctaggttcagcaaatgcacatctctctgggagttttgtttccatgggagttgaaaataagcactccaaaggtgaatgctcgcccagtttacagtcagtatgaccattgcttctattcaaatatccctagataataataattcagcacagggctcctccaggggaatgctgtgcttccagcaaatctgtaatttacaaaacagtcacctgagttttaaaaagataatttgaaaatattcagaaaaacgatgcctgtctcccacaaatgttagatttggagcattacaactcatctgtgcttggtgcctttatttagtttacttggtttagtttacttattagttcatttgttttagtttaataactaataataactacttattcacttggttttcgtttttgctgtgcatatcacttgcttaacaaggaaaaagattatgtgtctccttcctggaagtggacttctctgccaggcaaagatgagatgacattttgggtgatttttagacagcagaaatcaacatgactaaaaatttggtcattttagttgctcttatttaataaatccccaaagagaaaacattagttcctgcatgtccctcttccctctgttgacaccatttataggtagtcatttagggaacatctcttctggatactagttttgataatttcttccatccaaaaagagtagtccttaagcaattcttggtatatggtatatcctgtagctctgtctgacttaggaacagcatgaaaaaaattgtatatacttggtatatttattctaggagcttttaattcaagatgtacagtaatgtaagaaactcagtcaacatgatatctatggctaaatgaaggcttctctgccaaaacacaatggtaatgtgagattaatgtggagccggtgcaagttgggagagtagctatgcataataagtgactatttgggatagtgcatttattagggcagactaagtgctttgacaaagataacccacactgctcattgtgtttccagcatccacgggccaggaaactcaacagaagttctttcctggaacaactgtggggcctgctttatttctctgcatatatctctggcccctgtgtctctctctgtcaaggtgatgctgagaaccttgaggctatctggaataataatcctgtgtggaagctccactcttaattaggttcaaactacaaagctctgccactttgcttaactgagaaattttagtagacatttgtggctcaaaggcttttaaagtcttatttcacattgtcctccagaatctgtttccaacctgtgcgactccaaatttctgatactttaattctgtttctttttgtgtgcaaaccagctaattttatcttgaactcatctttcttgcaataccttgccaaacacagtgagggaagagcaacatatgctagcattctggctctttcctgctacttccctgagaagcacgggctcagtaggcacttggtctgccttccacgttaacaagggtgacagttttaccaaatgtttcactacagcagagcagcaatttccagcttgctaggcctgtttcctcagtgtctaccacaaaactgctaagctggtgtcagatattttagacatttttttttttttgtcagcatctacttcaaggctttgacttctgtattggttagggtaacgttagctgctgcaacaaacaaattccaacattgaatggcacaacaaaacaaatgtttatttttccctatacataaattccagtgcaagagttcctggagcaagaaaagatagatttccgccacatggtgtcacagggatccaggttccttctgtcctgtgactccactatgcactagagcctttgaatcctcagcatccagccagccaaagaaggaagagtaggaggcttttgtgtaccagccttgaaggtggtacatattacttctgctcgatcccattttgctagaacttagtaaaggctataccaatgtataagagacaggtgaagttgtctctgggcagctgcttctcatcaacaacagtgcatatactacaaaaggttgaatcatgaattttgggtggcagaaagttgcttctgccatacatagaaaaggtgttggaagaaattattgatttctattattgaaggaagtactcagtgtatttatatatattgcatataacatctccaccaatgcccactactgccttggtagagtgccctctctttgcaagcctgagctagacaccttggtttgggaagggttaatgttaaggagaaatactaggctcaataaagaaagcacatacattcacacgcatgcagatacccatacacatacatcttaaatgaagatctttattgtggacaatatgattccaattatattcatttttattatataagggatatttttaaagttgtgagatacataaaccacgtgtttctctcccaatttttatgagtacatcccccccaccccccaccccatgcaatcctagtgtgagtctacctggaagcatgcagtgccaggctcttctctaatgctaccattcttagcatgagtttgataactgctctccatggcatgctttctaattctgcgttcttgtttcagaaaaatggcataacaaagccccaaaccccaaaattttaccctcattttttcaaaaatgacttccaaaagtattgttagtaatacagcaagttccctctagtttccttgcaaattgacatactgagatattacagttgctatgaagtttctggtgactttaaaaacttttacattacattagtgtaatgacagggtttatctacagcttatgactgtgaatgcttcagcatacatttccataaatagaaacactgtagattttacattaatcataaagggaattgataattgcctatgggagtttttagctatgagcaaaaatgtttgacccaattatgcttgcatggtgagggacaaatatattgaattatgatgcatagatcattggtggatttcagggaaggaaagtaactatcccaagggaataatccagaagtgagcaagtgtttacaactcaaaaactgataagactgtcattacatcaactgtcacagctcagaagtttaaccccactcaatacataggatgaaaaggtaaacctgggctgttcaataatgttaagcacctgtcattcaaatcccaatatccagatgggtgtgttgagaagaaacatgcaacctctacatgtagctgaaacccgtggtgatagttggtgactggttttccaaaaggttaaactgaagctagtgccacaggcttccacatttgaatgatttgccaaaagataagcttccagtcttaattcaaaagccatcaactacattctttgaatgttgcttaagattctatttggtgttgataaagttgaatgagaaacttaaaagtgatttatcagatttaatttcaaagtaaagtcccttttcacatacttaaccattcaaagcctgaggattttttgcttgctattatgaattgaatggaagtcaactacaagagagaagaaagatcaatcactttagtagtcatcaggaattctgcttctaccacaaattacaagttcctcagattctattttcatttataaaatgaagaatttaaacataaaaactagctctagcatatagtgatggtaaaagtcatatgcagtacaggaactttagtctcattctatcttcctcttcaatattgactctctttcccattttctcaaaacttctgatgactagctcaattttccggttaactattgtagtagggagaactctaagatggcatccaagatcttcaccctcaaatgtacacaccagtgtactacttgatctttgagtgaaggccgaaactgtgaataggatgggatagtctatcatagctccctgggctaggttatgccacatggcaaatgccggtgggatagtcacccctgtgattacatcacattatataagttttcatcatagtaaactggggagcaataggaagtcagtgaggcaaaatccttctgtcctggaaggaagcaaacggcaccattgtggactgccgatgggggctacgtggccaacaaccacatcacagtaagcatctaggaactgggagtggccccagctgacagctcataagatcacaaggacctcagttccaacgccacagaaaatgaattctgcccacacaaatgagcctggaagaggattcgaaacctcaggtgagaatctcagccctggctgacaccttgatttcagcttgggcagatttagagcagagaactcaggaaattatgacccataacaactatgagataataaatgtgtgctgttttaaactgcctagtcggtgataattcattatgcagctgtagaaaactaatataactatatacaacatttccaatcaatattcaactcattcttgtatttcattgtatctttattccttcttgcaaaaaatattttttaagcaccagcaatatgatagatggtgtccttgccaccaatgatataacatagtctgtgccgtttatttttcgtagactagtagggaaaataattatataaacaaaatagattaagaaagtatcacatgtgctctaagagtagcttctacctgagatagccagggcacaaggaggaagtcagtcagtctaccagtggagcaggggagacacaagaaaagattctactataagctgcaactcagggcaagtgttgaaagacaagcagatgttctttaggtggagagggaatagaagagcaatctgaaaagaaaagctataggagtaatcacacagagatgtttttctaggaactgtaagtgggtaagaatggtgaaaaggatgggagtgcaggctagaggtgattgggattaggaagacataccttagagaagcactactccaagtgtcatccaagggggaacagcacgggtgtcaccagggaaagtgttggatgtacagaatctcagtcccacccactcccctatatcagaatctctgccttcaccacatccctggggcgttcacaggaactttcataggtttcagtgtcttgaggctagtgaatctggatgctgtctttcagagaaagggaagataatgaaatggtttaagttggataacaacatagccaaatccatcttttagaaatagcaggaataaggaggggaggtgaatttgtgaggcacgaaataggaagcagagaaaccagttagatcctgattctaatgtccagacaagagagccacgcagggacagcaggtgcagagaggagtgcataaggaagtcagatcttcatgaggcagatcatccagggtgtgaacgatagacgagacgacctcactgagggacaatggcttatttaagaagcatcttagctgtctgcttgagactatgggtcattctcaaatgtaggagttttattttggacatgtggagtttgagatgcctgtaggactgaggtaagatatttaggaagaagtgggtgtatgggtctgagatcactaggagaatctggttcattaattcaaataccaaggacttgcagggtttatcagaagacatgagagcgaatgagtgcttccaagctattaatttctattcaatgttgttttctaatatgcttgacacttctatactcaagatttccatggcacttgattttccctcttccaccttattaaaagaatatttatgaaaacacaaaaatatgtccaatgttaaaaagtttgaagtggactaagtacacgaagcagcctttagaatctaatgtgagagggtccttatggttcccaggtggaaggtgaggctgtgatggaggaaaatccacccacccattaaatttcatataccttctccttgatggttaaatacaaagaaagaactaataaccataaggaacttgtgaaaagatttgctggaatctgtgtcgtacttacaagatgaataccattacacctaaaatgtaacggaggaaacacaatttttaaaaaattatactacagaaaccagaagacaactttagaaagtatcttgtacataattttcataaaggcaaaaaaatcactaactatgaaaaagagataaaatagaaaatgatgtaactgcagactgattttaaaagagagctctattatatcaagaaatatttcaggaaaccataaatgcaagaaaggagtataagacagaaatagcactctaaaatttaatcagcaatgcagagaacacatttgagaatttttttcaaaattaaaagataaagaacaaagaagtaaaaaaaaattaatgtagaaagcataaaagttttgaactcaggagaatttaagttcataaaaacaaatcatactgaataggagtaatattcaaataataaataattgtttcctcagttgaataaacattttaatttacagatagaaaacattcaggaaacaccaggtgaaataaatgaaaaaaaaagaacatgataatatatgaactcaacttaaatatgctatatactaatttattattgttaaatgtgtgccaccatagcaaatactaagtaatatactgttgaattaattaatggaatatagcataaaataaacatcaaaaggccaatagtgaggtttccagaattttgcttctggcaatgagagattagtaccaaattcccttcagctgtaagcaactagaaactggcacaaaatatatgaatcattgcttttcagatattggatgacagtcaatgaagacagtgatccttgaggaaataaaacagatgaagtgaagcccatggaccactctgcactctgcctagatgcactctctggaagctcattatcttgctgagttaaatagaaatcagccttcagtgaggctgaggagactgcagaaggaggtataaaggactacaaaaattgacacagaggtcttctagactttattggtgaacacaaagaggcattagcacagggtgaacctgcacacagcatggtggaggactcctggaattcattaatggtttatttgagttctgaccagctagagtggagagattttattgagcaagtgggacattcagtgaagacaaaagaagggttataatacaggaaaacgtttattatttgaaaagatcaggaagattaataaatcccaaaagactgcttaataaaatacagaagaggtgacaattagtgaaacagagatgaaagaaaagctatcactatcacttctacagacattaaaaggataataaggttgtataataaaaactgtaggtcaacaaatgtcaaattagatgtaatgaaaaaattccccacaaaccaaaaattaccaaaatagtcacaagaataaatagaatacatatataatgtttccacaaaaaaaaacaactctaggtctgcatggcttcactggttaattatataaaatatttaaggaggaaataataacaaatctatagaaataatttcagaaaatagagaaaaaagaaacacttcttagtttattttatgaggccattattacacttatatcaaaatcaaagaaattacaaggaaaaaagctctattaatcaaaattatgcataaacatggacacaacagtccttgacaatgtattacacaattaaatccagaaatatataaataggatagtttatgacaagtatattttatcctaggaattcaaggttggtttaacatttaaaaagcaattgatataactgtatattaataaaatgaaggggacaaaaattaatagaagtggtaaagcatttgataaattcaacattcctttgtgatacaaactctcagcaaactaagtaaagaaagtaactttctcaacctgataattgtaatctacagaaaacctatagctattatcatacttcgtagaggacggaatgaatactttccctctaagaataagaacgagaaaagaatatctgctctcaccactgctatctgttattaagctggaggtcctagctattgcaataatgtaagaaaatgaataatatgtatacagattggaaagaaaagtgttaaattctctgaatttatgagtggcatgattgtgtacatagaaaattcaaagcaatctacagaaacacaaatattaataggtgaatttaacaagggtttatgattacaataccaatatatagaaatcaagtttatttctgtatattggcaaccaattggaaaatttaattaaaaatcctatttacagggtcatccaaaagcataaaatatttagaaatgaatttttaaagatatgtataagactgttcacttgaaactacaaaacattgctgaggaaatataaaggaaatctcaataaaaaagaagagacagtgcgccatatccatgggttggaagatgatagttttaaggtgtcagtgcttcccaaactatacatatgctcaacaaaattctaatcaaaatctcagcatatttttggggaggaattgacagtctgactcaaaatagccatacacatatgttccactgattttcagcaaagaggccatgatgattaagtggggaaaaagattctcttttcaatgtatggtgctcaaaaaactgaatatttatatggaagagaataaacatccattcttacctcatgtcatacacaaaaactcaactcaaaatgaaccacagttcatataagagcaataattatacaacttctagaaaaaaaatacgagaaaatatgtgttggccttgagtaggtaaatatttcttagaccgaaggcaaaaaggacaaactgaagaagaaaacttaagcagttaaacctcatccaaactgaaatcttttactctgtggatgtgtaaagaaaatgacaagataagacacaaaatggaagacaatattatcaatgcatttatttggcaaatgacttgtaaccataatctataaaacagtcataacaactcaatcctgagaagacaaattatccgttttttaaaataagtaaaatgtttaaacaaatacttcaccaaaggccaatgagaaagatcaataatcacatgaaaagaggctcaacatcaagcaagtcaaaaagaaaatgcaaactgaaaccacaatgaacgcctcttcccacattctaggataaataaaaacttaaaagactgaaaaagaaagtgttaaggaggatgtgggaacaagtcaaattctcatatattgctggtaggaatgtcaaaattgtacaaccattttggaaaataatttggtggtttcttctaaaaattaaccatacaataacatatgacctagtaatctctatgtatttatataagaaaacgttcatagcagtttcatttatgatagccaaaactaatactaattcaaatgctcatcagaaagtgaatagattaaaatttatattagattcatacagtgaaattctattgagtaatgagtaatgaaaagaaactttgatacacaaagcagaaggaataaattcaaaaaacattatgctgagccaaaaaaactagatctgaaaaagaacacatatgattgcaatcatgtaaagctctagaataggtgaaaccaaactgtagcaagagaaagcaaagccacatttcctggggtccgggcttgggggttaggggttgctgaaatacactggagagggacatgtgttgagaatgttcaacagtggtgattacagtggtggtgacacacacagacacatatacacacatatgtgtaattgtacactttcaaactgcacactttaagtggtcgcattttatcacgtgcaaaatacaccttaataaagttggttagagagttcacaatcgttctaaatctatctttttagctttttccatattttataaattctttctccaaatacctgtattaatattttcatcagtgataacctaataaaaatatttttatatatttttattgctcatgtcaaagaccccacgtaagcactctttgcaagcaacttaatcaactctacctgatataatagtaatgtataaaaactacagtctttaaaatcttccttactgtgtgtgtgcgtgtgtgtgtctgtgtgggtacacatattggtaggttttcttttactgatgacatactggactcatcattttaaaaagaaaagaaaacctgcaagacacaactagcctttgcatgtataattttccccatcagtcttgctgaagctgacccgtacagcttctggccttgtaacatatctgggtgtgggcagtggcaggtgggagcctggcaagccaaccacaggcagagtgaaaacacctgaaagcacctgagccatggtgaggccagcgtcggatcagaagcagaaatgaagacgatatgaattttaacgagttaaacatagtgcaaaatgagacagagataaaaatagatcagatagagtctcaaaagtgagattcaattcttctaaatgtccgagaaagctaattctacaattggacccttggcagctaaggctaacaaagaaattatgtagtattacttaattatccttttccactgaaagaaagagcatgctggttttctgaaagaaaatatgttcctggagaagaactcaagacagaatttactatgaggataatgaatctttggtaacgaggtaaatggtctcttcaagagaattttgaacaaggcagaaatcttgctcaaagacactgttcttgtacccaagactgcagaggtgagactaagatagagacctgatgaagatggctaatttgggacacaaggttacggtaattttttaatctgataacctaacaatacaatgcaagtaggactaggaggggacagaatgtgctttataaagactgatatgcctattaaacagtctgtcaaatatcagaaatattaggatagcctttggcgagtgccggggctcagacggtttacgattgaattttctaacaggtacctgtagtgcaggcgttctatgttgctgtgatggccatatgctttagataccagatggaaaggaaggtgtcattctgctggaaagttgaggagacagacagaaggctatctcacttcagagcaggtggagacagcagggtttctttcagggagagccagcattttcttcggggaagagatttctatcttctaaagtacttaagcatgtgtttgcttaagacctcaaagttctaaacaacctcggaaaaaaatggcattagcttgaaaatttttaagacaggtcttggagctgaccaccttatccatcaaaggaacttcagcattcattctgtggaatatctatctttagacagactacactttgatgtgttttgccaagatgactaagttacaagaggagctaaaaacgtcacctgtgcattggggttatatctgttttaccatgtttacgctcatgaatgccttacaaattctgtgtttgcagtttgggtaagagtaatgcagagatgctcaagttcacattcttcttgagaacaattactaaagtcaacagaggttggaggaaagcaattgcttaattcagctttatttaatgacccagatgattactgagcaccctccaagataaagaaagagtaaaatacagaagctgtagggaattttttttaaaatagtaaaacccagtgccagagagcttgacatatacagccatgattgtgtgattgatcttttagatttatcgtgctatttaaatatgaaaatagaactagaaaacatgttaaagtcaagctccaattgatagcatttaaattagaggttgtacctgcaggaggctattcccatcatcaacactggttagcagaagggtttagaagcacgtctgaagaggcattcttagactaggctctgttggctacaggctattcctgtccattgagctaaacactagtttaatgagcactgaaaataggcttaactttaattatcatgtgttttctttcatgtgaggaaattttataagtggaattatataaactctggcttcctataaacatccatgcatatgctattttgtgagcattagtattactaaatcttcacttgctattgtgtttgataactaagaccaaatgtttgaaaattaactacaaaaactaaactcattaaggtaaacagattactctttaaagttcccaagttaaaatagttctcaacccattctaactttcagtaaccttttgattctgttacagttttacttagagtccctctacccttgggataaaacaacagtttattatgatataatattttatagttaattgttcaattctattactaatatttaaatgatatatttgtgcctatacacaaaaatgaaaatacttcacagtatttttattagattttaatattaacataatacaagattattattattattattattattattttatttttattttttttgagacagagtctctctctggcgccaggctggagtgcagtggcatgagctcggctctctgcagcctcctcctcctcctcctgggttcaagcgattctcctgcctcagcctttggagtagctggggctacaggcacgcagcaccatgcccagctaatttttgtatttttagtacagacggggtttcaccatgttggccaggatggtctggatctcttgacctcgtgatccacccaccttggcctcccaaagtgctgggattgggtgtgagccacggcgctcggccaatactggatttttaaaccaaatttggaagttttattgttttctatgccatgggatagtttaaatattataggaatttaaaggttagttgaacctcagctgtgaacccttctggtcctcgtgcctactaaaaatgacaggtgcttaagttgatctgttcagcgtttctactttctagatgaattttggtagttagcattttgctaggatagcatccatttttttctatgttgttattgagtttcacatagtattcctataaaacacttcaatctgtctggactcagtgttttgttgtgattgtttcttttctcttttcttagtcctaattgtgtctataattgttttctctgttttcttcttcatcagactcacaaaggacttttcaatgaattggcatttgaatttcctcccctgctctttttaatttgttcctttgtttgtttttaattcttgatcatatccatgttaagtccgtcattttaggtctgtttaattattttgttgttctttctgtaatttcttaagatgagttactatattcttcaatttatctatcttcttactgttagttttttatgaactatgccaacttaaaaaaatttattactctttcccattataattatttttgtcagatccttcctgccttatggatcatttcattttatataattgcctatatattatatagtatatggagatttatacctaatacatcttaatctttatccatttggtggctctcttttgtatttttatttgtaattttaaaaatttattttaattttttgactgagtcattggtagatattcttttgtatttttagaccttccattctacgttattaacagttatagtcttccgtgctgacacaatcagacgtgttttctctctattgtttgaaaacaatataaaatataacttcctcaccaagactgactttcacccatcaaaatgcccgatttcctttcctatcctccctcattagatgtaatatttgggaaatgtttcttcctcctccccacttacctcacagcaaatctttggtattttttagggtgcttctcccactttcttttcttccaacttaaagttctagttataatgtagtgttctaggcagcatttagacttttttggggtccatgctctccttttcaagggtgggtttgaacacattctcgggcaatctctccgtggccacctgggaaggaagataggcgcttacttctcaccctcgtttcttcttcctcacccctccctccctgcggtctctgttctggctcattacccgtttgctgagctgttcttgagtgtttccttccagggggccggggtctctgcgtggagcactctctgaatgagtgtcgactctcgaaatctttcttctgctctgacaagtgaatgacatcttgaccgaatacaggagtctagtattgcagtccttttctctcagtcatcgctggatgttatgtttcttctagcttcctgtgttgccgatgattctatttctttttcctttgtaagtgactggttccctctacacaagagttcctaaagttatatagttatatagaaatcggaaatttcattgcagttaagagtattttaaaaagacacatgcccagtgaaatagagatgctgaagatgacaaagtgaatttaaaaataataataataataataaagaagaagatttaaggggagctcagaagtattgctgcagttaaaagaaaaaaagaagaaggaagaagaagaagaagaagaagaagaagaagaagaagaagaagaagaagaagaagaagaagaggaaagaagaagaagaagaagaagaagaagaagaagaagaagaagaagaagaagaaaagaagaagaagaagaagaagaagaagaagaagaagaagaagaagaagaagaagaagaagaagaagaagaagaagaagaagaagaagaaaagaagaagaagaagaagaagaagaagaagaaagcatgggccgggggcggtggctctcgcctgtaatcccagcactttgggaggtggaggcaggcggatcacgaggtcaggagatcaagaccatcctggctaacacggtgaaaccccgtctctactaaaaatacaaaaaattagccgggtgtggtggcgggagcctgtagtcccagctacacgggaggctgaggcaggagaatggcgtgaacccgggaggcggagcttgcagtgagccgagatcgcgccactgcactccagcctgggcgacagagcgagactccgtctcaaaaaaaaaaaaaaaaaaaaaaaaaagcatgcttctcaatgaagaaaacaacacattttgtagttaaatgaaaacagaaagtgtcactgttgagactcaaattagtggcctacaataaaaagtgtaaattatatttcaaagtacagattaaaaggataagaagatggcaattatgaatatggacatagaagtttaatatgcaaataaaaattatttcatatggagaaaaagattgataagatcaaggtaaaatccgagcaaatcatagaaaattatttgggcaagctgaagagagacctgagcctcagtgggtttgctctattccaggatagactgatgagaaaaacacatgccattttgcacgtgttttattgcaccatcatattgcaatgacatttctgaatcttgataatctattatttttcttcaatacattgggattcaggtaatgttgtgaaattactacataggtgaggggagataaagtggtctcttactctgggtggtataaaaatagtaaagtctcccctactgacacacatttccttttaccctcatggcctcagaggcaagaaggatgcatcccatgtattcagccccttctaggcttcctggtcatttgagagagtcaggccattcaaagtaggcaaatgttgcaatgtcaaccttcacctggggtcctcacagactgttgtggtataggcttgccttaagattccccactttctggtcctggacaaaaataccctgtggctaatatctagtcctcttacagctcacaagacagtaagtcctgtgggaattctctccatagcaatttcagcagttactagcatcagaattgccctttggtcccagatgtgtgagtcaagaggcacagattaaagttgcaagtaaggagaaaagagaaacattcagatctgcactgcaaagtttgttttaatcattcggaaatatctttggagcaatctctatcacactcagaatacaaatagcagcaataactactactaattaatattgatgctttaaggtttacaaaacacatttgatctttgaagtcaccctgtgttatgggtgttattgtgagaaaataagttcaaagtggtttagtgcggtgcctatgtgtacaagttggcaaaaaacaacaacaaaactaaggctttgtctctccaagtccaatgatttttgcataatcattttaacaagcaagaggaggtcaaagctagtttcagcctactgactttaatctaagtgtataataaagtagtaaggtgtatgataaagcaaacaactcccaacatcaagatgaataaggtacttgcagatattctggcaaaggaggagttattttctttaatccaatgcagtgttatctttctaaagccaaggacagtatcatttttgcttgcttgtttttgtctgtgtttatccttttattaaatgtaatgagtgagtgtaagtaatacatacatcaatatatgcatacagagaaatccacatatcacggatgtacaacttataaattttcctaactgaatacaactatgtaactaccacccaggtcaagcaacataacatcactcacatctgagaaggcccctcaggctccttcacaatctttgcctcccctgacaaagacagctatgaccctgacttccaacagtttagaagacttttgcaaggacagtcttacttgccattctacacacatcatgtaacacagaatatctgctgtgtttgataagtatctgtcggatgtgtgaatgaatgaatgcatcagtgaataactgagtgagtcagtgattaaatgaagagacccttagaagacgaagtgttaccaaatatggctttggagggagagtttgaagtgaggttctgagcttagctggttgtttaatttgaggcaagttgtttaacctcattgagactcaggttacttatctataaatagaaacagcagtgtctatcccataggactgtttgtcataagcctaaggttaatgtatatagaaccagtgcctggcacctgtaggctataactgatacgtaataattgttattacaagagagggatccagctatctgcatttggggcatgaataacctccttaccctgatcttttctgttttaaataactttcaaatcctttcagaaatgatacaattttaatacagtggaaaatgtgtaaccatacccagcatatcctagcaaaaataaaaacagtcatgtacctcataaatatatacctactatctacccataaaaaataaaaattaaaaaaacacacaaaaataaacaacaaatgcaaaagaaacaaacagaaaatatttggtgggtaatgcaactggttcgtgtcctggagtaagtttgggtggagatctggttttctgttcctttgcctgcagtgcctgctggtgatagtatgttctcagatttctgacactccaggtttgaattattcctggtggtggtgactcaccagccaagccgggttggatttaagctgggatagatcaatcaaattcccactctacaccttgggtgttcgagtcccacaataatcaaacctcatgtgatctctaccactacagcccatattcttcatctctatttaatgccatcaccacctcttcataaaactccacctttctggccaccacccccaacctcattgcttcctccctctgtggcttagacggtgatgctgagatgtccataacaaatgggcacggtgccttcacactgctctttctgaaacgccacgtgcagccccttgatctttgaattggtattgctttcatctggctttccagttaagaagagtggcaattcgtttcatatgtaagaagaaagactgggctttaaaaaggtttgttttctgtagatctagtcaaatatttctttagaatataaatacttatggaagaagtcatattcacattagttaagttgcttaatttctcttactaaccggttatctctactgtaaaatggagacagtctggattggattctccagagagcagttagggaaatgcacatatggaaggtgagtggacagagtcccattaaagtgaaggccctggaaccgctccttagcgagaatcgccaacgtacttagaagggctttttagtatttccatgatcgatctacataaaaaataaaactgcaacacacgaaggactacccatgaatgtggaccaagaggtttgtagggagtctgctatgttggaagagtaattttcctattagtaataatggtaatgctactattatttggttgctatcgtttttttcattgttactattaatgataataaggacattaatttgttcagtgtctgttgaactttgtgaggtgaaagaccatctctgtctttttgtaccctatcctcagcacttaatatttagcaccagctaggttctcaggtgactcaatgactgaataaatgagagacagatacactgtgcccaatactttactgtgttatgttctttaacttgaagcaactctagcaaatagcaagcattatctccatcttacagatttttaaaactgagtagcagagatgttaaacaatttctcaaagccatagcacctatgtgtttccatcccggtcagtctgattccaagaaagtctaaacagcacttaccactgctctgtaatagttcaggtttacaaggtggaagcctcctttagaccactggaaacccctatattatcctgtcacgcttcccacctcccaccctattattttcaaaaatggggatcggcatgctagttagaggtcctggcagaagtttctggaaggcgaggttgaaaatgttgaggcctgtgcatggatctgagcatcagcatacgggctgagggccagctctaccttccagctgctgtgctgggctctgcttcaggtcatttctataccaaagaaaggtagattggaaggttctgaccatggaaccacaagaacgactagagtgctggagggattgactggtgagataagattaaaagacctcaatatttatcatttttctaagccgagactgtgggacagatgggataaccatcgacaaatatttgctaggtgtaatcacttcagactactgaactcatggacggttctccaggcagggacatgctgcttgtcagaagggaatgaagggggcttggagggtgtggagtgccacggtgcgtgctgatcctccttgacaccacctctgtgtgcagggcctgtctcgcacctctggcttgggagggtagatcatctctgcacctcccctgtgagcagtcacactgctgttttgagtacaagccaatcaccaggataaacgttttgtaatggcccaacttaaggcaatggaagaaagggacaaatccttcaacgcagtgatcctcatgtaattgatctgcaatagccattagcctaaaactcaccttccatctacatgctccgtagtttctgtgtaagcgaatgctgtcacatgaggcgtttgcctttcctccccacccgccgtttactactttgttccttgggagtcagcctaagaaagaaagaattttactccttgctgctttttacctattcattcactgagttctacaagtgcttgaataagaaatggcaatagaccgacacaaaataagtgctggatgagtgttgaatgaatgaatgaatgaatgagtagtgcatatacgggcaaaactgcaccttttagaagtcatttttaagacacagtgtcctagaatgcatctaaaagcagagatagcttgtgtaggacttagaacaatggtgagctccacacaccatgtgaaaagcattcatgtactttggaagcccctacctagattatgctacattaaagaaaaagcccaggcagaaagctgccataggtaacggcctccacagagaatatatgatggccacccttgtcactgcagggagtgttgggtaaccaaggctttggagttaggggaacctgaacccgcatgtcagtgcctctcctcactggaggggcagccttgggcaggctacagaagtactcagccgtgctccttcctggaccctgtagccaaagggggggaaaaaaacagcactagtgatgtggtctttatttaaactgttcacatcttgtttattctttactttttcattaaaagtattgtattaaagtatgcatctcaatcgctgagttttttgtcacccacttaaatttcactccagtggtgaaggcttactcacggcagcctaatcccagctctctcgtatctcttcttcttcatttgaaaaataggataatcatttcttccttatagggttgttgttaggatttaatgagagaatgcagtgcccaggcgctcctaatatatgcttaataagtgggagatgttattgttatgagctatttacttagcatcacttaaaaagggaatagtgatattttaggactgtccttaaatacactattggtataaagtcaaatgcttgatatgcagcttgtggaaatgatacctggttgcctccaagctgccctttattgctcttgtttattcgtctgtctcatagccagacactgctctgtcaggatacagcatgatgtttgcataacgggagtccccgcgagaaccctggtcccacagagtcatgggagacccttgtaggagcttgattcccatgtaggccagtacagtgccagtgcccataagttcagggcgaacagcagatatttacggcattttctttctgtgctgggcattgcctgaggtggtgacagtgtagtggttcaggtcatgatactgccttgtgggagcagttgactggggttggggggtggtgggagcacagaactctcagagtgatggaatgcctgcaccatggcaagaatgcacagggtgctcctgaaccatagagaccgcctgccttgtctagtgtggagggatcactttattggagtaagcgatgcctgagctgcagcatggaagtggttaggatattccagatgggaggaagggaaaaaggtgtttcagattgaagaagttgtgtgcaggggcaatcagctgccagccagcatgtgcatcgaggtgtaatgatcagtgccaaacaggaaagcgtaactcacactagttattttcccgggggaaatctagggaactggccacaggaagttgaaggactggaagggcaaaatgaaatatcgaagccctcctgcagctggggaaacaaaggaaaaggttaaggtggtcagaaactagaacctgtacctgtggaagaggccatgcacaggtgcggcccagccctctcaggagtagaggctgctgcctgcctggctgtgctggtgtctcaggagcacgcaggaggcaggagggtcacgcggagctgggagttgggcctctgcagaggggcattgctgctgctgctggttcctatgacggtgaatagtaggtgttgaaggaagatggaagcagaactcacttcccctggaactagtggctgctgccagtatgaagggcctttgcagggaaaatgccacaggaaccgcaggccaacacaaaggggcaagtgcctgtccccttttctgccttccacccttcttagtgaccccttctgaggagccaacaggaaaccagttgacaaagaagaaatggagtgtgtagagtcccagcctcaacatcacaaggcagcatagagagggtgcatctggagctgagagacacaggagcttatcaagaacgtgggatggcctcgacatcagcgcatgcgtaaggtgagaggctggagctggcacagggtagggccctggggaggatagcacagtaacagcagttctctgtcatgcaccaatgacggcaatgcctgatctatcaggaggatgcctccctgtcttccttcctcctagagagagtggcattaacaagtcagtgtaggagttgcatttattacacttacaaatagtcaaaagtgatcctgagcaattcattgaaaatatttagctaatgatgaaatagaaatatctttcttccttttgttttctcttagtaaagcacttaattgtttaaagactaaaggaaatattaatacttagaaggctctaataatgtaattctaatttaatgctttttagcacaaaaaagattttgactaatgtgtttagtaagtaatggttttcctgagtaatctttacagcaagtaaatgacttgagatcatttattagaaactagtgaggtatgtttttcgttgttttttccttgtggttttcaagggtgagtaaaaggacatcaataaaacagtgaaaggcagattgacaactatctctgctccacatctccatccacacattgttatagaacatttgctctaggtgggactctgtaagggggggcaggatgcagcaagccgtaaaaagtgacctggctcctgccctctaggaactgataatggaaatgaagacactgggtggacaaagagcatttgagtatgactatggcaacacatttgtttattccggatagaatcgaaggaaatatgagacaaatgggacctgtgcaaagatatgccttttcctctagttgatgacccactctgggagttgttacttacttttatgttcttttgctgatgaaggcaagaatccctcaaatattgaaaagtaatcacacaaagtatggtaatggtaatgtgtataaatcaataatgcagtttagaacaattaccaacgtaactcccaggtgtcttttctcacagatggatttttatatttgctagaaaataacaattactttagtatgtatcactaattaaaaactgttgaataattttcaacagatattaagtaattattggcaattccatgtcagcaccagtaaataataatctcaccttgtatcatataattaaaactacaatggccccctccacaaattttaagcagtcataaataattccaattgtgcacaagtagcagccacgcattcaactcggttttgtttgtaatttaaaatgacatttttcatttgatggctgatttatgaaattaaaaaaaaatgaatttacctttcataatggtctaatgccctttggggatataacagatgttcgactgcccaaggttggcagctgggcagaaaaaaaattagccaagcatgttgatacaagacctaaacaagaaaagggtagtaataatgggtgtcagggtaaaataaattaactgaaggtttgccgtagcgtggtcctcatgatctccatcttgttgtgtgtgggtgcatgggctgccgtctgcaggctcccctgggcatctgtctgctcctcttcccagtcgccattgttatcatggacgtagccgagaactggcacagtgctgcagttgttttttcttctcctgcaagggaacaacatctaggaaagagggaagatggagactcctccaaatgccttatgcatctgtcctcccgtggcctcgcttcccccagaaggacatggtagcagaggtggcaaggatggggagtctaaagcctgactacaaagcagattcagttgttccacctatctatctaacaaatatttactgggcatttactatgtgccatgtactatggttggtgctgattttaaggtttcctgacttttaaaaggagacgcaataaactttctttattccttcacctcaaacaatttaagacctattgatttgtatccataaaacagtatgtggccattgtccatttctactaaggtgtgaatatcagctattatatagacagaacatctgcaactctattgattcagagatatcgttctgggtcatttaagatgtctgcaacctccttccctgtagatggataataaccctctgtactggcacctgccttgggttatttaggtgctttcaggaagcagatggtaacgcccagtgaacttctaactgcttgttcagtgatatctcccctattcgatcgctatggtccatgacaggagagtccatgtccgtattaattaacaatgcatttccagcaattagctcagtgtaaatatttgttcaattaattattgattgaaattccaaaacagaaaaaagggcagacagaaaatttgccagcaactcttttagtaaagcactttcttgtttaattgttaacttttttgtttagtaaacgacttcattgtttataactaatatctctcactttttataatcaagagtatacatcttgaaagataaatatggccatacatactatatcccaccctaccccactctaattaggctcatcctatatgatccatccttagagtgtgtacttgaaactatcgcatactaatgcacagagtcaacctggagtggaatcctctgcacagaattcttggatgtctagctcctgggacacatcaggaaatgctcttttttgagctaatgggcatcttcactcattgaatcaagaaggcatattgcaggtgtacaaacaaatcaaaaaggattttatttatttattctatatcctcaggtaatgtggggccatacgtagggtaggattcatgaagaggtctgggttggaaaagaggggaggcaattcaaggcccctgaagatcacagggaaactagaagggctttgggtttggagccagccaaatacatcccggctcagtggagagtttgtttccatctgtccaccagaattgaggaggcaggttctggagctttaaatccagtgatagctgatccaagcagtaatgtcaagtagactgtcttccccaggaggggtgggcacaggagaggacctataagaagggagcaacatgagaaatagaagatcagtatgtctgacttggtgtgccctcagctagaatcctagtggcctgcagttaactatggcagcagcccagtgtgatggaaggcatctgggtttgggtgtcaggatgattttagtttgtatcctagtccacctctccccatatataagaacttacctattttttctaactttgatgaaactccttgcctttatttgaaaatggggaaacagtagccatccctaaaattattggaggatgtgatgagatgatggacataaagcacctggtgtggttctcagcacactctagatcctcagtcaatcttagatccccacacatagtgccaagccagcggaatgggtgatgctgaaggaattgaagctctctctaaagtacacgtacttacaaagcaaacagattttcaaacatgaagggtctatgacttttggaatccgagaacaggatttaaagaagtaattgcaatccccattgtctcatctggtagaatttacctaaacaagtggagtttcccattttactgaaaacaaaccaagcaggctaaacggttttacttccattttgcccatcattctgtgtttgtgacaggagactgctttagagctgtgagcttcaccttctatcccttcctggccccaaggctctccatgggaattgtgaaacacagaaccacaggtgtctccaaaggaagcaacatatcttttcttctccctgcaaaagattcatataggctaaagaaattgcatgaatacatatcgctttgtttaaataacacttggttttgctgcttttaatcattggttcccctgagcctggcatgctttctgcagcacacactggctgcatacctaacagatattttgaatacaacagcttgactcccctgctgcttggatgatagcaattgcctaggtgttccatcctcttccttctcccccgctctatggttgcaaggagatttcaagtgcaatttggccttgcacatcaaacagcaattttcctgcagacatcacaacctccaaaaactctaccctaatcaaatctatcaagcccaatttaggggtgagcttgtgtctgtttatcaaggaaatggagttgaaattgtcccctttaatggaatcacagctgcccaccataatctttcacatggatgtttgaattaatagtaggacgtggcccgtgctctccaaccttggaatttgattccggttataggaaattgctataatttctgttgggactctcagagatgttggggcatttggggctggggttagaattaatatgtcagaggaatttaagaattcagaagtggttgggggaagattagcacttttacacaacacccaatgagtcacctctgcatcaaatcaaacctgctgtgacccacgtgaactacttttaccaagtcaaggagaaagagcagaggaatgtttttttctgaagttcaaattttaaatgagaacacagcagatatgggtagaatgctatttgtccttctgaagtgtagggcagctcacttgaatcaattgtgtgttgggagttgccatactgggtggccagcagcccagctgagatgtccaggtcatccctgagcgagggagaaggccagtagccagtcctggggcccactcattcactcccattgttaccttgggacattgtatttctcctgaggaagcctcagtatccccttagaggttgtgttccgctcagcttggagacagagcctgtggcagtttcgccatagcacagggtcatttcaccttttaaaatgcccttaccaaaggacattcacttcctctttcaagcaccttagcaccttttgtttatatcttgctatgtagacccctttttttcttgcacatttttgtgtttgtatcccgtgtcatcctcatgctacagaagggaggtaaaccattcctgatgcagtattgtaaatgaggaaagcccagctagatgaccttttcaattaatggtggcacgggaaccaggccgccttgcacaaacccgtgctcttcccgtaacacgttctgacgtcctgtcctgaacctttctctcaatctccttgatcagaatgtgagctgggcccatctttcctgaggcagcatccatgaccccagccctgtgccacccacacagacctggttacctctgacctctcaaggaattttctcctcatattaccctcccctcaagaattcattctgatagagggtatttcagggagacatgccttgtataatttttttaggtgcagtataataaaaaaaattaaaatcctaaaaaaactaattctgagcattacaatgcataggtaagagagagtctctttccctgaaatacacctgaagttttccatctttcaactgacaataaaagactcctaaattagagaatcatagacatttaatacatgtggggagagaacctattcattttcttcaagagtggctaatgcctctcagaaaattctcccatttagaattaattcagcttttctcttggattcctttcttgtttcctttcctcctgcattgtcgtgcctcttttcattttacttagggccatttgcatgaaaacagcatttcagctacttggggttttatctgctgccatttactctccctcagaattcataattccctgctatcgcctccaactctgcacccaccacgcttgggctgccttcaggtaggagggcacatgccacccatccccatgagcagcaccctctgtgggagcctggaggcctggctgtccccagagtagccttgctggacagaaggattgcctggtaagtgatgcgtgggggttagggccgtgagggtgtgtggccaagctctctccctgtgccatcagcagctctgcccttgtctgttatcaatggtcggtatgtgtggggagtgcagaaagctgtggctcctttctcgtgcaaacagagtgctgcgctaaccttcctcactgcactccgtatggctaacaaatagtcagagcctgagaaactgtgaaaagaaagcgagaaacaaaaactcagtgttattttcccccactttatacaattgcctcagattattgattgagctttatccattatgctgtgcaacagcctttgctgctgttgagaattgtgaaagggtgtctgttactcaggagagagcctgatgggttgtggatgtgtttgtgagcagacagatgcagcccagctccagattgtcgagtactgaaaggactataggcatcagccaataattctagcatgtcatgtacctggcaccctccatttccagacacttcacagagctgtgaggtagcaaatacaggacatttgaatgagattttccccctatggcaggaggtcatcctcattcaatttgtgggatgttttattcctttcactgacaaacttaattgagaggggacattatacacagagtttcctggcatcttcacgcttcttcatcttttgccacctgtttccttcccagaaaactcctctcttgaagtttgtcactaacgtattttgggagtgggtttttttttttctttctttttcagagtctcactctgtcgccaggctggagtgctggagtacagtggtgcaatcttggctcaccgcaagctctgcctcctgggttcaagcaattctcctgcctcagcctcccaagtagctgggactacaggtgtgcaccaccacacccagctaatttttatatttttaagtagagatagggtttccctatgttggcgaggctagtctcaaactcctgacctcaagcaatccgcccacgttggcctcccaaagtgctgggattacaggtgtaagccactgcgcccggccatcactgacttattaattatcaaataaactggctgaatctcaagccaacctacttgtttctgcagcacttgctcccagccaccagctgctcctctctgtgaaatctgctttcctggccctccagattttgaccttcctgcctcccccgaacctggctgcctggcctctgccccttgtgggctcctccgccttgtctgcctcctgagtgaaagcattctctagagttctgtccccaacctttctcttgtcctttcttttctttttatacattcttttccttggtgttctcttcacctcccactgtccaattatcacctctgtgggaatgatgcctaaatctgtttccagccttgactatttatccaaaaatctcatcttgcatctataattgccttcacagtattaccagctctgtcttccttgccccgacataaaatctgtctctcaggcctgctgatctgttgattttaactttgctatttcgtaccactccttttcatctccaccacctgcatcctagtttggtatttattgcttctcactcaaactagcagaacaaacaattagttaatcactctcccttccatctcttgccctacacacctctgctagattaatcttcccaaagtacaactctgaccctcacactttctaataaaaagccgttaatgatacccttatttttgccaggtaagttaagtccagcttatttattgaggcaggggtgagggggttggggtacggccacactcataagtgtgacgtctgctgtttcctgtgcctactctggtctatctcaagccctcaccttcttaatcttcacgcgcacccagctttcatgccataaagggcaagagtagtttcctgaacatccacactcagtgagacctctggatttgatcctgccatcccctctgcctggatcagcgttccttttcccatcccatccacctcaccacctccttgcttacccgacacagtctttatcatctttcaaaactcacagcaagggttatagcctctgcaacatcttctctcagccaacctgacagcatcagccattcccttccttgtacccccaggccgcatactatgtctctattgctgtggtttgcatgtgtttcctgcaaaattcatgtgtcgaagcttaatccccactgtgctggtgtcaggaaaggggaccttttgggaagtgattaagtcatgaaagctctaccctcatgagtaggttagtgccttgtcaaagggctggagggaagtagtcgtgactctttttcgccccttctgaccttcctgccatggaaagacacagcgttccttccttctggatgatacagccacaggtgctctcttggaagggatgacatcaggcattaaacctgctggcaactggatgttgcaccccagcctccagaactgtgagaaataaatgtctgatttttataaattaatcactctcaggcattttgttaaataagtacaaatagatgaaacattcacgttataatatatgctcctataaagtagaggccatcctcaccatcttcatcactgtagccccagcacctagcatggaataagcatgaaatcaggaccagcctcaccttccaacctgacagaaattcttttctttacatgagcatgtactatgcttccttctgtctttgcttttgctctggtacttccttcccacagaaatttcctctctattatggattcaccagaattctacccatcctaaacaaagctcagcgtacatatcttttcccacaagaagccttgtttgatctgttttcattcatcctacatgcatgtgtgatgtgtgtgtgtaagtgtgtgaactcccaaacatgaaaatcgtatgatttactgttatccgattatattagaatttggattcagattttaaagctttattccttaatttaaaaaaagtttgccctactctaataataaaactcatcttgcaggggcaataacactaatttctaataatagatcttatgatagcatctggaatacagtaaatgatcaataatgttaattcatgttctttcttctttaagagacttaacattttatgacttcagcatattcatacacttctttattgtcaataatagaacaaaactcccggtggaagaacaatatcttattcacatttctcttgccagcagtgaatatcagagattcttatatacttgtattgcttgggatatttattaaatttaacggagcaaacagatttagaaagctttatgctttaaaaaagaatatagttttcttatttgcacaaaattaaacatgatgtttatggtcatgcctataaaatgttggacttcacgcttttgataaggaatataaccacatgataacatattttctatgggaaaatcagatttgacatccattgtttcaatttagtgttgttagcagaaattttgtttcttttctctgttgtatctttatataagcatgaaaacatgaaacagcattgacttgacaacatttttttaaaaggtggccaatgaggtaaattagattacctgctaaattccatgcagtaattgagtttttctgtaagtctaagtgcaacatctttgaagaaatttgttttccactatggggcaagttgtaaagaattgtttatatgcactcaactgctatgacccagaatcttaaaaatatctaataatcataaaatttgaagctctctggacttcagtttttcttttgaaaaaagatatgtggttaaaactgccccacttagattgcaatgttgatatgaaaagctcatgtgagcctctcaattccagagtttgtctttgtttccacatccctgaagcctagtagagtgtctggaagagaaaaagtgctcaacaactatttattaaatatataaagattatgagaaagattgttgaggatgttaaactgtaatataatataatttatattatctgtactaccctctcattttagatggggtaatgaggcccagaaaggagaaggaatttgcccagtgacacacaggaagctagtggcagagcgaggagtggttcccggattttatgcttccaggtctaatgctcttcacacacatctcaccgtatcggtcatgtcacagatgacacacactctctgatattagaaaaaccagtccaattcaactgatatttatggatttcttattaggctccaggcacaatgctaagcagtgcaggattacaagatgagctatacagtctctgcttttaagttcacaaatttacatggaggagaaaacacataaaccactaccaaatagttattagggtataaatattgccatggggatataaagaaactgctgggagctcacagtgaatggagtcatgatgctggattacaggatgagcaacgttaaaggcctttcatgggaaaagcgttttaggctattctttggaagaaacacagggcagtcaagctaagaagagaaggaacattccagtccaaggaaaagtacagagcacaaaggccctgcctcccccatggctgtgactgaaaggagttatagtagtaattatggaataaagactgagaatatgaatttgtccaggtcatcaagggccaggaataccacgcttgggaatccagactttatttgatagggaatgggagcttttaaaggttatttgaagtcaggcactatatttttttgaaagccattccggctgccgtagcatgaaagtggagggactggagacaagaaaagctacaaggccacttcaaaatctagaaagctttctccaaataggaaagtagtgctaagaacagaaaggatacagcaaataggagaaacattatggagaagaattagcagtgtgggctctggattcagactggctgtccctttgtgtctttacgcaagttaattatattatttgtgcttggtttcatcatcagcacaatagtgctagagcgcccactcacagtattggaggtgtaaagtgctaaaagggatgcccgtctcatagaaagatctcaataagtgttcatggtggttgttgaaacaaagatgttaacacagaaggcaagtctcaccagagctggcacccaccactgtcttcagtgcctagaaaagtctttggcacctgttaggcattaaatattttttattgcttgtattgtatcttctttgtattttctccctttatacctttcagacatgatcatatatgaagttatttgcataacgactacgactggagtcttcagatagtttgtgttgatatgggaaagattattaatgatatcatgattttctctaaaagtgactatcactttcaatgtgttggcagaaggtttgggaaacaaaatgtttaagtgaaggtgaacattttggagacgtccttccttgaatttgatttacaagatcagtgagctaaggttcagcggtaatgattcacaagcctggggctctgtcttggctggacaggtgactcactgggtcaccagagctccatgctttctctaggactcactttacttatctttgaaatgggatttattatctgacccctagaaatgctatgttcatgaattgatacacattgatggcttaagaggaggaaggcagtaggcagctgataaaaccctctggtttacaaagtttgcacagggtcctaagataatcaggaattgacagtccagttgtatctccaggggctgggattctctttgtatttgttcaatcatttgttcgatcaggattcattttccttcattaaaacatcattagtgaaaaatatccttccagccaccttcagcaaagcatctaagatgggccacacacactgcctagcatgatgtaaataagcgtaactaagacatagtctctgtgaacttaagaaagccatatctgttaaaaataagttcaatcaaaatttaaaatgctctcatagagatatgtacaaggtgcaaacaaagaaaattagcagtactcagtggaccaggtgttggtccggggaagtgtcacagaggagtggtcatgaacctggtgtctcagggtgagtcacatcacatgggttgtagggagaggagtgctcctagctgtgggagacagcacgtgcaaagctttgacaagtcatcactgagaagcagcacaaataggagggggaatattcaaaattaggctggaaagagagaaaggagtcaagtacgtagaagcatgcccgtgcacacgcacaaacacacccagaggctggcgggacaaaagaaaaagcttattggggtcagaaagacccaggctaaaatcccagcttcttgatcatttcatgtctcaattttctcatcattgatagaagatacatcacacctacctagcaatgctaatgtgaatagaaatgtagcagactttttatgaactggaaaataaaggaataagtggatgcatgtgcaatatgtggatatattagcattagcattagcatatatgcatagaccattctatatctacaagatgtgtgcagagagagatactaatggatggactgattgattggtttggtgatagatgctcaacacttaatttctttagtcccttccaggatttctacaaaagtctttgaaagaatagtaaaattatatgtataccatgcaataacagtgctgatgggtcagctggtaagtagccatcctccccgcactgccagctttcttgggagatcttgggcagctgattaacactgcctgtgtctgattcaccttttcaagtcatagagctgctgctctgcatctagacttccctgtcccaagggatttgctggcatcagtccctggccatgcctcatggagcagctgatcactgctgtggccccggtgaggccacccgtataagactagggtaccagggagcatgggagagaatgacaggcgggtttcacagttatgcccagcacttcaaactgtgtttgaacacaggtttctggattccctagatatgttcctcctctccccacttttttgtcagctgttatctcagttttgttgctgtgaaatctcctttctcctttttggagaactcttcctgattttgatctgaggcagctgtcgtctggtgacaaccagcaatttctgctaacggcaccaatataaatcttcggcttccccctcagttcttgtcaaagacgtgggccagggtgcagagtgagacagcagcccttctgtgtcccaaaggtaggtgagctattgggctctgccagctgtccttcgaaatcacctacgagatttgtttccaaattcctgccttgacgtggatgtatgttttgatagaaggttaatgcatacgtgaatacacaactttttgatttattgtcattgtgaacttatcactctttcctttaaattaaaactccctccagatggggatctgtgacacagatttatcgatctgcaataaaacctcactcataatctctacagctgcccattcgtcttctcgagaaagagggttcattactctggatgtcccaggaatgaaagcaagaagctaactttctcctttgttctactcctgtccctcctctgcttaaggcttctgtcctcctacctttctcctccacctcctcctcccacgtcatgagaccagctgaatcccccaaacacattgactccctgtccccatgttgctcagattccctcatatttcttcttactcccctgtcacccacctcaaagatgccctaccattttgtgggcacccagagagtgctgtgacattgaatctgatttgtggcagtacagcaatagcgtagccctctgctctgctccttccagatgggtctgcaccccccaatctggacaaaccactgtggactctggtagatgaatgagatcattagaaaagggagactcgagcagccagactgataggaatgagcacgagcggcaggtgggcaggtaccatgcttgtgtctgaatgggtaaatgtggataaagaattcttactactctgcgttttgctgggtccagagaaccctctgatttattgcttaggagatattccgacatgtgaacatgatccaggctgcttcccctggtcagcagatggtttggtcactgtgccaggaagcagaagttgctgctatctcagactcaacagaaggaagggcaaaaggacttttagagggatcagatggattgcctagtcagctcagtggagtattgattcagtgctggaattttcttggatttccctgccgaaaaataaagcatgggcatcatctagtctagtggatttccagtggagtgtcatgatacactggtgtgttgcagtcagcttatggtgtgatgtaatattccagtgtgtcacaagtaatttattacttctaataataaaatactaaagtttacaaatgaaatactttaaaaaatcagaacagattcaaagctacatttataataatgtgattgtcactcacgtgaattccaatgtgctttcctgagtaggaatgggatgttgttatggctaacctgccagaaattacccattgtatatagagatctagtggttatgtggccagtatccactactgggagttgagaattgctgttctggtctgtctctccctattaggcaggaggactgtccttagaagaattctaagtcctcatcctttgtgtcctcatagcagaacaaaggatgcagcctctcatcatcatttagaaatagcaaaggcataacccagacccaagcagtgattgctaatgtcaaggcttgaacccaagtgtacaaatcaggatttcagtgtgcacatcccactgaccactacctcctccaacaggcaggcttgaggagcttggggcagaggcaaggcacaggtggaggaagagcgagtgggaaatgaatcatcattaatcactgtaatcaggaagctaccccaagcaggtttaatcaccgcatgcagggagggctgcagagcaagtttatggtttacagtgagcaggctgacacagctgattgatgtcaaatatgtcatgatgtatattgtaaagcagggagatttaatggtgtaactctatggcaggcttagaaatgagctgctgcagagtgagtcgtgatggatgggctcatttacatgtaaaattgccaatggcattgacagcattggtatgtgaggggaagataagaggcacatagcaagattcactcttgtcctagtgttggaatattaaaatacagctgcggcagcatctggaatttgcaatggcctctaaagataaaattgtttttcacctttcagacctgagataatctacatcttttataaggttttctaaaaagtcaccataccgttcctggatcaagtatttacagtagatgatgctggtatgaaattcagttgtatggaggttgttagcaaaccaagacattccacggcttttatctccacccagcctaacaaccacccagtgcgtgtagagtaaccatatgaaagaccagagaactgactttaaaactccatttggtctcttccaaactcatgccctcttgtgttttttctctaccctttgtcagaaagataattagtcagcctctctctctctctctctctctctctctctctctctcttccccttcctccctctcattctcccccttattttctcctctaatgaggctgccattatcatatgtgggctaatgtctgtaatatatgagggtacggggaattgaggtatcctttcagtaaatagtgatgtttggatcacctccagttaagcattcaggcatgaggatagaccctaggacctgaattggctaactgaagagcacttcatatttgccccctaacattagaataatgaccatgtggcattagagcctgccttgccttctctccatccctcctttttcctttcctcctccatacaatgtacaccaggcattgtgctagggactggggcacaacacaccaaatgagctactagggatgccgagaaggaaagagcctcccaccggaactccagatggcttctacaaatgcctgagaggagctaggggagtgcatgggacaaaggtggaggggagctgtctgataaacaggggtgacatctcaggggaattcatatctgaaccaagactgaaggggacttgaaggtagcaaagcaagggaggccgaagtggagagggaagatgactgcaaggaaagaacggtgcccatgtctccacagcaagaaagcatttagcaaattcaagggcctgtgaggagcttgaggcaggagcaaaggagcatgtgaggagggacagccaggagatgaggctggagaagtgtcagtacccctgccagtctccagctggctcaaaggtggagactattgcaccgtaaggcatcccttggtttttatgacaacgtttcagttttgccctatctatggctttgcctttagtgagttgggtcttatttctggacaggattatcaattgtggtaaggaagttatgttgacaatcacaaaagttatcaaagttacgccttcgggggtgctcactgtcattcagcgtgtagtgctaagtgctgaggacttaccaaacatcaatttagtttaaggtatctcatgtattttttcagtaaccagatcgttgccatcatgacattgaatgatttttacacacaaactaatagcatctgtgctttatgattcaatcattctttcgcaccttcaaaacatatctagtaagaacctactaagttcaaggcacactgctacgtgctggggatgcaaagatgaataatatgagattccttctcataagctaatgaggaagacacatatgcagaatcatggccaactcatcatagatggagctcctgtaaaggacggatgaaggctgtagggagtacaggaacttatggcctttctctgggggagtctgggatgctcaacaaaagagatatgtgagctttatcttaaagaatggttaagacttttccataggtagatgttacagatgaggaggcttaaagagtttggatgcagacagctcagccacgtggagtttcactgagttcccccaataaaatcaaagtggtattataattattagatacattcagctctacaaatcatcttttctttcttctagaaacttgactgcaacactacttctgtgatgcaattggcagtataacttagtggttaggaccagaacctctaaaatgacagagacccgggttctaacttcatctttaccatctcatagttgtgaggccttgggggagtcccttcaacccacagccctcattctcctcattcgtaacagtgcctacttcacagacttcatggagtattaaaagaggtaatgtactggactcagtgttgagcccacagtaagagttcaacaaatgttagccatgtatgattaataataatattattattatctgtcatttaacacctaatgaagcattgactgaaccacaacctagtgactttatagagctaatgtacttcccagagagcttaatagagcgctccactcttctctcttcagaaagaatgtgctcccattgcagtaaatcaccaacacaaaagtgggtacacatggtccctattctctgctggccactttgggttttactccaattattgtgctatgttccctggtgtttccctttctggctactcagctgaaaacttcctgaatgcctagtttacttccccttccagatcattaacaaagcggctctgaaagcccacacctggcaccactccaccagctcccaaataggtgcctccccagctggtcctttgccgaaccagattgtgtgtccacacaaatggttctgatcacactcaagtgttgtcatcctgaaagcacaggttctggaacctttccatacggtttcagatggcagtacattttcattcctcaactgtactccctgcttaaaaaggaaaaaaaaataaaagaaagaaaatgtatcaatggtgtggatcctaaaaggtcgcctaatcttgtccgttggtaatcaatgcaaagaaaataaaagtaaacagacaactggagtggggaggtgagcggcaacaccatttaaaaccatgcccactccttgctgcgcgtcttgcgttttgcctccactgtcctgccgggctacgtctgcagcctaatccaccacctctgcagctgcttttcattcgtgttgctacactcactccagcgtccagtctagaaacctgggctttcatcttgatttctttctattcctcagccatcgcatgcaagcaatcaccaagtaaactctgacaacccagcttcctatatatctctccaaacccactacctctcccagctctgctgccagcttcccataccaacacactgcgggccatggattttgatcttcttcattttgccctctgccagtccgttttctattgagcaatccgagatttttaaaaatgcaagcatgatcacctcgctctgcaggtagaaatactcgtgtggcttctgtcaccctcaggatcaagctcgaactcctccgcttggcttagagggaccatctggactttcccggccctctcatccccttgcggcctatggctgttcttctgcccccgccttctcccacctcacctttctgggtgcactggctaactacagtttttgtgtctgataagagcttacaaaggactgccttctgggagctgtcccaccgtgcccgcctcagctctctgccctcttgtatgctgggccagcttccccaccctccatcccagccctcgcccaccctgtgctgggccagagctgctgtctccctagctgggctgtgcgcaaagagcaggcaccatccctcctccccacagcaagcttccagcagggttctggagcacagtagacactcagtatggactggtagagctcttaaagaattttcttgaagaatccttttgagaagtaaaatgaagccagcgaggaatgaaaccaaatttgtcctgtgctctgcagaggaaagggggtggcttacccaacccccacttcccccctcctgctgcccgcgcctctcccccagcccctcggatcaggatccagcctctcccttctctcaacttgacagtcagcagaagggcctaaattgggatattttccagaggcaggttgagtaagcactgactgagctgaccctgatagaaatacttaagaagctttgcagggggattaagcggctgcctttaatcttgcttccttccgggtggccgcggtgggagcggattccagcgtgttggcagggctgggttgagggtcctgagccccagctggtctctgcaggaggcggggcttgtgagctggggaaactgggagttggagatggggagagagatggcggtgaaactgaccatggtttccatttcaacctttgaaaacctaactgaattgccttctcttttctcctcctttattttcaattcaggaagctttcatatttccagatgtgaggtgctctcattagttgctggaaaattctgccttttttgattatgtaacgaccaaggctaaatccagagatgcataagcggaagaggatttgttctggatcacaccaagtgaatccatggagggaaacctctgaggctcagtcactcatcatgaaagcatctcagatgcaacaatcctgactcagtatgctgttttcacaagggtcatgtggcatagcctgggagtacaatgtccatgccttagtcccttatactctccaaataacagtcaaccccttagattacctaccatcgtagttttttaaaagccgtggaagaggggaaatgatatttttactaaatctggggtacgtatcttcctggataccctgtatcttagaggctttgttaatagagattacagacgaaatgacggtagttgacttctgggtggggaaacaagttcattgaatattaaagcaagaaaaaaaaaaaaaggaatttaaagattattagtccaatttatcactggcaaataaggaacctgagtcttggagacctgtccccaaatcgtacacctctataacaaccctgctggattagaattagatcccactttctttcagccataccaaatttgaggttttagaggcgaagtgttctgtaggtatctttcctaggagccctattcagagctaaattgggctattcatcatttgagcctcctttcagcttgagggcttagagttgaggttttaggtcaagggtccatacttagcatagcctaaaacactgggcactcaacgcacgttaattaaataaatgttaaattcatgtggtttagtttacatgtattctgagtgggtttctgagtgtctggaacttccaaatattttacttaatcttccctgaaatttttaactatttcctctccttcctgtggcacagcatctatttacaagtatttctgattctggccacatgttgtgtgggcattttaaaacccagggggcacatggggctgcatcttctaattttggtttggctgggtctattattttaggttttaattttagtttgttttggtctctccatgattactcagtctttctttgcattcgcatccaggctgttctgagtacctgtatccctaaaaggctcaagcatatcattgtacttgtgtattaattatgtatttcattcattactactgtacctcgagcaatacgaccttagggcatatacctgacatttaagactaacaatgatttcacatacagcatatctgctcaaaaaataaaatcatcattagagatttagggggagtgagaatttaatggatagtactgactttttttttaagcaaacacttgaccctaaaactgcttctttccatcttttgcttcagcctgacctagaagtagctttgacttacaactgggcacctcaggggctcctctcccagcagattcactgctgctatcatcccttagccaatgttcatgtttattggtggcggggagagcccacctgaacattcaaggaatactcagagttttagtgcagcatgcagctgggtatatacaaaggttttcctgggaggggcctctgagcttccatgaggatggttccctctgctccacctccttccacccctctggtcctacctttctgagctgacacattgtccagcaccgtgaagttggcaacacatcccaattaacaataattgccagcccttgcgggcactgactagactcatcgcagcccctgtgtaccatggtttacactgaaagacttctcatgggagctgagaggcccttggggctggtgccagctcctgttcctgggtttgaactgcaccacttagtctttataaataagtgtcagtcccattgactgtgctttattccaaacagatttttcaccagcaacaacactgaagatgataggcgggggagcaggggtgttgacagtacacacttgacacacatcagcggcttttggcacccaccagtcatcaactaaaggagtctgggagggacaatagactgaaatctccctccttgcttcagaacccaccttcacgctgcagtgcatcctttacagtgatttccagggaattaatttaaaattgctcgttcagtcctgtcggtatctcctcagagggctcccaccacccaggcctgcctcatttcaacccagactcgctcccattgactttgggaaataggtaaaacatacttaaacaaaacagaggacagtttttaaaggagttataaagatttttacctagtgacatagactaaaatctcaacaggtgcaaacttattcttcctggaagagggactatatccctcttggctctaaagacatagatttgcatattgatagaatccatggatttgtatagctggatagggatattagaaaccattaatcaccgttcagcacagcagtcagcctcttgaaagttgttgggggttgggggcaggctatttaacatctagtcaagcagaaatactcaattgccaaaaacaggccacactgattcatccaacagaggtaccattcattcattcattcatttaatcattcacaggatagctattgcacgtcatttgtgtcaggccttatcggtggctggagataatgaatgtgaaaggcggttgctatcgtgcttttacacttaccgatcatctgagtgtctgtccttctatccagaatctatgtggactataatgggaattacgaggtcttctctctgccttttactagatacacatctttgatctccccgcagagatgcagtacacggaaaaggaactcagtaccatttatgctggttgttctgcatgagttctgggatttggggcttcaaggtcacacagctgtcaaatctaaagaaaccatgaagatacctagctatcatcccctcctaactgtttaaactgttgaggacactgagatttgaagtttagtgtacctgcccaatgttgcaaagctaaattctggcaggggtgagaccacacatcacctgccttcatggcctgctggttgctctgtctactctgaagttcatgacgaaaccccatgagtccaggtgaagaagactgtaagagaccctctagttcaaaacttctctactggggagaccttgtagttcaaagcttctcaactttggctgcacatatctagggacccgagggagcatgccacactacagaagcctgagctgcacccccagaaatgtaagtttacttggtttggggtcaggtctggacatctacatttttaaaagatgccctagatgattattgagtttagggaaaactcagataaaccacacatcctactgtcctgctcactcacatacccgctcactcattcactcattcattcattcatttgttcatttcacaattttcctcaaacattactttagcaagagagacatacataaaaaatctccaaagtcatccacatcctgtgtcaggaaaatcctgccaggctgttggcacaccagaggcactttccaagttcctcacccagcttttaaatatcactaataaacagcactagccagcatgcccatgaaagcctgcagcttgtccccatttccaagctcactttgcccaggagtcactctggagccctgccaccatgggatggaaacacgtccgtgttcggggctgtgacagaagggcaccaggagcttgttgctctttatttacctttaattagaattttcctgtgtgtctctgccctcccatgagagcagcagcaccctgttaatgggattatgtggtatggatgctgctgtggacgtgtgggccgctactccgtctctgaatttcacccagataattgatttcggtctgttccctgacactcgccttcgtggcacagggtgttattagggcctttgttccatttttgagtgacaaagcctttacatgccagccaagcaaaagcaattgttgcatctctcacttttcttattaactaacagagaattgcaggcagcttgaagcccgctgagagaaataataacataagcggctgcttgggcgcaaagtgggtcctttcaaccacaacagcctggtgagattaacaagggcccctcctctcctgcagccactggatccccactctccatcttccctgtctgtctccctctgcctttcccttatcgcctctatgtctgcttctggaaaccctctggttctctaaagcaccaagtggtccgtggagagcaggagtcctccaagattctgggtaggcctgctccatgtcttaactccctgtggattggaatcacgcattcccatatcaccactagttggtgtttctgtgtttccatgcttgcttttcatttttaaatatgtattatgaaataaatatgtattatgaaagaatttagacatataaaaaaggatgagagaaaatgaacattagtgtatctactacctagattaatttttttaaatggggccaaggccacctgagagtcttttcctgatctgctctccctctctcccacagagttcactatccttaatttgatatctgtcattcccaggcatccatttacatttctaccatatatgtgtgcaccactaagcaatacaaaggattggcacttttttaaacttataaagatattaaataccaggtgtatttcacgatctgaaagtttcgtgacattttttcacttggtaaatgagctggagtgttctgtgatcaatcacaatgttgtacttagcaatccatttgtcggaggatgttcagggtttaaggtgtctccattcattttgctattacaaacgcggccactatgagtatttggattcacacctccttgtgcacacacacaagcctttcctgacatacaagcctagaagggttgtaaggattgctcatcttcaactctagcagtaacaccaagatgcctccaaagggtttttttttttttctaattatgtaataagatgaaatgtagggattggtaatcccatttcacacgcaagtacaaagatgatttctccctgtgtttggccaggaaggcaacagcaatgaggaaaggaaaattacttccccctagtttctattcttggtctcccactatcccaggtacctaagctgtcaagaagcattaccatcatcctaatggaactgggaactcattcctgttcctacttccttggtaactttgttttccatccttgagccattggcaggtgagatccttagtcatgacctgctctttcttgtggtccaggcagggcaattcctgctgtgtgaaaagtactgtgtgatcagttacccagagctctgagctgataggcactctgtttccatggttgcttcagcaagtcggtggtcacgccagcaaacacttgagtctatcctgaatttgcattctcatgctcactaattttgtggaccacaatcaaatacttaacttctcagatgctgtctcctcatctttaaaatgggaatgattgtacatacctttcagaaaagttgtgagaatcacgtaaacaaagcaaagcgacaagcacaatgtttaatactctgtggtcatcctgtaaaaagcataaatgactttaaaatgcatgctttgctctgcgtatgtggcgtgaggtggaggaagggctctggggctggggagaaccatgcccccactgactctctttgtttggattccaaatactagggttggaagacactgacgagttttacaccattgactgatccatgatagtttagaaaggaagctgatttcacagaactttcttaggtctactagttcttaccccaaagaggctagtaaaactagtttctttgtggacaaaagactcaaatgtatatatgacacttctgccttgattctgtacctctcctaagtgaaattttactttgagaaggtagaatttccttcctttatcaataaaagctcaggaaagtcgaaacacttttagagctccctttaggggtacaagaaaggacagggttcagaacccattgtatgctcccaggcacataaagtgacagtactgctatgttgtcttcttcttagcagttcttgttttctcatgcagtcgtcaccccgtttaattacccctctgtctttgtttccatctttatccactcccctctcctcccttcttccttttcactgcatcctcatcctttcttcttcattctcatggcctcctggcacctccacaattcacctgcttgtccccaaagactctcacgcagctttcttgaatgactgattactggaaggaatagaattgttaaaaacaacaatgttttctatacaccagtgtgtaaaatgtataataataaaatggaattgcactaaatgaattatggtttttttaaaaaaacaaattacccacctgtcaaatactattaacgctcaaatcagtgtgaagaataagaacgcgtgtacagagggagcttttcttcctttgtaaaacaaataccagcccctcataacagctgctttcagtgtcttgaatcagcaactgataaggggaaggaaggtagaaaactctccaacaagtcgtttttcatggtgtcaatgtaatgtgttactttcgtgtgtaattcagatgtgttctcatatttgagtgaagggttcattaacttcccattgcttaatgatattccataggatagggcaaatgagaaaggggaacttatgaaaacaaaagtgagagtggaggtgggttttcaacgttcaaggactcatttgcttctcaaaaaaagcggctttgaaagccaaacacacagggaaataccttgtttttgtgaatatgctcaaaggtagcattgatctggacaaagaacagtagcttttttccttcctttctttcttccttccttccttctgtctccctcccttcctccttcccttcctttctgccttctgtagtttattttgttttatctttaatgatgacaggcaggagacaaatgcacttgttcttcaatccagtgagattgtttttccatagaagcacgtctacgttagtgttaggaaaggaaaggacagttatattacttgggaggggagatacactgctggtgattgtcacagggtatcccagagaccatggaaatccttcattcactcttagagggttattttcttccctaacattggtcaaaagtaactgccccttaggcagagcagaagccacacatgtcctcagccttcagcctctcacagctttgttgaattcatctaaatctctcggttttgttctccacgtgatgactaagtggccgatgcagtaggtaagcacgaaattagagggggttaactgtattatacacagatttagctcacctggcccaccagagacgcggctcagaccctggttgaattaaggaatttgctatgaaccctctagctgacctgtggccagcattctaattaataagttctatatctggcttttgttctctgttaactacaaataattcttcttccttgactttaatataatagaatacactctttaaaagtgtcttggggaaaaaaaggaaatatagacatagaaatgattattaatgttcttgcttaattgaaagagtattttcctgatagttatacgtcttctaattacctcaatgtgcattgcttaaaatttaaacaaaacaaaacaaaacacctttgggttagagcagtaattgtgtttatattatttcagctagagctaagtggatttcaatggctaacctcaaatgtaaaaagttgttactttggcctatgtttgcatttaaagtgcacaaatacaagggcttaagtcagaaagacatgaaagcgcatggaatagttcccagtttctgtttgttctttatgcaattcaaggctgtgtatgattacagtgttggttgcatttaagtgctttgttttcccctgggttacaaacatctaagggaggcgggaggataagaggataaagagaattgaaaagaattctcaaaaggcattgtgaagcacatcagctgaggagtgagttataaatgaatctaacagagagacatttaatttccttctacataagcttgaggctgaagaggaaaagttagtgggcataactttacttacaaggaacagcaaattttaacaactccttggtgtaggggagaataattcaagccatttggtagtaattatccattacatttgttcagcacattggagttcattgtcccctacaacttctacataatttggctccacaaatatttgttgagtgtccgctaagctccagacgtagagctggctttgggaacattaggctcaaagaagtaatagcccccactctcaagggggtcacagtgtacaagatggacacataagataataaaaggtaatgcggcaagttctgtaatagtagaaagcgtaaatccttagctgagtagaagagtgagcaattaaattctgcttggactacatttagagtaacctagaatgtgtattgatgtaagcattcattcatttatttattcactcactcattcaaagagcaaatgtgtttttctagcctgtattgtgacagacattacactggtcaaagaatgacttgagtgatacacaattatgagctgaaacatgttgaatagtgaatgaatcttacttaggctgtggtcttcctcagggatgcctttctttatttggctatggaactggggaaagagtaggagtttaaaaagtaaatgagagagggaaaatattctggacaaaagaaatggcttgtgcaaagctctgctgtaagaggcagaactctagatgctggaggacaaggaaggccagtacagctgtagctgacagagcagaaggaacacggcatgtacgttagtttgctagggctgctgtagtaaagtattgcgaaatggatggactacaacaacagaaatttattgtttcacaatcctggaaactagaagtctgcaatcacagtgttggcagggtggttccttctgagggctatgagggagaatctgttccaggcttcttgtccagcttctggtgggttttgggcaatcattagtgttccctggttatagatgcttcatcccaatctctgccttcatcttcacaaggtgttcttgtatgcatctgtgcccaaatctccccttttcataaagacaccagtcatgttggatgagggccccagccaattccaacatgacctaatcttaatttaactaattacacctgcaattattctgttttcaaataagatgacattctgagatattaggggttaggacttcagcatatgaatttttgtatggtggtggggggtggggacaatttaactgctgacaatctgggatgaggctggatatgaggctagcacttgatgtctttggcttcttcgaggactggtaagtcatgttacggacttggttctttatcctcagattttgagcagaagatgccatggtcaaattttcatttcacaaaagtgtcccaacctctgcactgtatgggaaggttgggtgtggacagacctgttgaagacagttgcagccattcgggtgagaaattatagattatgatataccaggatggaaaagatggactggagaaaaattgatagattgggaagatgtttaaaaggcaaacaattaataggaccagttaatgggtttgggtgataaaaagagggtagggtacaggatgacaactggatggaaagtggcatcatttactgacacagggccagacttaacagagaaaaatatgaattcagtcttgactatgaagagtttatagtaccatttaaatatcctagaggaaacagcgaatatgtttttggaggatttttgaggttagaaaagaggtctgggctagaaatataaatttggagattattgttttatatgttaatgcataaattaaaccatgcacaagaataaaatgtcttggggagagggtagtataaagtggagagagcctaggaatttgctttgataaactccaactttataggacgataatgaaggaagatgcctacaggagaatcagaagaagagtgaagaggtgaaagtagccatacaagtcaaaagaagaaaatagttcaaaaaggggcatgatcacaatttagattgctgatggttgaggcaaatgagatggggcagaggagggagttgcccactagattccatgacatgaagacgaatgaagccttagcatgttggcagaagagggaagaagaaggaagtcagcaagataacaataaggagagctagaggtaaaattgacaaatgccatgagtcccagaaaagcaattttaacaagaaggtagatgatatgggagggtggatgatcatcaggaaggacgtctctagactctgaagcagatgtcagagtgagagaacacagagccaaggttgcagacggcagtgtcctcagtagatagacaggcttggacagtcagctacgtcgagggattggtcgtaatattctaaaaaaaaaaaagtcagaaaaagtattctaaatggcgcagtggaaggtgaaaaaagaatggaggaaagaagagcaaaggccaggagtgggagggctgggcagggaggaattttttcatttgatagtgacagagatgagaagggacaagaaccagggtggttagtggttcagtctcaaaagtccctttcaggaggctgtaagaagatgtatactggtcccaaactgccagagtgttggccctctggagctttggtgatatgagctccaggatctgcagtttcttcctgtaggagtagcgtgcttgcaaatccaggtgtggagtttatgcagtcacatggcatggagtagtggcattttatctagctggagtgcagaagaaaggtctgagagtctctgtccctctagttcatggctggaggtggtagtgcccccagggagtgcattaattcatttattcatgcatgtatccattatttcctttattcattcaacaaacctttttaagtagctactttgtaccagactctgaatacacgttgatgaattgaagctattattcccaccttcattaccctaaagtctatttggaaaggggaaaataaatagaaaacaaaatcaacaaacataaaatggaattacatattagaaaactgctatagaggtaaaggcaagatgacacaataggaaataaaaggagagccatacatatacagatactttgagcctgcacagtgtgagatttttaagaatcagatggatctggcaatgtgaatagttggagaccaaggcatcctggcagaagtgggaaaggccagtggggacaactgtgggttcacacacagtgggtgacaaggagtggctgactgttatggagaaaggattgtagaaggggacaaagggatgtaagaggggttagtggattcagaatccatgtgtttcagttcctgggtatcccatttctgtttaaaacaatctgcctgtcatttgtcctttgtggacacattttcaatgtctaatgttttgtccaaaacctgaagccatgaaaccacactacttcccctttatcgctgtcctctacagtgatcatgcagataatccaagatcaggaagtcaactaagagagaaaacaaaagtctatattttcacactgagtagttatcttgaagttcaagttatgtatatgctggtaaattacagatatctggtgtccttccccaaattaacttgtcacattctaacaaaatgatcaaattttctggacagctaccttgttaatttctaagtccattctcgaagctgccctctaccatcatcaggtactaataccctccaggtctcctattcccagacgttggcacacaaaccagttctctactggattaaatttttctcagtgttggatccttacttttctacattttgtaggcagagctgtaagatggttaggctcatgactctggagtcaaactgcctgggttcaaatatctcactcaacatataggtatgtgaccttgaaaagctattaaattctacctgccaaattttccttatttgtaagatgaagaaaaaaaaaaacaactacctctcaataacgtttttaggtctaagtgagatgaatcaggcaaagcacttatcacaaccctgtgcgtagcaagtacgtagtaaatgtcagctgttattatttgtactctcgtcactatcaccattaccaccacgaccactttcactattaacaccagtatcaccaccgccttcaccattattgccaaaattgtcactaccacaatcatcaccatctttgccatcactgcaacatcaccaccatcactcatcatcagcatcactaccaccttcaccatcatcaccaccaccacaactttcatctacattgccaacattaccaccatcaccaccaccttcaccattatcacaaatatcaccaccatcatcatcactaccactaacaccttcaccattaattctggtattgccaccatcatcaccaccaccttcacagtcatcacgaacatcatcaccgccaccttaaccatcattgccaacatcactaccatcactaccaccaccactgttactactatctgattgtgatcacccactgtcttttctttccaggtttcacggcacgtctccaaaccaggacaaggcatacaacttttactcaaccagcttctttgttccctcttttcttctcactaacctagtctctattctaccttccaagtatcagagtatctaaagcccactttaaaaattgaaactctttattcagtgcaattgatcataagaaaattaaagctagtaaaaatgttccttttagccttatgactacttaccctgtcattaccatcttttatttctctctctctcttcctctccctccatcactctccctctctctctctctgtctctctctgcctccctctctctcacatacacacaagcactcacacatacttatattgaaagttcaagatcatataacctccttaatcacccctttgcctaagcttagacccagtaatgagaacttccagagcatcaattctccctatcatttcagagaaaacattttttctgtttaagagtcacttaaaaaaaaaatgattacaaattttgctttagattcatgggatacatgtccaggtttgttacttgggtatatcatgtgatggtgaggtttggggaacaattgatcccattactcaggtattgagaatagtatccaatagtttatcaacctttgtacccctccctgtcccctccctctagaattctccagtgtctattgttcccatctttatgtccatgagtacccaatgtttaggtgtcacttataagtgagaacatgcagcatttggttttctgttcctgcattaattcacttaggataatggtatccagctgcatacatattgctgcaaaggacataatttcattctttcctatggcatagtattccatggtgtatatgtaccatgttttctttatctgatccaccattgataggcacctatgttgatcctatgtctttgctattgtgaatagtgctgcaagaaatatatgtgtgaatgcaactttttggtagaatgttttattttcttttggatttataaccaataatgagattgctgggttgaatggtagttcttagttctttcagaaatctccaaactgcttcctacagtggctgaactaatttacattctcatcatagtgtataagcattcccttttttctgcagccttgcgagcatcagttattttttgactttttaataatagccactctgaccagtgtgagatgctatctcactgtggttttatttgcatttctctgatgattagtgatgtggaacaggtttttcttaatatgtctcttggccacttgtatgtattcttttgagaagtgtgtgttcacagcttttgcccatttttaaatggggttattttttgcttttcaaattgttcaagtttattatgcattctccatattgacctttgttgaatgcatagtttgcaaatattttctcccagtctatagattgtttactctgttgatagtttcttttgctgtgcagaaactctttcatttgattaagttccacttgtcgatttttgtttttgttgcaattgtttttgaggatgtagttctttcccaaggctgatatccagaatagtgtttcctgggttttcttctagcattcttatagtttgatgtcttacatttaatctttaatcctccttgagttaatttttgtatattgtaaaagacagaagtcaagtttcatccttctgtatatggctagccagctattccaacatgatttattaatagtgagtcctttccccattgcttgtttttgtcgactttgtcaaagatcagatggctgtaggtgtgtggctttatttctgcattctctattctgttccattggtctatatgtctgtttttgtaccagtgccatgctgtttgggttactgtagccctgtagtatggtttgaagtcaggtagtgtgatgcctccagctttgttctattattgcttaggattgctttggctatttgggctcttttttggttccatgtgaattttagaatagttttttctcattctgtgaaaaatgacattgatagctggataggaataatgttgaatctgtagattgttttggacattatggccattttaacaatatcgattcttccaatctgtgagcatggactgttttttcatttgtttgtgtcatctttgatttctttcagcagtgttttatagttctccttgtagatatctttcacctccttggtgagctgtattcctacatattttattttattttattgcagctattgtaaatgggattgcattcttgacttggctctcagcttgaaagctattggtgtatagaaatgctactgatttttgtacatggattccgaaactttactgaagtcctttatcagttcaagaaatcatttggtagagtctttagggttttctacatatggaatcacatcatcagcaaagaaagatagtttgacttctttttttcctatttggatgccttttatttctttttcttgcctgattgctgtggataggacttgctgggactcacttttaaaattaataatagtagcttcctaaacattggaaggctccttttcaggtctacatctataaaatttagtaaagaactaaatttttgtagtttgcccttgcttacaaggcatattaacaaatctgatgcatgttgaagtcccagcacaaataggagaaaggactagtatctgcttttgctgataagcaaacccagccatgaaatagatgatatacccatgtcctcatggctggaaaatggcagaatcttagcctatgccgtccacacaccagaaccaggctgggtcacatgtgcattctagtgggagtcccagcctgagtctggtgacttccccaagcctccagaaagtcagggctccaagcaatttgtacagtgttcatgccactgcttaaaacttcccagtcccaaattactaaatgtgtaaactttttagatcttaaagcttacgtagcaaatagctttctcttgaaaaccactccataaattctagggaaaagtcttctggatttgtgttcatgctgtgacttttctgtaaaaatcaggtagcagatactttgactttggatctacattaaagagattgaatcttacttgaccactctttgactaggccagtgttcagattatctccgggtttctgagtcctttaaatattcataaaagcataaaaggtcccaaaattaatcccaaagtaattaattctcccaacattaatttattcctatgtaattatatatataatatatataattaaatataatatatatatgaaaagcctagtacatatatatatgtgaaataataaaatcaatattagtccattctcctacagtggaagctttttctgcatacaggtggatgaaccaaaagaaagcacttcgttccaaaacctactcaaactcccaaattgcccttcaaaacacgccacacacacacaaaagcaagcataaacacttgggtcaaactccgggtgttagaagagaaaaaaaaaaaaaacagagttcatatgtatgcgtgatgcttcctcttctcactcatgggttcagagtaattttttcacttgctaactcaatgtcagagtctgagagacaaaattcagtctcagcagccaggggactgagcatgtgatgtttggcaaagcaatcattacaaagaaacctcacttttaagaaaaaaaaaccatggataccctgaggaggctttgacctgtatatttgttctttgatggtaaaaaggtatcatgattctaaagactcactagcagtcaagaatttactataagccttaattttaatcccaatacaggacacattttgttgtgataaatcccagtagcctatgaaaattaatcttgacttcaccctcagcttggatatgaggcagcttagtgtaggttaactcaaagcagggtctggcattggggttcttggtccctcccttctaattccgtggccttagatgattgatgaaggctttctaagcctcagtttccttggctgtaaagtgaagaaaataatagtaactccttccagagtcacattggagataaactgagggaaggtgtatgtgtatatgtatgtacgtgcatatgtatgcacataaacacacacaggattaaatatatatatagacaagggcgctttaaaaactgttaagttctatccaaatgataagctaattttaaaatataatttaggctgctctgttgtaaggtatttgttgtaatgagatttctcctttactaattgtgaactaatttgctcatagagtgaataaagtatttataacatgttagaattaaagttgtcataaatacccataaaataaagtttttctctacaatagtaactagctcagaaaacattaagctcacaaagtgtatcctattggatgtattttgaacagaaatttatgtatcgttctgaccacatattttagatttcacctgttcacgttttccttagctatattgtgtgatttttgtattgaagaattgtggtgcagtggaaaggtgagctttgtagtcacataggcctgagttttacagtgcactctgacatttcctagctttgtccttgtgattaattcactttctattgctatcaatatctaacaattggcagacacttgatatgctccaggaaatgtgctacatgcttcacatacactacctcatgtaacccccagcatacaccatgaagtagatactaattgtatccctattttacagggaagaaaactaaagcacagagaggtttatatgccttccctaaggtcacacagccagtaagtgacaaaggaatggaagacactcatgggggaagccacctcaggagactgagtgcatctgtagctcacacatgagtcaggacgtgactgtcaaggctgaatgacacaatcatcatgaattgaagtcttttcaaatagtattcagtgacatgaacacacagtggtccttggttggttctctccttaaccctgccgtgttttccattaggccctgtaccctaaaggaaggagctctgcctctttgcttctgaggaggcaggatagcctagtggttaaagatggggggatgcaatattcaagggcataaattctattatgcaagaaaggtaacttcctttttcttcctgtaacaactcaatttctgtttcaagactttattttgcccaaagacagaaatcttcatttcgaagtcttttttcttagaagttttataaattctacttgctcttctccccaccctatggtattctccatttccactcaggactcatctaagttctggaaagcttacatagcctcatggcatgaggatgaggtggaggtagggagaacatctggcataagtacagtctcttctttatcctgatatcttctctttcgtttgttcattggtttctgttcattttctcccttggcctctgtttagtctctgtttaattctctgccacggtgctactcagaatagggaggctcagggcccaccacactcacgtgccttgagctggctttaaaggttgaaattcagtagtaatcaggcttagggcctccttccttctcactctatattttcccaatacccactcccttccacatctatgggcttaactatgacctatcggccatttctttgatttaattccatggtttctgcatctaactaattactgatttatcctttactcagtcaataagtgtttactgaattgttttcatgtggtaggcactgtgctggggttgcagctgtgagtaattagaataggatctgacgacgtggagcttctgttctggtccctatcatcctaatcatccctgtcaccttcatcatcacccccaatgccatcataataatcatcatcatcactataagccaagcatcttcggaatagtgtgtgtatatatatacatatacatatatatatatatatatatgtataatcttcacagcaacgcagtgggatagtaagattattatctgtactttacacatgaggaatctgaggcacagagggattatgtcactaaacacagttcacacagctactttactattagagccatgatccaatctaggcatttttgatctgtagcccataatttagatcaccctgctatactgcctcccattggatatgtggcctaaaacatttgcttctttaatgtctaacaagtacagtggagttgatgttcattatggtcaggggtcaggtagctaaaatcctcagagagaggtcaccaccattgtaaccctggccattaattcattcaacaaacagctttaacattcttactatgtgttcagtattgttctcaatactgaaaaatacagcagcaaagaagttcagctaacatccctgtcctcatggggcttacactctggagactggatgtattataagcagaacaggaaattttaggagatggtagataccaattatttgttttctgccaagatttaacatatgtatttgggctcagatctgaagatatttctgtttgaaaattgaaaattctgtttgaaaatacatgtgtgttgtatgtgtaccctggagtctatgaaagtaaacaagtgccatcgagaatgttgctgggatcacttgtaatctttctagtctgaatagttaggatattcacgatacgtatatgaaaaaagacttatctctaggatggataaacacctcctacaaataaaaaatataaagacagacattcaacagaaatagaagaaagatttaaacaagcacttcacaaagtgatcaaaaatgtgtaaaaggactcaacctcactaatcattagagaaatgtaagtttaaaccacgatgatatattgctatatatccatcagaatgggtaacattaaaaaaaactggcaatactaagtgctggtgaagatgtgaattaactagatctctcataccttgctgctgaaacctaattggtacaaacactctggaaaattatttagagctattaattacagaatctctcattgttcctctcagcatagatttcccaagcatagatatatacatgcaccaaaagacattttacaaaagtgttgatagatgcactatttgttttaactccaaactggaagccacacaaacataaacagtaaaatggatatatggatagggacatatccacccaatggaatattctaaaacactaagactgatgacatacacatgtcatagaagagtgtcacaaatacaatgttgagcaaaagaagtcagacactgaagaatttataccaaatgattctgtttatatggagagtaaaaatgggcaaaactgatatagtcatgaaagtcaggccagtgctacttttagagaatgaagacaggctgcaagaataggaggcttctgagtacaggtcattttcaatttctttaactgctggtagtaatgcggttgtgtttaccatgtgcatacttatcaagctgtatgcttatgatgtgctcattttttctatatgtatgtaatgtttcaacaaaacttttcttaaaattaagttatgtaccaccttatatttcctgcttatccttctgttctccaaggtttctcatgaaattctaattctgttgaactagttcgagagcttctccaagccagaattcttgctgtttcatcttgtaagccccctttaaatcttcttggatctaaatagggaatgaattaaaagatttgctatggaaattctcatttgtatatgtaattgtgtagcacagtgcttggaacactgtatatagacagtgaattttgacatgtgaatgaagggatgaattaatgttttctaaatcatattaatcaatttgtttattatctacactagtatgcaatttatttgagcctaggaattcaaactctacttttccaatgagcacattcccctctgtatgcttctctccatgtcatgagtggttggacctttactgagttgctgcagaagtcagttacccaataagggatgctttgtttactttaaatatgtgaaaaatggtttcattcctcaggggattattaattactggtttactaattactctggaactgattttacagaaaaaaatctaggcagttgtttgaatgaatccttatttaagtgagtaattagttggatcaaaataattgactaaattaagaaattctttaatagacattatttaggtgtcagtttgattttgctcctggtgatgtgtaacaaatccattgtgtgattagtaataaagctgtcactcctgaagggatcttttttaaaacaaaaggaaagtctcttttgaggctggaaaagaactcaagtacacataagctatgaattatttttcactttgtccttaaactttagattacagacaaaacttaaaacaagagtcaaggtacaggaaaacaagtacatacgtattaacataaaaactctggtggggagggaatagatatatttcaagccattttggtgtcaagaccaaagtaggtgggagccacttcatgatatgcatttccacacaggcatctaccgaatttgcacctttgtcagggatcaattcaaaaggtacctcctcttctctgccttctcttaccctcatcccctcaattaagtatttagtgattcctaatgcagtgttttctaatatattgtgaaaatcctaaaccactcttctcattataatttgggtattcactgatagactgtggcctgctggagtgatttctttgtaatctaagaaagtagcctagttattgtacagtgagtccagaatgagttactatttaggagagtcacatctaattgggtcctcattgagaaccccttttctactttgcgattaacacagtttttctaagatgaaacagatcacccttaagtaataatactccttctgctacatttggcctgggtggtcccggatcctctgtttgaaggtgtcctagacaagcccaggcaaaggtttttcaacgggccccaactcctgggtggaaaaggttcctgtgcacccgagggctatgcgtggtgttgcgggagacctgtcattgctgcctgccgcgatgccaggccccacgctgggggagccacccgggtcctcacctggagatgtggctctctgtggcgacgtgccctgacgtgggaacacatgttctaactggagatgactttaactgcctgaagtcgaaaaaggttgtgtgtaataccaggttttatactaacccaaaataaattttctctaacacgagttttcagacaggttggcctaatatattaacttctgtctgtgttttgaatagtcaatttcacggtgaaatgagttcttaataatatatttaccacctgggaaacatctcccagccatctggaaaggagaggggatttagtgcctccaaacagagattggatttttttcacagttatttatttatttatttttacatcaggtaaaaaccggaaggacgactcggttccagcatcacggatgcagggggcggggtgtagacggcacaggtcctgcgcatgctcagtgatcactcatcccggaagtcgggctctgtcatgtgtgtcaggactccagtcaacgatcctgaaggaccagcctatgttatattaagtactggtgggaaacacaaaaatagtacagccgagtgtccacctccttagtgatttacatatctatgggggtagcagacgttaaaaggtcagagcaatggctttggttggaaaatagtggattcaattcctgatgtcatgtattagttgtgttgcaaattgctaaatcccactgagcttcattttctgcattttccacagggaaataataatgtctatcttttgatgttgttgtgagattggagatagtgtaggtaaagtgccagtatccagggtcaatatggaagtgatcaatggaaaatatggaacagagggagaaagttaaaaattcatggttgtgtgtgcgtacaatgtcatatgcgcactcaaactgatctgatagaagatattggaactggatagataaaacaaagggggtttattaggttttgaaaagaatagaatataaactatagaataagaatacaaaaaaacattccatcattcattcattcaaaaaatatccactgagcatctactgtgtaccaggtattcttggaggtgctttgagtgcatctatgaatgaagcaaatattcctgccctctttgggtttagattctcaagggaagagtggacagacaatcaatggtaaatgaaataagtaaataatctttttttttttttttttagatggagtctcgcactgtcacccgggctggagtgcaatggcgcaatctcggctcactgcaacctctgcctcccgggttcatgcgattctcctgcctcagcctcctgagtagctgggattacaggtgcacaccaccacacccagctaattttttgtatttttagtagagacaggctttcactatgttggccagactggtctcgaactcctgacctcaggtgatccgcccgcctcggcctcccaaagtgccggaattacaggcgtgagccaccatgcctggcctgtatattttaaggtaagtggttaggtagaaaaatataacagaaatggattaaagaattgggagtttcaggaccagggcaggttgcaatattaacagggtatttgaggttggtgtcatttataagctgatgttagagcaaatatgtgaaggagatgaggaaatgagtcgggggacatctggggaaagaaagtccacctgaggaagcagccagggcagaagccctcaggccatgctatcctgctcagtgtgcagcaaggtcagcagtgcggctgcagctaagtgagtcaggggagattagtgggagttaaggaagcaagataacaggacaccagaaaaggagacttataggtcaccataagaacacagacttttactctgacagtcactggagggttttgcccagaagagtgaaagaatttaatgtacacttgaaaagactcatggattagtttgctgctatgttgaaactagatttgaatgggtgtgagcaaatgcagttgttgggaaaacagtatggaaactgttgtatgaaaatgatgggaggtctgacccagatctgtggcccaggccagggtggtagcagtgaaccattgggagatagtcagtttctagatgtatttccaaggtagagagacacatgacttccaaaagtactgcaatttgagtattagagacagggagggggcagcagatctgactacaagccttcacacctggacaactggaggatggacttgccatcagctgagacagacgatgaaagctgtgttggggagttcaggtcaggccttcagctttaaggacatcgcacttggtgtgtctgttagacacaggtagagttgagagtaggcgattgcatatacactcctgtgactcaggaatgtaccagacacatgcattgggaagttgtgatacggatgctatttaaagccacgaggccaaatcagatttcccccaaggaagtgaatgggaaaaggaaaaacgcctaaggattgaatccttaagaattccaatattaaggattaggtgagcaaatgaggacacagagcaggacactgtacaggaaaatccctcaggaggcaaaccaagagcatgttctcctggaagccatgtgaggaaggcacatcatggaaggtggagtgatcgatcaactgtgtcacacgctgccgatggaccaagtaagaggaggtctgaggatcgaccatgagatttgaaaacagggagctcagtggcaaccttgagtccattttcagatgtgacagcaaaagaaaacttaaggaagaatctgaagagatggataggacattaacattgaaaactttcatgagttttttctttctacagaggggagcaaaaactgacacctgtccaaaaaaaagaggtatattttaaagaagtgaaatgacctaaaaatgaagaatgtgtttatgtgttgatgggaatgacccccagaagaggatgtgaaactgaacaaagccgtgtcttccatcctacattagagggtgtgggatctggtgctggctcactggaggacctggagcgggaccctggaagtgctcttctgaacagttttatttttctcagtgaaggaggaagtgaggccatcgggcaaatctgagaatgatggagggaatgtcagaggtggaggatgacagaaggtgtgaaatgaaaatgttcatcttgaggagtgagatggtgaatgaactagtgggaaagtatggtcttccagcagtacaagacccacttgaggttttcagtgattagtttaaactgagctaattcaatttatggtcagttaaatagatttagtacacatttttaagacattttataggtcatgcactgttcttggctctggagacataaaaatgactaggatgttgttcctctcctcaaagtcctgcagggagagagactgaaatatgaaaccaatagctataataaattgtaataattctataattgagttatacttattgtttggggaagtactgccaagtgttgttgccaaatatagtgacacagcaagatgatggtgtttttcacatcagaatcagaatgtggttctccatagtgacctcccatttcctcaataaacatttattaaatgttcagcactgtgtgctaggtgttagagctacaacggcaaataagatcatttttgcactcaaagagctcaccatcaaatacagtgatttccaaccttggcagcacacaagaatcacttgggcaattttaaaaatcctgatgcccaggccataccccaaactaataagtcacatttttttttaacattccccagtatttccaatgtacagtcaaggacgagaattgctgatctagggtgagagacagataagaaaacagaaaatggaaatataggtgtgataactgctatcagatagggaggcacaagctactaagggagccctattgaggggtcagtcctgaaggtagaggggccttgatgacttccacgaggaagagccccctgagctgagtgaagggtgactggggtcagcgtgggaagtagaggagggatggggattacagctgaaggagcaggagcggcagaggcctggggactgaaagagcgtgtcccactcagaaatctgtgattcagtagagttaagccagggccacaaagcaggaagaaagtggcaagagatgcccaacagccattaggcaggagccacactagaatgggcgaattcaaatttgtttccccactactgtcaaattcctattcaaatacgaccagagaaacgtatggatcatacaaaaccggttaccccaacttgcaccacatgagcgagcagcaccttgagagaacctcagtggagtcagaggttagaggagctcctttacagagctctaaaggctggagtgagccacaaggtggttttagggcagaagtttctgagcaggaactggtcagatcttgcaaaccattttaatcgctggaacagacggtggtcttttctttggaacatatgagtccatgagaaggtgttgttaagtcagtttttctcttgtcttatttggattataagggtctgaatgagctcctattaaaacattttgagtttacagtgtttgtgttgtgtgtcctggttccacagagtttatctgttgtgaatttcagcacagttttgcaagtcgtggtttccgtttcatttcttactgtattaagaaaatgtggtgtggtaaatagagcatcgagaggcagtagtctcccataaaatatggtgtccacaaatctgctgactcctgaaggtgacctaaaaatgaacattatctactaagcatgttcaacgcatccaggacaaaaaaatcttgaactgacctttttgaaaaagacattgcaagagaagtacattaattgagtatatcaaccactgagtatgaaaatccaaaatgttttaggcaaacaccattaaatttactatctaaatttctaatatgagggcaagcaaagtggctcatgcctataatcccagcattttgggaggctgtggctggcagatcacttgaggtcaggagttcaagaccagcctggccaacatggtgaaacctcatttctactaaaaatacaaaatttagtcgggcgtggtgccgcatgcctgtaatcccagctactcaggagactgaagcaggagaatcacttgaacccaggaagcaggggttacagtgagccaagaggtaccactgcactccagcctgggtgataaagcaagactttgtctcaaaaaataaataaataaataaataaatataaaatgaaaagcaaaatttctcatatgaatattccaaacatataggaaaatatgatgaataataaaaaagttgctagctaccaattttcctcatgttgtaatatttttgccaaatttatttcacacattattactagagaaacacaacattaatctaaactgaatccacttgtttattcttctctaaatccattttccctgctcctgtctcccctctccagaggtccccaaaattatgaagttatcagatttttcttctctagtacattcatatgtgtttaaataaactataatattgttctccatgattttgaactactataaatggtctcagtctggttagattcttcagttacttgccttgtttatgtaacttcatgtttctgagatttgatttattcctcttaaatagacagatagaccacccattcattttaatccaatttatgactattaccactgtttagctctccattattgcaagacctgtgggctgtctccacctgtaaaaacaatgctgcaataaacatgcatgtatgcagcttgtgcacatgtgagcgggaattactcagggtaggataaaagcaccttcaacatttctaaatattgccaaactgcttaataaaatggttttgccagtttaaaatctcactagactgcatgcgaataggcaattttctgggtatataatgatatcttattgttgttttaatttgtattttcctgattgctagtgtggttgaacatctttttatatatttattagccatttcattttcctcttagtgaattgcctagttttcctaccaagttcttttttcttgtttctcttattggttggttgggattttattctcttttttttcacattttcgatatgaattcttttttacatgcattgcagttgcaaattttttctcccagcctgtgtctcttgtttacactttatgatgtcttcttttttttgtagagaactatttttcttttaataaactaaaactttattttctttgatgagtttgtggatgtgtgtgtgcgtttgtgttggcataaaaaataatttcctacccgaaaaacataaaaatacctgcttatatttgtattctaataatggcaaagtgttgctgttggtatttagctttttaatctatctgcaattgatgtttgtgtgtgatgtgagacaggggccttgggagcatttgttgattacaggaatctgcaatgttgtttctttccttaatccagtttccatttggtgtggttctgtattcggacttttatcggcttctgttggttcatttgtctttctggggcccattccacactaccttaattcctgtagctctgaaatgcattttgctatctggtaggatgagtccccccatcctactcttcaagttcatcttaattattcgtgatactttgttcatcgctctaaaattaacttctagtaccacacaacattctcttgatattgtcactgaagttgtattaaataaaacttatagaatatttttgtatgaattgacatatttatgatgttgtgtttctctgcccatgaacatgttatatgctttcatttatctaggtttcactttttttggttttcaatagagttttgtaatttttgctggaaatctcttatacatgttttatacagtcggttattctcacaaactctatttttgttgttattatagtgtctcttttaattaatctttgtttttgtacagttcacattttaaaatttcattgatatttctatattcatcttatattcagcaacttttctaaactcacatattaattctaattaatcattagattcacttggatttcctacatagataatcatatcattaggcagtttgttgttttcttttctaatccttattatcttcatttctttgtcctgtctcactatgctgactctgacctccaactcactgctgaatgaagcagtgcaaataagcatccttgctttgtttctgactttaaagtgattgcctctaatattttgactattaaataggaaatttgccatatacttttggtgaatgccctttttgaagttaaggaatcccctttagattcatggttttctttgaatttccatcatgaatttatcatattttattaaatagttgttctgtattctttgaaataaaaaacagtgatttttttcctcaaagttgattacacatttaaggaattcagtgaataaatctactaattacatccagaacctggctcaaggagaatacctcagacaaaaataaatggaggttgggggagcttgtgtttgtattctggaatggggttggagaagagctcctgactgaaatggaaatctgttccttcaataccagcactctacattgttgcttctcagcgtatagtagagcagcagcagcagcctccacagggtgcccagaaatgcagagtctcaggccctcccccagccctactaaaccagaatctacatttaaccagagagccgggggaacaatatgcataagcaagtttgaaaagctggtttacattgtccttcaaataccagaggcgaatccattcacattatctagtatatctaattcatctctggaacgtaaaccaactttgcactcctgagataaaattcctgtcattaaaaaaaaaatacattcctggattttttttaaaatatcttttcttgctctctaaaaccactgtaatattttaaaaaaataaaagaaaaaagacaaaaatatacctttgaacttaatttgctaatgtttacccgaggatttttccttccctatacataagaatgacctctaatttgcctctctggtattatcctcttctggttttgaatcaaggcagttctagataaataagtgatctgtggagcatttcctgtttttatcctctccgaaacattccatttagcttttgagttatctgtatcttgtattattgttaggactcacctataaattcttctgtgtctaattatggttgttaagtttttaaacttctgataacattttgttttaaacatcacatgtataatttgattttccgtgctttaattatttctttatatattttcttgttttcaaatttactagcaagcgtcattcctgttaattaaaagactctgctgaatttattactatataccaatttgttgtatccctattattgcttgtttataccttttctgtcttttttccttaacctatgttaagagaggcataagagttttgttgttctcttcagagagctacttctcaactttgtgaattctcttggatttttattggttttctaagtcagtagtttcttctcgtatttcaaattattcctttgttttatatattctttgggtttactctgttgatcttttctaatgactttagtagatgatcagctcattaatttttaatctttgtattttaaaaaatctccccttaaatactatactgttttaactctatcatgaacagtttaacagttaatattttattaatatctctttccaaatattttaaaattattgtttgtattttagatatgttaaatttgagtatgaatgaaatttgaattttaaatataactattgtatatgttattacttgctctgtagtctaaatagtacatattccatgtgtacttggaaatgtatgtattatttatagaaatctgtagtttctataagcaccagcaagcgtacatttcagaaataaggagctgaggctgggctgaggaggcaggattagcagtgtctctcaggttgggagctgagccctaggctcaacaacagaaatgcagttatttgaggaaaaaaataaaaagagtgaggtagaaaatcaggaagggaggggcaaggcatgggaatagagctggagcaatcaggaactggactgtttagcaaaacctgcagtgagaaaggtctagggtcttgttaaggctctggcttaaaagctataaagtaggaacttgatcatgatgtggtagctaaggttcctgcttctgtgactgcagatttaatttcaaatctgtatctttcatttagttgtagggactatggttatcttttctataaagtaggaataataattatatcccccatattgaggaatatgtagaaattaaatattgaggatatcatggaaattaactagtaaagtggtaagtattaagtgattactcaatagcaaactcaatgaattccactcttattatatatttaaattattttaattacataagtttcaattcttattaaataaattaaatttaattcttattaaattctaataagaatacctgtaattgagaagaagtagaagggaaggaggaggggaaaagatggtaaagcagggaatgagatgagaggaggtacagaaatagaccattgtacatctgtgcaaggataggtcctgctttcgggacctgtaggctgtggccaacctgcaggaggaggcaggaagctgtggctcatttcaggcagagcaaatgtgtaggaatcccacagttccttcaggaatagaaacccagcaatattcttccctcttctccccacttgttctggaattacaatcaggtaaaaaatcagtccaggtttgatgaaccatttcttacctctagtattgattccctagtcatgcctcagagctcagcagtagggaaataccaaaaaaaaataaaaataaaataaaaacaataacaaattgcagatggatggggagctctgttcacgctctgtgactggggaggaagacatgcatataaggaagtcctgctgcttcagtaccatccctcaatatcatcctcaactgtcaatacttcaaatattttaactgtatttccatccagttgacgagatttaaaattattttgaacaatgtattctgtttgtatgtctcattgagaccatcctggaggctggctaccacacatgggaaatgtccattatgtatttgtaacattttaaccagtaagagaaacagttgttctctttattctttattttattcttttataatgacgtttgctgagtatcatgtagacgtggtgtatcactaaatggaattttattaaggggttctaaagttcagatataaagttggtatgaaagaaaagatatactgaatatatacttttttcttcctctaataaaaattccctctcctccatacaggtctaacttgtgtattttcccttggttacagctaaacaatctaacagctgtagatgaagacatgatacctgcagtagccataactctccagttggagtttccttgatttttcttattagatagttgatcccgttttcttctcatctgataaggttaaactgcagccatttggaatgcttttcatctacatgaaagtcgccttcctgatgatgtggtaatatcaatggtaatatagcattcagctgcctgccaggctatggggaaggtcacaatggatattattacagagaactcatccctcccatgaaacattcatgctttatagcagcctccacttcactgcttcttgaagaggtccacttccctttgacctttgatgatggcattaaagtgcatgctcatttcaaaaatactattaataactaccatttagatagtctttatgttttacaaagagctttcacatctgtcatcgcccttggttctcattccaactctaggctgcagatgtcagattggccccaaatcgcacacctaggaaatatcagagccagaactaaaacccaaaccttctcctccaagtccctgatcttttaattacatcatagtgcaagtggagtttcaacactgtttttctcacaaaccagggagtgttatttgagccagtagcatattatattacttgtcaatgtttccagaaaagggtatcgtaaataattctttgccaagtggatgacttttcttacaaaaacaattttgctgcttagaaaatttgttttctgaactataaaataggtgtataatcatttctcctaataatgacgtgaggctaaatgaactcattaccgttaggatttttaagcttccctattttggcttatcaatggcatgtttcaagcaaagctcagtactataagaatgaaggatttagaggaagatagtgacgtagatcctgctcccaggaaagactgtaatttgagcacttgttcctaatgtgttttgggtcaagtagaactatattaggccatttttgcattgctgtaaagaaatacctgagactgggtaatttataaagaaaagaggtttgattggctcatgattctgcaggctgtctaagcatggcacccgtgtctgcttggcttctgggttagcctcaaagagcttttactcatgacagaaggtgaagtgggagcagacacgacagtggtgaaggcaagagcgagagagagagagggggaagtgccacacacttttaaaggaccaggtctttgaaaaactcactatcacaaggacagcagcaagccatgagggatccgcccccatgatccacacacacccaaccaggccccatctccagcactggggattacaactcaatgtgagattcgagcagggccaaatatcccaactatatcaagaactctggaatcttttgaggacattgacccttcctggaaaagtctccactgacaaaaattattgtgcaacatttcagagccctttatgggttagctaatgttcatctctggttgccggttaagacctgagaatacatggacacaggaaggggaacatcacacaccggggactgttgtggggtggggggcggggggagggatagcattaggagatatacctaatgctaaatgacgagttaatgggtgcagcacaccaacatggcacatgtatacatatgtaacaaacctgcactttgtgtacatgtaccctaaaacttaaagtataataataataataataataataataataagacctcagatctagaggcacgtaatttgcactcaggttgctaagtgtaggttgcggtgaccatcaacagtaacctaatgcccagaattagctttaattgcttgctaatattagtgtagatgtaaacacttaattagtgtaaatacaaatcattccattgacaggtaaaatgcaccttaacttccacagttgcagctttgggtgtttgggttagcaaactgatgtaaagaattgccacacaattaataacaaacgaggatattcacttagggcattcattaggttaaatttgcatacttgaagctattagaagacattagcccattgtaaccaggagaaaaataaagctagcactatctctttgccttccccacttcacttggctccaagcttagccactctgatgatacagtgctaagaagtcacacttttctccttataaatgactcttggcccctgcagaatacacatgtctactagggagacacagagctgggaggctttcgggagactgggggtcgatttcctttccttaaaatgaaagtttgacttgtccttccaaaaataaggtctttgtcttccatttgcttaaagaaaactgagaaacaaaaaagggattagctgaatttcctttgggtaggtagcggctgctgatcagaagggtctaatgaggtgagcagcagcaatcaatgttcaaagggaggtgacgacaaggtcaccaggtcaggcggtgccatcggatttggctgcgattgtctcgtcgataaatgtcctggcaggaaattactataaacaaactgcagcatctttttaattcaggtgtgggctgaggcgagggcactgacccataggatttcttgaggagaagaagaggcagcaggttatttctcagatttctttcaacagacaaatctatggagctgagctgtgtgtacagagatgtcctgttttcccacctatcttgtctcgtctttgcagaacatcattcctaccactgccgtgttgatgctgctagtggctgagcttgggccctcctgagtgtccacaccaaagctgagttgagacttgctttagtccatggggaaccaaaatttgtcatggtcagctagctcttcatgtctaaaggagagtattatgagttcaggtcatatataattattggggtcaaatggatctaaataagttattaactaaaagtatgaagtatagtgggggttccagtatccaaaatctttggtatcatagagcagtagcatccttagaatcatagagctgttgaatactgggcaaggaaggaggcttgggagggtgtacagtccagcaccggcatttcaggtataaagctgaaactccaagtcattaaatgattccctgctcataagtcagccctcccgctaatagaaaaaaatattttaatatttttgttgtatggctaacattttcattcaccatggatttttatcccttaataaatctaaggcatgacatttcacattctggctggtctataacatcacatgccctggtgagaatggcgtgtgtgtgtgtgtgtgtgtgtgtgtgtgtgtgtgtggccaagtggaggtggactcaggggaagccttgccttgtctgcaaagcttctcctagccctttgcagagggcttggcatctttcttctgtgccactgatttttatacaaatgccattgcagcacctttgaggacattctgtcattctgtcctaccaggtagtgaactgcttgagggtaggaaccataaattagcaattaaaaataactgccaaatgatggaccaaagcatggcccatagattatctaacactttagtaaaataggaggcagagaaaatgacacaagatagagaagaaggagaaaaaagcaaggaggaggaaaaagttgtcattttcataaagagttctgaagaagcttttggtcactttgcatttaatcccctaaatcaatttgcctgcctggaacccgggtctggggtgcttgccatgttgaggatgagctggcttcatttccagctactggactcgcagatagaattgtccttgatgttccgaatagagagaaaggcagagactgacagagcgggagtgtggggaaggctcctgcagggacagagtgttctaacctgctgaggcggctcccatggagccatgagctgcgtgcaaatggcagtcagtgtgtgctttgaagcctccagccttgggaacttcaaacaaggggaggacagacagatgatctatgggaaattaacatctaaaaggtctaaaatctgttcttcctgtcaccttaatctcctgcctgctcactgacagtatttactttctgaacatagtgaacatttaatacaacagaggctcccacacacttaacttttctaaaacagaaaatcttacatttcaatacaatccattttaattattttatttcttcactgcattttgaactgttcctttctctaggttttagaagatttccttaaggagtagagtaaatgaactttgagagaagaggtaggctagcaggtggaatgtcctgccactgctctggcagctccatggtcacctggcagatgctcatggaatcatgtggagtaacagtgcctgctgggtcaggggcatgttttctgcctcttaccttttgatttattttgattcctggaatagatcagctcactttgaagtatacctaggaaggatatataatttgtctatacccacccaccgatggatttatccattcactcatccatccaactattcatctactcatccatccacccatctaaccacccattcatccactcatcaattcatcttctattcacccacccatccatccacccatccatctatccatccatccacccatccgtccatccatccatccacccacccatccatccatccatccacccacccatccatccatccacccacccattcatccactcatccatccacccatttattcacccacgcatccatccacctaccacccatccatttattctcccacgcacccatccacccatccatccatgcatccattcactcactatttgtgcattcaggaagagagtcaatctacaaacatctttagagtacctactgtatgcccagaactatactagatgctggcaataagagaagaataatttgtggctcttcctttaatgagaatatgttctacacagtctgagcaccataagcagactatttctttttttaaatttccaacttttaagttcatgggtacatatgcaggatgtgcaggtttgttacataggcaaacatgtgccatggtggtttgctgtgcagatcatcccatcacccaggtattaacccaagaatccattcgctattcttcctgatcctctccttcttcctccaccccaggcttggacaggcccagtgtgtgttgtttccccctgtgtgtcttatgttgtcataatctagctcccacttataagtgagagcatgcggtatttggttttatgttcctgcattagtttgctaacggcaatggcctccagctccgtccgtgtccctgcaaaagacatgatctcattcctttttgtgattgcatagtattccatggtataaatatactacgttttctttattcagtctatcattgatggatattaggttggttccatgtctttgctattgtgaatagtgctgcaataaacatacacttacatgtgtctttataagagaatgatttatattcctttaggtatatagccagtaatgggattgctggatcaagtgatatttctgcctctaggtctttgaggaatcaccagtctgtcttccacaatggctatactactctacactcccaccaacagtgtcaaagcattccttcttctccacaaccttgccagcatctgctgtttctttttgaatgagttatacactcctattttgaataacgacatatttatttttggcataattttctagaaagctagtaatacagattatacattagaaggtcctggagtagatgcatggttcatctgtagtagtttaggaaagcaagcccagacacattgcaacaattctacttactaccctcacaaagaaagcattggtatatttttacatctcataactgaagtcatcttagaataaggtgttttctagagtgttccatgggtaaaggccaagagggtttaatcctagatatgaagaggctctctgagctgtcttcatggtaatcgtggtcagataaggtacacagtgatttaaaaagacatacgagtttcttcctttagggagctaccagctgaatgaaaaggtacagcattaaacgacaccaaattgtttttaaaaaggaaaacttcttttgctcacaagcactgtatagacaataaagagatgtacaggatagctggggaattcgcatggtgtaaagtcaggtaaagtctttccgaggatgtgacatttcagttgaaatctgaaggaagagggaaaaccagcactgcaaaaagcagaaggaaatgtactctacaccaaggaagcatcaagtgctgagtcttgacatcagcatgagctcagtatgttggaaaatcaaacagaggtgaatgtgcttggagcccagtgtgggagggagagtagaggtaagttcgggagataggggaaaaattaggccacgataaggagtttggattttgttttaagagcaatgggaagactttgcaggttttgaaggagagtgaatatttaatttattgtacaaatgcagatacttttgaaattaaaaggggcactcttaatcattagacctggacacagggcataaactgggtgctgcaggtaacttgggatgtaggtttttcctggtttcaagtagtatggagacaaaacttctgtttctaaaagattgttcaaactgcttagcaaataatacataggagagtgagggtggaaatgcaggcaatatagaccaatgcaatgcacagatttgggaagggaggaatgaagatgcggatgtgtgggaccggtgctgatgggaacatctgggccctgtgtctgtgaggtgctgaaatgcagcagagtcccagtcctggacagggaacacaggtgatctggcaattctagatcatcagaatgaagaagcaccacttgcagcttagaaatagtaaatttagaacaatttaagcggaggactttttacccagcaggtagtacgtacaagaaacttgctactccaagacgtgattgagactcacaatctatcaaggttaaaagaaaacgaatggaatgagttgctaagggaaacttggttattttgggtatgtccataatgttttgatattaatttaaatgaaagtttaccacagcctctccataccacactcagaagcaatagaggactgaaaacctttgtggataactctgacaattttcacatcttaaattccccactctaccaacaagctcagatcttactcattccagcaaagaaaacaaaacagataacacacaaaaaaacaaagctttcttttgtttctgcctttccttaaactaccacatcattttcctttttcctgttattgccaaatctcttgaagtagctgtgtatgtacacttgatagccttcattttcttgccttctgttgctccttaaatcaatgccttttaactttcatcctaacaatgtgtttaaagaacagtcaaaattcttcagcacagtgaaaattccttaatatcaaatgcaattacattgctcttcggatccttctgtcttgtttgcagccctaggaggtctttaagctccctacacatcagagacccccacctccctgcatggattttgacttccttggggtaaggactgtgctggatcaatcctccatcctcaatagctagcttagtgtctgacacacgtcagatatttatgaaatattgtggacttggatttggtttaaaatggcctaccctgttctctgccagatccccacgcctgaagatggtgagtgtccaataaatgtttgttgaatacatgaaagaagaaactcctggactgattagacagtcgctgcgtatttattgatcccttctagggcacaatactgtgtttggagcactggtacttgctggggtgaataaagtgagaatcttacagccacggtcttagtttcctcatcatcctttctttcactctttagcagcttacaatgctaattttttccacatctcactgctactgcagaaactccatctctaagagtatggaaatgtccttaaaaacatcatatataatgactttttcttagaccccaggaaaattatatattgcataattttataattaagagacagagatcatctaatctaagagtctccaaatttttcaacgaataatactcatttcttaatccccgtaacaccattttcaagaatatctcaccaaaattatattcagcaacaatttattttctccttcaaataaaggcatatacatatctgtcctcaaagccactgaccagcattcattcacaactgaatatttattgagttattatgaccccagtgctgtgctggatgccaaaaattaaatgatgaacaaagcagattcctttcttgatcttacgatctagttaatgggaaaaatccaagcttcccatactagtttatgtaataccagccaaaagaaaagaaatgtcttatttagattcaagcgccctttgaagatgtatgtattcttttatgcatgtgtttgaaaattttaaaatatgcctgactaccttggaggctgtactatactgtgggaatgtccagatgtgaagccattcacctggtctaatagcccattttacaggcaaggacgttaaggcccatccagaaagctttatcatagcttgctaaggatcacacatctaagcaatgataaaactggggctggcagccaggtatacatttgcaatcctgtactttttccttttttctcctttgataaaaaagcccttgatcctttttttacctttttatataatcttaaagtatctaagaagtttgttagccctagaacctgtttaacttggtttaatccagcattttccaaatgtaacttacccactatcctctaatgtcactgggcagttgtcaccatctcctgggacacaggccttccacagaacagacacaggtcaacactgacccagatagtgaagttctaactcctttacttgtcgttgaagtctcctaaccccaatgttgccatctctgtcttccatgactctatgcatcctcttctaaaattatactatacccctgagctatttgattcccttccccgaatatgccttgccttccatggctgtgtcctttctcacatcatgtcttggcctgctgcagcgtccccttcctatcagcccatctcagttccagacatctctccagcttcccattcagtggccctcaatgagtccagctggaaatcatcatttctcctctccctcccatagtactcactggctgtacctttcatctggcagtgaaaatgcattactccttgctgctagttctctttgcgtgttcacacgtcttttcctggggataggaaccttgtctttttctttgtaactcccacaggacaagcagtcaggaaaaacgagaaatttgaaagctagtcaggatttctccttctccctcaccctcactaaatgacaccgcagatttgtacatctttcctatctccattgctaaagccttaatcctggcctattatttcttgtttagtctatgttattgtctcctaacttgtctccttatctcctggctcacccacctccaatcatcctccctgcaccctcctgctagatgacctttctaaactagaaatctgatcaagttattccaatgacatctcatcatttgcaggattgagcttcgtctccttcaggtaacataaaagaccctttattgtctggttcctgacagctctccccctttctctgtctcccccaatttccttcatacccctctctctgcctactccatctcttccagcctccgccccgcccatgcctcacccttcctttccagtctacattttatcatactgagctcttatgaggttctggaatacataagttgttttgtgatttctgtacatgctattgtgtttgcttgaaatgctaacccttgccttcctacacactctcttttcttcatgctatactttttcatttcttttcattggctctgcttctgttagttactttgcggaagcttctatgaataggccaggatgagcaagttgattctctccctctctccctctctctttccatttctccttacccgcccccacccatgcacatattattagacacattgctttgcaattattgaaatatttatctgtttccccagttgggctaagagcagaggggaatgctgtttggacaatccttgtatctccgtcttctactaaagaatctggccaatgtgaggagctcagtattttttgagtaaatcaacacatgtataaattgtcaccattcgtagaacccaggaggttttccgcacgctggtgggctaagtgaatataaaatcggatggtaagttaagtgagaagagccctgcaaatgaggcaatagcagccgcaggtgctttgttctcacctaagcggacaccgagctcactggctttgctgaagcagctctgcagcacgttgagccgcagcagctggaattgctctcgtctgaatcctcccttctggaatagggaacgagggagtgaaagactagcacataatctgtggggcttaatctttctttgcaaatccccaaatactgtgaaattggcaataatccaggcaactccaaacttctgctcaccaaatagtccccaccctgcttctacagagggcagctcaggtgttttaaatgcggaagtagctagtagagagcaacttcactcctgtaacctaattcattctcagcctggaaaatggaacgtaaacatcacaacctcagccagtcagagttttgccgcacttcagctcctaggaaatcatttcaattcctcaaagtctattttccccttcaacatccatccatccatccatccgtccatccatgtgtgcatccgtctgtccgtctgtccgtccattcatccgagagacacatcgggtgtcttcctggtgccaggtatgtttcagagaatatggttatgtttatagagttcacaatttagtaaatattttgtgtcatctaagagtgctctaaaaatctataatcctgaccagtagaaaaaataaaacttttgaaaattaaggtttcaagaaagctcttatttcttaaaactgtatagaggactgaaaatctggagctaataaagaccttggtacggttgactttcccgtatgtgctactgggaatccaggtgtctcaagggacaattaagagtatgactgcctcttgtccctttcgagtagtcctttgagggttgttttatctttctcccattttaaccatattttacaagtctaacaagacttgagagggtgatgctctgagacttcacttgtgttcttgagacacatactcgagtgggatcttggttccattactttccagttctgtgacttggctactttctataaccgctctttcccttggtttcctcatctggaaaataggaataataataacactcattctctagtgcatcccatggtgaatgctagctgaaatcaacatatgtaaaaggctttgcaaatgcctggtttaacggaagtgctctacaaacagtattgaagaggatgatgtcgattatgatagtaaaaatagattctgagacactttgtatttccattttagaagtgcctccccttttttttttctccttttctctttctgagactattaaaggttgttcttatcagtaagggcagcttttccccttttctcacttcctccccactccccctttgtctggaggttccttggcagaaaggaacatgtgtttcttatatgtgagtaactctgatatctattagagtctgctgagtgcagagagcttagtcactcctgggggatgatgcgtctatatcgggcctcagctcctatctacagcctccgtcaatgtcaaaaagatttcagggcaggtgtgaggtttagaattgagggaaggacaagagctagtgagacagccttcactgagagagggactgacggggcccccatgaccatctcgtgtttggagggtctctggaagggctcctgagactcagcacacagtgctgctcatggctgggctttattcctgtgccatggtgaggacacagggctggatcataaggggtcaaggcacaggcagagtctgaaggaacccatgtgagactttcttatgctctttccgtcccaagagggtcccacagagcccactgtccctccacaaaaatgcagcaaaacatgtgggatgtttctgcccagggaagcccagtagagactcagagtctaaggtcttaactggacgctggtcatatcgtcaccctctccctagcacttactaacataccagattcccagaaggaaaatacgtattcagcataaaccacattgcttgcacggataatctaggcacaaggagccacgcttactagttaacgaacagtggaaaccttcctgaaatccaagttttctggtgccagccaaggaccaaccatgcaagcaggcctttctaagggcagcaggtcccaggaagtacactttcaccaccccctgaattcttagctacatttccttggtagaggtgatggtggggctacatcatctttctgatttgcacaaccttcatggacacacgtttatctccctgtctcttgctggctacatacttatgaaaaaggcctggctgccagaggcatgataatgccaaagacactgatgtccacaactgggcacctccttgtgagctggcatcacttagaatcgagcctgatttgccaggggcttttgcaccctgtcggttggcctccacttcccttagggtgtaatcttagtcccctaggatttcttcagccctacccctggctttctggctttcccatgggtatcctgttactgagagctgagcatgaaggggacagtggagtcagaaaaaatatccctgtcagctgccaaaagaagacatcattttccattgcatgtgagctctattatgaagagctaggaagggcctacacatcaacaccaaaatattaataaaaagaaggctgtacggtcctatccccaagtgctaaaaagactttagaccaatgtgacctgtggtataattgcacaatttcaagcagcctttctaaattaaaacgtaatcccccagcagtgaggggcttgggtggcccctccccctccctgggattcatttctctcttccaggcccatctctttcctgccgtaaatctctttccttctgtctctctgtctgttcatccttctatgtcctctatctagcttttcctttcttgataaaaattaaggaaaaacaacttgatagattttccgataaccttctagaaagtctcaccgggttacattttgctttaatagcatttaagccaatctgcctgatgttgctgtaaaggtcaattaaattcaccctaaaaatttcactcctggctcattatacaattggaaaatgaattagaagcacatgctgcccctgaggtttctgatatttcactaatgaatatgtcttaaaatgcaaaaagaaaaaaaaagagagagagaaaagaaaaaaaggtgttgtaggccacacagcagcttgcagtgctaccagctggtgcagaacattgtcataggcagtggtctgagactagtgaacactaggtaggcctgtctccactccacattcagaggtgttcacaggtcccaaatgcacgtgggtctggtcagctcttcaccactcctctgcacatccagagcccactgttaaaccccaggggaggcatccagctcacctgactcttcgttggctgctcttagtgcggtctcaaggaccacagttcagtttaatatcagcctgagcaaaatgtgattctgaaggtaaatctacaaggatctttgtgggcagagcacgtgtgttgcaaagccaggtctcagttgatctggggattctcagactgtctgagaattttagcattgtaactgtctgaggagagaacagccctgtggaggagggaacatgtatttctgggtcactctgagggcacaactggggccaagagtacagagaacacaaagtcaagtttgagcccgacttaaagaagtaattttaactgactttctccccaactcctgacaaaagaaagccatcagacaagatagcaacttcctggtccctgaggaaggcttcaacagaactgagcaaccctatcccaggagtccatgtttcaggtggaagtctccttaattcattcactcatttcttcattctgcatatttattgctgtgtcctagacagtactaatcttgagaatgaacacaattgcctagttgttatgtatgaatcgagggttgttttttatttttgtttgatggtaaggttatattttaaaagaatataccatatctaagtccctagtttcaaaaactgtcctaaaattcagatttttgctcacattggagttgtaaaggactttcatgttcctcttatagcaaaggctgtgacttttctgctttcatgaaactgcaaactggtatttattttaggacaagatggctccaaacctcgaaatatgagttattggatgtctgtcttcaggtttaagtataaacctagctgaattgactaaaacatatagagacaatctctcaagcctttcagagcggagagaggaagtctggttgctatcctccatgcctcacagatgttcctataggattttaggattccagactagaagtgacattgaggtcatctcactgaagcttatcctgtctaaaacgaggaagctgaggaggcttcccttgggtagtacaagaacaagacattcttcagccagggtctctagactcaagagcagtgttctttcatggtaccatattgacttcctccatttgcaaaattgtgctactcacatgtatggtgttttggaaggtggaaccaaaatttctaggaagagtgagattgcaaaccatcatcatgtgtgttgagagtggccaatcaggcagtgaagaaagggggaactggtgaagccctgggcatttcacctcagggctgctgtctctggcaccctgatggtgctcctcaaagcctgcttctgaaagatttcatccaggtgttgttgatgtttcccattccatttcctggtgtctccatgtcctttttctttattgcaaacctggtgtcagcagatgttcttggggtcctcctgactccactgtgcagcaggctgagtgcagtcagactgtcattgagaagtactgtaacctgggtccaggaagcgatgctccaagtcactcagccactcctcagcatcactgacactcagcattctaaccttggaactgcagaaatatagtcgaatgcaaaggccatgagctagagattcatgtttgaatgaggaaggggatttccctttccttctttctaaactgaacctgcaaaccataacatggaaagctgaatactgtcctgtctgacgtccacaagagcgggatatggagaaacatgagcacagactcaggtccctccctcctcccatctgccttctcttccctaaaaatcttccacaggttcaggatgtcctgctgccaatcaaacatgagctcccatgccacatggctggggaggaccagccagcgcttgtaggcctggcaaaattgaggatgcattttgatttactcacatttaaatatcagagctagttttgatgacatactatgtaactgaacataatcaagtttcagataaaccagagcaggccccaaaagtgcacctgatgaatttccttgtagaaatggagtgttggcagaataagaaatggaatgcatggagtgcccagcataagaagtcgggggtcagggaggaaaggagggaaggaaggaagagaagtgagaggcagggagttagatcagtcaatcacacaattaccctgaagacaagaaatagaaggactatctaatttaggatgttatatatcctcttgaaatgtaaagatttagacaagaaaaggggcaggggagaaaagcaatccaacgaaagacgaaacaaatccatcagggcaggatccatcaggaaggaaagagtgtggagcgactcctttgcttaatgcgggcttctggtcagtccctggagcttgtcatgtgacagcaggattctcctgctgctggagagcctaataggcaggattggtccaggaactcctcccgctggactgactggtttcaattaagactatcacaaaggctaattatcattttaaacctgactctcaggctcactctccctcttgctgtaaatggattgcttaatggtcccagtgcaaggctctgaaaccctggaggtttcctattatttctttgcctccagcagggaccagggacttctagagtgttaggtttcaagggagaataagagtagcaataccctctttctttttcacagaaacaaagactgttagcattgagggaatgttcgattttggttttgatatagtcggaccttctactgcatgaaagagtttccctatgtgccacctctgaccaggatttcctggcattgtttgaacacaactggtgagagggagcttgttacctcctggtccattttggacagttctcatattcagaatgtctctcctaatgttgagctgatatctgccctttttaatgtccatgattctttcccagttctgccctgtaatgtttctgggcttagacaactgacagtcgactgagccagcagggcctgagcttgggaaagaggaaagcttggcaacctctcccgcaccggcccagtgggtctcccacctccagcaccattctgtgtgggtgttccatgttctggaacctgcctcaagttgcccagtctttgttagatgagcacatgcttcattttctgggctgtatcatgcgctctaccctgagacaatgtacaagtccccaaaggcaggtattagtatccccatttacagataagaatgctgaggcttagaaagatcgagtagcctacccctgatcacatggctgacaaatggcaaaagccaacactcaagccccttctgttggatcccaaagcctgttttactatgtcacaccaagacaaaattcagagtatacagtttgccaggtaacaatgtgcttgtgagcataatataaatcaatgtgtgaagttgggagtgtccagaagacccctgaatgtgttgtatttatatgaactatgtgattggttaccaccggagctattccaaaggcaatcactgtattgtgctcacccagcctaacaattcccttgtgctctgcacttgatagctggtttaaaaatcaaaacccaaaacaagcaaacagaacaatgctagcagattcttagtacagttgcatgcacgtgcttagcctggcctagtggggcaggctccctgccctcacaccctgctcaaccctcttatgctcacaggtgcacacacacaggtacacactacacacacactcacatacacaccaaaaacacagacaccccacacactgacacaccccacctgctctcacacgttgcacacacacaagctacacacacatgctacatacacacatgctacacacacacctcccacactcacacatgctacatacacacatgctacacacacacctcccacactcacacatgctacatacacacatgctacacacacacctcccacattcacacatgctacatacacacatgctacacacacacctcccacactcacacatgctacatacacacatgctacacatacacctcccacacactctcacacatgctacatacacacatgccacactctcacacatgctacatacacacatgctacacacacactacacacacaccccacacactctcacacatgctacatgcacacacacacacatgctgcacacacatgcctcacatacacatgcatgccgcacacacacggtgcacacacacagcacacacaccacatgctgttcacaccctcatgctgcacacacacatgcatgcgttggcaggtgcttccttttcacccttctttttccattcagccttgtcccaaatttacatgggaataaataaaaaacaaagcaaagattgcctgtgggggtggggctgtccccctcaatggcatctgcaggttgctggctgtgttttgcagcccgaggcctatttctcagtcccagctccttggggccagaagcctggaacaaacccaagggcaggccttaggcacggggacctgccctgactcctccgtagggccaggttggccatgccttcagagctccaaatcccaaaggaatgagtatgcaaaactaagacccacctcacattaatttagtgggtgaactgtgtgtctccccctcccctgcaaatctatatggactaaaaatacctgcgccctccatggcgcccaagactgctgacaaaggaatttgcatttgcagtcagaaacaccctcggattatttttgaaatcacctcccttacattttaaacaggttggtggattcatcatttaggctgccaccaggaggcagctattaagagatgtgactgggaatggcatttttcttaaaaaaaagtggcgatttcactacaatgtcgtgattttttttggcttaaaaataaaatctgtttgaacctaggattctttagacaaactgatatcttcagggaaagtagattaataggaaatgtttttggaggaaccaggtgtcttcccagttcccgtggaatgacagcaaggacagtgcgcggcagccaagatggagaacagggaggaggtgggggaagggggcactccctttccttctgggcctcttggactaggggaggggaggacagggtgcaatcgcaggatcaattagcagcccaaaagtaaattagccaggaaattagcttttcaggtgtccaactgtgtgtcttctcaaagactgcagtcctacccatctgctatttacgctttgtgcagggctcgggaaagaatgtggtcccacttacacatccagcctgccagagagcaggtctcagggatgcctaaacgcagtggggaagttggaaggatccgcaaaggctggagtggagaggttgcagcaaggaggaaaacgctgtgtgcgtgcggatggagaggtctgcctgtatgtttgtctgtgtgtctgggggtgtgtgtgtgaccgtgtgtgtctgtatgtgtgtttacgtctgtgtgtatcagtgtgaataaccatatgtgtatgtgtgtgtgtgtctgtgtgtgtctgagtgtgtgtctacctgtttatctgtgagcgtgtgtacacgtgtgtattgtgtaagtgtatctgtgtgtgtgcgtgtttgggtgtctgtgtgtgtctgcctgtgtgtatgtgtgtgtacacatacctgtgtgtgtatgtatgcatgtgtgtgtctgtgtttatgtctgtgtatctgtatgtataaccatgtgtgcatttcttcatatgtatgtctgtgtgtctgtaggagtctaggtctgggtgtctgtgtgtgtaaatgtgtctgtgtgtatgtatatgcctgtgtgtatgatgcgggcatgagatttgcagagagggtgttggggcacaaaatgaggacttggtttacacacaagcacaggccacggaaccccaccaccagcagatggagctgaaggtacagttttgcgggaggccaggctgaactgccagctgttttggtttgctggagacctcagaaagaatgaccatgttgagtggaagagctatctgcatggagagagaggaaaccccaaacacaccctggagtcttgcttcttcactacgaagccagtattgttttgacttgctgattgaattgcaggtggaaactaaatacatcgtaccttgctttatttcagtgtgtgattgggagataagggtccccctgtagccagtttagaattagaattttaaagtctggataaaccttaaagaatccaaggcatccttttgctttacagatgagaaaaaaaggagctgaattctctggcgtttttgtttcctcgccctcactctgtccaagccccgcagccacccacccttttttgtcccagtctttcgtatcaaaacctccctcctacctctttttccttcctgtccagtacagtctttgatcacctcccacctgagctcattcaatggtctcctaactggcctccctgcctgtgggctttccgcactccggccctctccacaccaccacaaggttaaccttccagcccagctctgattgtgtcgggctctgtgcagacccttcagtgggccgccactgccagcagctgcagaatcaaacccggctgtagcctggctccaatctggaaatgacacacctttccagcctcacactgggtcacctcttttgccctccctcttcgagagccaaactgagtttcttgcgatgtccgtgcacaccctgagctctgtgtcactctacctttgttattgttttctttttcaatttgtcctcgtcgtattttatttccaaatgactcctcaaatctccccttcacatgctaccttccctataaggctgtcctgatgacatcagcaagaaagatctatttcctgctctgatctctccaggcacttcctcttgacccctctgctgtaacctgggcctttcactgtgattatctgtattcacatcccatccctctgtcttgaagagactcaccactttgttttcccactactgttgcatataggaactcaataaagttttgtgggcaaatgaatacaagtatttgaccttacatacatttttcccagctcagcctgcatttgacgtggtttatggtggtttcctcagctcagtctttcccactgacagacagcatgaccacgtgcaatcaccccccagccccccgcaatgtgccttcagtatcctcaactctcaattgagaacatgagtaaaaattagtagatttcactttttttaatgtgtgtgctatcccctagcgtcaggcaagtttatctcccgggccctctcccttccttgatgactggaagagggaacaggcgcaaactcatagctgcttctccccgcctacgcgctatgacttgttggaaaaccattgtttcagaggaggagtcctttccggccctgccagtcattgtgtgatttacaacaactccttctacctttcgtagcttgaagacttccccactctccttcggggtagatgtggaagcaatataagagtgaagaagttctactgtctccggcatctgttaacatttcactggcttcccgagaaattggctcatcctgtccttgctcatcttttgtcccaagtaaaatttaaaattatttcagatggcttagtcgatgccagcttgtagccttccaactgctatttctaaaaatttatgctctcattttattttattcttaggaggatgatagacttttagaaacagaaggaaacttcagtgataattcagaaaatttaatttaattgtagatctcaggcccaggtgccactgtcccatgctttcttccttgtcccttgtccttcctcatctaagatagctcctggaattcccattgaaatggaagcaaatcttaaggttagagcctggcccatccagctctgaacagttactgctctgtgagcacggctctcactcacctttcctatgccttaaggacttcactgttggtacagctttaagtcagccgatatttactgatcacagaccatgtgctatgcaaaagtcatcttatttcattcacacctcagctgtacagagcagacgctaattttacaagatggaaaacagacacaggaagtttaagtaacttgatgaatggccctcaccttcaggaggtgaagctgggatagaagcctgggaattctggctcgagtctttgcttttatcgagtccattttcatgcactcttgtgaaggcaaaagcttaggggaaggaaaaatagttccatgctgaagtcacagtagaaagaaagtggatgggctttggatttagagacagctgaaatgaatcctggttttaccatttacttacatgatcttgggaaagctactttaattttcagagcagtggtttctttattaacaaaatgggataataatactattgcaaatgaaatagcacactaactgaagttgtatgtgtgcaatgcctagcaatggctcctggttgaatattgggtgctctctgaatgatggtctctttcctctgagtagaaagcttggcagcccttgtcccgcctgatgggtgccccagcctggtcatatgtctggagcttagcctagcctaaggttggattccaggctgtgagccagcgagggccctcctctttaagcagtgcccctttgtagctctgagcagcttctctcacccctccctaccttttctgaggttcaaggaattctattcccttgaatcttaagggggagaaagtgctgataaaaagacaacaacttgcaaaatttagaagccaattctcagagagaaaatgattgaaataaaacccttttagcacaggacacagcatttctcaatcagaaatgagcctaagaaataacccacatgtactacccaatacttaattttcaaaaaaagcttatcttcggtctccccacctcccctaaaatgcaacatatttgagatgaagactcaaatgcgtcttttaaaaaatagtcctatttcagacctgctatagtaggtgtagcagaaagaaggtggtaagattgggtctatttaaggacctgacctaacctaaatacagaatctacaagctgccatacagaaggaacaaatgtgagaaagctcatctgaaagcaccattacatttttatgagactgtagctgaatctattgtgagtttattatctgttgctgcacatgcaaaacactaccaagaaagagtttgtgtgatcatgtgagtgggtatgcttgtgttttaatcagggagaacatgaaaaccaacatacgttgtccctctgagtcttggcagctcagagttaaatttagtgctcagtggtgctcagtcgcccagcccaggtggtgctggatacatttctttccttgttcattttaactttgtgttcctattttcatttgtagctattctgcttcatatatattttaacatcacaagctgtctcagaccctttttccaagtaggtggaatataaatcatgagtaaataaataaagctactgaggcaatgagtgacttctgaggaagtggaggtatcacaggcaggcagacacagcatgactgaatgttattatagtgtggtttatactatgatgatacaactatagctattagcgatcaaacattgtttatgcattgttgcctcttctatgtttattaattgatttctataagcttacacaaatagtttatcaatatgaatactttgcatttatgggcttgttctctccctgttaatccaaggagatgcatggagagaggattgcacctgttagctgctcctctctccctcccctctagagactcatcatgctttgtggctcctgtaggccaccctgccctgggctccctggggaagtctttcttccttttctttctgcatttgccactgttggtcccctaggtctttcctttgtcatcaggtactgtgtcttctcttccttgtttccctgcagctcctgcagtttctccctatgaagaataaagagcttcagccaatttcagtcctaaaatttggaggaatgtgtcagtatcttcaagggatttccaagctcttcctgaagacatgctgtgtacacatgtcttcatgtacactcccttgccacattcaggagtttcatttattctttcatgctactggattgtgtgtcagtgcctctaagacatcttattaccaaatcattctccactgggtacaattccaccaaattccagccaccctcaatcaagagtaaagcagggtcacgcagatctggcacaaactattcacaaacaggtgaggaaacagaactcaggagcttgggccagcctttaattaaccttgagaaagtcctccctggagttttactatggctcagcagcaactggcttttgggtgggaagtggcagaatggttatgcacaaggagaaatagatattgacatactgaggaatacttagattcgtcgatttctcagtgtccttcgttcttgttgtttcatttgtcttgattccccaaaagggccagtggctgcctcacatattggcttgttcagccaggatctatgatcatgttttccacttcacaaaagccatcctgctcacattaccaaacagttacctatcattttctggctctctgtcaaattttggtaaattttgcagaagcccaaaggagttggtatatctctctgcatgtgtgcatgtatagttgaaagaatatgaatggtgtatttatgagtataaaatggaattgtagtattttaagagcccgtctaatttggtgattcatatttttatatcatttgatagtggctagattgaaagctggtaccattaagattttgttaaagaattatagtatcatactgtggggtaattagaccagatttataggggacaatgttgacacttaaaaccagcaagagaatgatttataatcctttatgcatatacccagtaatgagattgctgggtcaaatggtatttctgcttctagatccttgaggaatcactacactgtcttccacaatggttgaactcatttacactcccaccaacaatgtaaaaacgttcctatttctccacatcctctccagcacctgttgtgtcctgactttttaatgatcgccattctgaccggtgtgagacacatgcacatgtatgtttattgcagcaccatttacaatagcaaagacttggaaccaacccaaatgcccatcaatgatagactggataaagaaaatgtggcacatatacaccatggaatactatgcagccataaaaataatgagttcatgtccttttcaggaacatggatgaagctggaaaccatcattctcagcaaactaacacaggaacagaaaaccaaacaccgcatgttctcactcataagtgggagctgaacaatgagaacacatggacacagggtagggaacatcacacaccggggcctgttgggggatggggggcaaggggagatacagcgttaggagaaatacctaatgcatgtggggcttaaaacctagatgatgggttgatgggtgcagcaaatcaccagggcacatgtacagctatgtagcaaacctgcacgttctgcacatgtatcccagaacttaaagtgtgtgtgtgtgtgtgtatatatatacatatatatataccgtatatatatacatatatatataccgtatatatatacatatatatataccgtatatatatacatatatatatacacatatatatatacacacatatatatacacatatatatatacacacatatatatacacacatatatatatatacacacacacacttttaatgtatatatatcagctgatacatatatatcagaatggcgatcattaaaaagtcaggaaacaacaggtgctatctctccccttgcccccatcccccaacaggccccagtgtgtgatattccccaccctgtgtccatgtgttctcattgttcagctcccacttatgagtgagaacatgcagtgtttggttttctgctcctgtgttagtttgctgagaatgatggtttccagcttttatatatatattatatattatatattatatatattatatttacatataatatatttatataatataatataatatatatatatatatatatatatatatatatatatatcagcaacagggtgttagtcccaagccttgatggttgcttcaatgtgaaaagaaaataaaaataaaggccttcttggtctcacctgggctcccacagttcaaggtctggaaagaggtaggttggggaaaatgtggcccatcacctctcctgcacacaaatgggatgagtcattttgactgacagtccagcaagatgtggaacaagagctataaatctagggcatgtggcatgctgtgttttatcatgcttgtcatcctggttttaagtcatttctttgaagaggaattgtgttcatcatgatggctaatttttttcaattgtttttaaaaacaaaaaaaccaagcagcagcaacaacaaaataacagttaagacattctccactaaagaaatattgttgcacaccgtatgaaacacattttaaacccagagtttatatttcaattgactaagtttcttaattgtaacattcaaatcttacaggccccagttttgagggtggtagttaaacctttactattttactatttcttgtgcattctcagccaaggactagcaattagtttaataaaaaatttgtcttttgcgtagatctatctctattccttctaaaactgcctaaattgttctctaaactagttcatctaaatgtaaggaataattaggatcattttgatttggttaatccaaagattaatcagggctgtattattgccaaaggtcttattccagcccaggaaaaggatcataataccaattctcaacccttatcagttggattttctgtacgagggataggtctgcagtaatgagaaacttagttgtgatttgtaattgaagagagtttttctattaactaactatgtaaagaacaaactcaggaaggcgagggctgaggtccccttcttggtgcctatttgtatgacggggcctgatggggcagcagccggccaaaggcaagaatagagacttaagctgagacagaactggggccttgtcctggattctccacttgttcactgcgccttggaaaagctacttaaaccccatgagccttatttcatcacatatagaatgggtttaatactttctccttaaaatgtttcccctcactgtctatccttcctcacttaatcaaaaaattctggtttattggttttatacattgggcttcctggaaacattttacgtagagaaagtttccctacactttaaaagaaaaaaagagattgaacatcactgcttataatatttggtgagttccttgaaggcaggatctgtgaattgtttacacctctgtcttgacagcctggttgaggacctggtatttaatatggtaggctctgaatttttggaatgttgaatgaatcagtgaatgagtggatgaatctataataatgcagaaaatttatgttttcatgtccttcagccaagcactgttgtgcactgtggtgctgttatattagacgaagaatagaaagttaaaaagaaaaaagaaagctatacccaaggaaatcagagacgccttttgtagcattgtgaaatgtcatggattttaagtcacaagaaagcaaaaggatccttcaacagtttctgtacacagccttgcacaatgaatcgcataagaaaggcttttggtaatgacgacattgaaaatgatgatgagtctcccttctgtgggcttcatggacactgtcctggagctggaagtggccagctggcagggaaagagctctttcccactcatgtctttgtcctttgtttattctcgattactccctttagtggaaggctttccaagaactgtttttcagttcctggaggctgcagcagtggcatcctgaagggtgagtggtggcagaggcagcgaggagcctcccaggctgaggaggggcccagtgcaagggagagtcgggcccaggagtgacactcaacaattttgttttgaacttctctgttatttccagcaaagcgatttccgtgacattttcttgtggcatttgaagggggataaagtagatttttttttctttatcatatttttttccttttctccctctccaaagcgatttatctggtctttctccaagagtcagcactccgcagaggctaatcaacagtgtgcatgttgcagaaggaggcatatgtgtgcttctccagctgtgtgggtgcctgtgtacacacacttgtgtgcgtgcagtgaggcagcagctgtgggcacatcaggagaaatcctgtcacataaagcttgtgatgaagatgccagtgataaacaagctgccggaggcccactgggtctcctccactcatctcccaccacattcagactctctggctagtggattatccataaccaatctttaatccctggcttggtctcaggtgcctggtcctattactctcctgatgtgtgatcatgaaaagaccaattaattttaatcttagcccaagcaaaatataattagacaaatctgctagaagaatatcatatgaggcatttcaaagccaaaagcaggtcaaattctgccattggaaggccagaagacaacgttttgttttctctttgtgcagtagaaccaccattgaagagatatcacttatgctactctccacagcaaccagagctgagagaggccaggttatatgagtgagacaacctcatttttttctgtctgtgaataaaaataacaatggctatgctagaaccgtagtgcaaaatgtaatgaaataacacctgtaaactgtaaagtactatatgaggagaaggcatagttttatgaacacaaagcataacttttttttttttttttgagacagagtctcactctgtcacccaggctggagagcagtggtgccatcttggctcactgcaacctctgcctcctgtgttcaagcaattcttgtgccacagcctcccaagtaactgggattacaggcatgagccaccgtatccaagtaatttttgtgtttttagtagagatggggtttctccatgctgtccaggctggtcttgaactccctgcctcaagtgatccacccacctcggcctcccaaagtgctgggattgcaggcgtgaggcactgcgccaggccccaaggcatactttttactgaatgaacacttgctgtgctgggattgtgcccagctccctgatctgcagcagccactctttgggacagttcatctcctccctcctgttaaggatctgcattgttcagtgccacctgccaggacctatggagtctccccacgttggcttttctcgcctggcctcttgtttaagttggttttgggatttgaaggagtaggctatcttcaagagtgtgtccaccaggaacctggccagaattcctgacttcaaaagaattcttaggaagagtctcacatgacaatgaatgcactcacagagccgcagaaacccagcaattcattcttcctggccctgagagggcccttttgtatctcccccacccctattccacccaggatgcagcagtcacaaagcaatcatgaaatatacccatctcgggcaggcttaaatctctgttgggtctccatttttctttctttaaacacttatggaataaatggaatttataatcagaaaccataaaatgtctgatttattactcatcttgatgacaatatttaataactcgtatatgtttcattgcatctttctactgccctgttgtggaattttactttaagggagcccgccctctacgtctgataccacaggagaagagtctcctttggagtcaggggctcagagttgctgtgagggtgctcagctccctccaggtggggtgggaatctcagcttctcagggcagggctggcctcgtcccactggacggtgttctcacgacacctgcgatgggggtatgccagggctttgtcactgacttccatgctggaaattccatatttgtagatgaattcctttggtccttgaaagcattttcttttcatgtgttctttgttaccattctgctgttctcgggaggaaaacgtgtcctcattgagtttggggattctgtaataaagagacatcctgtgagaagggggttgtgcctagagttggggacaggaagaaagctcgggagggaagaaaccgaagtgggattcaaagcgaggccagcatgcttgatcattttgcttggaaggatggacttaccctgttaagctcctgatcttttctttaataaaaaatatgtcttggcctggcatggtggctggcgcctgtaatcccagcactttgggaggctgaggcagatggatcacctgaggtcaggagttcgagaccagcctggccaacatggtgaaacaccgtctgtatttactaaaactacaaaaatttgctaggcatggtggcgcatgcctcccagctattcaggaggctgaggcaggagaattgcttgaaaccaggaggcagaggttgcagtgacccgagatggcaccgctgcactccagcctaggtgacagagggagactccatctcaaaaaaaaaaaaaaaaaaaaaaaaaatatatatatatatatatatatatatatatatatatatatatatataatgtcttatgttcatacagcactttacagcctacagatattatttcattaaatcttgcactacctctctgtcatagccattgccatttttattctttagacaggaaaaatagggatgtctcactctcatataagctggtctttctcagtgctggctgatgctgcactcatgagtaatatctctttaacgatgactctctcttaaaataaagtgagaggggaagatctttgcctaagaggagttcccaccacccctaaatactccagtgttcacctccccggagtaacggctctcacttccttgccactatgtacgctgccaatcaggaaattgacactgatgtcaataccacctccaatccacggaactcactcagcttttgtcatccatcctgacaatggctctttttcctttctgggccagaatccttcccaggaacacactgaattcagttatcataacctacagtctccttcaatccagagcagttccttggtctcctcctacctctcagcaaacttcatgtgtattcaggcttctcattctgtaaaatgacctcgaacctggatctttccaccttttactatggcccatcccaggggtgcatctgggtggaaacatcacagaagtgatgctgtgctttcttgggggccttcacatcaggaagcacagcgtccacccgtcccgcagtgatgttaaacctgattcctgggtcaagttagagactgccagatttttccactgtatggacaactttttctggaaacaacataaaaacattgaaattttgggtcatcttaatgatgacagccccactcccaaccaccaatcttcaacactcttacttttaaactgaagtaaacttattaggtgaattcaagaatataaagcaaaatcgagggtttcagaaaggtggaatggaaaatagtcctgctcgtcagctttgtagcactataatgtcttgggaaaaacatgactggcttcaaaatcaaaacatattaattttttgaaaaaaatacttatttgaaaaatattgatttttttgtcacctttgaatcagaaagattggaatctagctcctgaggtcttgtggataaacttccaaaaaatccttggctcaagctgtggctcttctcttgcagtcttaaatagttgtcccaaattcctttcctcttcctagattccatatatagtcttctttatgtttcaatggtctgtggccttagaatcttgaagagttgaaataattatctgttataaaaagtggggtgttagaagttttgtgtttgtctgtgtagtgtttgcaattgttggtttgctttttgcttttaccaccttcaaggattacaatagattttactgcatagagccatagtggacaggagataagaggctggagacatcgaaacatcaactttcttctttctattccgcctccctaccctctcccacatgcacaaacacacatgtgcacacagccatcttggcaaatggctaaatctcttccgacccagcagataagtcataaaactctcaataaatcgaaccaagaagactagttttgagattgacttttttctccttttttgaaccactgctgaagccttaaggaggctgcagcccttgctggtgctggctctggcagcagaactcctagtcatgctcagttccacagcaaacagacctggatctaatgctgaattataggctagagaaggagaggactcaaggggcagataatcacaggctataaataccttcaaggtaacaatgcaaatgagggaagggaattgttcatttgctcagcaggtgctaggacaaggagcactagcttaaagctgaggaagagaaagtttaagctggggattagcagagaagctcctcacacagagagtttcctgcccagggctctggacttgggagtccagtgccaggtaccagggacagaagcatgataaaggcattggaaagaattcctgctcgattcaagggtcacagggctaacccacagctttctggttgttatctatattcttaggatgacatatacacactctcatttgcctccggcgttcaatttatagcctggctgttcaggaaacaaattcctctggttcagttccttgtggcacctggaaggataaattccaaatctcactctttttttttttcttttgcccccaaagctggggttagctgaattcatgataactaattctaaactctgataggtgctaatcccatatgcaaagatatagggctcctgaactacatttggcaggtagggaacagtcagatgcttaaaagatattagccaccactgaaacaacattccagtggtaaccattactgcttaaattattgtctactttctgaatgtgtgtcttcatggaacttgccagaaccttcctatggagaggaatcagtgtattcccccatggtctgctttcctacacaaatgtccatagtttccaccctggtttcatggctcatttcctaaggaggccttcgctcagctgtgtccaaccaagtctgggctctattgtttgtgatttgtcttccattccattgccctcattcacacgcgttgagtgcttaatatgagaaattaagacaataaggacataggcaaatagaacttttccttaccaccctcctctcaacggtttgagggagcacttcagtagtgaaaggtacatggatttgaaatcagaaacaccgagttccagtcccggattggtcagtttttaatgatcggggtcattgacttgaccctacagaatttcagattggggataataaaatctacctaaaatgtaattgtgagctctcagttacacacacacacacacacacacacacacacaccccccaaagctttgacgcagaggagcagccaatactttgtggacaccagcatgcaaaacacagcggaaaaagtgcacagacagaaagagtgtgaggcagcattttactcctccactaagaaaagctgaaaaatgcagtaagggcatttagaagagagaaagatatccccacttaggaagtaccaaaaaggctatagggttgtcatattttcagcctacaatttgtttctctccaattattgagtaccttgtctacctactcttcactactgaggagtaatgggggaacaggacaggtgaagatgagaagtgacctgcattcttgaagagacagggctgtggatgcaaattgctattccaagtacaggcacagcacttgcaggacagaaggttgcggggctgaccaaagggtgtgctgtgcccatctccctctccagtagagaacaatgtcacacaactttcttctctttgcctaacatcaattaattgcgatttagaaaatagggtgaaatccaggaagagcttcacagaggaaggatatattccaacaaagggcccaagtgagtgtcttgcctgtaggaaaaggataacagcagaatacatatgtacattagtcagaattatctagagaatcagagttggtaatcaatagggtgtatgtgtgtatgtgtatgtatgtgtgtgtgtctttctatctatctatgtgaaagagcgagatttgaacaactagttaatggaattacagagaccggcaagttcaaaatctacaagatgggccaacggggaagagctggtgtcccagctcaggtcctctggctggcagaattccctcatcttcaaggcaggttagtcattttctattagaaccttcaactgattggatgaggctcacccctgttatggagagtaatctgctttactgacagttcatggatttaaatgttaatctcatttaaaaacacctgcccatgacatctggaataatatttaatccaatatctggatgctgtggcccagatatgtggacacataaaattaaccgtcacaacatgatagagaagttacttcatcacactggtgctaaatactgctctctttacattcggagtatctcgtgaagagagtggggtttggactgagccttccatgatgggagaagttgagggaaaattcaattcacaattccggtgaggaatgatgtatctgctggatagaaaaagaaagggaacaaatattctctgcttatttgtgatgggttctgaggcaggcaactcttagcttaattcaagagatcttatttaccatatttaaacatttaggcttgctgcaatgagcaattgataaaaggtaggagtttctacttcactgtttttttttcttttcctgagaaaatagggaataggtcaaaaaagttcaggaaaataacgaatgaatgggttgaggagaaagatcaggctgtgcaaaaagcacaagcagtcacactccccatgacataaagttgatgacatatcctgagtgcacatttctactgaggaaggaaaagatggcagcacctgccaaaaggacttctgtgctccgtagcctcacacccagaatatgactcaaaccgtccccatgaatgagaaaatcaaagatttttttcttgggctgtttgctacttgtcaagacttacacatcaggacataaccttttcatgccaattatagtgcatcttctaataattaaaaaggaaaagtcaaaacacgaatatttcatattcaaaggtcacgctatctccagtctccttcccaaagctggagacggggaactggtgggcttctccatcatgatgccacaaaatccaaacggaaatcatggccacttgtctacaagtaggtcacctcttctctctcaaggcatccagagccagagcctgtccagatcacagagagattctcagacacctttgagttatggccatagtcacagagcctctaaattaacagagagggagagagaaaaaacagcaccaggtatatagcgccatcactgttcaaatgaagaaactgaagtctagagaggagtgattttctttttgcgacacaactaatttgtggcagaatcaaggctcagactcagttggtttgacccccataccgtgcacattctctttggcttagtttacgaactcggtgtctgaaatattaaagcaaaaggtggtagagggaagatgacaagccagcaccaaaaccaggcgtggtttccctactccttcaaaggcaggaggctgtagttgattttcaaggtaaacttcactcccctaccaccccctaaaagtagaaagggcagcatcatatctttgtacgtggacaagccctgcttttcatggccagatggcattgaatgggagtgggtcttgacttttcttttattaaagggatgcatgtttgtgtgcactgggggaggaagtggccatatgatagctacaaataataatatttaatagttactgaatccttaataggtgacaggagctattctaagcccttcacagggataaactcatttaatctgtacagcaaccctacagactagatgctagtagagtccccatgttatggataaaaacactaaaaagttggctgggcatggtgactcatgcctgtaatcccagcactttgggaggctgaggcgggcagatcacctgaggtcgggagtttgagaccatcctgaccaacatggagaaaccctatctctactaaaaatacaaaattagccggacatggtggtgcatgcctgtaatcccagctactcgggaggctgaggcaggagaatcatttgaacccgggaggcagaagttgcagtgagcagagatcgcgctattgcactccagcctgagcaacaagagcaaaactccatctcaaaaagaaaaaaaaagaaagaaaaaagaaacagcaacactaaaaagttagaaggttttaatattcccaggtctcatagctagaatagggcagagctgaggtttgtggctccagaaacagtgttctgaactcccacaccacagcggccatgtagctttgggcatctggaggaagtaccgcctgtaaccactatgacattccacaaataaacaatccttgggtctagcacagggaaacacgggtcccaggggaaacaccaagaagagcacacagtgatcggaaatcatggaaagggggccattcgggaagaggctcgccatcctatcttgagctggtgattgacaaatcccataggaactatgtcacctgtgggttcctgggacaaaacacttctgtacggggaaagaagacaaaggctcttttgtagaatacaatggttaataattcttgagtgcttcctgtgtgtcagggctactcttagccctttaggtgcattcaaccttcacagcataccatgaggcaggggcagttagtggctctattagctgaggcacagaactttgcagagcaagagcccagcattacagctgggtaacagctgatgctgagacccacggtttgggtcaagcagtgtaatccctcatcctaatgtaaagaagagcctcagagtagagcagggttgacagaggccacggctctgaggagtgagtaggtctgcaggtctgtgaagactggacaccacacctcacccgggaagcagagagggtagggtttattcattcatccaagctgagcacctaatgcattccaggcactgggtatacaacagcaaacaggcaaagactcctgccctcacagggcttccagctggagaggaaaaggtgataaagggaagagagatccggcatatctgtgagaaccaatctagcatggtggagcccttccctcaagcctgcactggctacacaactgcgggcaggtgggggccccgtggagagccagctgacacataaaaatggccttttgcatttctgctgacatgtcgtctgtatctgatggagcaacgtcttcattatgaaattagatgaaaatcccgatgcacaggctaatagcatcccacgctcttcctcaggggctgagcagcagaaactgcaagagcaaggagcagagccagagcctgcccccaccccatccaattccattttcatacccacctgtcatctccccacaaacgtcattagttcacagaggggaaggagtctcattgcattatcagccaccacaacaaaggagctttttgtactgaggccgcggttgaattatggaataactagatacatttgatacaagaggctccctgatgggacagggctccctggggcccaggttccttatctccagtgcaagtgtgagcagactttctgcttaggaaggctgcacatggtggccactgaagaccagagaggtgtagttgatgagacagcaaggtacgagaaagtggggtacgtcactctgatttctgccttggaaggctcttgggttcattcttttccacccagggagaaagaaagtggattaatacctggaagattaagcacctgactccctgcctttccttcaatctcctagttttcccaagagacccctctcttccccaccagccctgccaaccagtacagtttcaaccttgccgttctctgagggcaagccaggcacaagcaaggctcagtgaagccagtgcctgagtttgatttaatcctgtccagttcactctgtcctggttaaatgctttctagccatccttccctgccatgcatctgtttgtaatggttcacgccatgaaaaccaccagcttctatttaataaaaccaagcccccacactcccactggcaatggaagggccttggacctcctggctgtctctaattcctgtggcttcatcctcctcaatgaaattctctgcccaggcaggctgtggaggagactgccttggcttgggagcctcttccccgttccccacctggggatgcaatggttttgctggggcagcagttcattatccagtcctgagttgagtcacttttgctcatatttgcactctacctctaaaaagatcccttctaactgggtctgaggcacgcctcttgtgtttatagagtaaactgtccatttggtggctgctgtcttgctaactcggcagggattgctgtttgcttgtgtctccttctgtttcccaggtgcagggctacactagagattcaggtgagatccctgcagaggccagggagcttgagggagctttcctacaaagctctgaccattaccctggtaagatgacagagccaagctttgctaacgatgtttctgtgctttttagcagggaggaagggacgctgtgtctccatacatccctgaggaagggcttgctggtctttatctgtcccgctgggatgatactaagacctctcattgatagagtgcctactgtgcgttaggcactgttctgtgcattgtctcatttaatcctcatagtagctccgcaagcgagcactaccattctcattttacaccttgtctaaggtcaaataggcagctggtaaaacccccatcagtatagctctaaagcccctgatgaataagttctggagaagtaacgtacagcatgatgactacagttgataacaatgtattgtacacttgaaatgttctaacagattagattgtaagtatttttgtcacacacaccaaaaagaggtaactatgtgatgtgatggatatgttaattagcttaattgtggcaatcacttcacaatgcatacttacatcaaaacatcatgttgtacaccttgaatatatacagttttatttgtcaattatatctcaataaagctgaagaaaatgaaaagactgagtgcctgggaacaaaaacaaaaacaaaacaggaaattcagtgaatcctgatttctaacacaatgaaacccaaactgtctagcgagccttgtgggcttctttctggcttcttctcctgccattcttcaggcacaagtcacttttcactgtgtcttaccaaacaggccaagatgccttaaacctcagcttctttgttctttctgttgtgtgctacaaattatctgattccgctctccaattggtaacttcctaccaattctaaaaaaactacagatccatctcttctgctaagtgttcccaaatcctttgatccttagatggactcatcttcaaaatttcagacttgttagatgccactctctttgctcccatcgcactgtaggtaatgtgtatacacatctatcttccccattaagttatgagccaccagaatgcaagcacaggacctcctactgcactgttgtccttgtatctagttcagtatttgctatattgtggtggcttatcagatgattatgatagcactgttctaggcactttatatgaagaaggtactattattgtcatcttcagtttacagatgagaaaaccaaggcaagaagagagtaacttgccacattaatccctttagtaagtgaaggagccatgattgaaatctcagcttctggcttcagtgcctatactttgagttgctactcaaaactgctttccagtaaaatatttggttaaagaatattttacgaggccaagctgggtggataacctgaaattaggacttcgagaccagcctgattaatatggtgaaaccctgtctctactaaaaatacaaaacttagccaagcatggtggcgtgcgcctgtggtttcagctactcgggaggctgaggcaggagaatcgcttgaacccgggaggtggaggttgcagtgagctgagattgcaccactacactccagcctcggcgacagagtgagactcgatctcaaaaaaacaaaaaaagaatgaatgagaccatggataccacccggcctgttttggagagggcatttcacactgcggagaaatgcgtcgttcattcccctccagctcatgactcattttgacccatctgccagcccggatctcctgccttaggaagtgagcttggcacaggtgagggctgttctcctttcggttcagccccaggtttggttccttcaggtcaaaggtcactgcagcatcccgagacaggtctcttgtggtacctgccttcccactctttctccctcctccttccacttccttgtcgcagatgtaaaatcctcacagccatctctgacgctgctaaccacaggcattcaggaacagtcttgctccaaatcctgcctcctattttcatatttcctgtggcgtcttatagaaatagcagaacaattgctcatccacagggggtaaagggagcaggattttatataattaaattttaaagtgacaagtttttccagcctgtggggtaggtagagggaaggggagatgagatgaagacctcctgcatttaaagaggagcctggtctcggcatcggcgacatagaatctagctttattcctctttattttttttttttttattttaccagtgacaaggaccgtggacataatttgtaccttcggtgcagcctctcttttcattgagctgcagcagcattgagtgctaaatgagtcccttgtcaaaggctgcttggagtcacccacttccaaagggagcgtccggattttaggaagtgttggtaatttatttccatctcctgcaccagtgcaagagaaaataaaatgatggttcatctcccaaaaggaacattcttaacatgataagggacagagatcagaaacatctgtctgtagcaagcaggcctggagtttccccataaacacaggtttccatgcaaaccaaacaaaggagcataagatacaggccaggcagattccacttcagctcccagattgaagtaagtctcacagcctccttccttttaaggtaggggaccagagggccagcctgggctctgatggccacaccccagcccatacccccagccaggctggcctcacacatcacgcctgagtgcacagcacacaccactctccagccatttgttcctttgatgtgtgctaagcaaaacataattacccactttgtcatattgcatgtgactttgacggcccagtgtgtgggcctttaaaaaaaaatacattagaaggtcctcaagggaaaacagtgctccttttagggtttgtttcaggacttccacaaggttctaaacaacagactcagtggagcctgtttgcctagtaaggagtagggactttgtcctcaccgcctgtcacttacaaatagagagaaaggagagaatacgaacaacagagtgggaagtgcaaagagaggcacatctgaggttttcatgaagaaactgggggaaggaaagtacaggaacccaagaggcatggagcactgtagcgcccctcttttgcatgagggatcagtagcatccctcttttgcatgataaattgtttccaaaaccaaagatggatgtctctgcaggaaccctctccctccaccttcagaaacttcctacttaggcatgcatttagctcctttcccaaatcccttgtattcaaagtctcatttctcttgttcacagagactcctccttctcagcccacccaaagctcatctctccagcagtgcactcctccctgacccaattctctgctccaaaggaaggcacctggctactttaagatagcagaaatatgcacagcacacacaggccctctctctccctctctctctctctctctgtctctctctctctctctctctgtctctctctctctctcacacacacacacacatatccacctcacccctgaccctcagagacttcccctctttgtagagacacacaccataccccctggaaacagagctttctaaacacattctgaatctacaaatgctgctagggctcaggctgtgaggttccttaaatgtgaagtctgctcatgactgcaattaattggcattgctgtgctaatggtaaggcagcctcctgtaataaccaccagcagcctgctgagtgcagggggagacagtggtaggagctgagccctgtgcgttgtttacagtagaggagacgaggaaactcatgagcgctctccttttttgtaaggcaaagtttcacaattggttggtattagcaattttcaatcatcttttattagtgctagattgattttctgggttttttttctaatgtatgaaagcagaattctctgaacaactttcatccctggtcagctgattaaaaatagcaccactacccagttgcttatcaagaagctcagaacgagctcctcgtgaaaagctctttggatgggaacagatactgtgtgctgctgatggtgccacccggacgcatgctaagtgagatggttatctctgggatgaggttgacttgaggatcccctactcattgtctgtgtctctggcagaaccacttttgacagtgggatggcaggtctaggggatttgtcagaatcattcattccttcaaccttttctgtcctcattctgggcaagcacgtccctgatttcagggtgcaaatgaattccagctctcctctagcctagcgagaggagaatgtgcgaatttgtttagactatgtcagctctctagggctcatttcctcatctacaacatgggcacattgatttagatgacttctatgagtcttttcatctatcaagtaaattggtctaataaaaagactaaggtcttagaaacaagctaatcccttgtagggaggataccatatgttgacacccaactatatcagaaggcagtgtgttcaatgtgctataggagacacaaaacattacaggcattcagaagagagagatcccttctcactgggacgaccaaaagacaggactccatggaagggttgcgggggcagtcagtcgaagcgtgtcttgaggggtgaatagtgttgattgacagagatcgagatgaggtataagacagggttgaccacaagttggggaaagcacttgggaagatgctgtccagaagtatggggaatctaaatggtgtggtgacttgacttccaaaaaaagaggccttttcaaaaagaagaagcacatttcacggggccacacgctgccaagagatcaaggagtttagccatgacatcctgagcaagcagctctccagatgcatagcaggcctctggttccccgaggactctgcccactccaccagtggccactggaaagcaccccacagggctctctgcggtgggagttgtgtcactggtccttgagcctggcagtgtctataaatcccatgtatttttctgtggacaacaaatgctgccttttctgatattcagaagtgagataaatggcaggcctgttacattgctcagacattttggactttctttctctctcttttacatgtcccattttttcactgggcctaattcttgacaatggttctgattctcattcgtctgctcctgaatcatagtcttccttttgccctttgtaaattatctctgttatcctatctaaacacttcttactctctaaaatgagccacagcctagggagtatttctcaaggagagagggtagcttcttgtatttattaagctacagcccagtaaaatacactgatttggagttagacgactaaatttgaaaccaaggtcttccacattccactatgggaactttgtcagctgctcctcttcttcctcctccccttctcctcttcctcctcctctttcttcttcttctttcctcctccttctcctccgccttcttcttcttcccatttaaggcttggttcactcatctgtcaaatgggacatggttctgctagacagggtagctgggtgagaattacattacatgataaagtataatttattccgcaaatctaacattttgatatcaattatggttattgtaaccgtgcaaagagagagaatctttctcattctcaaaagtttatcaaccatttcatgaacaaagtaatgcgtgtgaattacaattgtgtgcacatagtgcatcactcctctcagctgtgtgtaatttcctttgttgtcaggaagccctggctgatttctaatttaaaagtaaggcatgcagtgctttgccccctacttttctctgtgtattttctactagatgtggggtgcccccagtgcctctaatgagcatttgactgcattgtcggcatggtgcgggatggccacatgctgccctcttgttaacagacttgagggtggaggaaatttaaagacgctgctgcctccaagctcatcaggttctcctgtcaaggagcaggtgacactgtggactgggcaagaggggtagccatagctttgaccttgcccaggccagcccggcatccccaaagagccagagctcctcctgacaagaatccactgtgaagcggggcatctcattgcagaaggccccacagcagggccacctcagcatttcagcttccagacagaaaactcttctcctgcagcctgctgttcttccctgggaacagccttggcataccctttctctcccttacagcagagctctgagtgtcacttatggagctaagaagtcactttggactttgagctcttgttgggggattctaccttgtctggaagggcagaaggaggcagaaaaaccaagaactttataggagaacagcatattcagcccgaatgtaggatgtggacattgtggtctggattattggtagggttgggtattagggctagaattttaaaaatgtgcactagtgtatcaattattttgggtgctcaattgtttaggtgaagtccctttgaaattgcagcattgctggcctaaaatatatttgaaagtgagaatgtaggaggagcagagggggagccagaagcccactcatgcaaatacaggtatataaatgagtcagtttcctccttcgtaaagaagaaaatgattcggagttgctttgttggcaggttagctaatgagggggtgttgtgttaattaacgttgcaaagaatagtgaaagcattaaactttagaagtaccctagtgcttctaggagtattattcttggtgcattaacaggctgggtctgccaatgtctatgagagtgagggaataaacgaaagctggagcagaaggcagaagacgtgtggacacagcagcaccagctcggggctgagtgaaggaatctcaaagtaccatcttcagagctttaaaatatctttctcccaaggaaatggaaatggaatactttggatgtttttggttgcaagtaatcaagccccttacagcagatgcttaaaaagtgagggcatcaaggaagcctggaggtggggtgtgtccatgctcagcaatggcctccaggacccaggacctcagagttggtctccatcatgctcggcatgtgagatctgcgtgtcatgagtgaaaggtggccacctttcttcatctctcacaccatcacctaaccatgatcaaagatagtaatcaagtgggcctggaagagggcgcatgtttctttttgatgaggaggaatatctagtccttctactgtgtaaagtgacctgcatagctgcaaaagagagagaaaggtgaatatctggcatttttagcttcttttgtgggaggcaggctttgccagtaggaaagaaggaaggagagggaaaggcattttatatagaagtcagcaccgaacacctctgtgaacaatggacttctggataacaatctggtgtttgttgggaaatactctgtgagcactgggggcaattgtgcggcttctcttcaaccgccagccacatgcttgcctaattaggagacacgagccagttactctgctgtccccacctctccatgtgttcaggcttggtctataaagtattggcctaaaggcactttcacccatacatgggtcatccccaccaacagattcaccctggatgtgcatatgggatccgcactgtggcccttccacataagaaagtaagggagtgaagacttgggaagatttatgagctctgcaaaactggatgtggtaaactatgtgtatggcagctctgaaaagcagtactgagcctctgcttggggcctgacagacatggaggcagttctattgaaaccccaggcaaagggcctaatgagaaatcagtcagatgtgccgtgacactgcctaacccacaggcttccatctgcttgcacccttcgcttccaaacagagcaccagttgtgtttgttcagtgaccaactggctgtccatcgcctcacctcctccagattgcaaaccaccagcagcagcccgggctcctccctatcaaaccagagcagcccagggaggttgttcatcctcctccctctttcctgatgcatttttcatcattaaagggaaaatgtcattttggtgacagatactagtatgattggtgtcaggaatgaatcttcctttctctgtcagccttgcttcacacaatcctaagacaatgttctgttgaaaggccacttccatttccaacgccagcagtgtgggagaagagcaggctttgctgtgacggatgggtctgccaaggctggcgctgtgccaaggggtgtaactgaagctcgacccttgcacaccgggcaagcctgaagaagcttctgggaagctcaagtcttatttctggagggattctgctgagaacatatcttaaaaagagaaaacctgcagctctattcggtgattaggttttaagaggtggaagagttgccatcatcactgatatatagagtcccataaatccaaacccgtgtattggaaagctgatctggaaatgaagatttttattttctggcagcagaaatgtaggtcagcctctctagatcttttccaggtgcaggcctggacctggcatgggctggaagtaaccatacatttcacccatacagtgtgcctcatctgacactctgcataccacaacctgttaggactcatttacagcttcgttttctcatgcatgaaataaaggtaatagtacctagactacctttctcaatcactgagaggtcattttatttcaatggatatttgttgaactcacactcagggtcatatactttgctcagtgttgggcaggtacaaaaatgaacaagaaatggcaactgccttcagagagcttacaacctagttggtaagatcagacaaatctacagtccattacaatgtagatacacatacacacatttacagagttctagattgtgaaatatatatatatattatttcacattatatatgtgaaatatacatatatatgtgtgtgtgtgtatatatatacatttcctttaaaataattgatttcaactaatagaaaagagaggcatgggaagcattggttaaactaatgtttcatggaggaagtagaatctgaactggttcttgaaacctgaataggatttagaaagctgtggatggtaggagggcatcttggcagagcaaaagtctgagcatctacacagtttgtgatatgcagggcaactttccaagaagaacgtctagtccaggttgattgggtcctaggatgttacatgagtgcaaaaatgaggccacaacaaagactaacactatttaattaacttgggatacttcttgattgtcagtcttaagagttgggtctttatgtcataggcagggggagccactgaaacttcctacataagtaaaggacatcatctgatccctgcctgagaaagataaagctggcttctgcatgtgaaatgccgtacatctgctattcttaactttttctaacataaaaatcattgaaaatattttataataccctcattactgtgcagaaaataagttcacagataacatataacacctatcacatacttcaaaaaatgacctatataaagtctgactgaatctgaaggagaaataaatagaaaatgattgataataatataaatgtaaaataaatatttggatacaactaccccataggatataatgaagtatggaagcgtctatatgcagaatcaccatgaatgtgacagctaagcaacagtagagacctgctacaaggatgtagaattaattgatgactcaatattatgagaaacattcccactgagtacgtgatttttcaaactagtgaacacttcttggtaaagatgtgaacaaatcaaacacagtctttctttgacttgcaggatagttgcattcctggagaattagcgaatattaaaacctggcaagaatatctgtgtttacatgccaaatggagtacattttaggctttttttttttttttttttttttctctgagacggagtctggctctgtcgcccaggctggagtgcggtggtgtgatctcagctcactgcaagctccgcctcccgggttcacgccattctcctgcctcagcctccggagtagctgggactacaggcgcccgccaccaagccgggctaattttttgtatttttattggagatgggctttcactgtgttagccaggatggtctcgatctcctgacctcgtgatccgcccacctgggtctcccaaagtgctgggattacaggtgtgagccaccgcgcccggcctaggcttagatttttgaaagaaaaaggtttcactcacctaaatgtctggcaggcatttgacgtccgtggctgaatagccatgcgttgctgcgtctctaacctctgcggcctctgtacactaaacggcagcagtacctctccaattatggtggtgaccaatatccaatcaattttccactcccacaatccaaggagtgtgccctgcccctgttaagaagcactgactaatgcagaggcagggttggaagcagagagatgagttaggatttaattaaaagagtagagagagaggggaaagaaaaaaagcaagagagccttggtggtagcattggagactggcaagaaggaaaaaaattaagaggcactgatctaccagtgagcaaagggttggcaatgcccttggtaaagtttacatcactgtgcaaatattgttgcagttggagttaaatgtcatcacactcactgtacagagatggtatctgaagcactgaaaaggtgcaatgacttttgcaaagacacagcacaggtcaggaattgtgttagacacccagtgccttagaactacacttttactgtaattactaatgcaaaggagcttctactcagcatgggaaattataagcagaaaactcgagtagagcaaatataaaggtagaaataacttctgaaaatagtcaaattccaagtattctatttatcacctcttgatggaacacctgggaaactctaggattccaaacaaagaccaatattccacaatccatccactttttttgtttgctcatacctctaaatattcatcagtaacatttgagacaaaggaaagagataattatgaggggagagtttttaaaagatattaaaggttaacagaattcttggcatttgtgtcgtgtcaatttccatgtaattatgctcaattcccagaattcagtgtcagttgtgcctgttaatgcttaaagatgatatccttggaaaataatttataagatcatttctcaaatatttcggattcaaaccaagcaccctggctaataggctgattattattaatgttattcttggatggagagtgctaggaggtcgtaagtgggatgttgggatcaaagtggatttgttatgagagtgtggttagctatctctcctaagagcagaatgactgtgctcgaaatgtttatataacctgatttacaaacctcttctatttttgtttgataaataataagaatgtgggaaagcacgccagttctctggaatatgactgccttttagaagaaggaaagggaaccagtgctgatgtctgcctgtggggaagtatgaccaactggctttgtggaaaaacattgagacgcacaggcctagatattttttacatgtttattcattcgttcattaattcttctcccatttatcattgaatgtgttttacctgttctttgctgagatcgagtgattataaataagacactctccccttttctgttcttttgaaattgtgtacattccctttgtagtattgactccaattgtgattcattgattatctgtgcaattatttctaacattcatctcttccagcagtctgtagccatggaggttggataccaaggatatgacagtccctgatgtaacacgccacctaccctaggatatgcttgttgaataaatgtgagaagggtgttctcatccctactgggcaatcaaaaataatcttttcaactaacttactctgatcttgatttgggagaacattttctaaagccagtctaatcttggcctaccatgtttttcaatctcttgggctctgtgcatttacacatctgtgtcttcaggaaatgaaattgaaaaataatctagtttcccccaccttctgttgaggccaacgctgtggagcacaaagtcgagaactcaggctcatgcatgatctattgcttgggatgattgctgtcaccattctcttccactagagcgaaaaatgaaaaattctatggaaaacaaattgcttcccatcacgctctaaaatgtaggctgacacggggatgcattgaggtggctagaaagagctaagacagagtttagagacgtatgtcgtaatccagctcttctggttgctagaagtcaaacttttggaacgaggcagccaagtgaagtgaagtatgtgtccaaggtaaattcagaggcagtgtacaaaaaacaagtgagtgcacagaggagcaggggtccccagcccagtgaagagtgaaagttggaggtcatacatggaggaaacagccaagcatgtgaaggattggaaagcaaggcgggccaactaaccctgcctaaagggaactgttctcctcctcagggggcatttccacataaatcatgcacacacttttcatagtatttttaaaaatgcctttaccaagtgtacataaaccttctacaagaagttgtaacataatgtaggggtgagagaagggcgagataagcataattgaagtatccccagccaggcagaaaatggaattactgggtagatgggaccatgacattagaaaggtcacactgggtcacataaattcagatgtccgagttacctgctttggacagtggcaattttacatgagtcatacttcaaaggttacagatatatagcagatgcctctaacctaacaaacagtgtgggtatatcacacgttaatttattcaaaccttttcatatcttatttagagattatttttgtctgtataagttttattcagacatacttgtttttatcctttaactactgtcttgatttcttaagagtttttttattttattttagctagagtttggtcattaagtatgtgttcactctatccttatacatcgtgaataccaaatgtcatcatcaatttcatgttcctcgtttgtagagatttggaagtccctacaaaacaaattatttcaatttttgaattttcctcagctgtgctggtcacttaaatacaacaaatatttatcaaaaccaattatgttccaggcattgtgttaggtttcaggaatgtaacagagaaaaagacagaaattagaccattacatgtattctgagtgttatgcgaggcactgatgcagagggcatgtgccaagtccagtggactagcacagtgaggccttcatgagccagtcagaaccgagaagggtgacgacaactcagcccgagaccatggggactgcatcctaggcaggaagtggaacatgcaaagtccctcaattgagaaagaagaacctctgaggaattagaagtgtaatacaataaaacaaaatctgacatggctccaaaagggaagaagaagtagttgctaaagctgaaaatacacagatgccacgtcctgagggctcagaaaccacaggaaggatttggagctttattcaaattgcagtgtggagccaccaaagatttaatcaggacagtgacaaggtcagatttcaggaaatcttcctttcaatgtggagattgaaacagagctggcaagagcagaaggaggacatccacgtaagatgaatttcaggaatccagataagaaaatgaggagatcttggcttgggccaggcaaggcagtggaggttgagaaaggtggatggatgtaaaatatattttggaggaagaacacaggaaaaagactgagagagagaaagagggagagagagagagaaagagagagagagagattgggtaatgaggggcagtgataagagggaagagattaaaagtgactcgatttctgatttcagcagttggttgcatgaagtttattatttgtgagctacagtgataactactataagcaatactaggagaatttttatggaacaattttgagtaaaaataacatttctttctcgttcctattttttctaataccctttttagtgttttccataaaaatgtttgggccaacacttgttttttggcaaaaattcctgatacctgcagaaagcaatctatagtatcatgctccaatatgtgttgtaaggatcatagcttgggaactgctagccatcactgattccaagattactttcctgggttgtaaaagaataatcagtagcaaccatttgtggagttggtactacaggccaggtacttcactggtactttacataaattatttcatttaaccctcacagcaaatataagaggtaggtattattcctttttaatagaagaggaaaaggagactctgagaggtgagaacattttccaaggtcaagctggtaatttgtggaacttggacataaagtcaaagccattaactccagcattcatgcccaatcccttccacatcactgtctcttcatcgactgcctagatgccagcaacttacatgcatactttattttttctaaagtatcttccattatatttggccacttttccacatatccaaataactttctggattatttgcagctcatccatgtgagctaaagttttaattacttaagggaacctaatgtcttctgcaaacttgggagagttctctatgaattccctttgacagatcattggtaaaaatattaaatttgatttgtcctagcaactgtcccttggggaatctagtattaatacttggccatatagaaacatgtcaatctacccttgatttatatcttagctttaagcagctctctgcctttgaaaaaaaaaaagatagtcttctcattactcacttttctaaaaggtatctgtgatcctgacaccttgtcaaaactgttgtgaaagccagggtagattatttcatgtgttgtggtttattcacatgcacgttgacaacattttccaaattctgcctcctccaggttcaaagctacctgaacagcacataagttcattttcctaagacactcacaagttgctccttctttctcacgacctgcagtaccactggtagttttgtgctaagctagtgaaggaaagcataccaaagctttagggaaatcatttctttctgggaggtgctgcccatgtcaaccccaggttgggaaagaagcacaaggctgtgatgccccaagggcaacctcaattactttatttagaaaggccctgaactcacgatggtaatgcatacaggtggaccaacaaggtgaaagtcacagagattcacaagcatacagaaatgcattttattatttctttgtaagagtcaataagtttgtcagagtcaatagatactttaaattgaagtaaagaattaaaaaaggaagtggatagtttgggtattagtttagctagaaatacaaagaaacttgacttctagggcagtacaaattcaagccttccacaaacaaacagttgagagtatgtttatcttcttaaaatgtgtgggtgccttcccaccacttcacctgctcctcactggtgctttgtcccctccctactaccattcctgtcccggggcctgcaaagcaaacagtgaacatttacaaatcaaacttggtgaactaaacatttagaaccttagagtgaacgattttagtctcatccagttcctgcttccccaaggaaagttcagattctgtgcagccttgatgcattggtttaaagttaactcagtttgaacactaacccctctaattaggtgtttgtttgaaatccatgtctcagtagtcaactgatctgatgaaactggtatggtgtgtctgtatatgtttggtgtggaaatgtaaatgggttacaatcccagcaaaataacatcacagcagttcatccaggtccacatttctaataaagaatattgattgatttcagggatagcaaatatcagttctacccaattacactcttgctgccccttctaaagcagcatgactcaggaattatttcacggcacttagccttttatatacaactgctattataaaatgttctctgtgacacataaaattatatgtatgtatatgtatccgtgtgtgtacagaatatgctatgaacatatgcctaaatggcttatctgagaaactcagcagagattgagataaaacacagcaggatgagtctaaaccatgaagtccagaagaaacaaacactaacagaaaggagagagaatccaaataaaaagaaaaggtgggaagaggtagatacaggaaacacagaaaaaatcccttactgaagagaagaaaaaaaaaaatagggccgcggaaagttaaaggacagacagtgtgcaaccagtccaatagatctctaaaactcttctaacccggatattccaatagtctagtcatggaaggagtgtgtaaatattctctttatggctggatgcctagcatagactgtatctagatagccatgtcccagctaggctttaggggaagattcccaaatgggcaattaatttagatttaataggaccgttactgtaagtttaaataaatgccagttaaatattaacagcgtatttattgaagattaacattgctggttgcattgtgggattttcttttccttaaagaaaccctttatcagaagacttttaatcatcttgactcttccgtcgcttgcctcagatccagggcagctcattaattactttgtacaacagttttcaacattctgaagtggttacctagacgaatgggaagaatggaaggccatataagaagggctatttctgtgcaggaaggattgatgagtgaatttgataagagtgttgagaagcattataatcctagactattagagttggaaatgtcctgggaagccatctcatccaaactcctcatttagaaggcaagaggaagagagcagagctattccagtgagctggtaaggggcagacttagggctggaattccagaccctggatcccagccctttactgagctgtcaccgtactctgaaattgttcctttaattctgcaaaagtgcattaacccatttgagtgaattagtcattagaccttctcagtgacacacagatcatgaagatttttttttgttttttgacaaacaaaggagctaaaaattcaaacacaagcagtgacttatctaaggtgacaaaatgatgggctgagttgaaactagaactcaggtcttctggtttacaaaatatatttgcacaaatgtcacctccaatacaaagtacagttggacccatatgttattatgcaaattcttatgtcattaaaatttattttgtctgctgttgtttttggatggggaacaaggaataaaacctctaaagaaaatgaggggaaaagatcaaacagagacaaaagttctaggtgattgtttagggagaatggagcacaggggtagaagtaatccaagttcctctgagagtttaaaaccccaagttaaaacctggggttttaaactccaaatttgtacttgataaaattgccattcctagggctctttctgtttgagaaggcacttccctactctggctgggctcagaaacattagaactggtgtatgtgtgtgcctgtagatgaatgtctccaggtgactctttcacagaggttacaaggccaatccctgaatgtagaaattaggagagatgaggcaggcccaagatgttcttatccagtgatttgtttaagatggagacctgagcgtgttgggccttgcatggtcgaagaagctttggattcagccatcaggcaccttggagcaatgaagggcttaaaggcttatggtaggaggtcagacattgtggctcactttacaatgggatggaggtgtcctgtctttttgtcaggtggattggctacttttctgttgtactttcaaagtttcccaggctggtactgaaagagaaagctgcctcctcttttgcaagcacaggctgtttcccacaggcctagagaacagaggcctgacagtggggtgggagctggggggccacggctcttcctgctgtgggtggtctagaggctgtgctacttcctctctgactacatctcagcatgacgttcctgctctgtccgccttatgctgtgaactctaagagcattcccagggcctgcactcagcagtctgctcctgggttctctgcatgaatgttacctgtaggctgactcagaatgaaggaagcacagccaatggcagctccttccagtcccagcatgagaagcctgggagcagccaggcctgtgctaaactctttgcagctactccctcatctcatcctcacagcagtactgagcagtaggtaccatgaggaccactattttacagattagattagggcatgtccccaaggtcccacagctagtaatggagagggtgaatatttgacttctggtctgagtctaaaacccaaggtcacggtccttcttattggataaatatgtactgaatgaatccatgactgcatgaacacacaatgtcgatggcattagaggttttcagtgagacacagagcactcccgaggtgcccatccttagtttgtatgagcaccgtctgaggctgtcaaagaagtttctgctcatgctcctttccgtcttgggtcgtgtagcgtctgtgctgtcttctgccatccacgagattcctgcccatgcttgcccatcccttcatctccagctcacttttaagtccagtttaatgtcacttccttagggaagtttcctgatcttccaggcacgatgagaatctcccatcctgtcttttccattttttttttctcacagcattcatcacagttgtatccactatttcataaaattctttgttaaatgtctgtctcccctgctggaagtgcacttcatgcaggggaggcccacgttacttttgcctatgtctctcccattcattgctttccctggccctgttgagttgatgaagggcttcccaatattcagaagtccttcagagcaccccacccctcctaataccccttccagtgaagctagagaaccaagattgtgcctgggaatctggataagtgtaatgagacaaatcacttcccacaggctaggcagacctcagcttttttgtctcagcaatgagaaagttctcaagggcctataggggagtgcagggtggagttcatttaattttcatgaacgttaatggaaataaaaccactgacaaacccaatagcactagacgacacgcaactcaagggcaggggcatgtctttatttttgttcctctcaacacagttcctggtacacacaaggaactcaaaatctgcttgctggttgattaactaatttgagttcaaccaaataatgtgacacccaaagtgattctgggcaatcatggtaacctgtcctctgggggtctctctctcggccacagatgatgcagcagcaggagttactgagtggtcagctcttaaatattgttcttatctgacaggtagagtagaaagaaccctgctgtaggagtcaggagttctgacttctagtctggattggccagtttataaactttatgctcctacgatcaactcctcctccttcctggggctcaatccttcacttaagaaatgaatggattatactaaagatcttccaaggtcccttctgaatgtatcattctgtgatgttacgagtccagggtcttattatgacccaaaacttagataaaaaggaaagactctgccccaaagacccctggctctcaggctgtcccctttgggcacctgcctttcgctgcgtcggcactttgattttggcttgttcatcctgctccccctgacttttctgtctacctccgattgttctatccaccatcgctctgctttatgcatctcttataaagttttatgggtttaaagtccatagatagcctcacctttgccattccttcatatcctccttctcagttctctctatttgtgacctcttttctctccctggagccctcttccccttttcaagttgcacctttgctctttctgctgaaatcctaacatgttggactatagcccagatgaaccacgattttattttgatcctgtattcatagaggagcaaaaaatagcatatatttttccagttcccagcccttccctactgccctagaggcatctctttatccagatttacacatccttttctgattaaatcttccaatatctatttgatgtcacaccactctctaatggccctgcatttcccatcttctcgcctgcactcctatgtgagatctccaccaggagaggggagcctttagcctttttcgacgaggagaagcagagctggcatttgttaagctagtgctcctcttttcgtctcttgtgtgtgtggaatagtgatagctctttagctggccccagcttgctctgggtaacatggagtaaaacaaaaacaacagctaatttctctttcattgggagttcttctctgttccagccctgcttcagtgtacagatgccagggttgcctgaagtctccatctactgcttcctcacctgcctgccaaccatccagagtacacatggcaggctcttctctcctccctcctttgcagtcccaggattattaaagggaatatgattgtttccttttgctcagggagtgtgtatgtgtgtacatgtttgtgagcttgaaaggcattgtcctatagatattttttataacctgaagcaattacagctgtcagcacagagacaagctgtgacaagttgatttatgtgtacagtatatgtgtatgcacgaaggaagggaagaaggagacggagatggtgggaaagagggtggaggtgggcgctcgttaggaatcggctttcaaggaggcagaaaggaagttgtttctataaagaacacaaataatgaaattgctttgaatgtcatcccttttcattaactcggatatgctgggaaaaataaaataaatccagcagtttttatgaagcaggagacaggatataagataagccactaagtgttggtcatatttagggattaagggctgggaagtgagttgacatatgattttgatcttcatcttttcaaaccacttcaatagccggtttgaataaaatggattttgtcttgttaattatgtgggcatctctgacctttcaccactttctaaacttctatgtttgaataaagtttggatccctgcgcccacgaagcaggtatgaggttgcaagtgccttttctttgccctccctgtgagttacctgagcttggctgggttttctgctgcaactgctggattgctaagcttagtgctttcccttcacgggcagagacaaagatggtttgattgtcttagatcaactgcatgcagactggtagaaaccaaacatctcaaagagcctgtaagaagaattattttcttgcccagacatactaatgaagcaatggcaggcaaatgtattaataaagcatcttccatcttaaatggatttctaagtattttcctgtagagttaatcatatatgtaggcccctcgggaaagcctgttgttgtcattatccatatccctagatgcaaaaactaatgctcctttgtacctacctgaaaattagatgcaagagccaggattagcatttatcatgaatcatccctgccattctcaggcctctagggaaatgactgcaaagctcagaatgagcccctctcctttccccatgactagcatttgtttccacttgttgtagtgaggatgtgtttaagaagaggggttgagagggaggagcataagggatggttgaaatgaatggatgaattattagaggtgaccccttgacttgtggagacgaagcccaaattcagcagactgaaagtcagcaaacatatctcacagctttagtatatcatcatatttatcttaacgtggtgaagtttttcaatttcctgtttccacaattgcccgttggaaaatggagacacaatagaatcttccaagaatggactagtgctaaagtaggttaattttcctcctttcctttcaaaaatacaaacaaagatcttctgctccccgcagatgtaattgtttattcctgatagtaaagtcatttgttgcagccataagttgacgattgatagttttggtgttatatatcaaatgatccccagtggccaaaagtagcagatgagtttccctgagaatttaatatcagaaaagtcaccggaggagaggagggaacaattggcccaatgatgagttaatgcaaagtattttgagatattcactgtaaagtcgcttcactcttgctggctaagcacgtcctagtcaactatgacaatggaaaggcaagccgtcttagtctttctttgttacccaggagtgtggtttccacttctccaaagcctacttctgtcctatctctatagttagtgtgagggagatttgattggtgaaatgtttgtgtcctctccaacgtggtatctacatgtaagtgattggtactgctcgaaggttgccagaatgagtattgtaccgaagcccttatggttatatgactcagttataatggttcagtctctttgataccggatggctttttggaagaccatttttctgttatttaacagttgttaacaacaacaacaacaaaaagcttcctggttgtgtttgatagagtctaggggaaaaacaaagccactgttgcctcctctccatccccaaggagaatgtgggtcagggctggaggccggctctgggaatccctgagaagggagcattattaatgtcaccaccactgtgcctgctgagctgctctgtgcttcccccttgcacaagaaccaggcccagccagggaaaggaaacgcaggccattccctcagagccgaagttaagggagaaataataatacaggcacaggaggaccagcagcagccagagaggagaagtgacagggaccgaggcaaatccagtctctccccgggtttcaagaatttgagaaacacacctcttaaagatgaaatcagctgtgcgagagtgtgaggcccaggaaacctgggagtctgctgtataaatacagcaagtggctcacactcatccacccaagtgagcacttttgcaggcccagcatcttttaatggcgacaaaacaagaataaagaatgtaagtgggtgtctgaacttgaccaacattttgatgatgcgatttttccagtttcgcacactaagaggcttctgtgattttggatttgttttatatatggcagatctctagaatggtagtgttgagtctctggggttttgagcagctttgtggggggctgctgggcgggtgctgtactactgaataactatgaggttcttctaaaacatcctccgaacactctgagtttactctgaatgctaatgggattaatctgatcattttaaaggtgcatgtatgcatgctgcagggtgttcctttcccagttaattagtttgtgacccttattaagatgtctcaagtctgaggctgattaaggctgcatggtaactttgtcttttttcctaatttggaagcgcgtaaatggttaaactcctggcctgggctgggctggtgcacagcctgggcccggcgcggcgggggttaaggtgggcgcccgcgccccgcgccccgcgccctcccgccgggatgagagcgcagtccgcgccgccagcccgcccgctcgctccgaggcggcaccgggagaaagtggcggtcagggatggagctgctgccatgacaaccccggcggtcggggcccgcgcgcgtcggggctgctcccgggaggaaggcggcgcggaggccgggggcggccgctgagcttggcgtccgcgcggctccggtgcgggctgcgccgcgccttccccagcgagctaccgagcttggggccgccgcggtccgctcccgccgcccggcctctccctcctcggccaccgccgcagcccctgccccgccgagccccgccggacagcggcggccgcagcgcgcatttgggctccgaggaagttgaccgaggcggctgccgcaggatcccgggcccggatcgcacgaagcccgcgcggccgtctcctccgcgcgccacccctgcgcctcccgcgagctccacttcccatctgctattgtttccgattgttttccggtggcgagcccggctccgaaacttacaaagtgttggatgtcccccgttcgaactgagggactgcagaccgcctctgggtagctggatgaagcccaccccgtccccttctggtaccaaagtgcttactcctctccaaagtgccgtgtctgaactgccgctgggaagaagcggctcctgagacgcgcccacacctttcacctgccgcgcgcttccccctcctcggccaccttcccggcggaagcagcgaggagggagccccctttggccgtcctccgtggaaccggttttccgaggctggcaaaagccgaggctggatttgggggaggaatattagactcggaggagtctgcgcgcttttctcctccccgcgcctcccggtcgccgcgggttcaccgctcagtccccgcgctcgctccgcaccccacccacttcctgtgctcgcccggggggcgtgtgccgtgcggctgccggagttcggggaagttgtggctgtcgagaatgggggtctgtgggtacctgttcctgccctggaagtgcctcgtggtcgtgtctctcaggctgctgttccttgtacccacaggagtgcccgtgcgcagcggagatgccaccttccccaaagctatggacaacgtgacggtccggcagggggagagcgccaccctcaggtagggagctgacattgttctgcgaactgatggtttgtatggggtcggggtaaggggcaggggtgcaggtgtgtgcactgaggcgtgcctgggttggcggagaggtcgctggttccctgggctgcacaatttatggctgcgctgggggctctgcccgggaatgtggcagtcgtagggaaaggctcagaggttctggcggtgagctttttcccaaaaactggcctctgcggctcaggcacttgttaaaggtgaggggtggctggaccaggtggtcgccgagattgagggacttgtgcctggcactgtctgtgcctgagcctggtggccgtggtgacagggggcttggaggggctccccgcgagcagtcttctctgaagttaatgagccccaaaggaggggtctggcttggagtgaatgcccccactcgcccatgccatagggctttgccagccctggctcctgcactctgggagagccgctgctttgtcctgggcctgactgtgcccgggctttcctggggtgccttcatgccgtgagctggtgggcagacagagatgctttctcctgtctgaacgtggctttctgaggcccaagtcatggagtctgatttgtccgtggaaaatggcatttactgtagtgaactgtgttctgttcctgctctccaccaaaacggtacatgcaaaactcgtctactgaagagaaactaggtttcagtgttgggttgggtcctgattggcttctggggttaaggcttacaggcactgggggaggagaagaagaagaatcttggttatgctttgtgtaaggtagaatgattctatctccctgattaccttgcctgcagaaacgctaactgaatttccagtgttgataaaccacacctctcatatgcgggcaaaacacttaatgattgcgatgggaaattttattctctgggattttataagagaataagcatgaggtggacgttaagaaggttcatgggaacgatttccctgcctctccttggtttagtctgccctcctaaataaagttttccaaactaagcgacagaactaaccacaaggcaacatggcaatattcctgtcctttgcacatgaagatttctggaaagataaccctggtgctggtgtctactgttttgcccctctgatgacttcttctaggattgggttgttttggactgtatacttaaggcaatatctataggatagaaaatggtgaagaggaggcaatgtcaatacagagctgagttatcaggacattgccaaaggaagtgtgtaatttagggacccgtgcagggctacaagcatccagtgatcctttgtctaggcaaagcttaacctcatggctctggtgaactcctagttatttgttggctcacgagacccacctcttccactcttctgagcaaaaataaagcaacttccttcccccactcagaaatgattgtgtatctgctttaaaaatggatttcaggggagttacaaatatgcagtgatttcagactacttaaataaaaaaccaaaaataaatgtctagagcagtaataatcaaggaaattttcttgttcaagaaatgcttgttctctggatgccctctttgtccctagtccttggctgcaaggagggcctcccagggacagagacattctgaatggggaacattttagatataaatgggattttttttttcaaggaaaaggtgtaaggtagctctgtagagacttgaagataaataaacaggaagtgggtcctggcagacagagaccaggccagaatctggtctccagaaggtagtcttcaaggcttatcaaagtcaggactgtccagagggtggctgcattcagcagaggctgaatcacgggacaggcctgatttaggaggagcttctttttgaaatcgcgttatcatgtactggctgacttatctttctttgtcttccctttcatggttcttttttctcattctgccggtccccctctctctttcagcactaatgtttgtttgcattttcacatgtgttctcaacccagtggtattgtttgggtgtggatggagatgggaacatggtggagcttcctttctagacccttgaattgaccccaacccagccaagttccttctggaacatctcctgccattctgtgccagcctcaggggctgaatgtcttcctgacactcaagagaaaggccctgacagtggatggagcactacagggcagggattagatgagctagggtctgagcgacaccagcccttgaccacaggcctgacttaggatgtgaatcaggcaccaggtgtaacaagcaaccagtatggaggatgctcaggcctctcaggattgccctccttctcagactctgatgcgctagaacaaggaagggctgccctgctgggatggactttggtggggtggaagcccctgaactctcaaacataggtcctgcattttcttgttctgtgtacagagaggcaagtaggaatttcagaacgtattttgtttgcataaaaattgctgcattttcacgtaacctgactgtaggttgcaaccatctagtagttcagagttctgagttattttctttttgctttgtattgtgtgtgtgtagggggacagaggacccttccttccttccttccatctatctttctttcttcttccgtttgtttttttctgttttgactaatcatataaccaagctgtaaggaaccacaactaggggagaccagagcacccgtgctctggcctggagggccgccatatccatcttcctatgggtgattgggtgatgatggtgatacatgtagttttcttcataaccagcagaggactttttgctctaatttcattttattctgctttgttctcaccaacatcatattttgaggatcttttgcagtccctaaagaataaatgctcagcagaagattctaatttgaggaaactttaaaaaatgttttatcttatccaagtagctctaacaatccttgtggaggtattgggaaatgtttcaattagcatagcactgacagcctgaaaagaattacaatttgcagtctcccactctttctgccctcccgctggcattctgtaggcatatttcttaaaagggtgaggtaaaacagaatctgcattaataatactattagccaatgttaattgagtgctcactatgtgttggggagtatctaagtgttttaataatatctcacctatcattcagcctcatgacattaacactttaataacagccctatggtgtaggagttactattatccctattttacagacgaggaaactgaggtgtggagagtttacatgctttgatgaaggtggcacagctaggaagctttgaagccaggctatgaagcactggtaacaatcacgttaataagatacatagtactatcattggtctgttactgtgtgaacattttatgtaaacagtaacatttactcctcacacctctctgaaatagacaattattcccggttaaggcctagagagggggaacttacctgaaatcacataagcagccagtggcagaccagtatgctagctcaggactccattccttgactttgtacaccaagcttcccaggactattcaggaccctttggattcgtgttcctctcattcctctgtggcacttaatgtcttccctattcattttggcttagaccctgttttccagtgttatctctctgtcttctttcttcccttgggctgcagagcacctcttggaaagcaagaatcatgccttgtcatggcatgagcactgtgtgctggcagatgcttactcaaacaaaatgaatgaaagccaaacaacgatatcccccagctatattcagtttatctccttaccacatttctctatcattttattttaaatttcaactacggtcaatcagaaatgtattgagtggttctttcaagaaggggactgtattagtccgttaggcagtgctgacaaagacatacccaagactgggtaatttatagagaaaaagaggtttaatggactcacagttccacgtggctggggaggcctcacaatcatggcagaaggcaaaaggcacattttacacggcggcagatgagacaatgaaagccaagagaaaggggaaaccccttataaaatcatcagatcctgtgagactgattcactaccaccagagcagtatggggaaaactgccccgatgattcaattatctcccactgggtccctcccacaacacataggaattatgggagctacaattcaagatgagatttgggtggggacacagccagaccatatcaggcactgagctgggtgtttgggtgtggaaaggcgtacggcctggacttggcttttgggggcttgggtccaactggaaaagctggctgtggacaaagaggtcatggaccttgtgaggcagagtacaccatgaaaacgtgggcgatcacgctgtccgtggctggagcagagcccctctgttggagtgaaggctttctgtgggttggcaggactgcactagctcctagctcctgggtggaagtgagcagacatcagtgaggaatcagagagccccagaagccccaatgcatgggtgtcattcacttagagaccttcactaagcatcaacacacctgtcacttggcagtttcaatgaatgctttccacatttcagagattccccaattaaggcagcagctagtaaagtgcattctttcctggggatcacttggcaggtgggtatcagaggctgaacgctgcattccatcgcgcctctagaccataggcttagcgattggatgatgttgtttttcccgggtgagttaggaattgaaggtctgagaaatgtatgtaattttggttgagttttgatatgggactccatggaatcacacagactaaatgtggttttgatacttgagaggacgcgggagtcaccctctagatgaaggaagctgcggcactttgctcatgtcatgtaaggtgcttggagtttcatttgataagcagatggattctctggtagtccctccagctactccacagcctcttaagggcggaactaggcctcctccaggcttgcctcctaatccgcagcacatggcttggcctgtggaatttgccaataaaatccgaaggactctcatcctgcctttcctttcactcactctgttgtggacacccataaacacagcttattccagctgcaaagcgtttcctcttgtggtccgccctgctgggaacacccctaccctgatcttcccatggacagctgtttcttgtcattttggcctaagctcacagagaattccctccctgatgcctttcctgataccaaatcaaaataatcctctaccactaccaccagtcttactctggcatatcatcctggagtttttcttcagaacaatcatctccatctgaagttatcccattcattatttggttatctgtgtatgggttgtcttccccaaagggactaaaaattccttgagaagagatatgctctgtcttgttagcagtgtctggcggatagaaggtgttcaataaatttgttgcatgaatgactgcaggaatgaaggcctgagatcacgtcttcttctccttggagtctgtgtcctttttcctgaattgtcttgtgttgtccttgccttgggcatgttacttcctcagtgtcatttctgactgggcagctgtgtgaggctgctcctgtggaggtgctggagacaggttacaaatacatagaagtcattgaacttgtgtctgtctgtccaggccacagatgaggtgtgttggttgtccattatttcatatttgcacccatgacacttaccttccttctgctgggtcacctccccacccagtccttaagtctttgaaggaacaatgatagtcaactccagggaaattagcattttcaaggtaaggagggacacagaaaagcactctgctcatcctttctctctgtttgtggagtctgctggcagtggttgtggtggtataactattgatccgttgtttatgagttcacccgttcagaatagcaatgctactcaggaggcctgtgctgctcccactgccctgccccctctcaggacccgccactgggcactcacctctgggcttgccaggcatccggctggtgtcctgtggctctgaggagcaggcacagatgggaccaaggagggaggctcctggaagcacattcagctgttgaggagccaaaaactaaaatgggaaaactaaaaactcaaccaaacatagggcagaaggggtaggagtatgccagttgtcactgaaagctagaggaggctacagggggccagctcagttctctaacacccctcatctaaaccgtaagtgctttgcagaaaaacgtctcctttctccctcttttaaatgcattgcgttcttgaatttgaaaggtttgcagagagctgggaggtcaaccacctggttttacagatagtggaagtagtgataatcagtcttgcgtaaggaggccttccagaagggtgagagggccggcagccagtacactttccatccccaggctgtgagccctcacttggggctatgcatgctgaaggaaaggccatgtttccctaagtgcaaaagcatcctcctgaccatgaatgctttcaatgcatttagctgacatttatcaccgtattctctcctgactgctggtttagtccgtaccacaccttgcgttcttatgctttgactctcattccatgtgggacagctgtttgctgtgggtcaggtcctgtgctgagcagtttaccagaagaacctcatttaatcctcacagatactccatcaggtggacacaatgattactctgattttacagagcaggaaaccaaagcgctgagaggcacagtgaaggtattttcccagctcacatactcaggtgggtgctgagcctgggactcaagatgggtggtgtctgactcctaggcaatccccctcggttccatagtactggtcttgttctgtcccttgtattcttcattgccaagttcctctcccactagagacccagtgagtttggttgtccctccttgtcgtggtgcacaggaatcccctctcctgaagcatgaggaacagggcctgggagtgtttaaggtttcatgtcatccatggcgtggagacacagggacccaaccgacctctagaggtcccttctactcacagaatcctgcaatttctatagtttgttcagaggaagactcttattccaggttcttccattgatctttggctttaggtatcagcaatcttggactttctcacctggagttagtaataccatgaacatttccacgtacttctctggaatgcagtattgaaccagtcaaggcagacaccaattctaggaggattctacaggccagtcagtggatctggatgccatagcaccaggggaacaagagggaccagctccaaaacgcttcctttttttttttttaaattagtaataggcatctctcctggggaatcttgtaaaaaaagataattaatggtaatggcatgtttgttctcttaggttgaaagtctccactgatgagtaaaatagaacatcgtccttgtgttatttaaggtcattttgcttcctcaggagtaagttgatgggttcccactgtgtaatagataactaatactaaataaataataagcaatactaccaacatcattatagatggtcaaatatttttaggaaaccaaggacttattgggtttaggatgcaatttcaaattgcatgtgtgagctgaagggagaaggaagcaacggggaagtttactaggagtacaatcattggagacaaacatctccaacacacaagaccttactgactcgtaggtaccaggaggggtaggctagaaagaagatagagtgggagacaggaatctacaaactctggctcaggcagtttgtttgattgcaggcaaaatttgtaatctctccaccctgcatttaaacaggaccgttattacccatctcacagtgttgttttaggttaaaatgagatgacacacacaaaacatagtatatagttataactttctttctctatatatgaatatatatgtacatatgcatgtgtgcatatatgtgtatataatatacacacatataccaattttcattataaactattgtagcttaaacactttggcagatataccatgtcttgcttctgaaagatccaattataggtggacaaatccccctttgtccacctataattgtgagtttttttgtggtgcctctcctacacatctgtttagagattcttcagtttcaaatcatttcttgagatgtttgatttctgagagggagcgagaagaaagatatttctttgtttttcgtaaaaagattgttgcatagcaggttgtgacagttcatggctctgaagatgcatttcccatcagaaaaattcatccagaaggttctgtggagcaggttttctgtgaattcatgcatagatttcggagtgccagaccccttttccttggagaaatgatttttccatgataattccagtggagtcaaatggtaaaaaacagggtctgggataacatgtgttggggaagaggtagtttaagactctcgcagctgtaatgttctctaattgtaagtcttctcttcattcatatctcctgatgattgggaggcaggctcagggcttgagtggtgatggtgaaaatagagaaggaggcttctttgcatttgggaattttacttttggtcaggtctagggcaacaccagtgcatctggcattagaaactgatctcagcattcactgatgggatcacaggaagagtcctgtccattttaacccaatgtcaaagggcttaaattagtttaaatgtagtgaactatgaatagccgtcttgatctttcatgatctgtttttcttaaatctcatttattcacattgttgaattatttggttttatttgggtgtatttgggcaacttgctgtcctatcagtgtgaaatgttttggcttagaaagcttttggggggttagatttgtcttataaaatgaacgtatgaactaatcttacaatcttgctgatggatttcttaaaataatagaatttttaatgaaaacagcatcaaccaacagactgatggaaaattaaaaaaactaaaattgaccttcaaacaagctttgttgggttcatggagtcaaaggaagatgtatctgtgtgaaaatagtttcttaatcttctgtgctttcaaacggcctctaatgtgctggatgagtgaaaaaaatgctctcacattcagaataatcatctttggacaaatttacctgtcaggagggctcaatccaaaattctaacccttcagaagctataagtaagaaaaagaacgcatgcgaattatttttaatttagtgcagtttttatacagaaaagctggaaatagcaatgctgtggtttacgggttgaattttgtcccatctccccaccataaaaaaattatattgatgtcctaacctccaatagcttacaatgtgactttatttgtaaatatggttgctacagatgtaattagctaaggtgaggtcatactagagtagagtgtgcctctaaaccaatataactggtgttctggtaaaaagatgcctatgtggagacacagaagacacgcagagagtgacaacaaaggcagaggctgtagtgatgcacccacaagccaagaaatgccacagattgccagcaagcagccaggaattaggaagaggcaatgagggaaacttccctacaagtttcaaagggagtatggccctgccaacacggtgatctccatgatttcagacttctgggctctagaactgtgagacaacacatttccactgttttcagcccccagttttgatactatattatgacagcagtaggatactggaacatttgcatattaaaaaaataattttgttaaataatagtaacaatcttgcaaaggatcgtagataggcctggttagatcacccagttcccagctgtgacacgagccactgcagtccacagaggaagtgccagagtccagaatgcttctgggtctcagtcgtgagcccagcctctccattacaaatcctaaagaagccaatcagggtggaaatgcttgcccttttattcctcagaggccatcagcacaaaccctattgtatcttctcagttatctcgaccacctgagaagtcacagacccccaaccccagggccatgcatcgttttctagattcatatcccaacatccaacagcccaacccagttacaaacctcttcctcatcctccaaacctttttactctctggacttaatgatctgtcaccagcaacatttttacatctccagtctctgctttgaatgttccccccttattattatttttttcttttttgctttagttgaaactcggctgttccctggattatttccactcctggagtcctcaaaagtggctgtttttctcccacaccttgcttaccctgaggcctgaaagttggataaacgtcctccttgctactcattatggctgctggacatttctttttcacctttctcgacatatccagttagggtgcagcaaatgccacttggctctgttgccctctgccccttccttgccgtgatcatctgccatcagttctgaccacgcttcttcactctggtcctccagaccgcacatcctgctgctcatctacagagccttttaatgatgacattcaaactgggtcctcccagccagtacccttgacgcaaggcccactggaccacggccagctactccatcctgcccttccctcagtctttctgatcttaggaactgcaaacctagtacatcctttatttttttcattctctcctgtgcttcatctaattcaccactaaattctgtttgtcttttcttttaagagttatcctgaatcagaccactttttaccatctcaagcactacctccgtgggcaaagccaccaccgtctctcctcggctcttctggtggcatcttgcctggtctccttgtttctactcctgttcccctggagtttattatctgcctggcagccccagctaccatttcacaagaattacctgactctgttcaaaacctacagtggcttctggctaaacttagaatgaaatgcaaacacctccatggagtagaggctttttaatcgcctggtgcctatgtaagcctcataccactgcccacgtcgctgctgcctcgctcgtgggaatgcagaacgctgaacttctctgctgttcctggaacttactaagactgttcttgacttaagaaatgttcttccctctctcaggatctgctataaacttatgggcctagaccttcgttgaattcatgcatctactccagtaccccgtttaaaaaaaaaaggctttacagatcatcctgtttgaaatagccatgtcctcagcccccatctttctatccctctacctagctttaactttcttcatggcctgtaacacctagagaagtctgttatttatgtatgtcttctgttatttatgtatttctcatttattgctactccccctaaaatgcaaggtccaccaagctgctgagtttattgctctcatttatagtgattacattactgcctgggacatgggatctattacaggatatttgttgagtgaatgaaacgtttgttaggaataatagtaagctattaatagtgaaattatttatcttttactagaaagaggaaactcaggtctgtctctgtattggcatgggattgggtgttattaaacagagttcagatagggtgtgcgtgagctggcgtgtttgttttctaggtcagagagtggaatgagacattgaggaggaaattgtcaggcaatgtgacacacttcataaaatctacacatgtggaatctaaagggcctttaaatatccacttttgcaaggggttttatggaaaatctaataaacactggagaataaggattattctgctcaaggcctacaaactttgggggaagggaaggaagtgaagtggcagctagaaatcaggctgtgagcctgaagtttcacgcgtcattcaatgtccaatctttcatgttaacctttctttattaagagaattgtaccttagcgctctagaggataatgattaagtgcagggtctggagcccgaccctcctcccatccccagtttcaaatgctggctcagccactgggtatatgacctttggcacatggattagccttgctgtgcctcagtttatcatcatttgaagggactaataataggggttccgggccagtgtgaagcgtgaagtactcagaacagtgcctggcactctgctcatacttggtgttagccttacatagctgaggaaggacctggcctgcagtgggcccgtggtgggcagagggcagggtgtacctctcgtgaccctggagctatgtgtggaaatgcacagtgcagggcacggagctgggggccgtggctgacactggtgcacactctacagttacacagacatctggtggtggggtggtttttgaaaagtatcaacgcagttcattgcttttggcatgtgacttgtggtctcggggccaaggtgacctggcttttagtcctggctctgtcccaacgcatcatgtggggctactaagaaaatgagcattcccaggcttcaggttcactctgtgaagtgagaatactgctctgtttcgttcttgagttttgaggaagagattactagctgctcaaatcatatataagtttttttatttttcccctgagcacaaactcagctgcctttcccagcctcttttgaatttagaggtgaccatgtgacagctctacccaaaggaatgtgagccgaagctctgtgtaggttggcccagaaaaacatcccctgtgaaattctttatgttctttcctttctccttagaccatctggatgttgatgtccaaaattaccttggaaacctgtgtcctgtttggcgagctccatcggccaaattcttgaatgacagcacagagcagggctcacacccccacccaccagctggccaggaaccttgttaaattattacctaaagaaaaaacaaacttgtattcaggcttctgagagttcagagatgatttgttacaatagctagcattatcctatctaattcaatactcaaccattataatttatattttctgatttcagctgcatagaaatatacagatgtagtttctgaatccagacctaagcacttattacaatttcttggcaagacttttggtgatttttgcatgtgtctgaaagtgagaaccatggccttttcaaacggaagtctcaaatgtttgattttcagttgcttgactgtttacatctgtggtccaagtaacatgtctgctttattctacaggaatgtgaaaaccagtgacaaggaaaagttttaccttgaggcaaatgagcacatatccataatggacttaactcaagacatgctataattggtgaaaatacctcttagatgataaattactcattaatggctggaggtcacttatttagtttaaccttttgtgccagaagtattctaatatccagtgttttaattgacacacactaaagagatagataggatgatttgtaggcttgttctcaaaaatgttaaagagaaagaagagaaaaccactattagagttccttttttttttctttcttttctctttttttttttttttttttttaacagggtctcgctctgtcacccaggctggagtgcagagatgcagtctcagctcactgcagcctcaacctccctgggctcaggttaccttcccacctcagcctcccaaatagctgggaccacaggtacatgccaccatgcccagctgatttttgtatttttttgagagacagggtttcaccatgttgccgaggaggtctcagactcctgggatcaagtgatctgcctgccttggcctgccaaagtgctgggattacagatagatgtaagccaccacacccagccagagttccaagccttgaagagaaaccaggtggtggagaaatcgtgtatggatttgggtaaaggagaaaggaagctgtggaaaggggaagaggctgagccagagttgtgggtaggagacgtacaaggaatggaggcaatgcagagacacggggcaagattcaggtgcctcgattccaccttttgtaattcaggggtcagggatcttgtcttacttttgttgttgctttggtatgctgcacagtgcctggcacataataggagctgaatgtatccttggagaatagatgcatgtgttttgctgtgttgcttcagtagtgcctactgtacatctcctatgagccaggagctgttctaggtgctaagttcctctcttgcagagtgatgtttagtgaaggagatgagggttgcaacttgtatggattagaaaaaaaaggcatcttctcctagcatgcaacttgcacagaccaagtaggagtaggcattcctcgctgacgatgttgttcactagagtccctggctgagtaaacagagtgccagctgcattattttgttaccttcttcagcccttgagcagcgcacaagctgcacaactgtacttagcaggaaccagctgtcggaaaacaaataagtaaacaaacaaacaacgcatcacatggtggaaagtattggggcaggaagtaaactgtaggttaggggacagagtaacctggtgtgcagggaggggtaggggcttgcacgatggtcaaggtggtgaactgtggggagagccatgcagggaatagcgtgctgggcagagtatcggcaagtggaatgacctagtcaaagacgagcaaggcaaggaggaggaagggtcaaagctgaataaggggcaggcagtcagcaaagggatctggggggtcctcggtgtctgtaagtgctctttccatgtcaagattaagctgtgaatgatgataggagcacagctctcaggagatgggaattaaataaaaatcccacataagcaagtagccccaacacctgtgtggattcacttgctgcgcacagaggcctggtagtttccgtgtggactttgtggatttgtggcaacccatatttgatgtgtcacccctgcagcacacacatccagccgcgaggatccggggttttctaactgaaatgtcatccttcttgggtccactcttgtcattttcacttatcacatctgcaagttataaacgtttaaaatgtgcatgatatccaatttgacgttttacctgttgccatttccaagatattacattgtgaaattaagctggcattttacgatcatgtatggatgtgtgtgtaagtataagtaggcacgtatttggaattaatggactcatagaaatcagagatggattaggcctaatgagctgttcagaagaattatttagcacatatttcatctctctattcagtaatcaaacctacacagtgtgtatgctaaggaagtgagatttttgcctttttaaaaaatttcttggattatctccatttgtggctgaaaatttaacattgcatcctagggcattttgcaccaactttattaagcattcagtctgacatttccctgcacctggggttgcctttgttatttaaaaagtagttgctttcctagttaccattaatatataattagtagttggtgctgggctccaagcaccacaccaggatcctggcctggccttggagccattgtcaaaaacaaaatcttgcccaagtctctaggaagacttggagagttaagcctagatgggaagtgtatatattttgtttgaatttttatccacagtaaatggatgcagctttgtcttttcacctaaggcctatggtcaccttcctctggaagccacatgcacttgactgttgccactttggcttctgctgattcctttaagcacacagtttcaacagactttcaaaatactattcacaacatggggttccgtacttactaacaggaagaaggaaagcaaatgtgggatacttgatagtgtagaaggacacttgatacccagagaaggatttcattgacactgttacagagacataaaatcacagagccctgtggtagcatcagagatggggtcacacatagtcagctcccaatagccaggagtctaccctatgaattttctttacagcatggctagatacagtatatacatatttatcctaaacatatatactcaacttataagtctgcatgaaacatgtgaattgagaatatgttctatattgggaacaaaggattctggtgttgggaaaaacttaagctgggacttaatttgagctgtaaaattattaacctaatctctctgagcctttgttttttttttaatctgtgaaatggggctaaattatatcttaatacctacctgacagagttgttacaaaaatcatcaccataatattaataataacaacagaaaccaacatcggtagaagcacttaatgagaacctatgcttacatgataaatgctttacaagggttacccaatggtctaccctgtgaattttctttacagcatggctagatacttataatacttatcgtaagtatttttaataattacattaagacaagatataaattcttaaggattgtacctggcatatatgaggcactaaacaagttatttcatattgttaatacattccattagcaaaaacaagttaaaatgcttaggcatgtatagaggatgctggaagacgttctggctgttgccagaatctccagacacaaaccttttctgtggtctcccgtctgtgttttgtcccactacaaactctgtttgttttctgtggtctcccgtctgtgttttgtcccactgcaaactgtttgttttctatggtctcccgtctgtgttttgtcccactgcaaactctgtttgttttctgtggtctcccgtctgtgttttgtcccactgcaaactctgtttgttttctgtggtctcccgtctgtgttttgtcccactgcaaactctgtttgttttctgtggtctcccgtctgtgttttgtcccactgcaaactgtttgttttctgtggtctcccgtctgtgttttgtcccactgcaaactctgaactcaccattccccatggcttgcttagcctggttgcattttccacctccttctccctgactctttctcaaccacccacccctcagcaagtcaggtgaaaatcctgcaaacagcatcattctcaccctttccttcattttttcaatcagtacaaacctcttgttttctcatgttcccatagtgtgtagtttagaatcattcaattatttcttcaggaaagaaagtgttccacatctgctgagtgcctaacaccgttctagaccctgagactcgagaagacaatgaagaagtaagtggccgcacaatgcaatgtccggtagtgctgaatgctctgaagaggagagcggcagccagggagggaaaggaggaagtgtgcgagtttagactccctggttaggggaaggccctcctacgcaggccttgagtgagatctgatgaatgagggcgtgagcctgcccacatttaggagagaggtttccgaggcagatacaaaggtgctgaggagggatcatccttggcctgaaccaacgggggggcacatgtgggcggggcctggtccaagccacaggccttggtgatggctttggattttattcttcgtcttatgggaagcccctggagcagtttgacagtttgagctgctgcatgttagcagttttttttttttaattttttatttttctgtaacttattgcccttataaaaactttccgttttttttgtatacggcaaaggctgtattttctttgcgtttttgtgttagagacaggacacagccctcgtgtagaacctcctctgcactcccacaattccctgtgccacgtccattgttttaagcacttaactgtgatacaggacaaagctcatttctgcagacttcctctttttttttggttcacactgattcacaaagtaagacgccacttccaatggtcatatcgtgaaggtttcctcgaaggatcgtgaaattccacgaagtccgcttgctttcctgggtgaataaacaccaggccgctccctggactttccttgtcgtttgtgatcaaaggctcagctacctcgtgctcatggtcctgcgatggctgaaatccgtgaaatgtccagaaagaatgatttgtcatgaatgcatcagcaaagaggctataagcttctattcttattttcttatctacttttaaacactttttcattgctttaaaaaagtatataattactgttcatttggtgttgatgttattgccttgctcggtgttgggggttgtttaaccattcagtgtacaccagtgactttttggtctgtatttcccaacaattacactgagttgcagagaaaatattaattaaacatacttctattttaaaaggcaataataatatataattcccattagaaatgcatttgaaacttttctattaactctttactgttgtcaccaaagccttcccttctagacagtggaagtgagtgggacaggtggccatatatggtttgagcaggtgggcagaggaagaatgcagggtacttgttgccctctggttggtcctccttcctccatgcttattttcaaccttctggcccctcacactgggcccaactcatgccctgcactcggcaaatgtttaatgaaatgcttcctcgaggagcacaatattttatgtgtacagggagccgaatgcatattattgcatagtattttccttttgttatgaaatattttatataccagcatgtgcataatatatctatgtataaaaacataatacattgatcacctgtgttctcttggcacaatctaagaaatagaaccttctattacctgtgaaagtttctgcactcccacctattctctaccctttcttgcttgaggagatcaccactggcctgaatttttgtttatttcctcctttcctttagacttttaccaaatatataattattctcaaacaacatattgtctagtttttcttgttcttccctccaaatagaaagaaattttatgtattctccttcaaatgtttttcatttgatgttatgcattttctaataatttaaaattaacgtagtcctgaatgtgaacaaaggcagagctctaactcagtcatttcaggtaattaactggtctacaacccatcagtcagaagtgctttgatgctctttgactgtgtgtgtgtgagtacacaaaacacctgctaaaatattaaataaaagcagaaaggctttgacatcaacatagtagtgttcataacgtttctgcgtagtggaattgcgagtgacatagattttttgtgttttctctaattattaaattaaaaaattaaattttggattttcataaccagataggattagtgtcataaaaataggttcctaggccaggtgtggtggcttacatctgtaatcccagcactttgggaggctgaggtgggtggatcacttgagcctagagttcaggaccagcctgggcaaaaccctgtctctatacaaaatacaaaaattagctgggcatggtggtatgcgcttgtggtcccagctactggagaggctgagacaggaagattgcttgagcccaggaggtcgaggctacagtgaaccgagatggcgccactgcagtccagcctgggctacagaacaagacagtgcctcaaaaaaaaaaataataataataatatatacgtgtgtgtgtgtgtgtgtgtgtgtgtgtgtgtgtgtatgtgtgtgtgttccttttgaccacacactgatttgtttaggccatggggctttttgcacacacatccccatgtgtagggcgttgcactaggtgatgtttgggctacagaaataaataagacacagttcctgtcttccacatgcccatgacctggctaggaatggggagcttcagaagcaagacctcaggaggtgactgagaaggagccactgctggtctagaaggccaccttgtaatctggcatgtggtggggggtggtgcaggagcacagaagggacactggcggttttggggagaagtggtggcgggaaggggcctgcatctatgagggccagggcggctgtgccatggcagccaaaatacaatagggaactggagcagcaagaggccaccagctacagctgacgcatttctggcgggagagaggacctcagagttgtgcgtggccttcacgagtctttcccaccacggcggtgcctcgatctgtttccagctaagcccagagcagccagggctgtcagaaccaggaagactgataagcgtgtctctggatggcaacgtcaggttcaattttattcagcaagtatccactccatgccaaccatgtgccaggcactgttctaggctttgtggaatccagtagttgtcaaacataataaaatccctgtcctcacagcacttccctcctggtggaatgagacagtgaacaaaatacatacaaaacatagaataaattaactggtgacacatgctgtggagtggggcgggtcgatgggaaaggaagatgaagcctatgattccaagtaggatgtctagaacaagaataatcccttgcttatcggtatagtttaaattgtcaacaaaaacatgcattattttgacataagaagaaacatcaggaaaaaggtaaagaccacagtttattgcaatatatgcttttttcaacatttgaggaaaagagattgtacatgctgtattggaaatacgttttagtgtctaaaacggtgcagagccagaatgttgatcttcatttatcaccccaattcttcctggatcttaattgccccttcagaaagaataaaaaatggaagcacttcatccagcttctgcacagaaagcctgtctctgatcagcagacaaggaataggagatgatgctgatggtggtgatgatttataccttaatgagcaggcgttggtcatcagtatgtgctgaaaagggattcgctccctgcccacaggggactttccagatgctgctgagctgggcctgagctgcaggaggtacagaggctggttggaacagccgatccttggggcatcttttaggccaagggcctttggaaccgaattgagtggagcaatttaactgcccgggacacacaaagcctcttaaaagcaatggccggtgaataagccagaagccataaatagataaagtaacaagcaaataatgggattaataaatagacaggggagcagagccagggctgtgagctgagcgccactagatcaagaaatgtcagcttttctctcagcttttcctccacagcgccaactgtcagtaatttaactaacattttgtaaataaatgtggcactcggacagctgtcaacgtgcctgctatgaacactccttttgtcactaaaagctggcagtgacgctgtttctcctgcaagtgcagccagcactgccaattggctcctggtcctgggactgtcagggagtgcgtggggccctggggcagggaggtgggtgcctgccctagagacctcactcccctacacccgcaggcatcacctgggctcagctctttctggtgcacttggccggtttgtaaggtgcttccatcaaaaatgagactattgttttccaaacaccttgtgtttcagctgggagttccatgtgcctgaccatctagtttccccgccaaggatttgctctttctaaataagacattcatttatctaggttaaaggtacgaaacgcactgttttccactctagctgctgggtgattatttaaggttatgcagtcagtttccttgtgctgtggtttgctcctgaacttgaaactaatggctctggactgtgccttaggtctcccaggtttaatcacaaagttttattaagttagtgctttagtgtcctcttcctggaaagactctatctcaaagcttcttaacctatacccaagcagaataaggagaggaagaatctgtcttaatatcaaagtcccgtgggcgatgaatttgggttattgaaatagatgaaatctagcttggtgaggaaaagcgtgaactgggtaattaagtagtcagaaatatatttaataataatataaattctagtgggcatttactgaactctttttttctggggggggatgttgttttacaaagtgccctacatattacctcctttaacactcagagccccgtgaccatcccaattttaaaaatgagggtctgagatgcagagacgtggaggagtctttatgaccagcgtgtggctgaatggggatttgatcccagacagtttaggccctttgatcccaaggtcctgtgttctaaacaacagcactggtcttttttatgtatagttaccatgtgcacggggtatacaattactgatttttaagaagcaagaacacaataaaatgaactccatacataaatgaaggaagcatctttgacctttttttcctggtgaatgagaaggctctttattgtattgtggtaacccattgagaacgttattccctagagcgtatcacagagtaatatatggagaatacaaataaatgattaagtgaatgggctctgcagtcagctgagaagtttacttagcttcagaggcagaatagtagaagtaattaataggaactaccttgttgggatgttttgaggattaattataatcatataaagtctttacagtgcctgacacagggtaaatattcattcattcattcattcattgaaatttttattatgtgcatgtgatgtatcatggattctgcagtgaatgagagagacatgatgtattcttggagcttatggtcttgtgagaggagatagtaacaaacaaggtaacatatacaaacatcccaggtaggggaaagtgctgtgacggaggctgcctgggtggctggtgggctagtggatgtctctctgagaggaagtgacatttgagctgagatgtcaatggagagaaggagctggcccagcaaggatctgagagcaggacaccgcagggagcaagtgtccggtgctggagggagagaagagagacccctgtgtgtgcagcagcatagacaatggggagaggtggagcagacagacctgcagggtctgtaagccaggccacaggtagggatctcttttcattgtgcaagaggaggtcatcagagtgtttccaatggagcagtgacatgctccgagcctctgggtgacaacaggacgctgctgcctggcctcttggagactggcttataagcctcagaagtggacactgcagtattcaggtgagggatagtggaagatttggcaatgatggaggcagtaacaattgagagatagtcacagataggtttgctggtgaagcagactaagctgatggggttgataagttaatatggagggtgttactgactgcagtgcttatattctcggctaccttaaagtaacagagtaacggtggttttgttgtattagtgttattggggtatttacataatgaactatttacagcttgagaagtactcagagatttctttgccacattactactttgaattaaacatggacaacctatttgggaaagcatcactagccacctgccctacttaacactgattcagaatgtcgggctttttgtttttacttccttttcctacttcacttatgagatcgggattgatttcttgtgtttattagtcataaatatttgtcctaaaaaccagttttgggccacttccatgtccaaagttccctggtggagttatgttggaattggagggttacatgcatgagtgtgcacgcatgtgtgctgaccacagataattagggttaagagaagggtgtcatgaggataggtgggggagggaaggggagggttccctggcctgttttatcagatttcctctgcagctctccttcttactgcaagggccaggtacaatttatgttgcctgatttcctcatccatagaatgatatatttttaattaggacctctttcactagtctccttacctgtagaattttagatcaaaattacagaagaatctgtcctaggttcacaccctgtctcatgtagaacaaagaacaagaacaggcagaggaagacagtggcaaatctcactttttaataaaatagtggcattcaccatcattaatactgatactttgttcttagcttaaatcagcattaaagtaccagcattgtaattttgctcagttattgcaataactaagagtgataaaaagaggggaatcatggaaattttatatatatatgcataaaaatggattcttaaatatctcatcaactcctaagaatatcaatataaaaattggtgttgagagtgatggtcgagagacagcaacattttaaaacatgcaaaatcacattcagcattctcagtctctcaaggtattcaagtgagccatatgttttaagcaacttgtcattaacgttggttaaaattaaaataataagtttgaacatacaggattaaacttcagtttatcttggaattcatttctatcctatattgcattcctctatataataccagaagatggaggtattactgtaagacacatgtcttttgtccgtcctaaattttgagagccttctgtggaagtgctgttttctcccatgcctttttatcaagccttgggcatcactaaattctgggttaccaaaccactggccaaaaggaacttgttgctgagtggtataatggacattggagactcagaaggagggtgggtaggaggtgagggttggaaaactacctaatggatacaatgtatactacttgagtgatgggtgcatgaaaatcctagacttcatcactataaaattcatctgtgtaaccaaaaacaacttgtacctccaaagctattgaaataaaaacaattttttaaaaaactacgcacatgcatacacacacaaacacacacaaacaaagggaactggtttccaagatcagccactgttctggggaaaaaattctcactatgatacgtcaatggatggaactgaggcagacacagaacttactctgtattaacagcagggttatcaatcacttactatgtatcaggcactgctccaagtgcttatgtgcatctcataacaactctaggaggtagattctgttattattctgtgacgggtgatgtaactgagaacagttaaataacatattcaagcaaactgcttagcaaagagtcaagcgcagttttctattcagtcccaaaggtaagctttatcttaggtccaaagaaaaaggtgccacccacctactattttaactctttaggtttcagctatgaaaatgtgaagaaaggaagcaggagggaaattattccctgtctgtattgtgtatcaaaaacgtctactcttttatttctgcagaaacagaagttctgcgttttcactcaggagtagagtcagcagtttatgtgtgttttcttaataccctcttagcagttaattattccttttaataaatgcaatgaaaaagaactgttattggagtcatactttagttgaattagtaatttattctagctcttaatgtttgttaatattctgtgtattgcttcttgttctattagacagatatgacagggaggtaaaacgtgagctcacacaggagttgtgtgggtggaagtctctgggcgatgcatgggccactgacaggtattggtgggtgggggtacatgttgtagagagaggcctggagatgcagcgatgccttctcattactgcaaaagtgactgaagtcgtatggacaatttcttggtcagaggtgaatgaaatagcaaagtctttcatataccacataaaaattttcatctgaaagtgacttctggaatcattaagcctcttcccatttctctagttacagactgatctaagcacaggtgtattctacacttaatgcctcggtaatctggttctgggtctaactctagcgataaattataattttttacttctagtagaaatttacatagttttccatttagaaagctggccccatgttagaattataataaagggcaggaggtatggattaatgttattttgtagggcatgttcagcaaagtgtctcaaagggcgggtaaaaaatgagattctttctttaggttgcacgtagcaagtcctctgaacttgagtgcctttttggtgagattactgagccaagcctgaaaataatgtcgtttgctatgtctggatcctaataggcatgctcttaattaatttaactattacccatcatttgttcattccttcagtcatttctctaacacgtatcgggtgcttactacgcactggacaggattgtaagtggtcagggtacacaggtcacccagaaaaggtccttgccctcatggaagtcaccttttagtgggaaaagcagatgataaacatataattacacaaggaagcttttgacgacaagggtgggaagaaaaggacaggtgatgtgatggaaagtaactggagtgtgttggtcaggaaaggactgtggagacgggaacagtggacctgagccccgggggatgggcaggaggcagccatgcacagagcctgagaggaagcacagaattctaatgagagggaaaacaagtatgaagctgtgtggctgaaaccgtcttggcaagttagggaaagaaaacggaagtcactggggctgatcacagtgctaagcatgagagcactgcaagatgaggtcacggaggtgggcagggaccggcttgtgccaggccttgctggcagggtgaagagtttgccttttctctgcgtacaatggaaaggagaagaggttttaagcaagagaatggcttggtcatgtgtatgtctttgagacaccctggctagtctatgtatgatgcaaaaggtgggtggggcagggtgacaagaaaatactgttccggagcttcctgtggctgtgcctataagaggtggtggtggtggtgtggaaggaggtgtggcagtgaataaacagagatgtagaaacagcgtgtacatatattttaaggaacactgaggacgtgatgctggaatttgtgatgagagagtggaaaaaatccaggatgacttccaagagctgactcaagcacctgttgggttatgattcttttaacccatgtagagagactggtggagtaggtgggaaggagagaaatgagggagcaagaggacccttagatacactaagtttatgatgtttgtttagcatcaagaagagtttgcagatggatttatgattgcaaagctcgggaaagagatgagacttggggatttaagtatgggagagatcagcttatatttgttcttaaaatcttgaaattgggtaaaatcaccaagataaggagaaattgtagctagagaggagaatggcggatcggagtcctgagcttttgcaatatttaaaggttggagggaaaaggagcagagaattggcagccaatgaggtaggaagcaacccagggagagtttgagaccaaaaaatacaagagaatgaaatattttatggagacagtgaccgattttgtggaatgctgccacaaccaggagttctggaaaaggagaagtgaaaagtatccatgggactggataagatgatagcttgaggattttggcaagagaggtttcaggagaatagtagagaagggaagaaaaaaagatggtagtaattggagaggtaaatcaagtcaaaataattggtgtgtgtgtgcatacgttcagacccacattatctagtgcatgactgcatacagatgagaaagttccatctcatctgtgcagatggagggagtatggcgctggagagcagaggtgagaggtagagtacaagcagagggctggcacacctttggtgtgaagggatttctgttgcttgttttgtaaatctttcttctcttaatactcctgattcttgcaagctgctcatctggaacaatctggttacatatttttatgaattttccaacaggacagttgagagcatgaggaatttaccaaatgaagaagtggattttcaagattcttcttttacccccttgaatgatgttatgctctgtgtacagaggggcaaattaggagagtagcaaggagggatgccaaattggagtaggagggatatgaggcagtgacagtggatgtgtgaggataatagaaagtttgatttgaggaaacctcaccgtgggctacttcattacccttaagacttttagttgtgtgttctctcttgtctaagtagttctgctctagaggttcaagctgaacccagaaggaaaagaaacctatttgaaactgtgtaaaacacctcccttcagagagcttttctcactgtttttagtctcactgaagatgatcccagtatgggatgacgattctgcagagatctggcttgtctttacattacatctctaacctggagagtcttgctggatgtttccccaggattgtggtttcttatatttactcctgatctaatgcaaagcaccacgtgcaacttatgtacagttccacgactaaataatacaatggaatcaccacaaaatattatcagctcctcccaggcctctggttgttgaggaagaaaagtgggtggtgcttgttggagataaaacaagacgttagtgggtatacattgtgagataaatacatatgtattttaaagtttactggagggtatctgtatttacttggttttccccagtgttttacagatggtgcaaagtatacaaacatgcacaatgtacatatgactgcctgtcttagcagacaataccttatagacatatagacatagtccagttaacctgagctagagactcttaccttacaaatgattgtcccaaagcgttcagtaatgttttcttattttatctctttaagcaatactaagtgacttttgggatgagactgtcttttatctgaatctaggtttatggaatatttgaatatctgataccagacatggggatccacctctctttgtgcccagccaatattcagtgcagaaggggatttgtcactgaatctggcatgttgccctaacattactacaagcctgaattttgataattatcgcaattatttaagtaaatggattaaccttgctttgacaacatagtttatgagctgatacagtgtctttaaatagcatttcttaatacgggtgcaaatgataaaatttatcaaagtaaacccctgcatgaaaggtttcctcttcgatgattctgctgactggaagagcaggtccccatggcagtgcgcatagggcacgtggaggggttaaaggggagagggaagatattctcgagggtaatgagatgacaggcacattgtacaatttctcacacatctaatttatatctacataattttaaaaatgggcagtaacttataagtctgattcaatgccacttattagctgacatttttcaatattgtgtttgtgtggctctattttctaagagcaacagagtagaaacctgttatcctatatcatttctctgagtgggaattaaaagcctggagttgcatcctgggcttctgttcccttctctgccatccctgccccagccaccacccttttggggagagttagaataccatcagcaaaagagccatggggatatggattcaaatcctgtccatagcagggtgtggccatgtgaccttgggcaagttacttaattacttagctccttacttctgtgtagtgtcttacaagtgacaaagcatttcctcatattctctgtgcttgtctgtctctcccctggaactttaagcacctggaaggcagggtgtatgtctttgatctctgtatctccagtgcagaacactgtggaacaaaaacagggtaaatgaacgatagaactttgtttgactcctaccacaagcccgtgaggtgtcaggaagattgggataaccttgtaaagcacctaacacagctcagtaaaaatggactcttgttattattgggtaacagatattattcacttggagagataaaaacaaaaccaaaacactaaataatgggcttggctctcaacccaattcttctgtttccactctacttcattgccctttagtctaggtgaggtgtagatccattctaatgggcaggtgttttctgcataatcatccatattaaagaacacacttacagttatggaacatcatctcatattatctaactcatttttctttctttgcttgcttccttttcctcttttcttctcctcccttctggagatatttattgattatccatttaatgccagagttttgttaggtgctggggatttaaaaaaatgaataaaatgaaagaagttgtcatatcacaggaagatgggcatttaaacagccagctgtaaagtaaatggaacatgatgtggcagaagcaggtaaaactgctatgcaaaagcagagagagagtggattagtagggccagctgctgtaataacaacccctaaatccctgcaaactaacacaacacatattaattcttacttgtgcaatgtccatgcatagagtggttctcctgcatgacttcttccaggggatgatttggggacttggactcccttcttcctgtgatccatattgcagtccttactttgatgcaagtgggcagaggagagtagagagtgatgtagtatcttttggggccagtcctggaagcagcacctagaactgccatgatttcccatctggaagcaagggggctgggaaaggcaccctttctctgggcctggaaggggaatgatggtggtttggtggacacataacattgtctctgcacagggaacagctatttctatatgaaaagtctgtggatccaggaagatgatgcagaaggggggccatttgtctcagctcttcaagaatgcatagagtttaggctgggtgtggtggcttatgcttgtaatcccaaaattttgggaggccgaggtggatggatcgtttgaggtcaggagtttgagaccagcctggcccacatggtgaaaccccatctctactaaaaacgcaaaaattagctgggcatggtgacacgtgtctgtaaccccagctactcgggaggctgaggcaggagaatcacttgagcctggaaggtggaggttgtggtgggccgagatctggccaccgcactccagtcgggtcaagagagtgagaccctgtctcaaaaaaaaaaaaaaatgcgtagagtttagccatgtggggctaccgcagggcattcctggcagagagactaaaagctaggcatgcaactctgggtttttggaatccagtcaaggtgttggagtcgtcaagtggaagaggcatctgcagcagcctagcatgttcactgtggccttctggcctcttctcacctcccctttccaccatctacttggtgttgagttgcttatcagtttggtttctcagtctccagtctcctgtgcttgcagaggccgcatctccactaaggaagctctcttgctaccatgccccttcccctggctggtgtggactcaatttccaggctcactcacatggaaactgcacccaagtcatcaactctgggctggtgacacaacaaagaatgggtggctagaggtcagtcccagagccggctctgctgccctgcagcacccagttgggagggcccagtaacctgtgctgcaacaaaccttcggatggttctaatgcagctagtttacgagtcaccacttttccctgtttctcttttctgagtccaccctccaggtgtctgattccatcagtctgggttggcgccctgccagagtgaaagagaccagtggggcaggtgtacaggctgtcacttctacttctccggctcgttttttcccttcactctctgagcacctaccctcagttccacctatcacttttcccagctagttggcccaagcatggataaagaattttagaaatgcaactttccttttttttgtctctctctgtaggtgccagttctgtcattagaaatgtcttgccaaattagaacacaaataagccaagaatattcttcaaaatgcagataatcaaaagcacagcactggaatctgatcatcccccacacatccatggtgacagcccgagttgctctcttagagcctggcagacattctaattccaactcacatttttctaaaaggaaaaaaaaaaatacctgttaggctgatattccttaaagaagagtctttcttagagaactttataaaagccatatttgggcgttatttgtatgtgaaaattgtgctctttctgctcataaacttttctgaaacattttttttttcttttctgtgagagcttagaaaacggctagtaatttgaagacaacctatgtgacactgatatgcttttggtagcagataaatgccactggctggtgcaaagacaatttgcttggaaaatgtgaagtgctttatatctagaaatactaggtacagagtaaaattctccatttgttaaaatcagacactgacttgcagtagtgagttatgtgctgggctttattaatccttctgctcatattgctttagacataggagacagcggcgctgattagtggtgagctcttgatgaactatatttgggaggccccagttttgcaggagggggctcaggcaggtcactgcttcatgcacaaaacatagggaacacaagcagcagtttggatgtccacagctcatctcagccttgcttccacatgaggaacaatgatatcagcatgtaatctcagcattttgcccttgaaataaaattctgcccgccattgatatccagtagctcactcctcactaattcaaaataggtcccagtggattggcatcccctccatctgaattgcaacatgcacttcatctcctcctgtttaaaatgaggatgagcatgcttagagtgtttaagagttggaagctgcttcaggggtaggtatttgtagtttcatgaattatttatttaagcaaatgtgtacagcacatttatgtgttggagtatatgcctgatcacactcaaaggggtgtcgtggaaatgtatcatgccacggcatcaccattttgacatgtgtagtgcggagaaccaaaacactgctcctgggatagaacaggattagttcagtttggaatcatttggctctcatgatgcaagactaagtaaatgcgttttatcatcttccctgttgtgtaaggataaaacccagcctggatctatttgggcttcatgcctggagttttgaactaaacacagtcccattggtgtgtagtcagatttcattgtttttggttttgttttattttcccctttcaccaagcacaaatccggaaaaaaagcagtatgtgcattaaaggtttgcggtattttccttatagggcgattcacaaaattgcataagtcaagtccaatttttagctatttgtgtaaaacaaacagaggctgtctttccctatttccttagcatctcctgtctcacgcacacacacatagcaagaggtctgctgtagcacttaacggtgcattcaggggtttaatttgaagcagtgcaggaagtgagatgcctgaactccacagcgctctcatatctgggcatacacagccttgcgtcaacctggaaccctttatcccactgggtgtggttagcagcaccttcttgacttgctggtgggcacctccttgactttttttctggtccacttgaggttaaaagttgaggcggggtgaatctagaatgagcccctaacacatgtaagcctatacccttctctgaaaatagcaaaaagtgaaatatccaaactaacaggttaaccaggttcaatatttacctaaaattgccaacatttcaaaaatcatttaagaaaataacccaaataactcatcagccagccagtatttgttaagaagaaaggacaaattgcatacttgttaatttccctgtggggtagtctcagaactgtgcagtgacctctcgctgacattcctgcacctttactgatatgctcccaaagtctcacttagaagagtgaatataattgctcactctgatggctccattcaggaatcttcaggagacacaagtattaaaatgaatagatggcgtctggcaaatctcttcctgccagcgataagcaatcttgtctattaaatgtctcccagtgcaggcggatagtatattccatgcctggtccgtagcagggtgcaggctgatggattgaatgtatctatacattgtatacagctaatgaactggggttagttacataagaggaagattgatagaacccagaagttatagccagattcagtccagaaggagaatgagaaagcgatcccggaaatctgggtaaagggggagataaatcaggtgggtagacgttataaacaggcctgggaagctgggtcatgcaggcagtgggagactcgcgggagactgggagatggggagacgtgggggaatggactgctgatgactgcttcctgcctttcctccttagcacacttgggctggacagacatatgtgctttttaaacaagaatctttctgaaacctggaagcattagtctaaaaagatgtcagacaccttctggtacccttattttagagaggagaatgcacctaaggcacatacattgccacaaggtcaaataggccatttcctgatctttgccgctctcaaaataaaaagaaaatgtaaaacatatatgcaattgttaagacaaaataaaaaggagagaaagagaaggaactgtgcctgttgctaaaagctagagttcagtgttttaagaaatagaatggaaaagtttccttgaagagaactttatctttcttctccagaggagtccacaggttgtcatggattttacattcatctctaaccctacacaatgcacacaatatgaatcttcacaaatgaaatatgttccatatattgatctgtgatttcttttctctacagatagtatatcaacaatatgctcccatgtctgtatgtataaattaaccttgtttcttttacctagaagaataatactctattttgtaaggttccataacatatttcactagttccttataaatttatgtgcatattatttctaattcttcttctctgtcaaacaggctaccatgagtatcttcatgtatacaggaaagtgcctctgaaagcaaattcttggctacagagttactaggactaatggtatacaaattaaaagcttatgaaatattgaaaattacctaatataaaggttattggaaggtacaatggaatggaatgtacatggatctgtacagacatttccagaaaagctggtgagtagtggggtgtttctaaaatgtgacatttgccacactggtagttaaaaaatgtctaatttatatatatttaattatgaagtttagcatcttttcatataggttccatgcagctggccagaaaaaggcccccttcctttgcatgatggtggtcttgacttgtttaccatgatgccttcttacattgtgttctccgtacctggtattgagggactgggtttatcttcccacctgatgctacttatcctctgcattatgtgtgagataacttctggaccgcttcaggaaccctccctgcctgtggagtcatctactctaattgtccgggagttctgcacccctgccagaccctcccctccccgggactgtcttcctgtctttatgaaatcccagcacctacagagaaccaggcacatagaaacactcagaaagtggttggtgtaagaaggaagaaaggaaggcagggaggtgggtgcagggatgatacacgctggtatgaaacattcacagtgaatagaacatctgtaagacacagggccctggggtctgtccatggaattcatttttttcaatttatttagtgccttagccctcaggggccttgtttcctcacatggaagccagtcagttacgtatatgggggtggctaacatcccagttaataacagtgatgttggcttcagtcagatctgaatgtgagtgatggtgttctctcctagggttttgtgattagtttaatttacttaagcctgaatgtttcctcctgagattagtatgaggtttagatgatacaatatattgaaagcacttgatgcagagcctaatgtaagtaagcacacaataaccattggctgctatgagtagtacttattattagtagtagtagtatgattatttttattatcaaatggtaagatggtccatgcaatgctatctttgtccataaggccattggtgcccatgatgagcaagttattgtaatagaaattaagctcaattggccgggtgcagtggctcacgcctgtaatcccagcactttgggaggccgaggtgggctgatcacgaggtcaggagatcgatactatcctggctaacacagtgaaaccccgtctctactaaaaatataaaaaaaaaattagccaggcgtggtggtgggtgcctgtagtccccgctacttgggaggctgaggcaggagaatggtgtgaacctgggaggcggagcttgcagtgagccgagatcacgccactgcactccagcctgggtgacacagtgagactccatctcaaaaaaaacaaaaaaacaaaaaaacaaaaaaaagaagtgaagcccaatcattatcacatccaaaggcttattttgggggaactgccaacacttagcccttctcatttactgaatcggtggtgctcctctggtgatagaggcttgttcacagaggggagagtgttcctcaaagctgacctgctttgcttctaggaggagtgattgcttgtcctaaaatcagtgtgtccggttcagccctttagccacagggcttttgtacttgctgttctctctgcctggaaaggccatcctcatggtatctcaagggcttcttttcttacttctttcaagatggcaacatagcagaggcgtccatgctggcaactgatataaaatggccccaccgccccagtgctaggcaatctttagcactcaatgccctgagaaatgtccatatatttttaggtttgtaaaactttattttattgtggtcagattacctaacatgagatctgccttcttaaaacattttaaagtctacaatacagtaccgttaattctaggaacattgttgtgtagctgctctgtagagtgtatcttgcataattgagactttatgcccatttgacagcaactccacgtttctccctccctccagcctccgggagacaccattctacggtgactctacgtgtttgagtatttgggatacagcgtgtaagtggaatcgtgcagtgttttcccttctgtgactgacttatttcacctagtgtgatgtcctccaggttcatccgtgtcgtcacatatggcagatttctttctcagttaagactgaattgtgtgtatattgcatactgttacatgcattagtgtatattactgcgttttctttaatcattcatctattgattgacatttaggttgtttacacatcttggctattgtgactagtggtgcaatgagcatgggcgtgctaatatgttatgtacatttattgtttacctattgatttccaattgttcctcactaaaacctaagctcataaaggtggaagctttgttttgttcactgatcctgtgtcttcagaatctagaacagcacactgacctagactctaatcccagtacctgtttctttgttcttatttactagaataaaaagcaatctcagttgagttttaggcgttgcacaaagagaaacttccagcatgattggagacatcattgtctctggcacccttggggattcggggtcttgtgttgggtccaccttgagtactggccctatacctagaacagtgacccacattcccagggtctccaaggtccatcctcctgagtcacgaaaaatgtcctgtatggccaaagtcacttgtaagcctgtttttatttgaatgtcccggcccactccagctagtgctgtcagcttttcaggtccttttcagaagtcctgggagggtagaaagctctgtgctgatgttggatggacatttcctcttccttctaatgccccaaactcctatccattcatcctattgagactctcctagctactcacacttttctcttctgacactttgcacacttactagtatttactatttataattattctgttattgttttccttaccaaaatgaaggatgcttctctgttttgtttccttccctatcttgactaccttggtgcttgaccatattcagtgaatatttcttgaacattattggtggattgactttgtttcctctccccttccacaccacatcccagtagtggtacaatgggaatcccagactttaaatctgtcttcagtgccacttgcctgggttgccctagaggcctcctgtttttcatttttcctttgccctgcaatgtatggcaggtgacccagaagggtcccagaaggatgctcctgaagtttggcccacaacaccttcctgcttttccactgcacacaggtctttgcagactaataacacgtggattcccttgcctggttttctgggcatccagcatactggcttcaacttttctttccatcttacctccactatctctgtcctcttgcttctgccaagccaggcagttcacctgcctcacctataccctggcttttctctcgtacactttgttcactcagtactctctgtctcggaagcccactcactcccctttcaccctcatccttcctttgcacgtttaggtcctacataagctgaaaaagaacagagtctggtcaaatcttgactccgcttggccaatggatggtacttctcttagcctccgtttactaaaatgttaagggggaggagataatggcacctaccttatcaggatactgtgagagttacattagatactgtatatagactgcctggcatacatgctccgtaactatagactattatttctcttcaaagcccaactcaaaaaatgaaattcttctctatgaacccttctctaatcctcccacgcatggcctctcttcttcctccacttccttctggttctcttggagttgctgagcacgttgccatgtcttagaactcatcaggaacctgttctgtcttcccctgtatccaaggtgggaggcaagttgaagtcaggaattattcttgtgttctgcacagtgccctggacattgctgttgtttggtaattgtttttttttaatggactgaatcattttgctgctgcccaggctgctttctactacaatagcctgtagccttaagcaaggatgagctattttccctttagtaatgggccagcatctaggccttgattttgagttcttagtatggtaccgtgaaaatcactagtgttgaaaggaataggatcagagggggaataaaaaggcatttgatgaggctcttagtgtaacagtatgtctcactcatctttttttttccttagcctttgaaatagacaatggccttgagccttctcggcagatggaccatgtttgtgccttagccacttaacagccattagcctaattccatcctctacagccaaattaaataataagtaaaggcctatgaaaagctggtttggaggcagtgttactgcctttcacttgacagccttctctgaagcagatgctccctctccaccctattaacctgctcctctgaataaggagctgtccacacagaagcaaagatagaggcctgcaggagagtggtctggattctggagatagggggaaaatcctgatgatgaaagtccagcttctttggaaggctgaggcgggaggatcatgaggtcaggagttcaagaccagcctgaccaatatggtgaaaccccgtttctactaaaaatacaaaaattagccaggtgtggtggtgtgtgcctgtattcccagctactcaggaggctgaggcaggagaaatgcttgaaactgggaggcacaggttgcagtgagctgagattgtgccactgtactccagcctgggtgacagagcaagactccgtctcaaaaaaaaaaaaaaaaaaaaaagcccaacgtccatccactactcccacctcataggccacagaagatgagagctttaacccaaagtcatgataatgcgatttctgctttgattggtcaaagctgctatttgttagtagatagtatatgacctataaaagttcacaacaagaaagtaataccctggtcttactcctaacaagtctgataatacattctcttttatcacacttttttttcctctgtgtccttgcttatagactcctcctcctgaaatacttccttctattccgaaatcctggatacccctcaaggacagcctaaatgtccctatcctcataaaacacatctccgattctcaatctcattctctgactcaagtacctcctcctcctctgagcacccttcacccttaatctgaacataatttctaactgtattactattttcaaacttgaattatagatgtatgcatatgacccttactaccaggatctatgttccttcagggcaggaactctatagtcatctaaatacttcctacaagtttaaacttatttgtattgtgtttgtgtgtgcacacatatatgtacatgcacgtatgtatatatttatatacatacacatatactcagtaaacattttttgcatcaatgcatacatacttatgggcattttaattttttatttacacactctctctctcagctatcccttagtggcctcagattttttctgcatgtagtcaaataggtctctgtgcttgtgaaaatgtttctatcaactgtggatacgcataacctgattgttaaggtgttactttgagagatctagacagtgtgactgcatttttttcaacttaaagactggcagaaatctaaagcattcaactcaattaattttctctaaaaaagaagaaatttattactccaacacaaagatacctattacaatggttatgctttataaataagcaaacatggatgtcaggttgggatagctctgactggtgaccaatgcattatctctatttctctcttcttgcccttgctatctatcatgataggccttgatgccccagagaacagaaaggaaaggcaccttagagacattttgctgttgttattctgatcttgtggtggcatatagacttaaagtctctgatataagaaatacacactaacttgtttgtttggtgccagttttaagaattttgaaaattcagaaggtagccattcatcatgactcttaggtagaaagcgccgtgttcaagttcctccagctgctagcaaggacaagcatggggtaggtaaggcagaccctggttggctttcaggcatcagggaaagaccggaccatctgttgccatggcaacattcattggttttacaataaacatgaacaatgaggtgctaagccttctaaaaatagaggcacgctctatttttttccatatttttataagatagtttcacgatatatcttaggactaaaattgagatctatcctcctggttacaaggggcgagtgtagtatccatagctttttgaatggcagactccaagtttgtgtgacttgagtatgcgtgtgtgtctatgtgtatacacacagttaatattgagaacagacccttgaagaccactatacctacctatggagcatgacataaagtgaaatgtagcattaaaattatattaaaatatttgggaaaaaatagacaattttaccacctgatccaaaggagggagctttttctaggcaagtaatttcactgaagtgatggctttctgtgtcagttttctttgctattactggcctgggcaacattaaatctggctgaggctcagcactggacaaaatacaaaatgatcacaggcactcaggcttctgtagagcatcaattcactttctaatgaaaaagaaggagtaaagagagtgagggaaaaaagaaattgttggcaagctaaaaagagtttaagaaatgaagaggagaaaaggtaaagtgatcagaggtgagaaaaatgaggagaagagagataaatggtttgccatgaggagaatgtagacctttaacgtgaatctgatgaaccaagccactccgtggagatggagaaagccagcctttctttccctccttagccactatttctggtaatatcaagtccatctgtaaggcaggcaaggtgaatttattgtatttaatagcttccaatttaacaagtcgaatcggagggatccccaaactctactccccatggctatatgctcacagtgctgtgatttatggtaagccctcctttttcctaaaacaaccacctgagaggatgtctcctggcacgcgatgtcctctgaaaaccagaggccagtggttttgggagccagacacaggcattgtaagtagcacaggacgcttcactcagcagacagggcaggaggcctcggtagatgtgcagaagtcggggagaggcagggctagcctgctgctctgaccagacctagtgaggcaggagggtgactgtcgctgcttggtgtccttcccatcacagcagtgaggctgcaggccaagccttcacctggacacgatcagggactctggctctctgaagggaggtggtgatctcttttctaatgcacttcactgggtccacattaggccgacaagtcaggttcctcagggctcccgatgatacagcaggaggatgtacattcatccctgtccatcagcgcctcccagggaacctgcgtgtctgattgaagtaatttcacccatagtgcacaaagtgtacactcaatcaaattttatagaatactttttttttaacgaaaacattatgtttgttgtgcaaagttttagggagcagtgataagcaaaagcaaaacagaacaattaaaaccacctgtaattccccatccacattcgtcattgttaacacagtagtgtatatgcttctgtcggtattttctacagttatgtagttatatttttcatttaaaaaaatgaattcaatcttttgttacctactcatataacttatgtatatacacatctttctgtttcattaaatattttatgttatattttattgctacacaatattctattttctaaatggaccatcatttaagtagtaatgctcagtggtgagagagttagattgtttccagtggttttgctgttgtaaatactgttcagatgaacatcctcattgtctttattcacaagcatgattacctccttaggatatattcttccagtggtattgtggcagagaatatgcaaacagcagggtttttgacacctgctgtcaaattgcccttcaggaaggtaccctgagcacctccaccctcagcctcagcctcagcccgcttggttcttcctgctgtcacccctcaccaatgctacctattatcattttgtttaggtttgctgcttgataggtggaaatgccatgcctttgttttaaactgcgttgcctggaatagtaatgagtttgaaattttccccagatgttgaagggctacttgatcttttgtccctattacctagacacatggatcctagctgggctctgggaagtggcactatggcaactgctaggccttccctctccttggagaggaattagcgagaaaatgatgcctcttcaagtgtgtttttaaaagagtttaaaatgtaaaggggaaaatgtagatggccagagagataaattataaatggaggataattatcgtagtttttaggaaaggtaaaacatcaaaagatacataaatgacaaaagaactaaatatcttaggaagccgactttcctaaggtaagaatcgtgtgctgagtatgtggcaccaagacctggaaggacccatgtccctcccaccctcccagtgccccgacctcccacctctggtgctgtgctgtgactccacagggagattttgtgccagtgcccccaccagggactcatcaccactctagcccaatgactccaaaattgccttctcctaaatataatgtccgcgctttgacttttaaaaatagcagcagaaaatgaccagggggcactctgtgatgtccaagattcctggggcaaagcagcccctggagcctgttcttaagatagctccatccttgtcttgctgaattatttacagaacttgtgagggcagaggctgagtagaggtacttcctttctgaacatgctcaggcactccctgggccaggcagggaagccagtgtctggaggatgtctgctacccggtgtcagggagtctgccattgattttctttaggacaaacctctctgcaaatgccacagatttacattagccgcactatagagacccagtcagggccaggcgcagagacgtggggaatgccacgtgctgatttcttttctgctctgggcagttgcttcttttcacttccacgtctgaatggcagggagaagctgggtgcccccacatgtgagtcagaatgtgacctctagcatttgaaagtcctagttattaaatatatgatctgagttgtccacattaaaaaggcatttgggagtgcggggatatggagaaagatgatgagcttgatgtttggattgatttattctcagtagaggtgatttcagcaggctttcccaggcaagttaggatactttagcattactctgggtatctggccagagttttcaggggtgttaaatagtgaggctcttaagaatgcaggaagcttgggtcatctcctgcgttcctagggtactgccgagactgggttcctttcatcggtgtctcggggggttgggggtgggggagctgagccacagtggagcggaactgtctgcatggacccttccctttcttccagctccggtgtttgcccacaattccactcacttaaaatttgcctttgtcttctagccaggtagcttgccaggggaaactgggtgtgagtcaatggccttcctcttcactctatggtcagcctctgtttttgtgggacagcatcagcctgaagccaggcaaaaggcccaagtcatgtagtaaaaagtgtgcagggctcaggactggaagcaaaactctccaccaaccagcttggtgctattaatcagatactgtaactgcctggaaagatgagcaaacaagctgtattcctcaggctcctattttgtgctgtctacattgtgtcctctgtgctacctcatttaatcctgttaatcatggtttagatgggggaatatcatctctaatatgcatatttagtaactgaggtttatagacctccaaggtcatgtaaactacgaggtggccatgctagaatttaaacagcagtttttatttttgtgaaagtcttgttttctttccaagatattacagctgtcttacttcacaaaattgtcctgaggaccagataattgtaacatatatgagaggtaaaagaaaaaagtctaaccaatgtttggtagtgtgattattgcttttatattctagttaatttttctgtgatgaaaaagcaagtttccaaaggccctggctttgaagggaagtaatgcaacttggcccagtctctgggtttatcccagaaagccagttcccctccaactccctcctgcaggtgcagttttcagctgggccctcagacacagtccactttgcatcccacttcttgggaaaatttttcttaatgttcactagcgctaagatcattctgaaacctctccctgcaccactgcaagactagtgcattcttaaaccctgcagcccaaccgttacctgtgatttattttattgtcatttattcccacagacaatacacataaaaataaaggtagtaagtgtaagagcattttaattgccatcccactagtcttaaatgtccactgtttttatatctccccctcctaccctagaaaatttcagaatagagaagatcaatttatcatcttatcctcgtttcctgatctcaaattggaagatggacagtttttatgttaatagagagtcgtttagagtcagggaatttttcgaaggaaagtcgagatagatggatgaataggtggttgtgtgtgtgtgtgtattatatatattaatattaatagagaggcttcctttgtggcctcatgcagaatgcttaaagatcctagaaatgttgctgtaggaatggaagcagaagaagccgcaggcttcatggttgattgcttttctgattggtgccataaaaaaaatgcattagcgagagaatgtttgatttaaagagcgcctagatgccgacaccacctctgtttgttttccttcctttagcagaaaccttgtaaaatttttatgaagtattaatggatctgagattttctccagcaaattttatgaggtgagcttaatcccacacatccgacccaatttagcagtctttagagacatagaacgtaaaaggcactcagaaagtatcctgggtgcctcagtaccaggggagtgatggggcaggggtagggtatttcctccctctcagtgctttggtagactctcaggggttgtgggagaacagagtgaagaggtaccccacccacagagaagaccgcacaggtaagccaaaacttcagatagtaaatcttaattcataacttagcactgacttcaagaacttccctatataactgtagtctttgatgagaaaatcgtgtttagggaaaacaagaaattatttgtattaacagtttctgtgctgtcaacctggaatcactggctttaatctaagaaagagacatgaacaccgtccttcctccaccccaatttgttttctgtatttgaaacaaaagagccttgaagaagataagttacatttttgtgtatgttgatgagtgcagctacgttttgtaatgtgaagtttggcctcccacaaaccaagcaacttgatgagcctcagcacactagtgagcatttagcagttcccatcacttacctgtttatgctgattctgtactactctcgcgagttcttgccctgtaatgtgtgaattccattagatttatggtgacgaaatgaaggaagagaagttttttggaagagaaataggagccttcgccaactaagaaatcactgtggcctattcaagaatggtcaagggtttgggattttaccctactttcaggcaaacaagtccacatgccactgtttcaggggtgctggcggaagaaacgagactccagggtcagagataaaagactttgttactcgtggcacagcaggcagcatgagctccatgttcgtgtcagtgctttttgttccccaggtctcaagagggtgatgtgtatggcccaagtggatgttctgtgctgaggtggtttgcaccacaaccaagtaacccctcatttagcaaactcaaatcttttgtaatgggctgcccgcagatttgcccaatcttttctcagaagagaggtgttctctttattttactggacataaaaatctgccttgtgccatggagggagacaccatttctgtcttaaagttcttcgctgtattaacatccttgaaaagatagtcatggccaggcatagttgctcacacctgtaattccagcattttgggaggccgaggtgggaggatcacttgagcctaggggcttgagaccagcctgggcaacatagagaaaccccatctttacaaaataaaataattaaaaaaaattagccaggtgtagtggtgcatgcctgtggtcccagctactagggaggttgtggtgggaggatcacttgatcccaggagttctgggctgcagtgagttgtggtcacaccactgcactccagcctgagtgacagagtgtctaaaacaatactttaccttgttttcctgcgggtgaatattctcatgagtaaaccacctcatcaaccactctgactgatcaaggttggtagcaaatccattcaatttgtctaatacagcatttaattaaagctactatcaacagggttttgtgcagcaggatgaagctgttctacagtattgacctcaacattgttccccaagatcccagacctaaccagatgaagaaatgccacagacaatcatggtccaggtgagaaacaaaagggaaagttttccttacgtttctatattaactttctcacttgtctgaggcatgaatgcaggtacaacagcatgtactagagattgcacagacctgagtaggcttgcaaagaggcagtggagggtagttgtgttatccataacaatcctggccagtgcattgaagctgatttgaattccttccagggcaagggtgttatctccttaaatacttgaggttctctgtgagcacctctgagcgtaaaagtcacagggtgttcagaaggggcaagttaaggcctacttccacacaagaagtacaagctcgagggtgttcatggtgcccctggatggaaagtcttgtttacagttgttgggaccctcccaggtaagacctccgtccatccagaatcacaacttgacattgcctccagtgtcatctcctacatgatcgttaggacttaggggcttcagttctgctagaataattgagtctaacccctgtttttgagggacttcctgccctgtatatccatgtcaccggctggatgccattcatctggcctgtggaaccatggagcagtcagtgactctaggaagggaatcggggagacaatggcagatgttgacatatgttttgtgatgatgttccaggagctggccccatcccctaatgttcatataaactgctcagttaggttaaggggaatcgtgatcaaattgtgttgagagctgtcaggaggggatgctggacccaagagtcagttaaatgaaggtatttgcagcagattgggagaactgtatcaggtcattttcctcatgaagaggatttatggagtggttctatgacaaaagatccatcctgttcccttccagggtctacagcgttcctctccaagtgcctgaggttttggtccgtactctgcaaaattggtctgttacatccagtagctctaacttcaccttttccaattattttctgctgatacctggaactttcatcctgaagattcaggtgcaggagggtcaatattgctttttgaaattcacagagatgcgtcatgcctcctactttggcctgtttgagcaccgtgaggggatttggacaacagcgtcttcaacctactggccatcacctttttcatccaggagcatgtcaatccaacaagagaattcaggcagcctaaccagatttaagcatgagtcccctagatccttttgtagccaggttgctacccaaagggtgggccaactatgctggcctggggttgctgtcaagggaagaaaataactcatgttcccaggaatggtcaagcagaaatcctgaatttgaaaaaaccttcattgttccctccatttattttgtcctgttgattatgcaggaaatggcaggaaagagatgatccctttcttggatcagccactttcgggggccaaagcaccctattaaggtgtgtggagtgggaggacatgagggaaaaagagacagaaatctttctgattcaatttttcagaggctattccaaagcttggtgataccagatgcctgtggatgatggggagaattaaagcccgtcaagtaatccttgactatcaaatccattatttaatcatttttgtgatgaaaggtgcagcattgctagactgaagatactctggaaagcctagcacatgacacaggttggtctgatgaaaggtgaagcattgctagactgaagatactctggaaggcctagcacatgacacaagttggtctcaaaggccacactagcatggggagcagaatcagattacactggagcagcagcactgtatcctgcaagagtggccggcagtgaggcagcatcaatagccctgagagggggtcaaaagtcagactgagtgagtgagtcttccagaactgggcaggggtaattccccatgccatgcaacctttcccactgagacagagatcaccttttgtcaggagtcaccaagtgtgaaatgcagtggtagtccctgcattcgaaacatagagtcttttactgtgtgcctagtctaggaaggcggacatgttgccacatctaggatgatgatggatccatgcaccaatggtgtccatgtttcaccaaggctccatcagcaacttgattttgcctggtctcatgagggaacaggcgtttgttgtgtcatctctgtgagtggcctaggtggtttgtgggtgcctacacccatcagattcccttcattctgagccccttccctccttatggctccttagcatactttcctgggtgcatatgtcctgcaatacctcttgagggagcaccaagaaataccagcccctctcataatcatctttctctttaaagcagttgaggtcagagtagagggggtaggaaggatcaaggggtgtgaaggtcgagagcagtttcatgccaataagcaaggcacaaccaaacacatttctaatgttatggactgcacaattgtgtccttccaaaattcacctgttgaaaccctaaccctcaatgggatagttttgggagatggggactttgaaggtgattggatcatgaggttggagccctcataatggaattagtgcctttatacgaagagacacaagagagctccctctctgctgtcctccctgtgagaacacaacaagaaggcagccatcaggaaaccaggaggcgggcccttgccctccagatctgctggcatctggatcttggacttcccagcctcaaaaaccctgaggaacaaatgtttgaaccactctgtctatggtaatttgttacagatgatctaactggccaagacactaatgtttgcaatccacacaaagttccgtgtcctcattgcttatgccatttaccctgactgtggacccttgggctcagcagctgcagccttcttgtcagctggggctcaggttgccaccccattttcatgaaaacatccctccctccttccaccccaagtagtgtgagcaatgaccacactgtccttcagcagctcgttttattcctacttctcactgcaacctccaaacgttcattaataggtcggatagtgaagatccttactcactgcatcccccacccatcagtgtgaaatagcgtttgctacagggtgtcaaggagtcatttcatatccctgacacagcctgggacgcccacttccttacttttccagaaagctacatctttgtcagcatcccattctcatcactgaaatctgtcaggaactgtgatggatctgagattttacccaacaaaagacacgagactcctgggtcctaggcaaaagactttattactgtggcacagccagtggtatgagcttcaagttcacaccagctcgccatgctccccaagcaccccaaatccacaggtgtgacccagagcagcgcaaatggaggctagacacttgggttgtgtttgcatgacagctggataactctgagtttggggaacctggatcttttataatggactgcaagtaaacctgctcaacttttgcctgggagggaaatattatttttgttatactgggtgttaaagaaaacatgtcctctgctcagaagggagatattatctctgtctttcaggttgttcagtctacaaatatccatgaaaagataggtcctcttcttgcaatatgtgcagaaatgcaagacacccatggagaatatctcctgtgaccttgctaaaaggattctagccagaggcactgagcaggttattgttggagctctactcctatgttgagagcatcccttgattcagccattatgtaggataacatgccaggctctggaataggcacagggtagtgaataaataacacagtaattgtttctgccctgacagagcttatacagacaaaataataatgatgacagctacacttatatagtgctcactatgcactaggccttttctgagtaatttatatgtacctacttatttaatcatcagaatgacactttgaggtagatactgtggctatcattctcatatttatggatcagaaaacagagagagagtgttagagtcagaatccaagcccaggtagtttctgaatgtatgcttctaatctgtcttagtataactaagtacgctagttatacttagtataagtctgtcttacatggcttctagtggaattaccacacaggattataaattcagtgattttataataaaagatgaactggggacatctaggaggagtttctaagccagaccaaagggctgcccagaagaagagatatctaagaacagtccagaagggtgagtggacattaaccaagggagctggagaagacagttctcagcagggaaaccgcgtgtgcagaggcccaggggttggttgggggcttcctgagatgacagtaacatctacttagatgggtcatttgttgtaaggcacacatttatttggaatgagtcagctggtgaaatttcccccagacttctaattcacagctctttgttttccgtgtatttttaactaaaatatgcaacacttctactgttgagatatcacagcagcctctaaagtgtcagcaaaataagccagggcatagccaaagtgacaagtgaaacccagcattatttgaatttattttgatttttgtagaattcaagtgtctaattattaatattaagcaagtagagaaattaaggcaagatacacatgggattatgggacacaagaaaaaaataaatattcaaagcttcaaagactttttggatatgaatagcttctttgatggtctctcttcattatggaatcctgttaggcatcattgtccctgtgatcaatggctagatctggccatcatcgtcagcctcccagtagcctgggtgaggctccctgggttgtgagtgaagactggttatcctggtctttcccatgctcattccacattttaatgcagtatcaccagcttgagagtgccatgtgatctgacagctttgaataattgatgcccctcatactaaaggagagtttaggttttgtggttcagcaggatgctttactcttgttgaccttaaccttcagaggcactcgggcattaccaagagatcaataaaacttaccctggctggtctgtgaggacaggagcctgacagagagtgatgatcaagaggagaggatgggaggattacgctggaacctggggaagaaaagggaggatgtgtggggtagagtggggaaaggggtggaaatagaataggggagcatcgcagaatgagggagacaggagctccgaaaacgatgaagtgcatgacaaagcaatggaaaacaagggttgaacagaggagaaagagtatcaggaggaacatatacagaagccaagaggatgaatgagggacgcacaggccaggaaaggagctctgatctgtaaccctcctccagtctgtggttgcaaagctgtacagtggagggaggtcaccagggactcaacgtctcctggaaagcagacaaggaaataacttatagagtgaggcagaataaaataagggttgtaagaaaggaatgcagtcactgctgggcattggaggcacataaaagggactttaatgcttgaatgccaactacatgctaaaagggcatcggcacattattttaattaattattattaattgtattattaaatattgtaattattacataatatttagactaattgtcaaatgaaagtctcaggtaggaattattgtcctcatgctaatgatgaagaatagaagcttaacgaggttgagtgctttgagtaagctcgctgatcagtggtggagctggaggaggcttgtgactctgaagcatctttcaactcttgtcactgtctcaggctgccgcccagaaaggcaaacattggagtgatttattcttacaaaggcactggagaaaacttcagtggactatcagctaattgaaggtgaggactgtgtctgagttttcaaatctgccatggctagcatagtaaacactgcataagaatactaaatagtacatggaaaaaggaagggttggagcttgggtaggtaggtagagagcaaaggagggagggagggaagggggaaggaaaggagggagggagggagggaagggggaaggaaaggaaacatgagagggaagggaggaatggtatttgtgctgaatccagaaaaacaaattgcatttttctgggggtgatggtaggatgaagaacactcgagggtgagttaatagcataatcaatatagagtttgcatttgtgtgataaaaaaatgacaaaaattcactctagccagagtctagttggaagaaaatagtgggagatgagtttgctgaaacagaatggatcctgattcattcattcattcaacaaatatttaccgaggcagaataaactaagagttgcagtaaaggcacagctatgaataggcactgctaaaggagcctaggatacatcagtgaacaaaaccaacaaatacactttccctcacagagcttacattctagtgaaaagagacagacaataaacataatacatgaataaagtctacagtatgcaaaaggtgacacatgctattgggtaggggaaaaaagcagaatagttgaacaagagatacagggacaagtccaaatagtatatttaggttaaccattatggaggcgatgtttagcaatatcttgaaagaggtgaaggaatgattaacgcattttcctaggaaataaattccaggcagaagggacaggctatgtaaaaacctgaagacagaagtggacctggagtgtccatgggcaggggtggctgggatgcagagtgtggtgtcaggtaagtagttggagaggtgacagcagtctcgatcaggtcaggtctcagggaccctctcaccatgacagaaacaggacccagtggatggctttgagcagggtaggggtagaatggaatgtgttctaaaatgggacgctggcctctgtgtgaggacagacatggtggcaagtggtcagataggaagctgctgctgttgtcactcacagatggtggtgaggaaggtgcccagggtcagattgtgaatacctttagaaggaagagccagtaagacttgctgatgggttacatgtgggatgtgagggaaagagaggtgtcaagagcaattccagggcttctggccaagttgccactatctaagatgggctatgatgtgggcaaagcaagtttgctggaaaagatcaggagttatgttgtccacattaagatgaaatgagtgttagacataaaagcggacatgccaagtggacaggtgaatataaaagaggctggcacggaagagtgatgtcttgtaggagatttacactggagtggggtcatcagcacacacatggtatttaagactgtgagatagaagagatcatcagatggagaatagaagaggtccaggcatcgtgggtggtctcaaatgccatacccacagttcgaaactttaatttatgatcagtggggggcaactgatatatacttttggaggataggcatatcacggtctcagctgggcttgtttcattgatgcttttttttgtttgcctgttttgtgcagagaccacgctgaggtcatgtgtaggttggccctgggaaggccaaacaggaggctggtgcaccgagccacatgaaggtgggatgaggaccaagccaggaccattttaatgggccagggaggagcaaggagcaggcagagataaagggaagaagggaaaagacaaccaacttccctttcactcagttcaaaacagcaatcaccagatcaatagagaagaaaacataatttaagcctgaaacgaaggtttttgtgttttcttctctctcttttttgctgcttgaggcatggcaatgcttgataatgctttgcttcctgggggcatagctgacaacagtggggaaggaaatagagacaaggttttcagtattttagaaatctggtttctatctgaactgtggagggtgaggagcctgcttttctcattaactggtcagcatgttcagaatctgagagggaatttttgagacaaacagatctgaatgccttcagatagaaagatggaaatgtttctcctccccaaagtcccttgaccttttaaataattgccattataccaaccgtatataggaatcggctagaaataacataaataaatgcgaaaccatgtgcctacacgtgctagctagtgttttaccaacaagaatgggtacaatttaaaatcacctttatacaattatcacaatgcactctcacaatgatcttgtaaagtgaataaggatctcctcccctacatattttactgggaaataaaaaacaaaaaactaagacgtaagcaggctgtgacttgctcatgtcagagagaaacagaaccaagaatcaaaccaatttgtgagcggaggtctgcttctccacggtgtttgctctctggagacagagggaccatgccactgaatacactggaccctggtatccagtgcatcctcaggcccataatttgccattgaacagttcatgatcctctaaacttggcgtcctccccagcacctgtttcttaaacatattaaggttaaagagtggcaggtggcggcccttcttccaatcgtacccagcaaaagtaggctcaggggctcacatctggagatacaaagggatgcccatttctgtgtctcttgcctgatcttgaaattacccatcttgcctgatcagcgtttctgtcttcctgactccatgtgctttccttctgagtctttctggactgccctcatgtgctgtagtaaaagtgtagcagcgtttcaagctatggggttattgctgggatattttatatctaacaggcatgggggtgataattcctttttcacttttataattcacacatatcctcccccgaaatgcatttcgtatagagcttttaggcaactgaacacaaagagccttccacccccttaattctcctgatccttatttcaactattttcccactggctttttctcttactgcactttgggccaactgaaagccagtggtgtttaagaactcccttatggattatttgtcagtaggcaaggggatgctacctctatacctgaaacttccataatcaagcacagtttattacagagcaaatacaggacagtagcagggcttttaaaaatcaattagtgtgcaattcaagattaaaaacagaagagggctaattctatttttcatttggatggtaggctgcttaaggaataatagtacaaagactgaagtcattacaggaataatcagaagtttacccaggtgtctttctgagcccctttcctcctcaaggctcagtagcttactttcctgggttcatgtgtcctgcagttcctcttgagtgagcaccaagaaatactagcctctgtgaatgacaggtgggggcttcatgagagctggaggtgatcgaagacaggtcacattctcctaaaacctctgatggtgttttctcttcctatgctagaatctactccattcttttagctgtactctgtatgaatcatatgtacttgttcatgtttttctgcaattactcaaaactgtgtcttcttgacatatgctgtttgtccatcagctccagagagcaggctcctttaatctgttggctttggagactgagcaaggggaggcagggtgagtcctccatgcctttcactatggattagccacataatagatgttggggtttcatagtttggggttttgtggcatatgatgtgaatagaagcactttagactctcggcagatctatctctttgaagttctcttattatgtctaattttgagtactgcacagaatagctataaattttgacaatgataacctgctctctaaccccaggcaacctgctcctcttcccttttcaatgttttcattttagtataaagaaagagcgatgataaatttttttatttttattttttgagacagggtcttgctctgtcaccgaggctggagtgcagtggcaccatcgtggctcactacagccttgacgtcctgactcaagagatcctcccacctcaggctgcagagtagcagggaccacaagtgcgcagcaccatgcctggctactttctttttatggacatgacgtctcactgtgttgccatgctggtctcgaactcctgggcccaagtaattctcctaccttgacctcagaatgtgctgagattacagatttgagccactgcacccagctaataattcttatataaaggcaatgaaagcaatgcaattagaaacttcacctgcaccctgtcacaaccaaatcataattgtcctcatgcatccaggtcaagaataatggtgttaaaagccagttatcatggctccaatttttctatgttgacctgaactcagcttgtgctagtcttgggatttgattgtatgttttctgtttggcttccatgttctacctgccagtgggcttggggacctcttgccactctgcaccaggtaaactggaactccacatggaccttccgatttggtactgagctgtcattcatttgtcaggcctaatgttgctaatcctcttctggaaactttatccttcccgaattgggccacctgattcctagctgaatgttcacatctgctccccattccttcctaggacctgcagacagaggcagcaggtacagttaaactgtggtcctagcctctgggattcagcaacacttccgcctcgctgcttatctgaccatttttattcccaggcttatgccagttatgatatacattccaatcttatacctgggctctcccctcattcttcattcctgatcccactcattattcttcattatttttaccacagatgcagggtggctgagggttgagttaatcacattcctcagttcatagcacatcatcatccctgacaaggggatcattgatccccaaaagtgttatcttatttttcccctcatctctgattctatgccttgtccctttctgctacagcttcccacaccaaagcgtttcataaatttcattaaatgtgcatgtgtctttataaaatgtgatggtgcattgtatgcatatgtcactgatttatccatttatttgatttatcagggctgtctttccaattcccctctaacccaaacaagcctatgacaaacaaccctttacaaaccaatgagaaatttccctagtttcatagccagcggtgattttgctgggtcatgggactccacaggcttaattgtctaaatagctgccatattgcttttcaatatggatttacaagtgtacactcgccagtagagtgcaagagtgcccatctgcatgcatctccaacaaaacttagttttctctaatctctgattcccatttttaaaaccatgttcacgggtgtaaaatgacacctcactgttattttcatttgcatttctctggtcactggtgtgagctctttaatttgtgtgctttctcggctttttcttatgtgtattaccgattctttggcctattttttgattgaaccacctatctttttcttgtagattttcaggaaaaaatgcttggtatattcaagatgttaattacttctcagttgcagatattgaagatatgtgtcagtagatattgaagatatgtatcattttgctttgtcgtctcttaccatttgtcagtggggctcttcatttgcggtatagtgattaagagcatatatgctggaaccaacctgcctgggtccaaatcttaactctgcctctgagctatgtgacctcagtgatggtccttaatcttctatctatatgtaaaactgatatattaaaatgaccatctcagcttgagcaacattctgagaccccacctctacaaaaaaaagaaaaaaaaaaattagctgggcgcagtggctcacgcctgtaatcccagtactttgaaggccgaggcaggtggatcacaaggtcaggagatcaagaccatcctcgctaacatggtgaaaccccgtctctactaaaaatacaaaaaaaattagccgagtgtggtggtgggcgcctgtagtcccagcttgggaggctgaggcaggagaatggcctgaaccctggatgcggagcttgcagtgggctgagattgcgccactgcactccagcctgggcgacagagtgagactccgtctcaaaaaaaaaaaaaaaaaaaaattagccaggtgtggtggcacacaactgtagtcctagctacttgggaggctgaggcaagaggatcccttgagcctaggagtttgaggttgcaatgagctgtgattgcaccactgcacttcagcctgggcaacagagtaagactctgactcaaataaatacataaatacatacatacatacataaaaataaagttaccttcttcatagggatttactaaaactgaatgagttaaattgtgtaaataacttacaatagtgtctggccaaacacatacatacacatacatgtatatatataaattatatatgtattttcaaagaaaacaaataataatttcttttttagctttataattttgccttttccatttaggtaattaagatgaagtctatcttacataataaaaaataatcttaatgtaacaaaaggtagggctatagctttgtttcctcccacgttgtgagccagttttccagtatcatctactaaactgtctgtcattcccattgctttgagggactactgttttcatatgttgggttcctgtatttacatgcttctttttctgtgtttctgctttggcctccacattgcttttctgttcatctgtgctgatggaacccccgcataatgtggctctcttggtttccataaggctctcaataaccaccctggaacagaggcagtgtcagggtattaacataaacatgtttttaaagataaaaaagagtgccacttacaatctcatgtataattttaaatgaaagaaagcctgtgattttgggccactgttgagtgaattgtgtgtcagcattctcattttgaacgtgtctcattcagcgatgtctaaatcactttgtgccatcttactaagtagaaacaattcaacaataaccaggcagataaacaaataatcaagcagaccaacaaaaacaaaataaacaacatgtacttaacagtttacttaagtaaagaaaagattcgttctttaggatctgtgaagaactctaaatgtattagaatgactccactttccctaaagagtgttctcccaatcagggctgcctttttcctctgttcccatctatagtcatgtcaccagggatgactgcgcacaagtgaagtggaaaaaacacagtcagatgtcatatcacctctaatcctttttgtgcatccagttcttccaataggatacagagggggaagttgagcacaagattctgcagcggtaactcaggacttttgggaatttcaaagcctagaattctaaatgtgaggcctctcacttagctcttactttacagcatgtggaatagttcagcccctcaccatccaaggcaagactggtgaacctttattagtgcttctcatgtgaagcatccatgcttgttcctccactccacagtgaatccctaagggcaggaggggagtgctttgttcttctcatcttgtttttagaagactaactggcacaggccaggcgctgtggctcatgccgataatcccagcaccttgggccacagtgggcagatcacctgaggtcaggagttcgagaccagcttggccaacatggggaaaccccgtctctactaaaaatacaaaaattagccagatgtggtggtgagcgcccgtaatcccagctgctcgggaggccaaggcaggagaatcgcttgaacccgggaggcagaggttgcagtgagccgagattgcaccactgcactctaccctgggcgacagagtgagactcagtctgagaaaaacaacaacgaaaaaagaagagtaactggcacagcataggcattcaatatgcacaacatgggcttggactgtgtggttcactcatatgcagattttcttctgcctgtgccacccctgaggctggaagaccaactcctcagcctactccagctggagatggtgaggacgaagacctttcagatgattcacttccacttcatgagtagtacatatattttttctttcttgttattttcttaataacattttcttttctctagcttactttattttaataatacagtatgtaatacatgtaacatacaaaatatgtgttaattgactgtgttatcagtaaggcatctgttcaacagcaggctgttagtcattaattttgtggggtgtcaaaagttatatccagattttcaactatatgggggcttggaaccctaactcctgagttgttcaaggaacatctgtgttcaaatgaatgaatgaatgaatgaattgtgttaaaattgtgtctgtgataacttattccttacccaaaatgcatttaggctagctttttttaagataggagtccttttgcattttccttagcacctcagaatatttgtcctatagacaatttgaacagtgatgagcatttgcatatttataatctacatgtgaacttatacctctttgctctcatgttaatgagttcaacacatagtgagttagcatcttctgtgagcatagcataacgtctgagaggtgcacaaaagatacgtgtaatgtgaaaagagattagaagatgtaagcatgggctcttggatctgactgcctgggttcaaattttgaccctggcatttataaaaaacatgaccttgggtaagtcactaaaatgctctttgccttagtcttttcacttgaaaaatatttttttttctcatagagttattgtgaaaatttagtgagataacatatgtgcaaggcttggcacatacttagcactgcataattattaggtcctagtgtttttacagtctgacctacaaaactttcaaatttagagggggaaataagacagagactggaatagtctaaacttttgaaaaggctaaaacatatcacaaatgtcctaaattatgcctatatcgtgtccttctgcgagcctccactccatttattaatagtttgcaaaaaccttcagtagatctccctgcattgacaagtgagttttcttttcttagtggagttcttcagacaatgcaatctgacctatcttgtgccttaaaaaatattcaggtacagtaatataactgcctagtttccttgtttttctttcttcttattttttgccttttcaggtaacaagtgggaccaaaataagaatcttgccttctttttttttgagacagagtcttgctctgtcaccagtctggagtgcagttgagcaatctcagctcacttcaacctctgcctcccgggttcaagcaattcttctgcctcagcctcccaagtaacaggactacaggtgcacgccaccatgcccagctaatttttgtatttttagtagagatagggtttcaccatgttggccaggctggtctctatctcttcacctcatgatccacctgccttggcctcccaaagtgctgggattacaggcgtgagccactgcgcctggccgaatcttgccttcaatggaaagcctagtcttctagatttataagccttaaaatgttaggggaggggggaaaaaaaacctccaaacaaaaccccaataaaagcttaaataagggcctacgtgaatgaatttgtcatcagatgtgtttgggttgcttgccaccctatttaacggtgtgtttgttttgtgccttttctgcctgagttggtgtaaatgtcttttctccacggtttccttcctgtgatgacatagatgggttggattcgagagtcctcagcttaccgctcttccacttgaaaggaagagggtcatgagaggagaggatttctggagtggaatttcaatctctggtcatcaggaaagggaaaacattctgcccaggatttcctgtcatttattctggagagctttgtgttgtgctctgtgcaggatccgagatatgattaactcaactctggagtctgttggcagaaccaagcagctctggcatcagaagagagatgtccttaggcctaacctgccctccctggggtcttgttacctgctcaaaaagaacccagtggcctttgaatgcattttaaatctgtgattggtgcagtttgatggtccttccttccctccttccctccctccctccctcattccttccttccttccttccttccttccttccttccttcctttcttccttccttcctttcttcctttcttcttcagtttaactcagctttcaataagcttaatgggatgaagtccaagcgatgaaaagagaggtgataagagcacaaaggggaagcttatacccgagcatgggtgagtacaggagatgggttgttctgattattcttgctcctgttttgccttggccaccagttggccaggtcggggacagtatggtttatggactgctgtcacttgactcttccttctcagttgccttttaccttggatgaattttcaacgttctcttcccactttcaatcataaggagttgttgaatagattcatgttttctttcattcttccttccttttgtcttttttaactataggagatgggcacactgttcaacacacagataatttagaagaatgtttcagtgtcagttcttcctctccaccctctttcaccccagttcagtcataactgaaatcacaaatgaatggatccaattaatagtaaaaataaaatgtccaggatgctctctggagttctgagatccataggtcacggacagactcaagaatacaaagtcttcttcaggcctctgtttctaatttgcagaagaaaacaagagggtgagtagtattttgctttgaaaagcatctcagcgaaagtgctacatgataacacagccctcatttccataattctgctccctccggagcacaggtacatttaatttctcacaactgttccctaaatgaagagcagcatgaggaatacacagagaatgaaaaatatcggtgtgtgtgggtagtacatgaccactaatctttcctgacatttactttcactcatgagcacaggggtgaccagccccaccagtcctagatgctgaagataaatgtcagcaccatccattggaagctttctatgcatacatgcatattggaaatcaaatatatttggcttatcacacactgaggaacccatcccttcagaaatgcatggattgatctctgctaccccactcaccagtgccatttggtaaagttggggaatggtaagatagttcgctgcatttttaatggaaggaaaacaaaaagcgactacgcgtaacagtttttacattatatgccttcagtgctgtgtgctgtcaccccacgtgttgtactgccaaatttcccaagagcgtctgctcttcctattgtgaaaacaatgagctggtgtatgtcatgcaaggctattctgcccatgccaaatagctctgtatgttttaactgtcttcacactgggctccaccaatcactcaggcgcatacctcttcctcagccctaggcaatagaagttacagcattcatgagcaattgctttcctcacataaaggaaaaaaaggattttggtcttaaggtcttgccagctcattgactaatttactcctaatcctgaatgtataaagccacttgaacatttcatttgtgtgacatggttaaaggcttacgtaaatatagctggtaagggctaggattgtagattaaagtcagaaagaggtgattttgttctttttgactagatactgtaaattctgatgtccaattaagatctgaaggagaaacctttgtaacccaatgcaatgtgagtttctcgaagaaaaggaaaaaaaagggaaacaagtctccattctcagggacccattaacagctcagtacaatgactctttatgtggcctttgatatgcaaaaacagcccaaaataatttatggagaaaatcaattatgagctgaagagaaaaagaaagttgcccagattaattaccaagtcaggaaggatggcagtgcaagcacctggagttatgtccaagggggacgcccttctgcaaaaattcttcatggtcagaagaaggctctgtggtcaggagagaagggagccacatgaagtcagatgagctgagctgtaccttctggaatgctgagaatgagagcgcatatcatctattcagtgagataaaaaggctgcttcaaaactaaaggtatatttcataccctcgagtgtgaagtgcaaattgacaatggatggaacaatagcattggctagaaagcctggaataaaaccatcacaaattgaatttagagaacttatgaaagctaattttatgcatgttttattttattacatatttttctttaaaacagtaatagactcagggatgttggcaatggaggggattttagaacacctagtctggtggatttcaaattattcgggtcagagcacctattcttttgaacaaatcttactcattattaagaaattaaagcaaacaaagtcagaagaaaaaaaacagtagacctgctctggctaaggggctgatgaggttggagtctcttccctatttcctatgactgttcccgaggctcctgcagcagtaacctaaggctctagagtctcttccctattgcctatgactgttcccgaggctcccgcagcagtaacctaaggctctatggaacactatcagaactcagtgattcctaatattagttcccacactagaaccatgcatcctctaccaaaatacgtttccttagtttaataagtttgttaaatattgcttgcacaacccagagtttggagaattacattagcacattgaaggctgtgagagtaaaacttcagatttgaaatgcattaacctatgtttaacctggtttttcacctgcatacttgaatgtacctgaccgggaaacccttttatcagaaacacgtattaacattctgtggcagataagtcccctaggatgcagtttagaaaacaaaactcttgtctgggttccagtctaactcccttgttttttaagtgagggtacagagcctccgagagcatgtaaatcgctcgctcttgggtacatacttggaagcaaagttaggaaccagacataggattcttgaatccatgaagctaaggggattttcaaacatattttctttaatatttccacatgtctgtgggcagggagcagtcatgttctattcttttgatgctatacactgaaacacagaaagtcaaggttacccagtcaaactctagtataatccttccttcagtgccctggtcggcttgcttggtgctaaaagaaaaaaatcaatccatctccctgctgagtggaagaggataaagctgtccaatttttagatcttagatatttaaactaaagaagtgtgtgatagcattattaacaattggcgtagtaatttcttgaggtttagataaactagtttacattcgcaacatttagtgatgatttaagatgctttgctatgttggcattcaaaaattgggcaaacctctggccaaagtgaagtacagcccatgtgagctatggaaatgcaattaaaaggagtcacagagccttctcaactgcctgggcttaattaagatatgatctgccagtctcttagtggccattaattcattgtctggtaatccaataaggggttattgtttgaagctgtttgagagccacttgcctcactattaactcaaaattgcccaaaaggcggtactacaatgtcattctccctgccccaaagaggacatgacattgaaagacatttgacatccacatttgacaacacttgaaatggcaacattatggcttaagcattcacaagtctatggatatgataatggaactagtgacatctaattactaactggcaattaatgataatagccctttgtgaatatgtagggccattctctatagggagctccttgctctttgcacatattaattaatatagataggcaggtaggtgatagaaaggtggctttataacattattgctgctgagtaaactgagtcaggttccaactgcaccttgtagatgcacaacgattccttgctgttttgaaactaaatggattacaattttaagagtaattaaagaggaatgagaactgtagggaagtgaagggaatggatgtcaaaggaaaattcaaggtatcactaactatttgaattcttgatttacttccacccatgtttctggaataggaattggtcatttttcccggattggtagccagatatgaaacattaagtcggctttcagcaaaatgatgtctggtatattcagaataaggccgatttattttctccccacagagccccattgatgctgaatttttattgcccaatagaattcaacctggttgtgattatcccattggtcctgctagataaaacccatgtgtatttgccaaacacccacttggaaatggaaaatttaattaaagacaggaaactgaatttaatgatctctactgatctcttaaattccccaaattatttcattatggcttacttattgaattttcttaaggaattctaaaataaatgaacaattacctgaattttgcagtgttgtacatagaaatagagtgagttttcaccacactttcaaaaacaagtgagagtctaccccactaattcatatattctttcattcataagcatttattgagcacatacagtgtgccaatgctgtgctgagctctgggtgtactgatagaaaaagctttgatgtggcccttaagatgctcagtgtggtgatagaaaggaagttaaacaaataagtacaatccggagtgaccaattctacaacagaaagatgagcaagttatggggagtaatgagggcaaagaggaatgagagttaactttgtgagtagcccctgcctggctgtgcgataggggttcaaatccgactctatgtttatgggaagtactttgttccatctgcctatccacctgtcattacttcaagttgatttaatagttctgcagttgggacctgtggggtgtgtgtatgtgtgtttataataagtttaaatgaggtaatccttttataacctcactactccctattgggatttgtttgttttgatggaagggagggagatgagatttggcacatagcaggtatccagcaaatgcaactgcagcctgaagagtcaacgtggacaaatcccaaacaatgtgagccctttgggaatgctccgctttgtgtttcctctgaattgcatgaggctaccagatgaggacaggaggagaaagaattaaagtgtcctgacaccgtgttccaggttgtgtagcttttaagtgggcacccatttttccacctaagagctccaatgtgcctctgtttgaccacatggctttccggttagctgtgtgacagctggatgtcccagcatttctttctctccctttccaatcacgagctggagcagtcttgatgaatctctgcaggcacgtcgtcctcaactgagggatgattcattggcatgaagctgttaagtgattaaaataaagcacttttatggaaacgttctgcttactctgtgttcccagacacctctgtagtgtgtctgtggcaagagaggactgtaggggacacacatcgtcttatcattttctctcttgttacaatatccaatatttctgtgctagggcagaatttgaaaattgtagttcaattcagataaccttgcatgtgctcttgggcccttgaaaggagagaaaacaggcctggtgcggtggcttatgcctgtaatcccagcacattgggaggctgaggcaggtggagcacctgaggtcaggagttcaagaccagcgtggtcaacatggcgaaaccccatctctactaaaaaatacaaacattagctgggcgtggtgtcaggtgcctgtaatcccagctacttgggacgctgaggcaggataattgcttgaacctgggaggcggaagttgcagtgagccaagattgcaccactgcactccagcctgggtgacagagcgggactccatctcaaaaataaaaaagaaaaggagagaaaacaagcaaacaaaaaaacccacagaaaacaacacaacaaaaaacactaaaaggaaaaaaaaagaaaccgtgcagtttgaaattatctcctaggttgcccatctgcccaaggggaaaagtctatgagaaacatactggggtggagggaggggggacttggaggcagcaacacactgttctcatgggaagggaggctcctttttgtttgttttgtgcacaggaacttgccctgattggagtagagtttgcaaccctccccagtgtggggtttctttgttacgaagatcaagagaaggcatagggaatgcaagaatgtaaagagaaagaaggggcaagaacaaggatgaaaggagctggagaagggaaagggacagcgatggcaggaatggagagacacgagaggtgggatgaggaaacaaggagggtcatggaacagacacagctgctcctgaaagttcaggagcagctgggagaggggcttctggcttcttccagccagggtgctcccctatggaaagcagagtttctgggtctgtcccgtgtatgtgccctttaaagcaagtgtcactggagacacataaaatgaaagggggggcagggtggaataaagggaaaaattattgtaattcttaaacagacaactttaaaaagcagtgatttaggttgttttattcattacacgtcataaaggactcaggctgtggtgcccactggctttaaaatctaggaccctattaaaacctttccttgttagtaactcagagctttggaaatttgataagaaaaaaagccaatttaatcaaggcaagatttaacacaaagaaaggacctggtcttgcctttctgcagaaaaactttcaggatcaaatggcttatgattttcatttacctaaagaatcccagtggaatcagcagttggggagaggaggggtcatttcattagcttgcagggcatgcccagattcagtttcttcacacactactggctgcttccttagctactcaaaggaaaatgatttttttttttttttagtcatactacatggaagaacacccattgtctaaagaagaggcaaaagcaaatctgcctaatatctgaaagtaggaaaagattggttggtttatcttgacctcagtagatcccattttcaataacctgtattgtaccttcaatcctcaaatgataatgtggcatttgtggcatcacaaaaagagatgctggagttggggagacacagggttgagtccaacctctctaaattgtgtaaattattaaaaataaaaacataacaaacctcatttttcacctctctaaaatggagagtataaaattgtatctttttttttttttttttttgagatggagtctcgctctgtctcctaggccagagtgcagtggtgtgatcttggctcactgcaacctctgcctcccgggttcaagcgattctcctacatcagcctcccaagtagctgggattccaggcatctgctaccacacccagctaatttttttatttttattagagatggggtttcaccacgttggctgggctagtcttgaactcctgacctcaggtaatctgcctgcctcggcctcccaaagtgctggtattacaggcatgagccaccacgactggctataatattgtatcttctattatataaataaaattctctgagttgactcaatataaatttatgacttgctcactcaacaatctacaatgaatgtttctgattgttgttgaggagagaggctctgctccatgtagtcactcagggatccaggctaaccaaggctctgccatcttgaacacatgacgtccaaagttccctgagcattagcttccagccaaaggaagaggacagaatatagaagaatacataagggagattgttaaatgtcatatggtatatatcactttttcacattcttttggctagaatgaaattacttgatctacctgcctgtagagccaaagaaaaggaatgtaacctaattaatgccaagaaaaaatagacacagattttggtgtacaggtagcaatcatagctacagtaggcatttaagtaaatatccatttgtacccttcttcacatactcagaatacacagccccaaggtagactactcaaaatccaattcaattactgcattcagctcaaagtccgagttcacctggtggtatttactcctttttcttcatgatcagccatggctgtttatggatcactgacgtataactgaaaagattgccaccccttattccaaagtccttttaaatggggtagcaagatgggattatcacagtaaaacaccttatttggaaaatggaagcattgaagatacacagcagttactggttcatgggtgatatttttgccccggcagtggagaagcttcttatctatactctgattctgttctccaggaggagatttcttacctattgttagtggtggctccctggcgtcacacactggatagttcttctttgttcagcatcctccatggccacatctgaagtggtcattgtggagtacgccctacttgggggctgaatgaattatctagcccatttgctgtgagtgcatgttggggtgtttggcagttggtttacagttccaggctcttttaaaggaaaatcatagtttttcagctacacaaaaactgtcaaaagtatcataagcttcttccctatttattttcaggcagatccatttgccacatgaaaaaaaataaaaaatataaatagatataactcatagacctacattattgctttctttttgtgttactgtgccctttttcttctcttaatgtggatacattgggatactctgaaagaaagggcgtggaaaggaaggtaaaaaccttgatttgataattgccacgaaggtgaggcctttcgtcaaatcgttaagtaatattgagcctttgctgcttagaaccattttttttaatcttcttcctgacatttgagatccagactgagttggtgttctcaaacatttctgaaatcagtctctcattccctcccccttcatttgcttgaaaataggagcatctcttctgagctcatctcttgtgatcatcggtgtaaacaaagaggagtaatcaatcccagaaacgctttggctctttctatccatttcttctagagccgcaggttcagtaggcacttggtttgtcatagaagttatcacaagggacagttttaccaaacattttgctatttcacaacaagggtctacagacttctatctcattctgttttcttgacacccattgcccaagtgcaatctgtgaacacatttttgatttaatcatgccagaatcctactcttggtaccactttcaaaattaactaggggcacattagttgttataacaaataaacctgcaagtctctgtggagtaacaacagctctccatcctttgcccatgcaacagtgcaacaccgtgctactggcaaccacgggtgtcaggcttggcctcaggcggcatccgggaatggtgcatcaggaggggttgcctaccctcagtttgtgacttccaagatcaccacgagtcttgacatcttcctggggtaaggggagagcacgcggcgtcataggaaaaagttacgaagggcccgggattaggcagttgtgcatgttactcctacgctcattccactgggtagaattcagtcacagtgtcacgtaattgtaagaggtgggaaaatggcatcgagtagggtgcccaagaagaagagaaaacaagttttggtgagcagcaaccaatctctcttacaatatccaccacatataactgttgtgaggactgaattaggcctgtaaagagtctgtcatcaggacacagcacatagtgagtgttccacgagtgtttgctctgttcacctccctccgccctctaggcagccccgaagtacccaataagcacttaataaacacagaataaatgaatcagtattcatagttatttcccctctgaattggagagctttgaaatctgaccctgttttggattgaactatgctggatctctttggatctgatttttctttgaattagaaacatctcttaggaaacctagactatctttcaaagaaccccatctggcctattggaaacagtttcaaagttgaaacatcaaccatgacaggtcctttggccgctaaagatgcagcccctagggatatgtctctgctggctgttcacatgaaatagcatagcagagattggatgagagtcatctgctgttctggattttgcatcctctttaaacacatctgcctttaaacatcctttgcacaaaagcttaattttcccttccctaggttttaaatcactttgcagactacagaaaaagattacagaaggcctgtttttgttccattccttttctatacttgactatcacgtttgcttcttctacctgacattcattttattgtttcagttaattaaacatgtatcatgtcatgaaatatgtgggtcacatttatacacaactcaccagagttaaacttgctgtaaccatcctatctaaaattgcagccccttctgtccagaactttctatcttatactcctattttaacattttccttaacactttagctgctggcatgtgacttatttatttggtttgtatttgccttccttattaggaatataacctccatgagggccagagatttttacagttttcatttagggctctattgccactgcctagaagagtgcctgactataaagggggttcaataagtattcattgaatgaaaaaaatgatccttattccttagtcttaaataacttaattcttatgggggaaatctgacacattccaacataattataattccaacacaactccaacataattattaggcaaagaagattatattggttaatttatgatgtgtcagtgttaaccaagagatgaaaggggaaagaagggagaaatggttgttgttgaggatcttttattccaagcaaattttgcttacattatttcatttattttaaccagtgtggtagttctaaaaacaggtggtaaatgtcccatattactaatgaggaaactgatgcactaaaaggcagttatttgtctaaagttgtataactagcaagtggtggaaacagtattcatcaggtctgtctggctttagtacctgtgccaattatttgcaaagttgttcatactaatccttagaaataagcatattttaactggaacacactccagacaagtacacacatgcacactcccacacagactggaattatttaagatttagctatttgcaaaacatgttattctgtcctattcctcctattctattctattctattctattctattctattctattctattctattctattttcattccagcccatcccatcacttttatctttcaaaatttgacccattaagctgtttctgcagtaaacaaatgtattgcaatacagacttcgaagatctttgcttttaggcacattacctggtgaggaaaagaactgaagatttagaccacaaagtgaggactagagaatactttattgtggagacagtatttgaggtaggccttgcaaaatggattgagtataaagaaaatcttaataaaactttcatcatttcaagcaatattacttcacttaggcttctatcaaataatccaaatgctctgtattttatgatgaggctgaaaaaaagtccaaacactcaaatgtgtggctttcttcatttgaacagtcagccactcagtcaaagattagcaatcatttgcttaggaagtaaatattgagcatgtgctatatgccagccagtgggctaaatgctggaaacgcagagatgactcatgcacactgtctacctgtaaggaacatatgtttgttgccttagtccaatctggttgctgtaacaaaataccaggctgggtggctgataaacaacaaacatttattcctcacagtctggaggctgggaagtccaatatcaaggcaccatccgatttggtgtctgttgagagtccatttcctcagatggtgccttcttgctgtgtcctcacatagtggaaggggcaagcaagcttgctaggagctcttttataaggacactaattccacttatgggggttccacactcattacttaataattccccaaaagccctgcttccagataccagtaccttggtcattaagtttcaacatagaacttttgggagacaaaaaccattcagactgtagcattgaaggttattgtctgattaaatattaacctttccctgagttgatttgttaaggaacatttgcacaacggatatccaactccattccactgtcagaggaattggtggtctgatctggcatcctggggacactgcattgctctctctcctttcttccatcatgatataggatttgtaagttacaatggagctatcctttgtggcctggtgacatagtgactggcagtggtggatattccatgtgaatgatggctgtagacgtggtgaggtaggttgatgggttttgtcatcacttcttttacctgagatcaggttttttctccaagctgggaaaatgaacattgccacatccatttaaatcagagattcgctagagaaattgatatgtgtggttccataggcagtgccttcattttgacagttttctgggtctgatgaattgatggccagcagaggcagttaggtaggcagctgagcttacacaaaaagacctctgtctagaaggcttctaacaagagcctccattaaataggctttatgtgatgaaaacgtagtaccaaaaacactgttatatttctttattttaagcctatagtagtgagctcatattattttggaatggaaaaacagagaaagtaaaatatataaaaactgaataaaatagatatatcatcttcctgattctttgaatccagctatagtgggtccataaccttctgcaccagtttttgtttgttttattttgatttgttttaattgatacaatagaatttattggtactatgtttgatcactgagatacatcgttaaatatgctactgctgattcctttttaaaatacactggactgaaagtcctttgaggatagttctttgttattatgtctcatgttatcccctgcatgatgtcttccaaaaagtagctgctcaaaaacatactaattaacaaattagtatcaactgatatttcaaaacagcaatttttaatttataaaacactttcatatacatttcatcatttaaaaaatcaacagtaatttatttagtggtttgttcttattggtgtgtttaatcatgtttgacttactcattgcagaattaaattacgatgtgatattgcggtaatagttatacatggcataaaagaaacgaactcataggaattattcacttaactcgcgggatcagaaaaatgccaatgtactaaatgttagcctaataactatgggcttttggtatgttgtttagaggaaatgacatcagttaatctggcaggatatcgaagtgaaaagtagttaaggggttctaatgtgtatcagtcagattggctaaattatactgcaataacaaatgctcccaatatttcagtagcttacaacaaaggtgagttatatacacatgcatatttagatacatgcacacacacacacacacacacacacatgaacacatacacatacacttacttactggaccaaagcatataggaataggttctatttaggtcatgcagtcttgcttcagagggaaaagaatggtacaaccatgtgaatgctcttaaagcttttgttttgtagtaatacgtgagatttctattcctttttcattggctcaagcaaatcaaatggccaaaactgatgtcagtggggatagtaatgtaattctttcatgcaagaagttgtaaatatttggaacaataaagacatccatctattactgttattatatgtagctggaattttgagactggggtagaggaatcagtcttattgattttgatccccaaaagcaacctgtacatttggcagaataaattttattcactacattttatggagaagaaaacctaaggctggaattatttttaaacgttttcaactctcatagctgataaatggaaaattctagatttgaactgaaatctaaatctgactttcttcctaacctcaatcgaaatccagtactcttcataatgtggccatgctgcatatgtaagtgtgtggatgatgccagtaactaaaatgaaaaatgaaaatgttcagtagaggatgctagagaatttgtttttaaattttcgcttaaatatttcatattcttttaggtgaccaatattgaacgttcaaggtagttctcactgtacatgggtataatcatgattttcagcattaagattctcattttagcatttgtgtgggtctgtgtgtgtttgcatgtgtgtgtgtgtgtctataatgtgtgtgtgtctataaatccaggttccttcagtcttacacaaaaccttaacaaaatgttcctatagatcctgctagaactgctgactttcaaatcaggaattagttctgattctgttgatgtaaacctgaagagagaagaaaaacataattcaccttcctgcattattaagatttcagatacacagtttttataaaagcttgcaagtgcaaaatttgctatcaagcctaatgtagcatggaggattttgtctgagctagcaaaggatcacattttcatctcctgtgagtcagggactgagctctataaactattttccacatatatgttctattaaaaatagtatctcattttgactcttagtctgtttttatagtgagcgggctctgaaccgagttacctgataaattactttctgtatgtgtgatatacatactgtctaacctgaacaagaacactgacttcaggtacaaggaaaaccagtactgcacaataaatgggctcaacgactcattcagttcgattaatgtttactatacattaagcactgtagtatgtaccatggagcagatgcaatgccattctaactactgaggagcttttattgaagagatgagttatctaatctttgatagatagccttgaaataggacttaaaagaggtgtttttttgttgttttttgtttgttttgttttgtttgttttttaccttctttcttgtccctgccataaccatgcatctcttgcattgcatagttgagaacagcagttccacaataagagagtcttgtttgggagtcagagattgagttactgtagtccacttttctatccttttctccctttgacatcttcttctgattaattagtaattaataggtgattgattaaatgattactttagtctttcatttaataaacattattgaggacattctatgtgtccaacactgtgccaaataatagagagccaaggacataagcatagcccatatccttcattttaagtcaaatgagagaaacagacaagacaagtgtcagtgttgatgccacatgaccaaagccatgtcaagtataaacattttatgtaaaatgtagctattttaggacacagggaaagagtgacttttccgcacttaaagggcctggtaaggatttctaaatgaagtggttcttgaaataagtcttcatggatgataaggctaattacccagataaagaaagggggaatgcattctggacatgtacctgccattgcattcacaaaggcaggcaagaaacagcaggtccaggcatgcaggacaagtagttaagcttggtggaaatatgggaaatttgggaggaggagaaaggttgatgatagtggacaggtaaagacagaagtcatattttcatgaagtgcttatagtccgtgtttattaatctgcatcattctggatgtatatatggaaacctactcaatctaacttgggaaagaaaggaaaacctgatgaaaaatacacagttgattcttgaacagtatgggttttaactgcatggatccacttatacacagattttcttccacctctgtcaccctgagacagcaagaccagttcctcctcttcctccaccccctcaaactactcgatgtgacgactatgaagatgaagagttttatgatgattaactttcacttactgaattgatagtaaatctacttttttctatgattttcttaacattttctcgtttattactttattatacaaatatgatcaataatgcaatacatataacatgcaaaatatgtactgattgactatgttactggtaaggcttctggtcaacaattggctgtaataatttagttttgggggagtcagagtcctacctggattttcaactgcatgggggtccacactcctcacccccacattgttcgaagttcagctgtagaatgagctctcggtgtatgaacataagactacaactttgcttcaaaaacaggcaccaaggacaggaatcgcatcagggacctcaattctgctgttttctcatggcttttttattctcctctttatgcagaactgcttactctacttctctaatctacatgatggaacacagaagtaagagcatctaagattaaatcttacacacacaattgcctgaaaagattgaatacttttctatgttcctcttacaaattcactttgaaaggaagtctgtttggttagcttgggtctggtgcctacacttgcactggtgtaactatggccagggtgtgagttgtgtcataagagcatttttcctgtgaccatgagactggagaggaatggttgcattggaaatacccagagaaagacactggaaattttacaaaagatacccattatataaatggtcccaaatgccaatccacagagagggtgcctcatactaacttctgggagtttgggaaacatactcagtacttctgggggtttacccactaagtattctgatttgctagatctagggcagggtctgagaacctgattataaaagttcagtaagttattctaatgcctagatagattgggaaacattgtaagaaatttagaagagaggaaaccttaacaagaaaacaaaatcctcatgggatcaatttgcgtcatagtacacccactggcaaatagtttgggagagagaggctgcaggtgaagcaacttcttgggagtgcattgcagtcatccaggaggggagaaaggtcttacctaaaggaggagccatgcaaacagagaggagggctatcgggaaggtggagtaggcagttcgttgtcatcagttgtatctgaaggacaaggaatgcatctagaacaagtcccatgtttttggcttgggtaatgaggtaattaagtgatggagggggagaaatgggacttgtagtagaggatgacaagctgggttttgacatcttgtgtttgaaatgcctacagggcctccaattgtgcaagtccaggaagcagttgtatatatagggattctgagctaaagataatgcttttgtaatcattgtttgcaaatgatagatgaagacagtgtgtgcagatttcctagggtggatataattaagaacaaagaaaataagtctatgaatttcagagacatacaaaaattaaaggggattgagaagaatggaatagagcaaccataaaggagagacaggctgagcggtggctcatgcctgtaatctcagcactttgggaggctgtggagggtggatcacctgaggttaggagtttgagaccagcctggccaagatggtagaaaccccatctctactaaaaatacaaaaaattagctgggtgcggtggtgtgtgcctgtaatcccagctactcaggaggctgaggcaggagaattgcttgaacctggaaggcagaggttgcagtgagctgagatcatgccattgtactccaatctgggccacaagattgaaactccatctccaaaaaaaaaaaaaaagaagaagaagaagaagaacaaagacataaacagcagcataatagaaatcaagggagctcgtgtctctaaaggtggagaaagacattaaagaagacagtattagccaatggtatgaaacacttgttgcaaacatgctcattggatttggctagtgacaagtcagtgattaccttgagaagaacagttgtattctttattgttatttacatacatatctgtcttccctacctaatggtaaacttcttttgcagtcaatgagtaaacattctgaggggtgggaagggagttctgaaatatgtaatttctgactcaaagagctcacaatttaatggaaagacaagtaaaaagatgataggagaaagtgagagttgctgatggaagtctaaacaatattaggggagccctcaggagggatatctaacctctcaaccaagtaagcactcaataaaagtttattagcacaaaatacatgctgggacaaaaacaagtggtatcattagaaggtgcacagaaacaggagcatctaatgtgagcgggtgtgttggtgagattttgttgagggaagcaacttcttgtctgtttttttatatgctcgtatttttcagggtttcatcataagcacactagcctcctgtggctctacacagacacctaggactatttcatcccacttcagtaattttagcttttgggccactaactccccagtttatgtttctggccttccctggacaccagatctatttctccagctgctgtttggatatttcccccatatatctcacacatacctcatattaacaaggcccaaactggactctgtatccaacttcatattctgaatttctactcctaaactcattatgcacctattcactagatacctaaaagctgtcctagattcctccccctctcttattcctcattgtttgcagtttatttgtaatgtcttttatctgccatgtgcatttatgctgccactgtggtagttcagactgttgttccctcttatttgcattattgaaatgagccagactgcctgccttagatccccctgtcctctagtgcaccctgcacagcatgcccaatctcacctttctatctcctttaagcccaagtcctgcttcagtcatggatgatccatggtaaggatgggttatgatctaagcacttagcaggtcatgaaacatcttctttacctgttttcaatctaggcctattcagcaatatttaacagaatctaaatttttcattctttgtgccacacagtggtccaggtgctaggatgcaagcacccttgctctgatgggactgccattctactgcagactacaacaacggaatggaaggttgaggatctagtgagtgtctgaaagaaggacctggagggatggaactgtgtaactgtgcatctggtttggtctgggtgctgtggtggtatcattgaggcttctcaaaggaagctgtgctgaggctgaggcatcaagaatgaggagtcagccaggcaaagttgtaggggagcagggcatgtgccaagatcccaagtggaagagagtgtgagatggggaagcggggccaaggctgagagaggagactggtgctcagcaggggccagatcatgttggcttgggcatgttactgaaatgccaggggtttggtctaggtcctgttgcttgctacacagaaagccaaccaccaagacaacgaatgaagccaacaaagacggctttattcaggtgtcatcagcccaggagacagatcagtcttaaattcatctttccccaatcaactaaaattgggggtttctacagtggaaaatgaatgtagctacatgcaggaaaataggaattaaggcaggtaagggagcagtcctgctgaatgaggggtctggcatctcattgtctgcatgtggtgacctggtgagtttcagttcctcgacattatctgggaggcctgagggtcagtttcctgagaaaggaactcagataaaacaaatgtcagtttcaagctttaagactgggagcattaatttccatgttaattaaaaaatacataaacataaattctatagggaaattgggccagtttcagggggactgccctaaagaatttggactttctcttatgggttgcatcacacatctgaagagttttcagtagggacatgatcaatctgtgttttaagtacaggatgctaagggttgtgagaggaatggattggatgagtccaaaagttaaggaaagaaaagcagtcaccctgctgttcccctgaccccctcccctgcacctgccatacccagcacagcgcctgacacacatgtagagtaaattaatatgtacatatccactacaagagatggacgcgctaggcataacagatgtctgtatctgaaatgtgggttgttcttttatatcgcctgccactgtgcagttccctctacctgaaatttcagctcttctctgtaggtgctggaaaactcccgtccattcattaagatgctactcaaatcccacctacacaccttatcttctctaatccttagagcagccatatgaggcaaatgttttatctccactttacagttgaggaagtggctcagaaagattaaggacttgcccagtgacacatagtggtgtcttgggatttacagctgggtcttgtcgtcttcatacttgctttacccgccactcttcaaggttcctggaagcatgagtgattaaggaggaatcattgccagttcggtgtcattgctgccagccccctctgaggcacacctggctccctgggagtgtgtttatgctctgccaggactctccccagcctgcattctgaagcatctccttccttgctctgccacatccccgcccctctagatggagggaaacactcctgtaaatgggaattcacccaatagttcatccaaacatatcactggcttcctacctttctctccttcccagcctggacaacccatagcctccatgatcaatcactttatgaacatggtcagcttcaccatggcctctcctgggctggctgctaggctggcctaacagctgcagctggactctaccctgggcattttaaaacactgttacctctgtttctttgatattctctgaggtctaaagtcagcatacatcacttctcctgcttgtttgggttctgtatgtaggggcttgacagccagagtggctttgcagaaactcatgcccctggcccacccagcctctcgccctgcctggagggcagattacccctcagtgtgcttctgctaggaatggccatactgcatcattcctgttcctctgtctatgacttctgcaggatgactctggctttttctgggtacgtgcggaacactgggccaggctaataagtttagaagaagatttaagactccagatcaaggcacaggatcacattgtctcagtaatcgtgacttgaaaggaccctcgatgggcctcagctaagagctggcatggtggtggtgagcatgcgggcagtgggtttgcaggcatagcacaggctgtggctggataaaaaggtgttcacaccatcattgacaaattttctgaaccatgtggaacacttgtaatgatctgaactgtgtttctctccattttcttttcctttttatcttttcgctctctttcttttttcttcctggaatgcagctgtcacaataattggaagatgcccttgaaaaagtgctctcgagcctgtgattccctggcagcttcatttttcatctttccaatgaaggtggcatttgcccagaccctgttagctatgaggctgcctgtagaaccttcaactaccattgtgtgtggtgaatagtactggggttttggcatttcagtgctttgaactgctgaagaaccctaaagccaggctcatatgcacctctcctccctctctcccacctccccttgcttcctttccgcccctcccctcactccctggttcttccaccccaggacccacctttgctcaaggcaacccctcccaccccatggtgttcccctcctctttcctggaggccttgtaaatgtacagaccatttagactttaagacagtggggccacttttcatctcaggccaggctgctgcctggttttacggggtcataaaagtcctgacaggagtcataaaagcctccaattgcactgcagaaacccttggagtatattttaagggcccctgagttttcattttgctgcttttatggggactcgtaaaagctgcgtggagtgagcccactgattggctgctcagcacggaggtagttaaaattacagctttagacaaattgttccagtcccaataaatcagtatccggcatgtggcagggggaaggcttctagctctgctgcatcctgggccccccttgtcctaccacacaggcaaggctctgcttggggccaccctggccagccctccaccatttcctgaagccattctttgcaaaggggatagtacttaaccagctgtttttatgcattttaccacgtagctggttgacttttttttaaatttccaaaaacctgatctttaaaaccagattgacttatttttcaattcaattgttagagagacacaatctcatactccgtcggtcaccctggccacaggtactacagactacagcctgctttctccccattggtccccacatcccatctccctatacatggccttcttgccttaccttctttctactgttgccttggtatatctgttatacccctacagtgggccagtgcagggcaagaatgatcggtggggatgccattctcaggacccatcctaatttcccactggttatgcctggcagagaaccataccagcgtgggtattatgggagactgctgtgttttgtgccatttcaactttttaggagcttgtggctcaaatatatcaccagtctggcggatttccaagacactgattggagaagcagacattgttttctcttcccttctttccagatccagaatcactcagccccagctgaactgccatgctgacaacctgaggatcaagcatactcttcatttgtgatgtggaagtttaaccattaccatcgtgtgtgctcttccttcgcaggtggagaaagctttcaggagaggctctgagggtgcagaagcaaggaggggtccctgcaatgtgctactcctgtttgtgtgtccgcctctgttcccatggcaaccacctctttcccttgctatttctaaaaagcacgtgtgcttgtgggagtaccattctgaaaaaaatgatgcttactcctccctttctggatcttagccaagtcaataattcaagcagcacgaggtatcttagtacttgagcaatgcccgactgatgtcaactgttaggagagccaactgaagtagggagaacagtttggggtaagaaaggaagaaaagaaggtactgtcaagctgtgggttaggagaaggcattagcctgagaaataagaccaagatacatgtgaggaagactccaccaccattagttcactttcagagtcatggctggtagatgctcccttccttccagagcagggaggaaaagggacgcagtctttgctgcaaatttcctgcataagttagtggagaaaacaggttctcttctgacatatgcctctgttttgaagagccttgttcttttcttaaataaatgaaccaatcacaaaggttacaggctatgtgagagaaaaacacatcttatttctgtcttgctctagttttatataattattatatcaactgtggctgatcaaagcattcattaaagagaaactatctctcccatgcttttgttacagtttggagagatttgacaggctttatacatctctggctatatttccctttctctttttcacggttgatttcgctcttcttcctctcctcctccccttcctgcgtactagtgatttctaacatgactttttttcttttctttttcttttttccccttccacctagcctaatcaaatctctcataagacatcaagggaaccctgaaccaaagcaactcttggagttatatcggtacattcaggtgagcacaggctgacttcctgcctcagagcagccctcagcccacctggaagccaggcaaggcttctactgcacacactcccagacagtccctgcctttcccattgtctttctcaagggctctgatttctaggctgagcttactgccctgttccaatagcctcctcccaaagataggcacatatctgacactcctttgtcaatccttgggggagttctgtggccagcaaaagatttccatatcatcaactccttgtctctttgcaaacgctcatctttcaatgtggtttttgctactccttctttcattatcctcatgctattcttcctgaggaggttgtttcagtttatttaccataagcatgttcccaaggggatttcagccatgcaaatgaattacggaggatatgacttcaatgtgcaaagcatttggggtgaatgtgtacaagtacatttttcatattatgtgcccctctatcccattgtgtggcatgattttatctcactctgttctggactaatgacagactccttcagacatttataaaagtctgctttgatcgttcctctatatttcatcttgcatttatttgttcactccctcaacacacaaagcatagactatgtgctgagtaccatgctggtaccaggggacatggagataaataagaaatagtctctgtcatcttggaattcataaacaaatagaacaggaaaaaatgtaatcaattacttactaaacactgtggaatatgcaatgatatatcaggaggaagtaagggtaagaaatgactttttactggcgtttatcttacctggatttttctcaggaggaaagaataaggaaagggcattccaggtagataaagcgaagtaggaaattcccagaaacatagaacagcgtggtatgtgtgtagcattcatagtcatctgccaaagaagaataggtgggaaaggtcttgagcagaaaagagtctgaagaggaatccaggaagcatattgtgaggagcgtttgttttgcaggttgcaaaacatgagtttgaggttgctaaagaaaaaaagcggcattgtatgattccatatcaaagtagggcattgtggtccctttaagtttagcaaatactgaatgcctgctgtgtacaagagtatactgggtgtagaagaaatacaaagatgatgcaaagatggtatcttagtaccactttttaaggataagaaattttcttgtatacatagggcataaacatatataaaggctgatttatagtaagctgttgtgtgaggccattctggcattactataaagatatacctgaaattggataatgtataaagaaaagaggtttaattggctcctgtttcttcaggctgtacaggaagcaaagcatggcaccggcatctgcttggcttctggggaggcctcaggaagctttcaaccatggcaaaaggtaaaggggaagcaagtatctccacatggtgagagaggaagcaggagagagagggtggggaggaggtaccataccccaacaacagatctcatgaggacagcccgaagctctgagggatctccccccattacccaaacatctcccaccaggccctatgccaaacactggggattgtaattcagcataagatttggcagggacatgtattcaaactatatcatgcatatacacacagacaggcacacacacacacacacacacacatacacacaatcggtcaacagtgtaaaatgagatgacaaaaccatacttgagcaattgccaaatgatattaaggacaaacaatgatggatgtagaggagagtgtaattagacaggtatggatggccaaggaaagctgcagagaggaggcgaatgagtggataaggagaatgggtaagatatggagaggtgaagcctcatgtgtagaaaaacttgaataaaagcaatggcagggacagccaaagaggaatcagaatcagttaatgaattaggctcacaggggtggagagttgatgctgtccatggcaaccggggctggaaattatgctgcctgaagagggtggaggctcttcaaatgtccgattaaaggtattggacttttctccattggcaacagagagtcactgaaggttttgaatagggaagtgacttggtatttggctggacttgtcttgtgagctatttgtggcagctttactgtacaaaagcgatgaaatttaataattatttagttatttggaacattaatatgctggtgtatcatatattttaataagaattcagaaatgggagttttctaataagcaactgagttgggaaggtaacagaaggggaaattttggttgaataggataagaatgagaattttgagtgtcagtgatcaacaattaaccctacgtctcaattcatcataagcaaatacaattactactctgcaaatactatgtagaagaatgaaatgatgtgttggtgtctgtcccccaaattggaggcttctggccattgcttgaataactttctgcctctagtatccccaaacttatgttttgttttttctttttctcttagtatccatgcttctcctgaatcattcctctcgttaggaatgtcagtctactaaattttgtggcaatacaatgcctgggtttgaattcaagttctgccacttccttactctgtctctttatcaataaactcattgggaaaagtggaggaaatcatagtaacgatttattaaagttgaagattgagttttatacatttaaagtcctagaacaaagcctgcacatagcaagctcttagccaatgttagcagccattattactgtttactgttaataacagaaattactattaaaaaagaggaaacaggaaaaacctttgtcttcaagaagcttttactgtccgcctgtcaaagttcctgagcagcagctgatttctggcttagaagttagggttaggaaagtaactagtgagcgcactaaacagtaagatgcgctgccacagttgtgtgtgtaattgacttttatagtcaattctgcttatatttcctccttcaccctaatgctagcccggttctgagccagagttatttcgctctgccagtggtgcacttcagaaacacctggaggcttgttgaatccggattcctccacccacacccttagagtttttttttcttttttttttttgacaggttatttgttgcccaggttggagtgcagtgacgcaatcacagcttactgcagcctcaacctcctgggctcaaatgatcctcacacctcagcctccctagtagctgggaccacaggtgtgcaccactatgtctggctaatttttaaattttatgtagagacagactgtccttatatttcccaggctgctcttgagttcctgggctcaagcgatccttctggctcagacctccaatgtgctgggattataagcattagccactgcgcctggcccatgatttgcatttttaacaagttcctgggtaaaactgatccttgtggtctggggaccacactttgagaatgtgctttcagctcagctctgttgttcactcaagaagaaaaggcttttcctggtaggtctgtctgtagctcaatcacatgtcccacatggagcccactctttcccatggtacaaaaccctccttaattgcctccttggaatctacacagagaaatccctgagctttactttttctggacctgccacttacagaaccagcttcattgagatgttgtttaaaattgatttctcacctagccacacagattatctaaaaggtcaagattctcatgtagacttctttttgaacattctttagccactcgatggcccagagccccatcctcattgttcaggtttcatcgtctccttaatcaaccattagcataatgtattagcatatctatagcacaattatattttgattgctgtggtcccagtcagactaaaggctgccttcaacctagatataaataatttagaatgtttataccaaagggaattataggggagggaagggaagaaaggaaagagaatatttgtgtgtgtcaggggaatgaggggggcattgggagagtaaagatggtggcaaaaggtaacttaggttgccactttttaccacaacacttttctaggctattctcaataagaaaatgtgaattatatatattcaaaatacagataccattttgaattgctttaaatccactcctgcctttaatctcattacatctgtcaaaatatgtctcatttactaagtaaaaagtagaagctggtttccagcacctctttctttattatagcctgatccctgtgcaaatgcattttcctgtggttcatctttgaaagatctctcttctcttgtctggttaacttcctcaatgaccattgatatctttgtgctactttattgtccacttggaaacctgatttccctttattagtgtcctctgtaataggttagcagaaatcttatatggttccaaagaagtttctctctctttctctctttctctctctctctctctctctctctctctcacacacacacacacacacaacacacacacacacacatagacacatacacaggtgcattgtatcagctggaacatcagcatatgtgtggtaggatcacaatcattcagagcttctgatgttcatggtacctaggggattgattcagctttcaaggagctgtggacagtaagattaaaagaactgctctccttggggacttttaagtaatgacattattggtagtcctttgagcagcatggagagatgtttgaaatatgaaattgctgacagttttaatagttgcatttagaatggatgatatttgcaaaaattgctacttctttaccttaccacgcagaatgacaacgggatgctaggactaagccaacttcagtattcttctgcaagtgatgtgaaaacgttatagttgatggctcaggatcagtgcagggatggtaaaggggcagaggatggcactatgaaatcatagtattgacacagctggtcattagattaagcctagtaagggagtctaaaaaaatatcactctccaggtcccatgcatggagattgtcattctgcacctctggggatggaatcccatcagctgagtgtgatagctggccagaattgagtagtttgggtttagatggtgtcagaaagactggagaataaatcttctcttgggtgatgaatatctacaaaaccttaggtaagacacattttctgagtctcagtttccttattctgtggacattgtctttactggatggtagacgacttgaaggcaggagctctgttttctctttgtcatcagctacttgcattgtggcagacagatagatagtaggaccctagttaaatggtttggaataaatgattgaatgagtgaaagatgaatgaatgaatgttggaaggaagggatatatgaatgatatctcatcaatttgttgtgtgtattaaatgaggtaattttatgtattactcctgacagatagtggggattctaagaagtttccatctcccttttccattttcatatcctaccatccaacatgctaattgtgtggtgttgttttcatatttctatctcttccttttctctttttgagagaggaaagaggtgctcagtccttattcctcccattttctgtttcacctgcatctgcccacagcagtttccttagcatacattattagctcacctagacttaacaaactacctttctaactcaaatccctcctgtttccctaaagaaaatgcttcttttttgttagaaaattttaaaacaacaataacctaggttttgaagaaataaaaggtaaagattttaaccacatttgcgtgtttcaattattagtgttttccctgtggcccattcatgtggataagagacatctctgcattattatcttgtcagaaatacagcccctttcccttcccctcatctgattaggcatgcttctctttggaagcctcatcccatttggctaatgcatcttgacaactcctttaataagagtgcttggtgttcgcattcaaggatgtgtaggagttgacagaaatctaccttgtaatctttccatggcttgaaaataaaacccagggagacctagcacccgcatctctcaactcaaaaatggcgagaaagcttgaggggagagggatggccattgatttaacagaaacagttttatttgtttgtggtttttttcccttccttctgtgtgaaaaagctagcagagggagggaaaatttgggaagcagaaaatgtttcaatctacataaaaaagaggaaaataataacccaacaatgagaagagccaagagaatatgagaaggcagcctctttttgaaatagattaaaggctttattgcaagaacatcgtaggacaaaggtgtctctgcaggactgggaacttcagcaaagcacataaaacctcattctcagacttaaagacagccctggaagaggcagtccacaaagcagtgtgtgcctaggcacctattctaaattcaggagagctctgcagtcatttcctttgggggtgaggcttatgaggctggtgtaatcagggatataactaggaatctcctccaaagaatgagtgtagaccaggtcaaacagaactattgtgatgcatttgtcctccacagtatcaggatctcaagccccttgtcctctgtggttatagaatagcctggggcaccactgtgggcctatggtgatcatgggtgccacttcctgagcacttcctgtggtaggattgtacttcctcctttgtggagaagaacattgactagtgctggccaatgagaggcagctacaaatgacgtgtgtcaccctgtgggtgggctaaacattttacttccagtgcgagaccctcctgggcactctctttcctctgtcatgacatccagtgactttcaagactgtgactgccccactgggggttcctgagtgaatggatgaaaaaagctcctccctgtcacacctgtgatggatgtctactgtgaatgagaaatagtcactgagactttcatgttgttgacgatttcggcataacctacttatcctgactgttacagagtctgatcttaatgcaaaacctagccaggaattgaaggcttttattcagtggccctttatttttgaaggtgaacattctacagggtagtttggataagtggcaataagggaatggtgctcattcatcccaggatcacttaagagcacaaataagaccgccagctgatgccaggctgcacagcaggacactaggtcactaggagagtcaggagggcataactcctgctgagcgttacgaagcacagcaacttgtgatttggggcctgtcaacagctatggactcagtaaacagccctgaaatgtgaggtttccaggcagatatttctgatgctctcttttgttgcagcctgctttgctttatttatgcaaagagtgtatccctgggggaaaaatcaagtcatatcataagtgcatcagagaagcttactatttaaagaaatctatggtgaatccttttgtgaaggaataatcatccacctgatttgcatttgctttgtgaattgtgtttgtgtatcaggttttatgagtttggggcacatcataattcagagcatcaaacatagagtccaacagagctggattttcatctcaggtcagctaaaacacaaagcttgcctttgtcctgggggacaaagtgaggggccaactgaggatgaattttttgcctagaaatctctgcaacttgagaatggaggtaaaaggtagatggtgagaataaccctggatggagttagagttgatataagggaggtcaaagaagggaagggctatgaggagtagaaaggaaaatgttaggtgggcgttgcttcgattttagaataagccttatactgtaacaaggaatttggggaaatacacctagtcctctgttcaggccccaaatgaagcaaggcaagagggggcacagtgtgactaagcagggaattggggttagctcttgactccactgtatggggatcatgacgtggtggactgttgtctaagacagatgagagaacaaacgctcactttacccctcgccacttatgggatgcatctctttggacaaggtttgcatttgtaaaattctattgtcctgactttaatctttctgagtcttggttttccatccatatgcttaaggtctttgtccctcctggcaggacttgtgtgaggatcaagagaccatgaatgtcaagtgcctaatatagctgacctcagataggactcaggaaattaaaactatcaatattgctgactatgtatttacttttttctaagattctgaatgttaaagcgttagtatagtgtggagtctatgacaggtttttatagatatttgtggaaagaatgaaccatctagtagcctaagaagtgtggggaatgaacaccagatgtgagtgctgaggggtttggagcctctgtctgtgaatcttatacctttcctccctggcattacaaatgctccccatttccccctgaaaacatgtctgtttcacagaatccacattgctcacaaagattaaaatcattttcaatgactccatggtttttgttttttttgtcctttctgtcttgccacatcaggttatctgaccgtttgatttcagcaactcaaagagctcttcatttttttcctttctttccttttttcttttccttttctttctttccttgttttcttttttttttttcctgttgtcagagccctaggagtttcttttccctttttaattaagagcgaatgaaggtaacaaaatgttttataactggagagaattcaccagcaggacaccaaggcagaaatccacatcctgaaagaaaggcaggcagacaccagatcagcgctgtggggaatgtgtcctgcacacactctgcttcccgctgactgatggtccagccctccctctgccatcagcctggaagctttacctctggcagaagtctccctgtcttttgttaggaaaagctacaattggaaacctgcttttctaaagcatttttaaacacacagtgtgctcccctgaaatacgcctgtgcctgcaagagtcctgtaagttaattcctgccacccagggaagtgtcctaattttccctgacttttactgacctactcctcattgtgtacctggctgtctttaagctgggggacagtttgagattggaacagcaaatttcatgggagagcctgtcagatgggtatgtatgtgccgatgtaaagccagattgagcctaagagaaagagtgtgagcagaagaaagggaataaaatcctactgcagacagtgatgtggaaagggatgtcgtttctggcactgacactgtgcctggtccagtgccctggctgtgccatcccggcagctctgaggctttctgacagtcctgagaatggagcacaagcccccagggacgtctttggagccctaattccggtgcactgctttcgtgcactctgttttgcacgccacacttggaagatggcattataagactgcttccaaggaaagcgtgcttttattaaactcctagaccaaattgcctccctgttgacctctttctttgtcatgagacgtgatgggttattacatttgtgattaaaaacatccgtcatcggtgtgttttgccttttcaattttgtaggaaggtgatcatgatgctggttctcagaggaacagaaggatggagaagagagaccatattttgtggtttaaggaacttgcccctcagagaaggttaccctttttttctgagttcactgctgaatgtgtggctcaaatggccgtggaaggtcactgagctgaccgaatacacgttatatcaattctgcacagcatgagtgaagaaaatggacagacaatttcttaagtcactagattgtagagatcaatacagataattttggaatttttagaaaatccaaacacttatcctcaccacggctgttcatgtaatacctcagcagcttcttgcttcatattagctttgatcttactctctatttggaactaagtgtttcagaaatgatttctccctcctataaaacatactgaacacagaactgagttcttcaaactcaacttatgtatgacaaagctatagccccagcttttagctcaccttggtaactccgatggtggagaagacaaggataaggatttcttttctctgaggctagactggtgaagttataggatgacagatacagtctaaaggtcagtccctggctgctcttcccagagaccctctgcctcataccttcccagcctctagtctccagtctgctcggacctctgctatacttctttgtgctagaagagtgatttggtcatgtctctcctctccttgagcaaaccttaatgaattttccctccaatggccagtcctgtcttatcttggcatttgaagctctttattaagtgaccatttctactgtctttttttttttcctccattctcttctgctaggctctaatatgaactctttacggcaactgatgctatcacagaaggacctcttgtacttgctccagtctggggacttggtcaggtgtctttctgtctccctgtaaagcgtttccactctgcatttttgcctatcacaattgtacagtttcctgaaggcacagctgtgtgctatctctcttaagaattccctgatggaagtatcatttattggtgccaagtgactgaggttatattcgcagctcttggacagggctcctagactccccttagtctcagttacttatctgtgtataaccactaagcacccttcatcttactcccataaaatgaaagtgacctgatatttacatgtcgatctcgtatgggcattatcacaatgtatgctctgtggcattgagttgttttcatacatgttaattataagcaccagcaagcatggaaccatttcttatatgattaatatcccttataacaattaggtctacaatttgtaaaatttgttccattaaatatgtgattgaagaactgaataaagtcacctctagtgaaaattctacttgatattgatactatgatttgaaaaataataaactgagaggggaactccttgacaacagtttactgcactgtttctaacatttaacttgaagtataaataaatggattttagcaaatcaacctctctttgaagttaactgaatgctaactgtgttctggaatgaaagggttcatgcatctctgttaagaaatggaaaacagataatggcagcggagtcaataaagtcagtgcctcatcttgaactgggtgagcggtccctaaacatttgttacgtagtttcttcagcagactgtttatgtctaatgtgttctttttttcttaaaagaaaaggatatttgcatttttgatttacaattttattacttactgtgtacctgacctttacaagcattatccaaattaattcttataacaattctatgacttagagttataatgcacattttaaagttgagaaaactaagggtgtaagtaagttggcctaggtcacacagctaagtgagctgtagagcaattattccaacccaagcccatctgattccaaaatttaggttctctctagtacctcaagtggtttctacatgtgctctacattttcctgcttcttggaatctgtgcatgctcattcctaagcttgtaataccttttccctattctgtatctcagaaggtgtccttctttattcccaatccctgttctctctcagtttggaagtaattgttcttttattgcaaattctcacagcacttagatttttatctcaaactctttaatgtaattaattgttttcatccatataatatagtcatgtgtacctttatgtaccacatcttcctttccacataggaagctccttgagggcagaagcgatgctctttgattcattttgtattcttcaagatggactagaacagcgtagtcaccttgtaaacctatgtggtggatagggtcggggaagaaaggaaaaagagggaaaaggaagagaggaagaaatcaaagaacgatagaagacagtatataattcagtgttaaattgtgtggttcagactaattataaattcctttaaaagaaatgcaattttattactttcaagaacataaagttaattaatggctaacaaaatgttatcaagtagctgtcttgtcattcccactgtaattaatcaatgcttttggaatgaaaaagtggacttaagcctagcccatctccagattattgagaattttaaattagcacagtctgaaataatgaggttatcgccaccccttggttaaacagacgtctgaagatgaaagcatatgatgataaagaagacgtataagaaatttctaaacatgttttttctctttagtggtactaataagggattccttaattgttaaagcgcatacaggaccttatttgccaaaaattgtagcacatttgcttagaattttgagttatttcttaattcctcttctcttgattaatttaatggctcattaattcattttttaaaaaagagaatctaaaaaggttatttagaacaagctaaatccatacacagtagtgaaggtgctgtagcccatcacagagtgggtgggaagaaggggctagaagaaggatctagaagtggtaggagaggatgcaggagccattcagaatacgcatcaggaagaggaagcactgctgagtagcctcaggtttctttcttaggtgacttttcggagaagattagggaatgtagagggatagagagatttgtgaggaagaatatggagttaattttggacttactgtgtttgggatgcttatgagatatctaattggaattgttcatggagcagttcacatacagatctgatgctcagaagtgagggttacttgaagataaccaattttcgaatcactgacatgtagtaaaggaagattttcacaaggggcagctgtgtgaagtcaacagagactagaacaaggaagggtaccatgaagattgaaggtaaggttcagaagaagttgaagaaattgttttgagaagtgatatccaaagaagtcagagaaccacttgaagagtggtgtcaagaaacctaaaagaaaagatttttaagaggggacctattaaataagaactgaaaagaagccgttaaatgttgtgcttagagagtcactgatgctggcagcttatcatcctagtggaaaggaagcctgactggagttggttgtgaaggaagaagtgagaaagtagcgatgtctgtcatagaccattctttaaagaaacatagcagttaaaagaggtagctagtggaggacttgggagaaacaaggagatttgggagtaaacagaatctagaaaagtggtggtaagatcagtcttgaacagggacagcaccaactcccctgctgagagaagagtggcatagtcctgaatgtttatgacttcaagatagatctgatgaagagttcagctcactatttcatttgtattagctttgtttaggcatattttatggaccataaaatttatccactttaagtgtacaattcaataatttttgtgttttttgttgatacatagtatttgttcatgtttatgtgatacatatgatattttgttacgtgtatagaatgtgtagtgatcaagttggggggtttaggatagccgtcacttgggtatttatcatttctgtgtgttgagaacatttcgagtggtatcttctagccatttcgaaatgtacagtacattgttgttaactatatttaccatacactgctattgaatattagaacttattcctatatcgtatgtccttattttttattcctatatccattagccaacctttcttcatacccttcctctccaccccttcacagccctcacatccttcggtaataatcattctactctctacctccgtgagatttttggctcccacatatgtgtgagaacctgtgatatttgtctttctgtgcctgacttatttcactgaacataatgacctccatgtcaaatgaaagacatgatttcatttgtttttatagctgaataatattctatctattctattttgtgtagatgccacattttctttatctattcatcagtcgatggacagttaggttggttccacatctttgctattgtgaacagtgctgcggtaaatgcgggtgcacagctatccctttgataaactggctttttctcctttgaataaatacccagtagtgggattgctggatcatatgatagttctatttttatttttctgataaatctttgtattgtttccatagtggtcgtactaatttacattcccaccagcagtatgtaagagttgccttttctctgctttctgcattattttttgtctttttgataataaccattctaacctgggtaagatgatatcttgttgtggttttgatttgcatttctcagatgatgagtgatgttgaccatttttttcatatacctgttaatcatttggatgtgttcttttgagaaatgtctattcagatcatttacccgctttttaagagaattacttgttttttttttttttttttttgctgttgagttaagttccttgtgtattctagattatttccttattggataaatagtttgcaaatactttctcccattccacaggtgtctcttcactctgttgattgtttctttggtagtgcagaagctttttggcttaatatggtcccatttgtctatttttgtttttgttgtctgtgcttttgagatcttagccatataattcttgtctagaccactgtcctggagtgtttcccccatgttttcttctagtagttttatagttttagttcttacatttaagtctttaatccattttgagatggttttttgatatgatgagtgatggggtctagtttcattcttctgcataggaatatccagtttttttcagcaccaattattgaacagtgtggtctttctccaatgtatgtttgtggcaactttgtcaaaaatcagttggccataaatgggtggatttatttctgagttctgtataatgctccattgaattatgtgtctgattttatgccaataccatgctgtttttgttactatagccttttaatatattttgagtccagtagcgtaatgcctctgctttgttctttttgctcaggattgccttggctattcaatatcttttttaaagttccatacaaattttaggatttttttttctatttctgtgaaaaatgccattggtgttttcgcagggattgcattgaatctgtagattgctttgggtagtatggtggttttaacagttttaattcatccaattcataggcatgggatacttttccatttgtttctgacatctttaacttttttttgtcagtgttttgtagttttccttgtagacgtcttttacctctgaagtaaaatttattcttagatattttattttattttattttattttattttattttatgcagctaatgtaagtgtgattgttttcttgatttcattttcagctagtgcattcctggtgtatagaaatgctactgatttttgtatgttgattttgtattatgcaactttactgaatttttaaatcagatctaataggttttttggtggcatctttaggtttttctaaatacaagatcatatcgtttgcaaagagggacagtttgacttcctccattccaatttagatgccttttatttctttctcttgcttgattgctctggctaggacttgcagcactatgttgaataggagtagtgaaagtgggtatcctagtcttgttccagttctgagaggaaaggctgtcagcttttctcattcagtatgatgttagatgtaggtttgtcatatatggtcttcgctgtgtttcttctctgcctgttgttgagagtttttttttttcacgcaagggtgttgaattttatcaaatgctttttctgcattattgaaatgatcatatggtttttgttctttgttttgttgatgtgatatattgcatttgttgatatcgtatgttgaacaatcaatgattttttaaagtgaatgtatagagttgtgtaagcatcaccacaacccagcttaggaacatttccatcaccccagaaagttcccttgtggctacccacagttaacctccatttctaaccccagccttaggcaaccactgatatgatttctgtatctataatccttttctggacacttatataaatagaatcatgcaatatgttgttttttgcatctgacttcttttcatgtttttcattttccttcttattgtgtaataatattctattataaaagtataacacattttgtttattaattcactagttgctagacatttaaatagcttccagatctgagttattatgaataatgctgctatgaacattcacctacatgtctttatgtgaacgtatgttttcatttacattgtggagatccctaggagtggaattgctaggtcatatattaagtttattttaactttgatagaaactgccaaccttttttccaaagtggttgtaacattttacatttccaccaacaatttatgagttttctgttttctctaaatccttaccaacacttgttactgtctttattttttattataaccattctagtggatatacaatgttatcttctagtggttttaatttgcattctgttaatgatgaatgactttgagaatcttttcacatgcttattactactcatgtatcttcttgtgtgaggtgtctattcaaatattttgattatttcttaattgagttgtttatcttcttatgttgtaagaatttttatatattctggacacaaatcctttattagctgtatgatttgcaaatatattttcccagtctctgagggcttttcttttcattttttaaatggtgggttttttttgaatcacaaaattttaattttgatgaaagtcagtttatcacttttttcttttacagatattttttactttgatatctaataattttacaatccaaagttatgaagatttttcttctacattttctcctagaaatatcacaatgttagttcatacatgtcgatctgctgtgtattttgggttttgtgtttgacatgaggaaagggtctacgctcattttattcacatggatgttcagtgtttctagattcatgtgttaaaaacagtctttttcctcactgagttgtcttaacacttttgacaaaattcagttgaccgtaaatgggattcatgactcttgatttgctcctgtgaatgggattaattttggaatctcaattttatgttattgatctaaatttctaactttgcatcaatatcacacattcttgattactgtaattttatagtaagtttgaaattggatagtgtaagtcctacaactttggttttcttttgttttagttttttctatatcttttgcatatctatatatagtttagaaacagactgtcaatttgtatcagcctgctgagattttaatagggattgcatttagtttatagatcaatttggagagaattgccatcatgatatattgagtctttaaatccatgaacatggaatgccttttcttttatttagatctgttttaatttcactacacagtattatgtagttttcagtgtaggcatttattgctgtttaatttttctcgatgccattgtgaatggaattatcttcatttcatgttcggcttgtttattgtcagtgtacagaaatacaatagacttttgtatgccaatgctctttcctgaaaccttgctaaattgtttactagttctaatagttttttgtgcactctttagaattttccatatccagagtgtatcacctgagaataaggacaattttatttctttattcaatccttttccttctttgtccctctctccctctgtctctctgtctctcttttcctccctctctcgtttcctgtctccctcccttccttcctgtcctttctccctccctcattcactgcctccttctctctttcttccttttgtcccatattgcatgggtagaacctctaatacagtgttgaaaagaagtgtcaaaattagacattcatgcctctttcttgatcatgggggaaaacatttagtctttcatcattgttgtatgatgttacttgtggatttttctaaggtaccttttgtaggattgaacctaatcctcttggttgagaaatttttattgttcattttaaatcatgaatgtgtgctaaatttttaaaaatgtttttctttgtcttttgagatgatcatgtggctttaaaaaatttattatatactatatttcattaattgatttttagatactaagtcaagctatcatttttgcaataagtcccacttagcatgggtgtatgatctgctttaaatattgttggattcagcttactaatgttttattaaagagttttgcatctatgtttatgagatatagtaatctgtatttttattccttatgtttttgggctttaatattggatgaccctagactcatgaaataagttgagaaattgtttgactttttctatattttggaagagtttgtgaagtattgacatgttttgtttttaaatatttggtagaattcacttccgaagtcacagaagcctggcttttctttgccgaagatttttcattgctaatttaaatgcttgatttagttttattcagattttctacttcttctggagtcatttttggaaatgtgtgtctttctaggaattttcacatttcatataaattatctaatttgtcggcataaggttgttaatagtatggtcttctaatctgttcatagtctgaaaacgtagagtctttactatttttcttctctctttttcctggttaatccaacaaaaaatgtgtcagttttatcaaggagcttacttcttgttttattgactttccctaatttttttgttttttttcattctcttatcattattatatcacttgttctgtttgatttgaatttagttttctattccagttttttagatgtaagcttaggttattggttgagatcttttgcctttttttaacatagacgtttacaggtataatgtcccttaagcaccgatttaactgcattccataaattttgaatatgtcaagttggttgatagtgttgctcaagacttgtggttctgttgtttcttgacagtggggtattgaaatctccaactttaaatggtgactagtctattttttctttcaattttgtcaggtttgcttgctgtattttgagattgtgcttttaggtatgcatacctatataagtattacatcctcctgatatatgaactcttttatcatactgaaatatcccagcttgtctttgaaatagttctagtcttaaagtttatttttttctggtattaaaaaaatttcctttccaatttacatgccttctttcttatggttactgtttgcatggtatatatattcatcctgttacttttaacctctttttagctttgaatctaacatgtagaaacctgagattattaaatattttagatttttagatagcttataagaaattggatcttactttttttatccaatctgacaatctttgcctttattttattttatttttgtttctatttatttggtttttttttcagggggtacatgtgcaggtttgttacaaagggatcttgcctgacgctgaggtttggaatatgattgaatctctcacctgcatagtgtgtatagtacctgacaggtagttattcaatcctgtactcctcccctccttatattcccccatgtctattattcccatctttatgtccatatttacccagtgtttaactcctgattataagtgagaataggcaatatttgattttcagtttttgtgttagttcacttagggcaatggcttccaactgcatctatgttgctgcaaaggatatgattgccttccttttttatggctgcgtagtattccatggtttatatgtaccacattttctttatccaatctaccactgatgggcacctgggctgattctgtgtctttaccattgtgaataacactaatatctgccttttcattgtgatatttatattattcatatttactggtacttatttttatgactggatttacatttgacattttgctatttgatttctgtgtgatttctctttttaagttcctctatttcttttacattgtcttattttgtattaaataaatatagataaatattatagtgtaccatttaattattgtattaatattttgtctatttgagttaatgtttagtggtaactctaatgagtatgctacacattttagcttatcacaatctactttagattgatagtaactaaattctggtaaaatgtggaaaatgtctgaatttatccctcatatttgaaaaaaaaggtttttctgaaaactaaatttccggttaatagtattttattttccttttggtacttgaatatatgttatcccattgccttggccttcattatttcagatgtgaggtcacagccatcttaaacttctcagtgttcccctataatttttttggatggctatcaattaatttttcttatatggttgttttatttttttctttggttccaaaagttggatgattatatgtcaaggtgtggctctttttgtagttatcctaccttggatttgtagagttttttagatatctagattagtgtttttaatcaaatttgggaagttttcactattattcattgagtgtattttttgcttcctctttgctctccttatgggattcccattattatatatgctggcactctgaggctttgtttatttttcttctgtcttttttcccctctttttccaactgggtaatttatatggatttatttctacattcatggattctttcttctgtcatctcgaatctgctgttgggtcctccagtgagattttaattttctcattgtactttttgtttccataatttgcatttggttctctttatacttttgtttcctttgttagactctctacatatggatttttttgttgtcatatattcctttaatttcaaaaacatggttttctttagttttttaaacatatttataagaatggcttgaaatttcagctggtaaattcaacatctggggacaatcagagagtttctattgcctactttgttttgtatgggtcacagtttcctctttccttgcatatctcatactttttttaagtgcacgttttagaaaatatattttagcaaatattcctagcctcacttttcccgcaaaggttgtattttgctgtttttttctgtttatgtctttccttgtttagcaaactggctaatctgtggactctgtcttctttgctatgcatgaacagtcactaatgtcttagggattttttgatgtttttaaattttctttaattttatatcctgttttaattttcaagtctctcttcccataggttgccccccaggactgagttgacatccaaggcttaaacagaagttgtgctcaaccatcttgagccagttagtccccttctgatagatttgtgtatgggtagtgaagcaccttcaaagtgcggaccatttccaatgtctcctgatatttgcttcctactgagtcctgtcatgtcctttctgctcaggtttccagcttcagtgtcaactaagaatataggcctgacttgagccctctccaggctatggtgtgtttgcatgcagatttgtacttgcctagccctgagcagaacctggggtagtcattggccctcccctctagcctttgagagaatgacttctaccaacagtgccactggctgtggtgtcactcaccattcaaagtaagtgagcctctgaaccagggcagagatgccactggtcctcaggtattaccctaccctggaggaacctccatgactgagctggggctggagtcagaataccacagagccccacagttcttaaccgaagttcagaagtttcacaagaacatatgcttctcagattgttaagatttcgttcaattaccactccactggaatggttgattttgtcaattttgctcgactttatgctctgttttcttggacagaatatttgacagtcttctttctttgccataacagaagtcactggtctttatttagcactgttctcagacatttatatttgtagctttgggtgatgtttcttcagagtccgcatgatattcgttatcacagctctctaaatttgtaagtacactcttagtcccacgtggccctgcaaaggacactacccactctttgcgagttcccttgtgctcaactaagagccctctaacacttaggtccctagatcctacctctgactgtgaagtaaattacaagttcatgtttgttgaatataataatgtcaaaagacagtccctaatccatgcttctcttgaattccctggttaaactcaggggaaacattccacagacagctttatccctgaagttgtcatgtggactagatacctgtaactgcatggaatcaagtacagcaggaggaatctaagaaaatgtgcactgtggtcctttaagatttgaaagatgcaattcaaaggctgttaagaccttcagctggtgataattggatttgtaagtcagtgcaacatgtgataaaaatgctcctgctggatgggatcccggttttcttctatccttcctattaatgtgataaatgttactgtctcagctgatagggccacgttggctaatcagattggaatcaagtttgagttcctcaggctggctccatgtgaagctcatgggaagatgttaaaaaaatactatagagaatacaaggaggacctgggtttgcagaggggaaaattttactttgattaggaggctttgcagcgtggggaagacacatttaccatagaccctagtcacgtgctgccgcctgggcatgttatatctcatgggggactgtgggacattatctccattgttactgggcacatgccatcgtggagcctggggagaaaacaacagcagctctccatgtgggttttggggcagagaggagccaaaataatgttggaaaattaaacctctcttaattaaagctgatggcaaacaaacacaagtaataatgcactacagctgggaagcacaagttcaatatgaagctgaacagctgtgaaattgagccttctggtcacagctgggcctgtgagaaggccagaaaccctggcaaaggtgttgaccctggctgcagggctggcggggctagggtgggcagccagagtggcttgctctcctggttgttttggagtttgcgcccgctccagtgtctagctctctttgcatttccagactccttctcaccaagagcacccctctgtccgataggattattcagggttcttctcgaagtgaacagcgttattgcaagcactagaattgaggggatagagggaagatatgctttgttgttgttgttggttttgttgttgttgttggttttgttgttggtggtggttttgttgttggtggtggttttgttgttgttggtggttttgttgttggtggtggtggttttgttgttgttgttgttgttgttgttgagatggagtctcactctgtcgcccaggctggagtgcagtggcgcgatctcggctcactgcaacctccacctcctgggttcaagcaattctcctgcctcagcctcccgagtagctgggactacaggtgtgtgccaccatgcccagctaatttttttgtatttttagtagagatggggtttcaccatgttagccaggaggtctcgatctcctgacctcgtgatccgcccacctcgggctccccaagtgctgggattacaggtgtgagctactgcacccagcattttttttttaatgtaataaatttcccacagagagggaaggaggatagggtatgtttgttttgtgtttttaaaattgtttgctctctgcatttccccaaagacatccaggctgtgcctttaccgtcagcttgtttctttggtcagtgtctgccactgtgttcctgacctacagacttgaaaggcttgtgcagttgtcctggccttcagtatctgaggggcactggttccaggatttccctccaatattaaaatctgcagatgctcaaaccccttacctaaaatcggaaattatttgtagaaaatctatgcatatccttctgtatacttttagtcaactatagattacttataatggctaatacaatgcaaatgctatataaatttttactgtattgttttggatttttttgttggttttgtttttgaatagtttcgatccccagttggttgaatctatgcatttggaacccgtggataaggagggccagtcatatagggcaaatgtgggactggcttctctctaaagagagggataaagtacacctcagatgcgcagatacagtctggctgcagttacactgggataggtatattccggactttccctgaagttgtcaacttctgactcagtcacattcttgacctctgagcatgtagctatcactttcacttgcatattagccttagtcctcttactcatttgtctgtcagatttagttgttctctgtggaggttaggaacacacaccgactacaggcactgagtgtcaggattgtcaggatggactagactatgctgtggaaacaaatacaccctgagatcctagtggcttcatgcgataaagtgaattactagtctccttattgcctggagtaggttgcacagacccacagaatgtctctccactgactggagactcctgtgtctgaattccttccctcgtgtggcaccagcaccttggagtcatgggattcagctacagaggggagagagagaggctagaaggctgagcagtggggtagcaggaaagattgagcaagatgtttcatgtccaggcctaggactggcctttctcttcatcttccattgtcatgtagtcattcacatgccgttgggctcacggtaagggaaattggagaaagaggtctgccatcctgtgtgcccagaatttggtgggcaggtggtcagtctgttctacattttagcagtctacccaattattgaagtcttagtgcctgggcttgaagggatctttggaagcaattttgtaattcttttatctgcacctaaaaccttagactagtgcttctcaaaatgtggtcctgggacttggcagtgagcatcacttgggaactagttagaaatgcacatactcgggccccatttctgacccattgtacgagaaattcttggggttgagtcaagggatccacttcaagcagccctctgatgctccctaaactttgagagccactgtcctagaccggcagttctcactccactgtgactacccactgggattgcctggggagctttggaatgttctgatagctgggtccatagccacagattcagaccgaattggccgggggtgtggcctgagctgaagatgagaagcattgccctagaatgattattgaggaatagcttttatcctgaagttctctgtgaaaatagatttcatatggctccattggcacttactaatcactcaaaggccatgggagcaattgattttcatgtcctaagcccttcccttccctttcaattggaagcaacctcccagctttgcataaagtacagacaaaatagagatttgggaacttagacatggaatcctgattctgtcactgactcatcacgtggccctgagtaagccaattaatttctctgtgtcgtgtgtctgtaaaacgggagtagtaacacttgcccacagatgttgccagcattatctaattaatgagcacagagtgtttgggaaatacaaagtactgtacaaatgctaatcattatgatgaatgcggtgcattttgcagatataaaagtgctgtgtatatgctcataattattataattattgctaataccgataatattcctactgctaatgtatttccctggcagtaagagcttagtgtattctttgggttaacatcttgccccgcatgatcaggaagtcttgctaagcagctgttaaatgcccctggctttccacctttcagaaaagtatcattcatcaggagtacaaatagtcacgtatgtaaaccatcctggggtccacttatatgagacatccctggctgtcaggtcactgccagatcatgttcaagaagctctttttaggttccagaggtacccagaatgtagagtcatctgctttttcttgtattttcatcagaggtattttttttccttctactggttttttatctacaatagctttgtcatctgctttcatatggtgctaaatgtgctgaagaaaattctagtgtgtgttggtgagtgttactaggttccaatgctgacaattcacagatattatctgcagcaattggtgttgagaacaagacaattatttttgctgtggttttgtttgttcagttttaacttgggttttgattggaggagaagtgttggggaaaggcaattgtttctctcttctcactttgcaagaagggaacggtattgaggattgtgggactggtttgaacaaagcaggcaggctagaaataaagagagcaaatagatgactttaggatgcagtcagcagttacaagaccattgtttctatcctcatgttccttctgtccttccgacacccatttcctggttattagatgtggacctctgtattttgtagaccttgtctacgctactgcttcctgaattattcatagcaaattgggcatgaaacttacaaaagaaactcatcctgagaattatcccaatttagtacaaggcttgaaaaacaaacaaaaagcagagtttactgactgtccataccatagatccctgatggtccaactcttgtctccatttcaaaagccctgatgatccttttccttttccccttttgtggccccacatgatatatgaaatttcaagtttctttgccttgggctggaactacaacaactgatgaatttgtgctgattgtcttatgctgatctgaatctctgattgatagaggaatccctgataaataaaaatggggaaataacgatcaatttatgtagatcagaatttcttaacgatatcattttcattttctctgaagaacatattttaacatttattgcaaggcaagtatcctggcaacaaattccctcaacttttgattgtctgagaaagtcttaatttctctttcacctttgacgaataattttgctggatacagaattctagattggtggttctttagttttaatactttaaatatttcactcgacgctcctcttcctgtatgcatggtttctgaagagaagtccaatgtaattcttatccttgcttctctattggtaagccctcttccccgaccctcagtttctcaagtttgcctgtctttgattttctgcagtttgaataagatatgcctaggtgtagttttttggtattttgattagtgttctctgagcatcctgaaactgttgtttggtttctgtcataaatttttggaaattctcagtcattattgcttcaaacattttttctgcttctttctcccatctacgtctagtaatcccattgcatgtatattacacttccttttgtagttggatattctgttccatttttttcagtttttctcttcaaatttcaggtttggaagattctattgatattcttcaggttcactggtttttccttggccatatccagtctattgatccatggcattcttcatttctgttgatttttttttttatttctaccatcttcttttgaattcttttttacagttttcattttctgcttacattccccatttgtccttgcaagttgtctgctttttccattagaactcttagcatattattcatagttactttaaatcctcaatctgataattccaacatctctgcgatatctgagcctgttctgatgcttactctgtttcttccagctggttttttttttttttttcgtcttatagtatgctggtggtacttttatctttaaagccagacatgatatactggggtaaaagaaactggagtaaatagatttttagtttaaagttttatgtttctggctagggatcaagctgtaattattgcttgttgtaactgtgtcagaggttaaagtttcctctggtgttcttgtttttgatttccctgttgtccctagaaatttattttcaaataccatctgagatacagaattctttcatttccattcccctcttgttatgatgagctactcctatggatgtgaccatgggtgtggggggagggaaatcttctatagagccatgagtaggcctcagtattttactaagcctgtgcccctgcgccgtgagcttcacaagtgtgtctcagggttgcttttcttcccccgctcaggtgagacaggaagtgtagaaggggctgcagttgggtattttcccttccctgcatcattaggctctggtaatataatttctattgagggcaggccttcataagaacaggatgcatgtgtcatatttcaaaatggctgcctttgctctccccctgctggatgcatgaggggatttttctttgatccttactgtgagaacctcctagggctcttgaacctcctagggctcctattgaagtgtggagtctcccaaagtctggagctctcatgttttgacccctaagacttgtgcacactgaacctccagcaactcatcagttccattttagtttttctatcctgatactggctcccgtagagggttgtatggttggttggtgtgggtttttttttttgttttgttttgtttttttgctactgggcttctgctcttataagttgtgattctctgtatccacctgtcttttccaatttaggggcagtgttttgctctgtgacatctctgaggatctcttttttttatttttattctttaagttttagggtacatgtgcacaatgtgcaggttagttacatatgtatacatgtgccatgttggtgtgctgcacccagtaactcgtcatttaacattagttatatctcctaaagctatccctcccccctccccccaccccacaacaggccccggtgtgtgatgttccccttcctgtgtccatgtgttctcattgttcagttcccacctatgagtgagaacatgcggtgtttggttttttgtccttgcgatagtttgctgagaatgatggtttccagcttcatccaagagttgttgactttcggtttggtcagctttttccttttcatgtgaaaagcatgatgatgatgactccagcctgtttaggtgctttaatggaagctggaaggtgtttgctccaataattatcacttaacaaattcagtccacatagtccatcagtcaaaaaataatcatatgggcctttagttgtgaaaaagtgggaaatagagtgaacatcggcttatagttactactatttgttcttattaatggacttttttgaaggaaaaataagaaaagcatataagggagggagtggaggaggtagtcagagacgaggagtgggtataaagtcatttctgcctgttattcatgaggaaagaattatcaggaccttcattaccagtcctcgtgtttacatagggcaggcttatttaggaggcatcagcagtgttccacatgaatgaatttgtcatataactaagctatcatcctttaaatggaacttaaaacattgcaatcctttttgatagagttctttttctaaaatatattattgttttgtcttattgagcaaaacatggagattatcatttgtcttattttgttactcaggtcattattgaaaacatcagtcacagagtgactctgttgtaatgtggagtaggtaactgaggccatctacacctaaacacactccctgtctggcttcataatgcctagcttagttacccctctcctcaaacactcctaaaacccctaccccacctactccacctaaaataaaattaaatttattaattactattttatttgtgtctaagctagtccaattatctcctaaaatcatctcgtatatcactttgtgatatacatacaacaattaggaaacccaaaccaaaacactgtgctgtaggatagggagaatggagcctattatttaattactcaccagactttatgcatgaaaatcgttttctggcctataggctaaaaagtaaatacatgcataatatgtcatttgtactgtggtgtactatggagaaaaataaaccatggccaggggcttaaatgggactagagatagaggtggtcttggaagccctctttgttaagataatatttaagtagagatctgaaggaagtgaagagggaagccatttggatattgtggagttggaagagggaacctcatatgccaaagccctgtggcaggagtatgctttggatcaggaaacttaagaagaagatatgattctgagaaagggaacaaaagcaggagtgagagtgagaaagggagaagaagcaggagatgagagcagagagatagtgggaagctagatcactgaattagtcagctagtgccacaatagtgctgcataaaactcatgggcttacaaaatagcattttttctcactttggacttgtaggttcgctgggaggactatagactgaaaattgggctcaggcttcttccacatatgttcattctggggcccagactgaggagccagcagctactcacccagacctggttgatggaacaccagggcgcaaaatgacaagctagccactcatgcacattgcaagcctcaatcctgtctacaaacatcgtgcaggccaaagcaaggcacagagccaagctccaaacacagtggtgggaaagtataccctgccaacagtaggaggggaaaagatatgtgaccagttattcaatctaccacacaaaccagaaagagtgtggtttttgacttttactcttagtgtgaacatctttaacttttactctttttgtaaagggaagtcattaagtcatattgatctgacaagtgacttgttcttttattttcaaagagtaactctgggaccatgagaatagactccaagggtcaagttggaggcaagaagaccagtaaggagactgttgccgtattccagatgagaggggatagtggctttgaccatggtgtaggagtggggatggtatgaaatagtcatcttctggatttgtttttcaggtagagtttcgagaattggttggtagattgggtgttggtatgagataaagagatgggtcaaggaggtcttcaaggtttttgggtggaatgatgagtagggaagactggatgaagttcaagtttgaaggttgagggcagggaatctggagttctactttcatcattaaggcttgagatacctcttaggctttgcgtacagataccaagtagtcagttgtatacatgaatctagtgctcaggacagaggtgcaggctggagacagggttgaatgaaaattgataatagacttagacatgtcttggatgttgaaaataatattttactcagtgagagagcatgatttatataatctcttatgtgtgaaagtctttaaatcttcttgttctcatctagtttttccctccaaaatgacatgctcaaaggccctcccactcattaatctttctccttctctatctctgtgtttcatttttaattggcatttttgaagactagtctttctttatttttattaatttattgatcaactgaagtctgtattatgactgctgaggttattaaaactgttctgaccaaagttctcacactctgcacacatcccaagtggactctatgctgctgactccaccactccatccctccgccactgaccatgcatccactactgtgttcaagccattccaccgcctgtctcttctgaagccctctcccactttggcttctgcaactctgctctcctggtcttgttttcttcctgctgttctgtgatgctctggctttgtctccttgtgcatgctttctctcctgtgctaaccccttatatgttggttctgtccttgacttgaagctcttagcccactctgtgggaagtctcatccattccttggattttcactgctgtttgggtataggagctgcacacttcattgtctctgaccctggcccctcccttgaatgtagtgaaagtatttccaactacatgtaggatatatccaagtcaatgttcagtgatacctcaatttcaacatatccaaaatgaaacatcctctggtgattggggaggtaagagccatcgctcttcctctgtgtcttagtgactaggaccttcttgtaggtgtcatactcaccaatccctactccaacatctgttcagctctgaattgtcttataatgctctagagtgggaagtcctccaagtcaccccttcaagttttcatttactcatactttaagatatctgattcaatcggtatctcctctaagaaggctcctctgggtttgtaactaggatacagcattcttccttggtattctgccaacattttattcacatctcatcatattatgttgatgttatgtgtatatatttttccctaacatcctaagttaaacttctccagggaagaatgctgtatttatcatctcaagtacctagatcagtgtctaacatttagtaggattttagtaaacatttttgagcttgacagaaaggattaatttggattaatgaacccaaccaaaggtaagtaaaggctcagatacagccatatatgcctggtcttctaaacctcatagctttacctctgggattcatagtaatgttgatccatgcaaaagctttttctttgtgcccactatacacagataatgagagcacgctcatggctgcgggcaagtagcactgcatgattgacatgagttctgacaactcctccgaaagagaaagtagcccaatcatccccagctagatgatgagtgtgtctcatgttattttcaggcaatgtaaggttttatttttgtcatgcaccaaatggacttggtgtcaggccgtcaaatgtctggcaatctgcctagctgaagagataacatgagtggtgaatagaacattattgtgtgataatgatttccagcagctattgaagataaattccaatgcaaagtagaaagctttatttccaggggaggagatattgatcctgtggccactgtaaatagaatgagaattgcaggtgtagacagaagtccagtcttgtcacaaacattgagatctgactagcagaaggaactgcctcctgaaggcaaatgaaagcccacctgtttaggaattgctcgttgctccccctaatgctgtcactttcctgtaggaatgtaccatgtgaaccagatgcagcgtgagaagcatattaccaacacaattcttaaatgaaaaatcaaagacctctgcagatcagccataattggctgtggtatggtccctgggatctcgcttggttctttaagaaaaatgtttttatgagtcagagataaatccggagactggattacgggatttgttttatagacttaatggttgattgaaaaagaatctcatattctttatatacaatttgagattgatgatgtggttagtcttcattaggttttgacaaactggtcattacaacctgtctacttcatagaatattcagttttagaaagaccttaaagatcatctcatctaattcttttatttttcatgaaggagacagtgaccttaagatggtcttatagttaacttggacacttttttgaggcattatcaaaatacatgactttcttaaaccttactaggattgtgcattaatgcaaagctgttttctttgggatagcacttatttcagaatgagaaaaatcttcccagagaccttgcaaatgcttcaaggtctgggaattctaactctctcttgtttcacaggctagtgcacatagtttatattccttctgtggataaatgtagactatctggtgctctcatctctttcctgcctgcccagagatcacctgctagtaggcactacccgtcctggattgcctcaccacgatttgcttcacccgtctcaggggtgtcctgaacttcagtgtgacaaacttcaggatgtatgttaagtgcatctgtgcacctcttagtgaaggacatttgcaggatgttggagatctgtggctggaagattagcaggtcagaagctagctcaagtgggcaactggatagtggcagatgggtttacattcaatccagatgaaatcccagagggcatttgggttaaccctcagcaatggctggatggtaactctgtcgtgtttctccacctttgacacctagttttgccatcagatggttgtgagtttagggacaaaggaacctggagagaggagtagactttctttttctctcctcagagtctcagagaaatgacctccctgctcctgcaatggactatgccccactttaactgtgccgaggctggatgctttgccaaaggctttccttgtttgttccattgatgaccacagttctccagatcttgacctagttgctaaatccctgtgctgatcaaaaatgttcccactactgagggcagatgatatacattcatgatacaagcacataaactccagagggatagtgccaataggagcatatttctggtctcctagcatcttgattattcagttttaaacttgtttatgctcatatttctgatgtttttcttcccatggttttcattaacaaaaaataatctgttttgctgttgtttgctttgagtaactgagaggactgtggactgagagaaatttaaaatgttcctttctaaaaaaccgtacatgaacttgatattcaggctctcctagatgttcattttaatctataagaagctgtgtttatgattctgtcataccagagtgagtcccctcttttctctacttccatagctcttgttgtctgtaccagtcattggcaattaattatatactgccttgtggcatgataatttcagtttgtgtgtctttatatcattgatgtaagtggactcggatccttgagggagagaattgagtgtcatgcttctttgtttcctctctaacaccgagcagaatgctatatgcatagtcggctgtcaaacaatatttgctgaatgatccaccacacagaatttcttaatgcctctgcataatggtcccagagataatgttgcataaaaagagacaatattcttcccagtattaaaatattcggtgaaatgccacaatagtgatgtttcaaaggtctgcagattaaatgtttcagggaatgtaaattggctattgggctattggcatgtgtgtgtgtggcagtgggaggggtgtgtgtgtgtgtatgtgtgtgtgcccatgtacatgtgtaatgttcctgtgtgcgtgagccccattgctttcatcttgaattttggagccctctgtcagtccctctgattgaggaaggaggatgctggctgggtaatggatgtcttgctctagctggcaaggcagtaatgcttcaactggaaaatcattaaatcccagatttcagcctgtctctctgccacctctcatcagcagcaaatctgctttaacagctaagaattcccttatctctccgtgagtgtggaccatgtgctgctgctctctgtagatgggagatagagctgcatcattacgcgggggtgacaaggatgtaatttacaggctcaatcagttctagttaccatgtaattacagagttattacatggtcatttgttcctgatggacaccagtgatctcttatcctgttctactgtggtctgtttcttgtcttatgctactaaggatatttagtttcttctgcatggcgtgttaaatggtgtactagggaggaaggacagaaacgagttgggataagatgttgattatgctgtgatgctatttgttctcctcaattggcctggtgataataacagcatgctgtggctttcctcccctaggctccaagttcacattttcttcataagagagactggagacaatattgtacttggcagcatgggggaaattgggtgtaaggaatattctgacccattccactcagcgaggagatgacaatatcaaccccaagattatgtcactgcctcttgtaatttgaagctcatgttaatgcagtggctgttggagaaaaattcctttttataatgaaaaaggagagggaaccatttaagtgtgtaattcagtatcagggagaaatgatgagaaggttcagtaacctgcccaatgtcaccaagcgaatggtgtatctgggacacaaatgacagagcttggccccctccactctaactcatttcagtgaattcctgtcattaggaggcaacacacttttaatagcacaagtactggaaaccatgtggagaaatctgaatattccctcatatttgcttgaatgacctgggataagctcctttcttaactccttgtttttattaattaagaattgatgtgtgtgataccatgacacattctgaagatgtctaacataggtggattcctaatccttgggaaatggactgaagggccatgtgtcttgctattagaaagtgtggcatccatatggtgctgtgggtggtatcctggggtcagcactgaatgcacgtcaggagacctgagtcctgtctcagtgtttccactgagttgtgtgattcacagtctgctactctgcctgcttaggagtcagtttccttctccagatgctatagtttggatgtttgatctctgcaaacctctgctgaagtttgatccctgatgttggaggtagggcctaatagaaggtgtttggaccaccgggatggatccctcatgaatagattaatgcttcctcttggggggtgagtgagctcttgctctgttagttgctatgagatctgcttgtggaaaagagcctggtaagagagagggggagcccttctctctcttgcttcctctctcccctgtgatttctgcacatgccggctcccttcacctcagccatgaggggaagcagcctgaggccctcactgccacgcttcttgtgctgcctgcagtaccatgagccaaataaaccttttttcattataatccatcttgggtattcttttatagcaacactaaatggactgagacactggacaatagtcaaataggccagacaattgctgaagtcctctccagctgaccatcgtctgtgactccatgatttaagttgacctgcgagaagagtcagaaagcactgtggtatcattaaggctgaaaaacagaggtcatgggatgaggatattcagtgttgttatcagagaagcttcttcccactgggagccagaaaggtgcttgcatgccctctctgcatttcagttgatggaatgctgtgagtcattaacacgctctcctacttccctccaatgaaaacaccttgctgatttaattaaaatacatttttttcttcttttggatgtctttgaaaatggcactaattataacatagctgctatgtaactaatatgtgcaggtaatattgtgattatatatagacagccatatgctactatgcagccagtctcattgctgttaaactgctgaagcagataactccatgtccgtgcacacaaagtaattgcaccaaactaatttgtgtttgcaaacagatcctaaattaactatgtaaataggcagatctgcaaacaaaatattagaccgtgcatgtgtgcacacacatggggcagagaggaagtggtttttcacctgcttgaaagatgtcacaggactggggcttgcctgtggcatgtgttgccttgtgggcctcttggtcccacctagctcctgtcttgcattagtaagtctgagttattctgttccgacacaggtgactgaaggcaacctgaatttgttttctctaggggtaaagggttatcttgatcaatccacctttcttgatggtgctcgctgccctcatgcattctttgaccaaagatatttccaagacagctggccccggctgtgtgttgtatgtggagtggagatgttcttaatgcagagaagttcacgggtgtgattgaggacagtttggttcctcggcttgcaattgttagtgcccggaggagtgtgtgatcctttgagtctagcagggctgtttgaaatctggttccaccttgggcaagtcacatatcctttctaaggctcagtttccctgactgtaaagagggggtgagattggagtttcctcctggggctgtttagaggattaagtgagcaagtgtgcgtgtgtagcgtttagcacattggatccgtgttcagtcaacccttgctgctgttgctgcacttactgatgttgtcacccctggcagaccagcacgcttccctgtgggccctggcaacagtgtgctgactgcttgcatggatattccaggtgaggaggtcagcctcaaagaagaaagcccactttaatcaggcaagttgggccccaaaggacgtctcgcctgtctgccttcctcacgtccctgtgtccctccgtccctcctgcactcagcgtctccctctccttcagcgtggagcctgtggtctccacctccacaatgctctacttagacctctgctcttccatttcccaacatgcttcttgtgttgtaaaccttactctccccaggcttattctctcaagtcttgctccgtgtctgagtggttatttgagtgagggcaccagtcgggtacagcagccacactggtgtccatggggtgtttgtgccaggtaatccctctgtccagaacactctgcccagggagatgggtgaggcccggccctttgggctttgaggtctgtgctccaaccttgccttctccagcagcactgcctcccacccaattggaccgcagttggccccactcccactctccattcttcttaccctgtcctatttttcctttgtttcatagccaacctcaccttctaatattttgtgcgcttgacttatgtattgcttactgcctgttactccctgcttgcttgtaagttccttgaaagcagggccttttgttcattaatgtttgtcaaagatctcagcctgagtctgtgctaggaaggcccctcataattttttttttttttttttttttagaaagacagggtcttacaatgatgctcaggctggccttaaactcttaggctcaagcgattgctgtaattgtgaatctgtttcctgtctggattcttttgctttcactctcagaagccaacagacttcaatgggaaggacctgagggccaggaagaggagtggagaaaccttcgcagaggtggtcagaggacaagcaattcagggaccagatgaggctgggaacttaatgggcagagaggcccaaagggggcctgaactggaggaaacagaggcaggcaccaaggcaggtgtgtgggaataagacagcagcaggaatgtgcgagtcaactccatgctcatattgcagatgtaaccaagtgacttactttctctctctgcggcgcagtttccgcaccagtaaatcaccatgaaatctaccatattcacctcatcgagaatttgtgagcgtcaactaagataaccacctgaaagtcattcccaaagcagatattacttttttttttggagacagagtctcgctctgtcacccaggctggagtgcagtggcgtgatcttggctcactgcagcctctgcctcccaggttcaagcaattatcctgcctcagcctccctctggagtagctgggactacagatgcatgctaccacgtccagctaattttttgtgtttttattagagacgagatgggggtttcaccatgttgccccggctggtctcgaactctgagctcaggcagagttctgcctcccaaagtagtaggattccacccgcctctgcctcccaaagtagtaggattacagacgtgagccactttaaatattatagttgcttattattatttctgtttgtatctcagtttactagtctgggaaatgggccctagcaagaatggccattaactagaatggaggtaaagtgggaagtatgatggatatttctgaaggattctaagacaccattgaaagctgcatgcaccaagaaatggggcagtttgggtgacacatttcaggagaagagctttcactttcctcagcacacctgaaggcatttcttatttcattaacctaagattaggaacagccccatgacaaaaaatgttggcaatattgatatgaacaaataattaatcccaggtgctacctgctttctcccaggtccccctgtgatccttctccttatgctaaggggtcttgttcccactcccatccccaggcttagggagttgtggacaggacagtctattataacacttatagccattaaaatgtgagaacaaagcccgctctgctctcctgttttttaacctctttgctgaagcataacttctgtcaataggtgacctaattaacctgttcaagtcttgaggatttttatctgtgcatgttctttgatttcagattaggattctcaacatcagttcaccactagctagctatgtgaccatgaacaagttgcctgacactcaatgtccttattggtttaaaaaagggggtcatagctagctccacggtgttatgaagattaaattagttaatatttgcagaagtacctaagacaattcctggcatccagtagatgtccagtaaattttagttttgtcctttgttcctaaaataagcatgctggagtcttcaataccccacatttaaaaagaactgttgcagttacatttttctggattggaagctttctttgtgtgaaatacacgtatcacctgtacctttttgttatttttgctctgcctttttgtttgtgtgtgggtgtgtgtgtgtgagagagagagagagatagatagagagagagagagagagagagagagaaagtgagaagtggtttgttttggggatatcatttttgttcctttttgttgttgttttttaaatttgtaagcaaggtgatggaaaaaaccagaggagaagccaagtgtatctgaagacaagaatgtggaagtgaagaatgtttatgagactcactctaacatgctgatagcaaaggacttttgttcatcagattccctcacatgtattcagaattaaccttaagcacatttagtcagtcatacattttatttttgtctctgggcattaatgtgctgacttgtgggattattaaactataattccccaagatatatttctgtctctcagtgggtatgaacgtgcaatcattagcaaatccaatatttaggagtctttcttctctctccacggtaaatgggagcagaggaaggatcatggctgatgacagcatctgggtcagacagcccccagtactgctgagttgctgggcagtcctgaatgatagtggaatgactgtggcctttggaagcataagacatgaggcttgcttctggctctcacgtttactagcagtgtgactttcagcaagtcactgacccacactgaggcttagtttcctcataggtaaaatggggagaatacctgtcatattgagaaggtcaaataagtgtcatgtattagtatattaatgagctgtgaaacaatgactattgttatatgttgttagtggtgttgagttatcacttagatttccaacctgaggattgagtaccaggattgtaagctaattatcctgaaggcctggcattctattgaacttgttaaatttatgactgtgtattgttttaaatgagtaagcagtaggttgccacaatgtaatctcccttttatacttcaaattgcaggtgcatgtctacacgttttcctctagacccaaaatgaggaatgcatttgggtcagaatctagaggaggtgttttgctttgatcatagatgccaaatagcagcccctcgttcctgttctgtgagagctgtgccccatgtatcagtagaagaatggccccatttctagagcagctatggctactgggactggaaatgcccaagggatgtttatacttcctgctggtcaatcagatctttgtatgggctccagatgtgttgctgaagaggaaaaatttgaccaaacaaaaacaaaacaaaaagctgatgtgagcccaaccttttcaatgtcccagatgctgggattttccacagcatcactcttttcaatgagtgcctttaatgctatgctgaaatctccctggacacctccagtgaaaaggctctcgctgttgggcactgccattgtctgcctccaagaagacaaagagcctttgagcttagagctgggaacacaaaattgggtatgagatgggtcctgccatcagaagctcgcagacatcatggtcagaaatacctgttcacaatgttctgtcacagtcaagtattgtacagaccatataaggcagggtagaatagataggatacacaaagctagattacttttttaattaaacaattatttatgcaacatctgctatgacattgtatataatgtctgccatccccattacatcaaatctccataaagacagtatctcttgttcatcttatatccctggtttgtaggactctatctggtatatagttggtgcacaaaataaatattttagagccatatttcattttctgagcttattactgttgatttatgcctctgttacataagtggaagtatgaagaggccttgattaaagtggaatacattgtagaggcaggggcagttcttatgatgctgtagcataaaattgcaattgaggaatcctattccatcattctaatggccaagggatgggtagaagacattgctttttggtcgtagctgaggaatcctaggtttagtctcacattcttgctactgcttagctttggttagtctttctgcaagctcctacatggtcactaaggacctgagcttggttttaagatttgacctaattcttcatccttcaagcaatatgtgttctggttaatgagtttgtcagaagcaaaatgaacaattctaaccacctgtcccttaacaaaggccactttaacaaatgtgagccatgtgcatttcagctaagatgagggagggtgctttcagccaactgtcaagagctcatcaagccccttcctgcatcctctgtcactgtacaattattgaagtccagggagtagcaaagcaagagacctgggtgcacgttggccccacatggagccacagactctgactcagccagtttttacagattgttgatttgggttcagttatagtttctgcaagattggaaagtggtcacccgttatggctcttggccactgcttctgggtcatctcaagcacattattcaagtattctcttcagaatgagctggcagacgcaaacaagccacagcatcaggcttcatgggaagtctggggacttaccattgtcgagtagtatcaggtggtgtctggaggggagaggagagaggtaagattgaaaattcaaagaatacagagttttggtggtatgaaatatatcatctggaaaatgtcactttgtcctgagaaccattctcctggttaaagaaggcccaatcttgggataaatggcattactgccatctcagcattttaagaagacagacaccaactatgtgtgtgtgtgtgtgtgtgtgtgtgtgtgtgtgtatgggtatgtgtatgtgtgtgtatatatgtgtgtatgtgtgtatatgtgtatgggtatgtgtgtatgtgtgtgtatgtgtatgtgtttgtgtgtatgtgtgtatgtatatgtgtgtatgtgtatgtgtgtgtatatatgtgtgtgtgtatgtgcgtgtgtgtgtgtgtgtgcttatgtgcatgtgtatgtgtgtgtgttatcatttaaatgggtcttatgcactacctaccacaaggtcattctataacttgtggcacttcagtctcaataacctctgccaataacagggctcaagtgataataagtttgcctgtgtgactctttctttcatgcaaatataaggcatttgtatgttacggcttaccttttccctgcaatacctggaaatcagagtcagtgagacactgtgtgttttagagttgggaaatctgaggccaaaaagaaaaataaattgtagaattcagtagatgtgtctgttcaagaggaggacccctcttctgaatttcctcatccagtagcacctctttgtggatcttctcatgagtccatatattttcttatttccatgttcctgaggtggccgacaactgagggaagcaacaagctgccccattgctatcatgggtgtgataggaacgagcctccacattgggaccttcgccagtgcatgtcctctagtgacattttatccctgagctcccagtgcttttcccgagcacaactccatgggacactgcctagtggaagagaccacagcgggatgaaggaagaactagaaaatctagacgaaatggataaattcctggacacaggcaccctcccgagactgaaccaggaagaaattgaatccttgaatagaccaataacgagttctgaaattgagacagaaataaatagcctaccgaccaaaaaaagcctagcaccagacagattcacagctgatttccagaggtacaaagaagagatagtaccattcctattgaaaatattccaaaaaattgaaaagaaggggacttctccctaactcattatatgaggccagcattagcctgataccaaaatctggtagagatacaacaaaaaaagaaaatgtcaggccaatatccttgatgaacatcaatgcaaaaatcctcagtaacagcgttagtgtttcatatcaggctgtctgttgcgttctgtttattattgggatacagtgcttttgtgataagcagttacacatctctttgtacttgttaaagggttaagtgctggcagttctgggaggcaactgccatttaaaggaagtagaataaaagatgatgttgagaaggaagtgaaatggagaaggaagaggtcagaggaatgagggggagaagctgggagtaaaggagcctgcccttacaaatgtattggtaattaggctgtgctctttaaaaattaataacatttttcccattgattattctacatgtagagatatctgaagttattatttttgtgtattcccttatattcggcttcttttacaaacatactagtatggtcttccatgcaagtatttatttttcagacacaatatgaatggcaatttaatattctagttcatgattcatccaccattttcttaggtttaatccaaccagaaaggtacgggatatacttagctcccaaatatgagtacagctagatcagagacagggtttcctcaaagcacgtttctcagcatcagtcaatagcagcggggttgaggttttcctttctggactcttcctttttcccacggcacagcacgtgggacatggcagccatatatgtcggtgttcctggctgactttcttagagaccctggaactggtgacccttttctctgagctctttctgagcttcttccatctctggaaatctgtccgaggatctggagcagtgttgttttggatgggaaagtaaacaatgagtgaatactgctattctcgttctgcataggttgtgtgtaaaaatagagttgcttatataaagactccaaaatggaattttatctgtgcatttctgtgtcatcccttccccttttagactataaccatccaaactgtatgacctcgagtgagttactcaacatattcaagcctcaatttctgcaaaatggggataataatagtgcttacttcctaggatggtaatgaggattaaataagataagtaaagtaatatgcgtgaagtgctcagcacagactggaccagtgtgtgcacagctaatgctgacagttcatgctattttgtcattattgctatcatcctgagctcttccacaagacaaaccatattgtatttattttttgttgaaggcattcaatagatatttgttaaattgaactaactgttttaagtaaaaataaataagaaaaaggaaaagaaaaaaaaaaacccacccctttacataacaacacagcaattctactggccaatggggaaatcatacatctttactgctgtgagttattatactctctgaataaacataagcctttcatatgacctaatgattaatggcttatgcaaagaaattttaatgccattaataaaaaattaagcagcaagcttcccccacttttttgacagtgtcaggctttcacctgttctcctggggacaacaggtttccgggaacatgctgagtacagataatagatcattcccaggcgacactcccctgtgtgcctcatgtcttcctgggcagcatgtaggatggatacaaggcactctttagagaaaggcaaggggtctttgtggtgaggaacagagatcacagctgagcactggctttatctatctatctgtctgtctatctatctaactatctatctactgtttatctatctaccatatatctatcatctatttataaatcatcaatctatctgttatctatctatcacctggttattctctcatattgagtatttattctgtgtcaggaattacattaagatcttattcagtcctcatagcagccctaggaatttcaaagttaatctccgttttacccatggaaccctgggctcagagatcatttcctgttcatggtcatatggtgactgaaacacagatctgggattggaatgtaggtctgtctatttcccaagtgtttccttatccttctttgcctccatccagtcttctgtgcccccatgggctgggatctgacataggtatcattcattctaagaagaatgagcaggattctgacactgaatgctccagaagggaagtttatccttttaactaaatactctttcagtgttgaggtcaaatttcacacaaagtctccaggccagcctgatgctgaattctgaatatcccttatgaatattttgtcctattaactaaatagtctttcagtgttgaggtcaaatttcaagcaaaggctccaggccagcctgatgctgactcctgagtatctctcttgaatacattgtctctaagcctttggtcagctgtgcttccaattcaaatgccagttttcttcaaaggattgatctcagcacctcttatttattttgaagcaaaagctccacattttcaaaactgggattcctggtctgcgaggcaggggagtcagctagagcctggtcatcactggcattctgagcagatagcagcctcctagccatagctctgttcttgacccggtggccaggcagggcagtttgcaagctcagctacagacacatgccctccacaggcctccttcctcttaggccccactgtttttccacataacttttctgagtctgagagaagaaaactggttttctctaaatcaagagtagggtcctcatttaggaaagccagaattttctgtcttacgtatcatattacatccttgacctgtgtgagacctcctgttgaggtcaaagttgggtggacgacccgcttgacatctcagtgtggagctggattgcccttcaatccctaatgccctcactttctacccaacttagcatttcacttgtaattagttcctattaacttttttttttttatatagctgagtatgtctgcgtgtgtacatgggctcatgcttgcatgcctgctctgcttagctatgtttaaactgttagaaagaagagaccattccttttttatgtgtcttttggatgagctcaaaatctaggggtatatagaagaacttcagatcacactgctgcctgaccaatccctggggatcctctctgctgccaaatgtgaaggaacgcattgttagacagcaataccccccatgccgccacctcctccctcccttcagcggcaaagcagagcccaagagcctcctgcaaagagagaaaacagattatattttgtagtttgtaaagatctctgggtccacacgatcaatacatttctggtccctgtgtggggaattgttaagtcattctttagcaccaagaatagaggggccagtacttcctggggactaacaggacaaccatgacagccactgaagcttttcttgtgttcacctctggaaacaggaaaagaacagattcttctcacccttcagagtgcaaagggttctgcatttcttgtcataattccggagtctatctgaagccttgtgtgagaaagtagtgtgaacacggttgatgtttgtgtcaagatacaaccacagtggctcagggacccagaagttgagaatcccagcacaggtcagcctggtctcagcattctcattctgacatcctcaaaacagacagacacccccaaccaaaacccagcaatatcgacaacaagaacacaaaactaacaaaaacaccagaactacagagctgtttttcttttcttttttctttttttttttttttttttatagcagctattacatgaaaaccgtgtactctttccttctgcacctatttgtgcacggtgctggatcggggcttctgaagagtcggcccttaccctgtaggagattcaaggctgactgacctgagagagaaggacttctgcattgctgctcaggatttttgtttttatttttctgttaattatgagcccagaaaaagggaatttcgatttttcagatatgaccaggtcataggaaatgcaattgaagggaaatataattggagggagatgtagcctcctgactttgaggccacacacctcacatacctgaggacaagaaacaaaagaggaaatcagacacatctgacaaaagtgagacggatagagcataaagtatgtctgaaaacagcaacaacaagaacacttcctccaagtgacccctggaggaagacacccccaggcggcccaggcatggagactgtgagactcacatctacagggcacacttcctaggagaaaggcaagggcacattcccccttcatgctatggggctggccgcacctgaggagggagccacaccctttcatccatgccagtctcctccctggaagagaggctaggctggggcaggggtgcggttgtgaggctgaagagcagccaggaggaaacccttctagtgagcagaggatcagctcctccaacacacactggctctggggtctcttgcaggggttgtcagtgagaggtgagcgcccttggctgtgagctgggagttatcagcatggctggagatgagatacacattgctccatcaccctcacctgggaccaggttttgcctatctcaatggcagcgtgactggtgggatgtgacacctctggggaagaggaccaatgctgtgttcagccatgggtgcagggtgggaaaacctgatgggggaaaagacaaagcaaggagggacatttcagtctagctcagtcatgaggatggccaccaaggtttttgccggtcagacatgtctctgatttgatggaggaggagccactttctagggaaaactgatgtctcatttttgagagtctcctttgctgggtggggggcccttccaacagtttttgatacacaaagatctgcagcctcctgagcaggtgattctgaaagatgcagtgtctctctcccagctttcccactgacctttactgaatttcagacttaggctatcccaaaaggcagtcggaaatttgctcagtggcatttacctaactgaggccactggcagcatgacacagttgggtgactttagggtttagagagaaaatgctggcaggggactggggaagggagaagggtgaggtaggagggatgagcttctctttctcgtattgctatgcgttgctgaaaggcaagctaatagttacccagccagggtcaagcagctggagagggaagttagagaaattcacagccagggccctgagagcagcctgggagcacagctctgtcctgcagcagcagaaccttccatggctggtcctcagagccctgtgaaccagcccacccctacgaggattttcttgctctggaaattcctgaaattgattcctaacaaagttggggggaaaggggctgggcaaatgatttttttgtatagcaggcactgtgttcactgtggggaaagagagaaactgcccctgccttcacagatcttaccatgaagtggggagacaggcgaaaacatgcaattacacaaataatggcttccaattgagatctgtacttccaaggagaggtgcgtgctctgagagggtttatggcggcaaagcctagattggggcatctggaagctccatgaggatgaaaaggaggcagctagggaagggcaagatagagaactgcctgtgagcaaaaggtgcccaggccaccagatgtggggcacacagacacctgcagggccagtgtgtcgagagcagaggcagaggcggagcttgcagggctggctggtgtctcttctcttttggccttatttgcctgcttctggcagttttcttttcatacttacatgtcttgcctccagccttgtctggttcttcttctgcataactatgcctgccttgtaataggaacttgataaagaggacttgatgaaatctgagccctgcagcaagtcgggggtggtggaaaggatgtcttggtgccagtgggttggctgaccttggtaaagacagatgccttgctccttggttaaggattttccctgtggagtcagatacatgtcagtttgaattgtaaccctgtgactttggtcgagtaacttaatctctcaaagtctcagtcacactggtggaaaaatacagatagtgcctacctttatttatttgtaacatatgacgatgatttttttttatgccagacaccgttctgactgcttcacagatattagctcatttaatccttagagtaaccctgtgaagcaggtaccattattatcctgattttataaatgagaaaactgaggccctgagagattatgacatgactactctgtgttaaagtcagggttcagaatgatggaatctggatcttgaatccgcagtctcaactgcttatatttttcttatattttcactccgtgtgggttctggaattgctgggataccaagtgtctacagtgaccaggagggaaggaagtaagatttttggccacagggagccttatccttcttggcatatcacttaatattttcctgtgtctccagtcccccaggctccgactgcctggaccagcagcccctaatgatggtcaggctgacaagctgctggcaggactggcacaggatgccaagagccccctcctccccaggaggaccccttagacagcagtgtcagtagaatgctggctaagccctggccactcctcactgctcatctaactactccgtctacagttctgatccggaatgtgaggaacaaagccatatgtgagctttatcaagtgctgagtctatttcagaaaagactgtggagaatgcatcaaagctggttgcttattgcaccatgatccctgaagattggatccagttctgtggaagctggcagaataatgggcccagactgaccagtgagctcactgagggatgttactagttggtccattgctcatctgccaggtcagagacaggtgggaggcaagagaactaattaaattggcagtggacattttacctctaaaatgtagggcaaaaaaaattgcaaacaggccttttatatagaagctaattattaaaggaaagtaaaaatattggggtgttaaagaaatatgtgactggtttagaaaatcctcaacagatatttatcccaaggagggagatttacaaagccaaatttgctcttaatccttaatccacaaagctgtgatcccacaatttcaccaggaataactgacatgaatgctaattggaactctccctttttcccttcctcctttttatgttcttggacaccagcattccggcattctctctaagtttgggagtcctggtctatttccccccttagacagtgatgtttgagtaccactacccaccactcttttggcattcatagtgtaaatggcactttatcagttgaaaatgtgaatcctgtcaacagcccccagctctgccatgcttatcagggcaaggaagagggagagtgagattcagagagatgtactccaccctgttcattccagaagagtgatagataataacattttccggcaagaaacagcaggaaatctaacagacaggaattaaggcaccaaatgggaaagtcaattgcttattcgctccaagttttgtatttgaagggaatgttatttgatttggggattccctcattctccctttcttttttctagggggcaagtggaatagtagaatcaattatctcttcacaaacgtattttccaggctcactgtgtgtgtgtgtgtgtgtgtgtgtgtgtgtaaatgctcatttaaccttttagtaatgtttcacaaacatatatttctcaattatgtcaaagctccccataagtaaaagaaggaatccctggatttttttttctcatggtgtctcttgtcactctaaaatggacctaaactaagaggtagaataacaataatgaaacaacaacaacaaaatactgcttttgtagtgctacccatcttgtttgtacagtgtttgatagctttccactgcattttccttgcatttcatcaacctcactagttgctgtggtataccgatcacaacaaaaatgatgagcatctcagccctgggcatgcatgattcagcataatgcttgcaatggccttatcagggggtagctgtcattgtcctcctttaccaatgaagacacaggcttagagagattgagtaatgtgtccaaggtcacccacctgacaagtgatggagatgagatttgatccgaggcttacccgatgccagggcctgaccaggtaaaatggtcattctttcggtgacagaattgaggcagaggacttgtgaggtcacccatagatgaagaacggatccaggcacagaactctggtcttgttaattctcacagctgctcttcttacctcaccaaggctaggagaaaagagcatctagtcaccaaacaaactcatgctacagagactctctagtctctttcataatgcaaaggaaaagaattctgaaattctataccaagctgttaggtgttttccttggattggggaatgtagagggattaatgaggacaggaggcagaccttatcagggtgaaataacatgaaaaaatgaggatgaactactctttcttcatctactacccaacctctcaaataaatttcttgcaaaattaagtgaattcttgcttcaaatactcaaatagaggatttatcttgtttgttccatcttgtgtgatgaatccaggtgttttctaaagcagaaggcacttaatgtaggttctttatttttttgtgctgattaccctaattggtgggtttccttccaggatcagcagccaattctccactagagtagtatcactggaccttagggtctatttacagtagcagatgtagtggtcacccaataaaaaagtcgctgggtgcggtggctgacaactgtaatcccggcactttgggaggccagggtgggcggatctcttgagcccaggagttcaagaccagcctgatcaacgtggtgaaatctcatctatactaaaaatacaaaatttgccagatgtggtgacacacgtctatagtcccagctactccagaggctgaggcaggagaatcacttgagcctgagaggtagaggttgcagtgagtcaagattatgccacggtactccagcctgggcaaaagagtgagactgtctcaaagaaaaacaaacaaaataaatcaaaatattgtttccacagtgcagttttagcctgctgtctcaaaagggcctgagatttgctatatagccaagctgtgtggactccacaggagactcaggattagcaccttagagtcttgactgggttttcttctttaaacgaagctgtagatttagctataatgccatttgtctgcgcttactactggatgggcacagtggattctgattcgtagtcctattcagtgaaaatagccaaatcattgtgaatacactttaatgtgaaatccttcttctgaagagcccagagcaaattcccatgttagggagaggcagatggatggaggcagagttagctctcaatgagttaaaggaatgtcagcatcttcttgactatactggtagctggtagaatagagtgtattccatattgtaaatatagaatacagtcaatctagacccaaagaaagagaaaggaggggcagcaggggatatactaacttatgaacttgagatttataagcattatcaatcttgaattgaaaaagtgaatctcttgagggagtactggtggcattccaaaagctaacccaagtatccatctagtttatagcaaatctaggcacataattcccttagatgatggaattgagatggaggacatggaaaatgatcagacacccttcctgcctggagtgtagctcagaatgaattatctgtggttaagggaggggtcaagggaggaaacggtggtactggtgaggcattccaagggcttggtgtgaggttgcagtaggaagtggattccagcttttgaaaaccactgttacatctacattgccagcagaaagctgaatgcctacatggcattggaatggagtgaggcagattgcaaaggatggggctggccttgaggttggatcatatgtggctgtttctttgactgtcaatcttcattcttaaatcttctcacttgaacaccttttattggcactaaatttgttttaggataatgaacgcagctgttccaattatggtgctcaccccactcacctccatgtttcacctctcaaagacactgcctctcccttgggactagccctgagcatggtgaggccggcatgcccagggctgaggctggcacttggagagccctagcgtcagaggggttaacacattatctgggcatactcaaatagtatgagcccatcaaataaacaaacacaccaacttgcaaatgaatagaaacatgtttattagagtagaggaaaaacagctttttggcacattaaccctgtggcatcaggagtggcagctgcagcctgggacgacaggcagggaggaggagacagtaaacgtgcattttgaaagtgcttaacatcaggagagggtatttccaagcaaagaggtgtgtgtgcgtgtgcatgtgtgtgtgagagagagagagagcgagagtgagagagagagacagagagagagagagagaaccatcaaagcagtacaaaggccaggaggcagtggtagtgtgcacataagacctaggaggatgtgggtttgaatcccgtctctttcaggaattgggtggccttgggccctgtgcctctctgagcttctgtctccacacagttctcttataatctgtccttggcaggcttgtaagtgaagatcatatgagatgacctgttttaagcatctagcacagaactcggcactcagaagctgctggataaatgccactcctcactgtagttctacgttagaatattccaagttttccatggttcctgaggaggaaggcagctgtgtgttcaggtagaaaagtatgaggtgtgggacagtgggaaattctcatgagcaggtttcaattgaggaataattcatttttgcagtaggcagattaattggaaatgataaactcctcccattgtaaaattaagaattaaaagtgtttatttttattcagtaaataccaaaccatgactgtagtatacttgtattccaaactttgatgatttaaaaagggaagagagaaggagggtgaagggaggagagagagagaatggctatgagaaagagagcaagactacattctgagttcctacacgtcatcccctatccccaaaatagcagctccacttgtatacattgataaattttcaatgtagcagttcattggcagagagatgtccaatacctaaaaatagcttgatagctcctagcatagatcatctgccatatcacctgatatttcatcttccccactaaaatgtaagctccctgaaggcagagattaataatgcatataggaggtaatctttgatatttaggatgaggcaatgaatacatgaatgaatacgtcaatgaatgaattaatcaatgaatggagagacaaggagaatcagactctcttggactcagggaatcttatatctttgaacactaaaattatgcttctgtcttttcttgctcttctcaacccaccttgcctgacagtttgttacattgtcaaactctgtcatttcttcatttagcctgcccctatttcactgttagccaaattcttacacccacagagatgatcctcaacctttgtatgttcaactcttgcacagtccacaaatcccccagtgcactccacggaaaccactttgcaaatgccaagcctagccttgtgtgtcgccttgatgaatgagtcaccaccagctgtgctgcccaccagacagcttcttggttccaggggcgccgcctgctttgtcgtatagcagtgttagtacgattgtttgaatacttcactgcattcttcccccacagaaaaatgaaagtgctgataccagtgataaaaaacataggtttcataaacttaacacaattgaggcaaagatggaaatcatttggcgtgcaaaaaagagcaaatgtttagcctcaatcgggtgcttatcatacttgagctatctgattgtgtgctcagctgtaaaggaaaagaaaaaagaaaagaaagagaacagacacaatgcagtaaatattgtcagagattaagtctaaaatatacggtgtattttggattttttttttttaggtttctagaaatgcagatataaatctagttcgttttcactctcaggcatgttttagcaatgtgatgtggtagtgcaaaaacttcttccctgattttcttgtcctactttgtcaaacagattcagctgtgtgtttatattttcaagaattgtagtaatgtcctttcagttgcctagtttttaagaaaacatctttgaaaataaatacttgcaatttttcctactcctcccaacatgagtgtccaccacgagtcccctttcgccaaacacttcatgttcctctgagctgtgctgccccttcctttcctctgtacttctgcatccttagtgttttctcttgaatcctgtcttctccttcatggtctctggaggggacactgcagatgcttaatttgtgaggggaatcacacaaacatagtagaccctaaagaaacatcttagttggattttgaagtgggcctagactccgcgtgtttttttctcaacatctttctttcccttactcaaaatatcctgcagctggggacttctctcactggcgctgttggttgttttttggtttgtttgtgcctcatcagcttcctctacctcattttgtgatcattttgacctaagaccattgcccagtggcttctcatttccaagatctctacttgggtcctttttcacaagtctgtgcttgtctcataactcctagccttgttcatgactgaaatatttttttatctctctgtggacatgaaacctacatatacagtcctattctcctttccctgttagctctgatccctctgatttgagttgttctgtctgttgagcctcttttattttgtttctttatttgatgttcatggtggcgttctttgtgaaatgtttggtgattctggattgaacccatctctgtaacgctgaatgaccatttgtctgcttgttgcctgtccttgcattctgatggaggaagtgggcgggaggtgctgctgctggaatgtgtgctggtttcggtaaaaatggggaaggcgtggaatgtgctatggggcagtgctctggtcctggctgtggtgagtccttgatcctcccaatgtcacctgccttgagaactctgccctgcgaagcggattaagtctccttcctagccttaagccatgcactccatgtctttctgtttggtgtagagatttagcctttctgacttctcccactgcaatgagatgactaatgctgtgttgcttccaaccatctcgagactttcatccccctcttgacatgggcacttgccatggttggttctctctgcttgctatctttcagggattattcaagttcctattcttagtatgtttctcttcccttattttgtgtgggtttggctggggcagggagttcagaaaggaagagaagattttatttagcaagccacctaaaacaggaagttgccttcttcgctgagtctgagacatactgacttccagaacatcacgaaaccaataggatcacagcccagggcctgaatcctcttgtttgaaccttgttgtagatgcacaacctgtgcatttcaaacgtaggaagcagggtgcacagtgggtacttgctctatattgaatgaaattaagccaatgtttcccacaatgtgtgtgatagatattgtgaaaatgtgaagtagaggaggagtgagagggaattcagtgtgctggtggtatcaagcgtgcaaactctgtttaagaactcctttcacaaaagttttaagattatcctttctagcttaaaaaaccaatatagacagaaaagaaaccccactctggtgctttctcccttcttccattcctgccttgaccatcccttcttcctcatagcctagaagcagcctctgggcctccaccttcccttttggttgtcccctcaccctagtctaacacttgcctctttgtagagaggagcttgtcggacacatgggattcacgggccaggtggttcagcagcccaacaacctggatcctcctcaccctcctctcctcatggccagcccagctcagggccgcctctgagagtctggcctccacaaaggaagatgaaatgtagagacgcatttgctgcctccaagtaacagtgcttcaggtgtttacctttcctcaagtcatagaactagagagcagggcgaggccttagggactgtctgttgaccgattgacacattctttgtattttgaaatgaagaaactgaccctaaacccgtcaagtgactttcccagtaagtgtgtggtaccggctgaactcaagttcagatcctaggttagcagtcctataaattgagaaacagaacctcactactcaagccaagctgatgtctaccccaaaccaaacatccaagtatgcactggggtaggtgctttgtgaccagttcccatggactccacttgagagcccttcgaatcctcccccgccccacaccaccccccatcaccccctgccacgagctctgcatcagcctcagagcctggtttgtttcttcagggtatttatgtcaaggattcccaaatttgttattcagttctttccccactgattcccagctccattcctcagccacacaccaagctacacagtgcctcatggactcccctcctgcaatgggttctctggagtccctcctgcagccttttgagggaggtgcctatttcttccagattagagaccctcctgtcctctagatacctgtagctctccaggatcccccagcttcctctagacaagctcatatctcaagcagtgtgcatccaggaggggattcttccctccacatgagacataggccccaggttgagtggcagaactgcctcttcaggccaaaacccaggcgtgctgcctcaacacgaagaccacactttggcattatacgtcttcccaaagttacaatacatccaccccctgggcttcgttctagattctttcaacacttaagtgtcttattacaagtctctttcctgtttagggaacgggcaatgaaattgtgtaggcaaggggtgctccgtttacctggtgcattcgaggctgaagacaaggagacattatcctccaaaatacttttttttaaagcaagtctgccctagagtaaagtcttcctaaattttgattgttactgcgctatgaacagaggttgtatccacatttaatggaacatagcagtgagagaaactggaatattggaactgctgtcctccgctgatgaaaggaggttgtaaataacattttgctgttggtaaacacgcacaataaatacagaaatatggagccatgcaaaaaactttcgactctgtcacatgttattggtggaaaccactcatagaaaatcaaacacagactttgacttgcagtcacagaaatagtatactacctggagtttctttaggatttgcaatctctgtgcggttgcaggctctgcttgtgttatcttttcatgagggtctagacctgagtttgcagaatgattcagaaatcagtgtatttcctgcttcatatagtgtgattaatcttttttgattttacatgtctacaaatggtgttagtggtcataactgcaaatgattgtgatttttattggtctagaatgtgaatgtttgtgttagagcatctgcaaaagcaaacacttttgctatgttgaaaaaataatgaagatctaagtgattttaagatggcattttgtgaatgcatgctaaaatgctgctagatttttatttgttttactgttaatgctgcattgaagatatagtagtgctgcagcacaatttttttctatttcttcttttcctttgtccttcaaaaaatacccattctagttgcaatttttgttcaaaaatcaagatagtcacacactaagataagttcactatctaagaagtaaagaaatgtaaaagtaaagcatctcatagcagttatcagctgttttgtgtcatacataaataacattttgcttagcattggcatattttttgtgtacgttctaatagaatggccaataaatcaaagtcatctaaatgtctttatcaacaccttaggtattacactcactgatgtttagcatctttcatattgcaattataaaggtccctcaaaccctggctgataaattattttaggtttcttgtgaagaagggttgtgtttaactattaattttcataccagcttatacctaatagagtgtgtggctaatgaatgtgttaaattaaattgagttagattgaatcaaattgaattgaacagaaataaattgaattgtattgaatgataaaccggagagggataatgcatggtgatctaatagcatctgataataacagaacactgaatttacacgcctaacttaggagatatttgataactcatgagtgggaaaattgcccttctcctatgttcctgggcatccttgccaagtggagatgaatgtcacaggagacctcaggcagttatacagttcaagcatcttctgtatttgtgtggcaggaaattgtgccagaagggtcacaaacctgctttattattctgtatgtcaccaagcaggagctccattttttaaagatttttttaaaaattttcttttgttcagcagcagctggctgtgtgtgggcacttaggaacaagtgatgtgagtgcgtgtgtgtgtgtggatcagatagggggtatcatttgctagttttaattggtagattcaacatcttccactaaccatgcagaagccactggctgaggagttaccatggtaaatcaaactccgctgtgtgattggtagacttctgaagcaggtacagtcactctaatcaactccaggaaagttgaggccatctggttttgcctcacttggaagtaatttaccaccccaggtgcaaaaaatttaccctgaggtcagtaacagtaaacctgcctcaaagatgttccagctgagtatggaagaggagtggtgtgacatagtaatttctgtttgtttttatattttcaagcttgggaaagtgagggggctaatcatgcaagccagagccaagaatagatttggcaggtgctgacccagctagtttcagacagcaaagtgaaaactcctgaagctcattctacagcacttctttaatggtccagttcagaatgtctaactaattgagattttataaaaggaactttgactaagcatcaagttgctgaagaatatgatggaagagataggcttttttttttttatttgagtagtaaggagtgaaattgggaatatttgcaaggaagggaatctttcaacaagacttcactctaaaaaaaataaaagtatgttgggccacaaacattatgcatagctatttaggattgtagatattcttgtaatcagacaggatgtagccagccctaaccaaaatatacacagtgagaagacttcagaatcattagctctttggaatagttagaggaatgtgttcggctcatatgacattgatttgttttggctgcacttgaaatgtgtggtctttgcaagtcaatagaaatgaagtcctttattgaatagtagaaactccatggagtaaattatacaaagaaatggaaggccagggttctcagtctcttgtttatttgtgggagtggataccaggcaggatgggtggggctttcgaaaggaaagctcaggggcttgggagaaaggtcagtgttttagactttttgggctcctagagcaaaataccatagactgggtaggttaaaacaacagacatctctttttcacagctctggaagctatgaagttcaagatcaatgtctcatcaggttctgtgtctggtgagggccctcctcttggtttgcagatggctgtcttctcctgtgtcctcatgtggtagaaggggcaaggggactctcctctcccttttgggagcctctgggaagtctctactctccttacctaattacctccgaaatgctcctcctccaaatacccttgcattggagattaaatttcaatgcatgaatttggggacacaaacatttagcctatggcagtaggaatagcaaagtcagattaacggacagccatggagaaggtcattttggaagctggattcttccagaagtgtgataatcccacaaagctggaaatgggaaggccctgaaaaatcagctggtgtgacttctccgtctattaatgagagggtggaaggccagagggcaatatagataaggaataatcaaaatagtggtggattccaattttacagtaccctgttcagagatgcactgagccagcagagcctgaaaagctactggaatcgtgtgtctccccaccctccggtgccctaattgtgcagttatttcagacttagacttcaatcattttacaagtttaatactgatgtggaaggactgaggtggaattgctctttgtccagattctctttgttctttggctcaagagcagtaaggaatggacagacgtgtccttctttcccctgcctggagagggaacacaattaggaatcctggtatgtgagtctgtctccacttcatctcctctacaaaaagaggcagacatagcacttgtgataagccagctcctctcaccatcttcaccctctctaagcttttagtcaactctccagagagtcagaatctgttaaaacacacttaacatgacccacaaagcaacacaaagttaaggagcagggtgctgtgtactttagcacgtgggcaccacaccattccctctaaaagctaactcaacaagggaaagtgaggagggacatcatgttggaaaagcagtgtgaggaagagaggaggaggcagaaaagcacaagaaggggagatgagagagaaagaaaggaggagagaaaggaagaaaggtaagagtgagtcttttgtgggttgcacactctctttaagaatctgataaaaattctttctttctctggaaaacaaaatgcataggatcacatattgcaaataatttggggttcagaagcccatatatagacttgggtaaggagatctaatctatctatctacctatctatctatcctaacaactgcaatttagcaaagttacatatatatatgtgtatttgtgtgtcagtgtgtatataattgtgaaattgccattaagttaggtacatgttacatgcattgaaatatggaatatatgtcaaacccaatctctcattatccaaaaggtacaagagtgaataatgggaaagaattgagcaaagacacattcaaggtgactgtcagcaatgaagagttaatagtgaggcctcctacaatgtagtgacttctttaagggaagggatttgaagccatgggatttcggatgatttaaaatgagcctcactaaagccctggatcacacagtgcaggaaacaaacctgaaaatagccagagtagcaggcagagaagactaactgatctctactctttgaaccccatggttccagtccatttaattgttcttcaggctaacaacttcactttccataggggaggcagtgtaagtgaccatggcctggggttatgggtcagaacatcatacctcattattttaaatgaataaacatttcaaacaaccactgcatttcattggttttccagaacatgattcattttacccgtgtttcctcatttctgtttaaaaatccagcgcaatattatggatttattgtcacactgacaaggatgtgtgtgtatgttaagattcaaagatcacatttgcctctgctctcacaggaagaggttaggggaatggcacattccactggtttgtctgtgcacaggagtgcagggcatgtgactcttggggaaactcctacagctggctgtccggatcaccaggaatcatgaaagcaggctttgtaaacattgcatgcattcccagacattgaacattgtgacatttcatgaccagctctctcagaagagatgccaagtgtagatgtcctttctggaacatccgtgcataattaggctgcccccaactcctcaccacatacatgcaacattttcctgctgttgagtaatcatttgtgcttggctagttttctgtctcctcaaacatcatctcagggcaaaaaggcacagcgtgtagaatatgcttcttatagcagagttaaccagggcttcctcatctcattactagaatctcctgcaccagattccacactgtctctcttctcacttcatatcttgttcatatgattgttcatatctttctaccactagataatgatgtttagaagacagatctaggttacagtatctcgtattttataattattctatgaattaaaactcataaagttagaaacccttgacatgccattcaagaatttaaattctgattggaacctaacttttctagcctggtagtggaaaaatgaaagatgataaatcatgggttctaatcctgacttttcctacttgcttactttctgttactgggtacttggttaagtttaaagaactgtgtaggcatgtgacatacattagttcatcgtaacaattgggtgaagcaggtgctcttatctttattgcttacattaaactcagaaaggtacagaaacttatctgtgagcacgtggacttgcttcatttgaattcacatccgtctgatgccaatagccatgctatacagcctttctttgtgtatgcctgtgcatccttggtaagtctttattttttttccaatgtaaattggggttgtggggagtgtagactagaccagttgtattcaatatttttagttctccatgtctcccatgaagcacaatttgaaaatcactagaatacctctaacatgatgcctactctaacattctaattttatctctttgtcattatcatcccccttccaacccttttcagcaccatgaatttcatgttcctccatttgaacagtgtcttcttctcagaatgtgctggtcatttctgtgcctctacttcttccaaatgctctgctctctgtgaatctttctcagtctcctccacctgaggaactgttccaaggcttttgcattttgcttacgtctttattgttgtcagccatccctgtattagagctagctggatattcatctggacccttctataggttgattcataaatttttatgatggagactgatgactttctcattttagttttctgtaggatctgtgttagtttcccatgcttgctgtaacaaattaccacaaactgggtgacttaaaacaaccagaagtgtattctctcacagttctggagcccagaagtccaaactcaacttcactggccccacatcaagacattggcagagccgcaggagcgtaggggataatctatttctcatctcttctttcttccagtggcttccggtattctttggattgatacattatctcattcttcaaggccaacattttcaaatttctctctgatgcatattcacattgctttctcttctatatatgttcaaatttgcttctttcttgctctgttatgaattaattgcattgcatttaggacccactcagatactccagaataatcttcccatctatggatccttaacttaattgcatctgtaaattacccccaccccaacctcctccaccaaacacacaccatataagctcatgtccacagattccagggattaggatgtgcatggcttttgtgaaacattttttttttcttttgagacagggtcttgctctgtctcccaggcaggagtgcagtggcacagtaacagctcactgcagccttgacctcctaggctcaagagatcctcctacctcggcctcttaagtagctggaaccataggcatgtgccaccacactcagctaatttggctaatttttgtattttatagggtttcaccatgttgctcatgctggtcttaagctcctgagctcaagcagtctgcctgttcccaaagtgctgggatgaccaggcatgagccactgtacccaaccagcttttgtggaatattttttagcctctcacagtgtgcccaacctttggcttccaaagattcttgtctgtcccacatgcaaaatacattttccccataccaacatactgccaaatttcagcctgttacagcatcaactcacatccaaaatcttacctaagtgtcatcagccccaaaagtcccaaactcagcatctagatcaggtatgggtggtactatggatatgatccaccccaaggtaaagtttctgttcacttgttgacctgtgaaactagaagacgggttatctgcttctaaaatttaatggcagaataagcatagaataacagttgtaggcactcctattccaaaggggagaaaatggaaggaagaaaaggttacccagacccaggcaccttccaaatccagtagggcaaattccattacatgcaaggcctgggaataatcccctgaggctaatttcactgccctctgggcccatagctctgccttctggccttgcaattctgggctctggttccaaagctcagccctcacagtcatctttccttttttcatgaagggtagcacatgtttgcaactttgtagttttatgagcttattttctttctatggaattttgggagtctagcaaccttctttcatttagtcatgtccttgatcctttcagtctaagctggacatgtttctactgatgtaatattctcaaaaacctggtgattctcctgtatgtgtcatagggattcatattattagacaaaagggtcctccacagaatttcttagataatctcatctttctttctgacctatgctgatatccattcatatccaagggtcacatacccattcccttcagttctagcaacagggtgttcagtcatatacttggcgttctctccagaggacattttgttaacagtggatcttctaattttagcatattttgcaatttaaacaagctgttaatttctaaatcaagggtctttttttgcgtaacacttctttcctcaattaatctatttttgctcacattttactataagcagaaagaagaaaccaggctgcaccttgagtactttgcttggaagtctcatcagctaaatgtccacattaatggcttaaaagttttgctttacactaactgtaaaacaattcagctaagtttctgcttctgtataacaaaaattgcctttcttctagtttccaacaacatgcttctaatttttttctgagacctcaccagaagggcttctatggattcgctggtaaagacaatctgggctttttctatcatgcacttacaagttctttgagcctctactcattgtccaattccaaagccagctgcacatttttaaagtgtatttcttctagcaataactcacttccttgtagcaaaatctgcatcagtcagggttaaaccagagacacagaactagtaagagacatcaaaaggggtgcattgcagggagttggctcacatgatgatgggtgctggctaggcaagtctgaaatctgtaaagcaggccatcaggaatggcagctggagctttctggcacaggctgaagctgctgtccacaagtgggatttctttccagaaacctcagttctgcctgtagggcctttcagctgattgggtgagacccacccagattatccaggatcatctcttttatttaaaaccaattttatttttgaatgttaatctcatctacaaaaatggcttcacagcaatgacgagattagtatttgattgactaactgggcattgcagcctagccaagttaacatgtcaaactgaccatcacaggttagtaaacacgtcacacagccaagttaacacaacaaactgacgatcacaggttagtttacacgtcacacagccaaaacacgtcaaactgaccatcacaggttagttaacacgtcacacagccaagttaacacgtcaaactgaccatcacaggttagttaacacgtcactcagccaagttaacacgtcacactgaccatcacagattagttaacacgtcactcagccaagttaacacgtcacactgaccatcacaggttagttaacacgtcacacagccaagttaacacgtcacactgaccatcacaggttagttaacacgtcactcagccaagttaacacgtcaaactgactgtcaccggttagttaacacgtcacacagccaagttaacacgtcaaactgaccgtcacaggttagttaacatgtcacacagccaagttaacacgtcacactgaccgtcacaggttagttaacacgtcacccagccaagttaacacgtcaaactgaccgtcacaggttagttaacacgtcacacagacaagttaacacatcacactgaccgtcacaggttagttaacaggtcacccagccaagttaacacgtcacactgaccatcacaggttagttaacacgtcacacagccaggttaacacgtcacactgaccatcacaggttagttaacacgtcacacagccaagttaacacgtcaaactgacgatcacaggttagttaacacgtcacacagccaaaacacatcaaactgaccatcacaggttagctaacacgtcacacagccaagttaacacgtcacactgaccgtcacaggttagtttacacgtcacacagccaaaacacgtcaaactgaccatcacaggttagttaacatgtcacacagccaagttaacacgtcaaactgacgatcacaggttagttaacacgtcacacagccaagtaagttaacacgtcaaactgaccgtcacaggttagttaacacgtcacacagccaagttaacacgtcacacagccaagttaacacgtcaaactgaccgtcacaggttagttaacacgtcacacagccaagttaacacgtcaaactgaccgtcacaggttagttaacacgtcacacagccaagttaacacgtcaaactgaccatcacaggttagttaacacgtcacacagccaaaacacgtcaaactgaccatcacaggttagttaacgtgtcacacagccaagttaacacgtcaaactgacgatcacaggttagtttacacgtcacacagccaaaacacgtcaaactgaccatcacaggttagttaacacgtcacacagccaagtaagttaacacgtcaaactgaccgtcacaggttagttaacacgtcacacagccaagttaacacatcacacagccaagttaacacgtcaaactgaccgtcacaggttagttaacacgtcacacagccaagttaacacgtcaaactgaccgtcacagtttagttaacacgtcacacagccaagttaacacgtcaaactgaccatcacaggttagttaacacatcacacagccaaaacacgtcaaactgaccaccacaggttagttaacacgtcacacagccaagttaacacgtcaaactgaccatcacaggttagttaacacgtcacacagccaagttaacacgtcaaactgaccgtcacaggttagttaacacgtcactcacccaggttaacacgtcacactgaccgtcacaggttagttaacacgtcacacagccaagttaacacgtcacactgaccatcacaggttagttaacacgtcactcagccaagttaacacgtcacactgaccgtcacaggttagttaacacgtcacacagccaagttaacacgtcaaactgaccgtcacaggttagttaacacgtcacacagccaagttaacacgtcacactgaccatcacaggttggttaacacgtcactcagccaagttaacacgtcacactgaccgtcacaggttagttaacacgtcacacagccaggttagcacgtcacactgagaatcacaggttagttaacacgtcacacagtcaagttaacacgtcaaactgaccatcacaggttagttaacacgtcacacagccaagttaacacgtcacactgaccatcacaggttagttaacacgtcactcagccaagttaacacgtcacactgaccatcacaggttagttaacacgtcacacagccaagttaacacgtcacactgaccatcacaggttagttaacacgtcactcagccaagttaacacgtcacactgaccatcacaggttagttaacacgtcacacagccaagttaacacgtcacactgaccaccaccgtgcttgcctgtattaagcccttgatgcctgtgtatctgttaaaatgaaagactgtgatagtagaatgttcccttcctatcagtgaggagatcatttgattcaaatgtgggaaaaattaaagatcatgaaaatacattagccatgattataatgggagtgtggggaagggcatggtaaatatttagaataagctaaacttctaatgaaatgagatctcctcagctggggctggtggacccagatgagcttcagtgggtcatgaacctcccagaattatatggggtgtgcgtttttgtgtgaaagagagaaagaacattttttttttctggaattagagttcatagcttttatcagattcacacaaaaaagtgcgttgtattataaatgtaactacctcatatatatggtaaccaggtcatccatcagtagcaataggcctgtattaggagtccttgacggtggatctaataaaatcttctgtgctcgtaactcacacctacctggatattctagaatcagctcttggagaactcagaggtaatacagatagtggttcttatagggattggctagggcaaaattaggagatgcttgttgtaccaaagtctactggtatgtttcctactaataaatcatgcctgatgcccccaagtcaatgactcgatagaggaagtgagtgatgaggcaggcagcataactctgtgaatgagccaaccccagcccttcccctgacttaaaaaggggttaatgaacacagatggctgcaaaccccccaagcagccagcatactgtaaaacaatattaacatcattgccttttgaataccatgtcttgtaaaccccaggatatgacaagcctctttagaatcttctttgattgtgttactcagactcccgtagggaagtagggaggggtaggggtagataccagaggaaatgtgtaattaggagtctcttagaacaataagggttctcaaacacatatgtgtgcaactgatttgttgcttttggtatttctgttggtgagtaattaactaaccatgttttgggggcagtctgtgcaagcttgggcaatctgatagttgtgaaccatggggaaagaatagttgcctttagctatattttcagaaaaatactaagtggagatgtgaatggaaaggaaagaacagactttctggagagatgccattatggtaatgtcagaacttcctttcagtctcagataaatctttcttgttatcacccttatttttagttttactcaagacaggaggcccagttcagttggagagtgccgtgtacacagatatccctgccacctccccgggagagaggcacaggggcctctgcgggactctggccccttattttacggttgtgattcctcctcactgtggtgcctgtgtgtggggtttcagggagaggggccttttgatttgactgctgagaggaataggggttttctcctgggaactcttctgagagaataagcttttgacaaacactctttgaaagttactctatggccagatgcgtgcagatccaaagatggtgtcatttgtgaaaaatgaggctggcttatgagctgggtccatttgcacacagcctgcagccacggagtccctcagcttggagatgtgctagctccttctgtcctgtgggctgctggggctttgtgtcactggcatcagaaaacagaatttggcagttctctaggctaagggtttccaaactaagtgtcctctgtattaacaacgaggagccaaaatggggacttttctatttgtgaaggggatccagtgaaaataaactgttttattttggtgactttgagtataggaattgtcttctctggacctcagtttatccaactagaaaaatgggagcagaggtgcctagttatctttaggaatgttctgtgacttaatgaagcaatatttatgtaatgatttggtggtgtaaatgtccccagcagtgcatgatgttagttgtatgtttgcaaagtacctagctcccctggtaaaggtaacctttgtaaatggcaagctatgagtattgttaaaaggacatatggctccaccttctttccaaaaaagatcactgaggaatatagggccagttaaatagcatagaaagaggttcagagtgtcttgacctggagcagtttttaaaacctcaggccaaaactccactaggaaactcaccaaactaaccattatggtcaatttcattttgaaataaagcaccctaattcatctgtccaggagtccaggttcctgtgtggcccaaggttgcattcggaggtcagagtaaatcctgtcgctaaagagccactccttctagaaatagctttttttaatgtctgcaatttctcaattcagttctttgactctttagttctatcccatttctggccacaaacctgtttggggtttgctccaccataagtcaacacatgcacatgctttcccatcagttcccagaatgcagaggacactgtaggtctgctaaggggcttctttcagaacttctggggttaacgtggttggaatgtgtgctaacaggctgctctcacagtggcagttctaattggctgaggatgagtcttgaaatgtcacagaaagatttatctctcagcacagattctccctcaactaatttttcagtaggccaccagataatgggttgtttggaaaacaatatgcagttctcagatgcctttctgtgttggaatgaacttggtaggctatttgaagcaaaatggctgatggcaaggaaactcttgactgacttacaggccattggacactgggaacaccaggccttgcttgtgagggatttggctgagtcagtttctcagggtccatcaccattcttgtggggactcagcacacaggtgggtggggaaacctgcctcagaagtttggcttataaagaaatatggggattgatatctggatccttttatatcagcagcaaggattaattttagagaagatatttcataaaaaaatggattcttccctactctcagtttctcaggaaaaatatatttgcttgatttgaaggtaccattgacagttagctgcttgttgatttaataacagctttttttttttaggattaagagaaatagaaaaatgggcaccatgttcaacatacatacagattagaagataaatttctatttcagaaacattgcaacactgttcgcaacaaccaagatatggaaacactaaatgtccactgctggataaatggataaagaaaatgtggaatttacatacagtggagaaatttgttaaagaatagaaacttacagctacacagtatggataagttctggtgttgtataccactgtaggatgactataaaaataatacagtatgtagtttcagatagttagaaggaggatattgaatgttcctaatgcaaagaaatgataaatgcttgagatgatagatatatgaattaccctaatctgatcaccataagttgtatgtattgaaaaatcactatgttccctataaacatgtacaattattaagtgtcaattttttaagagtatataaagatgcatacagggaatgctgcaatatgtgacatcatggatggaccttgaggacattatgctgaatgaaataaaccagtcagaaaggacaagtactccatgattccactgatgtgagatatctaaaataagcaaattcatagaatcaaagagtggaatgatggtcaccaggggctggaatgagaggggaatgagcatggagtttcagttacgcaagatgtgtaagttctggaagtctcctgtacaacattgtacctctggttaccgtattatacactgaaaatttggttaagagggtagagctcatggtaagtgttcttgctgctataaaataaaattttaatcaatacatattaaaatgtgaaaacatattttgtaaaactaaggtgcaacaatatttttggtgactcaccattaaaagtcctacatacatttgctctagaatcctattccaagatgggattccaagttgattttgcatttctaaggttagcaaacattttgtcttttattggttgttttatacatatgtatacctatgtagcaagaaaatttctgatgatctcaggttcatacacagctcttgtcatttccaaacagctctggatttttcgagctattattagcctggagagtatagataattgcagtctacacagaaatctaaaaataaactgtttattcatttttctaaagaattcttttagcacatagcctcttcccagaaaggtttacaagtgcttagattaaaggataattcttttctctccctaccattccactctaaatttctgaagaaaatgtgaaacagcctaaaggcagaaaaggaagtacagtaaaggtcttaatctgtctctcagaattattgaaaattggctgaaaatctaattcttcttatgcaataggtaacctttttattggtggcatttacctgaactaaggtaaatgtcgacagcattggtgggtatgtaatcaatagcatactttcatcatttattttttttaaacaacagatacaatagtattgattactccatacatttcatgctaaatagctgtattaatctgacttaatgagtatgtgttgttgaaatagctgtcttccaactgtaacctgtttttagcaagaatcctgcttgccaaatacttctttttttaatctatagcttctacttgattcttgtgaaccaggggtcagcaaactttttctgtcaagggacaattagtaaatattgtagactctgtggactacactattactgctgcaacaactcaactcagccatgcaatagaataagcatggcatcccaataaaaattcacttaccagatctgcaggtggttgggacttggaccatgggctgcattagctgatccccattgtgttccaaggttggagaaagaaagcaaaatcaacatcatgatttgttgaggccaactatggagaaggcatggtttaacagtgtagtggacaagctgggcaagtttcctgcttttctggagctaacattctcttggagagtggggaaatttgaaaatcaaatctaataagtcagcaaaataatttcagttgacaataagttctatgggaagaaaagatgatttggtaaagaacgacttaagacttaagaggacataatttgtagggggtaatatgggagtttgaacatgcatccatgtttttgagtcccacaccaacatttttctaaggaatctctcaacctcattttttctatttataaaataattaatatcaatacttattgcatagggctacattgaagatcagataagctttatgaagggtcttctgtaaaacagcaaagccaattacaaatttattatatcttatcaatattggtcttgtcatcatttttattacccatctctttattgtgtctcatgttttctttgaagtctttttttccaaaacataacagaatctttaaacgggattgtgtgaactgcaattctttcccttcatattccctagaagaggatttctctaagtcactgacaagttgaaactgctttcttcacattaagctgacttgagaaatcagtgtttaatattcacactttaccttaccctactagaatatcagtcattgccgccagccaaccctatggacttgttggtgacacatgcgaaggcacagggtgagctggtccacaccttcagatgaagagtgtgaaaagacttacaatttggtcttgcatattggaagccttagaaagacatctgttgataacagtgatgagtgacaaacttagataattaaaccttcttgtcttcaagtctttacttgatttaaaatgatgactgaaatgtctactactgtgtttccacttactggaggaagatctcaataaaagtttgggccttgtaagaaattcatgcctacagaatggaaagggcaagagggaaaataccagcagctgtcttttgctgagcccttagaagccaggaactgggaagtgtgttggattcaacttttcttcaacccccactatctaacccccatcacaaccttcaaaggagtaaaattctccttttccacaagaggaagtggagactcagagagactaagtgtcttctcaaagctgtctgactgataaggggcagaggcaaaattcaagcccagacctgcctgatccatagccaatggtgtgtttaccagacagtggtctcaaaatgtttttgattgcttatagccaacaatagaagaacaaagcatgaaaaatcaaacaagcaacaagaacaaactttattttttggtagagaaaggatctccctttgttgcccatgctggtctcaaactccttgcctcaagcaatcctcttgcctcagcctctggaagggctgggattacagttttgaactcccacacctatccaacaaaaaacttttgagtatcactcataatatacgtatatttattggcaagttaaatccttataccattatactaatgtgtattgaacaaataatcaaacacttgaaaaatagaaatgtataaaaggatgcactacaaataaatatacatggaaaaactcatattttcttgccccacacgaggggatcatcacttgcttctcagtgtctactttgaacaccatgacactaaaccaaatggacacatcaggtctaacaatgtttgttctccccagtaaagtcagtttaatctctgtttagccttgcctacataggcttagtttctcaaggattccaaatgaggactgcttggcctggtgaggctagtgcaagctgctggaactgacacactcacggatgtgcggcttcgaacctcagcaaattggtagcacagggttagcatattgcctagagtcgggcttagtttccctcggtgtggctcaggctgctacagcacacttagcactggggtacctgggtgagtgccaccggtgacgctagcagtaggctctggccatttcagaaaatgaactgcttcttccagcacacaaatatcttgctaattagcaattagccgttaagggagaagaaatggaggggaactgggagtctgaaataatctcctaagagacatgaaagaaagcagcacttaaagtaagccagatagaaactgggagctgcttcatttgggcaagatgtctctagacatttttctaaacgttttacattcagcagaggaccccagtgcattctgccaagtgcttttccctttaatttttagatgcattcaaatttcaaggggaatttaatccgtatgtttctggttcttttacacttaactcatcaaaatgttgttctttaagagccgttggatctgtaaggcttatgagcctttgttataagccttttcaaaacctctttcccctttttgaatcagcaaatggaattttgccaattctgaatgggatttcaataaggagaagtccaactttaggattaaatgcagaacctcaagagcatccgacctgattttgcagagatgcacacttgacccttgcatcctaggaggaccgacagcatcatggggtcgacccagtggctggagcaatgcttggtgagcgcgagcccacggaagacaagcaatgtggttcagggcctgtgcttctgttacagaaccagcaaaccttagacttagacattctctagcccatcctcccacccaatgagatttgtgacacataataatgaaaataatgatactaatcagtagccgacactcatggaggccacctatatttccagctgcttttctacactctttgtatgcaacatccatctctcataatccttatcagaatggtgtgaggtagatgtggagttagtaaaacttagtggacacaagtttaagatttagaatcaggcaacctgggtttgaatcctagcatcaacacctataaactctagcgcccgaagaaagttctttaatgcttgccaaagggtgctttcatttccagttgctcctgttaccatcgttgttaaggatgatgttgatgctatccttgttccagtgatggaaaaagtccctatctcctggtgcagccatttttattggtaacttggagttttccatattttctctttatgtgtcaaaatctcctgttttacaaagtatgcccattttttctaaaatagagttaggctaactcctcttttgcatggcagaccttcacattcttgatgacaattgtgaacgtaacctggttgcatgttcctgacactaaaagtgtacacaatgttctggatggggtctgtccagtatgaagtaggaccttgctctcttttgttttgtattttatactattaatatgattgcataatccattaacttttgggaagccacatcacacctttttgttcatctggagttaatatcacctaatataagttttcctttgcttgaactgttcatagggcagtgttccatctcttgtaattctgtagttgattttttaaatttcgaaatatgacattttctcatgggctctaatttaataaaaaacaaatatggatttggtggagaaaaatatacatggtacagggttttgatgttaagtgtgggtatgataaatgtgaagagtttctgcattccagttcctatattaaattcatagcccccaaattttaaactttcagagcctcatcctgaagagtcattatgaaactcaggtaagttttatcatgaaagaatgctgaaaaaaaaaatcaatgccccctggccctcccattgagtaagcaactgaaagtgagcttacagcctgtgtaggacatcttttaatttgccaagtgactaaatgtgcagtcactgcagcaggcatccaccagctgtgcccacatggcccactcagctgggctgcttttcaaagagcagacagggcttatcttagtaccaaaactccatgccaaaaagatcatcactgggtttgagcatttgcacaaaatccccagcagccacgggtagacagctttgcttgacaaaggcagcttcattctccagactaatgggcaactttggctactactgggcaccatgataaaatggctgggcatagagactgtcagccctactggtgattctagccatttggccatttaccttttacctacatttcatctctgtattcccttgggctctgggaagccctttaagcttcaatgacctgttctgtatgagtgctggacagtccctgcaggttcttacttaacctgagagcttgttaaatgcatctccatggaatatcttctattgttaatagttgctggtttggattttaatctaaaaaaaactgtgaaatgtgcttgtttcatatgatgcttttctgagaggttgcatggagatctaatagttgggtagctgatggcaagtgggaatgaaggtaattgattaagcagcagcacctgtgttcctgatatgtacccagtccagtgctagatacagtaaaaatgtaaaagtttagggcaaggtcccatcctctacccagttttgaggactacataacatagttgaagggagaagtttcatgtaaaggaagtaagataagtatataaaagaataagcacatagatgctaagggatttggcacaggctgtaaatgctgtagtccctcaaatgaggaagagttcactgtcactgagaatatcctggaaggtaagacttcatctgggccttggagctgcataggaattagactggtgcaggaaatggtgagacttggaaatgagaatggataattagaaatttgtcatgtggaaatcaaacacacatgcatacctatgtatacatattacactacagaaacaataacccaatactacttcattttcctttaattccctaataactaaacagtacctgattgtgggttccagtagtgatgtacattgacatcttgtagtaagaccttttttcctatcctaagaggatggacaatacatcttcaaaagccagagtggttggccaggcacggtggctcgcgcctgtaatcccagcactttgggaggctgaggtgggtggatcacaaggtcaggagatcgagaccatcctggctaacacggtgaaaccccgtctctactaaaaatacaaaaaattagccggacgtggtggcgggcacctgtagtcccagctacttgggaggccgaggcaggagaatggcgtgaacccgggaggtggagcttgcagtgagccgagattgcactccagcctgggcgatagagcgagactccatctaaaaaaaaaaaaaaaagatagaagccagactggctctttaaatctactaacacttgtatgaagtaatagctttcaaagtagtatgtgaaccagctacttggagggttgtggcaggaggatcacttgagcctaggagttcaaatctagcctgggcaatatagcaagactaaatatatatatacatatattcacgccacacacacacacatattcatatatatatatttatatatatatatatagtgattaaaataatgcaattgctggcacagagaatatgaaaagcaactatattatgagaggacttcaaaaattcatggaaaaatggaattaaaagataaaaaaaaaaacccttcatttctcaaaaaaagcttcatcaaggttaaaacacttttgtaggtggtgatcctagccatttagtccatccctaaagaattgatggtcctgggaatgatgcagaattttcccccctttgttcagctaaatccagttcttgtttcatgaccaggaaaaattaggcacacggacacattgaaaggtgaggagggtggaatttattaagtgaaaggaaagctctcaacaaaaagagagatcctgcattcaggtttccccctcacaaattgaataccaagccaccattcatgagttgaagaggcaaggctcctcccagcataaggcatgaattcctggtggctccactccattcccccggtatgcatgcaggtccttagtcttctaaaaaatcaatgcgtactccatattgatttattttccttactgggcatgtgttaagggacagaattttccatcatgggcatgattaggcaagccccctctgcacaatgacttgggcaggtcagaggttctctggagactcctccctatttgcctaggcatttggctgtctcctccctctatgattcccccatgtaaagaagtacatataactgctgttagaataaggacaaggatgaagactgatcttaactgatcctgctgacagggggcactgtttggggaaaatggcagtcagaggcctaagggtccctggtaaaatggggccattgttcaaggctctggttgcatgaccgtttggagtttgatagcctgaagccaagaaaggacaaaccgggttattagaagacatgtaccaaaatgaaacaaaagcgagggtaaggacggctcaaaaattctgaggctgctggcaggctcagataaccggtggctatagttatttctgctaagatttgggtgcatggcccttggtttgtggttagctcccttggtcttgattttcccaaaaaagaaacctccaggttatgggcactctattactcccatcacctggcaggatttgcaggataattgcccagaactggaatattgattcagatttttatattacccatccctttttgtttcttctgagttgcagccagacatcactgtttacttcagaggaatgagcaggattagtttaaaatgtagatgaaaaacttaatgaatgagtctagaatttaatgacaaatctatgattagctttgaaacagaatttctctctccagtccttatttttgttaaaaacaaatagtgataggactgagttgtttgcaaaataaactttagttttatacttggcctgattatttgcataaagtgcagcaagaataattatttttacataggcttttaaaattggctttgagggaagtttgttccacaaggaatctcagataggactttttaaagctgagcctagccatgggtttctatcctcaaatatacctatgagttgggtgaattcctctcttcttgaagtcacaagaatatggagttcctgggcctgtgagaaagtgacattctttactcaccacaggtgaggaaccctgtaaggggactgtgtagacaaggtatgaggccaatatccccagggggcttttattggctctgcaagttgagcttgattccttaaatggaagcatacccttacagtcaaacccttagcaaaagaaccagtgtctccaattgcatcctcttgcaaaagaaaatggattcttattgcactgatgcaaataaccatattgccataagataagaatactcacagatagttttcaaactctagaggatccaggcagagagaaacaaatgtgctccaaattttttcacaggagtctaccttactcaattattaaagactttaaatagttcaaaataaaagtgcccttgactcagaaaaaaaaaattagcaatattttaagcaaaagttaaaaaaaaagattacttcagttttctattacttcagtctattcagataactcttgttctgcttgatattcgtgaaattttcagctcttcataagtcctgtatgtttttcctttattccgatgtcacaattttcaaaattatcagaaaactgcatttgacagcacctgtcaaattcatgtagctgattataaaccatcttttgaaggggataaaaacaagacaacaattgtctatgaataagaatatgtacagggtcgctacaatcaaaaacatgattgacaaagaaatttggttatctttgtggtttataatacttaacacccttaattatgattgatagcatatactcagacattaggattttagaaatctcatacaattttgtgacatatactaatattatttactaaaatataacctgaagaagattaaacacattttgttaattctatgtacctaaacatgtcagataatcctgttcatctctcatctggatgcctcagggaccctccatggcatccaaaagagagagttcaagaaagacaaccttgaagctgaaatttgattttgggaagcctgttaaatatggtagaggtttaaaacacttgatgttgtgaactagaatttcagattaccataagttatttattttgccaaagtgataacttgaaaattattttagaaagacaaaaacctttactcattaagaggaaatacttagctttccaaaaaatgtctcctgtctttctttcttttccttggtagtctatgcatgaggcaaacaaaaatatttcattatcttttactattacatgaaaatcttgtaccagggagagaaagccaaattttacccttgcattagtttactattgatgtcaaccccaatttattaaatgaaaccttatagaaaattctatgcaatcttaaccagcttgaccatgagctgagattcttgtaaatcttttataaccctttacaaattttgctaatgagtggattagtgccttaagaaaacctttgtgcttttatttcaatgctcaatttacagagtttagtcaatgttcacacacagaattttgtttgcaagattaatttttagaaaccttctataacttgtttaaacctttgtctttatcttatctaatttaaagcaatattttatcccaaggcaaaaatgtacattttcatgccttcttataatcttttactaaagacacattttactgttcttatacaccttgcatgtaaatgtattttcagtggtctcaattacatgttataatggtacttcttagcaatttttaactttaacataaaatctggtagattgttttaattatgcagtaggtgccaataaagttttactccttcttgcatggtgaagggtgtggttaattccatatatccccaggccttaacaattgtgaagcaggcaagtggagcagttctcaacagctaaagaagcagtttataaccttaaaacatttagcaaacctagtatctgacccgtataatttagaccacctatttacattttaacaacatttgcattttaccagtaatctttaagactgtttttatttctcaaagattaaagtcacatgaactaaaaggcgttaaagcttttatttttccttcaaaagtatttcagttaagcacttatttttctttagaccaattaattagagctcttttttatagatatcatgcacatcacatatataactacacagacagaagaagattcagttgttacaagatatttcatttgcaaatctcctaattggattattggtctctgggtggtgccctttaagagcagggttaggaaagcatgctgtttgtaggccctgataaacagacacagctggaagacaaaacatattttgagagggatttatctgcctctattttctgggggttccaagaggaaagcagaggtctctttcaaaatggaatccacggtgccttttctgtttttcccaaggagtctcagagcatcagaagttatcttagggcctttcatacatgcattaagagtggcaagacaaggcagggcacggtggctcacgcctgtaatcccagcactttgggaggccgaggtgggtggatcacgaggtcaggagatcaagaccatcctggctaatatggtgaaaacccgtctctactaaaaatacaaaaaattagctgggcatggtggtgggcgcctgtagtcccagccacttgggaggctgaggcaggaaaatgacatgaacccaggaggcggagcttgcagtgagccgagatcatgccactgcactccagcttggatgacagagcaagactccatgtcaaaaaaaaaaaaaaaaaatagtggcaagacaaggtggagaaaggtaattcagtcgattgaggaaaaaaaaacttttctccagcaaaacaagatccaagaagagaaaaacataaaggccttttaaatatacctataacttggatacccccttttaattaagctgagtgctgtttaagaaagtccttttaagtcccttattacccgatgttagccacaccatgtgtccaatgtttctggcttttgaactttaccaaacgtgacctcacaggtgaaaccaacaagcctcaattaagacgctaaaagcacaccagattagctacagcttaagcccagtctcgtatattctttttcattaatcaaaactttacagtaaatataaacagtgatccttatcattccttttactggtttgcacagggagagaggggccaaaagtccaacaggtaaaaaatattttacccttttgtcagtgtgtcaggcttctgggttctcttcccctgagctcaattctaagccaaccagtgtcaggttttggaaattaacttttctcagtctggaggatgcatctgaggggagtgtcctatagtacagggacacagttacccatctgtaaagaggggacagaggagtaaaaaagaaggctttcttcttccaaaggagcctcagaggttcaggatgcattcaaaaggaaagcagactgaagatgaatggctgctcacctagaaagaggggagccctgcatccctggttcctttctcttcctagggaatacccaggatatgtgagggagaaaagaaaaaaacgtcctttttccttcttctgtccttatattcccaagtcccagtgaccttgatagggtgccacccatggttgtcagtgtggctttcacccatgctaaggggaggcctagagggtaggattatccacttttgcccacgtactgcctttccctctgctgtcagtagcctttgagtttcctagacctcatttatgccatggatactagcatgacctttatccatgaaacaggaggcttggcttaatcagcaagaattagtcatgctcacctacattgtgccttttaactactgttgtcatctccctctggatccctcatatccagttttctttcctaggggttgaacccaaggcttggaattgagtttgggacaaaggaactgcctcaaggaggtgcctggtctcatcaatcccccagtgacccacaccagactggctgctacctccttatcataagcccagtgctaaggtataactgtggaatagggtccttctcaaacaaggaaggggaaaagggtgtcctgtgaattgtggtcctggtctaataagatgcttttcaagaaagaaaaacctctcacataaaagttaactcccgacagggtggagcaaagggaaaaaaaaaagcttaagtgctgggccaagaagacctgggggaagaaccttttgttcctttgcaaatgggtttctccaacagggagagaaacttttgattgctgtcagatcaagttggattaattgaccaggggaagagaagactctgtggatgtggatgcatagtgggaaatgctggccagccggctgcacagggcccaggtccctgaggcccccttgggtccccggcattggctgtggctcattcccatcctgcatggccattggatgccacatagacatgcagtggacacagccatgcaccccagccaagagggaagtggggcagggagccaccactcacccgtatatcccacatgcacacctgtggccattgggatggtggtggaacacccccaatattgtaaaagaaaagataaatgctgttacagtaccaataaaaggaaggaaaataccatagaaaatacagggttggattgaggccaacattcccgacccctgagagtgagtggggtgggggacgtggggcagcttcccctgctctcagaaaaagtctgaggatgagaaagctcagaaatgaaagggaaagatatttttgggttcacattttacttacccttcctcatgtccccatactggccaccaaaatgatgcaggattttttctccttagttcagctgaatcccggttcttatctcacaaccaggaaaaattaggtacatggacacactgaaaggtgaggagggcagaatttttattaagtgaaaagaaagctgtcaacaaaaaaaggggtcctgcatgcaggtttccccctcacacactgaataccaggccaccacatacgagtggaagaagccacgttcttccccagcataaggcacacattcctggtggctctacccaattcctccagtgcgcatgtgggcccttggtctgagccagtccacattgatttatttcctttacagggcatgtgctaagggatagaatttttcaccatgggcatgtttaggcaagccccctatgcacaatgacttgtgtgggtcagaggttctctgaggacacttccctatttgcctaggcatttggctgtctcctgcctctatcaggaatttaactctgtcaatgcagtcttttttgcattattaactgaagaaaaatgggtcccctttaaagattttttttttttaagatttggaaacaaaaagaagccagaaacagccaaatcaagactgtaagaggaatgcctaatgatttcccattgaaactcttacaaaattgcccttgtttgatgagaggaatgagcaggagtgttgtagcagtagagaaagactttctggtgaagctttcccaggtgcttttctgctaaagttttgactttctcaaaacactctcatagtaagcagatgaaatcattgttttgtcctccagaaattcaacaagcagggtgctctgaggatcccaagaaactgttaccatgagccttgctcttgactggtgcactttggctttcactggagcacctccactttgtcttggtagccattgctttgattgtgccttgtttttggaatcatactggcaaagccttgtttcaattcttcaaaaaaatgcttcaggatcttgctcccacttgttcaaaacttccattgaaagctctgcttttgtctgtagcttatgtgggtgctagaggtttggcacccattgaggggaaagcttgctcaatattaatgttttaagtcagaatttggtaagctgaactaattgagaagactatggcatttgctattgtttctgctgttaatcatcagtctcttcaattaggacacaaaaaagatgaattttttcataacaaattgatgtgaatatcctgccctgggcttcgtcttcaacattgtctcctcttttcttaaattcagttattcatttgtaaactactgatttctttagggcattgttctcataaactttttgtaaagcgtcagtgatttcaccattttccacccaagcttcaacataaatttgatgtttgttcttgcttctattttaccagaatttgtgttgctctgttaaaggcttttttcaaaatgtcttattgttcttagtgcctcaaactagatcctgttcagaagttttataaccagttagtatgagtttattttgatgcaaaaaaattaaaattcaaggttttttttataataagtattttctatgatcattttaaatacttcttgtatttacacttcatggagcccttagtgtatgctaatcactcttccagatgctttgtatatattgtttcatgtcatcctcacaatatccttggagggtaggtattattatccccattcacagacaagaaaatgacttacagaaagattgagtaacttgcctaaggaaagacagttaaaaagtgacggaatgagactataaaccaggtattctgactctagcagaaggtgagcacttaaaccatgggctatatgtaggaaaataatctaaatctgcctggcaattaagcacttgcaagtcaccttcttataccttgtctccttggcccttcacaccttccctatggcagagagcgtgttaggcccacgaaaaagctgggacacagagaaagtttctcttaggttttataatctccctttctgctcagacctcctgtacccagggtatgagtcttccagtgccccaccctctcagtgttaccttcccatgcccagtaacttcatctgccctccgttttagggtgccatctatggttaccctctgaactttgtgatcgtgcccgctgtctctagctcttcagtcactgaatcagaaaatttagtgaaattcagtcactaaatccttcccagcttgagttatttctcttctttgacctcactggaacctaaagctccttgaatgccctacttttcctcaatcccttagctacaccctttcttcactttcttccccttcttccccatccagcctagatgtggcaatgcatggcttcatctatcactgtcagactcttcaacctccttaccccactgtcctcctatcacattctcctggaaaaactccactccagaaaaaattcacatcttaagagtttacacttgctgctgttggggaaaatcatatatttctatacagtggtgctttcacaaattcatgatctctcacctcacccagacctaccaaaaaaagtgacagtcctctgtccctgtttttctattcctcccattctctatagcggctatttccaattttctccattccacacaagcctttactgtgtctttcttactcaagaggattattggcatttttcctttggcaaactctttctaggtttcagctcaaaaattattttctcttctggacatggtgagaaaccctagcttataatcctagcactttcggaggttgaagtaggaagattgcttgagcctaggagctcgaaaccagcctgatcaacatggcaaaaccctgtccctactaaaaatacatacacacatacaaaaaaacaaattagctgggcatagtggcacatgactgtaatcccagctacttgggaggcttaggcaggagaatcatttgaaccagggaggtggaggttgcagtgagccaagatcgtgccaccacactccagactgggtgacagtgggactctgtctcaaaaaaaaataataaattaataaaataataaattatcttttcatagttgactatatttctcaattttaacacataccacatatttattttattgagacaaggtctcactctgtcacccaggctggagtgcagtgtggtgatcatggctcactgcagcctcgacctccctgcctcaagcaatcctcccacctcagcctcccgagtagctggggcaacagacctacaccacacacctgactattttttaaatttgcttgtatacttggtggtctgcttacattacccaggctgatcttgaactcctgggctcaagcagtcctcctgcctcagcctctcaaagttctgggattacagccgtgagccaccatgcccagtcccacgtgtttttattacctgtttaactttaccattatcagtaagtttcctgaggtcagacaacatgtattgtacctccagcaactacacattttagtagatgcccaataaatatttgttgagaaaacagatgaataaataaattaatgaatgaagaaaacataagtataccatcatacgagagctctcataactttttgccaccaaagctgtgagtcccgcttcccttccaccttcaatcctcttaaagaaaagctattccacccaaagctagatcttctagcaatgctatggactttgttcacacctatcttctcagtaacgccatttgataatttttcttgtctttcctatgccttcagtctctcactttctatttcccttcagcaatggaacgtgatcaaatctatttcatatttaaaatcattgatttcttgtccaaattctgttctgtctcttccctgtgatagccacaaagaattcctaggcattatttatacttgttgtcgcttctttttcattctgcatttagtccttcctcagagtgcctggcctctgtcctgccactccactgaaaatgggagatctcaccaagatgaccactggctctgctcttgttctttccaagggggaactttgcacttgacccacctgacctcctcaagtcactcagcacctatctccttgcttctgcaaaccttagttcccggattctctgggcctatctccctgtctttcatggtgttctttgggattctacttcctctgacagtaacagcagtattggtgtcccccaggcgttgcttgttgagtccatcatgctccaaggttccagtgccagctatatgctgatgactccctcatcgatggctccagcttagtctctcccaaccctcagtcattgttttcttgatgtttccatgtaaagatctacagacctctcaaattcagtgggcctaaactgacagtatgatcttttcctcaagctcagtttccatatagtagtggtcccttgccaagaggataaaaccagagaccttggtatcaccccaagtcctccattttgacttcccaaatctgtctgaaaactaaacatttctttccatccccatcactccttggataactcaagctgcctgatctctcattgggattattatggcaacccctaactggccttcccacctcaggctggccctgatccaattcattctccatgctgcagctagaaagagcctttgaaatggaaatatgattctatccttacactttttagaagtttccattggcattctcattatatttgggataaaatctcacctttatagcttggttttgggtgccctaagccttccatcatctgatgtcttacatgtttcatttctaccctcgaatcttcacctattcactctgtacctctccacatactcctgataacccacattcaactctggcaatacagactctttcctgtttctctccatgttctctcttgcatctagacctttgcacatgctgtttcctctgcctggtctgtattagacatgcatgctttctgagcccacaagggcatgaaacactagaaagagcacaagatttggaaccagagactcagcttagcagcttatttttcatctctctgtcattcattgttccatccaacagatattggactgagcagtcttctcttcctcccttcctccaaaacacactttgcctggtatctcctgcccatcttcatgctgcactttagacatcaaccacccagaatagctttctttaacacacacacatacacatttataaatctgtcttttttgatattgcattgtaccctgaaattctctatcagagcaatttctttcagtcagcaaatatgtgttggatgcctttctttgtagaaggcattgtgttgggcactgtttacttgtctatgtcaccaacagggtggcatgcttcctgagggctgtgacagtgactatttcacaatttcatatgccagtaactagtactactcttgggttagggtagattctcaaaaatattgtagattctcaaaatatatgtatttatgttgttaaaagaaaaactttagctgaattaaatttcagagtttaattgagcaaagagccaattaaatccggtagtttcctgagccagagtaggctccaagactccagcgcagctacgtggtgaagacttatgggcagaaaaaggaaagtgatgaacagaaaacggaagtgagatacagaaaccgccggtttggttacagctcagcgtttgccttatgtaaacatggtttaaacagttggccacctttgattggccaaaaacccagtgattggcacaagagtaggctacagtctctttacagttttatctaggttatagttcacaatgcacagagaaatctttaggctgaacttaaaatatataaggaggcagctttaggctaaacttgattatttaacaatgtattgatttgctggctggatggatagaaaggtggaaagataagttggcaagctggatttctggttccatgtcttgtgctcttcctagggcaccttgctcttgtgggctcagaaactatgtgttcctatgacagaccttcagatacccctcagggagcacttgctgtcctccatgggtgcagcacttcctgtctgtggctactcgggtgtctctctctcatttttccctgccagactctcaacccttaaagattttagtccttctctttaggaagaccaaaaatgaatgagagtggcatggatttgaaggatgagatgactgaaaggaagagctgactgatttgtttagattgagtagtgcattgaggacactggtccccaggtgttggtaaatagaagccccttaagcagaggagcagcaggcttttcctcctctttcattatggtgatgattattatttttgtggttcccatggaaacaaccagagagagagaacaaaaatgtcagggaggttagaatgatgagatggcccccatatgcttaagaagactatgtgagtccatgtgtgcatcagtgtgtatgtgtgtgtgtgtgtgcactgcctgcacgttctgctccagcacactgctgggtcaggagaagttgtgatgcttattcatggcatttgttacagtcagtctcagcaaggagacaactctcagcttttagtggttagggagtctctgtagtgacagctccatcattgcagggagaggacaaacagagatggagacattcctcatgtgagccagaggagtgtcaaagaagaagacagctcaaaactggagttgccggcctgctcggcgctcccctctttttgtctgagagggctcactctgggcacctactttgtggctgcagtgggtacattgaaggcagctgtctgcagatctgaggatccttgagctcttcatctgctgctcacacttttacttctccccgcctttctgattctttgcctaatttgggagtgggaagaaaatccagcctagggctcttctcagaatggtcagccagagcattaacatcttgagcaccgagagagttgcaggagcccctccacaggaaccctttcatccactgtctccgccaaggctctgcagggactggcggctacctcttccgcatcatttgtggccaggatgttcaggaagcacaaggctgtaagtggtgtcttaaccacagaaggcatagagagaaacagacttgaaagccctgaactgagagggaattcattctgattgagaggagaacacagaagaccagaactaaagaagacattgggacaaaggcagctgctgtccatttcaggctgagttttctcttcagtagtcggcatgcatgtccaaaaagctcaggactccatcccccagccatccttgtgtctaggcgtggttgtcacccacatggttatgtgtgctacttccagactttccaccagctgtgtatcatcatgcagcgtgatcctagaagacacgtattagaaagggaggaaactccattaacctggggtgcttcaaaactgcccagagcagatttggctctggccgtagccctgcctaatgaccaggaacacccacactgtactctacctgggccaaaaagactcttctcgtgtgtcagctgcggacactttggagttgattagttccagtactgactactgccctaactgctgcagcatcccgctgtgggaggaagcaggatgtcatttctatcccaacccctctgcccccaggccccatgatctgccacagctcctctctgacagagtgcagtcaagcctcagtgacagattctgtctcctaggccactcttcttttccttcaacaccattccattgactttctctccccatactttttagtcttttttccccccttgaatgattttcttctttatctttctgaccagcgacctttgattgcaaggagcaactcagtttcacattactagagtaacagagtgtgttgtaattggccgggcattggtcttgaaatgtcagggaaagatttatttcctagtgcaacctctctgggtgctaattttgctataggctgcaggataatggttcccgctcacaatgggcgagagttcctaatcagaatacagggctgtaattgggttgaagggattttaaatcattaaagttgcatttagaatggggaatagaaatagaaccccaagattgaatgactcacttagtatttaatgagggagccatggagtattacttataatattcgcctaatgatcttacaagcaatgtaactccccccgccctctagggcctattcacaaggcacaattctgcagtctcagacccaccactctggagcaattaattactgacccatcaaggagcaatcaggctccgctcggccagcagaagcgctgatttcttcccccagtgtctcctcactcttcatcttcctgcctgccttggtctagggcctgcggggaggggagtcgacatttacaagccataaatcatcatgcagtttttggaaaacccagctcactatgagaggaacagggtgaccaagggtacctgtggagagtctgagaggagaaggcatcagaaggaggctatgctggccctgggagtgtacagtctacaggtttcagaggatgttctctggtgctgcagacactaagtgtctagcacatagtaggcactaaataaattgcagcttcccatgatatgactatgaccaagggttactaacccagctgaatagatttgtttcaggtggcgtgaagctccagcagttattttggacttaatctctaggtagatctgtaagaccaatgttcctgtaaatggaattcctgagaatttaggttacagagaggctgcttaagacatatgtaccccttccttctgcaggttcagaaacagctcagctctctagagagagcacgcaagtgttgtgtgtgtggtggtcgtgtcattgctaatggtccttcctaaagggaacacacatttgggagtgtgattgacctggtcgagtggcactggaaccacagcaggtcactgatcctgagttagcctcacttggctgttggtgccacgtcggccaggatgctggggacactcagtctgtgttgcactggaggccaggatgctcctgggtgctgatggctcactgttctaaatctcatcagggaatgtcacttgtccgtcctgtgtcaggcctcagaaagacgacttccatctcttctagtatttcaagtaaaacaaagtctatgggtttctttggtgatacctcagttgtaacttctattgtgttgacataacaactgagatatcataatgagtaaataacactgatatgacctcctaggtcaggctggcctgggaaaaagctttctatttgagaatgtcttgaacatagagcctggaaggtagtagagacttcgtgaacactcgtgaacttctgatgaaagggcttctcctcaaatacttggatctgatagcttcatgcaggtcattgtgatgaggaccttttccataaaggagccagagggaaaagggttccggcattggttgagttcctcccacttgggcagatggtaggctgctcatcacactaaagtggactcatccgtgatgcccgttttgcaattgaggcaaactttacccttgggaataaactaaaatattctaccagttctgcttttgcccaattaaggcaaagaaagattcgtggcaagtattttgctgtaacaggtattgttatgaatatccattgatcctgctagaaataaatctgtcatgatgtggaaagttaaaacagctaggatattctttaattatgaggtgttgactgatttaaatttagtaactgttaaaatatcagtagttatatcattagtttaccaaaaattaaaagtgataatgcctgcttcatacaaatcagagccaaacagtgtaactttgtgcatgaaagaacatgctgtgcttgatgtaattagtatattcccccaaaattgtgactcatgataaatctaataatatcttaaatgcaaaaaaggtagtccaatattttaaagaatcccatagagaatcttttgtgtgaagagcctttggcgttgcggccatctccattaattcatctattctgaaacttctggggtctgtgcttttcctataaagaaggccacctctgtgcatgcttcatgggtggcagctgtctcctacccacgtgcttgaatgacgagactaatgctctagaccacgcacctcagttgcctgcagatagtgtccctgtcccgatctaatgccaatgtcttagctttgccttttcagtcttctatttcaactccaggcaagtctggctactagcccataaagtgccttttaagaagtgggagacttgcccccgtaggcaaatatagccccacaagtacaaggcgtggtgaacttgtagcatctctatgtgaattccgtcaggagatgtagccccaacctggggttgatagcttaacaagcaaatagtacctggacttcagcctcacatgcttccttggccaggcacccttgtgcagtgaacaacctgcacaacctgtatacagcagccctgcagcttggactgttttgatcacaaccagagcaatgtccaaataatctgccaaatatttgtgcaaacattatgttcatgtttaatcgggagcgatagttttgtcttctttataaaaggagcaaatccccagaagctggtcaggagcaccagctgtttactgcctgcagaagccgctgcttatctccttgtaaccacctgcctcttagagatcatgtcttaattaactcagtgttatcaaaactgaaattgtagcaacacctgtaacatcaaattgtaaatgagagataaagggggaaaaactctgctgaccaagaaagggagcttggaaactctctcttgagctgtaggtagttggctccaggttgattggtggcagtctgctgagaattagaatcagagactcatacattattccatttggaaagtgtcttggaggtcttctaatccagtggtggtcaaatattttttatctcatgacacacaacttattcttctgatgttcaatatatgctgatattttctattttatcttatttatttcattttaaaaactcacggataaaaatcattccattgatttcatgacccactacagattcacaacacaaaaaaactggaaaacagtgatgtagtctaatttctaaaatctaaaggactgagggacaaagaggtgaagtgacttgccccgggtaggttatcagtgggtattgttcttaaacccaggtctatagactccctcccagtggttctgttccctgaaatctactaaattctgccactgcaggacagctccgagaagaaaagcaagtcttaacttaagaaacaggtcttcttgggaccctgctactttccggataacaagcctgagtacctacataatacaaaatgtaccctttgaggagaaggtcaggtgctttctcacataaaaagcattgtaacaactggtggtttgaacgcctcactgcattcccatgctgaaacagtaggggcgccatgcctcctagtcttggtgagcctccttaaaaccttaacaccctgtgctctaccccatccttttcttcctctttcatttccttcccccactttgcaccattgagatccctttctactcaccaccccctaaacttctcctttgagacactggactaaaatcgtgaacaaaataggcattctcacagaaacagtaattccaaattaaaacaaaaacaaaagcagtaacttattacactatgagagacctttttacatttctctgcctatatttgcatgtttttaacatattgaaagaagttttccaaatgaaagctgtctgattggtaaccacacccatgtgtcccatggcagtcactcgtgggagcaatcttgggatctaaacagagtttgtttagtatctttgtgtggtattgatcagcatcattgataaagtatgcactggatgttgttttcccagatcagggattgatttggaagatggttagccagcaccactatgatctgactgtgggcaggcggatcatcacactggggggacacataggcccaaagaggatccagcagattgaatttgcattatgcaagccccctttgagtttcacccactagcacatgcttctgtgacagttgaattaccagctatagaactggggtggcaggaagcaggccatctccattagcttcttttgaatccatttcttcatttcctttggccctgggcatgtgggcacaaacttactcgaatggccatattcacagaagcacaactttctacagcaaggtattatcagctgttgctgtcttcggaaaggctttattgtctcctagctaagggaatccctcctttccttccagggttcactaccagcgccccacccccacgcatacatatacagacactgagctgtgttttgatatgtgaggtgggctatcagctgtgatttaatgacgagtatcactgtcagactttacaaaatggaatttcatcagatggtgagggaagacttctgcatagaaactacagagggaaatttgacagctttttccattcagttatcaaagcatttgcagttcaaagcaggtgaaacaataatgtaatcttagcactgaatgctcatttgtatctgagtgtttcaataaataaaatggtcagggaaatgaaagcagacctgttgtctccaatccactaaatttaatatccagggtattgactgacagctttttatcaccataattagtatggattgttcctgaggccattgatcaatctttcctacctctatggacttgagtggctgttttcttcctctcctgccctccccaccctttattttaatattgatcgtgccagttgtgttccaccgcagagaggctgctcacttaggcaaaagaaaactcaggatgaagagagatggctgagcagcagccatttctaggtggcatccacctgtgacatcactctacctcatctatgttgaccttgtaacttgacctcttggtaccagtgaccttcagctcctcaatacgataaccaggcacaccgtcttccccactgggtggaagttacacaaagactagctacagaagccgtggtcaggaaatatctgttgaattcatgaataccccttctgtaatgttgtcaagctaaataagggagtttggatagaccaaggaacacaaccttgtgtgtgtgtgtgtgtgtgtgtgtgtgtatgtttgaatgtatgtgaatatctatgatgtaacctgttccatataatgcaggccagaaacctaagaccttcttatttctcaccgagctcttccaatttgatgttgtcctcttctcagtctgtctatcactaggcgtatacggtgtgtaggtatacacctcactatctcttgccttaactgttgccataattcactatctcatttccctgcctcctgtcctgcctcacctaactccaaccttgcatcttcaaatcttccacacagaggacaggcaggtttttgtaaaatataaactattatagtccttgactgtttcacatctaagatccttgtcatggcacaaaaagctttctgtaacctgatctctcctccctacttctcagccccatttcccaccattcctacaggtcacactgctggaaggtagaattgcaatggatccgttcagtcattgcctgcttcacgcctctaagtcttggcttatgttctgtattttgcctgcagtagccttcacattctttttctccttggccactctttctcattcttcaggaattcattcagatggtatccctttcaggaaacattactttagctcccaaagtatccgaactatgactttttctgtcttctgagattttaatagaatatatacatatacttttttatgcatctctatcctatactagagaataaacctgaaggggacaggggctacgtggtttttcgttctgtctccaatgcaaggcacaactcctggctcctaggatgtgtttcttgcactggaaagaagtattcctaagaagagagtcagtgtgcctgaagagctggggcatacattatgtcaaactggatctgtcttgggacacacaacgtgctgtgccatataactgcaccacgaacaaaagcgaggtggatctcacttattctcagggtggtgagaagagatgggaaaatatcccttcttcttataagcaggtagcaaggtatctttctgaccttaaagaattcaggtgttgtcaactggttattttccacagtgtggaagagttttgctatctatacactggagtagttttctcattggtcttcctaatggaatttccctctgccccactttgtagtacagatcacccatttgcataacttttcggaaggatgcttcctgaggggagagatgccatgcatttctgggagtgccccatgagcccacactgaccttagacagcccccttgctcccaatctgcaagctgtgtggagcctgtcttccctgttcctggcacagcagcctgccccaacagttacaggtgctcgcacacatcaaatgcctcttgttgaggcattaaaccaagtgcaacttttccgaactgagcacaacagagccaaattggactggaaaggccacaggttcctcagggcctcagggagcctgtggcatctacattgcaaattggccccatagaaaagcaactgatgccagggccggccttcatttcatccctaccatgcctattgtggaaccgcaggggcagatgtttctggaggtgaccgcctgggcgcacacaggcgcaggcagcacctcctcctcaccggcctctctccaggcttatgtaagacagattggacagactgataccaattggcacatcgtccctgccagattggaatcaggcccttctaccatctttggggtccacggtggctccaaataaaatgtacagaaggaatgtgattcttagctacagccaattttccctttgctattgcgctggcatttctaatctcgggcattttgttgctgtggagcacaccactacaaatacagtctccagcttaggaacgttgagatttgcaatcatgtgaaaatgccttttcgtattcctacagtttgtctggataatttatttattttaatgtattatttagtgcaaaactattaagtgagcttcaggttatattgttacgttgttgctaattcagttacatatggctggggcaggtgacaacaaggagggaagatacctatggcacctgctctttcctttcctgagatttctgcagcttctgcatgtagatacttaaccctaaaagggaaggtagtgtgcatattttgcctcctggattcgtgtctcaactgtaccactgagtggctgtgaatttagtcaagacacttaattcttccgagacttaatttccttacctctaaaggtcttcccaggctggagggttaaatgacgtggtgcagatgaaaatgcagagcaaggagcctgacacacaacagagggtgggcaaatgcctgtcctctcccttgctgtcccttcaagtggccttcatcagcagacctaggcatagcacctctgaacttcaaatagtctattagtagcaggaccacatttgaagttatgcgtatggtatacaccaacttgtatgtgtgttgtttaggaaggtcattctacagagtatatctgatgcagaccgggactgtgtttttcgttgttgttgttctattcccagttgtgcaaggcacaactcctggcacctaggatgtgtttgttgcactagaaagaagtaatcctaagaagagaatctgtgtgccttaagagctggggcatctttatgtcaaagtggatctgttatggtgcatgcaacaggctgtgccgcatgaggctatgtaccaaaatatttacagtagaaatttttgagtgatgagattataggataatttccctccttccttccttcctccccttcctccctccattttcccccgtcccatcttctttccttgcatccttcctgttcatgtatttttttcgtaaagtttatatcttataaagtagtaaaagatacaaaaataccctagctctttaaaaattgatttcagccaggtgcagtgactcacatctctaattccagcactttgggaggccaaggcaggaggattgcttgagcccaggattccgagaccagcctgggaaacatagtgggacccccccccaccaaaaataataataactaatagtaataatcataataataataatgggtgtggtagtgcatgcttttagtcccagctactcaggaggacaaagagggaggattgtatgagaccggcctgggcaacatagtgggaccccatttctacaaaaagaaaagaaaaaaaataaattatctgagcatggtggtacatgcctgtagttccagctacctaggaggctgaggcaggaagatcacttgagcctgagaggtcaaggctgcagtgagctgtgattgtggcactgtaattactgtaattactccagcctgagtaacacagggagatcctctctctctctccatatatacatatgtatatatatatatatatatatatatatatatatatatatatatatatatatatatttcatgggaagccaaatgaggagggcaacatttgagtcaaacaaggaagcccatctctgatgagctttcacaatgtcctccttctttcaccgtgaggagacctcaggttcactgtgtcagctcaccctatctgacccacatccccatcactttcctcccagtgggtggaaggattcacccaaagctccaacacgcacagctgaaggagcacgagttgagacctgaagtctgaacatggcttaagatggaacgccgtttcctgaaaccatgccccgtatctccagatgaataaacttggaacatagaaaattcccaagggtgtggaacactggtaggttcagaataaataaatatgtctgcttattaatatagtagtactgttagctcagaaaactgtagaaaagagagctattaaaattcaatgattgggagagaaacatgagaagagaaatcaaaagaaagggaagaggagcatagtaaagaggcccattaggaagtggagaaagaaagaagaggtgggagaaaggaaccagaggaagaccacggtaagcaggaggaatggagaaaacagtgggaagagacaaaaccccagcaggcagcagagaagcgttgatcctgtttccagggtcagtatgagacttaggcactgcagcagccagaccacgtgactaattgtccttaattgtcatgagttgactctccaggctgggggtcccaggcacttttctcagattggttggctgacactgcaggcttctgtcatcatgcagccttgctgtctgcttcatgctggcagacattggcttgaggtccaccttcactctaaccatcttctccgttttaacctaaagattgtttccatatcgagaaagaggggatgttctagatggcacctgtgcatgtgtgggagggaggcagagatagagaaccttgtaactccctccaccagcctgccaagtccctgctgtaatcccaggcccagctcagcaagggaagcttaaacctaagtcaatttgagggtggcctgggatcatgggctccgtggcaaccagggtggatattggtctgtaataagtcagtgaaatagtgaggttcaattacttacatgttccctgaagctgaaacaattgccattatcccacataatattgcttgacctacatttttacttgaaagccttcagctaacaattagtttgaatgttgagttataaatgaacacattcatattccagaaatgaaaagggaaaggggagtgataccaacacggctccctctcttcccgccctctctttcctttgccttttgtatgatatttcaacttagcttttccaagatggaagtcattggagagtttgtctaaagggggaccattcagaggtaatgagacaactgggctttatctgggaaaggggcagcttggtcggtgccaaggagatttgagccatctggattaaaatggtcaaactctccgcaggaagcaattaagcagctccatgtggagaagccacgtgaccacgccaaaggagctgccaagaacaggagattagtaaacaaagtacccagcaggaggtgtccaggttggtcactgctctggccacttggcatttgcacagcttcctctgtctttggcatcccatctgtctgtacccacagcctacctataagctatctgcagagtttaaacaaactcaggcagaactgagtttatttaaaatgttaaaagtccagggctcgggtgatcgtgatgatacatcttagactcacacagcatcccttcccaggtgttctggcaatgcctcggatgtctttgatgactcttcgctgcctgtgaaaagcccagaggtgtactgccattgagctgcgatgtttaattccctgagcgtgatcatttagccatagatagtcacaactgggttaggaagcatgtacctagattattttagtgattattttagtgccggtctttgtgaaagcttgagaaaaagctgagttctcctttcactctaagaatctttttgtttaaaaaaaaatccataaaaggcatgtaaaactcccagacatatgccttttttcattcagtgtacatttattagccaggcactgtattagcccttgtggttagaatagagacccgttctcatggatgttacccctggccaaaagaaagacgcagaggcattgggactgtcagctactccctacatagagtcctcttctgatttccagtcaagtcagtttcacacaacacaaaactaacttttctcaaggatttgtaacatcttgaagttttcatgtgacctgcaatgggctaatgtagaatggtagttcaagtaaaagatttatcctttttttttttttttttttttttttttttgagacagggtttcagtctgttgcctaggctggagtacagtggtatggtcagaacccactgcagcctcaactccccaagctcaagagatcctccctcctcagcctcctgagtagctagaagtagaggtgcaccactatgcctggctaatctttttttttcctttatttaaaaaaattttttttgtaaagacagtgtttcactttgttacccaggctggtctcaaactcctagggtcaagtgatccccctgccttggtctccaaaagtgctcagattactgacatgagccactgtgcctgacttttactttttttgaatgagttaacggcagcttactgtgcagcaatgtatcatgggaacaatctatgatatgttctcattgttcctaatgttcttgacttccatgacacataactccctagttttctttgtccagcttttctaagctctgcatggtgcactacaccatcttgaatgttgtcatgctaaagacttcatcctatgtcttctgtaccctgtctgcatgtacacacctggaatctctttcataaattgatatctttgctccaacatctccactgagttcctgacttataggtatagtgatctgatagaaagtcccacacaaacatataatgatcattttgttttactcaaaccttgttaatgatgcctactccttctcaataaaggacaccaccttccacgttgttgctcacaccaaaatgccgcatacaaactttatccctcctttatctttcctccccatctcgtaatatccattgtttctaatcgattcacacattttgttgagtgaacttccaaaatatatccccacttcatacctttacctctatttcaacaggctttagtttaatccgctgtcatcaaaacgacaatagctgcatgagcctcctagctgacctctttgttatcttgactttcccttgatactctgttctccaaaagaaaggcaaaaacatatttttaaggaatgaaatagtgccatttgtagcaacctggatggaattggaggccattattttaagtgaagtaactcaggagcggaaaaacagacatcatatgttctcactcataagtgggagctaaactctgaggacgcaaaggcataagaatgatacaatggactctggggacttgggaggaagggtggcggggcgaggaacaaaagactacacattgcatgcagtgtacactgttcgggtgattggtgcaccaaaatctcagaaatcaccactaaagaacgtatccatgaaaccgaatgtcacctgtccccgaaaaacctattgaaataaaaaatttaaaaaaaattcaaatatttttattattattatactttaagttctggggtacatatgcaggatgtgcaggttttttacataggtatacatgtgccattgtggtttgctgcacccatcaactcatcatctacgttagatatttctcctaatgccatccttacccccactcaccagcccctgacaggccccagtgtgtgatgttcccctccttgtgtccatgtgttctcattgttcaactcccacttatgagtgagaacatgcagtgtttggttttctgttcttctgttagtttgctgagaatgatggtttccagcttcatccatatttctccaaaggacatgaactcatccttttttatggctgcatagtgttccatggtgaatatgtgccacattttctttatccagtctatcattgatgggtatttgggttagttccaagtctttgctattgtgaacagtgctgcaataaacatacgtgtgcatgtgtctttatagtagaatgatttatcttttagttatatacccagtaatgggattgctgggtcaaatggtatttctagttctagatccttgaggaattgccacactgtcttccacaatcaatgaactaatttacactcccaccaacagtgtaaaagcattcccatttctctacatcctctccctcaccccttccaccatgtgaggacacagcgagaatgtgccatccataaaccgggcagtggggcccaaccagaccctgaatctgccagcaccttaatcttggatgtcctagcctccaggacaatgataaataaatttctgttgtttataaggaaaaaaattaaatatttttaaaacatgaatcttctattatattgctcccctgcttagaacctttcatacttaaaatccagtctacttatcaaggtgtcaagacctacacgagttagcccctactttcccctcacctccatgtccactgtgtcccactgggcctcttggccagccatgctgctctcctctcggctccgggacgccacattttctcctctctcagcacactgagtgtgcacagcattgtgtactgtacccaatgtgtagtcttttatccctcacctccctcccactctttcttccaaatcccaaagtccattgtatcattcttgtgcctttggcatcctcatagcttagttcccacttatgagtgaggacataagatgtttgggtttccattcctgacttacaatttgcctggttctcccctcttctgtcccccagtcctccacctgacaggctcctgcttaccatttgggtttcaggacaaatgttacctcctcaaaatggacttccttaaagacataacaacctttcacttgggctcaactctagcccaatgccctgtgtgttgtcttcggagaacttactgctctctgcaataaacttgcatcttttttcttcctgtttctcttctgagtagtgcataggctccaggaggggagggcctatgccctgtcttttgtgtgctataccccagtggctagaactttgcttggtgcagatttgatgctcaaaaagtatttgctgaacaaatgaatgaatgattacataagtgaataatgcactcttctttccataattttggttttcctggcaccaaaacacttaggaaataatatggtcttcaaagtttctgcatgtcttatctctgccaaggacagttgcctctccggagaactgaattgtcgacatatggctgaagtgtgatccagtggactggaggtatgcactgagtatattcctaatatcacgttgccctgtggcatggggcttaatgcctttccatttttggctgaagggcttcactgcaaatgctttcaatcatatccatgtttggttgaaattttatggcaaaagataacttagagacaaggatttttatttgaaaattacattaaaatatactgttatttctaaatatatgttcaaaatttcaatgaatcaacacagagtttttattgaacttctctattcacatagcatatgaattctcactttctgtcacaagagaagtaaaacttaggccaagcatggtggctgatgcctgtaattccaacactttgtgaggctgaggtgggaggatcacttgagctcagatgttcgagaccagcctgggcaacatagagagacctcatctctactaaaaataaaatttaaaaaattttaaaaaatatttttataataaaaataaaaggcatggtgatgtgtgcacctgcagtcccagctactttagagtctaaggcaagaggattgaaaccaggaggtcagagctacaatgagccatgattgtgccactgcacacaagcctgggtgacacagcaaggccctatctcaaaaaaaaaaaaaaaaaaaaaaaaaaaaaaaaaaaaaaaaaaaaaaagagacagagagaaagaaaactatggtccaaagtttaatccctgtttaaaacagaacgggctagtctccttggtagcaatgcatgtggcaggaagtccccagaaatttatgtgcatgcctatgtgtgtgtacgtttgtgttgtgtgtgtatttatatatgtgcacatatataaatatatgtattttttatatatacatatatattttttcttgattccttgactttttaatctcctttctctctatgtttaaaagttttagaaaacaaaaacaaaacaagccttccagtcaaaaaattttcagcacaagataagtgaacagaagggatctatcatcctgaactgtttttcataagccttcatacagctttaatgcaacacagaggtttggacacaagggtaagcatcaggcatcgaggagctcaaattccaattcgtgatgctgcagtcctctgcagtcctaagcaagccagtatggctgctcagtgtcacagtatgccctgtgtaagatagggattgttttaggaagatcagtgaaagtttaagaactgacctcctgaaaacagttgtagattcctcagacatcaaagtcagctaaagaaaaataagtgctaggcttcagattcatcgcaccaaatgacttcctatctaaattctacaataggtaaaatagaatacgtttcttctaaccaatcaacaccacttggaagctggatctgtctccataatcctggttagtaataaagatgcttcaccactagtttgaattttctggcgaggttgtcagtgattcgtgcttgaggcagaaggaaaccagtttgattctcgcataggcgtttggcaaaggaagagagaaactttgcttttctcaacagaggctagaaatgactcagactacaaatagctgctctgccatacaacaaaaggtcatccctccctctcatttttcctttcccatttgtcctgaatgaaggccaagctatatttccccatctctctcttctcatctcaaaatgcatagccttctttatgtggtgcattctagttcggattggtgtgtgacccaggctaagacagtgttatgcagattggagcatcttaaacagaccacaattgaatcagtcttgccaccatttgtcctgtccactataaggcattgaatggtaaatgaaagaaactagtgtcttttattcagcctagttctcttcttgcacacatgtttcacagaagggtacagctcaactcttaggggaaaaatttctaaggaagaaagaaaaaaatgaagaaagacattttcagaaaccattcccttagtaaataatgagaagtcttagagaatctcttgtgtttctctgatttgatagagaatgatgtttcagctttggtatgggaatgactggtggagtcaacagcaagaaaacgagactcccagtgggagggtgtgtactgccaagtactatgtaggcaacactgaatgcagccaagaggcggccttccactagagaaggcatcccgctctctaatcatgacgtccccccgggctctcagagggcaaaacttggaccgaatgctgttttggtctaacacacattttctgggactgcacacttacacacacacacacacacacacacacacacacacacacacattacatggcaagtcttctggattagcaggagaggctgctgatcaaatgcacccctgggcttctattcagattagctttgaatgaaaacaacaccaactctgttttcttattttaaagatcacagagataatcttccttggtcacagttggggaaacagccagagggggtcttgttacctccagaaaagccgtggaagatatctgaattcctgctgggcctattggaccatcttttatgtttttagacagaaagaatctaccccagtgagattctgaaagcagctcctcccagtcatcctctcctaggtattgtttatagctgggcccgtccctcaaagtgtttatttttccgtacatgcatacatcatgcacactacctgattgctttgatcaggttaaggatgggagcaggctctacttgcgagtcttgtggcacttccatgcagcccgtgcccagtctcagcgaggcacttctcctgggtggttggtaagatattcaactagagacttgcttcttaaataatgttggaatcatatccacggttgtaatgaacgcctctgtgatttgcatttaaatagtattttcatccagagatcacaaagaggaaagctatcttaacatcctgactctaattctctgtatctgaaagccagtctgtgtgcaccacgtacacattttccctctaggtctctttcagatctgtgtaccctactgatcaaaacaagcgtttgcttgcattaggatggaagaccccgacagctctggcatgcactggattctctcgccgcacccgcttcatcaacctggatccccatgagctctgattgaaatgcctccaccactggctgggatgtgagaggcactcccagatggtgtgctcagtgccaggcagttaacacaatcatttcttgggttgtcaatgaagccaattggatctggaaatgattgagaggcagtaaatatagacccccaaagtcaccttagcagtctctttccagagtacagttgtgcttcgaaggactccatgcaatcctaaggctcactttccaagccctgggaggactagagagacaaagggctggctgggctcagagacaggaaagggcacagaagtcaacatcaggccctagctttcagccccactgatggctgctccatgctgattcctcagtttacccatgctgcggctctttccacctgactccaggctttttgtttcttttcatgtcattcttcatcatcttgtggaaggatgttttttcatattgtacagttgaacttatttcatcatcaacaaatttttctctttcccatggattctttaaaaggcgtcttttgaagatttatttctattcggatgcaagcttttgtttaaaaaaataaaagagatgtaaatatggaatgttattgaaaagatcttatcttgcttttgacatgacatctaaaaatgtgtttaaaataaagagcaagtgttgttcaaggcatgtatcaaggcagttggcttcctgcagtgagagctgggtagtacttcgaacacttttctgcccctatgaaagcctctcacaggttaggcccctgcgacccagtgtcctcctccttaaatgtccctttctgatcagccacgagagggcaatgcagggcacttggttggctgccttggttggattgcagttggcaagttactttcagtgagggaagctactcagactatgacagtaattatatcagtctcataaaaaccctgctctccccaacttgctgctgccctttttcctttgctgcctgccttccttcctttcccatacccctggccattggctttgtatttgcagataactcactcatgatcctataaggcagagaagagtatgtgaaattaatgtttgcattttaaactccgaactagaataataggttgtttctagggggaaggatcttggagatcatcaagtttagcctctttaagatgaggaaacctaaattgggaaaggtggcctgactggttccaggtcacacagtatcacgggtaggctccaggggcatagacattctacaaatgcctacattttctttatccagtcatctgttgttggacagttaggttgcttccatatcttagctattgtgactaatgctgcagtgaacatgggagtgaggacaatcctttgggatagtgatttcattttctttggatatatacccacaagtgggattgctagatcccatggtaacattttcggcaacatggatgaatggggagggcttcaggctaagtgaaataagtcagacgtagaaagacaaacactgcatgatctcacttatatgttgatctagaaaaatccaactcataaaagcagagtagactagtggttgcctagggtgggtggagtgggagagaatggggagatgctggtgaacgggtacaaagtttcagttacgtagggtaattctggagatctaacgaacagcttggtgactgcagttaacagtactggatagtatacttgaagtatattgagagtggatcttaagtatcctcaccacaaaggaaagaaaagaaaaagaaaatggtgaggaggcgaggtgatagacatgttaattagcctggttgcagtgatcatttcacaatgtatatgaatgggaaaacatgagattgcacaacttaaatatatacaagttttatttgtcaattattccccaagaaagctgaagaaaagaaatacaataagattagggccgaaaacaaaggaaaggtagacataggtaacattttcctgtcaggaacacacaaacttccagaggaatttgggaaagaggagatgactctgtgggaggaggctcagccgtagtctggatggtgatgctctgttctacgcacagtagcctcggtattcagccagggacccaggagctattgaataagccatgactcagtgtttctgtgaccacttgcccttgtctttctaatgtttgcttaatttacaaaatgatgatgttgcgttcctctcccttcattgattatcactcaaaccttgtaggagcctttacctgcaaatcattcacacactatgtggcaagggctggtgagccctgctctttcatcagctctcaacctgggaagatcctttctctattggggcaaataagcaaaacaacctaaaaatgcctttacacaggctcatcctcctccttgtaatgctctttgccccattcatccattggttgactgctatagcttcttctaaactcagctcaggtgtggccttctctgcgtctctctgagcatttctcctttctcccagttccctggattaggcaccgtatcagtcagaaaccactctaggtataacagtagttggacttggttgcacatgtgatgcaagggctgagaagcctaccaggagagggtgaggcaaccaagggagtaaacaatggtggacttgactaccctattcccacttccacacactccatagggctggagggacacagggtgagaaactgcttttaagtaggggccaggccaatccagcaagtgctaggaccatggaggtaggggctggagccactgggagacactgcccatagatagtacccaaacagaagtggggggtgatactttctcctactcttccattgaccaagacagtgctgaagccagagggagaggaagcctgggaattatagggaatgcagtttctggatacagagcaaggcagagaatgttgggaaatgaaggggacagatacatgagtgcccgcacctcttctctggactcttactgcatcttgtacttaaccaccctcatagtagtaactatagggtgtccttaacatcattcagagcaggagtgttccttctacctcaaggacctagcatagtgcccagcaccaggagatatggaaggaaggcatgcataggtttgggaaattgtgatatgccatggaaatgcaagtcatgattattaagatccagccaaaagcgtgagctctgctgaggatgacagttatagacctttcttcaccacatctaacagatggctcagcccctttccgtgatgctatcctcatttgcagacttgaaaactagtgtagttaattaaaataatatgagtgaatgaaatataggtgtagggaagaaagaacaattctgcaaggagcccaggtcgaagaaaagtaagggggaaactatccatcgaggacaacacagagcttcttatgctaatattttctcaagaggtgagactatttcctggcatcatttgatcaaggcagactctcatcagcccccaaagtcatagaagtccaaagttccagaatgactcacattcatttctaattctgcattggaaaatttctattagaaatcgtgagtgttcatttaaaatgattgtttttttgtattgcaactgctttctaccagtctagttaaccctctagcaatgcaaatgttgttcattcttgctacacgaagacaaagagagtgtttgccaatgtctccataagggaagggagcattgctttttgtttcttctctagttgattgagtttgaaaaggttagaaaagtgtgtcagtcttcagactggaaactctgagcatgggcccctctccctagtctgtgccccaccttgcttggcttcctggccatgtgatggacaataccaagctaagcttctgctgatggaaggagtgacaagtctttgctctcagaagtgaagggctgtgatttgacaaagggctttgaaatattcttatatataaagcattaatttcattaatgtaatcaatgctaaagaagcagaccaaccgggccctttgattcttcccaggctaaaatctgttgggctgatgtgatataccaaaaataaaatagtacccctctccatacttcctgttgtccacacaggaatttattggtctgcattggatttactctctgatgtatttgtttatttggggttttgtttgtgtaagttccatgagaacaggggcttagcacttaaaaaatactttactgctctgtttctgaatctaagaacaagcacacagtgggcgctgaataaatgagcattgtacagaataaaaagtaccccagacacctgtcctacttcagggcaacactgagctgttagttataggtatctgtccagttccttgtctgtgctcataccctcaagtacctaattcaaaactgaagaagaacttgggctgccttgggaccaatgactccgcgctaacttgaattaaatcaatcttgtcactcccatctgcctgcctccatgtcatagtagattaattgcaacataatataaaacacatttatattgcatcttcacaatagtttcagggtcctttacagtcttacaatctaattaagcggtagcttcaaacatgaatttctttagtattttaaaagcgtaagttgagcagataagcttttttttttaacttccctattctaaaactgaaagaccagctgattccaaagtccctgagtattattaattaccagtggctgcaatcaatgcacaaggcttgtctagaaagctatttcctccttaggtgaatggttgggaatacaatatatggtaatcaacaatttgagagggctgagcatggattgaggctgagaaaaagctgggacttggcattgcatctctcctgtgcagatggcagagaataaatcttgactttgcaaggaagataaagcaaggtggaggtgttttcatcgcaatcgcacagcacataaatggcagagagaagaaagaaacctcggaacacgggcttcctctccaaggacagctactgctgttttggagaaagcttatctgctcttatttcaccatgagagaacttctgtcctcaagagccacggaaagggtaccagaaatagatgagagcccaccaacaaaaggaatgatgaagtggccctttaaatataaatctctggcacccccaaactctctggatgttcccttacgtattcaaatgagatcgcagcgtcagattggtatgcattaggctggtttcaatgaaaattaacatgtaattgcttcaaatgaagtaagtgaggaggtaatctgttcttaaattggattcccgggattttgtggtaccataatgcagctgtgaaatgaaatatattttaaggatgatgtcctcaagggggtgaaggggctgggagggggaggagtagagatagatagtgtatagtagaagcgcctctccccccagcctgccacattctttctctgtctcattctccagtttccagcggatgaaaagatgttctctcatccatgggtggcccccatgctctgggccctgggacctgggcagacagtgccccacattggcatcagccggtctcctctacttcttactgtgtctggagcttattcccagaggctgtagctccccagggctgtagctctgtggtcaccctggacactggatttgtaaggagaaggtgctcgtcctgcaagtggtgtctactgagatcatcaatggctgaagggtgcactgctacagttgggcaaattttccaaagcacactgtgcagtaagaaaaaccatcactccttgtactcctggaatggggacatgtgcgcttgacatcatgactgacccttctgatatcaaagagtggagctggggtcgcagcagcaggaacagccaattccattaccaccaccggcctccacagcctgggttcagccagaccaggcacccctgccagcagtgatgatatggtctgtgaagtctgaagatgagcctgggaataattaaccttcttaccgttcaatcaggacgggaagcagctgggtgaggagtcagtgcaggttaatgcattaaattgtttgcctttgccatcctaggctgaaatgggattttcagtcacaatggaaataagctggcagtcttctggtcccgtggcatcacgcctctctgccaaagagccatatctgatgggctttggggaccttctgcaccaaggctacagaagggcagagctgttaaatgaaatgcaatcacctggcaatgcacaggcagtgctgggttagggttcacacagcagagcagtgccactggtctagaccgagtccccatcaagggctagcatgagaatggcatggctgccttgcatcagctcctggggagatgcagatttataacacgctatataaagagtatatgttctggtgtaaaaagcccccatcagagctagagagaagggaaattgacaaatctcagaagaatgcgattctgggcattctctattgcacgcgaatcaggacccccgtctgagccccccgcttgccttccctcccagtcacagcttggttctacagctcggctgatgattttttttttttagttcttgtctttgtttcctcctgtttatgttgctattttctttctgcacatgttgagcagctctggctttaaaactgatcagagctcatggctccttcaaatgtagacgttgtattgctacagtctctcaatatatgggaccaagatttttgagagaatgccagaatgtttctgctcttcccaggagttggtagacttagaaatttgaagaagagaaaagggaaaagaatgagagtgaggggtgacaaaactcagtttacccgactgagtttaggtctccctaaaaacagtggcctgagacactttagacccagctaatggcttttatttcctcctctaaggttgcaagagacagtgtctttgctgtgggcaaaagagggaccagactatgaccaatgattaaattttgaatcactccatataaagaataggacctcttttgaagaccaaatctgtaaaccacattggataaatcatctatgttgctggctcctttctttcttcatctggtagtaggcatagaatagtatttgcctccctgcttagggttctgcaaggattagtaggcgttaatatccacaggagtccccagagagagatatgccaatagcaagaaaagagagcttagcgtccttttctagattctccgtggatgtggaatctactgtacagtttatttgtcgtctgaaccccaaggtgcctcttggtagagtatgcataggctgctgcaagcttagctctgctggaagaggtgggatggaatgtattttgtggggagtgcgtgtgtgtgtatgtttgagagagagagagcacgtacactcgtgatttttccatgatctaatatcttgaattaatcattgtaatgcctttttctgctatcaaaatatgtccagtggtcaccttgatatgctcatctggtttaactctcctcaaagtttgcagtgttcacaggagaaaagtagaaggggccagcggtttcattcccattttagagatggggagggtttcaccgcaggagcctgaggatatgcaattcatcttaatcactaaagttgtctcaggcaatgacctctataagcccttcttccctggacctcatttgctttgaatatgaaatcagggtcagggtgttaatgtcctactcttaaaatgcaaactaacgtcaaggtctaagtataaaaagtaaaatataaaacaaaatgcataaagttgtaccgactgtagataccacagtataacagaaaatactgaaaaaaaatatgaatctcgtataagactcctggggtcaacagaggcgtgatgaaatgcaggagatgagggacaaatggaaaatgccccagctccatttatttaagtaaaaagactatgaagtacagaaaatatgagtgaaaagctggttcattataggatcctgttcccagctctattcttgccaatctccctttgacctaagaaatcctctcctgtttctctcttaaattctacctcagaacctttaattctcattttattttcctttcccatgagtcatttgtgtcctcacacagctctgtgtccctcgattccaatgggcagacccacccctctgttcctcccccctctctcgaaccagcctagactattttgccaatagttttcatgcataataacttaagtgcatcacttttctacaaacatgttatcattagagttcaattcttctgctcctagcctttgtgcctggtaaatatacttctttgacgagtgttttggaagatggctccattttatgcatgtgcattagtgccaattgcacaaagcagaaacacaaattacctgtattctgcagacagatctaatcacctagacaccatgggctggcattcattgcagcctccacctctatgcatgaaactgaaaggggagcacctaaactgcctattaatttgaaatgtaggcaaagtgctataggcgctgaattgcgtgtttaggaaagctgtagcaagccattgtgctaggagccgtgcactcggtgtgggcctttgctccgaatagacagggcttctctttgggaagatgtagggctggggcgctgggaccctgccaaagtgatctctgcctgagactggaagagaaatgagataaataaacaagggaggccaaagtggggtgtgccccctggataggacacttggaggggtagacgtggattttccccactatggtgttctgtaagattcttttccaactggttttatttcaacaactctgtagtcagcaaatcggcctcccctggggctgttaaagtcaaatccaggaggttttcataggaatgaatacttgtaacctaaactggggctgcgcctactgtcagagttcgtgagttttttaaggatgcctgaagatgtgcctcaactacctggcggggaggaaaagaagtcccctctgtaaatgagctgacacttgtctgataaaagtggtgcctttggtctgatcatctgaggacaaataagcagcagtgccacctcataaagggaaggggtacctcagagccccaggggtgtcctgagcaaagggagcactttccacaccagctgtatttgggaaatctctcagccagggactcacccctttctcccaaatctcctgagctccttagttggcgtttctttaaagatacttaagtttgccctgttcagaatttttctgggtttgtagcttgtcacagtggtgcccagaattagattcctgttgccttgtctcacacacactcacacacactcacacacacagactcactcattcatctaattggaaacaaaaagagcaagggagatggaaaacatggactctagttgttctccttcctcgccacgttgaatgtatttcctcatgctccccctggctggcctcctcctggcacacttttcctatcttctcttctgtgcatctccccgtcagccttgcttctctgcatctcactccccctttgcttctctctcttttctctcatctgcaatgaggctgctcaactgccagagggtcagaactgtgagggatcagcatgagggccacattgacaaggaaagctgtcatcaaattttacagcttcatgtaaaatgcactgtccatggcaaggacagagaagggactggaaaggcacagggggcagtgtggggagaaggggtagttagaagagaggctctctcgtaggtgaagggggaggtaaacctacgtgctttctacagaaaggtattcatggaggcaaatctgccatcttttctaaacacaaccatgtctctggaagcctcactaggagaccaacaattaataacagtgtcagttatggcatgtctgtgtggtccattgcatagaacgacagaggaagctgatccaagctttgagtaccaggaagccaagggtagcaatgtggatgggcctatggccgttctgttttcggcgagagctagggaaatcccctgccactggtccttcccatacacaatgctatatgcgcatttgatgagccagccaacaggtgcctgagtacctgccgtgagaccagctggcaatagctcctctgaggcacagcagaatggaccgtgtgctaaaggcatcaacagcctgggcaggcaaacaggaccagcccaggagagtccattagagaaccacgcatgtgccggttactgaccaagagttaggttcctacgtgtgcacagccttcccccagattccattccttaggactctgcacccatcccatcccactttctcaggacagaaaccacgaggcagagttgtaccttgccttagagtgtccgtctcctggagaccgtcagtaggatccagtgcctgctttgtaatttagtagctttgtgacccgaggcaatttattaagtttcagttcccttgcaggtaaagtggagatatttttgtttactaccacacagagtggccgtgtggctcacataacatgatctgagtaaagtgctttgcatagtgcctggcacactccagtgatcaataaacgttagtcagggtcattattgtgctatgccccttcctttctgctattgcccctcccatccccggatcttcgatcgggccatgggttctacttcccggtgtctcctgtctccatcccttcctgtccagcccctggggccctgccctccctgagatctcagcagccgtggctgggctggcttttggtggttttgtgagtgctctcagtctgcagggagagacaggctccaaaacacaggtcccagcacagtgccgccctgttggaagctcttggcacctgcgccttagattccttaacataacttaaaatgcccttcacgaaagtacttctcttcacctgtccaggtttgttgcccatctgcctccccatttctacccaaatcctactcagcagctgctcacaataatgattctcagttttgcacatcagaaaaagttgtggaaattgttctgaatattttttgtgtacgtgtgtgtgtgtgcgcgcgcacgcgcagggcggggttgcttgggtaatttataaagtacaggcatttatataaagctccacaatggctgagtgtggtgtctcatgcatgtaattccagcattttgggaggccaagtgaggaggattgcctgagtccaggagattgaaattgtcagcctcagcaacataacaagaccctgtctctacaaaaacaaaaaaacaacaacataaagaaaaatagctgctcctggtggtcctagcttctgtactcctaggtactgtagctagcgccagttgtctaagctactctggaggctggttggaggctgcaggggtgatgattgtgccactgcacttcagcctgggtgccagcatgacatccatctccaaatgaataagtaaagcaagttctacaggtgggcctgatttgcatcttgagttctagagcacaaccttcccagacacaccctgccttcctcacactgcccgcatatctgtctacactcagtcccagcaaacgcaaacggatgggctcacagtggggatgcaaacaaagatgaggcgactgagtgagtgaatcaggaaaggatgttttcattttattgagtgaattagactaagtcaaaccctcccttagagtgtaaagtagaagataaataatgtactggtgtgtgtttgtgtgtgtgtgtgtgtgtggtgtggtatgtggtatatgtggtgtgtggtgtggtatgtgattgtgtagtgtgtagtgtatgatgtgtgtgtggtggtgtatgtggtatgtggtatgtagtgtgtgctatgtgatgtatgtggtgtgtggtgaggtatgagtgtgtatgtggtgtgtagtgtgtggtgtgtgatgtgtctgtgatgcgtgtgtggtgtggtggtgtatgtggtgtgtgtggtgtgtagtgtgtgctatgtgatgtatgtggtgtgtggtggggtatgaatgtgtatgtggtgtgtagtgtgtggtgtgtgatgtgtgtggtgtttggtggtgtatgtggtatgtgtgtcatgtggtatgtggtgtgtgtgtcatgtgtagtgcgtagtggggtatgtggtgtgagtgtggtgtgtagtgtgtggtgtgtgatgtgtgtgtggtatgtggtgcgtgtattttgtgtgttgtggtatatggtgcatgtgtgttgtgtgttgtgtatctgtgtgtgctgtgtggtatgtgtggtgtgtggtgtgtgtgtggctgggtgtatgctgtggtatgtggtgtgtgctgtggtatgtggtgtgtgtgcgtgcatgtgtttgtatgtgtgtgtgtgtatattgtgtgtgtgtaagagagatcaacaggggtcccaggcaagggggatgagtgggctgttggcagaggaagaagcgcagcccagcaaaggtggagcctcgctttccataagcagcttgggtccccaggcgcccctgcgcgatgtgggagtgggagagactgagtgggcgcaagggtctcgccacctgggtgtgtgaacgagtgcagaaatacaaacagctccgagccagaggatccttagtccatcaattctttgcagaagaaaagtctgatggattgaaattgtcacacaagaacgctgtgaacaatagcagggagatactgtttctctccagcccagctgtggtgagttacttcttaatggcaaggtagggagacacacaccacggacaatgctgagggtgacaggagatgcctgtgccagttatttattatgggagaggaaggtgttccttctactttttttccttccatcacccccttcttttctgtgataagtgggggctgagctgtttgtgttatgcagaggctgacaaaatgaggcgatcagattggaaatcaaagctctcaccatggctggcagtgtgcggggacttcgcagccacctcccatggcgggggcaggaggagggggaggaagcagctgctgtcatttctcccctagcagttgtttttggttttacttttatttctcccaagaggagaggagctggagagggcagccaaactagcacaagaaagaaaaggagaaagagggcaagaatggaaatgcggaaggagaaagagccctaccaggaggcaaagggagagggaagcgagaaggagggaagaagcctccagaacgtgcctttttccgatttgtgctggctgcgaccttgcagcctgtttctctgccagctgcccctcctttgctgtgagaggtgttttctgtgacccgcaaagcgtggtttaatttacagggtgagttggaaatgattcaagcatctgctcctttcaaatgttgggaaactgaggcacagcacattaagaactatttaacttgcttctttcgggccttattgtcagtcttttttcttgagagttccagaaactatttccatctccagctttcaggatgaataacttattcaggcctttgcttttctggtgcgttctcccaaaactcctcctatttcaaactgccccccaaagtccctgagcctgagtcttatgggttgactctgccctctggtggatcgaaaggtggtgaatgaggcagaaaagggagctcgttccagaaaaacataccttggcaggcttcccaggaaagtctttggttaaagcaacccgaacccaaaatgaatacagctcaatatgctgtgatgtattaatatcctgataagcgagtcagaatgtgtttccaaatagacctattacataagtggcaataaatactaacccatctctcaccttgctgcggtgagcgcatagagagggatctgcagtgtgggattccaggcagtcttggcgatgctgaccttctgacggatggggaggcctgagccctctataacacaggtcccctgtgacatccacatcacacaatcgtgccctttgcccacctttttaatgactttctattttgttttacaaccagcaatctgctgcatgtgctggtcaacagtatctatcttttctgctgtggcttgctgcctcggatgcttttatgggcattgattccctccactgcttccccaaagaggttcttttccttgagccagagcggcattccggcggattacagtgtctgccactctgctctccgatttattgccatcctgggctttagtctccctacattcacagccaagcctcattcattttgttttctggggcgagcaaattgaagaagttgctattaataggagaaagagtgtcatgccggcagacttagtagtgtctaacgttatagcctgcaagtcccagagccaagctcttgtcttagatccacccttccccatccaagggactgaaccaggtgggatgctggcctgggcattggctctctgaaagatttacacttttctggcttttgtcgacaaaggatattctcatatttgggcactctcatccatatgtcctctccttttccctgtgaccatcagtttacatttggcagaaggctgtctggggttgtagatgaagtctgagggcagatggctggggacaggacgctggagaggagaagcacatggcagtggtataggatggtttgcttctcagctttcccagacactaaagtatatgaatccaattaaagttgttctgtgagtgtgtttttttttttacattgataaacatgtttgctaatcatttatcacaaattaaatagtagagcaatttctaaacaatgtcctacagataatgaatgtcttttgaatatgcatacacaatgttacatctcaactgttgctagtcctgtttactctctcagctgtagaatttagaggctgcctggggactgtagagagcaggacatcagatgttgcctctccagggaccatcctcagatctttgtggactggccccaggctgtccagatgtatatctccttcatgcagaaacaggagcctcaaagaatcttccagtgggttatagttgtgggtgtaggagttcacccaaccaacttaacttgccaggtgatcacacaggtacaagaggctgataaggggctgggcatggtggctcacacctgtaatcccagcactttgggaggctgaggcaggtggatcacgaggtcaggagatcaagaccatcctggctaacacggtgaaaccccgtctctactaaaaaaaaaataataaaaaataaaaaaataaaataaaattagccgagtgcggtggcgggcacctgtagtccccgctactcaggaggctgaggcaggagaatggcatgaatccgggaggcagagtttgcagtgagctgagattgcaccacttcactccagcctgggcgatagagcgagacaccatctcaaaaaaaaaaaaaaaaaaaaaaaaaaaaaagaggctggtaaggtcagaaatcactatcgacagtgtagaaatttttctttgggatgggttggtgtcacaagtcccagcaggttattgagtgaacaattctctttagaaagtgccgctggaaaagtgtagtttgcaaaagatgtgtgtttgtgtgtgtgtgttggtagggtggatagggtggggtctattggtcatatattctagaagaggaatttggaggtggctgtatagggacttggtatccaaaactgtttgcatttctggaagagcaatgttgtatagtgcatacagctgtgtacgtattgttactattgatgctctaagtgatagtttagaaccaacttaggggatagttttcctgtgtctcacacatatattgattcagagtctctggcactatcctcagtaaggtaacaaagggaagcaaacagatcccaggagccctgagttgaggtcttgctgttcccaatcagccgatgtatcagaactctgggtaacttgacccagtagcttaggccctgcattcccattctggctttgaagacaggagaaatgtattttaagacagaattcctaaagacagacctcaggtgggtttttcatgcctacctagaagtaaggttagcttcagttaatctacagcttcctgtgggctctacctcaaagtcatggaagggaagacttcttaggaaataaaaactgatttttgtcattatttttcttcagtgcacacacagaatatctgtcctccaacaccagtcatttcaaaatggggctcctaggactgtattagaaagaccaagaagagcatacagtacaggaggtaccaaatggatacagcctcaacattctgagctttgccagaaatgtctgtctgtcttctcccactgtttcctcaattctcttcccctttttcatcttcacctacctccattttcttgagttttcttgtgcagttttggtcaggctttttattgagaacaacctcaactcctgccaatgactttacagccttcctctttctctctggatgttcttaacaggtttggatgaagctgaaatgtaaatgtatctgattcttaattagaagaattcaattccagagtctgttaggactttgggagtaggagatttgttttcacagtaaatattctcagaaggagaagggaacctagtctgatattcccagaggtgaccagtaataggaaatcatcttgacagatgaaaccactcgtatctagaaatcagatgagtagcgggatgagggaaagacagtgaagcctcggaagtgggagttggttcagctttgttagggagatgcaaggagataccacaccagtcagagaaagtcataagatcaagaggtatggaatgtggctctcaagtggaaaaaaaaaggaaggtaccgcattttccattctctgccttgtttttttaattcccgtgataattacaatgagaggagcaatcatgttgctaattttacttcatgcgtttaagttctaattaatactatctggttcttctgcgttctgctgaggtgaaatacagcatgctcctttgcacttacacctttctttctctcaagaatttgcataggaagtgaaggcatgtttgcatgtatcgtattttagtaattggcatccctgccttcacagttctacaccactttctagtctaatctcctggacctttcctctctccattcaccttggcaaaagtggaacagctaggggtttcaaacagccctgcccctcagagaatagggaagtctgatggagttgccggcagcagacctaagccgccagcaggctcttcatggatccccacagagcaagatgggagatttctcacggtgagaactgcacggctgaggccgcatagacattaccattgtcctgtacagaaaaggaaaccgaggcccagggtgatgaagtgacttgcccacgatcacacatttcatagcctcagatctgggatttgagatgtgtctctgcctccaactttcttatgatgatgctgtgagatatgaattatatgagaaagggctttgcatgctgtcatgtgcaaggaaagtttgagctattatttttctggttaattaacaaaaacattgtcatgaaatgtctgctgcattctccgttctcattttgaaagcttttgtggagcacaaaatgttgctttgtgacttctagtggcatagctcacatgtgctatagatgcacgcgtgttatgcttctggcagcccggtgtgagtaaccatggaaaacagttggagaggtgccagtgttggggctgagtgtggggccagctattgtctcagagacacctggtttaggacagatgcctgctgcagtgtgccttcacttcaagcaactgatatttactgactgcctgtgataatgaactaggtaccatggaaggcacaataggttgcaagaggattatggaaagaaagataaagaaaatacacaggccctgccttcagaattgccatatgggctggcaaaggttatgatggaaccctacgaaagtgcagccttgttgggtcagagggagccttgtgaaggaaggggtgtgtgggcgagtaagtagggaggggtgctgtagacagaggggcagtgtgggaaatgggttggggcatgggagagcatgccacactaaggaagctgcaggatcccagacctcaaggtcctggcatgttcttctgaactctttgagcttcatcctgaaggcagtgggaaccactgaaggctcttgaacaagtgattctcaaacagatttgttagaaaggtccctgcggcaaaaagagtgactggactgaagagggttgcgtgtgggaccaaaagagcaggtggaagaggccccccgctcccactgcctggtgttcagaagatggtccattgaagcttaggaaatgatttgagcttgtggttggaggttcaaaattagagagaatgcatgcagggaaataactagctcttctacagcctggctagagtcccttcctacagagaccagttaatagagagcatcatcaaaggcaccaagagtttccgtaaaggacttagataattatttgcccagtgttggttgaaggaaattactttggaatgaaccagctgatgcagttcaagtgcccgaggatacattcctctgcctgacgttttatacctgtgcgaccactgccccgcccccatctgctcccccaatccccgtcaggatcctgcctgctccttccaccagggtgggaactacagcagagtgaaggaaaacagccctctcctaacggcttcctttgtttggttcagacttggtcattgtactttgagagttaaaattgggtctatttctttctgtatccgtccggtgtttgtcattcaattgcctgtgcaggttctctgctttatttcatttaagtagctgttatcttctttgtatcataagctcctaaaatatagagtaaggaatatgttttgttctggagagtgaacactgcatcttcacaggcatatgagctcaataaataaatgtgtaatgttgaacatagtgatgtagccatgtatttggttacttggaaaataatagggaagggagggaacgatagcatccgcactcagaaggtttgtaaacattaacacctccatgctcctgcggagtccttgatactcttcccctcaatacttacatggaccctcattacaataagaacagggtggggtagagaccatttttccccattgacatatatgaaaactgagtcacagaaagactacggactcaggcttgtcgcaacacaatggaaaaagagagaagcaccccactggactccatggaaatcaagctactaggcatggttgctgcctctctcaaatatgaacaagcaagctgaggtgatcgcaggtaaaatatatgaatgcatggcggcttccagatggcagaaatcttgttaaaatctgagtaacacccagtgcattgtcaagctttcaaaatgttcattgcaaaatcttacaatccactcaccccagaaaagactattactaattttgggtcaaagaatcaggagatgctcgctgtcatccaaaatctttcttgaagtaagtagctaagtagccttaggcttatgaaagaaagagctgcacagacttaacctctgtaggttccttattgataaattatctcccatgtctctcccagcaccatatttatactcatttgtaaagttctcagcagaaacttcacttctacaagcccttccctgacccattagactaggctgggttcctccacacacgtctactttctgcacaacacccataatttcctatcataagaaacagcacacttctgcattataatcctgtctttctgtgcctctctgcatgagtctgtcttgtttgcctctgcattgaattccttaagagcttaacacaatacatggcacataggaggtgctcaatgaacatttggcaaataaatgggcatataatcccatcctaatgcacttcagttcatccacatctttggagataactgcctgaagtgaagtttaaggggtaagttagaagcacaggtcgggggatggctgtgagttgaaaggttccccgggggacctaaagaatgggccacagagacccctgacacacagccctccctgccagccctgtttaggtggattccagcaccttaagagcatgtctgtttatatgtctgatggtgagaacgaggcctaacgtatttgggaaaggcaactcccaggaagaggacgtttccatgcttctgtttctggcagtgatggacttccctgcccccattatctcttcaccctggcttacttctttattgcttccaaatatgatttttctcctgccattcggctctgcttatctgctttgctgctgatgggagcatacttcccagcctggcatttgagggcagctacagctgactctagtctttcttcctcggtgttctctctctgctctcatcagaccaaacctttaaacatctgccccagagccacacccaaatctttattctttgtttgtttaattaattaattaattttaaacagtctcactctgtagctgggactataggcacatgccaccctgcccagccattttttttctttttttgtaaacagggtctcaccatgttgccctggcttgtcttgaactcctaggctccagccatcctcccaccttagcttctcaaaatgctgggattacaggcgtgagccaccgtgcctgccccatacccgtatctttggatacctttttcttcctagggggaacaccttctcacctcttttctgtttattcagctgatcttttgtttgtttggttggcttttatttatttatttttttatttcagtaggttagtggggaacagatggcatttggttacgtgaataagttcttcagtggtaatttctgagcttttggtgcaccttcactcgagcagtgtacagtgtacccaaggtgttgtcttttatccgttgccacccctgacctttttccctgaggccccaaaaaacaatgtatcattcttatgcctttgagtcctcatggcttggctcctatatatgagtcatataggaatatatatgactcatatgacatttggtttttcattcccgagttacttcacttagaataatagtctccagttccatccagtttgctgcaattgccattattttgttcctttttatggccgagtagtattccatggtatatatatatatatatatatatatatatatatatatatatatatatatatatatctcacattttctttatctattcattgattgacaggcatttgggctggttccatatttttgtaattacagattgtgctgctatatacatgcgtgtgcaagtatctttttcgtattatataatgacttcttttcctcctggtagatacctagtagtgagtagatctacttttagttctttaaggaatctccacactgttttccatagtggttgtatttttattattttattatatcctttattagtttactgtccacatgctcctgccacccactgaactccccaaatcctcctcccctccccacagaatgtccctcgttagtacctaagcctggctggattgtgtcccctcacccctgtgtcagtgtcccaggagacagaaatgttcttggcactccaaggtctcttaggccagggccagaagggcccccactcccggcttctggctgcaggctctaccttgccccgtgtcctctctcccaggggcagggctcacctgtggttgcctgctcccagtgcctgactacagaccaccctccatctttctagcaccttcctttccttgcagcctcccaaatatctcacactccctctccagaagagttccttctgatcacaaagcatttgtgagatttacacataagattgcctttgttccagttctctagaggcagattctgggatacggatttgtgtggtcatgacttattagggaagtgggcctaggagaacaggcagaaggtgtaagggaagccaggcaggacagggcaagaagccaagtggaggctcgattttaggcaaagacccaccagggtgaccaggcccttttacaactcccacacaggccacacaggctactgctaggggccaccctgggggacgcaaaccctaggcacttgtggctgtctgtggaggtgggggtgcaaacagagtctcaggctgggctgtcagaagcagaagcacccagaacccagggagcacacagaaatgatggaaggggccgaggggcctgggctgaaggctgacttcctgctttgtcctgcacagggagagagagacagggcagtggctgtgcaaatgatgaggcccccatcgaggtgagggagggctctggaatgacaacaggccccagcaaaggtagtgtcctcccactgggagctttcctctttctggggatgcatcttgttccccaaggtgccacgtcacctaggttaactatctggagagatccagttaccttttctgcacttaattactcacattttcttgttttagtgagtgttgtctttccagaccctggggaccccttcctctcagcctcctcacagtccactagagagaggagaggcttctgtgggctctacaggatagggacagagaaggatgagcctccagcccctgcagtgtgtattgcatgttggtcctgctctcctgtcccacctgtgtctcacctccgtagatggtagaaatggagctcagaagccagcagcctctctccttggaggatgccagtccactcacctactgtgcctcactctcacctaggccccaggcagtcatgtgggcactgtgttaccaccaaaggtgagaggatgtgttgccaaggtcacttagtgagagaacagacaaggcccacctcgaacccaggtgtcccctttgtccctctggagttctagttgtatttgacctttcttcctgtgaactgtggggtttggatacagcagagactgtctctttggttgtgaaccagattccttctttccagccactccctcccaccacacatggccacacatgtacatcatatgtgtacatggtccctggggcaaagatcaggtggacaggcagtctgcctgctgcccagttcgcacacatgggtgccaggcttcacacacactaactggaagggaaatggcagctgcatgtggtctggggtatgattttggtctcctaagctgtgatatttttttttcctcttcaagtcatgttcaagttctaagtatggatggtgctttagggtgataggagtgtgctagaggcaggatccaggtcggattctggggtttgctggttaaagtgtgtcttgacaaagaattggaggtggaactagccccagagatgaagccaggagtgacacacatgctggcttccccagaggccagtgcatctccttcatagtcgcactaggccttgggcatgggaggagcaaggtaattccagccccttttctagtgtgactccatgtggctaatctatactgttcttcctagtttgcctgaatacatcctggtttaatcagtgtaatcgcaaaaagtgtctgatttgaacaataatcagtgtaacaatcagtttaatcagtgtaattgcaaaaaaaagtgtcgatttggacaactgccaggctggcctaacttgtccagggactgaatgaagccccatttcttcatccagtgtgtcccatagtatggggtgacacacactggccagtgagggcaggactggagacaaagcaaagatggaggagagcctgcagatggatttgtttcagggactcctgtttcttcttcgcagctccttccctgccaaggagggctgtcccctggagaagaaagagacaagctcaagtgtgctaccatctataaccatcagtgattctttgagctggcctttgcagagttcttcattttggttccctgcctgctctttgtcttcaggataaaatgcagactctttctttcacgagggcttattgcacaacgaacctgtaatagtcagggatcctacagggaaaagatggcatcctcaaactgggtaatttgagcagagtttaataaagtggatatttatgaaggtgcagccaaggtgtaggaaaactgtaagggacagtcaggaccctggggccacgaacaggaaggcactgttaacacttttaggcctgaagggataaggggaagaggtcatggctgccaccagactttgatggagggatatagacagctggtggatggaccctgcttcctccccaaccccgactcctgccactgcttcccagtggcagaacaacaggaggccagagggcagggagcctgtccacgcgatccgtgctggtcggcctgcactgggtggtggacttgcggacacacagagagcaacgtgctagcttgctggctttgtccctgctaaattttctcttctacccatgccttctattccataagctccccgtttccatccttccacaaactcgccagtattttccccagctcctttgtgctttgctcatgctcctcctactgctggacatgctgcaccttactcctccttgctgtttaccaagctctttccaaccttggcagccgcctcaacacttaccaagatccaaattgccctgaaagcaagcacgagtcatgtgtgagggttcttggagtagagaaaaaaattgtatctacttcctgccttcccagagttccacatatgacaaaaagataaagcatggacatcctgcttccagtacacaccaagataaagtatgtctggaaaacactcatgggggaacagcaaaattttgcagagaaaagcttgccggtatatgaattaatatttaagcttgaccttggtgtggcataggaatttgtctaacaaacaataaggaagggcattccaaataaagcaggaagtcacagaattcccaatgtgaacagaatgtacaggaaacagtgaaaagtggtccggtgcacctaatgaatgtcatgttcgaagcagtgtggggtgggagtgtgtattagtctgggttttccttttcaacagaatctatctatctatctatctatctatctatctatctatctatctatctatctatctattctaatctatcgagagacttataagaattggctcatgtctgtagtgtaagtttcagtctcagtccaaaggcctgagacaaaggagctgatgcccaaggacaggagaggaatgtcccagctcaagctggaagagtgaagtgcccttcctccactctttcattctgtccagaccctcagtgtattagatggtgccctcccacattggggagggtgggtcttatttatgaagcctgctgatcatctcttctagaaacacctcacagatacacccagaaataacgtgctaccagctgtctggcatcccatagttcagtcaaattgacacagagaattaatcatcaccgaaaatgaggtggaactttgtagggatcactcactgaagtccaagctccaatggcagatggagtccagcgtgaattcccactgaactttcggcacttctgggctctttcctttatgaatggttggtctccatgacaggattccagagaccactcttctgtgtttggactgttttgaacatgctagggaaagaaaaggaaagaaaaacatccaggttacctagctttggtcacctaggggaaaaaggctccactgtctgtggctctatgagatgatgaagatgccccaccttgcccaggttaccttttgctagagtttagaatttagagttcttggctacatgtgtgtaacagagttattgaatcaaaaaaatggcttgtgggagccgtgacttacaaacaagatatgacctattgagcaagcccattcttgcttcagcatttaaattagtgttgggcttttgttgtaggtacaaatcaaagtgttgtgccattcatttcagaaaagtcacggcccaccaaactcaacagagtttgttttgagaggatactactgtatttgacagggacaggaaggacaggtggtaggtgtgcttatggagaattttctggaggtgcacagagcaaaggcttcttgatttatccctaggacattacagaagtggagggggactgcctccttgcacgattctcacacacagtgaccaggtgttgggggagatgtgtgcatttgtatttgtgagtgcaggttggtggggacatgcagagtaattatactcacacactgggcctttattggatgcaggcctcatggtcttttatctctcgggagtttgtgaaagatgggagattttaatcaaataattaatcagtggacagatatttattgtgtgcctacgttgtactctacacaatgttctgtagagacacaagtgaaaataagacatgatccttgcttttcaagaacttaaaatcaatcaagtcagcaatgttacatccctaagatgagaaagcagtacatgttatagactgtacaataggtttatttgttgaatttttacaataaacaaaagaatgtatttacatgcatgtttccatttaatcttctcattaaccccatgcaagaagagaggttatttctactgcaggtgatttaaatgaaacccagtggagtgagataacctctctgaggcctgaggggcatcaggaacagagctgggacattccttgtagcagtcagacttcagaccctattctctttgctctcccggagcctctctctgactacaactacctcctagcggtgtgggactcacagtgcagtgtgtgtgctgctgcttttggttttgtttgtttcctttttcctccccctaatcctttcacctgtatcataagtgtgctgtctgcttctacctaggcatgatgagccctcttactttcatagctaggaaagattccatggcctacctccgttttcttatgtcatgcaaaaatggtaatagttgggagacgtaagaacagtgtgcaatgtgagtctaagtctagtatttttgtctctctatgacccagatcaattttgtaaacttccacacaagtttagagtctaaaagaaatccagtagggtcaaaattagcagcctcagtagtgacgctttctcttacaataaaggagtaaggtgctagctgatatctgaatgttcagtgtcttcgtggggaagtatcctgttttgttaatttcttagtttcccccagagaacactttctcacaagcgcagatgtggaagatgtacacgccaaccccatggcagcgtgtgtgggtatttctgagccatttgcgtcgtgatgttcccctatgatgcttgaggggaggggcagggcacaagccgaatgctcagaggcaccaaacttaggggcagctggagcatttctgtgtgataagaggcaattgtgaccaggtgctgcgaagggcgaaagcacttattttgctgtggcttcaagcattgcttgagatgcgctgcctttcagacacagttaaagggccatttgatagaaggaacggttggaccgcacactgtctgcatccattattgccctcagatcttcaggcaggtgtgtttaagaaaggccaagcctggatgtttctctcttttttcaataatctatctccttattgcaacactctctttgcccatctttagaagattccaagcagacacttttgcttctttttttcttccaattcccaggttctctctctctttctctctctctttctgtctctctctctctccctctctctcccccctacccctctctctctatctctctttctcttttctcatcctaaatccaaaagtagcttcaggacctgagtccatactttcatggttctatttctgcggtgcacatcttgggcttgcttaatcatttgtttttgcttttcctctatgtgtaaatgcagcatgtgtaataaaacaactattcatcagagagatattcaggacacagagggttgcatttttagagcattggaacaataggtgcagctgcagaaaattacaggtatggcagtgttctttctctaccatactcgagctcccatgcatgagtgagcatgtgcacatgtggctggatcctcttttggccaaatacaccctgaatattgacacaggtggggcaccctcaataatccctgctcaaacagtataggcctattctctaaaagaagacacttatccaaaaaaggaacatggtgcagacagacacacacagactaagaaggggactgtggctcggtactgaaatggaaaacacatgccttttccaggctttatttctttttgtctggattcttccaggatgctgagtatgctaggccatgggctgtccacgggggccacacacaggaggggaaggccgcaggagggatgctgatgggaaaaccattcacagagacacagaaggctaatggccactgccagagggctgcagtgcggggcaactggagggcaacattgaagctggaggacagaagggagctggagttgcagggcccagtccagaatcctcaagggaacctctgtccctctattcttcatatatgtggcaggatgggcagagaggatgccagcggtgggagggcggtatatctggaggttgtggacgaaaggggagaggctttgcaggtctgatctgggaacatcctgcccttttgatcgcccatctcccacctcttgttggcctatgttacattgacttgtgactattcctccatatctgatgagcggccatctccagttcagctcacctggatgagtcagggacagtggagtttgaagccttactcactctgacttaatcaccagttaaccaccatcctgagagaggtgagataccgtaccgtgtttcaggagcagttttgtagaaggactatgtcaagggctgtctctgcaaagagaggactcgttgtctgaatgtcccacctccagagccttctctgtggctgagagagcaattatgctcattttcacttttctttttttaaccgaggagcgatgtgtcctctgcattgttgaggagactggatcaatgagacagatagatgggggcaggtgtgaggaggtgacagagttggctgccgaggtacctttgtgatccatctctgcagaagccggcattcattccgtggggattcagcaagactgatacccagcagtgacagtttggacatctaaacatgaccttggatgtgttcagaaccgcagctggaactgtgccaactcctcagagtagtacatcacaggagccgcagaaccatgctggaaattggctgcgttctgagtgctagtgcatctgcagacgaacctctctggccctgtagtgcggtgcagtgttgggggacggcttccgtttctgtcaattttcaataattagatgctcacaaggaagcccaggacagtcctctcgtgttcatcgggaggttgtgagatgccctcgttgtgggcatcaaaaataattattcaagcagtttagtgtttgtcagtcagcgtttcctgcaccatggccactcacctggtacttgtcagatttcagctgctggggaagaaaataaaggactctgcttctggtttccctgaacatatgggttacaggaaagttctctcctgtaacgtatcagaaaactgtttcataccagggtcctttcctagtgcctattcactctgcaactctcatttttgccaggaaacacacgtctaggttagaggttctcagggagctctccagaccagcatcagcagcatttggaattttgtcagaaatgcagcctcccaggccctgcctgggcctactgaatcagaaacccatggagtaaggtcccaggaatctcttttttatcaggtctttcaggtgattctgatgcacagtgaatttgagaagaactgatttagatgttcttttgggagcacctataagaacactaaatttggaaaacaaaacaaaaactggcatgaatcctgcttctacagtttaatatcagcatggtttcagtcaatatggctaatgttttttagcctcagctaattttgtctgtaaattggcaataagtgaacccaaccaagtttgtgagatgataaaatagtacacatagtgggctcatgtagtcaattaacattgaccatgaatgtgaattcatccagtccctgcttggacccaagtgaaggtcagagcagtggccacccttcagattattaatataagctatcctagatacattactagcaaagcaagctgcaaagtgtgtttttgttcttgagagatttcaaacttatgtcgttccaaattcatgtttcagacaaggcagtaccagatggcagtcatggggtctgcaaggagcataagggaaggtacacccttaggtgtagtaagagaggtgcaccctctatcgactgtagttttctccttcttgctcaccctcagagtccattctggatattgtcatcaaagccacaagaaaggcttggatcagttcaaacttcatgtgcattcaggttacctggacatcttattaaaatgcagattcaaatttcttatctctgagaggagacctgagtttctgcatttctgatgagctcccacccaagtgatgctgatgttggtggtttgccagccacacttttgtgtagtgtggtgctagctcagtgcttcttaaaccctaatgtgcacaaaactcatgtctagatatgaacttctagatgtgactcaaggaatgaccaggggccatcagctttggcattacctgggagcttgctaaaaatgcagaatccaaggccctacctcagacctactgaatcagcatctgtacttcagcgaaatccccagggggctcatgtgcaccgtaaagcttgagaaacatgtggagctggcttcacaactttgtttatttccatagaaatctgtggttggtttaaggctgtgttctcaccaccttgaaatccttattcatgcttgagcaaaatattctgtgttcttattttgcactgggccccataaatgatataagttgtcctagacacactgctccatattagtggttttgaaacattagtgtgtgtatgacccaactgagatgttgttataaattcccaaatattctgaatcagtagactgggggtgagactaagaatctgtaataaacctctcctgtgattctaatataagtagtccatgagcactttgaaaggtagtccccagatcttctccaagctaggccttcactcatttccatgctgtatcaggatggtgccagagagagcccacctctcatctgcattgccagaaaatgcaatgagctgcaaaaaacttgttggacacctgtgccaaggtgtttctttttgggcagtatttcccacaagaactctcagcaaactatccctgtgcacctaagtgatccttacataatgttgagacatttacataagcaaagcagaaaggatgcacagtacaggatgtctcatggggacagggggtctcctgaagaagcaggtgtgtatagtagcacttgttagaatttttatggtcacaaaccattttgagaatccaatagaagccatcacccatcctcaatgaaaaattcacctttgcacattatgagtctcacatagtaccaggaattagaagacttgactgagaggtctgacttctatacttctagctctcattccttggacaagtcatcaggctattcagaaccctagtgtcctgatctttaaagcagagaatgggtaagagtgtcaacctcataaatttgttgcaaaacatcaaaggagacattgagctgtaaaagtgctttgtacactgcaaaataatgtatacatttgagacatcattatacatcctatgctacattgttatttccagcattatagtcaggatcaggacactgcttgtaaatttagcctaaggccatggaacagacttgctgtagtaagagagggaaatgaatacagacagaaagacatgatgaggacttggcgagagttgctgggaaatttaaaagtgtagaaaagagaagggagattccacaattcaaggactccagatgcaaaaataaaagaaagaaaatctatttttatatgtgcagacagttttgagattttggaaagtggctttagtctagcagttaaccgaacatttctgcccctgggtataatgaagatgaatagcaatagtggtggtctgtatttagttttgactgcagaagccttctgtgggaatttgctattctgagatgagaggaatgatgtttagtagttaaaagctgggtctctgatctaacacataattattgtgtgacttggagaactagtttagtttagtttctctgctcttctaggctttttccaataaaagattcttcatagggttattataagtattgaatgacttagtgcaccctaaacagctagacataactatgaaggattatcatcacccaaatccttgagcaaagggagaactggtagtattcgaagtatccagccatcctgggcatgcaaggtacctctaggttataactgagatcgtatttgaagtggttctgtgctcaagtggtttgagaagctccgagcaacattctgaggctgtaatcccataagacctttgctgtgttccagaaaagtccacccctgacaaatcaaaggaaatgtatgtgttgggggaagggagaaagacaagatattctagccttgccatgaggacctccctctgatggctgctgtcgtctctcagtcccttgacgtacctgtctggtcttcccttcaggtgcactattgacaaccgggtcacccgggtggcctggctaaaccgcagcaccatcctctatgctgggaatgacaagtggtgcctggatcctcgcgtggtccttctgagcaacacccaaacgcagtacagcatcgagatccagaacgtggatgtgtatgacgagggcccttacacctgctcggtgcagacagacaaccacccaaagacctctagggtccacctcattgtgcaaggtaggtgggcggggcttggcggggagatctggctggccagcctggaaagccttcaggtaaaggtttgttctctgatcctcaacagagatgagttatccttattctacgcatctggggtccagggcacatttctggttgtcattttgcagttagaagctaaattttccagtcattttcattgagtggaactaggaattgtttttttcatttttgttccaataatatattttctcaggaaattatcttgtaattattgctcttcttggcttttttctcccctaagttttagttatttttgtttgtttgttttttgttttgttttgttttgttttttagatttcatccaattccaagactgtgttatgtttaaaaccagacttttaatgcacttttggaagtacaggtatgccatgtccccctccagccttgaacgaaagcagagccaaccaggatgcactgggcactgccctcagctgcatccttcacaagcacctgcttgtttccagctcacttgcgcctcctctcctctcccagccaggggttttggatgccatttctcccatataatactggtgtctgattctccctgttttgattccatcccaactctcctggccttcttctcctcccctgactcctagttcatgaggccttgtatgtttgtgtgtgtgtgtgtgtgtgtgtgtgtgtgtgtgtgtgtgagagagagagagagagagagagagaatatgtgtgttggttatgctctcttagaccctgggaatggagctcacctcttcccacaaggcagaaccagtcctggggcattcagacaacacttaacccggttgaaggattcctagttagtgagcaagagctggcatcacacttggccactttctggctgtgagaccttaatcaagttattaccgtgtctcagggttctctttctgtaaagggggtcaacgtgaggattgaactgtaaacgtactgacatagaaaacacgtagaagagggcgtggcacatacaagtgctatttcagtgttagctatggagctttcttttctcttttttaggacttttgtaatttttaaaatttttgagcatcttttacagtgggtcaaatatcttattttgtgatgtcagcagtatagcccctgagcagcggcatgccagatccagtgctggagccctttcccaggctgatcccgaggccctttcaaccagggacgtgtagctccagggtgacaaactcctctcctaggggctccttccaccagtccccttgtcggtgtgttcaagaaaagggtaaagaactatgggatgattggttagagacagaataggaaggaaggcagcttgagaaggaagaactgaagtgagccggaagaaggaaggggaggcctgctgtttgacagtaggggaaggcggaacttgggtcgtgatcagcactgttgagtgaggcagggtgagcaggactgagaggaggacacatgagaacaaggtgatgctggacctggctgtgggcagaacgtatgccaggggacatgggaatccttgatgctgtggcccaagtttggtcatgccaagtttttattatattttgcttactctttcttccccaaaggaaattacaatggctgtttaaaaaatgattctataaatgaatactttttgaactgatgcatgcaaacagcaattttaaagaaaatagaattgcatagaaggtatcagagtgtattacaaagagtggagtaggtattgccatgtgagatttttgtttcagtttgtgtacattttttaatgtaaaatacattttttattatggatagggaggccaaaaatgcttgagaatctccactctgtgggcagggctggtgaatgccctggtgccaccatctgcatactctaccaggtggtggtttggaagctattgctcagcccccctcctgtcctgccccaacccctgcacacttagtgttgagaaaagaatgcctagcattgacaatgagagactgggaactaggaactattagagatatttgctttaggaagcagggcctcatggaactggaaagtggaaggaattgtgaaaagtgctaatgtctccttgaaaactggatcatatttttgtcattttctttcttcagccacccccactcacacacacccccacacccctgccctgaacacctcgcagaatgcctgatacaaagtgaacatttaataaatgcttattgaagcaaatggctagaattagagccaggtgatcttatatgggctccaagagagacggctgggtgtttttgggggtgagatgatgggagggggtgagaggatggagtctacatcaatcttcactcacatccaagctaatggaaaatgtctaatcccttgctaggtgtttacatctgtgacttagctaggtgccctctcgcatgacacaccacctcaagtattggaatctcatcttgggctaattttcgaatgctgatgggtgtattgatctggaaacaagctgggttaaaaaaggcattggtcttttacacagactcagcccaagctaatccgctgtcgatatgcctggactgagtattatcgacactttaatgaatagaggaccatagttttttcagagccaaactgaccccctcttcaaagcgatcagacaaactaaatagagccagattcttgtgtttctgtattggaaagaggatgcaccaccatcctggattacaaaaaaaaaaaaaaagggaaagaaatatatttatcttgggatcgtttattataccaaacataaaccctaattcccctagcagaagctgactctctggatttgaagttgctattcagccctgagcttctggaataaaagttgggcatattaggttttcaaaatggtattatgatcctttaaaaaaagaaataaaaacagcaacaacaaaaaggaactaaattgatattctgcccatgagtatgtgtatttatgtatatgtagtcaccttcatatctaaataaatccacacagaaggaaggtagtggcatctcacagcattgcacaagctgcttcaggtctggggtatgtctttccccttactgtcaaatatcccatctaccccctagttctctgtactggattttcttcccctgtggttctgatccaatatggttatttcttgcagacagccgtgaggccaaggcgaccacatggagcaagtctctggggcaagctaggagcaaagggcatcctgggggaggagggtgaccctggagccagtgtgggagggagatggagggggaaggcggcagaaaggaggagacaagagaactgagccaagtagctacttgccagggtggctattttaaattaaatttaaattagctacaaccaaacaacatttaaaatttacttcttcagtcacactagccacactgcagtgcttccatagtcatgcaagactactgttcccttgtgttcattttgcattactataaaggaatgcctgaggctggtaattcacacacataaaaaagaggtttatttggctcatggttctgcagcctgtacaagcacagcaccaacatttgcatctggagagggcctcagaatgcttctattcgtggcatggcgtgaaggggacccagtatatgcagaattgcatggtgagagaaaaagccagagacagcagggacggtgccaggctcttttttaccaccagctttcgagaaagctaatagagcaagaactcacttgccccaccccctgcatttatctatttatgctccatccccatggccagacatctcccattaggcccccacctccaattttggaatcaactttccacataagatctacgggaacaaatacccaaactactgcactcctgtgttggacagtgcagagagagaacatttgtgtgaacttccattgtaaaaagctttattggatagtgctataaggggttaccattatggatcagcaggtgttaaagctagaatggctttccatggcttgaagggctaggtatattgtggaaaggagagtggaattttggaaagagaatggaaattttaaatagatggtgctcttttaaaaacaagagagaattgttgaaaaagatggagtaatggatttcctaggttagcttcaattgtttaaaaagatggagtaatggagttcctaggttagcttagacagagaagagtctggagtccaaggatgtacctgcaggagagtaggcagagttcgagggttggttaagtgtgagcatgggggtgatgactccaccaggacactgagatttctacctgtgagctcaggggacatgaatactaacatgtctaaagatcacatggcaaaactgattcatcagcagaggggaatgagttcagatacctggatttcttgactttgagatgccttgaatacttccttcaaatgtgaaatgtaagaaataccacccgtggatttgcatgtcctgaacataatctttttgtccagaataggggagattcatctaaaatttattaacatttaggtctaatgatttccatctctttgaccttagggttttttgcctaataaacataattaataagtggttctctctggagtctagcagaatattttattcctttcaccctcttaatcctgctaccaaaccgagcatattgtacatctgaaaaagccatactactgtctccattgttcctttggacaaggttacatcttggaaaacagagtggataaaacattcagtgggaatgaattgtttggcaagttaaggacagcttgagaagacgtctaaaaggccccgtctgtgtttctaagaacccatgaatggtggtagagcaaaagtgtgccatggttgtgtgcagagtgttaagaaaggtcctccttatccaagtatggaaaactgacttctccattttgactggtgtacctgcaggaattcactctcacttagagacacatttgtatgacagagaacagtagaatacagtgcttataaaaacagggatattagtgtaataaaaaatgttaaaaaagcttttagcctctttgtcagttttccaggccctagctaggtttctcttttgtcactggagtatctaatcatcccctcccttttgtttggtaaaatgagttttcctatttcttgctgggcagaattaatctgaaaatccctgctattgtttgatagttaattacctgcctttggagtcaaacagctccgaagctcaggtaaagaagggaaacacaaatgtctatggaatagggcaggaatgagggaaagaagccaggacattctgttcacttcgtgtgttaaagtaattccagagagaaagggactagactagggagacacccagcccaggcagtgacttgcaaataatggaagtatggccacatcagcccctaatttacctttgattgtctccctatttctgactctctctcttacccacttgatatatacaaccgtgtttctttccaatcctgaataattagttgaccttgtcaagcaaaagctcattattatgattcagagaacaggaacaataacttttaatttctaggtagctacaccctagagacccctccccactctgaatctgaactgaaggtaatttgaaacacaaaatatcaaaggaaataatgtgacctaatccttactttgaaagcaaagctttctgcctctccagacatgtcacccagaaagcaccatgcccttctggcaggacaaggctcccggagagctctgcagatctttgcaccaacacttcccattcaagcgagtcaatggtagaggaaaacatcatgatccaattcgaaatagactgaagtcaccttctgagaacatctgtgttctctagatgtcagtagccctgtgtgacagatagtgggggcatactgatcatcccaaactgctttccaatgacctctctttttcctgtcccattcaagaaatagatgaaaatgtatatttggtctggtcataagactgtgtgtctaaatttgatagaactttgaaaaagtcaggaaattaaattccactataaaattggagctctcctcaaagcaccccggagaatgacaaggaagtagggcattttacctgcaattgatgtacactatctagacagcatgcagatgaggcaactctgttctacctggtgagttttaaaatttcttgaagcagttgctgacaacggagggacaaaaattgacagaaaggctagagcacatttcagtaaactcacctgaggtatcgtctgtctgctaagccaagtagggcaaaatgtaaagactaaagtaatctcagaaaaatgccagaggaaaagttatattcattgaataatggcattttcttttccttttggtatggctgggaaggggtcctcatgttctctacagagtttggaaaacttggcgtcttttgcagaagagtggataaaaatagggtcccctgttctagcctttcacacccactcatagagaatggagcagaaagtttagatgacccttatggctttacagcaagcacttacagaagtcaggcaacatctctccaggtaagcagttagggctcccatgggaaagtctgtaagcagccactgagttcttaccccttaggtgcttttccacagggagtcttggctgcttctgagcggcctcagagtctaacaccataggattgagaaacatggctctgattccttctggatcttgattctttctgcagcttccaagtgagaaatgtcatttattttggggaaaggacaaacaccagatcctgaataatcagctttttcaagatgtatgcctttagactcccattcccatatgagagtgctgatttattcaagctgcacttgaagaaaatcttcttaattaagggttggatgaggtctctttatggtctcatgacccaacactacagatctgtctaatcctataatatatccaaaattttcctcattaccgtattcctaatggtttcagaaggtcacccatacagagtgtgtgatacagcaatatcaagagcagctgacttggatgccatcactgttaggagaagattcttagacactcaaaagacccaaagattctggttgttcctctcttcttaataaaattaaaatgcgtagcttcttaggacatagggagtagttgatgagaaaggtttccgtccatctgttgtcagatcgaagacactctactgaccctgttgaattccatttaacagtattttgaagccaggtcctggggacacaaagattcagacagagctcctgccctgtccagcagaggagaccactatactaacaaatatctgtcttataaggtaacagggattaggatgtttgagggtataaatgctatgaatacattgaaatggagtaattgaatttacctgcaagattagacaaaactacaaagttatatttcatgagggtcttcaatgggcagtagagttttttaggggatctgagaggaaatggcatcccaaacaggatcaatcatgtgtgcaaagcttggaaggctgaacgtgtatgttgtgttggacgaagagtgaggacgctaatatggtcacagggcagagttcctggggtgaaatcactcaatatatggctagaaaggtaggctgcatctcagtttcaggtggaaccagataggcttccaataggcttatttttttctggttgtcctgctagaatgctactttctttcacaaggaagtgcacattagattgttttgacaatggacaaatactcaaaagattatcagtggaaaagaacatgacaaacacctaagtcaataaatcttgggtagaaaggagatatattggaaggaaagaatacatccaatcccaactggttctatgcttcttgcatggttaagacacaaaggggaaagattgccaaagacttttctaccaatacgtcaattttcaaaatctctccaatgtatgtcttacatttgaatttgtaataatgattcttcttccatagtatagtaaggtgcatctctttgtgtcttagcaaatagagggtgtggtactgggttttgtgctgtcatggtgatgatcatggcagagagggtgaggatgctgccgaggatgaatgacagctgcaagaagcagtccccagccctcaggtcctcagcagcctcctacctgagagtcctcatacaaatgagaagacttcctgtttctgatatctccaggctaatttaggctttgaggtgtcaccacttggagtgtatgttaagacatgttcctgttgaatgtcgcctgcagtaaataattgtctaacattggtatgaaatctaattggcttccgctagagcttggctcagcagaggaattcactcctggagtttttggagcaccacactttcttcatttcatgttatttgagaaagaatttattgatgcaaaatcagggcagtttaatttggtggcatgttttctttatgtctcaattatatattcatgtctttgtggtaaactcagctggtggggggattaagaattcaaaatagaggattttcacttggcaagtagtgctttctactgtgattaattgggagtctgcacaatgaacccggtgttggctccgttggggatttaatagcttagtagaaagaagtaaatttcaggatttaagagttttgggttacagtctgaattttgataattacctggaaaaatgatctccttgttttagttattccagattagatattcccaattagataccttttatagaagtgtttttgtgtcccataattcgatttggagaagggtgtcaagtaggtgcagggaagcagaagagcacccctcattgttgtgatcatccaacagccctaaagacttccaggtgcttacatccatttgtctttttctgtcttctttctatggatgcaatcctctagatggggaatgcacacatgtcctgccgctgatgtgggtccctgttcccagaaaccggtctgggtcgcatcccgtttctccagcctcagccgcctccgcggagctctattgctcctggctttctggccttctgacctggtgctcttcctcagctctcttgccaccatctcctgtgttctcacagttttgtttgggcatgttttatggtgttcttatcgtcctaaaacctggatttcacagaggggacctgtgtgctaacactgttcctcattctgagggctaggctggccaagccatttcttcctactctgagaaagaaagatgagaaattttgattattttccctttcacacataaaccatcatgtgtcaagtcctgaaattgaggttggaatggatacaaagatggatgagatgggtccctacaatggggatgtgcaaaggagtggggtgcaggtagggtgtgtaagggcagcagctctcacagccactggagagtccctgggctgagagcgatggctgcaagcttgggagccaggctttgctgttgcagaaggccaagaaaataataaagtcttttgaaattgagtaatgtggcgtttcagctcccgactgttagaatgaaaatagcgattctgccacacccactttgcacccctcacccctcatttctgcacttgtagcctgagtgatcttttcaaaccaaatctggaggttcctcaaagacttctctttagcccaagagagccaattccttatgaaggagttgatagtcctggaggccaggctccaggggacctctgctcctggttcatgccatgtcctgcctcactattttcattctagtgtattttttcttgttatttctggtcataggccctttgaacgttcccttccctcttcctggaattctcttttgcttttcacccagtcggtcctatttatccttcagactttgactcaaatgccatttccatagagaactttcccagacctgctaaccactgccactcccacctctgccaggagctagagccttgcccttcttcctgctttttgccacagttaaaatgtggcatttgtctgtgtgattggttgattatgtcattttttctgaggtcagggggcccgtatgcttgtgcattctatccccagtgcctggaatttaatagagctcagggactatttgttggataatctatctgtaaagtttcttttttattgtattataattattaaacaaaatgattcatttttttttcattactagttgtagtaggctgaataatgtccaaacaaagatcagattctaatccctggaacccaaaaatatactttgcatggtagagtctttacagatgagattagtttaaagatttgagatagggaaattgtcctgggccctaaatgcaatcacataaatctttacaaaagggaggcagaggaagatttgataggaacacacacagaggagaaggcagtgtaaagacgggagcagagggatatgaagatgctgaccctcagggttacagtgatgtggccacaagccaaagaatgcccatagccagcggaagctgggagcaccaaagaccagatatcttttgagagcctctggaggaatcacagccttcctgataccctgatttcagcctagtgagagtcatttttggacgtctcacctccagaatcatcaaagaatcaatttctcttgtttgttaagccactaaatatatggaaatgtgttatagaaaaaggaaacaaatacactgaccttcaatgttttgaatccttaatggatggaaataggaaaaacaaaaattgatatttgaaatctgccccaaatttagtctttgtcactgtgagagatgaagtaacactcatctttttcattatttctttttaaaaaaaatctctttggagatgcacccttgtcatgtaaatgcaatgaggcatcagctttttgtccttggggtatctacaggagcagatggagtcatccacatttcaaaactaagatgatactttttgatgttgaaaatttctgtcccaggggccctagggtatggaagcagggagggaaagacacctctgccaaatatggttttaatgagaggaaaccattgatgtcgcctagcattaagctgtgagatttggtttgtgaatgtgggaccagagttgaagattaaaatcgctaaacattctcttgttaactgggagagggacctcgtatttgtgttttttctccactatgtgtctcataggcatctcaaactgaaaatgtaaaacatagatctcttgaattctagccttctttcctgaccatcctctgactccaaccctaaacctgctcctcctggagtcttgccatctggtaaatggcaattgcattcttctagtggctcatgtgaaagctgcagtccgtcttcactgttttccttttcccgtcctcttcctcaatcctgagcacgtcctgctagattttctgaattcggaggtttatccagtcctgcctcttctgccctctcccaagctgctgttacctttgtctggagtgttccacagctttctacctaactggcctgctttttttgttcttattccctatcgtctgttctccatgctcagcgaaagcatttctgtgcaggcttcgttgttcctgatttagtcgcttcctggctcacctaaggtctttaacatccctactgtggcctaaaaggtcttccttggtccggccaccagtgtctccctggcttcacctccacacacactcccttttccttaccctgtctccactacttcctgatatgcctgtgatacaccaaggtggcctcctggcttccaggccttaaagctccctctgctggtgcccatgccaggtgtccttggggctctcttcttagatctctgttcaaggtcaccttaaggcagaggccttcttcaccacctgcataaaatagagcttccaaccccacatcatcacaccctagcacctttcttgccttgtttgttctttataaagtaactcacctattggcataatggatatttccgtgttggagagtggtagcctgtttcaacccctctagaacatgtgtgccatgatggtggggcttgatctggcatgttcattgttgtttcccaagtgcctagaacagggtctggtgcatagtaggcactctgtaagcatttgtcaaataaatgaatgaatgaaaacaaaggcctaccgttaagtggacttgatcatattttctcagtgtttgctctctctttggtcaggcgtgagagcatgaacttctctgttacttctatcaaaatgttttggtccctctagtctcagaccaggtgacattcagctgagttttgcagtgtgcattttcttagcaaggtaaagaattgaaccagattgaaggaacaaatcacacagcaggaaggactctgagagaccaaagatgagtcactccaggtcactgcctggaaagaaaacaggaatgatagaggcgcaccacagcctggatagcaggagagggccagatctctgccacccccagggtgtgggtttcactgtggaggggatggggaattataggaagggttgaacagggaaattaaattagttgtatttcagaaagatctctggcatcagaatgaagggtggattggaggggagttttgcagcagggagactgagagagaatgaaaacaaggctgagattgtattatcctgtgttcctgaccaggagacccccctctctccttgaggggctggacaaacagggctttagagcagccgatccatggccagagggcacatatacaggaagagtggaaggggtcccgtggccacatggttccagttttcctggatgatcctattcctaagagacgcgtttattctccatgtgtggttgctaagggagtaagtcaatggaatttaaagttgacacctttgtaaaagtttcaagtttatatatttacaaataagggaaaaaatgtgccagactttgtttctgtttggaattctgggaatatcgcctttggattatggacctgaaatcatgtcaccaacaggagatgcagtttgtgtgaacaaagggtaaagcttgaaataagataggataagacaggataaagaaccaggagagctttttaaataggagaagctatttgaaagcagaaaggagaacaggttcagaggataccaaaaccggagttatcacagaatgtttgtctgaccactcattcctgctgcctgccttggaatctctggaggaacttcccagaaaaaaaagaagagtggagaccactccacagacccaccgaacctgaagagcctaggtgcaggcgtgggtgtgggggtagaactgggaatcacaggctggagcccagcgagctaaggcccgaggcagctgaaggtcaaattgggaacatttcttacatcaaatcctaaatgaggttcatgctgattagtaggaactgtgtcaaataggtgagcaggcctgttctgggtttctaattacggtgtggctttcatctccctgagcttgttgctgcactgttgttcaaatgaaaaatgggaaacagacatgaaaaagagctgctcccctaagtgggtcagtgcaggcttcttccaccttctcccaccttgtttttctaaagagttacctggctttgttccctcactgatactcactgaggcatggcagccattcctttgccctctttggacagggcagcatgctgcccatttgggactggcagtagaatagtcaagaaattctttttacctttttctggcattcatatggcaaatgaatttttcgtgcaaaaaagcttcctgtgattgagtcggtctggtagcacaggtgacagctaatgcaccaggaagtgccctcaagggtcagccttggccacagcactgcatgaagctcacggtctggtggggaaggggagctgaagcaggcccttcacccctctcctaccaacacatgaaatgcctgcctcatctttcagcccaggacctggttgaagaaagatgcatatatagcaatcatcttttcttccttccttcacccatcaaatattccatgaacatctactatgagccaggcatcacgctacactcacggtagagcacgaatgccctagttacccccaaagaaataatatgtgggcgggtgactggagaagtcagtaactccttttaacatagggagagagctgggctgaataccaggggctatgccagcagccaggggaggcccctgaagaagcccagggactttggacatgaagttttgcccagctgagagctgaggaggattagctgggtagcatcaggaaggtgaaaccttctggacaaaaaatgacaagtgcaggatggggcaccgctgagggcagggtccctgtagagaaggaaaaagcatcccccgcaggcagtgagagaaggaggagggtgagaggagagacccgagaggggagccacggcagatggcccagggcctggaaagccctgccggtgacttcgggatatttcttaagggcagaaggagccaagttaggggagagcagacccaattcaggagaattcctcacttggtttcagttttgacaagagggtatctgggagcaatgcagagaccaaaggacctccatggttcacagctttgtgggatccccccttccttcttgcctggccagggctcctcagcggaggtgaggaggagttgagctcctggtttcatactatttgtgctcctccagtgaggcttcatttgtccatggattctcccccactggagtgagtgcagcaccctgtttagaagatcggcagaatcagcagatggacacccttcttcctttccatagacagttctcttctttgctattttccacctagctcttggaggctgtttctcatttggtctttcgagcagctttttttttttttttttttttttttccccacaaaatgttctttttgtcatcttctgcctgtcaccgtttttcatcctttttttcctgttctttttcatggtgtcctatttcactctcttaggcacgctctatctgatactcccgttctctcacgcatcgccaaccccgtttttcatgttgaccttcgattccgggcactgtgcacccgggctcatgcgtcctccaatttcacatttcccacagtcttcctccccccaactttctttgcttcctctcctcttcccctggcgcccccttgccagttgccatccctctgtttcacccagtgtccgctttcttccccgtgcgcagccctgtgcacccagactgcgattccctcctcccgcagctgcgccatccccggacccttcctgctgggctgcttctccacggaaggtccccatgggtttcgcctccaacactcagagcccacatggccgttgtagagaggataagataatcagatgcacctttttaattatttatttttcatttcacttaataagcacatcttgaaattgagctgcagtttcactcgtaatagatcatttcccttagggaacccacatccaaccccggttgaaattctctccgtgcgcagtgcagggaaggaagacactaggtttcaggtgtctttcttgagatccaaacatgttacgtcctaatgtaaagtgcgtgggtctgggagtgtgtgtttgtgagaggagtgtgtaagtgtgcatactttgtcccttctgtaatgtgcttgggtatagtagggtatttgtgttttggggggagtgtgtatgtgggggaagatgtgtatgtgtttgtgtgtttatggggagtgtgtatgtgagtgtgtttatgtttgtgtagggagtgtgtatgtaagtgcttgtgtatgtgtgaagagcgtgtatgtgggtggagtgttgatgtgattgtgtgtgtgtttgtggggcatgtgggggggactgcgtgagtgtgtgtatgtgtttgtgggtcatgtgtgtatttgtgggacatgtgttaatgtatgtttttgtgtagagcatgtgtgtgagtgcttgtgtatgtttgtgtgggaagtgtggatggggggagtgtggatgtgtgagtgtgtgtgtttgtggggggagtgtggatgtgagtgcttctgtgcgtgaggagtgtggatgtgatcgtgtgtgtgtgtgtgtttgtggggcatgtgtgggggacatgtgtgagtgtgtgtatgtgtgtggggcatgtgtgtgtttgtggggcttgtgtgagtgtgtgtgtgtttgtgtagggaatgtgtatgtgatcttgtgtgtgtgtgtttgtggagcatgtgtgagtgtgtgtatgtgtttgtgtgggacatgtgtgtgtttgtgggacctgtgtgtgtgtgtgtgtttgtatagggagtgtgtatgtgatcttgtgtgtgtgtttgtggagcatgtgtgagtgcttggtgggggaggaggtttctatctgtctatgagtgataggcgtgatggacatgtaacacttagcccaagtgaatgtgaagaccacagagggaaaagggaagagcagctactcaaaggggctgatgatttacctaactctcccctggtccaccccaagagaaggatcggttgtgaaagttccaattactagaagtgtgatggccactccaccagccacctggagcccagtggaaggagcgtctgcagagaggccctgcctgccatttgttctggcccagccacgggcaagcatctcaggaaaaagggatttcctggaacagtgcagcagcaacaggactgaattgtgggttgagtcccgaggatctcctctggctcctctaggcccagaggcctcttctgctccaggctggggtcctttcctagggcacaatgactcgggtgcccctagctagtctagtcatggaagattgtaaatatagcttctcatgtcgtcgaacttttagaggcaactgtaggaaaacagtagcaggcaggtttcatcatgcaatgataatgctatttttatgtatagcttattgaaacctgattatgtggcagccaagaactagatgaagctcattatgcacactgtgtcatttaatgttcaaacagccctgtgcgatagatgctgtcatttcccttcctttagaaatgaggagaccaactaacccaaggaaggttgcacattggtaagtggcagagccagagtttgaattcagaaagtctgactcttcacagcctccctcaaacactaagcttccccttatgagcaaaggatcaggttaacctgactcaaaggactgtatcccaattgccagcacaggcatgggctcaagttgttgtagagacagaagcctccttggaggccacctagccagtgattctcagctctgctgcgcattgagatacttggggtattgttaggcaataccaacgttgaggtcctcctcagaaattctgactcagtttactgggggtaagcccatggtgtctttgtttttttttttatttttactcctggatgtttctgttgtttacccatgttgagaaccactgtcctaatttacagatgggaaaacatgaaactgaagaggttagctggcttatccaaggtcatgccgctggttaagcacagtagcaaggactaacccagatctcccatctctcttccagggcgctttctcttgccccttgatgaaagacaaatctttccttatgtgtgtgagggaacaaaatacaatatggtgggtaagagtttggactgagacaccaaatgggttggaaaaatcgctgtgtaatcttgggttttatgtgttctctggctttgtttgttgttgttgttgttgttgttttccatctgtaaaatgaggaaataataaatcctgtctggcgggattcttgttaggtgataacatgagatgataccattaaaaagtgccataatctagctcagcatatggtcattgtttttgctgtgtggaaaggaccatccattagacatcagcctcactgggcattctcatgagctcagatggcaatagtcagtaacatcaactttgcgttttcaaaagtagcacacaattaaagaatacatttctttatttgactatgaactcattaaggatgatgtgtgctatgtaaatgcactctgcacaagttgacgtcacctgtggaacctcggtgacgatggctgatggaatgtctggccattggtttggctgaggtagaaccagcatctaaatctactgttgccatgttgtccttctaacttgttgtcacaaatggggacacttgctgttcttccacaagttcttctcaatctcatcactaagacagatgtgaagacattcataatgctgatcacgggtacatctctgaccctgtgaactcccgaggcctgttttccatgggatgatttacatcaggagacacgattgtctccatcactggtttcaataccatccaacaaagatgccatggagattggagcttactccctaaggacattgtctctcagctcatgcaaacgctactcttcctgagtttccccttgcctccctggactctgtctagacggctgttttattctcagctccccctcccctgttggcctacacatagtcttctgttcttctcacttaggctacatgctgtccagtgacccacccaggcctggggctttacctgcagtgctttcacccatgatagtgatatctttatatccaacaccggcaaagctatgtttgtgggaacctaatggaatctcctctcaaaagtggcacaatgtattcaaaattaaacaaatcatcttgccccacctcccttaccaccccaaattcctcttgcttctgtatcagcagtcttggagtggtaaaacccaattctcaagatagatagaggactagagatcgtccttgatttatttctttctgtagcactcctcattcagtcatctgttcctatagatgcccgtcactcacgattccccatctttgctgtcatggccttgcttcagccatttatcccatttacctaacttattgccttcctacagcctgtgtcctccactgtgcatcctgtgtcacatggtcacagtaaaataagagcaaacatttattgggtcctttccatgtgacaggtactaggcttaacttacagaatctcatttaaatctcccaacaatcttaggtagtagatatgagtgtgatatgaacaattttaggtgaggaaactgaggctcagggggggtttagtcttgctgaagatcatccaaataaaagatggggcttgaacccttatctactattggaagaagcccgactgtggggctgttccatccctaagaggctgagctctctctgctttctcaaaagcatccctctgctaagtgctgcttcttgcagaggtcttcttcttttatttctttttgggctctcctgtttccttggaaatgttgatttcattgcattttcctaatatttcatgctttaatttaatttatttgatactactgtacagtgccttgagcacctcagaggaagtgagagttttataaataaaataattattacagcttgctctgatggcagcccctgagctatttagtagatatatcaattactctcagtgttgaaaattttcacctaaagctctttatggcccaagttttccttggcttttaatgctctatcctgcttgttgtagttttgacacaatcatgtagcacttttctttactatccccatcagaagtgaacagacagcagctcagcaaaagtgccatataatgtattctagagaacatgacctagttttcttaacctttttgaatcacttagttccaggtgtcatttactagacctataatgtcagttttgcaatgagtcaacccgccttgcccacctcatggtctctattagtgagacctcattatctattagtctgttgcagaaacctcacccacgataatctagagatgggtatgaattaaccacaacactgtttggcacccaggatttcaggattctaaactacaaggcttatgcagacaaaatgtttgtcaaaatcttgaaaggaagtgaagccccaacacatggaggagggtgagtggattagagagtgcagtgtagagaactctctaatgaaattcagttttcctgcagctcagaatgctatgcaatccacatagtaattagagagaactgaggtaattttgcattcctggacccagtattctcaagatgcattaatcagtcagtggcaatttgcattcctactaagtgcaagccactgttcaatatgctgcttttgctaaattagcacattcctccacagttcctcctttcacgatgagtgagtctggcacatgtcataagattccacctctcaggaatacacctgaatgtggcactgaccatcattcctagcattatggctactttctggatcctgcctgcctcacaatctcatagcacttcactagcaagagatgtgagaggaccgttgtcatctgtttagtgttttagaggcatgttgaagaattcagaggataaaccaatggtcaagctaagatttctccctggacatctcccactcatgcagttagacctgactttcctcctctcacttccatcatggcatatttttttattctacttaaaaaagatacactttattctatcctattttactctgttctatcttattcattcattcaataaaaatgagcttagcgcttgctgtatgccagttatatgactggcatgtacaatgatgagcaaaattgacattgttctttattttttggagtttgagttcttctcttccttttgtttttaaacattttttatttgttttgtagagatgggatcttgttaggttgcccaggctggtcttcaactcctcaagtgattctcctgtctcagcttcctgaggtgctgggattacaggtgtgagccaccatgccaagtcttctcttcctctcatcttgacttgcctccctctcaaaattctactctttgtaatctgtagttgtattaaggatttctaaagaagtttcctcattaaccagaaacaatacactgtgctgtctccattttgtgttttttagcaaacaaatgggagtagccaatctgtccattataaatgagttcattcccattcaagcaatggctgtcatgtatcttgcctgaggcttcttatgttatgagcaacatattggcttcagttgtctgtactttttcctagctgcacagagatccttagatgaagggaaggcacaataactcaaaataatgtattgtattatacatagtagtcattcatagttccaatgacaggaaacacaatgagcttgttcaaggtggatatgtgtaaccctctcaccaggccaggtagaggttgttagatgtctaacaactattcttccccctagccaaatacgaatctgaaacaaactatgacccagatatccagaccagaaagaaacagataggatgaagcctgttttgcccacaacgggaagaatcacttccgatgaaaaacgactaactggaaatacttcaaattgctgtagagagtgcagtgtggagaactatctaatgaaattccgttttcctgcagctcaaaaatgttttgcgatccacataggaatcagaggacccaggtaattttgcattcctggacccagtattcacaagatacattaatcagttggtggcaattggcattcctactaagtgcaagccactgttcaagatactgcttgtactaaatatgtctattgcactgcacttcatctgatgatgggtgaggcccaagcaactcatcagatactacctctcagaaatacatctaaagagggcaaatcctaggcccattcttttcctctcatttctccaaatagcttgtgagcccagttgaccttgcctggatcaggacaatcctgggttgctggttaaaggttgacttggtccatttgcctctactctatgaggtatctcatatcactttcattgtaattctgtggtagccctttaataaaaatggccagcaagcccacaagataacagaataggaatcaatgagacctgcaattgtctgcatgccagattctcctgtcagcctggcctccaatccatcctgccaactcaacctcctctgggactgagacgtttgaaaacagtgcagcagcctcatctcctgggcagtgtttttctccatcatttgctttattaaatattgattttctgttgcattattaaaccttaagtccagagcataaattctgggctgatactttaatctgactcttctcatttttttggcttttagaactgattttcaggccagctctcctggggaatctttaagtcaacttagggccagagacaaacctgcctgtaggaaagggaggagcccggagttgagaaggagcttgccttgccagtgcactataaataaggctgtggctctgtcaagcagatcttcactttacacatgtcttagacacagaggcttatgctccctgggattcaggttgtagtgcaaggaaggacttttagattcccaccaccaaaactatcgagtaggcaaatggtatgcagaactgattttagagctctctagatattatcaaactcattatccatccaccccctccttcttttggtttctaatattcctaggatttgagtcaaaggttataatcacacaggcatttggatttccactcactttgggcctctggttcattcttgttttctcttactgtctcttctctctaagggccaatggttgagtaatcagctgtagccatccattataggatggagccatcacacactttatgaaagtctttctgagagaggcaggcattctcaaccagtcatattagccagagtgatatctaggtttaatttttttacttttttttttttttttttttttttttttttttggagatggagtctcactctgtcacccaggctggagtgcagtggcgggatctcagctcactgcaacttctgcctcctgggttcaatcaattctcctgcctcagcctcctgtgtagctgggactacaggtgcccacctccacgcctggctaagtttttgtgtttttagtagagatggagtttcactgtgttagccaggatggtcttgatccctgagctcatgatctgccctccttggcctcccaaagtgctgggattacaggcgtgaaccactgtgccgggccaattttttacttcttgaatacttcttagactggcagtatcattgactgaggctagggttggtgattttaaagataagaagcagaatactgacagacaagcatgagaaaagaaatgcaagtcaacatgtatggagcttctctggcaggactggggtatgttgctgtctacatggatgtttgcagagagctgtgcctatctccctgtctgacttctgttcatcccatctttctattcagttcaccccatctttctcctcagttatcccacctttgtcttttaggtcctgcatctccagaaatctagtgttaggaagttattccaggacctagcagagcctctgtttaggaaaagagtgaatttgattcgctcttcactctgggatggagagggaacacaggtagctcatggggctacagaaaccagcaactacaaaccttcagatgctgtgagccaagtgctgactgagccgggatagccacatcaggtgctgttgaaaatgattcttggggaatatttgatagaaacaatgtgaagatcagggtggaagaaactgtgtccttcattttcaccaatactcttcatgtcaccaataaccataggcctctaaagaataatacatgttctctttaaggtcatggggattccagatcatagatcttcctccaattccatttccaaagcctgaattccctctacaataggtatacagctagggagtatctaccatttatttgaacactgtcagtgatgagcaactaactacctattcatctaggtcttacttcctttagaaaagctctattagatccacatatacacctctctccctctaatatctacctcttggttacttctttataaccacataggataagctgaatcttttgtaatgataaaaaaagtccttggcatttaattaagagctatgaattttgaatcttactgtctatgtaaatgtctacaagttataggtcaaaatggctgaatattggcagttgcatatgtttcaatctaatatttaatttctcagagctccagctttctcatttataaagaacttgaatataaccactcatcagtttattgtgagggggaattgaaattaggtgggatacctagcattggaaagcattcaatttaaaaaaaataaataaatttaacaactatttactaaacgcttattctgtgtcaggcaccgtggcaagtgttgggaataggaaaatgagtgataaatggtccttgacctcatgatggggattgcggtatttgaggatgcctattgtagtccttaagtcttcccttcttctgctaactaaatagagcaagtatcacctgcatttgtctttgtactcagctcattaaattgtagttatctcttcacccaaaagttatacattttggggtgcaagaatcgttcactaaatgtcacatgtttttctccataaattctggttgttggacctgtttgtagttcttcatctttccttgtctgaaagattctggtgtcttcacttatctcttcagatgttagctgacttttccccagggcagcacaagctcaccgaggtcaaacaagcatgagcatgctgacttccattcagtcacctctgcacgtcctgccgctgatcctttatctcctgtcttaatctgcccaagctgctatgacaaagtaccatagactgggttgcttattaagaacagaaatttatttcttacaattcaggaagctaacaagtccgagatcaaggttctggcagatttggtgtctggcgtgggctcacttcctggctcattgatgacgacacctttttgttgtgttctcacatggtgagagtggtgaggggtctctttctagccttttttataacgacactaatccgattcatcaaagctttgccctcataacttaatcacctcgcaaggctccaccctcaaaaaccatcatcttagagtttaggatgtcgatatatgacttttggagagacattaacattcattccattgctttgtcctttcacacacttggaatgcctctattttctctttgattcttcactatttctgcatattcaatttttgtaatgattaaaaactcatctgaattgcaggaattcattggaatagttcaagaagatttattggatagatagatcagaatttatggaaacaaatgcaggaaaaacagatgagccctgtctgcaggggatacctctgactgctactctctgcccctctcttgttgggactgtgtagtctccttattcatgcttctttctgcaaatctcctatggtggtctcttcaatctcttacttggggtttctctaatccccactaacttcatttcccatgtggccttggcctatattggtgctcattcagacagcttgatagaccacagtcaactgactccacattggtgccttaaattccacatagcagaacaacaagtcagactgccttcatttgagttaagtgaccaaaatgagttaagtgagttaagtttggaccactcttggtccaaacagctattgttgagatgaacatagagatcatatgatacatgatgcgatttatgtctattcagtgttctgctaattcagaaacttggtaaaaatacattattaccaattgacagatctcatacagagatgtttgataatgtccacatagtcaaaaccaacgatggtctgcttgaaccttctctgcctcctgtctagttcttctcatctacctcactcattttctggacatatccattgccaaggagatgtctctgcccaagaaatggtctgaaaatgtgttcagaacctacaagccttctctttaaaggacaggatgtgggggaaatgcattcagtggctggaaatcaccctcacttgaaatgctttggcctgtgaaagaaggagactattacaatctactgaaatgtcaataattaaaagccaaaaaagttattggaaaggctcgccatgattcatgccaactcccattctccccagcatgtagcctcacaagatatataattttccatttgtgtatagtggagagttccaggtcacataggaatattgaaaatgggtgtaggacccagggtcttcaggctatttctgtctcaagttattttgattttcccttttgatgctgtcagaaactctggacatgatcatttgtgctggaaaaagcacaacttctgccctttgtttcgatcgcttttgccatgtgtgattggtgaatttgattgctggccacagaaaattgcatttgtgtcgggagcattctgaacagatcaatgtaggaggaaaccaggcaggatcaattgtaataccaaaggaccagtataaaaagtcatgcaactcacatgtcatcctatagctctcaatgtctaaacatcacatggatttttggccacaattcattaattaaacctcacaatatgcagtgaggtcaagtaatgtttgatgctagacatctagaagagtgggaaataacaccatgtcaatccaactgtctttatgcagagaatctgcaaaaagtgagacaacatgtaataatacaaataattattatagtcactccatatattttccaggggctggctatgtcctctatacacatttctaattttaacttcaagagaagttaaatctatcatttctattttatgactaataaatcaaacccagaagggttaaataatctgtgattgtccatgagtgtgcagcgaagtggggtctccggaattctgttctgactggctctgaacgtcatgcttttaaccgtctctatttattgtctttgtgtttttaaaccacagtgctatataccattaggaataagcattatcattgctgccactattcttgttagtttactaatactgccagatgtgtagtaaactaagtatttcctcttctccacaaagggatgctagggttctagggaggcagttattcatgtgattacatctgtaatatttgtatgcatccagcttgatcaagcagtttccctgtctattatgaaaaccagcttgtggaggaagtagggcaagtatcattcattccatgttccaagtgaagagagtgaggctcacagattgtgacttgtgcccaggaatggagagtggagctaggacgagaagtcaggcctcccagctgcagagatactgttgcttccactctcttgttcttctgtaacaggtagcagttgtttttgaagatatcacagcctaaatggaattaactttcttcttaaaagttggactgtctccagcctcccactttcttaaaaatgtgaaaaacaaacaaaaaccagttcagaacactttagccaaagagtgtgtcctaaatgagtgtgtcctactctctttaggcttggaccatgtcttatacacctgtttggtcctatctggtccctgataggctgccttcaacggagggaagcagtggaaaaagagcttaactgactgctagaagacaaaatttatgtcttaatgatacttaatgatttagtttcaacactgtttattagcaaaaaatgtttagtgatggcatcctacattctaggccctcactgggcactgagtagctgggcaaacttatacaggacacttaagttttctgggcctcaattctgtcatctgcaaaatagacttatgaatgcctttttccctactgcaaagagttattgtaagaataaaattaaatcatggaagtgaactgcttctataaactaatgacccctgtacttatgtgatgcattattttaggctctaaaaaaatcgtaaatgtatcagcaagttaagaatgtaccttgctacatgccccagggtaacagaatcgatgctagtgcagtgacttcatggactcagtatgctgggtgaggagcggactatgatgggcattgctgtgtcgcctctttctccctcttatggagggggctgccttcagcagggtggagctgctgctctttgtgcagccattctcttggaactgctttctctgagtggtgtgatttttgtagcattttcttcctttcctttctctttctggcaatggctctttgaaatattatttttgcttcctcgacggctgggctgtataattgatggcctctcggggttgctggagtcgtgcatttaaaccacgatcgccttggattcaacgcctcagagttcattactttttgaaatgcttcacgtctgtttgtgttcagattattgttgctctggagagagaggttattgtcaggcaggaagaggagtgtggagcagaattcatcataatcacatgctcttctcttctggacgaatatttctgggtaacaagacttcatatttatctggcatggctgttctgaaccagggaacccaggaccttcactttccccctgcagcctgctggagggagtttagcagcattcggtcttggaatgtgggaggctgctgctttgcaaataaagtgggtaataaaagtgcccagcgctcatactagagaatgatttagtgcagaatgtgtacatgtaggatttttaattaaaggtttggggtgcacttggttctcagcaatggtgttggtggagggagcatgctctctccacttgagctatgatcttctctcagttctgcagtggtcgtcccatccttcccagctcttgtctctctgtcacctcatggtccacccacaccattatcactcatgtatgtccacaccctggctcctgctctccacgctgcaccagctccataagcattagcaccccaaatttggtaaacccaaacaagtttgtgtaaatttggaatatactagaacctagtctatatggcaaatgaagaataactcctctaggtttccagaaatggagattcagagttgttggggaggctataactgagaacttttaattcagattctgccattctgtgcatttttattctcagactaaaaaaatcctacccaccccccttttttttttcagacagagtctcgctcagtcgcccaggctggagtgcagtggtgcagtctcggctcactgcaagctccacctcctgggttcacttcattctcctgcctcagcctcccgagtagctgggactacaggtgcccgccaccatgcctgggtattaaatcccacctcattctttaagactgaaattatccaacttcttgagcagccacccttagaagttccctacccccacctcattctatctcaggaaaattctcgggttccccattgaacttccagagctccttatttgtatcatggctgcaacattctttacattttttttgtaattctccatcttatgtctgttctcttttctctcactgtatctcttgaagacaggagctagattttttgtttgtttgttttatttctgaatgaccaccatctagtgtggttccaatatatgcttgacactaaagaaaggttcattgaattaatccatgaaagaattctgtttgatcaagtcacatttcgattttcctgttagttaagtgtaactgtatgtggaagagaagcagtgttgtgtgcgagggacacgctgattcatctgtcctttggaaatacacacagctcctcattccagagggacaggtagtcagatacagtttgttgggtggggctacttatacaagaccaggtggtaaaaagtaggcatttctaaaagatgggtttggtcaagtttggtcaattatggatatagaagcaactttccaggaaaaaaaaaaagaaaaaaaaaacctgtttgagaaaggtttttcatctcaatagcagatgaagtacttataagttgaaggcagtttcttttctttttgcaacatagcaattagaagatattgtcacatcttgtcatttgaaaattctaaattaggttatgcatgtaacaaaaatatatgctggtgtttaacaaaaaataaatatttgagggactattttctgtacatttctcaataggacaccaagtatagatatcctctcagattatgcttgacatgtgttattatattcatatatttcttagtattctgggggtgaggaaggattttagcctctgtgaatcctagttgagtatacatgcctaaagttttttttttttttttttttttttagacagagtctcactcttgtcacccagtctggagtgcagtggcacaatctcggctcactgcaacctctgcctcctcagttcaagtgattatcttgcctcagcctcccaagtagccgggattacaggggcccaccaccacatctggctaatttttgtatttttaatagagatggggtttcaccatgttggccaggctggtctcgaactcctaacctcaggtgatccacctgccttggcctcccaaagtgccaaagtgctggggttacaggtgtgagccgtgccgcctgacatgcctaaagtttttattgttactttgttactcaaacttctccttgacacattacaggagaatgctggattgcatggattataacagtctaaagctcagcaaagtgaaggtgattatcagcattttaaatgctgtgacattttgctgccaaaaagtaattgatttattaaagacattacaatacatgcatgattcaacataagaagttcctttgaatttgttcagtaccaaatcctgtgggagactatttgctttcagcaccacggacagaaactctttttcattcagattcagttggccttacacaagtaaatattatagctcagcagtggcactccaatccactggccacagtatgatccaatagctttaacattccaactgatgggtactggaatgttaatacattgttttccacttattttgccacaaagtggaataggggacacaagtggatgactttataatgcattattattaccttcactttgctaaaaatgaaggtactaatccataacaaatcagatgaaatacataacattttagaagatgactgattttttcctaacaagcaacttcttggcaatgctagatttcaaaacactaaataagaagccataactgagttcagtgattccacacctgatcactgaaccaaagagactaatgaaatgcctaaagctaataaaaaatcttgttgttgaaggcaatgaagccccaatggggcatggggtaaaatactgaaggatcaggatcttcatctgtcgtatgactatgactaatgcactcatcctgactgggtaaacctctagttaattcccaattgcttcaggcaatggatcaaaacttttaaaatacagggacacagtcttaatccagagtactgtttgcttccttattcactgttgattataaatgttccaacgcaattttatttctcctcactcacatgacaaaagaaatggaaaattttgatggagtaattcaggagttttgctgaatcgctcacatgaaattggattataaaatatatagccacattgatgcccaaattaaaaatatttatagaacacaagctgatagacgtcttagataacgtgaagtccaacctgtctccttacagatagggaggctggctccgcaggatctcatctcttgccttaggtcacagagataaacacatggttgggaggggcttattgcttgatgaaacaacaaagaagagaaggaaagataaactttaataatatgtaagttattttgtttccatttttattcagaaaagctacaaggcttcctttttactcaacaaaatgccatataagtaaacataattcccactttgcctttctgtcaggaggcttaaaaagaaatttccagcctaacctaaaaatttatattgacatttatggtttccataagaggtattctctttttccttggattttattttatgtgtttacccttttgttttgtgttttcattataagattcctcaaatttattggggaaatggtgaaatataaataattatgaaaagtttgatagacagccttttcaaatgtaaagtaatcatatataaaatatgacctggacaattgacgccttgtgtattttttgggatcaacttggctgtgaatcatttgctcgtcttaaaaattggggatgggggaagaatgttcatcatttatctcccaagaatgcatgatgaaggtaattaaaaatgaagtgaaaaagaataagaattttattagtgtagatataggttatgtaagagaggaagtatttttattcagaacaaaaatgtttgtaaaatattaaatgaaaatgtaggttaatagaatttagcatttaacttgtcaattgtattaatgaattcaaagcaaagaaaaacttgggcgtttcagttattcagttcaaacaattacattaattaagtaagcgggatttacttttttattcctggtcttatttatttttccgttcatttattgagtacctgctatggtttcaggcactctatactgtctgggtattcagagataaaagagaattgctcttctcaaagagttttcaggaaactccaccctctgctaaaatataacacaatgaactgctgcaagatgctggggaaacaaaaaagaggatcaaaaccaaaccggatcaaggtggagtggagcttgaggaaggctcctaggaatgagtctagatttaaagggctaagataaatttgttatgtaaagattgagagtctgccaatccaaagtaccctaatggatgcacaagagaaaatcctagggagagaggggcaggacacagatcttaatctagtttacagtgaataatggttgaaagatggaagtgggtaggcaaaggctctggtgtacgtgtgtgtggagagagagacagagacagagagaaagtttgggtgcattatggtaaaagataagataggagagctataaaatggggcagtccggaagggccttgccttacacctccagttaaggagtttacatcctgtgaaatgaaagagagtacttcaaaatgttataagcagatgagatttgcatttccacaaagatccttccaagtcattttggaagacggtttgaagagggacgaagctgacccactctattatagtaattcaggggaacagtgtggatggcctaaatgtagataattagccttgatgatgcaggagataccaagtggaatgtatctttaccagcagggactcatggggcttggcgactggtatgggaagaggaaaacttgaagaagaatgaggaatttccttgactggggggtagcatagcatagcagtttagcatgtggacactgggagcagactgcctcttctaaaacctcgctgtttgatcctggtatgcttcttaacatctcagtgcctccatttcgttattagaaaatagtgtaacactaacaatagtaatgttatttttcatacattttcagaaaattattggaaaatcatcaccgtttcttaaatctctttaaaggcctatgggaaccccgtttgaaagcttttgaaatatacaaaagggattgattgtctatggagagaaagtgattcattcaatatgggacttcacattcactttgtattgtgtattcacagtctaataaattattacataatttgtgaaaagatgaaagagaaaaagaacatcttcagagaggatgaaataatccaatagagagatgttggagatgattagtgaagacattcagaaggtagagagaaactgacagtcatgttaagtctaacatgactttcaaagaagctactaaacagtgatggattattattaaaggcagagattagccaagaagtaaagcaagcaacttcaaaggaacaagcaaaatgggaaaaaaaggcacttcaatccttaaaagaaaaggacaaatgatagaaatttttatacaactgaatggcttcccataagcaagtagctctggtcttccctcaagtctagaactgcaaactcacaggttttcaagtctagaaaagtaaaaacaaaaaacaaaaccaaccaaccaaccgaacaaaaaaacaaaaaacccacaaaccctctcaagctctcagacttttctataacttgtgtcctgggcagctgggtttaaattccatcaatctaaggacctgagtttccaaacactataagtctaatatgattaccaccagagttggtggttcagctcaccacctccactccacccagccttagagaatgaagaactaaaacccggtgaggctctcccatcagattttctttccattgtattcgctactaccagccccaggccaacataggccccttcctggaagaagcttcaggaaaaaaaaatggggagaagataaaagaagaaagaagtgatcaatttagttcatcatcatgtatgtaaagtcaataaatttaggctatgtatttaacttaaggatctcagaataagttatacaagtaagacaagtgattgtgctcaggacacaagcaattgcctattgccaaatctcatggcattttttcagtactctttctgtcataattgatgcagttgctaccactgtccttactgatgatactttctttaccaacttttcatgaaactactccctcttgactttcacccaactctcaccactccatctcagtttcttttctttatccaccttaatccttctcatgagtcatacctgttggctttcctctgggttccacatttgaatcttccttttatgtttttcctaggtgatgctactccatcatggcatcagcatgaagattatgatttaggcagtcatcctgctgtgttctgcctcatttcttttctaaattcccaaaggattacaagttgtctattgagattcttagcttttatgtcctgcagacaacttgagctcagtgtattccaaactgtttttattatccttggtacctaaccaggtttttggtttcaatcaatggggattgattcaggttgacttaacagaaacaaggagttgactaaaaatatgttgtataactcatggaattgacagaggtttgattcaaaaatgggaagggggtcaatacatagaaaaattacaatgcaggaagtcctgccagggcattgcatccactacagcttaatagtggcactgatgttggcactattgaaacactggcatttgatgcctcttctgttccttctgatacctctgaatgctggacatcccaacaggagtgaattctaactgtctctgtatctttgcatttttaactatgtatgcaaattccttgaccagagcatccagtagacagagaccaggtgacattcctatgctgcacctattagagtactataaggcaagtctgaaatcttatcagatttcaaaatggagtcacactatctagtttattattattattattattattattattattattattttaatctaggaagggtgttccgattctgggtagtagcttaaaggaatggcaaaaacccactccatatttcatgaggaaaccttatcttcaaccgttatttcccatgttaactaatgccaccaacatatatcagtcaagctagaaacctccatcatttgctagtttttctttcacttctttttaacacacctgttttgttagtagtgtttatttaagttcctaaccttacaattctatctaccaaatattcctttcccttgttttctattctgctctttccactcttatagaagccctaggtcatgactggagaggactttcatatttttaaacagtgatgtactagctaaggttgcatgctccagtgtctgatcacctgcatttgtatcaaactgcagatcatgctcactcattgtgcaaccctgggcatattatttaatctctctacgtgtcatgtataaaatcaggggaataataataatacctgccacacagggtctctgcaagaacaaattgaggctgtaggtgtaaagcattgtgtatgcccacaagcaatgtgcacacaatgatggtaaggtgacactaaaactggaaagtaataatgaggggtgaggtggtgaaaacagtaatgatggcagtagtaatctggtagctatctctaatacgtactctcttgaggatgcagtctgcattgctgccagcattatctttccaagcaaatctgcttcgaatccttggatggtcctcatttcctatggaataaaatccaaagtctttaacaaagcatataaacttctctaaaatggggccccaagttatccttttaccatcaaattctaccactgaccttatagtacaggaacacagaccacctcattttccaacattttaaagattttacttacaggtttcacatatgctttctgcttcctagaacactctcctttgctgccttggaattcacattttctgtaaggcccaaacacatggtgcctttctttgcattttcctccctgataccctccctgtgttcctgtcacactctatatttgcatctcacacggtgctgtacagtcctcattgcatatattgtcaacttctacacctgctggcacacccttgaacttaatgttcctatcttacccactcccatctctgttacataagaccagcacatagtagttgctcagggaatggttattctatgactgtaataatcaacacatttgtaatgactcttcaaggacccagaaacctggagaggcatgcccaccaacttgtcccagattagttaaccataccccactggccacatttggcagtgaccaaacaggctcagcatttgagggcctggactcttgatctctgctttcatcgtttccactttgtgcttggcaccaggcaccatggagaaactttagcatgataccgggaagacacagtcggtcatttttttctgaaggaattttcatgccaccataaactctaaattagcaggcatcatagttatgagactctggagccaaatttgcaatcaccattaagacaaagaggcaaaggactgtgcatgtcccagcaaggtattctaaaacagaaatcgctactccctttgacaacacaagtgtcatctgaaaaatctccatgttctttgaaagcaccagacaagtatatcttctctaggtctacctggtcatagaaactttagactcaccaactccaaaaagtaaagtgtggaacttggtgtaaagtgcttccattcctgtttctggaacttaatattcaatacaaatttaggccatcactagatttttcaaatgacacctgtgttgttaaaggcagtagcgatttctgttttagaataccttgctgggacatgcacagtcctttggctctttgtcttaatggtgattgcaaatttggctccagagtctcataactatgatgcctgctaatctagagtttctggtggcatgaaaaaatccttcagaaaaaaggaccgaccgtgtcttcccagtatagtgttaaagcttctctatggtgcctggtgccaagcacaaactggaaacgatgaaagtggagctgaagattttgtatttcaaacattttactaccgtttttgagagcctcttttgaaagcagtgagtttacgggggtgtccgtagatcttcctgttccatatgctgtgtttacccacagaagagggaactttccctgacacttctgcctcctcaccaaggcagagaaaagaggtcctctctttgctcctttgctctgttctcccgggctgaggctggggatccagttgatccagacagttactggctgcctcccaagcaagttcctctctcagctcatcctctttgtgcttccttggcacagctgtggggggcagtgcactgccccagttcctacatctcacacccatgtgagtgctgctgtttcttttaagacttttctactgactactgtataaatggatcagattggcttaaggtggagagctgcttcttttttcttgaggcaggacacaggaaattctttcctgcagacccccacactccagtcgtccggtcctggtagttaaaggtggtgaaaccctctcattcacctgaagcctggctcttccctcaatggttcagacctggaaggaaagaccagagaaagactaggatttgggccacaaagcttcaaaactgcattttttcttttaaatgtaaatttagattatttgtaattacacaagatgaatttgatgaacaatgagctacacaaattttttgggaaaaataatattcatttctaggcagttgaccttcagtcagatccacacagcgtcatgaacgtaccatgtcattgtgaacctatgctacggcttcatggcgtcagaggtgccaattcagaaacggtgtggctgggccttctgctttcagcttacctttttttgttgttctaatttttcttgatttggattaatactgtactctgccacagcacgctggattattttgctgcgattgtttataaggagtggcatccttatgagggtatttgatctgttattatcccactttctcttgaaattgtcgtatctaggctcagtgctatagaaatagaactttaaaagtgaaaaacaaaacaaaaaatctcactgctggaagacatttcacactgaaacatctctttctgtgtcttgctttctatcactgtcactctcactccccccatatgtgtgcacatgtacatacatgtgaatgtgtatgtctgtgtgtgtacacacaagcgaatatccaaacagacatttatgcacacattttcttgagatatcaaggcttttatgttccccataatgtgtgcctcttctctcacttttctttcttaagggaggaaattttcttccatcagaatatcactctgagataagccctgcatttataatgcacacaaagactttttccagtacttgtctaatgagaagcgatgcccaaaattagagcttgatgccttccaattatcctattgcacatgattttgttataccacaaatagttattttcttccttccccaacagctacataaatgggtcgtggtaatccactccaaaacaaatggctcagtattgctaactttgctgcatataacgcaaatctctccattaataaagaaaaagagtgtctggtcatttcataataattttaatataattatttttaaaagatatgttggtttaaaagatatggaggagggttggaagttagttctcaagagcatagctttcatgaaaactgggagagagcccaggatggagtaggaagggggctgcagggctgggtggcatccattactttcactttatttttgggctcggattctttaacgttgaccctgctttgtgctcaggcaaataatgggtcaaggcacttcaaagcagacagctgctctggacttgattcatcctaatcagaaataactgccgcccttgcctattcatcgctttcccaccctagaaatgggggattacgggaagaatgaagtcaaatctaaagagttctgccttagatagttaagaggatgattgaaatcaataaatcccaggctttcgggaagcccacttgattccaagtttgctaaagacggaaagaaagaactccaacaggagcctctggtgaccagaactccaccactgagccactgcggtggctctctcatcactgggacttcccagcaggagcctaagtattactcgattccacctcattatggtactctccccatgaggagtgtaagtcacaatgacaggacaacaaaatggttgggagacacagccaccaagggaagcaggcagtggatggccagcccctatgaatacactagcttgcctctttccagcagcccaaatctccttggagggaatcccagccagtcttggatctctaacgcagccttctctttttagtttgactggtatcccagctccccgaggaacctgcaggccacttgaaattcatgatgacagcagcagataaagactccatcttatcatccacgtggccactgctttagacagcctgctttttaaatttttattttttaatgttttgttttgttttgaaatgttcgggctttcaggtcatggcattgcagccattcctcctattttttttctttaacgatatgtaaatactttcatggaggttgtcttatttggttctcagaaggacactataagacaaggcagttataataatttcagttttataaatggagcaaatgaaccctaagacatcaaaccactggccctcaaatgcaccagggataggactcttgcaggtttgcccttcttccagttctcatcccattaccgcttccgagccccctgtggggatccggatgatttcctcaaacgctaggtggcgccctgtggagtgcccccatgctcacactttcagagggggtttgtggcagccatagctctatgaatatgtccattcccttgactccgtgtctaggagaacattgtctacatctgagtgccaggatccacatctgttcaattgaatagactccactgaatacatcagagaagcagggccagactggctacccatgccctttctaatctcactgttcaattccttggggaaatatgctactttgaggatgtcttcagtgccttgcttctcttttcttcattttcactggaaaggaggttgctcagatggcgtgtgtgtgtgtgtgtgtgtgtgtgtgtgtgtgcgtgtgcgtgttttaaggattgaatgccctgaaaaaacaagatgagacctagaagtatgttcagcaacaccatatctggcttctctatactccccttcatatttttcttagctgttctgttttagttagcaccaatatagtgctccccacccacgtatccctttagggtgaaacgcctgctcagtgtgcttgggaaaggcagtatattttaggcagcctgataaaaggctctaatagccccagattaatgcattcattcctagccaactgaaggattcattacagtgctcaggctgaggctcctctgacaaatttgccctgggtaatgagccattcagcagctaactaccctgtgctgctggtgacctccagaaggggcagtgagatggagctgagcagacacaggtggagtacaaaagaagggagagatttgaggcatctctgggctttggggagcagttgtaagagcaagaaggtgcttctgagaccacatctgcctctggagctatgacaggagcgtgatagggtatgtggcgcctctgtactttctgagcctaacaagtgaggttcagagcaaggcaatgtaaatctctgctttgaaagtgaacatggattgggtaactaaaaagagagtgatacgtaggagaaacttccaaagaattgcaatctgtccctctgactaacatgtctacgtggagacttccaaaatggaaaatgagacatagcataacagaaagcaagaaagcctcctaaagataagctagcccagcagctctgcagagtatgactttaccctccagggaacatttggcaatgacttgagacatcctagtttgtcacaactctgtgcgtgcgtgtgtgtgtgtgtttgtgtgtcagggaagaaattagcatgaagatgctactggcatctagtgggtatagaccagagattctgcaaaacatcctgcaatgcacaggacagccccacacaacaaagagtcatccagccccaaatgtcagtagtgctgaggttgaggaacccggactaacccaaacgcctccttttataggagacaaagctgaagacttgagaaaagtgcctggctgaggggccagaaacctgtgtcttgtctccctccaggccatgcaaggcttgcttttgaatgctgtcctggacagtactttcagaaatgaagaggttccttctcctcccagactccagggcacccttcccagctcacatcttcagaaaggaaaattccactgcctgccttaatgaacttacgccggtctctaaacactttagtctaggaatatctcttctgggggttagcttattatctttattatgcattttagaggtggatgttactgcagataaaaataggaattcccagaggaaccagcaccagcatcatgatatgctgtatgtgcaatgttgttgcaaacagttccccatgagggtgagatggagacccctgcatatacacataactgtatctcacaattattaaatattgattcatctcagcaggggcctgtgtctgatttaaaataaaggcaagtgcattaactgatgctaatctaatctagacctatagcactgcaccctgggctgtctccactgaccctggttctctgattgacagtgtgcatgggagccatttcctctgccaaccattttgactctagaaatgcgcacacatgagtttatatctggagttataggatatgtgggatgtgagcataagagcttaataagaaagaaaggaggcctacatgatgatgaatagcaattacagggaattagattagtatcagcatctggagtaattgtaaacattttctggtgctgatgtttgatagtgttgggaaggggggcaggtggtggatgatagaaaggaagagaggccaaagataagaacaaatatgcaagtctatagtgtgtgcttaatggaactgagatttgtttctctgtgtgtctttttaagcctctagatagatcatgaaaaatacagccagctgggaaagaaatagcccaaatgtaatttaaaggacagctttttaaccaatacttcaacttggagacacctgtcctatgttccttaaagatgctcagctcaggggaggagtattaaagttgctgatttatcttcaggagcacagacctatttttaatttattgcccagtgacaggtttcttgtttagcttttctgtgttactcaacacaaccttctcagtaaagaagagctgcctgcaggacattgttttatttcatgttccagagccttagaagaaggaaccgaacttggacttctccaaagcatgttgacactctctctagcttcatggcaagcagcaaattgtgcaccaggaaatatagttgccttgcccactgattcacggcagatacacacacacacacacacacacacacagacacacacgatacttgagtgccttttggagtgtgtgtgacagcaatggtttaatcactcctgtgtcaatagttatgtcatagaaacctttgccagaaatatgtcttttagtactgtagagccacaagaaagaaaatgtgtgtgattcggtttatgcatacaaatgaacaatcgtttgtggtgctcctactattcgcaagaaacactgttccatgctgggggccataaaggcgaagcacacaaaagagataaaaacattataggtcctgccttctagaatctcatattcttgtgggaatgataggtacatatacgaatagttgctaagacaaactgtgatatactcgatcagagtggtttgaacaaagggcaaagaaggaataaattaattctggccaggggagttcctctgttcaacaaaatgatttgagcccttgttgtgtgctgggaattgttggtggaagggacagagtgtgcacaatacaaggtttggttctcatagctgttacattccaatgagaagagagagacatcagacactaaacaaatgagaatttcagagagtgtcatgagccatactaataaccaaagcatggtaatgagataggccaggaagctatgtgaggtagcatagcaaggaagggcactgagaaggggaaatttgaaatgagaactaaatgataaacaactaaatatgtgacactctggataaagagcatttcaggagaggaaagaaactataaaggcctgaaggttcttaaccttagcatctttaagagatagaaagggccgggtgtggtggctcacacctgtaatcccagcactttgggaggccgaggcaggtggattgtgaggtcaggagttcaagaccagcctggccaagatgatgaaaccccgtctctactaaaacctacaaaaattagctggccgcggtggcaggctcctataatcccagctactcaggaggctgaggcaggagaatcacttgaacccaggtggcccaggttgcatttagccaagatcatgccactttactccagcctgggtgacagagtgagaatccatcttaaaaaaaaaaaaaaaaaagagacagatagcagatcagggaactgagtgaattctgggcaaaatagtccaaggtaaagtcagagacttccttcaggggttagctctgtagcatcttagagacacagggacacaggtatggattgtgaatttaattctaagttcagtcaaatgccattggaggtttataagcaggggatgatattatttgtttttttttgtcattttgctttgttttaattactctagtcatgatgtacagagtggaatgtccgtgcaaacagtaaaaacaggaagaccacagatgtagtaagagtagaatagacttggatagtatttaccagaggggaaaaaacaggtcagtgtccacaaaactaaaaagcattgttgcagccccctacccctgcacactgcccctctggaatgcttatgcttgcggccaccacccaacgaagtgctgttgctggtggtctgggagcagcttagccacccaaccccaccaccatgctagagtgctttcaaacctcagctccctctacaaagtgctggtgccagtgatctgggagcacctcgctcccaccttccagtgcagccagtgctcaacctcaaggagacagaggacaaagccacagaccaagttccagcccaacagggttagagcacactgcccaggagtgatcagctgagccttggccctctgaacacctctggaaatgaagccatttgactatacccagcttgcatcgcagtcaagccctcaagggctgtaaagaacataaaaacaaaaagccctatccaaagacagtaacttcaaaggatagaggaacatcagccttcacatgagaaagaataagcacaagaattctgacaactttgaaacccaaagtgtcttcttacctccaaatgatcacactagctacccagcaatggttcttaagcagatggaaatggctgaaatgtcagaaataaaatttcggatctgagtggcctggaagatcaacaagatacaaaagaatgttgaaacccaatccaaggaaaagagtaaaatgatacaagagttgaaagatgacatgaccattttagaaagaaccaaactgaactgctggaaattaaaaatttactataagaattttataatacaattggaagcattaacaacagaatagatcaagctgaggaaagaatatcagagcttgaagatcactcctttgaataaatgcaggcaaaaaaatttttttaaagaatttttaaaaatgaacaaaaccttcaataatatgggattctgtaaagagaccaaacctacaactcattggcattcctgaaagaggagagaaaacaagcaacttggaaaacgtatttgaggatatagtccaaaaaattttcccagtgtggctagagaggtcaacatgcaaattcaagaaattgagagaacccctgtgagatactatacaagatgaccatctgcaagacacatagtcatcagactctccaaggtcaaagtgaaagaaaaaatattaaaggaagctagagagaaggggcagatcacttacaaatagaacctcatcaggcaaacagtgaaactttcagcagaaaacaaacaagccaaaagaaattgggaacctattctgagcatcctaaaagaaaaaaattccaacccagaattttgtaacttgtgaaactaagcttcataagcaaaggagaaatacaatctttttcagacaagcaaacactaagggaatttgttaccaccaggcctacttcacaagagttcctaaagggagtggcaaacatggaaaagaaagaatagtacctgccatgcttaagtatgtagcccactgacactataaagcaactatgcaatcaagtatatgtaacaatcagctaacaacataatgacaggatacaatcctcacatatcaatattgacattgaatataaatgagataatccccccacttaaaaggcatagtgtgtaagttgtattaagaagcaagacccaacagtctgctgccgttgagagatatatctcatgagtaacaacacccataggctcaaaataaagggatagagaaagatgtatcagtcaaacagaaaatgaaaaagagtaggggtcgccattcttatatcagataaaacagattttaaaccaaagttggtcaaaaaggacaaagagaatcattgcttaattataaagggctcaattcaacaagaaaacttaactatcttaaatatgtacaaacccaaaatcagaacatccagattcataaaacaacttcttagagatctacaaagatatttagataaacatgcaataatagtgggagactgcaacaccccactgacagcattagacagatcattgaggcagatatctaacaaagatacactgacaaacatgacacttgaccggttgaatttaattgacatctacagaacactccacaacaacagaatgacaacagaatatactttcttcttatctgtatatggcacatactctaagatcaaccacacactaaaccataaagcaagtcgcaataaattcaaaaaagtcaaaatccaccaaccatactctcagaccacagtgcaataaaaaaagaaattattaacaagaagatctctgaaaaccataaaattgcatggaagttaaacaacctgctcctggatgactttggggaaaagaatgacattaaagtaaaaataaaaaaataaaaacaattttcgaaactaacaaaaatggaaaaaaaaatagatcagaatatttgggacatagttaaacagtgttaaaaggaaagtttatagtgctaaaaacttacatcaagaaattagaaagatctcaaattaacaaccaaatgtcatacctagaagaactagtaaaacaagagcaaaccaaacgccaaagataacagaagaaaagaaataaccaaaatcaaaacttaactgaacaaaattgagatgcgaaaatccatacaaaagatcaacaaaactaaaagttaagattattaaataagagagaagatgcaaacaccatcagaaatgacaaaggtgacattacaaccaaccccatagaaatacaaaaactactcagagactattaaaaacacttctatgcacacaaactaaaaaacctagaagaaatggataaatttctggaaacctacagcctcccaagattgaaccaggaagaaattaaaatcctgaacagaccaataatgagttccaaaatttaatccataataaaaagcctactgaccaaacaaagaccaggaccagatggattcacagtcaaattttaccagatgtacaaagagctaataccagtcatactgaaattattccaaaaaataaaggaggagggactcctctctaactcattctatgaagccagcattataaagacacaatgaaacaaacaaacaacaacaacaacaacaacaaatcttcaggttattatccatgatgaacataggtacaaaaatcctcagcaaaatactagcaaacctaatccagcaacacatcaaaaagttaatttaccatgatgaagtaggctttattcctgggatgcaagggtggttcaacatgtacaaatcaacaaatgtgtttcactaaatagaattaaaaaaaacaaaataacatgatcgtctcaataaatgctgaaaaggctctcaataaaattcaacattccttcatgttaaaaacccctcaacaaattaggcatcaaaggaacatgcctcaaaatgataagagacatatatgacaaacctacagtcaacataatactgaacggacaaaagctggaaccattccccttgagaaattcaacaaggcaattattaccactctcaccagacctatgtaacataatactgaaagtccttgccagagaagttgggcaagagaaagaaataaaaggcatccaaataggaaggtaggaagtcaaactatctctcttcacagatgatgttattctacacctagaaaaccctgtaggctctgccaaaagcctcctagaactgataaacgaccacagtagagtttcaggatacaaaatcaatgtacacaaatcagtagcatttcttccttttttttttttttttttttttttctgagacagggtctcactctgtcacccaggctgcagtgcagtggtgtaatctcagctcactgcaacctccacctcccagtttcaagtgattcttgtacctcaacctcttgagtagctgggattacaggcctgtgccaccacgcctggctagtttttgttcttttagtagagatggggtttcaccatgttggccaggttggtctcgaactcctaacctcaagtgatctgtctgcctcggcctcctaaagtactgggattacaagtgtgagccactgcacctgactgaaatcaatagcatttctctacaccaataacttccaagctgagaggcaaatcaaaaacacaatctcaattacgatagccacaaaaagagtaagatacctaggaatacgtctaaccaagaaggtaaaaaatctatacaatgagaattacaaaacactgctgaaagaaatcagaaaagtcaaaaacaaatcgaaaaacatttcatgctcatggataagaagaatcaatattgttaaaatggccatacttcccaaaccaatttacagattcaatgtaattcctatcaaactactaacatcatttttcacaaaattagaaaataaaaactgtactaaaatctatatagaaccaaaaaaaaaaaagaccccatatagccaaagcaatcctaagtggaaagaacaaagccagaggcattatattacttgacttcaaactatactacaaggctacagtaaccaaaacagcatggtgatgttacaaaaacagacacgtagaccaacagaacaggatagaggcctcagaaataaagtttcatacctacaatcatctaactgttaataaagttgacaataacaagcaatgggaaaaggactccctattcaatagatggtgcaagataactggctagccttatgcagaagattgaaactggcccctttcttttaccatatacaaaatttaactcaagatggattatatgcttaaatgtaagacctaaaactataaaaacccttgaaaacaaaccaagaaaatatcctcctggacattggccttggcaaataatttaggactgagtccccaaaagcaatagcaacagagccccaaattgacaagtgagacctaattaaacttctgcacagcaaaataaactgtcaacagagtaaaccgacaacctatggaatggaagaaaatattcatcaactatgcatccatcaaaggtctaatgtccagaatctataacgaacttaattcaacaagcaaaaaacaaataaccccattaaaaaataggcgaaggacatgagcagatatttctcaaaacaagacatacatgtggctaagaaatatatgggaaaaaaaagctcatgatcgctaattgttagagaaatgcaaatcaaaccacaatgagataccatctcacaccagtcagaatgctattattaaaaagtcgaaaagcaacagatgttggcaaaattgtagagaaaagggaacaggtttactctgtttgttggaatgtaaattagttcagccactgtggaaagcagtgtggagatttttcaaaggacttagaactacctttcaatgcagcactcttgttactgggtatataccacaaggaaaagaaattgtcccactaaaaaaaaaatacactcatatgtttattgcggcactattcacaatagcaaagacatggaatcagcctatatgcccatcagtggtggactggatagagaaaatgtggtacatatacaccatggaatactacacatccgtaaaacaaatcaaatcatgttctttccagtagcatgggtggagctgcaggccattatcctaagtgaacaccaaatacggcatgttcccacttataagtgggagctacacattgaatacacatagacacaaagaaggaaacaatagactgtagtgactacttgagagggggaggatgggagaaagatatggggtgaaaaactacctattggttgctatggtcactacctgggtgactggatcattaatacaccaaatttacccatgtaaactcacaatttacccaagtaacaaacctgcacatgtactccctgaagctgacataaaagccaagagaaaaaaagaaaataaaaagcatcgaatccagtttttggcctgtgagagtgaagctcaaagggaggttaaggctgatggcatgaatttggaaaccatgggtatctgatagcagttaagccacagatgggatggaagggagttttagttaaagaacagggctgatggtcatgaaatagaccatgtcagcatttagagtttgacattaaggaggagtagccagtaaggtaagtagagaataaggacagtgtgatagcatcaagccaaagatggaagggtagatctgctcaagtactgctgaaagattaaattatattgaggacagggaattgggcattagatttggtaagatgtacctcctgggatttggttacacagagattggggaaaatgattctattaatagttggattggtgagtgcatatttgtgtgtgtaattctatttttgatcttttaacatgtcctgagtactatgtaaataatctaaattaccatttgtcataaccaccctattaggtattgttttttttttaattttgaaagagagatgtttattgatttttaatttttttattatttaagttctagggtacatgtgcacaacgtgcaggtttgttatatatgtatacatgtgccatgttggtgtgctgcacccattaactcgtcattgacattaggtatatctcctaatgctatccctcccccctccccccaccccacaacaggccctggtgtgtgatgttccccttcctgtgtgcaagtgttctcattgttcaattcccacctacgagtgagaacatgcggtgtttgcttttttgtccttgtgatagtttgctgagaatgatggtttccagcttcatccatgtccctacaaaggacatgaactcatcattttttatggctgcatagtattccatggtgtatatgtgccacattttcttcatccagtctatcattgttggacatttggattggttccaagtctttgctattgtgagtagtgccacagtaaacatacgtgtgcatgtgtctttatagcagcaagatttatattcttttgggtatatacccagtaacgggatggctgggtcaaatgatatttctagttctagatccctgaggaatcgccaccctgacttccacaatggttgaactagtttacgatcccaccaacagtgtaaaagtattgttattatttgcattttgaaaacaggacactgagaaattaaataactttctgaaacatatgtctgtttatacatttattacttatttatttgagagacaaggtctttccatgatgcccttgctggggtgcagtggtgcagtcttggctcactgcagcctcaacttcctgagctaaagtgatccagcctcctgagtagctggatctacaggatcatgccagcataaacagctaagttttaaaaatttttttggaaagatggtggtgttgctatgttacccagggtgatctcaaattcctaagctcaagccatcctcccacctcagcctcccaatgtgctgagattacaggtgtgagacactgcacctgcgcttataaatgtattgaatacgactaaactgtatacttaaaagtggccaaaatgataaatgatagatacattttaccacagtaaaagctttgaaaaactatggctagtagatagtagattcaggattggagcctgagtctacttggctcccgagtctgagttcttggctatggtcatattctgcagatttgcatagagcccttactgaatattaatccattcagatagagagcaatgtgtgatatttatcaagcataattagagagaagactagaagataagtggggaaggaggagtgcctaatgtctcaggacatgtactttaaaatttattctgtgggtggacagagttggcaaattttgaacttttgaattcattcactcatttagtatcagccatccagccaatatctaataaggccctaatggaagacaaggtgtgtttagctaggactaaatgatcagcaatgtttcagacatgtagacctgaaaagcaagcatcttgtaagacaagataaacattatcaaccaaggcaggaagtacggaaagtggcagtgaattctttggtagaacagtcacagtctagggtggctagagtgctaaatgggagagggccttgaatgacaaagcatgggtttttaaatcatgttatgtggacagctatgattaatgaaacataaaagatcatgaaacatcagcaggagaaatctaagaaaggcgtgacaccacaggtagggatgtttggtgactgcaaagcatggtacatagagtgtagttcacctaattcatatggaggaggtttattacatggttaaagatacaaagggtcttaggttctgaatttttgttagttttgaggcacaacgtttgcttctatatgcttttctgtaattggacatattttggattgggtggtcaggctctttgatgtgcagagataaatgaacgctgttcagtggcgtacatcttttacagttctcaatagcaagagaagatgctggcataaaacccacacaattgcatttctcatagtaagtggtcaggtgacctcttcccctctgtatccatagataggggagaaattccttcctgagtgataccggggagtagatggccttgtgtcaagattcactgacatcctgatgggcctgctttctcctgctgggaactggtgagcgagaaagaagagttattgtcaaattcccaacttgccctttttgatataaagttcacttgtaattttttttttacttgtgttgctaatgcattttgttctcccaagtgtgagagacctagcttcctctgtagcctttaattagtttctgaatgatgacatgtctactgagaagcaactggttgcgtccctccaatctcggggggagataaaggaatctaataaagacattcggtatttctaggtgatgtgtttgacaagctttgtattaacaagaagtcatgttgaaacttctctctttccccaactgcactgcctcactcgctccagcactgtgacatttcacagggggattaacagagctgccactctcgctgagaacttgtagtttaaaacagacagacctgtgtctctacccctcatgctaaaggggaaggagcttcgccttgatctattcaccagccataacctttatgagggatttagtggcaataaggtcttggaacacaaaatcaacggataagtttcctttgacagcagtgggaccacctcccaggattcaagattcaaggtcggataatgagatgtgtcttcctcgcagctgcctagttattccctaagacggtggtcacaaggagtgtgggaacaactcaagttttaattctggcatgagcaatattgggactgtagcactagagagaggctgaaactcttctcagggctaatgaccctcctttgctgaactcaactgtgcagttatttggagaacaagagaaaaatctctggaattatttgcactttactgcagtcatggggtgaggtgtggtggggacttcaccacagccttcttactgcagtcagcataattccctgctgcatacagttttatagcttgtgtttgagtgcataactaccagtgcttttaggcaattaagaattaaagtgccgatgacgccatgaaggcagctgagaatgtaagtgagcttggcgctgttggcagccagcagattgacagctcagaaatgcaggtttctgcagagctgagagccgagagcggcgaccacctggggacaggggcttagtctctatctggttgacctccatttgacctgagtgaggcagcctaggagagaggaatgattattacctgagtatctcttaagggcaagaggagaacattagcagaatcatggctcagagtctaagaggttaccatgacctatacatacatacttacatatttgtttacctgtatgatatcaagatgtagaaatacaaacttcatcccagggtagagtaatggcacagactattatagcaaaatgttttttctctctgtgaagtgggtttctgaacagaagcaagggcatccaaggggcagagttagctaacatcttcctgattttgcagacaaatgacccctattgaaaaggtagtgggattacagaggttgaagtccttagaactagaacagaagtgtgtgtacctagagtgtccctctaattgaggctggagctgccagtggcaccctctacccatgagttttctaagcctaatggaatggggtcttgttccatttctatgaagatcttttggagattgtggaaaaagtctgtctaggggagagaagcaactaatggagtctggtatatgatagaagtggcagtcaccattgcacagcttacagtatctggtcacttgagtttcatgaacatcagctgcattcttgctttgggaaaggaaagtcacagtaaggtgccagatgccaaaagagcgaaagacacagcttaacgaggccttgcggttgagcctcaaaggatatggcaaggctatggcggttgggaactacaggaatagacaattcctggtgagaagaaattagaaacagtgatgtcagaaatctcttgccagcccctggctctgaggagaggatggatgtgaagaaaccttgcatgtcaggagatgttgctgagcactataaataaatcctggtcagcacatcagggttggtttttacagcaaacaattatgctgtttaccactaattcattgaactctgaattatctcaatcacaatagcattcatttgcagagtgattagtaattcactaagtgctttcaattatacctacatattttattggatcccaaatccctgtaggaagagcttgggtctgagaacagccactttctagctcagtggcttcgagcacatcattagcagggtaaaacctcagattcctggatgaaaagggagagtatatgggaagcccttattaggtcttcaacaaatattagttttctcccatgaggaataatattaaaaagtcatatttcctctgtttttacttctgttctcttcctcacgaaattatgtaatgaattagattaattgattcctttctcattgtgacgttatttcacgttttgaggatcttttgcttgtatacattttggctgtcagttttcagggacaccttattagagaatctgcagtgtgtctgacattctccatgatggttttgggttacttgtgtaacctctccaagcttcagtttctcgactacacggtggggaatcatgccttaggagttacggtgaggatttacaagggagcagcaaatgtggaacacctggcaaagtgctcggaatagaaggtgtttggtgtttcttttcttcccaccccatctatcctcccttcgtgaactggtccctaaagagagaggcctggtggtgaagggcaataaagccagtcatatagccccaacccaaagcatgcactgccatacatggaaaacacgcacagctgggaaacagatggccctgtctggatggcaggtccacatcatgatcactgatacaccccttatgtttccatgttaaaaaattgatgaagagacacttcttagtaatttcttagatgtgacccacataatagggcacttatgattacaggtagttgctgtgaaattcaatttttaccattatgccccgaagccaagaggcatggaataaggaaagaatggtatggactgcactctcttatgtctccatcaggaatgactaaaactcggtcaagaggcagagctcataaagacttccttccacatttcagttgatcctgaaaggaacaagttccaatcttcagaagcactggtttatgactaatcctgaaaaaatcactaggtttttttcctagagcttcagggttttctagccaacatgaatggttttactatggagggcgagagaaggaatgagatgtaacaaatgacaaaagggttctggtgaagagaataataatccactgaggttatgccattaaggagctttctacattttcaagctctcatttggaattctgattgactgtaatctgacccttccgttcttgaaaatgatggcagcaagcgcattgctgacaaaagaatggggtcctgttgcacagcgcaccctggcctggggcctgagtcctcatttaaagatgctgtttatcctcaaaccttgagcacatcagcagggcgtgtggtgcatcccaatgtccaaaccaaaacagccccctactgcactaaaaatctctatttctcttcgtattggtctctacaggtacacatttttagtaacactaagaaaggacatttgattaatgctttatgtataaaaagtgatttcttaacattttaatctgatccacagaacatctattttgaggagaaaagataggtgttgatatataatgaatacaatcagagactctaatgattgccatgcacttatacagctagtaactgtggggtgtgggcttaaaacctcggcttctgatatgaagcttagggttctttttttatcaaaagagaccttagggatcttcatgtatattcccatgattccatgtgcgtttgttatttttctaacccatattatttccatttgaaaaaacactgcgcggtggcacatgcctgtaatcccagcactttgggaggctgaggcgggcagatcacgaggtcaggagatcgagaccatcctggctaacacggtgaaaccctgtctctactaaaaataacacacacacaaaaattagctgggcttggtttcaggtgcctgtagtcccagctactcgggaggctgaggcaggagaatggcatgaacctgggaggtggagcttgcagtgagcctagatcgcaccactgcactccagcctgagcaatagaatgagactccatctcaaaaaacaaaaaacagcaacaacaacaaaaaaaaaacactgcaattttcagctgtatgtccttgaacaagttccttgactcctctgagtatcggtatcctcatctgtaaagtgtgggaactaattaggatgaccaatgcatccccatttgcctgaaatgcttttggtttcagcagtgaaagttttatgtctcaagaaactctccaattccaggtagacctgggcagttggttgccttagagagaatatctatttgtggggttcatacagtgaaaaataaaataaaggtaatatagccaaacacctgttatacagcaggtatttaataaatggtaattatcaacatcattatgttcacttacagtccttgggggcaatttaaagatcttgaggaaattcagtcatttcaatttgtttgcatttgcatacagccttgagagaatacagtaattcattcactcagaaaaattgttgaacacaaacgatgccaggcattatgatatgtgatgaccattttcaatgaacgagacaccagtggagcttacattgtacttaggagaggcagacagttgtgtagcaagccaggcaggctgggggttctcttgtagaaagggggtttgaggaagccttctgtgaggagctgaaattgaaataattagacagaaccaatgtgagtagcaggagaaaggcaagtgtgaaggatggagtcaaaggtgggcttgaggcatttgaagaggacaggtggccagcagggtgaggaagggagaatgctgtgggaagagcatggagagggaggcggcatccagagtgtgcaaggcctttgagaccaaagaaggagtttgccttcatgctccatgacagattcatctctccgttcagtgtggatgagagaagggaggtcctaaccaagcacatttgccacagcctgaatcccacctgaaccactcaactgtgcctaggcttcgcttgggtacacagtggcccttgggaaaagatggatttttctcaaaaccaacacctgcttggttgcatctttccaagctttccaatctgggttggacattcatgcaccaggctgttctcataggccttagtgtctctgcacgtggtctggaagccagaaaggttaagagcactccagatttgtcccattaattctgtaaagacaaaggtccctaaagaggccttagcagtgaagcagcccttgctgtgagaactgcccggaggagatgcgggcatctccagtcttcaagatagaggagaggcaggaggggaacccccactgccagccaaggaagccatctgggatctgtagatctgcatgcgccgtgcagttacctggtccaagtggcttatgtgcattctcagccccacaggactgcacagtgcttcataaagcatcctgatttggatttaataggatatccactgtgtgctaaaaacagcaaattgctatttattaatgacataattattaaaactcaacacctgggcagtggaagctaaaccaagagtagggaagttcctcagaatactgttttaataattatcttatttaattatttacacatttgaattaaaattcaataagagccggattaaacattaacctaatgtattaaacatggaactgtatccaaacagcatggctcccttggcttctgtctttcttcctaaacataccctaaccactccttggtctttcggtttctataattggtatattttctagattcagctctcagaagccaggaggcaccacatacatgcctgtgggtaaaagccaatgaccttttcaaaggactcttccactcatagcaggtctaatttactattggcacgtcagttcttacccctctgctctttacctttcatgtggattctcaaactgggatcttgcccagacctccgatcctctgattccaactgctaacataatagtaatattcttcctggatgtccctcatcatctcaccatcagcaagtctaagatagaattaatcacactaatgttctccccaaaagtagttccccctagaaggtctaggggtctccctgtgcagccgtccagatgctacttaacagaacggcattcctgctcgaccccatctccctggttgtcctcctagcaaccatttgtgcatttttcctgggcatggctctccaatccatcccttgcttttcatcttttcagagccaacagtttaatccaggctttgaacatcactgtcgattgatttctgtgactccagtttctgtctattttactccatctgacacaatgttaacagattctttttcttaaaataaatttttaaaaaattacgacatttcttttaaaaaacttcaaatgcttgtcactgcctgtaggatagagctaaaacctaggcactaggcattcacgcccttccatcatctggctgtcattcacttcatgatcttgtatcccatttttcattgattctgtcaaaatttatggactgtccattctgtgttgacactgcatatatgtgtttgccaagcacatacaatattaaaactcactcattgagcacttcacattgccagaaactgttctcaatgcatttcataacttactcctatgtctttgaaacagtctttatgaggttcagacagttattagctccattttataaatgtggagagcaagacacaggcaggtgaagtaacttggccaaggttgcccagttagaacatagtagagccggatctcagcccctgctctgcgttgcctcttgtagtcaatagacattgtatttcttcagtttgtggatttctgccttcccatctgtgcccatgcaattctgtcccatttgaaacagcttcactttttctgcctagatacctgtttctcatttgttgagacctaaaataaactccaatttgaggtgaagccatctctggaactctctctagctgttatcctccctcctagtaactcatagcacttaaagtttgtactgttcattcacattcaatcatacacaattttccaacatattttgccttgttattcaactctctggaatgtttacatgccctgtttcctcaaacagattgtaagttcatagagggccaggcaaattggtatatgtctgcatgtctttcatatacctagcacaccattgtgtaacagtaggtgttcacaaaatgttcattggatgacttttggcccagcttctaaagcaagggtctccaaacctcaggccacataccgatactgctctgtggcctgttaggaaccaggccacacagcaggaggtgagcagctggtgggtgagtgagtgaagcttcttttgtatttacagccactccccattgctggcaataccgcctgagctctgcctcctgtcagatcagtggcagcattaggtaggagcacgaacccttattgtgaactgcccatgcgagggatctaggtcgtgcactccttgtgaaaatctaatgcctgatgatctgtcactatctcccatcacccccagatgggaccccctagttgcaggaaaacaagttcagggtttccactgatcctacattatggtgagttgtataattatttcattatatgttacaacattacaatgtaataataatataaatacaatgcataataaatgtaatgtgcttgaatcatcctgaaaccattccttcccgcatccccagttcatggaaaaaattatcttccatgaaacctgtccctggtgccaacaaggttggggactactcctctaaagtagacttcttccattaacagttgtgcctggccacaaaatgtcttactgatagtgcttgccttatgttgtctcctttgcctaggatatctttcctccttttctctccagatatgattaatttttacttactcctagggcttaacttaggcatcacatatctaagaagcctcttgtggcatccatgtcaaggttggcttagatgtatatcctctgtgtctccataacacgtgattcaccattctgtgtcaccatacattagaatattaggcttctgcatctattttgatatcttgaggctgtgaactccttgaggaaaaggatggtatcttatttagtttatgtctctaatgcttggcacaatgctggcatatggaaagtgatcaatgaatattgaagaaggagtgaatgaatgaaaataagcaaaacaatcctagtatgtttctaacagtctgagtgatgagaagtcagatatagaatgtatccatggaaacaatataaaaatataagtagccctatctcacacttggtcagaagcttccttatgaggatggcttagctaaaaccacagtgcaccctaatcaattcaagtagtcttgaatactgacaatgtactagaagttgccacctagaaaatcatattttgactcccttagcatcttaggcatatgccaatttgtttctgataattgggattgctcccctagtcaaaccacctcatctctatgccatgaatgatctgtctttctcactcacccaagggcaatttgcctccttcaaactgtattcttaggcagaatttaaaggacagcaagcacttctcaacttctacctcatgagttggatattttccaattattagtggggggagacaattctagatgattcttccaagcatgaggtgcgattgtctcatttaatatacttactgcactgacagctctggcccaaaccaccttctgtcctgcttggggactgtccattgttctctagtgtatgattagcagattacctatcatgcaggaagccaggaaaatgaactcacagtaagcccttccaaagcaagagtaattcattacccggcctgatttccacttaaaatgtactttaagcacacttccaactacaaaccctaaatcaccctgtgttcacaaagtccatcattttttattttattgcatggcattggcgtgacataatcccttgcagagcatctcggagtgctttacagatcaataaattacttacctgcacagttgaagcaacgtctgcaaggccagcacagacattctgcaggcagcctgtcctccaggaagcaagcaaggctgtgtgggtgctaagagtgagcagggacagggaccagcaaacgtatgggttggtgttggggggtgggggaaggaggtggctggtgcatgagatgggaatgctctagttaaaactctgaataaaacacatcaaagtgtctatttttgcaatgatcaatttaaatgattccagaactaagagaatttagaagcttgtacccttcaggcagtcagcaaatcaaatgctcagtcattaactcatcagttacctttctgtcctggaaggctccatgtagcttttaaaatgatataaccataaatggcattgttacatcttaaaagtcccagattatagagctagcattctctctcctccaacccttgtccatgtccactctccattatttctgtcccaccaaatgcttatgggagtgcaattgagtgtgtatgtgtatgtgtgtgtgtgtgcatgcatatgcagagacacacacgctgcctatctgaagctcaatgaggatggaaatctaaaaatgattaactgttgcttactctgtgtaacataccctatttaggacagcaaaaaactaaaaagttaaatgaggatcttttcaaatatcttatattaatgtaatttatagtataaaaggaaaggtgggaacatgttacataaaagtttactttaaatgccgtataggagacactacagtgctgtggaatccccaggaaggagaggtcacatcctcttcaggttcatctggacagccttattaaaggggtggtaattctctcaggccttgaacaattttaatagatgtggataggcacagagaagagtgtaagcactgaagtcagcaacaagggcatggggataaggagatagctcagtgcagcacagataagtacagcacacgcttattaatgatgagcatttcaattgggtggatgcaggacatacatggaaggtaacactggagaaggagagaaggggaagaaggctaagatatctttataaactcccttttcatgaaggaaaagatccaacacaactaggaatgagtgagtaatggttcaagtagaggcaagaccagcattaaaatttgcaaacccatctgattttagtgtgagggccccactctgacctcgcaacaagcaataaagtcatcgtgcagcttccctgggctctccggcaggcccgatcacattgtaagccaggtggatggtgtgctttagaattgcacagcatggtggctctgaggaatagttattcaaggaaagaatataacatgaagaaacagaagagtgctggatggaggggacacttaacttgccaagaactaagaagtcaaaaccagcatcaggagggttgaaagaatatctgccaatgacccaactctgaggttggtatggacacgttgcacacaggttgggaaggtggttcccttgaataaccattatcactcaattctgtaaatatttgttgagctcttagcgtggatacagatataagtaacacattgttcaggtcatcagaaagctcatggcctagtgggtgatgctaagcacataaccatagcatagtgaaataactgtctagaattggagtgtgggagctcagtaaatgacatctttactccatccacttgaatgttaaaacacataagacagataagtagacacatggaaccaaatatcacatgtttactagtggtaaagctgagactggagaattaggctcagatgtgcagcaacaatgaggttctacgactggaccccggaaagaaacgcacacacatgcaatggctggatgttccacaggccctatccagtccttgtgggtgctgcttctgaaaataagcacatggaggagcacaacataatataagcttcagaaggttccaaaatagaagaccaaaggaagtagacatcctgtctccaactttacctattagaatgaaccccttctctccctagggggagtcatttagtggagaaagaaggtgggggagagagagagagagatgttatggctaactgaggcttaatttgattccccaccaggtgtgtagaatgtgctctgggcacatggatgaagaagcagcagtcaatttgagatgtccaaaagggcagagaagtatagagggtagggaaagtttcaacaaagaaagtggcatttgctttgggccttaaggatggctgcgcgtgcactttgataggctgaggctggtgaattgcttgagctcaggagtttgagaccagtctgggcacatggcaaaaccttgtctctacaagaataaacataaacattaacaaggaatggcggcacatgcctgcagtcccagctacttggactgaggtgggattgtttgagcatgggaggtcaaggcttcagtgagccatatttgcaccactgcactccagcctgggtgacaaagtgaaaccctgtctcaaaataaaaatgaaaacgagaatggctgggagttgcccaggaaggataaaaggaacaatatgaacccaaatactttatgcccagacagggcatgatggagaacaagggagtcagcagaggtgggatcactggggatggccatggaaaggtgggctgatgcttgattctgcatggcctcatgcctagaaggagtcaggctatgaccaggtggccatggggagccactggagctgtttagacagagatgtgatatgatcagaattgcattctttcaagacatcgctgaatgcagtgtggaggatggctcgtggatatgtgttggaggtgggtgggggtgagtggatacaggaagagggtggaggctaggagaacagctattccagtgttgcagtagaatttattcccattcggactccctgactttgtgtttaaataggaggaaatcaaagctaaattaaaggtaagacttttttatgtttaaggtaattcctctaatttcttatcgttaacttactgtagtccatatattttactctctggactgttctgccaactaccatgttaagacaactaagaaatgtttcaggaggatttttattttcattctgtcttgtttccacagtatctcccaaaattgtagagatttcttcagatatctccattaatgaagggaacaatattagcctcacctgcatagcaactggtagaccagagcctacggttacttggagacacatctctcccaaaggtaagagaacagtttgttgcattgcatcatgaggataaatgggggaattttgggcctttggtaggaggttatgggtgctgatacctactccagaggagtctacgtttttggtggcttgatggtaatctactcatggctctgcagagaacgttgatgttctctgcaaaacagccataccctctaagatttcagaattcatacctcagtatctctccagtcccttggaaattaatctctgttgtctctgggtgaaatggtggtaaggtgttctgggtgaactttacatgttgtttgatgatggaacaaagctttagtggcaattgttcagctggttgttttaaaatagagaaaacacataatgatgggtgagagctttaaatggccatattcctaaaaggagattctccaagtctgtgcctctgcagccttgccaaaaatctggtcacgagctgtttttgtggttttgttgttgttttactccgattgatcctagagaacaaatataacttaatatgtgactaaattgcaaaaatttactttatctgaatgctcagatgttacgtagaccaaagtgttgttttgtgctttcatggattgtacattaaaacctttagaatttgagacaagatgtcatttattattaagctagcttttatttgggaacaagaaagataaaaatatttcattcttaaatatttattgagtgcttgtaatagtccagcctctcttctaggcactgggggttacagcaataagccaaagcggtgaagttttcacactcatgaactcacattctcatgagacagatgacaaaaaaaaaaagagtatgcaatataacaggtggtattaagggtgagaaaatagaacaggatgtgttgacagaatgacaagagctttcttcagagaagggctctgaaaagaagatatttgtgcagagacatgaacagtggtccttaattgtgttgcttattgctgattaatgtgaaatgtgtgtatgtgattatgtatgtatatatgtgccggtgtgcacagatggatgaaggtgtgtgattggcatgaaagacgcatattagggggtgcttttggtctcaactcccatggaagggaaaagtgggaaacagaattgggcaggttagaagctggcttgtgcagtaggacatctcggctgagcctacggggagctctgaagctaggattgcccttcagaaggttcccttattgaggtgatggagctggtcctctacatcggcacagcagtccaaatgtaggctgatccccaaacaggtgtgactgtgggccaggcatctctcttcacatgagacacagggggctgaccaccgagggctatccaccagcagccggtccttctgtgaggcataagtcctctgctcctgaaggtgactgtgcatgacagtgtccactatacttcaacattttaataaatcagagtaagactatgaaggggccccaagtaccaaattctagacagtgacagttggccctaatggatgttctcagagaaggcgtgacattttcagttgtgtgtggcctgaattcctgggagctgtcctgggccaccattcttttttttttttttttttttttgagacggagtctcgctctgtcgcccaggctggagtgcagtggcgggatctcggctcactgcaagctccgcctcccgggttcacgccattctcccgcctcagcctcccaagtagctgggactacaggcgcccgccactacgcccggctaattttttgtatttttagtagagacggggtttcaccgttttagctgggatggtctcgatctcctgacctcgtgatccgcccgcctcggcctcccaaagtgctgggattacaggcgtgagccaccgcgcccggcgggccaccattcttgacactgtaactgtgaacaaggggtctttgaaagctattcatgtgtctgccagtctctccatttgaaatgacctcacatgtggactggcccaaaatcagggaggaagcttcagctgtgcatgagatcattagtgatggaaaatggccctgggcccttctgaaggaggggccattcagacaggtgcatgctaagtccgcggtgtgcaccattcatcacagcctgatgtgagtccccagtgctggcggatgccagcccagtctgtgcctttggagtctgcagaacatttatcatcagggtaagcttcctgtgcctgatgtcaagaggctctgtcttctgtttgatgtctcttctcattccctcatctggccagttctttgtccttttctgggtgtttcttcccccacttctcctgcatgcgtctcctttttgtcctgccattttatgcctataacttcccgataagttatttttgttgttgttctatgctttggctttctcttgcagcgtctgaaatgtttctgctttaatttcattattttccacattctctcttccctccttgcaattgtttgttgtcttcccctctgacatttgagcctcttgggtttgcctggctgatgttcacaaggctgtgtgttagagtcttttgtttccccttttgtgaccatcgaacagattcatttcccaagggaacttttgcctgagcctgggccaggtgtcccattttactgaggttttagctgctatggaaacagaagatggagcaaggaaagaggagcaggacaatcagaatgtacctgtggattaatttacatgaacagtgttttccagatctcaggtccagtttagttatcccggattcaaaatgatgagacatgccaagcaataactaatcacctcagaactcaccagagtgccatttcccagtgactgattatttggagatcagagatgtcacttggctgctgcccaatatgaactgaagctggagaccctcaacagtcaggccttcatctttccccagtagtatttcctaaaggaggcttattctaaataaaccaggatgggcttggtgttccttggagaagaagatctgcaccttagcggaggctccaaagaaagagcgctgttgtcatcttttgtgtcattcttcgagggtagatcacagttccatcaagatctttcttacatgcgaacctgccaaatccctggatgaacagctgatcagggctaagctctttcagcaaccctgatgacttcattgcattttttctctccagactgatctgtttgttctgtacatttcttaaaagtccttgtttccttcattatcacttatgtggtgctgcttgcgataaacttatataaacctctttaaattgtgcatttctagtcttgactaccttgtgtggaaaggagtacagaaatgttaaggactattttagacgtggctcatacactttgatataggggcagcttaggagtgaccatcaggtggaaacggagatggagggccctgtgtagcactttatatcagatagagaaaatgtcagttgtgcatgtccagtacagagagggaggtaggacctccaaggccacctcttggcacttccattgattgtttgaataatttccgtatattattatgggcattatgcctttgtagttcccttcaggaatttatcagaattcaaagagaaagtgagctagctttttaaagattcctgccctgactctgcacaactggtttgagatgggccgatgttgtttgcatctgcagagaccttggtcttttcaggaggaagagcccccatctcactcctctcactagcaggagccatctccatccacatgaaggcttattgaccccaagccggagtccttctaagtgctagcatagggtactaggtgcacaggcaccgttggtggaaccctaaccttctgtaggtagaaaaaaggaacagggcagccaactgcccactgtgcctggtgtcatgactctgtgctttgccctttgtctacatctagaccttcaagaatgtgttttttagcacatcccttaaactctcagctttctgtctccaatagaaaaacgttcatgctgtctggttctcctgagtcttcactatgtaaatagaagcatgatctctttcaatatactccaaaagatgctgtgttggacctcactcttcatagaaaagcattctgaaagccttattgttatgttaccagtttcagttggattgtaagagctttaaagacaagtctaggattcctacattgccacattcctgagagcccaaaatgaaactcaggtgagggagtgagtctcatcacttatctgtgggtgtcactatccatttgcagccagggatcactgagtgtcctaatggagctcccatcttgggtgcacttaccttcacctttctgtcatcaaacaagacactgacaataaaaacctcatctaggctacctagataacacgttgtactgagatattggtagggatattcagcaaagccctgcaaggtgttcacagaaatgtcctcctttccagtttattttcaatgtccctgtcccatgagttctttgagatcagagtttgcatctcacttctctttgattctctccttctagcacaatgcctagcacctaggaagtgtttaataaatattggtcagttcagtgaacaagcactgatatttgccaatgccccaaagaggcatgcctgttctcccagttcaaagactatcttgatccttcagaagttgtccttcactttgatgttggcatggagacctggagtgtttctggctggcgagtctccaggacattttctctggtcttcacaagatctccaagcctttcctgaagtccccttgaggggaccttgctgtggcaggactcaacttgtccttgaagaagaaactccttttcaagtttccttttgcaagaagagaggaggctcacaggtgacttggacagtgggtcatccatgagcttccttctgctgtcatggctgcctcattgcaactgctcttcatctggccattctagtgggcatctggcccttttggtgccttgctgtaccaagtactcctgtgtctaaaccccggatgactcccaaccactatttcctaaggcaatcccgatatcacctgggggattatttcaactgtatatgaaaatttgccattccttataggttaactaaagaaaaaggaaaagaaagaaatcaatcggtagaaaaaagaaaagtactttaaattcagttccactcttgtgcctctttctctctctctctctctttctgtgtgtgtgtgtgtgtgtgtgtgtgtgtgtgtatgtgtatgtgtatgtgtggggtgtgtgtgtgtgtttctcaggttctctctttctctctttttccttctttctctctgcctcctgatatatgaattgaggtgggttagagatcaaaagagatcttccctagggtgatataaagaccctgggggcagaattagagcagagccttctgtctgttggattccaagccaagcccttgttctgcaagcctttctctttacctaacgtgaagtgggtacatctgcgtggcctactctccataccaacagggctcagtaaccttcctcagctgccagatctcttccttcccacctcagttctccttttctacttgaagaggtccagtggacatttgactgccctgtttcttttttctggagttttaaaaggcaccaaattgatggaggcaaagtgacacccggataagagttctcctggccaatgccctgagccctgtgctccccctccccttccccaatatcctcaccccaccatacatccacctattttcctatttgtaagcactgacaaggccttctcctagccaagcaggacactaaagcactaattggcactagaggtatcacagcttgagttcaaccagagctggcaggttccatgactccagtgacagctctgtgaaaaagtgtcaggagcagagctctggcgtgccatcggctgactgcagcaccctggaactaatgagcagcctgtcagcaccagcatccggggccccgtgtggcgctgagatcattagaatggcagaggagaaagacttcctcagcaaagaggagctggggaggggagaagagggcaaaatggaactaaagatatcaccttacccacagagggcaaccacccaacaccaaaggactgagaagaaaaagggagaaagagagaaagcaaaagtttttctaaatccatctatgccaattctagacaactcttggaatctccttttggttgggttgccctgtcagtaatcaatatgggctgtaaatccttgcaataatccaagaaggggcctcagtgattaaattaactctttagtcttggctgtgctctgaaacctggaagtcgcccaagtctctaggaaagagggacctagggcgtaaggcaagacttgagatcttagtctttttgctatttgtcagggcaggctctctacctagggtatctcctgcactgccagctgcctgcctatcttctgctagagtatcagaatccaggagagacaattaatagaaggagttttcgctctgttattccttcccagagggaggtagggggactagtcagtgtgtccactctgtatctgcttcctgaggccaagtatgaattatccatcttgttcgttcttctgcttcaggaccagaactgggccttcaggtctgagcattaagcaatgcctggctcttctctgaggcttctgctactaacaatgactgcatttccatgagcaaaggcagcaatgtgtctgaaagagataggctttgaaggcaggtccaaggggatttgtattcccttgcactactcactggctgggtcatgctggagtagtgataaacctctctgaagatgtgcttctttattaatttcattcttgcttcttggcgtgaaccctggcgttttcatgatttggttctagaccccattttctccacacaccacagtcacactaacaacttggcattctccacacactagatgtctttgactttgcacaccccatctgttctccttccatcccccctacttcttttggtttgagttctgcccttgtttcaagaccatactcaagtgctaccagtttgaaagcctctggtgactttcttcaggcagagtgattcacccatttctttgagatcccacagcactttgcgtgcatttccaactatggcacctcttacaggtactcaagggcctctgactactcctgtcatgccagggatcatggcagccaggaaccaccctaatgctgttttgtctttagtgtctgataaagcaccagatgttttggggtcttgtaaatgattgttgaatgaggaagtatctgatactgtagatgtagttttcagtccctttctaaaattaagtctctcttaatttaatatgtataatattatattattaaaggtaatataatataataatgtatctctttgcatcagtttggactgtggatcatctcatatttcccaaaccaatcaaaggaattcataagaaaaggccctccccccccactgtcttcctcatgtgtactcaagtctgagctttagactctgtgaaatagagataataataccttcccacatggatatgacaaggattaaacacgtgcaccaatggaaagctcctggccccataacaacacatagtatgtgtccaataatgttagcttgcagaccttcagccagccccctcctcttcactcccacccgtgagaaaagaacggaagggaaggaaactcaagttattttttttctgaaaagattgaatctttataaaagctcaactcagtccattgccaaaatggatagatattcaaaggtgcttaatcagcaccactatcatctccaccattttctaattaacataggtgcttgattaaaattcccagtaccccaagaagctatcccaggagggccaagtaattgccattgcaaaagatattacagtagtcattgatggtgggagaacaaaaaaataattgcatcataatggaaagtggccagcttcctgttcagagtacctgtgaaacatagagcattaggttcaatatatacagaaaaaaagggattaattgtgacaaagataaaccagtggtacaacctcaaattggggaaaagtgtccaggaactccttacataagtggcttaaacacagacaggcagaccaaggtgggagagaaaaaagcagaggaagacatttatagatcactctttaactctgtcattctctttaactgtaaaattactgctagatagatgcagttagggtaaaatttgccagtgtcaataggggtttttgtaaatttaatatttatgatctggtttaaagcattattatagctgtgtaacttcctacttcaaagaagagagaaataataaaaagactagtggggaaattaatgagttcaatgtgctgaattgagaacatatgaaatcaagcctcattctagaaaccaagggcaggagtgcataccacagacactgtttgtggttttacccaattattttaaaacccttggaaaatattgtagaatcagatgtctgctgaattcagacattgctaacagcatcctcccccacactctccagagtcttaagctatttatgcctgtacttggtgaccgttaccatgcagaactgtcttgatggaacaaataaaggaaacataatagcaagaagattgtatcatcctccccacagaagccaaccagccatagctcagtaagatgcaaagtctcattaaaatggtagcccctacagggcaggagaccccatctctcaaccagcacccataagagtcagcaccgcctgggagtatgagaaggtccttagtgggatgtcccaccgcccatcacaaccagggtacctcctcgagtcacaccgctgtagaccagctaaaggcttggggagtttcttgtgtaggaccctccgagcactgccaaccaagctgggagaaactttcggatgaaaacgtccatatcactaggtcctcaggtgtatttttctgactttgtgcctactttcagatcctgagtcttgttttgacccatgacgactgcctttctcctggagtctaaataacaccagaggcagtatcattcaatcataacaatagctaacagttggtggatgtgcaagaatgtcgggggctctcttctaaaaacatttatgcatagtaatatctattcttcacaactaggcgagacaggtcttcttattagcccaccttatcaatgagaaaacttaatatgtttttccatttgaatgaggcttagggagatcaggctaatgggcccaggctaatgggctaatgtggcacagtgccacattgcagacgtgggttccaagccaggtagtcggtctgtccccagagtgcaggggcttcattgctgtgctgggtagtgtagttctcaaagggcagtctctggaccattgcatcaaccagcatcacctagttcatgccccagccttactgaacgacagctgtaagggtggggtccagcagcctgattttgacatttcctccaggtgattgtgatgcaagctcaagtttgagaactgctgctgtgtaaatgtgctctgtgcccagcaatcttcttcatcagcattatgttacttaattctcatggaggtcctaataagtaggcattatttttattttagagacgaaggcatgaaaatcagggggcaggagaaggaatttgcccacaaatactaaacggcaaaggtgaaattcaaatccaagactttttgactccaaaatccatattgttaatgcatattgatttcctgcttgatgtctagcccactgcttcatcttgctctctgggacatgtctattctctggtttcatcccacctaccagcttggggcacccggtctttgggttatgcacattctcacagcattcttacaaatttacccgcacctgtgtcatcgcgctggactccaggctctgctgtgtgccaggtctctgcattccaccctccccagcaacctcaggcttcttccagtaggtctggagatgagcacctcagtggcaaaggacagagcccttgtgtggaggttggacttcttcctcactggcagctgagctcttccaactgagtcaacctttctctttcctctcttccacctggatggccgtggcgcacaggacggacacagcctccctctgacctgacttttgttttcctcatgttaaatgctatcactcactcaaataatgctgtgtcttgtgcattgattattattagaagattgttttataccttaacagctttagacatgaaaagaaattgccagactccagggtatgtgtgtcctttcttatctgagtctgttcagtttccccacctgtctttgtgggagttggcattcttcatcttcctagctgtgtaaaatgcttttctctccagaaccaggacagttgaaagggattgagcagagcatcatttcagttcctcaaggccccagtctgccacctggctctccaaataccatggcacagccgcagcctgccttttgcactagaacccggagtcctgaagatgtggccccttccctgggaggctcatcttgccccttattctacccaacagtggtgggttcttctctgcttactgccctcaccccccacgcaccccaccctgaaaaacaaacctcttttcctcctcctaatccagagttaaacaaaatgactttggactttacagttcttccataatagattcaggactccccctgtttaactgatttgcagcccgggaggcgtttcctcccctaattcctttcatcactgccttgccctttatggagtgctttgctgagttgactgtggttgaagatatctggccagttatctgcaagatagaaaaagacaaatggctttctccctcattgatttatttatttcgacacacaccagtccagaaaaggatttaagcagagaaaatggtatggattttgtccccaggaaaaccttttggtaaagcaattttgattaacttatttgttcagtaattgtttattgagcacctactgtgtgtggggcaactctctgaggtactagagacctatgagtgaacaaagcagaccaaagccctggcctctcagaacttgtatgctagtgggagggagagaaaatcaacacatggctgaggaagccctgtaatatgttatatggtaattgctttagggtaagaggcaaagagatgatcaggtgtgtgtttgagggattgtagacttaaatagagtggtagaatggattcattaagaagatacctcataaaaggcggactgacatttgcatagctcggcaggagtactcctggcagggttcacagtgactgcaaaggcatgatatcaggacccagccggcacgctcacagaacatcaacatagccacatggtgacagaacctatttaaaaccttccctgtctgcactagactctaagcttcatgagggcaggaagcatgcctatccttgctcactgctatgtgcaccaatgtttagcaccaatttgcctctcaaatcatacacattcaatacatatttgtttaaaaaataagtgaataaaataaacatgagtttatagtttgagtacttgagcaagcatgctggaaagacatgagtttcgagtcagaaatggcagtcccttaattagtgatttcaaagaatgacaagttcaggccaatggcgggggtagcttatggctaagacagaggggaaggcccatgagaagatgaggccaggtaggtgacagcgcaggtgtctgaggactcatcacaaggagcgttgcagtcaccccagataatggctgaggctagtgacaagttgggctgtgagccaagtgtcaaagccctcgatgaatcttgagggactcaggatatcagtcattggcagaaaagaagagagggcggagcaacattgccaggtggcaggagcttcagaccagcaggagcagggctattcaataaaagtgtgaaagagaaaaggtctccacttgaggaggatcctccactacgaggaggatcatagacccaacctctgcatgccaaaacagacaactcaacattttcttgagaaagctaccgaggaggcactcccctcaggaaacagctgggtttcaataaatgaaggcagttcagggagcactctgcctgaaggctgatggtctcggggagcatcttgcctatgttgtgggtgttccagagagcccagtggatgggtgtggaaggtgggggagagtgaaagattggccagaagggggaaattcttttctctaggggaatgaatgggctggagagcctgatgatgttaggggagcaggagcagatgcacatgcctgtatgcaccctggcaataagagatgaggtgtgttggtgttaatcccacatgttcccagtggaaggtggtgaaacctcacctcacagatttcagcttcaacctgtgtctgtggcagggcagaaaccccttttcttcctgcccctgaaggtacagcagtggcagtaagtgggtagctctccataggccaagtcttcctgtggtccagagtaagaagaccaatcttcaggaaggcagtaaaaggtcaagggcagaggtcatgagatagtgggagtggagaagagagggtagggcttagagatatgttgggggccaaactgccagaacctgatgcttggtccaatgtaggatgggagtgagggtggaggacaggctgggaaagacgaccaggtttctggtttggcctcccttattgcctattcgggagaactaggggttctctgtccagcttttctcctgtgtggcaataggtagggtattatggacttgctgatgtctgatttatttctgcctgctgatccatgtgggttagctctcttttctacaaaaatgatcataacaactccagactcattttttaagagaagagggatttatcagattgaacagaaatgatagaatacagcagatatatgataaataggcagaatgaatcatcttttattcaatagatatttattgagtagctaaagcacaacagtgtatacttaggtgctgcagattgcatggtgaattcagcctttgcctcatcgggctgcagtatgggagtgtaggcaatattcaataaataaatatgcaacccaatgccagggagaggtagtgccatggagaaaaattaaaaaaaaaaagacatgggtgaagaaagccaggaggagctgcttttgttagagagtgactttagtgctgcaagaaagccagctcagcacagagcctagagacccaagcgagatgagacagcaagggcttgtatgaagagagggtgttccaggcagaggtaactgcaaatccaaggccatgagtggggaatgcatttggtgcgtatgaagaacagcaagaattctggtgctcagggaagtgatgtaggatgctgtgatgagagcccctatagtcagttcatgcatgaacctgaaaaccatgtgcaaaactgtgggacttgttctaataaaaatacaccagcacattttaagcaggagagcaaaataatttaataaatgtttccttttttaccttttttatttaaatttattttttattgtactttaagttctgggatacgtgtgcagaaagtgcaggtttgttacataggtatacatgtgccatggtggtttgctgaacccatcaacccatcatgtacattaggtatttcttataatggtatccctcctctagccccccaaccccctgacaggccctggtgtgtgatgttcccctccctatgtccatgtgttctcattgttcagctcccacttatgagtgagaacatgtggcgtttggttttctgttcttgtgtttgtttgctgagaatgatggtttccagcttcatccatgtccctacaaaggacatgaactcatcctttttatggctgcatagtattccatggtatatatgtaccacattttctttatccagtctatcattgatggacatttgggttggttccaagtctttgctattgtgaacagttccgtaataaacatacaagtgcatgtgtctttatagtagaatgatttataatcctttgagcatatacccagtaatgggattgctgggtcaaatggtatttctggttctagatcctttaggaattgccacactgtcttgcacaatggttgaactaatttacactcccaccaacagtgtaaatgttcctatttctccacatcctctctagcatctgttgtttcctgactttttaatgattgccattctgactggtgtgaggtggtatctcattgtggttttgatttgcatttctgtaatgaccagtgatgatgaggtttttttcatatgtttattggctgtataaatgtcttcttttgagaagtgtctgttcatatccttcgcccactttttgatggggttgtttttttcttgtaaattggtttaagttctttgtagattctggatattagtccttaaagaattactttaaccatgaagagaaagatggaggggagggggcgtaaagatagccagtaaaggcataaaggtatgccagttagaatactgttgatttcgtccatcaagaattgatgacgtcatggactgcagtggtaggatttgcaatctaagagtatgttaatctggaatatattctgaaactaagctagaaagttcattgattgattagatgaagtttgtgagaaagagctcagtattaagactgactataagatttgtggcctgggctgctggtgtataccatgctggtaatatactattcttgtccatcaaaaactccaagaaaagcatgcttgtggtaggaaagactttggtcctttagatatacaaatgaaaatgttgagtagatagttgactatgccagggagctagaaaaatgcatatgggaatcctaaccatacaggtggtgtttagagccagaggctggctatcccacatgcagcgtgaaggcagacaacagctttgtaggccaggaacagtggcactccaatagtccagtgtcaggaaaaggatgatccagcaaagacaattgggagatgagaaggaaatctcaaaaccagttcaaggagaatgtttcataaagagcaggtgtgattacagcacaagtgttgcttagaagtccagggagatgaggattaagatttggcaaaatgcacttatacacatgagacattggaaagaagggttctgatgaagacggtagataaaagattaattagaaagagggagaatgggttaaagaagttgagatagtaattaattttgctgagaagtttcactacaaagggaagcagaatatggagggtcagtggttggaggagagtgtgagttcaggattttttcctctaaagtccaatctgcagcctaatatcccttggtcctttactggctattattgcggtgtaattacttgtctcggtgttctctgttgttcctcctcctcaaataaaataggggaaagagttagccaagattggcctctgctttttgagcaatctatacattttgatcttcagccaaatgacctcaaaatttttatgtgtggcttttgggtgctctgggaatttggaacaaaagtcactatgttgctaaagcaattgactgtggctgacactaggtgctttgtctggaagtgagactatctgctgccagccctaatgaggattccactggggattgatagttgtggcacttacgggaaaaattgcttggagtgggaaccagcttataagaaggggcaggggacacagaacgatttctgctcatccccagtccctccccaaggaccaaggcagaagttctcaaagtcctcaatatttaaccctgcatgaccagatgctcacctgaagcaggggcgtatgaatgtatcttttttcaaaaaagatgccacagcaggaatcaagttaggcttttgaagccacccctctggcccacacacaagaagtcccctccttgtccaggagaagctctgaagggagtggaagtgcaggggcaacccaacgccacagaaatgtggacaaacactgcccaagtcgtatcctcaggggagtagggctctggggaaaatacctctgctctacgtaggtccatgccctgggaattctgtgaacatccctgctgcctcagtgctgtgaattctacatcaagggggcagaggaagcaggcagcctcagtgtttaggtttcaataatgttagggatgagggagagctcaccaacctggaaaacgtacctgccgccataccttgcccatctaatcttggcttccaggtgacttcctgggtattcatccaaaatgctcctcttcagagtcctaacaaacctattctcattgccaccattgccctagaggcactcctttcttggagagggaaagccagttgattgatagaacattgtataagatggggaataggagagaatagcttccatccctctctgtacccaccttctccccagaactcatggctcttgagaaattagagcaaattagtgagtgaccacagtgttttcctccacatcattctgctgtctttagttttgcttccagctgcccacactgaccagcccctgtgctgcttctgagcggtcacgttcctccgtgtgctgacatgtcttctctctgcatcaccagtttcctagacctcttggtttgggtcactcaggtgttgtcatggcaatgacatcctcagtagagtagcactgctcatgttgtcatggttatcaggacctcttgatgggagccccactgcactgttgtcatgcggagagcaggaaggaaccctaggaccttctggtaagcctggattcttaggctaggcatgagtcatctgtgcctgaaaatgaaggtggttatgattagggaaatagcagctgcctaaaatggtgagattctaactacttgagaaacgaataactgaaagagggatcatcatcctcatcaccgtgatcacctccttcccacctcctcttcatcctctgcatagtgtctgatatttttacggtagcttggctatgttccaggcactcttctaagtgttttccatttgagaactcctcatttttcttgacggccttatgatgtaggtgttcttgctgttcttttgcagatgagggaactgaggcgcagagcacgcacttagaccgcttgctcacaggtgctccctaacgtgcaatatggccaagacttaaccaggcaacctggttccagaggtttcactccgaactcattacctattctgtttcaatactaacaagaaaattcaagatgaatcaatctagttactgaaggcgttactaaattatatcaccttctttttggctagaatccatatagtttatattttttactacttttaagttttaaaatattttcatatgttcatttgattccaacaactgtctgcagttagtatgtctattaacggtattttacagaaaagaagatcaaagttttgagagttcataattccccaaggaaagttgacgtctaaactgtgttggacgaggtctgaattcatgacaatctgtagattcagaagctagtgttttgtcttgttctactgcatatcatgtcatgttatatggcccagagcctggctctggggaggaaagtggttcaaccatctaagataaatgggtagcagcagtcacctctatggatagaaggaccacatggcaagtcttggcatgttcactcaaggagccattcaccctcttttgccctcattattctatgcctaaaaattccactgtacagtagctactttatctattgccatataggcaagagagcagcaaccttccttccatggcaactgccgtcatagaatctgggctgccttgagcaagtcatttaacctgtacatgagaatcccaacagaaggttaattggctctgtctctaatataaatgacaattaaacacaaataagttacttagtagctggcctgtgagaaagtacagcttttaagagagaggaagctgagccctgagagtcgatgtatcttctcatttgagtacaaagggattgattggagggggacatgctgagtggggaacagcaaagctaataaagacgattataaacagtagcagcaaagacttctcattttttaaagtatctgacagaactttacctatatcagcatgtttatctttagagcagcactgtgaagtaggtaataatgtcatattattatctatattcaaaaaatagggaaagtgaggtgcagaaatgttagttaacttgctggaggtcaagtcagaggtggagatgggacctgcacccagcctcctggatgtgtctggcggcatcagcagctgtcttttctgcatttgaactgggtttcaggacctgggcctggagcttaatcaggggcataacgatgaacctcaacgctccctttctgctcaccactctccaagcagccgcgccttgcgcactttgcccaccctctctgagccttcgccatctcctctgtcaagttaagaccgtgataggatgtatattcctagcttgttgtaaggattatatgaggtaactcatgtaaatgcatgccggggcctgatataaaacaaatgctcaggattggtgtggtggcgcacacctgtaatcccagcacaataggagactgagggaggaggctcacaagcccaggagttcgagaccagcctaggcaacataatgagacccccatctctacaaaaaaattttttaatcagctgggtgtggtgatgcgcacctgcagtcgcagctgaggcagaaggatcacttgaggccagggggtcgaggctgcagtgagctatgaacacactactgcactccagcctgtgtgatagagtgacaccttgtctctcataataattgtaataataatgctcaataagtgtcagagtggtgacatcacaggtggtacacagagtgagcattagaattggtagttattcctgtcctcagcaaatgtgtcttcttaatcttaaagatgaacatactgtttatagcacagagtaaagtgccggatgtggcaagctaagatgcaaatgtccatcttcaagaccttttcacaatactccattttctctaatgcagagtttggcctatactattctcagatgacctgttggtacaagggctaccattttcttttggcagtgtttccaagtctccatgtcccctcaagtgaaatccataatgtcttctaagtttccagtggatttcaaagcctcataattaacgtccatttaatagcgatagcgaatgactgcttgttgctttcttaacatcctttcttttacaggtaaaagggtaaatttacaattagcagcctccaatttgcatagacacagaagttttattaagggagcaaaaagtgattgaaatttaactgaaagtaatactatgatctaggttttaataaaccaaaacaaatggatacattcttatttctattctaaaagggcattttattcaaaatgtgatggtccagtcttgaactgtgatatgtttttcgtcattgctgggtaagcaacttcctagccacattacacaaagtgaatttagctatgagctgtgagctatgagctggataccagtctgcccagtgacgagcctccttcattcctacttccataagaaagtaacttgggaatagtcagtgctgtccacaggccttgataatatcaagatgctgctggcctcatttgatattaaacatcagctctgacgctgttttcatgcacttttcaaatgaaagttctccccctgcctagctaatggatagggcagtgcagtgggaggagacccgtctgctgtcctccctaggcgatgtagctgccaagtgggtggaaggcagagcaagagagccaggaggttcacagcagtgtctctttccagatccaagggagacacaaaagggaattaaaaacttcacgttgcgttgttgtcactctacctgcgtctcgcctgggagagctctgcagctggagagtgctgagaagtcagcccttcagagcaattacaattcatattgactataaacttcccactgtgcgaggaaaggaaaggaggtgcttgccaagcgctcagaggggcgagtgtaaattatttcaccatctgatgatatataccacgttggcaaacattaggggaaaagaggaggagagaaagcaaagagtgtggggaagctgacaactgatctcccgcattcatgaaaggaactgggacccgggcacactgctgggacaggacgagtcgcccacctgtcgctgctgcagctggcttgtctatggtctacacttgggtgaggaaagcttttaacctgatgtcccagctcacacataactagaggagagggcagggaatacggggaagtgaagagcactttggtcagaacacttggtttgcctctttgctctgccagttactaagtgggtgactcttaacaaaccaattaacttctctgaacctttgttacctcatctgtaaaataggatcagaatatgaagattagcaacagtacattggaggtgctttgtaaacatgaacacattacgcacattatcctttattaaaagttttgtattaattatgcatattcttttgggcagtgccaagaaaataaaaaaggcagacaggagaggtgtaaacccaccacagagcaatcttctaagataaaggtgtttttacatttttgcaacacaaactcaaaaagcaaaaaacgtaagcggcgtttatgaccgttgttataacaacagcaattatcatttgttctcattatcgtttgctaactcctgcatttatttacacagcacaattaatctgaaagttcacctaaccatttcacaaatgctgtggtggaagggagtctaaggaaatgaagagagttgaacgttaggacacagctgggcagtgcaggaatcaaaaggtaaatcactgggcaaaaggaacaacgggattgataccagttttagaatggggccagacaggcacggggactcacgcctgtaatcccagcactttgggaggccaaggcaggcagatcacttgaggtcaggagttcaagaccacctggccaacatggtgaaaccctgtctctactaaaaatgcaaaataaaattagccaggtatggtggtacacacctgtaattctagctacttgggaggctgagggaggagaatcagttgaacctgggaggcagaggttgtggtgagccaagaccgcgccactgcactacagccaggatgaaaaatatctcaaagccagtgttgactcttattgtctcatttcatgtcactagggatcagcagattaaggcaggtaggtttacgaatagcttgtgggctcacaatgaatttcatatttttaagtggttgaaaaaattaaagaagaatcatatttcatgacttgtgcaaattatttgaaattaaagtgtcattgtctctaaataaagttttatcagaacacagccatgcccatttgtttatgcctgcttttgtcttacgatgtcagagtggagtagttgcaactagattgtaggtataggttggcaaagcctgagatatttattatctggtcctttagagaagtctgccaatccctgcactgcatgaacatggactcctgaaggttctgaacactgttattaaaattcttatttttctccatactccctttttgttgcctttcctcagcactctgtgaagttgcaatgaggatagttctcacatccattccaaatgatgcccacttctctgtcttccaagagtggcccctgccaccctccaggggtcctccctggcttgtagatgttgtgctccagtcgacagctatggctcaccttattttcaacctcagctacaacaagacactttcttgcctcgtccctgactagtcatctctgcctccatcttcattatgcaaacaattctatatcctgcccactttggcttttttggagtcattcttaactggggttaacaaaaatctgattcttgccctggatctttggttatgctcactggtctgcagttggttctggttctatctatggggaagtttgtttttggatagtggcactggttgctttgtttctgtagcatacagcattctgtggcagcatctgagtcggtcttcgctagtactgccttagagagggccatcatcttcccaggaggagcacatttgcctcaatcagcaccttcaaccaaaacatatcattgcatactccttatctctgctggtttcaaacccatattttaccatcaccaactcttcttcctgcctcttcaccctctctccctgttttctgtctggaatctctctgtagcaaaagtttatttgtgaagcagaggtggcatgccttaagttgaccagaagaccatggtcaaatgagccctactcaatttactacatttcttttgaattccttaggtatctcctcaggacctctcagaatcccgtaattacgatttcataatttcaaaaacactttacacgttataataataatgatttcaacaagaagagaaagggaccactttgtcatagagatttcttttctattgagatggactttgaaatcttgtcactttcaaaagtgaatctcaatttttacatcaaaaaattactagttattgttaactgtttgaagtatgtgtcatttatattcttctacataactttgttacttttgaaaatgtgtaatatgtgtttgtgtcaatcttgtagtcataaactgagcctttagaaatagattttcaacgttagattccagtaagatatgtttagctgaaacagatattgaattaaatcaggacgggcctttggtgaaccagcaggcaacatgcctgcctgtattaatgtggttctcccctttgctgtgatgcagagcgctccatatgatctgaagactctgttgtagcagcagtctgactcatgacattccctagttgtcaatgggatgaattctggaatgaagcccagattctaaagtcaacccacatgggttttctaatgcagggggagtcatctctgcttccatcttcattaaataccattagaatcatcttccgacccctcaaggagatgagaaatgttggagcctccaatgatgcatcaataggaagcaaggtgggttatcaaacccccatcaggctttaagtgttcactgtgtgtgggtgtgggtgtgtgtgcatgtgtgtgagcgtgtatgcatgtgtgtgtccagtcatcacgcatctccagcctccagaacgttcttcctcttgtgttgtaaactggattgaaaggtggtcacatttcagaattagcagatgcctagaatgtagtacttttggtagcactgaaataggagaaacaaaactataaaaaggaagttctatttctttcctacttttctttttcttcctctccctatgtagcactaactcatttgccctgcaaaagtcccttgggctttttatcaattagctgaggtaatgcaggctgagccacatggggctcagagaccaccctgccataagcatcgacatctgacagggtggattttccaagataattccacacaattctatatgggcctgtttattatcccattattagtgtttttaaaagtgaaccccctgggaaaattttcaactgattaatattcacctctggcatatgcagtctatttgaacaatgtggtgtttttgacaattatcagaactacttagtatacccccaggaagtagtcagtgatctgccattgctgtgaccctttttggaatacatgtcatcaaaatgccttcgatttggtttaaaaagtcagccctcaattttttgacaggcacacacacagacacacacacacacacacacacacacacaacaaaattgtataactcgcttaattcatgatagtttgagccaaatggctgtttgcaaaataaagcctatgcttgaaaatgatttcgttgtcattgaaggcatgacaaagtatcattagccaacttttctggagcatttattctttaccaagcctgagtgaagtgctctacatctgtgatcacatttaatcttcataatgaggtaagtaccattgtaatcttcattttacagataagaacattgaagctcagagaggtttggtgatttttccaaagttatatagtaataacttttgtggcaattttttagtagctcatatcgtatctatagaaactaattttacttagaaggaaaacagcactggggaaagataatagacttggaatcaaacagacctgtgtttccatctgcttcacatttgtcagccgcttctccaattgtaacttgggaggaatatacacctctaaaagtgggacggcataactattccacatccactgtaggcataatggagcactcatccacagcagccatgattactagtgttattaggatgagaagatggggagagccttacctatacttgaatcgacagggatggacagagcaatgaaaaggttttgaatcaaaatcagaggcagggaaaccatagcactgctgtagaaaggcagagcaagccagactgaagcagtgggctgtgctagtgctcagaagtgtccgagaattctttgcgccactctcacccgtggcagtctaatctcccggcatggagaatggctggccttactgactccctccgaaagaatggagtgaggtggaaggaaggctgtgtgatgtcgaaggccaggttaccgaaggccacacagcttctgctggtttttcctggggacaccacatggcgagaccttcaagagaggggagaccaggggcccagatccccgggcccagctgtcagagtctggaagtgcagcagccctagagaggaccccagtcctccacgatctggccagaaacctcatggaagaccctgatgagatctgctggttgagctcattccaccccggattcatgagcagaaaactaagatggccattgctggtgtaagcccctgttttggagccatttgctcctcagcagtaaacgtccggaacatgggtccatcatcctgaagaaatgccagatgctaacttagatgtcctgttgtcctttgctcctcacgtcaccttctctgtccctctgcacttgcttcctttggtcaagacaaggtggacttacgctctcggctccacgagggcctttccagtgccctcagtttgcgatctgacctcagggtttttctttgggatctcggtacgtcacagtgatcccagagtttctgtcagattcaggtagctctagaatcacagagtcctgaaattttgtcttgataattagctctttactctctcagcctttgggccactgaccccatccaaatggcggaaagtgaaagaagccggtcccgtgaagaggtctacgttttcagcccgtttgtggacattctcactgcctgacaaagccgcactcagtctcagcatctcaggctgagggctacactgtggagacggaggtggggtgcgtcccaatgctagtccctctctctggaacccacaggcagaggcctcaagccaactgtcctcccctgtaaatcagaagcagggcaagtaaaagcttggatgtcttcgtctctccgtagccagaggaaatctgggcgcgcagagagatttggagtttcatcctccccgctcagccagtcccaggcctcggctccgaggaaattcgctgaaccctttcaataggcttgaattctgtcggcagcccaaccatccccttgtttactgttgaaataattactactttgccataatattagctctgagccgtgactccattaccattatcaccggaatattacccatttattatctcccagcaaccctggaagatgaatactgggcttcagagaccaattgttttacagcagacaggatcttggtgtgcattgtttaatgaggtaaactacattacagccagcattaatttggctgcagtgcactccactaaatcactcttaacctggaaatctgccactctttttgatatacccttaatcggcgaggatgggagacatcctttgagaagaggctggagctgaggggagaggagaggaaaggttacaggtgagcgagccccgcccagagatgtgtgcataagatgggggaggattgtggagtgagggaccaagggaggcaggagaaggaagcaggcagagggcacgcatcctctgttctgctggtcccaaacgcctgggaagaggcaaaggtgatatgatggctgaaaataatccacatgcctcccctctctaagctcaggagttatgaatccacagaatccattttctgaccacatttggcttttctcttctgtttggcatcttcagaatcaccacagcaacccacaatagacagaagacagaactagacaatgagattgtcttttggcatgaggttgtctttcggtatgagaggcagggcagcctcccagagctctggccatttgctgagctcatagcagcctgcgtgtggactcgcggagctcattgccttaggtgaaacgcagctggagacacaccaagaaacagaggagcagatgaaagaagtttctgcataaagcctcccttgtcacttacattcttgctgtaagctgcataaagtcacctgaggactttgttaaagtgcagattctaattcagcaggtctggggtagggctgaaaagtcttcatctctaagtggctcccaggggatgctgatgttgcaggtccacagcaaaaggagccttgtttctctaagaaatgtctgcactgccttgttcaagatcatgctccatgcagtctaataaaacagcagcatagctaccatttttgaggtgggcaaacagaaatgaattccttttgctccatcaaatgctgacaacatctatacaggtcctggggtgaatgaagcacaaaaacttctcagaaagaatatcccagatacaatagacaccagagacactgccgtaagtcggtgacttcagatttttagggcagagaacattgtagtcctaaaatgtcgtaagaaattacttttatattaccaattgagaaagaatcgaaagggcttgaacttcggactcttggaatccaatctaatgtttttctgtaaagagaaataaatacattttctgctatgccactggtgagtttcccaaaattatctgttttcctgatgttgaaaaccttttctctgcacagcctaaatgaatttaaaacttaagcaatcatcccataaacctagcccaggtaatagtggttgaaattttaaaaatggtttattagaaaattccagggtttcttctttaaaaactaaggtggggctgttatgtttctcaaagcctctctcagtttaccatgttcatctgcccaagcaccaccatcattgcattttactgagagagacagaaaaaaagtctttgtgatttaatatgtaatctcaagaatagcagaacttggccaacggtataaattgggaatgtcttttactgtacatcttccctcccaaacctttttattgtacccatcttgaaaacttataatgaatagtttttatctccggccatacatatgaagtgtgaggggtgtgtgtgcatgtctgtatgtgtgatgtgtttcatcctctataagagtagcataacaataataattcttcttttcaaattttatcacaattaaaggaaaaggacatcactaatttattttcatattgtctaccaaactgttccactagtgtttggattacatttatctggtttgggagcattatgcctctcctagttcatttatccatccattcatccatccaaccacccatccatccatccatccatcatccatccatccattcatccatccaaccacccatccatccattcatccatcatccgtccatccctccatccctccatccgtccatccatccatccatccatccatccacaaacatttgcttagcatctgctaggttctggtaaagctggaaaaacaagtaaaaattagaaaagtaaaaacaaatgagacatgatttctgtctttggggatttcataatttatcatgagagacaaatataaataactttttgtgataccatttggtggtgcattttagtccttctcttttttcctcaactctgtaagcagttttctttgtagagataatgtctaattctttttattgaaccatagataaaagacagagtggaatctagcagaaagctcagagtataaactgggtctaattttgaaatggtgattctaacagtcttcttgggtgagtctccaatacaactacaactccagttctttcttgtagcgtctccaattttaaaactgggcattactaacttgactcttccatctcaagaatgtttttacatattccaatgagggattgtcctgttccaaacatgggtggaaccctcagcttagctctagagagcagctgttcgctggagactacgcatttgccagaaaaatgccatcctgttgaagatactttgccactggctttttcaagcacccaaaaatggaagactgcactgaaggaaatttgttcgaaagaacttgagagattagggggtgaaattagatagagaaaaaaattctaaacacgttgagatatgtcgtcagtaaaatgcgctttggcataacaaagttgtgaattgaaacagttacagaaatattgtggctggggaaatcccaagtgtttctacagttgaacatccctgattagaaaatccaaaatcagaaatgttccaaaatccaaaactttttaagcactgacatgatatcacaaatggaaaattccacacctgacttcatgtgagaggtcacagtcaaaacgcagccaaaactttgtttcacacaaaaaatatttaaaatactgtctaaaattacctttaggctatgtgtataaagtatatatgaaacataagtgaattttatgtttagacttgggacccgtccccaagatatcccattatgtatacacagatattccagtatttcaaaaaatccaaaatctgaaacacttctggtccaaagcatttcacataagggatactcaacctgtattagaaaaattaagaaatttgccttctgtaaactttaatatatgtatttcatatataacaaatttatatataatgttttttccttttggcatataaagcctattttatttggttgataatcatgtgattggtgctctgaggccaatttaaccgtttttactgaatagttaccatgtgttggatgaaatgctatacaattaactgtaatattatttagtcctcatcccccccagcaatacaattcagtgacgtctagttacatgagccaaatcaactaatgggatattttcactgttgagcagggacatacaatcagagtaattcaaagtcgtaaacacaaacagcacccttttggtaactggctctgtccaggcatgctcacctcttgccatgacctcttgcatgtgtctctgtaaaatgaagctgataatgaattgttccgtactcctaatactaaaaatatctgtgatatagatgtaaaacttctggggtctttcttaaaagctatcgtgaaagtgcacaattattttgcatgtttgtatacaagcctcatatccacaagtgcacttggatgcaccctccagtcctgctccctgatttatagtacattcatcaagcccaattgcccatacacagtacaattctctgttaagaagcagcatttgggaggaaaatgtaaactagcctttgttgtgatggtcgcagtatgtgtgtgctgtgttttctctccctctgaggcaaattactgtgagtaaaacctatattatgctatcagatgcaatcccagcctttgctcaattgtactttgcaatggcacaatagattgtggttgtttgatgccatctcattcggttatttttctcacgtttgtttgtctctcagctaatcggaagaattcaagagccttcagtaggcctctcagtccttagcctcagatcaactagtggagccttccccatcctgggtaaccctctggaagtcaagctgtcttgatttgcattatcatctttctttatccgctctccagagagtccccatcttaacaattaaagtacacacaagaaaatgactgaggatttccttttggctttcctggaaatggaggatcaagctgagtaaattctccaagcttctcaatttgtgaagaaaaaatgttacatttaggggaaaaaaggggggctcctgcttagttaaaaaaatggtgggtggggacagagtgcaagagggagaaagaaagaatagcaaagaaagaagaggtgtcatttgggcgtctcgctagtttttcttctatcctggttatcaaaagagcaaagaaattctacttccctttcccctccctcaggtgcccttaggcctgcgcagcctgggctgggtttgcaccgctttcacacggcccgagtagccaccctgtttgaaagtaaagcaagagcagccacaaagtgtctgagattcatgagatcactccacaaattaaaaccttttatcagcctctaagagctgtgcaaactaattagactttggccgaactttgccaatgactccctcgaggtattattataaaattttgagcttggaaacgcgtccccattctgtcaacatcaggttgtttcagctacagaaatcgagctccagctcattttagcttccatgatgtgctttgcataatctgtggcattttgcactggtgtggcagggaggagagtagcacagctgtatttgaaaacacataaggatgtttcccagcaataagacttcagacacagggactgaatttcaagaaaaacccatttttgcccctcaattttaagaagacgctgcagagttcttagcttaagctataaaggtgagtactcaacatccaggtctaacagcttctaatttagggaggacatatcacttcccttctcaatgtttttggctcttcatatgcaaatgaagagctcttactaacaaattactgctcaaatctttgatcatgttttgaagcaaagtctgagagaggaggctttctggaagagcttggtaagaagtcagtaaactttgatttgtctcagagaatttaggttcataaatagcaagggtgcaaactccatgtgactcaacaaatatttgaatttgtcattcaaaaaatatcaaacatatataggctatttcgcattattgggggtacgtcgaggcattgacagtgccatgtatgccagtggagccgttcctactcttgctctgaataattctctgtggggctggcctgggagtgcagaatccctctgcagcagatgtggccttctgcacgctcagagccccaggacacagtggacattgaaggggaacagagaagtagagggtttccctcatccttagcccatgcctggagcagggggccaggaaatgagaggtggtatttgtttcctttgctgaaaatggagtgaggtgaccttccgatgtacccaagcaccttatgacagtgtgtttttaccacttcccagaactgaccatctgcccaacttttggaccaatcctgggccactggtggagccaggaagcctggagggtcatggaaggggagactcttgcccagtagtccacaagagggctatgcagctggcatattggcccacagaacccccagccctgcagcatggccctgagccctcacaggcccagagcagaggcaggagtggaggctgccagggtttagaccctccttcactaaagggtccccaggttcatttttgtctccgccgtctgccatcccgtctcatgggctctcatgatgggctcatcaggttcttgaattctttccagttgtcactaattacactgcagatccgtaaatcattccaggctggggctgacagggagagacgggccctctgccatcctgagctcggggcttcctgccacacctgcagccagtgaccctaaggcagccgctgatcagtgctcagtgtagaagggagggatggccagtccctcagtcacccatccccaggctctagccctggctgtggccacatatgtgtgctcatcctggaactaggtctcaggtaatgcaacccctggaagaatgcagctactgtctctgcctatgggtttttattgctgtttgaatattaaagacagctgcgaggaaaggtgagcttatttcatctggagtttgataaagttgagacagcactcctcaaacttagtttaataacgcaacagactgattcatcaattctgggattgggtctaccaatcttcattttaaatgtgtaccccaggtgattcttgggtggtgattcagtaccccactttaagaactactgtacactaacttacactttatctctctctggctctaggctatcattgaccctcttgtttctggatcaggtgagaaccttctcttttcaaccttgctattctaatagggacacacatgtcttctgatcaaaaccacactagcttctctgtacataggagctattcacaacgcaggtgcacaggcccctatgcctgtcactgagagaaagcctgtgacctctgggtgttctgcagccagtgtggtgggccgagagggagcccccagttcccccagcccaccggctcactgcacagattgctggctaatggggcggagctagctgaagtgccttctattaatggagcagaatataaacagaataaagccttcatttcccaggctgtggtttcattattaatatacttcacaggttgtacgtttgcgcccgtgttttctcagctggtgtaatctgcggctctgagtgagaacagtcataaaattttcatttccagttgaatgtgcgtccaattcgccgtgaaatgttctatctgtcgtgaatattaagtgcactgaagcaatggctgctggattaggcagagaggttccccggcccctgccaggcctggcagaggacagaggtttgccggggcatgggtggaactttaacagggaagctgcaccgtgtgaagtctgttttcttgtggccgcctcctggagctttggtggaagagaaggaacctactgtccaggcgggggagaggtcagaaataatggagactgtgcacctcagggccaataaaaagcattcagacgggaggtgaaagggcacaggaagttcaagtgcagagtagagaagtggagggccaggtaatgccaggacagaggtgaggagggaggggattgcagaggagagagcaggcctgaggggagcgtgcaccggggaggctggttgtcaggcataatattagaaagagcaagcggagcattttatgcacggtgcctttttagatacatcaattaagcgctgaggagagagcacgatggaggaggtgcagggaaaggctgggagtgacagcaattaggagagcctttctgtacgacggcctgcagtcctggtgcggggcagagcgtcacggggactctgtcctaagaacaaatgtttcccactgccagctggcctgcagtggatgttatttgcctcccagcactgacttagtatcccttcccctcatgccactactcggctcagccatgccagctggctcttccctccaaacccttcctctcctctttcttaggagttgcagcattgtgccagtttcagggttgaaactcctcggttgctcccacagtgtgcagagagactcggggagccaaggccagtaggagtagaaagcccgcaggatttgatcttctctactcatcccagctgccgcgtcaggatcttttctccccgggcggccacgtgcccctgtcctataggggtttgatgagagagctgccccgggctagaggagaatgagaggcaaataggaagactgagtagagaaagtggagtctccttgccttgggcccacagcctccttagcagcactgagcggaactggctgtgccctgcaggagaatcccaggaagacacccgctttgttttcccagaactaaagtgctgattcaggcaaaggggcctttgccgcacctcccgcacaggtgggactcctccaagcctgcccggtggcccacggagggtgtgaatgcctgtgcgcgtgcgtgtgtgtctccaccgacacaatcgcacagtgaaagtcaaacagttcgttctatatctcttggctttttacagttaaagctcccaacagcccagtgaaacagcaatggtgattttcctcctttacaggtaaggagcaccgcacggccacagattaagtgattctgccgaggtcacagagctgaactcccagtggaggcagaacaaaacccttttattccaatctggagccatgtgcactctccccctcctccaattattgatagttgactccctctctggtttccaattgttttgctttggataatattcaaataattttgtgtttctgaaacgcacacctgcggtgaggagtgagttgagaggaagaagctgaaaaatgagctgagctgagatattaaagtggtagaagaagaataacttaccaagtgacatcctaaacacatgtagttatagctcgggaaggcatcgtctgtttcgtatgtcggccgtcctttcacacgccagtcacataccgactcaccttcattgtgagcagaagccttgagaacaaagctcagcatccagcatgatgcctacagcaggcaagagcccggccaccctctctagccccaggctcattccctgcccttgctccccactgtcctgcgtcttcccagggtggactccagacatttaagctttgcagatactgttccctctgctgagaaaaccactccatcctcctcccctccccaaacctggtgcccaccctcacatccttccagaggcagcagacaggctgcctctttgggaaaccttcctgggcaccagttttcacccccaagtgtggcccctcctcctgggctccccatgaacttgacatgcacacatctcaggctcatcattgatcgccctgtggtttgccatctgcgtgtatgtccagctcacagaagagacagggaggttgtcagagaccctagaacatccatccttggacacatactcagggcctgggcattggaattatacaaatttgggttttaagcccaatgttgccgcttagttgctatgaggctcctgatgaatcacaaaaccggcttaggcctctgtttttacatcgcaaaaatggggatcataacttcctcagaggcaggttgtaagcaagcaatcagtgaggaaatatatacgtgctatagaaaacttagatacttttgcttcccttctctttaatagatgtctcttctttccaataaatgtttactgggtgaataaatgaataagaaaaaaacatataatgaagtgcaaaattgtttggttcagactcaaactatactggagattcagaaggaaaatatcatcaaaaggaagtatggccagggtcttcaagcaggaggtgggccatggagggatcctggattcggggataagaaccctttaaagttggatctaggagaccaccctctgcacattctcataccttcctcctttcctttccttttggatttcccttcttttctctgtctctttctctatccctgtctcttttctactctctgatttctttcacttgttggacctgaacacttagtagacacttgctacctcattttaccccctgtgtatctctaatcttaaatctgaactagttaacccctgagaaaggtcatttccagctcttaaatccttggattttccaagagcctcaccttctctccacaggccctagagagagcacctgaaatgccattaaatggtcacagcccacagcatccaaacatgggagaaaatggagaaattaggagaaagtgctcccaaaatgttcttgtctgatgaatctttaattctaccccttgtgactcagaactcctgcccttaaactgcattcagaatgcatttcgccagtgtcccattctcagggagggagagacaggggaaaaaactgctcatccttctcctggcttgtcactgtagagttgagataataatagtctttttctgatcccctgaactttcccatctgcttcataaaacaatggcaatttttttcccttgctctgtcttcctctctctcttttatttttatcctcctacactataatttaaaactgtggcagtgctatagcccttgaggttttttttttctctttcttctccccttgctttaatacatgactgttatttaaaatggcctttcatctgagcaccaggaggctgcctgagcaagctgcctcctgcttttagagagggagggtagggccagtgtggtccctggtctcacctagcacctagttctcttcagtactgccatgcaaatcagaagtgttgtttgttctttctgaaagaagacatcggaagccaaggtctggaagtgcccctccctcagaaatggacgtcatatcaagctggtggctgtcagtggtccaccacgcatcaggtctaaataaagcaatttcagctgaaggcagtaaattcagtgtgcccattgatgccaggagggaaacatgtatcagccactcagcatggagactcagccgttgctatgcaggcttttgctcagctgcactgccaatcaccattcagatgcatctctcctcagctggatgggcactgcataggaaagggtggtggtcagggacttctttcccgggggaaatgtcatctgttttggggatcagaaaggaaggtgtcggacactggtgtttcccataccaactctgcagccttccctgccatggatgctcgttcagctgctgctttggagcactggctggaacatgctccacacacttcctgtctctgtgacagttcagttccatgactgcacctgtacctctgaaagtgattttggccttgtcttttctctccaagctctctccagagccccctctgaactggcatcagcaaagcaatcatattctaaatgagcttcatgaagaatatgccattgcagtaaaacaccagagacaggataaggctgaaggctagaaaataaatcgtgtgtgtgtgatgagagggtgtgtgtgtatgtgtgtgtgagggtaaggtgtgttccagccctcatgaacgtggtgatcacttccttcttgaattaagcagccctcctgtcagctggagaaagaactccctggagaaggcagggaccgcctatccccagctgatctgctgaggaggccacccacctgcaggagatggacaacattttaatcctggctacgtgggttgtttccttgtgtgatgcccagaaggactggcggcaggaggaaattcctggagaaattgtctcttgagtcaggttgttggatttcaaatcctaggtgtcattgcttcagtccctccttctccttagaatcctcctttcctttaaacactggaaatgattcttaaaaccatgtacaactattaaggtgagaaaggctgagaagtcaggatccaggattttctcctgaatgtgatctctcaccctgatgtggtgaaggtcatggcctccagccaggcactttctctcggttttctcttcaactcattaaaggaccattttaatcaatgtttttaccttccccccgataatccaaggatgtccaaataattttaattttctctctcttggcccaacttcattgccattgctggtatatagcttaattaacaatctattttaagatattgttttaaatgattttcacttatcaccaatttatcaccttctttctgtttatttcttcctgcatcttagaccttacatctgggattattttccttctgccttaatcctctttcgaatttcctctgggagagctctgctgctagtggcatattttctcagtttttgtttagtgaaaatgtcttattttgtcctgattcctgaacggtacttattctgatacagaatgttaagttggaagtcattttctttcagtttcctaaggaacatttggctctcagttctgctgttgagaagtcagctgtcaatcttatttttatttccatgaacgttttctgcctttctgcccaacctccaacaacccctgttgcttttaagattttttctttggatttggctttttgcaagttcacgatgctgtgttagctatagatttctttctttaacttttcttcagatttgttagtattctggaatctatggattaatttttttattacttctggaaaattctcagccattgtctcttcaaatattgcctcttgtccccttttccctttcttctctccttttgggactcctcactaaatgtagacaagacccctccctctgtcaatgcccttatgcattgtttggcattcttcatctctttgtctcttcacactattcacttttttttttttcgttacttaacttacagttaattgattctctctttagctgtgtctcatattcttttacacctttacaccagtatttttaatttttcttttctagaagtcctatttttactttttttcctcaaatatgctagttacctttaataggtttattttccaatattattagtcaagtttgtcatgcatttctttatataaagatatttgttttacagtcaatgtttcatgattccattatctgatatatttgtatatgtttctgttttctattttatgctgttctcactcttagtatcatgttttcttgtgtgcctggttacttttggctctgtgaggctcattgtatttttttacaaaaagctgaaaaattttgagccctaaaatgaaagcaccttccctaaagaatgatttatatttacttctgcaagatgaccgaggtctatgtaaactccattaagggtgtctaatttctgagctagcccaggtaattcaaaccgtaacacaatttcttggagagaatgtttgtcttttggttcactcccaccttggggatgcagctttttgcagtctccacttattgtacagagcttttcctgttagactccatcacttcaaaagggtgttgggctttgattcctgttcccctgtcctttcagattgtcaaacaaaggcttcaatttacctgactcagcaaatgccctcaggtcaggaaccagctgtctcttggttcatgttttatctttaatttagggtctggtaattctgtaccaggaaggaagcttttgatacttttaagaaagatgtaaactgtctcatccagttcctttggtagttttcaaagggagggtagcctgaataacctaatctgcagtacctgtttaaaccacatcgcacatctgctctccatccacagcttgaaacttccttatgcgatgatgagcctacctatgaggaaagggcaaggcatgtggaagccactccactgctcaccagctgtttcactttgtacaaagatcaaagtttatatctttctgtgtctcaatatccttggatgcgaaatggcgggaccaatagcctgaagtgcctgtgcctaccccacagggttattccaaagctcaaaatgatcctcggtgtgtattttgctggactcagtggtacgtatgaatgtgccgtttggaatttcaagcctactacttatgtgtgggacttggaattttctggcttgtcaaagaggggagggccaaagggcaaatgtagggccaggaagaggcgcaggcttccacccatgagaagaaaatctttaggctaacagtgacaaagcacagcagcagtaaagcacaggtgctccaaacctgaggcttgcctcaccctgcctttccgcccagacagagagtgatgactgggaggcaaggccgtggccttctgtttggaatgtcttgaaagcaggtttgtccttggagcactccctgccataagcccctcagcctccctcctacctctccttttccctcccctcttagccagggctggccgctcagcgtcagttctacttggcaggccttcttttcctcatctttatcttagcatttgtttcccatcttatgaaaaattgcttatctacctacaatcaacctttcagctcagctccctatcagctcctttatcagctctaccatcctaacttctcatttgtttctgacaggcatcctgtaacaaattcttaatttgatgagcttgatatagcccactggctaaacagtgagctgaagccagggctggctgcaggaatatcccatactgttcagccacccattttcttgagagcagagagtccccaaaaaagggtggaaatgggagaggagcaattctgtggggcatatggcagcaggaaaagaaagcctggaacaacagttttccatggggaagcctggaagacagtgttggacagaggcacctgaggccagagatgtagatgggtagatgaataagaagttggttaataaaagagagagaaaaacaacttgcagctttgagatacttcttggtaattatagatgggaaacacaggctcggatacatgaatacctgggtctttttgtcctgatatatggctgggtaatcagagcagccgtccatgtgcaccatgatttctgaaaccattgttcagagtgacattgactgtctctgaaaggttaatgggtatttacgtagggaggaaaaatgtaccttggttaaataagtttaagcaactgtgtgtgctccatttcccatttggagatccataggatataagaacttaaagattctaaaaatcctgcccttgatctaacgaacccagtttccccagacttgtgtgacaaagatgtcctctttgcagaatactaattacagtaccgtcttgcaggatacttagaagaaaatgttgattctaaagccatagtaggctctgttttacctctgctgctattaagggattctctgtccaacaacaatgtttctagaatggtaactgtgagcaaaatgtcctttctggaacacatgccatgtcctggagcttaggatctggtaatcttctatctcactatctgatgatgataatgaccccccatttattgagggcctgttaatctcctaggtgctttttctatgcatgacttctaatcctcactatgatcccacaggagagatagcattaccccatttcttctatgagaaaattgagagtcgggcttattaaataatgtgcccaaggtaagcggctaagccaggatttcatccaaggtctggctaactctaacataatgtttgttttcatcacactatacccattatgaaaatggggcagatttcaaaaaacagagaagaatgatttaaaaagcaaataaatttagcagcctgtctagttacatacaaggaccacttattgattgaatgctagctctaggaaaacaaaaatctgaaaattatctagtcctattgtttatttttccccttgtaaataaagaaactgagatctgtagaaagtaaaatgacttgctcaggctcacgtggccagctggtttcagagtcaacatgatcactaccaattaccctgacttccagtccagagttacttatacccatagtgactttttccccctcctctcagagactgtttttcaggctaagacttgccaaaatgctcaatttgcagtgtgaagatgataaagacctcctcaggcctgccctcagctcggcccctctatgaggaggcatcaggaacaaaggctgtcctttccatctgcatatactgaggacctcgtgcagaggacataggagctcagcttgccatcgtgctgcactctcctgagttctccctggatatggagtctggagaaatgaggcagtctctgcaggtttagctgggaactcaagccaagcaggggctggaaggcagctctctggactctgccaaagcctcctctcacctggtgttgtttgctatccagactcttcctgtccaccaactcttctagatttgagctgccaagtaaagccggcagccaggcacttagcccttagacgcactgacagggcctgtgtgttctactgagcacccggctagagacagaccttatctcctgcctgcccctccctggggagtgtctccccgcaacccgtcttcatccccagcattcttcaatctccttctcgcccacttgtctcctggttgcttctcctattatttctgtgattcctctcttccttttgtctttatctagaactgttgctttgtttccccctcaccttttcccatgtttcacagaaggccagtctccttttccccacgtctctgtacacacccactgtgaatgcactttgttttcacctctcctcagctgctcagtcctcctaagtgtctctctgtgctccgccgtggcattgttctcaagtcccatctaccgctggccttcctttggccactcttccctcattcctttaattttctttgacctctttgtatatttttcttctccaatgtgatcccttctctctctcccacttctataaaagactcggtttctgcatcactggaagaccgcaccaccattctgtggtgatggtgatggctgctgggttaaaggaaatcagtgtctcctcttctggatgggtttggatggtttccagtgaggtcagaatcctgttgcccctgctgggattctccagcctggggttctcattcttggcgccattgatatttaggctggcgaatttcttcttgtgggggctgttctgtgtatgatgggataccgggcaacaccccttatctctacccactagatagcagtaacaagcacatcccaattgtgataaacaaaaatgtccccagacatttccagatttcccctgggaggcaacatcttccccatttgggaagcacagccctagcccacagcctgcagccttgcttctagaaccacatgcggagttgaggtttctatgcctgttggataagcagaaaaagatgtggaagtggtggatgctgtcagtggagacacaagaagtgtgtttgccaagataaatttgagcctgaacattttttttatctctttggtttgagtctgatctctttctactcctttcttttagctctttagctctcttttggctctcttttagctgtcttttagctctttcttttagtcttctttcactgtaatccaaacttctttctctcctgacaatatgacgttcttgagttgcagactgctaaaaacggctctgattaagccctttaagtgattcctgcagaagtggctctgacggtgttccatctgtaccctcagaaaggtcaaggtgtcactcggctgctcgagggaactctgcttctgggctcccaggtggttaatgcctgtttgattagctgtaaaacaaaatccagaaaatgccaagaggcaaatctcaattcacctttcagaatgaagctcactgcccagtcagagaagggggtgcggagtgggtggtgagatccacagctgttaaattcgcaacaggtaagccagcaaatagactcagtcctaatgcggctgccctcatctgctgaaccacctgagtcaccttcacctttctgctgctgactcttggctggaatgtggttcagtcctatttgctctgctttccatgcagctctgccttccacttgggtgcccacttccattccagtcagcctcccccttccctgctccactgccgtcctgttgctttccttccaagctcacctctacacccaggaagctggtctcggttgcacatcttcacctcgctcctctcacaaatgcatctcactcccaaatctgctgcaaaacatcagaaccaaagaataataataataataaaaatagacatacccagtgaacgtcctcctccattgagctcctcccaccttctcttctctatccctgcaccacatctgtgcatactccttcctagaaggcaaatgtggaatattctgtctaggctatgcagagggtgggctcctaggaagcatctcctcattcacttctctcttgcacataccacacacaatggttctaacaccatggttgtcttgctttccaacatccttttcatattattttccaaatcccagtgtggtcctcccacgtgcagcccttcattgaggaagacagcattactgaccagaccacagtcatgaccatagcatctgaaatgagcaacgcccatcacccagtgcttccctcacccctccagtgtccatcactggggcagcatgccaggaatgttgaccaggatttagagtgcgggccaacctaatcacttgcactgttcggcctctgcaatggatacactttcctctctcacagagccaatcagccaccttccacctttgagttccatcactttgccggctttttctcattctctgtgctcttcctctcattcctggctctccaggtcctttttccaccatgacattcctaaagagaggtgcttgctggatgcgagctggctctcgctctgttggttgattttttttttttttttcccctgggcttgtgtggactggcagggcctgttctcagatggaaggtgtgaaagtggcataaacggcacatgagtgcatctgtttgttcccagtgacttcaggagaggcagaggtgggccaatcagccccactctcacatatggccccagcgattccagccgcaggagagtgggcctgccgcccacggacccgtgttatcgtcgggacccctagctcccacagacaggatgtgtgtgtttgtctggctgcatttctgcaggagcatctgtcactctccaatatttcctttatcattgcagcaaattatttaaacactacccactgaaccccatctgtcaccgcgccccatcactgtcagggccctgcctccccaggtctgcaaagcaactcgctggcaaaggctctgtgccaaacaacagggcaaattaaatcaaagcgcgctctggcacccagggggaaaatgcacatcagttttgacttattgcatgaagcacgcttacaagagagaaagcagcggcttttgtcactgcaaggggccatgagaaatgaattagggcctctgctgagagggcatggaggagaatctttcattctgagatgttgtcctttctcaccttgcaagaaggaaataataaaaggagaacttgtggtgggtctaagtgtctccaagctttgacactatcctgaagcacttctgggtgtagaaaggaagtgaccagttggagacaaaaggactttgagaggcttggaaatagcctgagttacatggtgccaccagagggtgagaacttgagcaggtgcaggtaagagctaacggcatctgtccatcccgggaagctggagcggggagggacagagggaaatgcaggcctcatcctcactctgccctgcagtgtggcctgggaactcctgaagaagccagcatgacaagggagcaaaaccaatgtcaccaaaccctcactacacaccacttgctgggataactcttcttcacacttgatctctttcaatccccagattctcatgagataggaattatttttgcccatcttacagatgagaaacctcaaaaagtttaaagcgattgcttgcgatcatccaatttatgtgtggcagggccaggattcaaaactacatccatctgatttcgaagcccattgcctctctttataaaagaatttctcctctgtctccctgctccccgtgagacacagctcatttgttttcctataatgagggaggggccttcgatttcctaatagattgctcacctgccgtcctagtggagctggcatttactgtggcatttactgtgtagctgcagagccttccccaccagacacatttgtactttgtgacagcaagaacacatggacagctgctggggcatttctaacacagcccttctcaggcagagatcttggctggggacagcatgactccatcctccaggagaggacaagccatgcggcatctctaattagaacccaggctggaacattcagcttaatgagctgggagttggaaacgctcagctggaaacgagttggtctggcagaaaggacataggactgagggacacattttctaaactctgtcctcatctcagttgttaatcatcttctgcttctgtctatccatcagttggttattagactgtgttattgtgcatttgcctcaagttcagagtgaacatgcgttaaatatattggacgatggcttaaatggatgatttttcctatagtcttctaggaggtcgctcgatgttgccaaatacttgggcagttcttggactgctgacatattttaaataggatgtgccaccctaagtagtgtctttgctttttgcactctctcaaaactagggaagtccaggtcaattaccatagtgttgtgctttgccatagtgattttctcacctaggcttctctctatgtatttcttgagagtttggacccatataactttagccgtcttttgaagattgttggccacaaaagagaaagcggacaactctagacctagggccacagtgtcaagggaccactgatctaaaatgagccttttgtgtggcccactatttccgttcaacacaagtaagcagggacaccacgtggaaaagagaatgatgcttatgactttgtcaaaaattcataagcacattattgtagtgattgagtattcacctgtaagatagtgacagacatccttcgtgtgtgtgacagtcaaactgaatgttcagttcaattcagtcaaaatagtccaattcagcaaacacccaatagttctgtttggaagcatcttctgtgtttaattccataagtttcctatttgtgtcctgcccctgatttaactgctagaaatattactcatctctttgtgattttaaaggaagcattgaccacctcccctgccttggtttctctgtgagtcactgctagatacggctgtgggagcaggctgatgataggtaagaatcatgtatctagaatctctctccccacaaatatatgactttctagtaaaatcatgctttcaaaatagttgccattttaaatatgaatgtaagttttgatatgattaatattggaaagagccttaaattccaatgcataaatttaaaagaaaaaaaaagaccttgaggcagggtgaggaacctctgaagaagctcaaatgaaaaaaagaaatgtagaaactgcacattgcagactgatggcactgcagggtcagctgtaaaatagttttttaggccaggcttggtggctcgtgcctgtaatcccagcacttcgggaggccaaggagggtggatcacaaggtcaggagtttgagaccagcccgaccaacatggtgaaacaccatctctactaaaaatacaaaaattagcctggcgtggtggtgcacacctgtaatcccagctactcgggaggctgaggcaggagaatcgtttgaacccgggaggcagaggtttcagtgagctgagattgcgccactgcactccagcctgggcgacagagtgagactccatctcaaaaaacaagaagttttttagttgatcaccaataaatcaactaggacagttttttgtttttgtttgtttgtttgtttgtttgtttgttgagacggagtctctctctgtcgcccaggctgtagtgcaatggtgtgagcttggctcactgcaaactccgcctcccagatcaagcaattctcctgcctcagcctgccaagaagctgggattacaggagtgcaccaccatgcctagctaatttttgtattttttgtagagacggggtttcaccatgttgatcaggctggtctcgaacacctgcaactaggacagttttgagtagaatcagttgatgaaggcatttgcctgggtggcgggagcaggagagatgtaccttaggaaaacatggaaacttttgtgaatgggaaacaagggaggaggaggactagcatttaagttattttgtgactttctaattagcaaagaactcagcctggcaccaaactcaaagctaaaacctggctgaaacaggcagtctttctttagttaccacggaagcccatggatgaatcaatgttaaatctaaaaaatcacccagcctttttttttttaaagataagagaacataagttcagagaaattaagtgaatttctcaaagtcacacagctaattagtagcaaaagtaaggtttccagacagtgtaactatttttgtaacagtctttccacagcatcatgctgtctctgaattaccatgggaatgtttatttttgcttttgcttgttctatttgtttttaagaaagttctaaactttgctttggacagaggtgcttcaaaatgtggatgatgtaattagaagtaagagaaaccaaaaaatgaattaaaaagtccacaaaaaaattattaatatggcactcagtgttaagctgaaattctggtacaagcttgtgtcctcgggttttgacttgtctgtggtttgtacaactagactataaaatatttcaaaaaatgattttattcacaatctggccaaactggcttgttctggctgaagagctacatcaaaagagggtcaccagatgggaaagccttcgtctccggggcatggcctaaaacacagctgaattatccggtgttggcagtagaacaccacggaaccttctgttcaaatgtgccctgaacccattaagtcatgagcctcaggctggtttagagagtggcttctaggcatctcgccttgttttctcctgagcaccacttgtagacctactttctttaggaaagggagacagagccgttggcagctcagatgtgaaatggggtcatggaaagagagcatgcttaggagtcgaaggatttgggcactgttgctggttctcgttttagctgcacggtcatgcacatgtctgttagcctgatgtgaaggtgacgcaggtcactcattccatttaggggtggctgggtgcactaacccagtgtcttcttccttatctgtagaaaaggtgggctttttatggagataagaactctttggccaagagagtagaggtggctccacctccctgccagaacttccaaacaagctctcaagggccttaacatgtcacctcatttctctgagcctccatttcctcatgcttaaaatcaggttgtcttgaagcccaccccacggtggatggaaagtactgcatgggaatcgctggggcatgtattggaatgccagttatgagtgcacctggggggcacagacgcacggctcacagcactgcagcttcctcctcccttttgccgtggttataatactttgaagagcagggcataccagtagggcatgcactgggaagaggaaagatcctggtcttcttctttgtttagtcagaattggttaaatgcagaactggtagttcagactgcccatgttccagacctagttagatggaggcatttctgacatgccttttaagattgaaggcagaagcacagaaggccgtgccagcacaatggaagatagaatgcttgtatctcattgtctggagaatagataggttgcaggtttcagtagaataggagctgccagtcaaacctttttaatagaatgggagcagatagatttcaataaaagaaatgagtataaatattgtgagtggaggaagggagaaagcagacagatcatgtttgactagtcacagtggggaaactttgcacgaagtttaaactgaaaacccataaagccaaggtgggtgactgggttgaatccatcgacagctgcagatccagggcttgccccatgggcatccattaaggaggctccagctggataaagagcactccaagtctgtggtctttcctcaactctaagcccatcccagccaagtgcaatgagcattcagctatctgttttactggcatcctccacccccaccctatacagaatccacggaaccctgctggcattgtgcctgtagctggtgccttattagccagggggactctgaaataattcccccaggagtctctccagggcagtagccccttccaccatagtcccagagaattatttgttagcagctgcctgatttgtccccaaattagcaaaccaaccacctaccaaggccttttggctccttctccccactgcctcaggttcccaggatttctgtgtattttacccaagggtgggacttttggccattttgtttgccactggccacggttgactaaggctgctataacaaaataccatagatggagtggcttaaacaacagacatttacttctcacagttttgcaggttggaagttccagtcaaggcactgacagattcagtgtctggtgggggctctcttcttgacttgtaagttgttgccttcttgctgcttcctcacatggcagggggagagagagaaggatcatctctttttttatctattcttacgaggactttaattccattcacgaggactccaccctcgtaagctaatcacctcccaaatgcctcatctcctaataccatcacaatgaggattaggtcttcaacataggaattttggaggaacacaaacatctactccatagcattctgaccctgtcattcctcccaaatgtatgtccttcttacatgtgcaacacacttattccatcccaacagcctcaaaagtcttaactcgctccagaatgaactctaaagtccaaagtctcatttaaatatcatcttaatcaggtgtgagacaaaatttctttgcagctgtgaacatgggaaaacaagttatgtatttccaaaatacaatagtgggacaggaatggggtaggcattcccattccaagggggagaaattgaaaagaaagaaggggcaacggttcccaggcaagactagactacaaggcaaactccatgagatcttaaggctcaagaatagtcctcttttgctacaggaatatatcttcttttgtttgatgctctgccttccagacccagtggggtggcagtcctgcgcccacagttctgcagggcagggttgcagctccatggccttgggcagctccaaccccaaggctgttcaagggggccatctggcctgttgaaactgaggtggtgctcccctgacctcatatgaaacttaggaggctgccctggtgatctctgaatcacttttttgggtcgttcttcccttgtcttgaagaattgcacacattcatagctgagtagttctaggtaaaatccaagaaatcagacaaccttccttccttctgtttccttcagtttaaaccagaagttctcctgctaggtcagctgattagcttgtggttcacatccacgctgacttccttatcaagcaatgagtctgccacgcccttagtgttctttcttttccaaacatgcttttacattttgtataattcggaccagctgagaattttccagatctttacgttctggttcctttttttttcctgaacaattccatcttcaattcatttccctttctcacatgttattattagcagtcaagaggaatcaaactgctccctcaaacacattgcttagaaagttcctaagctaaatatccagtttcatccctcacaagctctaccttccacacaaaacactggaacgtgaacaatattcagcaaagctctttgcaattttacaacaaggattacctttcctccagtttctaataacatgtcctttatttctgtctgaaatctcgtcagaacggcttttaccattcatatttctaccaatattatgtacacgattattttggcattctctaagaagatggaagctttctctccagttttcctgttttctgttggaatcttcaccagaattgcctttagtagtagacaggattcctacaacggaatggcttggtcatagggcatgtttattttaaatgtttatattgccacccagcttgccctccataaaggctatgtcaattagcaatctcaccaacaaacagaaatgtctattttcccaccctttggcccataacagatactttcaatagtttacgtttctgccagtgtgataggcaggaaattgcacctatttcaattttcatattccagttactagggaagctattgtgcatattttttcatatttcatatatttattggatatttgtatttcttctgtgaattgcttgtccatattcttcatccatttttctattgggttgtttatcattttgaaaattgatctgaaaaagcagtgtatacattatggacgttaacccttttttataaaggttataaagggtgcagatatccctcccagttattttcttgtcttttactttattttatagtatcatttgtcatacaacagttttagatttgcatgtaataaaatctgtcaatctattcctttatggctttatcatctcgtgttttgcttaggcaggcttgcatttatacatacactgtattgtatatttgcataaaccatcttaaatctcttaaaaataaaggcaagatataaagagatgaatgaattaaaataagaagagttcctcccaggcatatcacatgtgaagacagtggtatcttatatttacataccacttttacttcccaagtattttcaactttattatctcattacccaggccttgcaatgtttccgacagacataactgccaaaggcaacctcaagcagctgctcatgtatttacctctgttgccctctcatggaaagggcaagagcatggatgacagctcaagtctcccttctcttcttataaagctgtgcctgtcccaccagcaggccccaccataatgaccttatctaatcctaattgcttcccaaaagctccacctccaatcaacatatgaatttggggatgaaggttccaccacatggaatttgaaggacacattcaaaccatagtagtagctaaggtgagaggattagctgcatgtgtaccagctatggagacttggagcaaataattttcacttttctcgtagtattgtcttttaaatactgtggcattagaatctactcttaatttgtatggtggttctgtgaatgaaatgggattacccatctcaagcattttaaacataaaaatgctcaaagagccagatatatttttattaaaaaataaaaactggaacagcttctggcatggttgaaaggagatggttttgtacgcaaacgtaggctttacttcttgttctgccattttccagccatgagattttgggcaaattacttaaattttctaatacgctaaagttcatttctggtccagaggagacatcaaatcttttctgaattcgttcaccagaaacaacccaaactctcccttgccttctgaacctcaaactggtagcaatgttgtaccagtttggattcttcccttgcataaaaaccagcactgatgttaatgtaatctaaggggaatacattgccgggaatctaggggcttatggaatttatgaaaagctgggtcaaatgcaggaaacatgacagtgaaggtggatgggaagtagggagcactggcatgatcattgtgatggtgatgatgacaccaacccgtggcatgcagtcgttgtgcatcaggcactatttcaagcattttttttatgtattaactcattcatttctaataacaacctgaatgaagtatgtgctattcttctccacgttttatagatgagaaaactgaagcacaggcagagaggagttaagtagaaagcccagggaaacacatccgcaggtggcagagatgggatacactgttgggatttcccacctgtccaggttcagggttcctagaagacagacacttaagccaaaatcatgtctgctacttccttaacacagggtgctgttctaggaggaagaatgaggaaaaacatgaagcaggacagagcaggagggagagcaagtacaggggtgacctttctggagctggttacaggttcacagtaatacacctgcctgcctggtctatgggatggctcaggagagtcacaagaaacaactgcacttcaggacagtcttttgtgggaaggagggacagggattgatcactcctggttgaagcctacagcaaggggcattaactctccgcaagtccagctgtgtcgcccagtctcccaggcagctagagcctccctgaggtgagtccagctaaggcacaggcatagccatctctcttgttgccagtgtggagtggggagccctggatctgtcctagtagtggcatctgaggccgcctcattacaacctcagagcagtgtgagccctgctaagattgctgcagggagggatgaagcagaaactgagacccaacctctatctaaatatgattttacatgaatataactctaggtagagccaaatagaagccacatgtaatgaggagaggcttttaatctcttcctctgagacagtagcatgatctaagttttaaagacagagaactcaagagctagaaggattatgtgatttgaatgaggttttattgctgtttagacatggtggtgagaaagagaatccaagtgccctagatctttctgaagttttgatttttgttgatagcatagatttaatatgctcataacagttttgggtctggtggaaggagtttcagagaggaaaagctgtgaatgtgtgtgtagatggaatttgcctaattgttttagaacaagcacatattgttgaataacttagttgacatttgaaccagagaaggccattaatagattttgaatgtaaatgttttatttgaaaccaaatgatctttatagagactacaagcattagaggttgttagtcctcatcagggaaagttggcgtatcaaatcatgacggaaataaccaacactgcagttcaaatagcagaggaaagacgggaggggccacccaccatttatcaacattttcatgtgctagcaccttgtaataaggacaagcagtatcttatacatgtctgctgtactccctttccctggagtagctagatcaaaggatttttcctctgaaaagctcatttagtctcatagcaaagattcagtagatgaaagactagaagtgcagtccaggagcataaaatcaattaacttaaaaaatacagtgtaatatattatagctggttacttagagatgctgctactaaaacattgcaaacatcatcggaagacatgctatcatttaaatatatacattcctcactctttagttacatgactctctttaaatctactgaaatttacgtatctccctccctcacactttccttacccatagttgatgggtttcaaatccacacgcaagcccttatcttgggttcttggatgatttttttttttttttaattttcattcagatacctttaaaaaaaaaaactcatgggagctgggtgcatggctcacacctgtaatcccaacactttgggaggccgaggtgggtggatcacctgaggtcaggagttcaagaccagcctggctgaaatggcaaaaccctgtctctactaaaaatagaaaaattatccgggcatggtggcaggtgcctctaatcccagctgaggtgggagaattgcttgaactggggaggcagaggttgatgcaggagaatcacttgaactggggaggcagatgttgcagcgagccgagatcgctccattgcactccagtctgggtgacagagcaagactccatctcaaaaaaaaaaaaacaaaaaaaacccagaaacctcattgaaaaatcatatcatatccatgaaactttcttaatggagtgcatatgggtgttttttttgcattcaggaaataaactaatagaaagaaatgatagtcaaacacaaccacaagaacactgcctttcatgttcctgttagggacaggctcttaggagtcaagaactagattgtagaatccaagcccctgggttcatacctataatattaccaaataatgactttaacaaatttttactgaatgcttaaatgtgtaaagattttgccactatggagcaagagttatgtaaaactttctccttacaacatagtagttagaccttagttccaataagacttatattaaaggtagacttctagaatcccatatttttcttaataactacaatttttaagtcatgatgcctcagcctcacatctgtgttgcactctgctagctacgtatacactattattttatttcaatctctatcacaaccatgcaaagtagacatcaccctcctttttcaaatgaggaattcagactccatgaatagttcagtcaaaatttcacaacacacataaaatcatcaaacaccttctgcatcttgttttatttttgttttagaagtttggcatacaatcgtgtttggtgagggaagaagctgcccatatgtttaggtttggctaatggttgtgattactaattcaagtgtgtgtgtctgtgtgtggtgtggatgtgtggagtgtggtctcctctgtgtgtgtgtgtgtgtgtatgtgtgtgtttgtggtgtggggtcctctctctctctctgtgtgtgtgtgtgtgtgtgtgtgtgtgttttagatagtgcgttaaatttaggataattttgcattatttttaaagataggtctgagctaatgctaatattttagttccatagaaggaaaaagtccagtttgctatgagaatagtaacattgtctacgctctctctagcagaaaggaaaggatggtgagtctcagtgggcagcctggggaaggtcagagaatgccagcttgttcctgagtggcctcagtgatgacccagacatggtcagtcatgattcctcagacttgggcataatcgaaggatcatctggatctctgcttctcctaatgcctttatcccctgcattccaaagcaagaggggagaaaagcaaaattgaatctgaaggcagactccatgtgaccactttaattaaatgtaagagtggctgctgtgtgaggcaaaaggaaaaaactcaggagaaagggcatgatattgttttgaagcagggaagccgaggacatacaatagaacaagaaaataaagtatggaagttgttcaactaccgtctgcttcgtatgcattctattgcaggtgtagagatctggagagaaggacagagagggcaatactagtgattttgtttttaaataagttaccaaaggtaattaagtcttccttttgtgcttcaatggaaacagaatgactcaagctccaaccagcaggatgtcatgcttcctgggctagactgcaccgtctatcccactaaaatgggcaaatatttcactaccgtttggtacttctctatgttgccttctgttaataaaatactcatcaataacaatcccatctaatatggcagattattatataggtcttataatgtagttcaatttatgtaaacaagcctgaagaatagatattttacaggccaggatttatatacaaattgcatcacccataaatgctacagccaggattggaatcaaggtttctgacttcaattcagtgttctcttcatgacatgatactgactgagagtgaccactgcactgtggctgttgagggtgagaaagcacagtcattgttgactgggggctcctggcaagccaacaatgtaaaaatgttccagaaaaatcccatcactcaggagtcaactctgaacatacacctgagagatgtgtcatttacttcatcaagtgatttgtgtgtggttttaaaactcaactttactgggctataatttacatacaaagactttcaaacattttaaggttgatgacttttgacaaattgtatacagtcaggtaaccaacttaatcaaaatataaaacctctccatcgagcgagaacattccttcatgtctctttacatttctttagtcattctctctcctcagcgtcctactccaggcaaccactcgtgtggcctctataactacggatagcgttttattcatatgagatcatacgtatatattctttagagtaaggcttcttcacttgacatagtctctgtgagatttgtctttatttttgcatatagtttacattttattaagagaccatatattttattttttattattattttcttttttgagacagaatctctctcgtttgcccaggttggagtgcaatagcacgatatcggctcactgcaacctttgcctcctgggttcaagcgattctctcacctcagcttccggagtagctgggattacaggtgccaccaatgcccagctaatttttgtatttttagtagagacggggtttcaccatgttagccaggctggtcttgaactcctgacctcaagtgatcagccgatcttggcctcccaaattgctaagattacaagcatgagtcactgtgcctggtcagagaaccatatttttaaaaatcagtttatttgtccaaagaaatttaggttatttttagtttaaggttattatgactaaaactgttatgaacatttttgtatatgtctttataaatttatttttatttttttttttacttttttggggggtaatagcaaggattagaatggctgtgtcacaagtgtatgttaagatataaaaaacaattttgaaaaatggttgagccgctttacaccaaaaatatataagccttccacttgttccacatccttgctctttggaattgtgctttgtgtatgtgtgtattacaattaactaattaaaaggtaatacatgaaaatgaataaatgcagttgttagcattgttgagatatgattaacatagcttacaccttattcatttacaaatgtataattttgtgagttttggtatatttaaaagttatacaactacccgtttattgttgtgcaatacaatcaatttagaaaaatgttatcatccccaacagaaacccataccttttgtaagtgaccttcatctcaccccccagcacattaccttccctaaggccaggcaaccactagtgtactttctttttctataaaattgcctgttcggtttatatcttttgtcttttgccactgctttgttgacttagcataatgttcttaaggtccatccatattgtagagtctatcagtagttcatttgtttttatgactaatattacactgtatggatccacattttgtttatccattcatcagtggatggacatttgggttgcttccaccttgggactattgtgagtaatactgttatgaacattcatgtacaagtttttgtgtagacatatattttcttttctcttggttttatacctaggagtggaatagctgggtggtaggttaactacatttcaccctttgaggaactgccagactattttgcaaagttgctgtaccattgtacattctcactttagcatatgactcttccaatatttcaacatctacaccaacacttgttattatccatcttttttattatagccatcctagtggggtggaagtgtgatctcattgtggttatgatttgcattttcctgagggctaatgataggaactgtttttgatgttcttattggccattcatacatctttggagacatgtctgtttagaactttagcccatttttaattgggttgtcttttttttttttttagtgagctgtaagagttctttatattttctatatatgaattcctaatcagatatatgattggcagatattgtctctcattctttgtcatttcactttcttggtattctttgaagcactaaacttaaatttttttgatgttcaacttatacattttttgttgcttgtgcttttgattgtcatataagaaacaaatcatttccataggaaaccattccaaggtcatcaagatttatccctgtgttttcttctaagagttatagaacttatattatgtatcttgagttaaattttgtatttagtatgtagtaagatacaactttattcttttgcatgtggatatctagttttccccagcatcatttgttgaaaagactactccttcccctaggaactgttttgatacccttgccaaaaatcatttgatcataactgtggggtgggagtgttgctcctaaactgtcaattttatcccattgttctatgtatttctccttatgccagtatcacagtctggattactgtagctttatagtgatatttggaatctggaaatgtgggttctttaaatttgttctttgttttcaatattgttttagttcttctaggacccttgaattgccatacaaattttatcatcagcttgtcaatctcagcaaagaagccagctgttattttgatagcaattatattaaatctgtaaaataatttagggaatattgccattttaacattaagccttccaattcatgaacatgggaagttttcccaattatttagatcttctttaatgacattcaataatattttgtagtttgcatagtaaagtttgtcactattttattaaatttattgctaagcattttattctttttgatactacggtaaaaagagttgcttttgtaaattcatttttagattgtttattgaaaatatatagaaatacaattgatttttgcatattgctcttgtatcctgcaatatttctgagctcatttattagtttgaattttttttagtggatttcttagttttcactgtatataagatcctgtcatttgtgaatagatttacttccttcctccagtttgctttttattacattttcttgcctagtagtcctggatacaacatagagtacaatgttgactagaactggttgagaggagatagccttctcttgtttctgatcttaagggaaagcattttgatttttaccactaagtataatgttagctttatgatttttgttttgtttttgtttttgttttttgtagatccacttctacaaaaatgttctggttcggattgaggaagtttcctgctattcctagtttgttgtgtgttttttttatcatgaaggagtgttggattttatcaaatgcttttactgcatctcttgagattattgtgtggttttgtaccttattctgttgaaatggtatattatattaatcaatttctggatgttgaaccaattttgcattcctggtagaaattccattgattcatagtgcgtaatcatttttatttgttgccaggttttgttgactagtgttttttttttttttttttttttttttcctgaggaattccacatatgtattcataaaagatattggtctgtagttttccttccttgtgatatctgcctggtcttggaattagggtaatactagctgcatacaatgggttgagacgtatcctctactatttttaaaaataatttctagataataggtatcagttcttcaaatattttgtgactttaccagtgatccatctatgcctaagctttctttgtgagtaacttttgattactaatttaatatgtttgttaaagtcctattttgatttttaaaatatctccttggctgggcgtggtggctcatgcctgtaattctagcactttgggaggccgaggtgggcatatcacatgaggtcaggagttcaaaaccagcctggccaacatggtgaaaccccgtctctactaaaaatacaaaaaattagccagcgtggtggtgcatgcctgtaatcccagctacttgggaggctgaggtaggagaattgcttgcacctgagagacagaggttgcagtaagctgagatcatgccattgcactccagcctgggcaataagagtgaaactccatctcaaaacaaaacaaaacaacaacaacaaaaaacacaacttcttgagcctatttcagtagtttgtatctatatgaatttgtccatttaatctaagtgatctagcttattagtatacaattattcataacattgctttatgatcctttttgttctgtaagtttggcagtaatgtttcctccttaattttttattttagtaattttacttctatttcttttgtttttttctttgttcagccttagtaaagccttgtcaaataaccaacaattgattttcttgactttttaaatttattttttatttcattaatgtcttcttttaaaataattttcttctttctgcctggtttaggcttagtttatgcctttttgtccagtgtattaaactgaaagtttaggttattgatttaaggtcactctcttttttttaatattatagacatttatggatataaatgttcctctaagtattgctttgctgcatcccaaaagtttttggtttttgttattttttaaagtttcaatatattatgtcttcatttccatttatctcaaagtataatttgaaataaattccagatgacctgctcttatatgtaataaattccaagtttcctttggctcattggttatttagaagtgtattgttaggttcatgtatttctgaatttctcgattatttttctgttacagatttctaatttcaatccattgtggtcagagaacatactttctatgatttcagtctttcaaaatttattggaacttgctttatagcccagtatatggtttatcttggaggataaaccatagcatttaatgtgttccaagtgcacttgagaaggatgtttattgtgctattcaatggagtatactatatgccagtctctttaaattttagccagtccagtgagtgttcagcgctgtttcattgtagggtgaattcatgtttttctgcttagtaatgatgttgaatatcttttcatttttacatgggccacttggatagttctttgcccattttcaaataaaatgcattatgttatttttgagttatatgagtatcatatatttgggatacaagcaccttgccagatatatttggattgcaaacatttcatttcattttttgggttacattttcattttcttaagttatcttttgataaacttatatatagttttatggcaagtctaaagatctttggctaccctaaggtcatgaagatgttctacgttctcttcaagatgttttatagttttagcctttatgtttagatgtacaatccatttcagttattttttatatgatgtaaggaaggcattgagatattttttcatttttctgattcagatatccagtcatcctagaacgtgtattgaagggactatctttttaacactgaattatattggtgacttttcaaaaatcaattgactttatatgtatgggtatttgggaactaactattctcttccatcaatgtatatatcaatccttgtgccaatgccacagtgtgttgattattgtaactttctagtaaggacttaatgagatagtatgaattctccaatttgatttctcttttttttcattttttgaaatgaattttttttcattttttgctcattctgcatacttcgcttttccacatatattgcagagcaagttagtcaattctttttaaagtactgtgttttttactggtgtttgtttctttaattttttattgatttaactgatacattacaattgtgcatatttatgaagtacaacttgatgttttatatatatatgtatatatatatgtatatatatacgtatatatacgtatatatatatgtgtatatatatatatatgttatataatgatcccatcagggtagttagtatagccatcgcctcatgtatttttcatttctttgtggtgagaacattcaaaagcctctcttctagctgttttgtaatatataatattttactgttaaccatagtcaccctgcaatgcactaaaacaccagaatgtatttttcttgtctaattgtgactttatacctattgatcaacttctccccatcctcgcctcctgcttctccttgctagtctctgataacgactgttctactgtttctgtgatattgacttttaattttttttttagattctacatatatgtgagatcatgcagtatttgtcattctgtgtctggcttatttcacttaacctgctgccctccaggttcattcatgtaatgcagtgaagtgacagattttatttttgtgtggctgaatagtattccattgtgtatagataaccacattttctttattcatccatcgttagtcacttaggttggtttcatatcttgtctattgtgaataatgctgtaataaatatgagagtgcagatatctctttgacatgctgatttcatttcctttagatatagtcaataacgggattcttggatcataaaagttagtatagcagacctgagactactgtcatttatagaggattgcttgcaagcttggcttttggggggtgtctcagactcaactggtaaacagtttcctaaatttataaaaaatactccttaactgaggagagtggcttactgtgcatagaatgatcacacaaaaattgtggttcatgctgacacctgctttccttctagaaatctggaattttggtgcaccttaggcaggaggtagctatgtgaccacttccaattaaaacattgtctgctaagtctcaaatgggattccttagacagcaacatcatccacatggtgctgcatttttgttgtgggggaagagtgtgctctgtgtgacccttcttgggagggaaagagcatagagaagcctgtatatgggttcctgcagcctctacctgtgcctttatcccttacgattcagcagtaagtcttactctaccattgttaaaagtcttggccaagagtacaactttatgctgagtcctatgactatccgaggtgtaggggtggtcttagggactcctgacagatagttggcttattctattccactatgttgttgctagtatatagaaatacaactgatttttttatgttgattttgcattttgtgacttcacaacatccacttctatttctagcagtgctttgtaaattccttatgtttctacatgggcaatcatgtgattggtgaataaagataattttacttcttcctttctaatctgtaatcccttttattactgtttcctgtcttattgccctagtaagacttctgttggctgaaagtggcaagagtgtacatttttgccttgtttcttatataaggtggaaaacattcatcttctcattattaatttataattgattttatcgacttacttacaagttaatgactttgccttgactggatgtttttctaagaaaaggttgcttcaaaacaggagataatagcaaggcatatattgtgctggtaccaggtgaccaaggattgtaggagaaggctctattgatgaggataaaaagagatgaaaggtggcattgcaatgtctaaaaacctacttgatacctttgcagattttcctctaatttgcttttcttcttttcccttatatatctctcagttcctagcccaatgtctcacagagttggttctcaaaaaataagaatttgggcgtacttgaattgaaaccaatcagtataagggattatttttaattttgttggatgccataattatatttgataacgtaatatcaaaagcattacttttagaggtatttttgaaatatgtctagggaaaatagtatattatttgggatttgttttcaaatattccaacaaataacaatagtaaccaaaatgagattgttacaatattggtaattgtaaaagcttggtgctatttctatcatgctaaaatatatatatatatttaaaaatccatcctctgtgctactgtttaatgagaaatgggtaaattctggtttgaggactcttactttctgagttccaagaaattgaaagcatatttgccaattacttttatataacagtttattgagaactcgaaaaataattggtattaacgaatcatcaaacagtctttgaaagtctgctttgggccacagtcaccgcttaatcactgtggtattcacatcaacatcggccttctggttgccaagtccaatggacacttcttccttaccttagttcaacactctgcatcctttacagcctacccaatacttattgaggatttctgttcctttgcttggcctctgttgtacttagctagtgctgtgtaagaaaccacccccaagctttgctgtgtaaaccaatcattgtattatgctctcagatactttgggtcagggatttgtgttggacacagagggatcaacctatctctgttccatgatgtctgtgggcctcagttggaaagacctgaaggctagggatgagttggcagcaggggggctggagtcatctagaggcatcttcacccatctctgctaatccgtcagccagaacacctacacgtggcctctccaagtagtctttgtgcatagccttgcttgggcttcctcctagcaaggtggctgggtttctagaacacaggcagaaactacattgcagccccacccagacacaagagacacaagtggaatgcaagggtgcagggtcatattctccacctctcagtgggaggactgtcaaagtcagtgtggtatggagacaccatccagagatctttggaaaacacattctgtcttagcttcgtaatgctgctttacagttctcctcctttggaatgtctttcttaaccttcatttgggcttctctctctctctctctctctctctctctctctctctctctttactgcttaaatgtcagtaatctccagggtggctctgatacagatcctttctttgttcactctacgctcctctccttgtatttcattcaaccccgcagctataacttacaccaatatgtagctgcaataaacatgtaacaagcagatctgtacagctcagtcttcactcctgagagccaaatccaaatatccacaagacgtccccttttgaatatcttacagtcacattaaacttagatcatccaaatggaatgcaacatggtgtttcttctgtctgcccctgatagtcttcctgttctgcttatcacagagaataccacagctatctgctggccccaaacagagacttgtaagttattttagatgccttctttttattccagctatcttttcaattaatatccaagtcccatcaattaattcttctaaatttccttttaatatattacattctgtccatttccacagccactgcctacctgaggcacatattatctcttactggaatcattgtgctatttctctcatgaatccatttgtctttagacttggcctctgcttcctcctccattctgctgctagagggcactgtttatcacagagatctgttcatgtgactctcgctccaatcttgcagatgatcatccaagattctcaggagtatcctacagtccttttgcttgtcatgtttagatgccagcccacatgttcgcacttaatgctcaccagaacttccactactgcacgttaaatcccaggctcaaacaattatgtataaatacttaaaaccatatgtcttcatgcctctgattttttgcacaggctattccacctgcctggaatcctttccgccattgatcttccaggcctttgtttatatttagcctttaaaaatctcagcttaagtgctacctcttctattaatatttccctaataactcaccttctccacccacacacatgcccatacccaccaaaattaacacacacaagatctctgtagatttgtggacttaacactctgcatttcctttgcataccttccatataaagattcacatcgtgttataataattgtatcacagaactctctgtgggctgtccatctcttaatggtgaggactgcctcagtaatcatccatttattaattcattcaacaaataatgaccaataactcctactatatgccggttactgttgttgaaacagaccgccatggtaaacaggacttcattgatagtctgtctccagctcatggtacatgttcagaacatcagcgttgaatttttaagtcatctctggactatcattggtgctcagtaattgttgttaaacagttgatgagagaaaattccccttgatggatctcaaccgaggtcatcagagaaatccttctgtacatatagggcagggattgtgatttactagtttgcctaatgccagaaaataaatttgaggtttgctagcaaagttccttggatttatcttgaaggctgtgttgacatcagtatcccccacccgaaatagtaatgtaacatggtgaaagtacaggacactccagcagaaacatgcagtttgctcgcctagggtgcaccagctctttagttttcgggtgaacttagtctcagcaccctccgagtctactggagacatctcctggcctcaccacactgtcctgatactctcttcttttttttttttttttttttttttttttgagatggagtcacgccctggcacccaggctggagtgcagtggcatgttcttggctcactgcaacctccacctcccaggttcaagcgattctcctgtctcagcctcccaagtaactgggattacaggtgcatgccaccacacccagctgatttttgtatttttagtagagacagggtttcaccatgttggccaggctggtctggaatggctgacctcaggtgatctgcccacctcggcctcccaaagcgctgggattacaggcctgagtcaccacccctggcctctgatagtcttcttattgtgaattgtagggatagctttcatttgtttgtggttctgtaaaccccaccccagatttcaaagccacctatagctagctgttcctcagattcaacagtcattgcccacagggcagtcattggctaagaaacctctggaggaaaatcacacttgaggcaaataacattctctcactattagcagctttgatcttttttaaaacctcattttctttttccagcccccattgcattgtagacatttttataatgagcataaatgttcatttaattttatttggcatatgctgctttgaaagtgccacatcaacatggagcatcactccttcagtaactaaattcttctaacagctttaaaggaatgaccttgggtgtgaccagtgggtcttcagagcatggctgcgttttgattagctaaattttctgttagcccagtgagtccacacaccaattagtggagcataatcacaagcctgaaggtttcaggagttttctcacagggaagtaacattgatacttttcttaatatattattatttttaagtaaatatctgacagtgtctaggtaatcaattctgtgcccacaaaagctcagtgtgcctccgaaagagttcaatatatacaagtatatgcatatacgtatatgtttttcacaattcagatgcaaatacacagaaacatttgttcatcttcaaatcattttaatagatgattgggttccttgtccacccactgcccaatgactgtgggagaaccttctttcatttacagaaccccagtctgtaagaatagatatctaaaaatacagaagtctgatgcccagaaattgtccttgaagcttgattccaaagcacaatatgtgcagcccaaagcatgaccagacagtaagctttcacatcatacatgggtcaagcacagacatattcttcttttagatttggaataagggttaattgcatcatctaggaagcgttcaggaatatagccttgtgaattctcacagttatgagtactatcaaaaattgacttcacacatgataaaaagaacaagaaatcttggaatgctttcaatctcaaaaaaagtattgtgatattaataacatagataaaatttatttttattaatttctgcttccaaactttcaacctgtgagctttaagcccacatcttatcatattgttatgtttcattgccaaaagcaactacgtattgatatttcagaaatgctgccaggcctttatgtaactagttgctattttacctcaaaaaataaataatgcttcctgtttttacttttacttatctggaataagtagctattgacatctgctgaagtcagtataaagatttatttacctgagtgtagatattgaccaatagggagcctggctcaatgtttacattgaaggacaataaattgccgtattgactgggctgagacatcaatatttgcattgttgtaaacatttttaaaaatcttcatgaaatattcctcagaaattctcttgtcaccagagcagctgagctagagctctttagggaatagcttgtgtctggaagccagtgggtaacttgaaatagctataaattgttctggtttccaagtttacacaaagacacattttttattgtgatgtataatgctgatcattaggagctttcagatgacagtcccagccccctcctcaaatagcagatttttgtctacaacaactctgaacagaaatacgctccccgagtagcttgtgtcttgaaaagctcatgttttccaaaaaatatctcattgcccaaacagtgaaacatcattaattccaaccagattaattaattaaaaatgtgggatgtttcaactcagttggaataagtttttcctttgtgtcaagagtagaaagaggaagatgatttagaaaacattaggacaggtaaagtgataaattgaatatttagcctgtttaagagagaaacataatctacacaaaatcttcttacaatctatgaatgcctattaataggcattaacttaacttcttaactccaagtgatatgtgtgtttatataatatatgccattttaattaagctttgtaatagatacaggttaaacaactttatcaacatgtgttcatataatttaatgtacttggaagaaatgaaacgggaaattcctttattcctttttttttttttttttttttttttatttgagacagagtctcgctctgtctccatgccaaagtgcagtggcatgattttggctcactgcaaccttcgcctcctgggttcaagcgattctcctgcctcagcctcctgagtagctgggactacaggcacgtgccaccatgcccacctaatttttgtatttttagtagagatagggtttcaccatgttggccaggatggtctcaatctcttaacatcgtgatccacctgcctcagcctcctaaagtgctgggattataggcatgagccaccgctccgggtcaacaggggcaatttctgtcatatggtgtaaaagctaaacatctggcaaattcttaattttttccaagttggtaaaatcataacctactttagccagcccaatagttctaagggagtggctcaagataattagcaccacctcttggagaagcacagattcattgttctagtgcagggtttggtgcctcatcgtctttgtcaagtaagacaattaggacagcgatcagagatcaaggagctcgggatgatgtgcaaaatgtgatgcctatttatgcttgaataacaatttggatgaaaaaattggcatcttaaaaaaatatttgcatcatggttatattcctaaatgatgaatgaaagaaaagaagcatccagttctctctgcagttgcttccacctctaggcggtacttcatagcaccctgttctaagttaggctcagggactgagaatgcttttagcgaagagggataggaggggaggctaagatgggcaagtctgaaatgtgccctcctgttcaatggggggctttagagggaaagtggaaatgtcctaccagtaaccgtgtctgcagaggagacactaagctcttgcccaggccccatgggagtgcctgtgctgtcatcaccccaggggctctatctcagtgattccctccatcccgcccttttcctggcctcctctcctcctcttgggcttctccctctcccttccttcctccctctgaggcaatgcccagtgcttgtagaaagccccaccacttccaaaggactgtcccagcccctggggcctcagccccaggatccctagaggatgattttgtggggattaaaatgaaatgaggtatgggaaagagctggcgcacagcaaaccctccaaggtgagccccctccctattctgggctttcccctggacacccactctactggttgctagcgctgaggtaacaaagtaccacagcctggagggcttcaacaacagcaatgcattgtcttacaaatttggaggccagaagtctgagctaaaacagtcggcctggttgatttctgggagggcctctctccttggcatgtagaaggtcgccttctccctgtgttttcacatgtcttccctctgcatctctgtgtcctgatctcttctcctaaggacaccagtcccattagattgggtctcccccagtgacctcagtttaactgcatgacctacttagggaccctgcttccaaatgccctcacactgcgatactgggaccctgcttccaaatgcccccacactgtgatactgggaccctgcttccaaatgccctcacactgtgatactgggaccctgcttccaaatgccctcacactgtgatactggcggttgggacttcaacttacggatttggggtgggagcataaatcagcccataacaactggtcagtccctctcctctgcctcctccaactgtcacattgtaaaccccacctgactcttccccgacagtggccttggggagaaggcggggccggccagggtttctactcctgcctcatggagacccgcctcagatgcccagcactgcgactgctgcacagccacgaggctgagccgctgcggatgcatgcgtgacttaggaatgtgtgctggtgtgtttgccacagcaacaggatgaggaaagcacagctccaagagaggtgggagctcatccacctggggaagcatgagcaggagcaggaagggtcactctgggactgtgctcatgggaccctgagatgcagcagaaagagcagtgtgaggagcaaagtgacgctgcctgcaggtgctgtccactcagaccttcccagcctaggcttccctgctacccacgtcttcccacctggactccccctctctcaaggggcatcctcagtagtgctctctcagcccatctgcccctcagaggcctggacccctgccttgccctctgtggcttcacattaacattgactgggagccatcctacctggttctcatgcccaccagccttcctctccaccctgtggtcacaggactatgggcagcctctgctctgagctccctttgtacctctctcttctcacctttttgttgttgttaattgtcatgcacatcttgaagaaggaggaatgaaatgctcccagctctgaccaactctgtttttctaagtgtcctccttcgtggacctgactgagatggcactgctactctcactgtcacagccacccctcgacagcctgaggcacactccctgctgttcaggagcacccagattggggcatcggtgcacctggacttgctatgtctcgggcaccacccattacacttatcactttttctccatgagttatattcacagcggttccccaggcatcaaattggcaatatgagtttagctcttaggaccaaaggacacacaagagatcatttattctttgcatcactccccttttctcaggtaggacatcaatcttccccgactctgctctggccatatttactgccagtcgctgtcccttagactgtctgcctctcctagccttgacagatgagtctcactccaccaggatctttacaattcaaggcacagtccagcctcttgtagatgggaatcttgctaatgtagccactctagcttatcctggctgcatcatgagaaaaatggagttcagctcaggactggcttcctcggtttgcagagtcagtgggcacctgcaaactaagagcttccatctgcaaggaagacctatcaccccaagcacttggcttggctgctggctgacatttgatcatcagtacctttagtttgagtctctggtttctgtgaaataataacttctaatatccacacagtggagtacaatttacagaatgcatccatatatttaaaatatttaaactgatctataaacttcacagtcgatattatatccccctcattttatcaggaacataaaataagagactcattcaagctaaaacataaacgagtctggcctatggcagtgcaggctatttctgtctgttacagcaggctgccactctgcacttcatctcaggagaacagtttaaaaatagtagttcttttcaaatgggattgtgtttctggccctttcttggaagaggacctgaatgaaggattgaaagattcaaaggaaggagatttaggagtaacacagaagcaccatttaggtaaatgctagagaagaacacgatattacacatactttgcctgtccgccccccccacccaaacacacacagcctcaatgcgcaactttggcccacttatttttgcctcaccactctgttgttgctactagaatttttgatacttctgatactcaatggttttcaactgggcaccatctctgggggatattcgaatatgcatgagcccaccagaatgaccgcatggctctactggccccctgtggggaggggccaggaatgctgaacatcactgtggctagagcagggcacagtgttgaatccacctgaccaccatgacaatggtgtatccaatgagaaaacaaactagggagatgcatcagacttaggaagctccgccatctgttcgcaggatccctgagaaccctggctattctacctttcctgcacttctgcctattgatccttctttgaagatgcttttcttctttggtgcctatgtccttctcactcttgaaatgactcaactacagaaaatcctttccctggtacatgaacaagggctttctcctttaaattcctccttagtgtgtatttattcttcaaaatattttctagaccatttgagacccctcaggctgtcgatggcagagaatgtgctgtctgatgctcatccatcatcctcccttgtcagatctgtctaaccagtccttaggccctttaggcaaggccagtttcagtcctggtgggtgtaaagctgagtaattttctcaggcacacataatggtgaaataatgatgatcatagtcagaattatgattttggtaagtggagtatgctgtgttttccaaacgcttatttttcattatgtatagaatgaataatggaagacacattgagctcaggacccggatgttctgtctgcgtacgtttccttctaataacttgagagaagcattcttttatccagctcatgtcatgcatgtcaggctgggtgtgcatgtgactgagcagaggaccctagagctgcatatgtgtcatgccacctgaggtttaagttatataaattcttgggggaaaagatctggtttatatttaaaaaatgcttaaaaggctggagaaaaggatcagagagactgaacagcctctaaaaaatacaatttcagggagtcaagtacaaatgaatcagggacttttgactctgcatgtttcccaatataaaacatctgaaaaatggatttaaactagaaataaatgaccagatctaaggattctgatagagaaagaaaaaatgtgctaacatgcatgtgtgagcatgcatgtgaatgtgtctctaataagcttacattgcatgagcttacaattttgggtcggtatgcatgtccaaatgcaggatatgggtacacatgaaaagcaggaaaaacatagtgtgctgaggatttgtttggtgtatatgtgtctattttgaagaatatggaagaataattgaggctactcatttaataaacatttatgtggttcaagggtatgatatacattgtccctagagacaaaaattagtaaaatttcagtttctttatatgctttgtgaaaaataatctccttttacaaaactctttagtattgtgtgcagcgcacagagcctagtgtcagtgtttctctggggattgaagcagacagttctgccaaccagcatggatgggggaatagcctgggcaggatgcaagccacatcgtgcagaatatgattcttagtggaatagaaagccaagtgccatggaagccaagacacgtgcaggcttaccaagatgccccaagccattggagagaatatggagtttctcagtgcacagaagattcagaagatttacttaaacttaaagggcaagtagaccttaagaagctgtaaaacttgaggacatccaagattctgacatatgaaatataatttctttggcacctatggtataccatacactcttagctactaaacttagctactttttgaatgcatgtttctgtgcctgtatgttttaatgcatacatcaattcatgtatagaacaccacttgaactgaacggaatacacaatagtttcaccccaaaatatttcttttgttgccttcccatcttttaacctctattgtttagattggatactttttttctttctttctttttctttttttttgggacagagtttcgcttttgttgcccaggctggagtgcaatggcacgatcttggcccactgcaacctccagctcccgggttcaagcgattgtcctgcctcagcctcctgagtagctgggattacaggcgcccaccaccacgcccagctaattttttgtatttttagtagagacggggtttcaccatgttggccaggctggtcttgaactcctggcctcaggtgatccacccgcctcagcctcccaaagtgctgggattataggagtgagccaccatgcctggtgcgataatttctatttatctttaagtttactgactttttactctatcatctctattttgctattaaactgatccaattagtacctaaaactcagtcctagtttttcttacttgcttcttgtgtatggcttctagttctgtcttgagaatgtccaccatcatatttgttttaaaagtgttcacctttactttgcagggcatagttttagcagctgctttaagatctggcaatttgcaacaattctcagggatggtgtttgttaattgtcttttcccttgggaattatttagcttccccttgctctttgtaggatgagtaatttttgattatatagtgcacatttttatcttactagactctagattctgttaagatcctttgagaatatacaggcagagttcaccaactaagactctgggtggtggtttacacaagagttcagttctcaaagcctttggtgtactgtcctgggtgagttccacacaagttcagagtgaacctgggactttatacattgctatacctgattcctttcttgagctccttctctccgtgatttccccctgctctccagctcccatgagccccctttctttgccatctgcctagaaagcaggagtattagcaccatactccatcccctcaccccctgccataaccttaatgttacaaatttcttgtgactgagtccaactccagggaaaagtggtgagaagaaagagaagaaaaaatgtaataggtattcctctacacttttcagaccacagaggctcctgtactcagttccgctggtcatgaagtatttttttagagttttagatgtctttgtggccactgctgctactatcaccactgctgcaagactgcagcgtcagcactgaggtttacctcagggcagggtcgagggaaggaaagaaagtggacttccccggactctccgtcttacaagccttatctttccacatcctcagaccaaaaagagtttatccaagagtttttgtttgttttgttctgttttgttgttgttgtttctgttggcatttgctatacagttttaggattctggctgttctaagtttaagccaggaaaggaaggaggaaaataaacaacaggacatttgccgctatattgttctttcttcaagttttcatttccctccacaagcttcctgctattgtttaaccttcagagctctcatatatttcatttatgtatttttgtcagttataatgaatgggagagaaaggataagatgtagttaccccataataacttggactgcaagtcttatagagaattaaaaataatagcagtaagactgactaaaagatagtctgatttttttttttttattatcactgtacacatgtaattttaaacaccatcagtgagcagacatctcccactgccctgcccttggtaaatcactgatatggggaaattgggagccgggagtaataggaaatagggctaaagagtcagctatgtttgtcatgggttattaaagaacttaataaggacggtgtccttcattctggagttctaaatatgcattggatactgagcgtattgttttaatagaccctgtgcataaaagcatagatgaagaattaacattgacctagtaaattataaatttattgagagtgaggaacatatcagctttatttttgtgcatttattcattcaacaactatatattgtgtataactatatgctacagatacagaaatactatctctctttaatggacctttactctgaagggagagagagataaataacccatccattttaatataatgtaataagtgttaccatttttaaaaagcaccaagtagttaagatgtacagtgaattggggatgggggtgctatcccaggggatgtgcagaggttacagaaggattcttatacgagctgaacttaagctgtaacctgaaagaaagaaggcgacaacctgaaaaatagagtgtttccaggtggtagtatgacaaaagataagatgacgttcttctagaattatgagttgtttccgttagatctgaaccacatgtgggaaaatgtgaggaagaaatgataaggaaatagaggcattagatcacaatgggccgtataggaatttatgctgtgtttgggatgatggtatcgtatggcctggtatgtgagtatggatcagatgttgacgcctacctaatattattattgaataaaaattaaaatagataatatttgtaaataagttttataaatgtgaaagtccagcagacccctccagttgtccctaaagtatcaggtgatagaagtgtcagtgaacagaagaggatggattcaagatatactttagaggtagaattaataagacttggtgatggatttgatattggattcaggaagcgttaagtactgagtatgacttctacatttttttttgagaaatgtgactggtaaaggtgccatttatgaataagagaaaaactgaaggagaagaaaatttgaaggaagataaatctagaagaatttcatgtcggacatgtcaaatgtgggatgcctatgagacttccatgtgaccatggaattgcctatggaagtgtagggttcatggaagagaaatagggtgaagatataaatgtgtgagttattgccataaacctgaatgttcaaagccacagaataaatgatattgcctgggaaatcattgtacagtgagacaagaatacctagaacctagccctgaggagaagccaggaaaggagattttgaaggactatccagagaggtggttgggcagttaggagattatgacattatagaagccaagaaaagctcatttaaaggagtgagttgtcagctatgtatattgctgctgagaagtcttttaagaaaatgctaagatgtgtgccatgaatttggacacatggaagtcattcagtgactttggaatgggtaggttcggtggagaggtgtgaacagaagctggattggactggttgaagtgtgaatatgaggggaagaatctgagacagcacatttggacaactgttctgagaagcttgactgtgaaaagaggctgtggagcctggggtcagtggaaaacagtggtgttaaggcagacattagaaggtgtgaaaacaaccatgaaaatgatccagtacagcaaaagcaggtgaagattgaggagaaagtccaggtagctgatgaagggaattccttgaaaaagtgagaaagaaacaaatgcatagaacaaaaggaggaattggttttttgatagcgggaagggaagacatttgttagacagttactgtaaagtatgaatagaagtgaaggggttgaggatatttccccatgagagttgcagtgatgggtcatgaaatctaagttttctaaaatgtaggagataatgagatggcaagcacaaatgttggtctgtacatttgatcatgagaaaatgagtctgtctgacggcttctctattctccctcctccggcccctcccccacctcagtggagcaggagacaggatcctcagcagaggacagcgtggatggagggagagggtggtgaggcactgagaagttggaagagcatgaagaaggggaaaaatgaaccttgagagtgctcaagtgtccatggcagttatgagtgcctgcttgagacaggcacgtatgagtgtacggagaagccagtttgtttttttgatgttcctacagcagacacagaggagacagacatttagattcatctaggatggggttttgccaggctagtggaacaagggagggaggcgaaggagttgagagtattttccagggagagagaacaatgatgcgttataaaatataaattttatcaaaagggatgtaaaagtaaaaaaaaaaaaaaaaaaaaaaaaaactaaaaaatgttggatcgggggatttaaatccctagtgaagaaaaataattgttccctcaagcgactgaacaaagattttaaaaaggtaggaagttatggacagagtgagatgcttaaattaatgccttcagaggtggttcagtttctgacaagttttaggtgtgaatgtggagtaggtcacagaagacagcagagcaaaaagtcatggaggtaagatcaagaatatgaggggccggtttttgacggattgtacttctggacgaggaggtcacagagaatagtggtaggagtgaggatgcagatggagactctaagaagcaaaggtttttattgaatagaaaaaaataataaccaggaagtcagtagagaacagaaatgtgatggaagaggaagaggcaggggtgtaattatttagataatatgagccttaaagatgtaaggtttgaaaaagatggagcaagctcagaagtttaactggaaaacaaagacaccaaccaacaaaaaaatatgtgcggtatttaaaaattgggtagcccccacttgacaggacacgtctccaggagagcccatgtccccgcctgagtatgagagtgaggtggaggcatctctccaagaattggatgctgtcagggagcgttgatgatgcaggagaggttcctgagtgcagaatggaaggactgcaaaagggtggggaggatgtggagtgcagtccgatgaagggttatatgaaacagcgggtgtgagactacaggaaatcatagatgactggagatttacgcgtctacaggagaggtcagcaaactacagcctatgggccagattcagcctgcagcctcttttctgaatggcctgaaatgtaaggttttttttttttctttttacatttttaaataattgagtatcaatcaaaaggagaatactatgttgtaacacattaggattgtatgaaaccacaatttcattgtccaaaagtaaagtttttttggagtgaagccacactcactgatttatgtattgtctatgactgcttttgtgctacagtggcaagtttaacagttgctctagaggccgctcagcctgcaaagcctaaaacatgtattatactagttggtcttttatagaaaacgttggctgaccctattttacagaattggttatggaagtctcctggagacgagtggtaactggagctgataccagggtcttcaaagcaccatgggatgctacagtggtgtgcaggctagctgtccccacaggcatcataggaaagcatggttaaggctaacacctcccgaaggtgtcactatgacttcgagctttaatgagaacacggtagtcacaggagcaagcttctgatttacctaagcaactgaataattaccttcagcaatcatgtgtgttctggttactttctctgtttgacgtgcaattttatcatctgcttgtgctctctggctctctcacactcccctcgccttcccctcccctcattccttcatcccagttttttatcagctgctaactccattggttaatgcatgagctcctgtctgctcttgtactgtaccatggaaggtgccattcaagtcttagagtggaaattcgtcttctgaagttgagatttagaactgaaataaaaaataacttaaaactcatcagttaaggttgctagttttttcacgccaagatccagtaaaatgttcctttattttcccttggaattatcgggaaggaggagttactggggttgaagaagtctagaggaatgggaattaatgcaacttacatcgagcagttgaggacaggaggaggcaggaaggacagcactgtcaatggcaggcaaagcccttagtcctgagaccaagcaggtgcaggaaagtcacaggagcatgttgaggctcattttgtagtgatggcagcagttttttccttgcctgtcccaggaaggtagagagtttaatctcactccttgcaatcattccactactaattacagacagacagagctgaatggccaggctgattccactaagaaaaaattcaacctaattgatgatgacataagaaagctctctgagaccatttttattagggcacactgcatgccaaggaagcagggacattggctataagagcttttaactaagaatatttgtgaaggtggccaaacctggctcttctcttattaattccaggcctagcttgatgaaggctcttttagttccccttaagaaatatggaataaaattatttagccttaggagattttaagacatctcttcatgaatccagccctctctctctctctctgtctctctcacacacacaaacacacacacacacagacacacacgagaaagaaaaaccttaaaaaatatacccactgttttcttaaaggtcatcaaagggtgttctgaatcattgatatgattaacaattgatatgatataacgatatcataatgaattatgataggctagaacagccatcaaaagtctagtcagctagtttattcattcaacctttgcccacatgatcatgtggccccttctacgtgctaaacctgctatagatattggagatgtagaggtgcataacagagtcactgctctcttggaaattagagtccagtggggtaaacatatataaataaataacaataccgtgtgattagcaatgctagagaaacaaataaacaataataaactaggtggggaggaggcccggaagtttgaatgtgacgaaagggttcccagagcagtgattgctgggatagttttgaaggctgcatagacatttgaaggtggacaaaagagaagacaaacaggcacagatcaatacaatgcctcgtgttttaggaacttcactggtgtgtccagtgggtgtagggggaagtgagatggcaataaagaacccagagatgtaggcaagagccagctcatgggaaccttcacattccatgccacggagcaatgtggagcagtggtaggatttaagcagaggtgggactgactcttatttttggcaattattttggcaataaagaaaagaataaatgggaggcgtggagactcataaagaggatattgtaataatccagagtagataatgagggcctgaattaagacagtaacaatgatgaggaaaagaagagaatggatttggaagctgtaaagtgagtggaaacagcagggtttgttgattgaaggtgaggaataagggaaagagagcaagcaatgtaactcacttttatcttacgagaatggggattcgacaatgctgccaagagagatcagatgcaggagttaagagcagatgtaagggcaaggtggtgaattcagcctgcggtgtctgggaagcatacagagtaggcatttcacaggcagttatgggcctggagctcagcaggtcctccaggacggccatgcagatgtggagatcatgagcacagctggccatctacagtgctgagatggcatttaaaagaataggtttacctggggagggggtagaagtagtagaggagtgggccttatgtgatgctgttatttagggattgaatgtcccaaacttttcctatagtttgttccttctaacatttttaaaattatttcccacgtgttaatcattcttccatatgtttgcacaacttctctcatataattttcagacccaatatatgagtatttgagtcataaataaacagccacattttactaaggagggaactgaggcccagttatttcctcaaggctaccagttcctaagagacgtcgccatactgaggattcaggagttctgtgtttgtctgcttgttttaatacattgcattctacccaagacccaggtgtgtgtgtgcctatatttagattttatgtgaagtgaagtagaaaggcacagtagtagtgtgcccagtgaaagagtaaatcggctattcttttccttcccatacaccgtctttttatagatttcatgtaggtgaaaattccacctggcagtggaatgctaagaacagaggggcaaggcattcaaaagtaagtgggcagagcccatgcacgtgtttccagcaggatgatttggcctacctgctggaaagtagctatggtgcagaatagattttgagaaatgtttataaagactcatttttttccagtcaaaggctttaattaaatgttacaaatacaagggctttcagtcatgtctccctttctcctgaggcccaaacaatcctactccaataggcttcctgctcttctgtagaattgtgctgtggtttcccaagttattcccttctgcacatgggctggtgtctgccctctccatgccaattgaaaatacacagatggcacttccatcttgagtattcctggcaccttgtagttttctcccagaatctgatctgaatttattcattagattgtcttaactatagatttgaccccaccccaggttttctgctccctctgtcccccaagtggtccccttgtcattgaggttttgcttgataccatcactaataaatgggattcttcaggaaagcctgcgttttgctctgcatctgaggatgctgcttgcaaagggaaagcctggcttccctcctccttctatgtgcaagaagcctctagttcatcagccagtgggcatgggcctctgcaggaatgggcagagccctgcatcctccgtgcatttcaacttagctttggtgggaaaagactttcccccatttagtgaaaaaagaactccccagatcgatatatctattcttcaaaaggattatttataagttatttcacttcccatcctccacaaaatatttaatgaaacatacgtaaggctctgcttccccgtggagtgatgttcttttgcctatcatcatctacatttttgcgggctttttcttggcagacatgtgagttgacatggatttggttctgcaccatcactaggggatgatccagaggatcatagcaagggggtaccaagccgtgtgtgtcctgggctccttttacatccttttcagagagctgtagaatctcttcttaaggaaaacacacaccaatgcacgtatgcataatattatttcctggtattcaaaacccctgaggttaacagttccacaattctcagattaagaacccctgccctacaaaatgtattgatggctaaatcataggctgccctgcttcccaaggctgttgggatccaggtagtgaaggtgacttcttatctgatcctgagcacaatggtgtcaggagaaccttaaccctttaggagcctcttaagtcaatagaattcccttaaattaatctgggtgaggaattgaaagcaattaactccttcaaagttatcagcactcagtactggcttatatctccagtgatttagaaaaagggaaagcaaacagccaagatactgaggcaatatgacattgcggagtgctatatttatcccctatcaatgtctttcagatcaaattggctgagtttacaaatcaaaagctgatttatttttttatttttatttttttagcagccatcagctgcactactgcaaatacacagttcccagacatcaagctgcaaactctaaacacccagctgtgtgctttctgactttgatatcatcacgcgtaatagagggtctgcatgcagatttgagctgacaggcctcctgagaaggctcacagcagaagagcacccaactccagggccagcccagcttctgaagccacatctgcaaagaaaacccacgtcatgttgttatgggaagggatgggcctcagaaatgcacagggcctggctctgtggagtacaaagggttcactttcttataattacactttaagttgaagcttctctttaatatgaagctaattattattcccagatttccctatcaaaaaaaaattaagggaatttgtttctacgtatctataaaatgttatagttgatatatgcgtagctatgcatattcaaccatatacacatattcagttccaactatcaaatgagttcttaatatgtgtcaggatctatgataaatgttttgttgatattgatagacacatatatgtgtgtatacacacacacacacacacgaaatttatagttggcaccagtttgtataatatttttattgaatctatatttattgctttatgaaaaaatctggttaataaattaatttaagaactattcatggccaggtgcggtggctcacgcctgtaatcccagaactttgggaggccaagaagggtggatcatgaggtcaggaggtcgagaccatcctggctaacacaatgaaaccccgtctctactgaaaataaaaaaaattagctgggcgtggtggcaggcgcctgtagtcccagctactcaggaggctgaggcaggagaatattgtgaatccaggaggcagaacttgcagtgagctgagattgcgccactgcactccagcctgggtgacagagcgagactctgtctcaaaaaaacaaaacaaaacaaaacaaaaaatactattcatttgcatttctagcttatgcaaagggtatagtgaacatggaagttgtttgaggaagggaacatggtgcaaaagaaggtatggcaaggtggaggagcccaggaagaagcagtttctgtgtatccaacagaaagggtatcctgagagaaaggaggagataagtttcccaggtataaaagaagttcaggtgaagtaaataggaatctgagctgacaaagaggcaatgtcgtggggttgttgccatatgcatactctacgacttacgcacagctcacaagcggccagcatgggcctatttaagaatgctttctcttatatgatgggaaccacctatttagaacaattcagctgtcccatttcccagagttgggctctatgtttgttatcaactgtgtgaggtctgtcctgcagtgttacaacaggcaaacgtaggtttgagcccttcagaacttttcctatgaaacatcttttaaatttgcccatttttggcaagatcatcagattctcttttccgccagccatgctacctgtatccaaaggaaatgtcaaggaactatgtgtaatatatatgtacgtatattacatatatatatagatataaaatatatttatatccttttatttttagttctgaaaccagagacattttttaagctctcagcagttcttacctgggctatgcagctatacctgcttttttaaaataaatgatcatgagaaattatatttattatcaatcacatcctgttttaagtcaagagagtagagttttctagttaaaggatatgtggtgaatcctttgtaagatttattattattaagttcctactggcaaagcagaggtctgattattatttcatttctgagttgagatgttcttgtatcaaggatcatgtgtattaaaaatgtgataaagcctaattagggttgcagtaaaaataaagatcatgatagctacgatttcctgagagcttcctatatgctaagtactttactcatatttagtcatttaatgctcacaataatactataaggtaatcttatgttctccattttacagaagaggaatctgaagtgcacagaactgaactgtcagataatactgtctatagggctcgagtgcagaaatactagagctcatcactgcccccacagtgcagccgggggaagtggtgcttacagctgctatcaactcttcaaccattgctccagcctagtatcaggcctacagaagctatcctatgcagatcattcgacatgaatgtcacattgtggaaacactttttaacactgatggtttcaccctgttgcagcggatattgctgtgtgggttatgtgggtagctcccatgtccccagccttgtctagcttagcggcacagatttgcattaattccatattactgtgcctctcagcacccatctgcctgcctgggaccctccgtttacctcagaactggctctggtatttcttggagtccctgttacgtgcttaaatacaagtcttcttgtgccaccccctttgacagtctctcacatggcctctgctgccacttggagtggggctgtttttgagccttattgttctatgctttccagctcccaggactgcactgattcctcaagggggacctggtgtgaagaaggccttccccagttcatcagcaggccttgacaccagaactcacagtggcaccatacacctctgtattagtctgttctcacactgctataaggacatacccaagactggataatttataaagaaaagaggtttaatcgactcacagttcctcagggctggggaggcctcaggaacttacaatcagggcagaaggggaaataaacacgtccttcttcacaaggcagcaggaagaagagtgagtgcccagcgaagtgggaagctccttataaaaccatcagatcttgtgagaactaactcactatcatgagaacgggatgggggaaaccactcccatgattcaattatctccacctggtccctcccatgacatgtggggattatgggaactacaatgcaagatgagatttgggtagggacacagccaaacctctaaagtctttcatgaaaacagcttctttcctttctggccaagcccactttcttcatgagacctcaaaatcagttcctggggcttgcacatgttggtattgaggaagaggagtctcacctctgtctgtcttatctcccagcatctgagcaaaaccatgccttcatccagtcaaaacagaaaaccttgaatgttcatcagccatcataatggcactgggggaatacaactgtccttgaggtcagcctgggtttaacaggaacacctgatgcaacctgagatggtggagagagcagaggctgcagagctggtgcaggactggaatgtcactgctagtcatgggatatgggctaaattttaaaaatgattccttccaactctccaattctgggattctatgttctgtatctttttcaatttctgacgtccaaagattgtatctcagctggtatatatgccataaaaatattaagcaaggaggcagctgtgtcctctcctctccagtagctacagctgtactcctgacaagcttattcttgggtatgataaaaatgatcactgtgggtattattattttcagttataaagatttttaatgcccaatctatgaagtcagaaatgtgggattttcttttccaaagggatgttatgcacacaagacagtctctgtcattcgattagttgtaaatgctaagctcagcactttggacaacaccaaaacccctgtggggatttgggggcaggtgtgatcacatatccagcttgcttcatttccctgcttcggttgtcgtattccacttaatgaaatagctgtatttccaaaaagttggctgtaaaacaaatttctgttagataaatcatacttcttcattgatctacacttttaaattaaggatgccttctcctgaggaaataattggccccaaaactaaatataaattatactacacactcgataaaccttttaaaatcacatatttaaagaaaatcttttctgttagaacactaatagtgatgatatttcctaaagtcaggaaatacaatgatcatgctaagaactacgactgtacatggtgttcttttgggattggggccacaggagggttaggtgagcaacaaggggtctctgactttttttcattgaattcaacgtgttgttctgggtctgtcagccagaagttagtcaataagaagttggcaaattttaaaattatgtaaactggtttcctagctgtcttgagagccagagatgtccaagaacctggtttctgctgtcaaaggccttcaatcgcattggaaaaagaagccccctgtgtgcagcacaagacagctactcaaaaacttgattacagttgcaggagcagtggattggacatcaggaggcctggtgtgctccatcactgaccagatgtgtgcccacagactcctctaagcttcagtttcccacaagaaaaatacgaggcttgagcgaaatcactagttcccaaacttgcctatttgtgagaatttcctaggaagattatgcaagcacctcatcccaggagattctggtttagtgggtatgagtgggacctagaattctatattttaagcaactactctagtgaattctactgcagacagactatgtactagcagagcaactatggaattatataaccattcatgtccccttaagctctttaattctgttatgattttaaagactagatgaactgaatgtgcaacaatagtgcagaacagccagaggcaccaagagttaggagacaaaagggaatgtattagtgtcccaggactactgtgacaaggcacaaaaaactgggtgctttacaacaagaaaactgtacagtgctggaggctagaagtcaaaatcaagtgattggttggaccatgctctctctgacagtgacaggggagaaccctccctcgcctctcctggcttctggtatgcaccagcaattcctggcgttccttggctcctagaagcatcactcctatcacatggtcatcttcaccctgtgtgtcttcacactaccctttctctgtgcatgtctgcccgaatccctttttataaggacaccagtcagattagattagggtctaccataatacctcattttaacttaattacctttgtaaagacctttttccaaatatagtcactctctgaggtactgatggttaggatctcaacataccttttttgggaggacacaattgaacccataatagggtgtttgcaaggaagagttaaaatttgaaagaaaggtggtatttgcttagatagatagggcacagctttctaggtgacaaaaaaaaaaaaaaaaaaacaatctgtgaagaacaaatcatcatgttggtccaggatgagaactagcatggcctggcaggagagctgcagcagtggcagtggtggcgtggtataccagttgtttagactaagttctacagagggcttctcctgggcccctcagtgtccccactgcactccacgtgttgtctttcacagcaaccctagaagtaggtaacgttattctgattgtgcagatgaagatatggtggtacaggggagttaggtgacctaccccatcatgaaactagagggtagagaattggtttcttctgatcccaaacttttgcctcttaggacgatgatctgttgccttcttcatagcacttgtgcaaaataaacttgggtgaatagatcagggctactttgtggagggctttgataataagggagtagagtttgtgtttgatgtgacagaaaaataaggagccatttctagtgtctgaagaagtggaccatgatgaaggggtatttcaggaagatgagtgtgttatttccacctgaggatgcattttctttacagaaagaaaaagcagacttataatgagaagctgttgaccgtgaagtttcttttcatagggttatatcaagtggtttgcctcttccccactgatgtctcttaaccaagaatatccttcagcactttaaagactatgcttgctttttttttttttacccaatatgctttgtaagttcctcacactagtgataaagcactgatcacttcatagccacagcacaaatgcttttaaacgaaacttttcgttgatttattaactctagaaagtcagattgcagtttagtgttttggggggcttgtttgaggcatctcctttaggaacctgattttgggtggttcaaagtttattttgttatgtgtaaactgaccaactttctctctggttttgccatatatgcctctagtagagaaaaaggtgggtgaggagaaaagtgagcataatgacaatgaaagcttaaatttattaagcatattactatgtacaagtcactttttacatgccttacccaacttaatcaaaaagtgtacatgtaataactggtgagcaatgaagtcattgtgatttctctgggattgcacatttggtccagggaacataggaaagtaggattaagcctcactgttcctgcaggatgacttgaggaaaaatctcctttctctggaattagaaatttggatcagtagagaccatacgccttccccaaaacttgagccacccaacgtcctttcctacacaagatcacctgacataaatatacaaaactacacataaattaatgtggcacccatgtccccacagaaaactgatgagttctcgattttgactgccttaatatttgtgtaactgcatttcagtccaggactgtcatgcctccaacaggcctttccatttggatgtccatgacaagttggcccctgcaaatctcgctgtggccacaaaagagcatatttgaattatggaattgaaacagatgcatgaactttagctggagagcacaagagatccagagaacctctgtctttttgtttgtttccccgctttggtgatgtaatacacagcttcacaggagacctgaggtcctatcagtccctgctccgaccctggagctcaatccagaaacagctgtccagagctaatttatttcctaatgctgcggcactgttaatttataaattacactggtaattcgagctattattaatttcagatggtgtagggcaagcctaattaaaatatgacaccaattgccacacatatgtaccaaggactaccatttaaaattaatgggaatattaagtgtgacactggtctccgagatgcttggcacagtaattatagcattctggcaggggaagatctgacaaatgtaagcccgtggttggtagcaaataaacaaggacaacacaagaggaattacagattcttcatttaaagctcttctcaattcttccacccatcctcaaatcaaggttagtacctttcccctaaagatgcttatcaaacaatattcataaaggctactgagaccattagaagtgtcttactggtaggaactatgagtctatttgggttaatgttgtttgtcctcttcacatcctggtctttttggctgtgttttctacttatgaagaggttccttctttgtcttgtgaatttagtatctctttcttgtttgttgtaatggacataggctgttcttttcctcttctgtatgtaacagaggcaagaaaccgtctgtacatacatagtgtagtttgcatatggcatgaagatgtatgagatgaggccccggttgggcctactgctgggcagtggcacagacttatcatggccaaagagtgctgatcgaatggaacaaggcagtggcccttgttcacaagaccatggtcttgttgttgttgctgttgttattgttattgtggttatcttgacaaaacagtgacttcaacactgttatggaacacatacaatcatcccttacataccgcacacatcatcccttgttgtatcggttttttacagctactgttttcgtgctctgggccagcagaaacacgtggcattatggaagggttttctcacctggagagaaatgtccctttgttccctttcttgggccactcatgttaatacagtgctgcaccccctgaagctgtgcctccaaccagattataggagtaataactaaatcaacaggtgggcagcacacgagagttttggagtgctttcgtgcatgtgtgtgtgtgagtgtgtacatatatatgtaggcatgtttgtgtgttagtctaaatagccccgtgaccctgtgaggtattaggattgtatgtatattatgtttgggaaaatgcttctcaattgctagggacagccttatgcctgttgtctgctaataatcattaattactagcacctcatttccttttaaaggtatccaggtttaggatgctgtctttctaattaccctcatttaagagagaagggaggatagcttgggatgtaagccctaacttttgtttttcattgtcttttggcaaggaagcgaaggctcaggtgcctctgggagagaactttgaaatctcctctagccttaaatatcttggtctttcaataactgagtgctcatggccagacgtcaggcacagagtctggtatgtgaagcgttgttattattactcataatttttcactgaagacaatgagtcccgcaatgattaggggactgagtggattcgcagccacgtcgcctgatgaatctctgacatgcttacaactaggcatcgagtgcggagtcccattgctggtctgtctttaggatcttgtacctaggagctctagcagatcgaagtttagcacgttgatttctgcctatccaattaattgtctgagtcaaaaaacagaaaattaaattttttatgttagtgtttctgctacctttgtgatgcacgtgtgtgtgtgtatgtgtatgtagctgctggtgtggcattttcaattaatttatgctcaagtgtgcagtcataaattttatattcaaggctcagtctaagtgataccttgagatcagaaagagttaaggtgcctgactcagatcccagagcacgacggcttggtaagatacaggcagtgtaaatgtcaaaattattaatcacttattgggaccagtaattctctaggcactgtgctttgttcagttaggaacacaaacatttcagctgttccactggggagccaaggaaaagttggtggtgcggaggtgtagaagagacggaggagggataacccacacagttcctcagaatctgaacttacaactggcaaattatctgcagacataaccattttatactttgttttctaagtgaacatgtttggtcttttttttccttgtatttcaccacacgttaccggttttcccgcagcggttggctttgtgagtgaagacgaatacttggaaattcagggcatcaccagggagcagtcaggggactacgagtgcagtgcctccaatgacgtggccgcgcccgtggtacggagagtaaaggtcaccgtgaactgtaagtgttctcaccaccacgcgccctgcacgtgcatcaggctggcctgttgtcacagccaccacccagagcccattggcacagccagctactgacttagggtgggaagaatgcagcaccactttccacactctgctttcaggagcaaacatttcaaactcgagtttttgacacttcaaggtgtcacagtgtcacgctgaaagaaaaagtagctaaagtaactgaaaataatgccaaacttgacttgcatggctggcagatcattaaatggcattcagctcataattttttaaacacgtcttcaaatccaaaattttcccataatttactcacacaatacagttgtgctggagcctctcactgtctagaccagacatctccataatgggacaagaaaccatgtgctagagtgtatgaaggaagtttcaaacttccatttatggtatgtctattatatctcattattttacaattatagatgtgcatggtatacatacaaatagttacgatatagatcttagaggatgtaacaataaatttgcttgttactaatagagatacagaatccaaaaagtttggaaggtgctgtgtggacccctcattctcctttctcagccttccagattgtctctgacatcaatcctacttgaatttgctacctcctttcactcttttccctctgggtccctcattatgtaccttgccttagctccctacaacattctggaggttttctctgctgtgcacattccaggaagacttacgaagcaatagaactcaataactaaatcggcaaacgagatgacttcccttcaaaacttgggtggcgtggagttaggagaaggatactgtatctaggagaatatccagtctttcagatttaggtttgtgttacaatgtgaacccagtcaatatgaagcggtttaagaagcaaggcaataggtataaaaatgctgtcattttaaaaatcatatcacaagtttttacaaagggacttaagaggatttacagtttataaagatgaacttaaaacataaagaaacagaagcaaagaaaaaatacgcttaggaaaatgagtgaaagctaggaaaacctcagcacatgaaatattaccacaagactgctaggtgcaggtgcagaatttggctcagccttgctaaagcaaagagggaaacatcacctgctttaagatttatgttgtccataagataaaagcaaattagttgcttgggagaaacactgcttttcgtggtactgagaccctagagaaaattctcttcagggtctccacaaatagagcactttgggagagagtcagcaacatcatgtacaatatttctgcattaaatagaatagccagtttattgtggctgtttttcataataccctttaatataaactggtagaatgtgaagagtagtttggtaaagacgtcaaatgaatgcaaaccaagtgcgtaggcctagcttggtcacttgctctggtttgattcagggatctgttttagaataccaagaatgactgatctgtatatccttcaggcaattctccttgaatattatttcttgcaactgagcttttgatgggaattgaatagttcgaggttatatacttttggcaagaacctggtgtgcagaaattctagaaggctgattaaaggtgctgactgtcaacccgtggagtgtagggttgatgggctggcatcatcctatgaaagttaaaaagtttaaacagaaaaaatgcttgagtacatggtcatttcaactctgtacagaggagaacaaaagcagtacatgaaaggaagacccagctttttcttagagcggcatcaaaaaggtttttattctctggtacaatttatgtagcagttttaccttctaagtaagcagagccagggcagagactgagaaacaaaatcaacaaatgaagcagccttcttcattttaaaatgctgtagatcaggtgcagtgccctgtaatcccagcccttttggaggctgaggcgagcagatcacctgaggtcaggagttggagaccagcctggccaacatggtgaaaccccgtcgctgctaaaaatacaaaaattaggcaggcatggtgccgtgcacctgtaatcccaattacttgggaagctgatgcaggagaattgcttgaacccgggaggcagaacgtgcagtgagccaagatcatgccactgcattccagcctgagccacaagagcaagactccatctcaaaaaaaaaaaaaaaaaaggtgggggggcggctatgagacatcttctttttgcagatccaccatacatttcagaagccaagggtacaggtgtccccgtgggacaaaaggggacactgcagtgtgaagcctcagcagtcccctcagcagaattccagtggtacaaggatgacaaaaggtaaagcttccttctttcctatcccacccctacccccatctccaggagaaacttttccagggtcctgattccacattgttgcaaacgagttctataaaatcctcttctgaacttatctctatagggggcaaatgtgcaaagaagtcttttcttaacattaatggatttcagctacgtttttaatgtcaccatgtagaattatcactggccaaccaacagatctgaaaggtaactttttttaggaaggcaaaatcacaaaggaaaggccaccaggagcattgtaaggcctgtgaattttttataggccaagaacataatgtgttctgcctgaagctatttttaccacattctcaggcttgcgtaaaggagttaggaaggctctcagggccctgggagtggctaataagttagctgcagctagtaggtctcccctcctgttccagacactatcagtagcggtgtataagagtccatgacccaatttagccctccctttgtgcccaagttgttcttttactgtaggagaaaagagaagggactattcccttccttcccattgtcacagcatcctcgggatatttgttgtgagtcactgaagatgatcatttccaggctttatcaaatgacatatcagtgcagggatcagtagctcagtacagccaggcaccatggcaattgctgttatcaaagagccatttttaagggggatgaacaacgggaaatgggcaagagctgcctgtgttcagaacattttcattgaaaaagaggtggtggtataggggatgctagagagtcctgaggtgtatgtggggtggagtaagagcaaggagtgggggaggccaggaggctgagaaggaaaaacaatgaagagggcattctgagaaggagagcagcatgagaaactgcaggccaggagcaagtgaatggccgcccacgctgtgtgcacgtcttcagccagccttggctttgtttccttatgaggtcagtcagaaacctaaagctctttctagtctctagatcgaaaattgaattttgtttagaaccacgtcaatcagttttaagattcactgggttttatcataatcctcccaaatgaaaagcagtgttttgtttttttaaaaaaaaatttttaaggacacattctggcagcttctagtgagatgtattatattcatgtagcccattttacagatgaaagaactaagacacaaaggggaaaaacaaactcatgaagaaatagagctggctttccccttcttccaagaaagaagaatcaagcagactggagcgtgtttttctgataaatatggtttccttacttagaaattctgtttcacttatgcgtttcctcttcgaccttcttattgtactaagaagtaaactgaggcataaaaattaattattgaaccaaaccaaacaaaaaacctattgagctatggggtcagttcccaaatcttcaattgtctaggtcttaatgaaaagtcatcagctgcgtcctattattccaattctttattggagaaaaatagaaaaaatacatataagggaaagcaaaatcttagaggaaaataaagcaaaagtggccaatggcgagtaaaaggatgagagagctctcctctgtgcagcatctctggtcacaatagggacagctgtccctgccaccattcacccaggaggagagagcaggctggcagggccagggacagtcttcagaggcccctggctcaggcagctttgtttctgtctttctttcagttcttctgatggcctctccttttctcccctttccatttagtggtttagtcagttttcccttccctgcacatgtatttatttatttccagtgtgctggcatgagacaggggctgtctttcctcctggcacccagctcagctgcagcatccctgcctctgaggtcctggtcacagcaagttgggtctgccaggtaggtctcccaaggcatattgtgtctgccctggggggaaggccagctctagcccatctcccattttcagtgagatgagcagactaccaaggcagattaaaggaaactgtgtggtgaggacaggcagttttctcaagagttagttaggtgagaagtcttttggccacatgccagaatgactcaactgcacgctattgtatgtgttatccaacaaaggaagaggaatggaatgctatacctacggaaggccacccatccaacaggggcattgaccaatgaaaagtccacagctttggtaagaaactgaggcctggaagcagtgcgggatggaggggatgtgtgcccgcacagagaaggggaaagcgtgtcctcccaggagctgcaaagcctgcaaagtgctgctggccccctgtgctgtttttagctaaagacatttcagagctgtcaagcaggagcctactttcagttaagtctctccccactgcagagctgaaatctcattcacagtttggttatgatgggaaagcttcctccccatggtggacgaatggtgtcaaaacggccagtgggatcaatcagcctgacttgctcgcagaatcctcccggtgagtggtatggacagcaccccctagaggatcaatgtatacatagcaagctggaaatgtaaaagtggcctgtggctgcacagccggatgcctcattccatttggacagtgctagcattttaatgaagccgtggactcaggccagttcattgcccctagcgtttggagaggaaggctcccagaggaacatctacataatgaaaagcaaggcaagtctgtccaacctatcttctgacttccctggaggcagatgttgggtgagaactccggccagaacctgcctctcttttctgatcaaggttactgtaagttgcaggagtggagaaattattctgtaatcccacagagacaggtcttcagataatgacaaagcagctgcactctatgccaaaaaacactgtgacccagggatgggcaagagtcatctatgtctaactccatagaaatacattatactgatgccattgtgcggtccgcaaagcatttcctcatcattgtcaaacagccttgagtactgtttgtttttctcaatagcatccatttgccccaaagcatgtcccctgaatctgttccagtgtgctcccgccatgttattatctgcttgctacaagctgtgctccagccaggccctaaacaggaaacttagctttgtgtccatattccctgagatccttcatcaagaaggggttttttgccccaagagtattcatctttcccatagcatagaatcagcttcagggcaaggattacagattgtttgtttcagggaaaaagtaaaaggttggcttaaagctcattctaagaaatggacatttcggaatcttgcaaaggaaagtaggtggtatccatgatcgccataggaattgctgttaacaacttcctgagaaggaggacatgtgcctactgactccaatagcagctttctccttacccttttatctgcctggtaatagaatccatggttctaataagcatacctcacttcccccaactaactaactccctgtggcatttctgtagtggcccccagaccaatgcaagtccttgtggcttactgggctgccattgtggagctcagggagactgtcctggctctaaagggacatattcttgggaacctctaatccttccagactaatcctctataacagtctgggcagatcactcctcccaagcccttcagagtcccctgatgagaaaaatgagaaaatgatgatttttctcctcttcatagccaaaaaattaagtattatctatacaatgcaatgcttctggtgcttcaggagaaattagattaccaggtgctcgaaaaacatttttctttcaaattcctcaggtggctcttctctcagaagtttgagtttttcatttgcatggttgtcatcatcaccatcaccatcatcatcatcaggcccacacatttgaaccacctactgtgtgaatcgtattgctctgaatgccacacagctggcaggggttatttgttgtggtgttgctgtcagactacaaagcaaggatgagaggctagggagatcagatgttctggtaggagtgcccctgggcacatgtgtgaaaatcaagaaacaacgtgtcactcactgtctgtgaactactactacattatggtgtggttgagtggatcaaataatggttataatgatgtcagaaaggggggcaaggagaagaccaggaatccctgggcctatcttcttcctatgaggacacataaccatcttgttttcttcttttttgtcttttgtttctctcagactgattgaaggaaagaaaggggtgaaagtggaaaacagacctttcctctcaaaactcatcttcttcaatgtctctgaacatgactatgggaactacacttgcgtggcctccaacaagctgggccacaccaatgccagcatcatgctatttggtgagactgtgctctgagctgggcaagaagaggggagagggtgcagaacgggagagctgggtgggagggcccctcaaggccagggtcagaggttagcagggtatcagtggacatggagagggaggaaaaaaaagagagagacacagaaagaaatggagagagagggacagagagacagggaggaggcagacagaaagagaaagaacaagagatacagtttacatgtatacaaagtagtatatgtatagtacatgtataaaagtagatctcagaagtgggaaaaggaaaatgaaaaagaatgttcatgtttcattctataatggaaaagatcccgagataggagaaaaatactttggaatgccaaaaatgacatttgattttttttttctcagtgatgatggctcctaagctgactgtgggaatcataattgggtaaaatagtcaagaactcagaggggaatgtttgctatttcagtctttgcttactggcttagtgtaaaattttcctttttccaaaactgtctccagtcgctgggacatgaagagccccaccttcgtcacatatctggctactgtattgatatcagaagaaagtgagcgagctcccttgtaaaccctgatgcctgcccctgctagcagacagctgtgcagacatgagcctgccttcctggtggtgccaccaggcagggccctgggcctctcatgatggctccatcccttgatgaacgcagattctccctaaaggccacaggattaaattccggttgtgttttgggcaaattccttcataccccatcaagttctttgagcttgagatttttcaaacctgtctccccaatccctcatgttaacaagcactcttgaatgtgatggggaagtaaggggaggcatttgacagataatttgcaagaacacaaattccttatattctgaaaactttgggataatcccatggcccagccatgtgccctcggtgctagcgtatgtggcttgctctgaatcacgagcctgcactgcttcaccacacgatctctgctcacccattacatcctcctgcattctacccggcacaaatagtaaatcccagctttatctgagagagctgggaaggagaaagccgcccttgatccccgagccagtggcttggaatgggcagagctgtgatttgagtgattgatgtgtctggcatctctcacacagggatgatcataagagccccttgcatttttcatgcctttttgcctttttggcaggcgtctgtctgcatgaacagagaccaggattaggaaggaacagacccctccttcccttgctttgcaaatctaaatctaaggctccccctcagtttcccattaacccaagtcctgctctccacccacagcactcctcatcctcacaggggtagtcttccccccgccaccccccactttgacctactctctcctgacttggttgcatgaaatggttcagccattggctttatcatgattgtatacttccccggcttcttctccttaagccatctcaggatgagaatagggagaagcagcaaacaaacagttctcgtaagagttgaatagatgacatttatgacaaggaaagcagtgaagtgcaggtcataaatatgctcttttcagcaggcacacatgtagcaattacaatgtctacttcccatgccccccaccctatgggtctatcaatcagcatctgccctgtgcctcctttgggacgtttctaccattgccagctctctggcgtccagggttttctaaaaaggacatggaaaagtagtagtatgtattcaaatatgtttagaaagagtgggtcacaccaagatgagtggggtacatgtggggatgttctttaatgccagaagtcccggagccttaacatgctaaatctctaggggagaaaaagtttgcaggatgtttcaatcagaaaccaatttaatttgttagcttcagttgagagatcattcctgaggagtccatcactagcaatgctgcctgggtaacataattctgtggagctcgcaaaccccattcctgtgtgagatgagtatttgcagccaatagttcggatgttattgtggctcctaggttcattattgaggctcaccatcaatgaggtcttttgacaaatatgaatttgtttgtttgttagggaattttccatgtcagtttccattaaaagccaacaagcacacttggggcaggttggaaagcagcatgtactttttgcgaatatacaaacttcttgatgaagttagaaaggcagcaaaattatcatcattttgccaccaacttgtgcataaactgcacgctctctccaagtggcctagacgttgagaagtgaggaattctggtgcaagagaccatagtcggcggtctgggaatacttaagccaaacgggagcaggttagtccttcccatcacaagcacctgatcgctaaggtgacagggcttgcaggggcctctgagagttctgctcccgcactcctgaatcacagtgctctggggagctcgttcgttcctaccgtggtgccaggggcaaaaatttctgaatttggtgtcctaagatgaaacgatgggggtggggaagtgggaaacaagtctcatctggaaggaaactttagtcctttgttatccagttagtagcatggctcagcatgagctaagagtgaatccaactgcaccagaatatgtatggcgtaaccagctccctgccttcccagtcacggcattcaatatggaaacataaagcatgtcagcgtttctcttgccgcaccttgtcctacgcctttggtttctgtcttccttttttttatataatcccccagaaatgtctgtgaaaggcagtatacaaactatatatgacaaatatatagcactgtatataatatatgtgtttgttctcatttttctctcctgtgtgtccctcaaccgatttagaactaaatgagcctacgagctcaactttgttgcaaggtcagtatcttccttgctttatgttttgtctccccttccctctatcccagaggcccccttcccctgctgtgcattacccgaagcacttgtctgtaaagtgtcttagaggatgtggaaggctattgaaggaggtgattgattgggagccagggagacttcaagctccctttgctttgctcatcccttgctctcactcccccaggagggctgggaaggggaaagaaagaaagaaaagtatcgttaaattctcaatgcccagggatcagcacaaaggcaaagggtagagagtgagtctgggacccataggaagactacttcaactgactgagcagttttcataaaaagggtcttattgatgacccctcagcagcagagtcagacaccaagcacatgataattcagatattctgtcaaacgcatcaactggctcatgaggttctccaaaggaggaggataggcatggcactgcatgagtggttgccaatacacagtgatttctaggggtgctactggggtccaggttagggcctgacgtccagtagctctttggtcttgggtgactcactaagcctcatttagactcaatttcctcttctttacaatacagttgatctaccttatccaccgtacagagttgttccaacagtcaatggagaatgcatgttacaaaggctttgaaaactgtgaggtgcatgttgaatctccaggcataaactgaaagacaaggatgcccctcagtggaacatcatagggggtccttcactcatttctcagccccttctccacagtccctttacatcctcttccacttccagtcctcccctgcaaatatctcccgcgtctcttgcctgtctttgcacatcccttccaattttctcactagcctagagtgagtgactcattaagactatgactatgactaagcatccaagcaagcagtggaataaaatgggtgccgcgtgcactgctgtcaccctgaggacagtgctgaccacagcagtagcctttcaggaaggcagctgtgaagccagggaggggaatgcttctcccaccttccatcccaatcccctgacctcctctccccacctcaccccaccctgttcatcccctcacattctggccttgcaaactgtcatcagaggatggctgtagactttggaggtggagggggagatgaaaagaaatgcattacatgggaaggtgcatgacagatgaaaaaaagtacctttttatcatggaaagagtgagggctgcattactcactttagtgatgtacagcaccacagcgatgagccacaagcaagaaaatgaaacaaagaaatagaaaaagtgaagtcaatagacttattcagattcaacctatgattcaacttacgtttattgaacctccatgtgactgtattcacagacgtaaaatagagagcagtagaaaagtggctaacagctgaggagccaagatggccgaataggaacagctccagtctacagctcccagtgtgagcgacgcaaaagacaggtgatttctgcatttccaactgaggtaccgggttcatctcactggggagtgccagacagtaggtgcaggacagtgggtgcagctcaccgtgtgcgagccgaagcatggcaaggcatcgccttacctgggaagcacaaggggtcagggaattccctttcctagtcaaagaaagcagtgaccgtcggcacctggaaaatcgagtcactcccaccctaatactgtgcttttccaacgggcttaaaaaacggcacaccaagagattatatcccacacctggcttggagggtcctacacccacggagtctcactcattgctggcacagcagtccgaaatcaaactgcaaggcagcagcaaggctgggggaggggcgcctgccattgcctagttagttgtttgattaggtaaagcagctgggaagcacgaactgggtggagcccaccacagctccaggaggcctgcctgcctctgtaggctccacctctgggggcagagcacagacacaaaagacagcagtaacctctgcagacttaaatgtccctctcagacagctttgaagagagcagtggttctcccagcatgcagctggagatctgagaacaggcagactgcctcctccagtgggtccctgacccccgagtagcctaacgggaggcaccccccagtaggggcagactgacacctcacacagccgggtactcctctgagacaaacttccagaggaacaatcaggcagcagcatcagtggttcaccaatatcccctgttctgcagcctccgctgctgatacccaggcaaacagggtctggagtggacctctagcaaactccaacagacctgcagatgagggtcctgtctgttacaaggaaaactaacaaacagaaaggacatccacaccaaaaaccaatcagtacatcaccatcatcaaagaccaaaggtagataaaaccacaaagatgggataaaagccgcaagatggctgaataggaacagctctggtctacagctcccagcctgagcgacgcagaagatgggtgatttctgcatttccatctgaggtactgggttcatctcattaaggagtgccagacagtgggtgcaggtcagtgggtgcacgcaccatgcgcgagccaaagcagggcgaggcattgcctcactcgggaagtgcaagggatcagggagttccctttcctaatcaaagaaaagggtgacggatggcacctggaaaatcgggtcactcccacccgaatactgcgcttttccgacgggcttaaaaaacggcgcaccatgagattatatcccccagctggctcggagggtcctaccccacggagtctcgctgattgctagcacagcagtctgacatcaaactgcaaggtggcagtgaggctgggggaggggtgcccgccattgcccaggcttgcttaggtaaacaaagcagccagaaagctcgaactgggtggagcccaccacagctcaaggaggcctgcctgcctctgtaggctccacctctgggggcagggcacagacaaacaaaaagacagcagtaacctctgcagacttaaatgtccctgtctgacagctttgaagagagcagtggttctcccagtacgcagctggagatctgagaacgggcagactgcctcctcaagtgggtccctgacccctgacccccgagcagcctaactgggaggcaccccccagcagggccacactgacacctcacactgcagggtactccaacagacctgcagctgagggtcctgtctgttagaaggaaaactaacaaacagaaaggacatccacaccaaaaacccatctgtacatcaccatcatcaaagaccaaaagtagataaaaccacaaagatggggaaaaaacagaacagaaaaactggaaactctaaaaagctgagcgcctctcctcctccaaaggaatgcagctcctcaccagcaactgaacaaagctggacagagaatgactttgacgagctgagagaagacagcttcagacaatcaaattgctctgagctacgggaggacatttcaaaccaaaggcaaagaagttgaaaactttgaaaaaaatttagaagcatgtataactagaataaccaatacagagaagtgcttaaaggagctgatggaggtgaaaaccaaggctcgagaactacgtgaagaatgcagaagcctcaggagccgatgtgatcaactggaagaaagggtatcagcaatggaagatgaaatgaatgaaatgaagcgagaaggaaagtttagagaaaaaaagaataaaaagaaaccagcaaagcctccaagaaatatgggactatgtgaaaagaccaaatctacctctgattggtgtacctgaaagtgatgggaagaatggaaccaagttggaaaacattctgcagaatattatccaggagaatttccccaatctagcaaggcaggccaacattcagattcaggaaatacagagaatgccacaaagatactcctcgagaagagcaactccaagacacataattgtcagattcaccaaagttgaaatgaaggaaaaaatgttaagggcagccagagagaaaggtcgggttaccctcaaagggaagcccatcagactaacagcggatctctcggcagaaaccctacaagccagaagagagtgggggccaatattcaacattcttaaagaaaagaattttcaacccagaatttcatatccagccaaactaagcttcataagtgaaggagaaataaaatactttacagacaagcaaatgctgagagattttgtcaccaccaggcctgccctaaaagagctcctgaaggaagtgctaaacatggaaaggaacaactggtaccatccactgcaaaaacaggccaaaatgtaaagaccatcgagactaggaagaaactgcatcaactaacgagcaaaataaccagctaacatcataatgacaggatcaaattcacacataacactattaactttaaatgtaaatggactaaatgctacaattaaaagacacagactgacaaattggataaagagtcaagacccatcagtgtgctgtattcaggaaacccatctcatgtgcagagacacacataggctcaaaataaaaggatggaggaagatctaccaagcaaatggaaaagaaaaaaaggcaggggttgcaatcctagtctctgataaaacagactttaaaccaacaaagatcaaaagagacaaagaaggccattacataatggtaaagggatcaattcaacaagaagagctaactatcctaaatatatatgcacccaatacaggagcacccagattcataaagcaagtcctgagtgacctacaaagagacttagactcccacacattaataatgggagactttaacaccccactgtcaacattagacagatcaacgagacagaaagtcaacaaggatacccaggaattgaactcagctctgcaccaagcggacctaatagacatctacagaactctccaccccaaatcaacagaatatacattcttttcagcaccacaccacacctattccaaaattgaccacatagttggaagtaaagctctcctcagcaaatgtaaaagaacagaaattataacaaactatatctcagaccacagtgcaatcaaactagaactcaggattaagaatctcactcaaaaccactcaactacatggaaactgaacaacccgctcctgaatgactactgggtacataacgaaatgaaggcagaaataaagatgttctttgaaaccaatgagaacaaagacacaacataccagaatctctgggacgcattcaaagcagtgtgtagagggaaatttatagcactaaatgcccacaagagaaagcaggaaagatccaaaattgacaccctaacatcacaattaaaagaactagaaaagcaagagcaaacacattcaaaagctagcagaaggcaagaaataactaaaatcagagcagaactgaaggaaatagagacacaaaaaacccttcaaaaaattgatgaatccaggagctggttttttgaaaggatcaacaaaattgatagaccgctagcaagactaataaagaaaaaaagaagaatcaaatagacgcaataaaaaatgataaaggggatatcaccactgatcccacagaaatacaaactaccatcagagaatactacaaacacctctatgcaaataaactagaaaatctagaagaaatggataaattcctcgacacatacactctcccaagactaaaccaggaagaagttgaatctctgaatagaccaataacaggatctgaaattgcggcaataatcaatagcttaccaaccaaaaagagtccaggaccagatggattcacagccgaattctaccagaggtacaaggaggaactggtaccattccttctgaaattattctaatcaatagaaaaagagggaatcctccctaactcattttatgagtccagcatcattctgataccaaagctgggcagagacacaaccaaaaaagagaattttagaccaatatccttgatgaacattgatgcaaaatcctcaataaaatactggcaaactgaatccagcagcacatcaaaaagcttatccaccatgatcaagtgggcttcatccctgggatgcaaggctggttcaatatacacaaatcaataaatgtaatccagcatataaacagagccaaagacaaaaaccacatgattatctcaatagatgcagaaaaggcctttgacaaaattcaacaacccttcatgctaaaaactctcaataaattaggtattgatgggacatatttcaaaataataagagctatctatgacaaacccacagccaatatcatactgaatgggcaaaaactggaagcattccctttgaaaactggcacaagacagggatgccctctctcaccactcctattcaacatagtgttggaagttctggccagggcaatcaggcaggagaaggaaataaagggtattcaattaggaaaagaggaagtcaaattgtccctgtttgcagatgacatgactgtatatctagaaaaccccattgtctcagcccaaaatctccttaagctgataagcaacttcagcaaagtctcagggtacaaaatcaatgtgcaaaaatcacaagcattcctatacaccaacaacagacaaacagccaaatcatgagtgaactcccattcacaattgcttgaaagagaataaaatacctaggaatccaacttacaagggatgtgaaggacctcttcaaggagaactacaaaccactgctcaatgaaatcaaagaggatacaaacaaatggaagaacattccatgctcgtgggtaggaagaatcaatatcgtgaaaatggccatactgcccaaggtaatttacagattcaatgccatccccatcaagctaccaatgactttcttcacagaattggaaaaaaaactaaagttcatacggaaccaaaaaagagcctgcatcgccaagtcaatcctaagccaaaagaacaaagctggaggcatcacactacctgacttcaaactatactacaaggctacagtaaccaaaacagcatggtactggtaccaaaacagagatatagatcaatggaacagaacagagccctgagaaataatgccacatatctacaactatctgatctttgacaaacctgagaaaaacaagcaatggggaaaggattccctatttaataaatggtgctgggaaaactggctagccataagtagaaagctgaaactggatcccttccttacaccttacacaaaaatcaattcaagatggattaaagacttaaacgttagacctaaaaccataaaaaccctagaagaaaacctaggcattaccattcaggacataggcgtgggcaaggacttcatgtctaaaacaccaaaagcaatggcaacaaaagccaaaactgacaaataggatctaattaaactaaagagcttctgcacagcaaaagaaactaccatcagagtgaacaggcaacctacaaaatgggagaaaattttcgcaacctactcatctgacaaagggctaatatccagaatctacaatgaactcaaacaaatttacaagaaaaaaacaaccccatcaaaaagtgggcaaaggacatgaacagacacttctcaaaagaagagatttatgcagccaaaaaacacatgaataaatgctcaccatcactggccatcagagaaatgcaaatcaaaaccacagtgagataccatctcacaccagttagaatggcaatcattaaaatgtcaggaaacaacaggtgctggagaggatgtggagaaataggaacacttttacactgttggtgggactgtaaactagttcaaccattgtggaagtcagtgtggcgattcctcagggatctagaactggaaataccatttgacccagccatcccattactgggtatatacccaaaggactataaatcatgctgctataaagacacacgcacacatatgtttattgtggcactattcacaatagcaaagacttggaaccaacctaaatttccaacaacaatagactggattaagaaaatgtggcacatatacaccacggaatactatgcagccataaaaaatgatgagttcatgtcctttgtagggacatggatgaaactggaaaccatcattctcagcaaactatcgcaaggacaaaaaaccaaacaccgcgtgttctcactcataggtgggaattgaacaatgagaacacatggacacaggaaggggaacatcacacactggggactgttgtggggtggggggacgggggagggatagcattaggatatatacctaatgctaaatgacgagttaatgggtgcagcacaccaacatgtcacatgtatacatatgtaacaaacctgcacattgtgcacatgtaccctaaaacttaaagtaaaataataataaaataaaaaataaaaaaagtggctaacatacagtatcagggaagtgagagagcctagagcatggacatgcattgctatggctatgctttcagaaggaccgagctagttctgaccactgagatcttcattctcagaggaaattggagcttttgaaactcaggtaggggtttttaacaagagagtatttaacagaaggtgtactcaactcacagagagaacaccatcccatagcaaagtcaattgcaggaaaaccaaccagaaacacaaattgaaagcaaacaggttactttacctggtcactgagcaggggcaaggagcccccatctgctgagacaaagctgggctgctcacttctctcctgtgaactgatgactctggttggaaggctttctgtgccaacttgctactctgattcttcggatgtgctcagcccctcatctcagcaaccttcttgggtgtaggagaatgggtcagcgaagaagactgtggatatctaaaacgttatgacagttggattagtacagtcttcagtagagctgctagactcttgtacaatgagaaattatttagagaaaacagcccttgcacctgggctcatttactgcactgatgtgttcattcccccgcctcctttgctagtcttcgatacaatagagagctatgtattttctcaggaaatacgctccaagttatacttaccttacctcagaaataccaggaaagatttatatgaatgcatggatttccactgacagagtacacttggctttaagagaagttcaaagctattttgctaaccaatatctggatggactagaagtattttgataagagaatttcattcttcctcagcattttctgccaccattgaagtattttactgcttcccttctgcaaacaaaacagattgcatgtcacctctcctattaatatttggtggtgcaggactctcacggtgataaataaggactcaaggatgttccaccatccctcactgggcttctgcacagtaaactgtactcaggccactgtgcaaactcagcggctccgtggctgttcattttccacccactggtcctttgtcttttatctcctgggcattaagtcagatttgatggtatcagtgggctggtaaaggttgactgattaatgtctgtaaacctcaaagtgaccatcaaagcaatttattaaagaatggggactaaagtaaactctgtatatcagaaggaaacaattgcagcagaagagattattagttcttccctgcagaggattaaagacagttaattaggccaagtcatccagtggttaagcatttctatggtatatgtgtgtctagataacagaaagcacaaaagaaagaaaattccctcaccctcttgctagaaggtttgtatatccgtcttcacatgaaaccagccctcctctgcccactagagccagacaacagccctttgcttatctggacactcggattcagccaaactggctttgctggcaaaaatataactttctggattgagcagacattgaatattgacttagagatgggatgggagggttctttttactgttgttttcttcttgttgtattttctgtccccctctcccctttcctctctccctttcttccttcctgtctccctccctccctcccttccttccttccttccatcctttttcttcctttcttttcaacatattttcccaccctccctgacctgttgttaatataccattaacaaagagatcaattaaatttcagttgaagtcttggtgtggaaaacgcatgcttgacaagcttgaattttcagggattgtttatgttcctgatagtcaaaatgttactcaaagactggagtttgtggccaggactagctttggtggctcaagcaaggctcctgcttctggaagcaggacacaacacacactggacagaagcatgtcaagcatggcacagaggacagtgccagcatgtgcaccttctccttagtaccaaagcaaggggggtggactggaatgagcatgatgggtttagagtatatacgaaaatatcctggcatttccacctcattgtggcgggctagaagtgggatcaaaaggaccctctagttgactggaaaggttgaacaactgctacctggaaaagcccaaggatgagttctagctaaagtcaaggatgagcatcacattttctttacctatgtggacactaaaaagagttggccatctttcaagtagtgtgtgttggagatttagaggaagagaaaaaaaccccatctggatggaataattaagctgaggtttttttgggggggtctttgtttatagaaaacctcttttattttcagcaggaatttgtgctttcaatgcattcttctttctgatagtctcaactgccaggtgaaggctcttcctgtgtccttcctccagcacagtctgaaccagtacgcccatcactgtctggatgagccccccaaaactgcttgtggtttgggggtaaaagttttatgattactttatctccccaagtctgtctttagtctgtccttcctccttccagttatctttttttcttggcacagagaggatcaaaaatcaccggtacctaaataagacaattaatgaaaatagcccctccccctccttagcttctgaacttgtttctggggcccagcaagcccttcaagggaccatccttgttaaatgcacaggcaccatggcatcatcacccctggcttttccctaccgtcctgcagtacatcagatattttctcaatcacaaaacttttgatcgtcgataaaccctttccctctttgtaccttcagggtggcttctcagggccgctaatgcccacttaaatcaagagggatatcgtgtgtcaggtgattttaaagagtagattgaaggtgtgaatgcacaagtacgtattcatctgactttgagcaaatgttttagttgcttttaggatgagttatatctaggttgtctttctgtatgcgaggacctttgcacagagaacacagactcccaaggcatcactttgatgcaaaaagctttagtgccattttccgtcctctctgtatccagggtgaacgacaaagagggaagtaaaagattagagatcattccaaattcaggccaaacaaggcatctgctatccacagaaaaggtggagagactccataggttgttctgagagttgaagctggtgaaatggagacctttcacagcctaggcagcagagaggggccagcctcccagcatttctacagggaggtcccagcaagtgcaactgtagcagcacgggtgtgggtcagagccgcaggctgccccagagagatgaagccctgtgggaccagcttggtattgtccagctcatcaagaaaagtcaaatgtcaatggtttggtctcctctggtacatggaagctgactcaccagtgtttctaaatgcatagctaaatgccagttaaacttttgcatttcaaatacagcatgagcacctacattcaaatgctgtagtataaatccatatgtagcaatcaactttatacgtaagacctacaggcttcaactaattagaggatagcctgatgaccaaagaaagtaagttgttctacaaagcctatttggtttggtgtctcaggctccaaaggtgcagctgtgtcacctgctaaaatcaggcggacatcttggctctgcttccatctgtggtccaatctgactgtcgttcacatccttctccagccatctgctcacctcttgaggcaactggctgcccaagtaaaccagaaaaccagaggggggtcacataggagggctgggcagtggtcaggacagcaagggacatgggcaagaggcgcagggacgctgctgcgccaggagcgccagcttcttcctgaaatcatctgagggcaaagtgagcatctccgtctgctttcgaccttaacagtggcttgtttttaatttcttttagaagtgaaaactacagccctgaccccttggaaaggtttgtatatttttcagacagctgctgccttggtgggtgtggggtatgtaaaactcttcaccttcctcccagatgccttctttcctgagctaactccaggaagcagcgcagagggaaccctcccccaaccttcaaccatctccgtgtcaatttagattaaccccatcctcaaggacatccaatccttcctaggtagatcccacttgcagtagcctaacttctctttgctggtggcactaatgagcacctgtcagtgcccagaatagctccatctctgggctactctgcaccaggcctgcctctttcctcacacacggatgctctaatgcagcgatcttctcagaccttggccctgcatgctgcccttgcttgcaccattctttctatctctctaacttggagctggaagggaagtggcaaggggaggggaagatgggaggaagggggaggttcttgggtgagtcacttggctacgaataaaatgcatcttatttgaagctttcattcctgccagatgtttccgatggataattgacactcatcaccgttctctgggaccctaactgtcctggtaattagtctctttaggcctccgcagctctctaatgagatagaggcaataaaggcattcactgtggagtggaggcgtggctgaatgaagaatggaggcctcatctgcgtggcccatgtcactaggcagatgggctgagctgtagctctgaccagcactggctttgagagggccttgatcccagggtgctgtggtccacgcccacctggacctaaggtcttcatctcatctcatggaatccttccacatagcattcattcattcagtgtgggatggcctgcgggaagcagcccagtggcacgcctgcggttctcaccttttaacctgtacccaggtggagcaggccatgcagccacactctcttctctttattctctgaagatgcatctctgagatagtgggaagatagttgcatttgaagacagaagtcaagagacttgggaaagtcacttaagcttcctgaagttcagtttccacatggtagaaagggagataataattctcatctcctacatgagtgtcattaaggtgttgtgatagctttcccagtgcaagcgctctatctgaaatcctaactgacatggctttgcttctatgtagatagacactcagccacaggaattctcagtaagttgtattggatatagttagaaaaggggaggaaaggtatttggaagaggaaattgaggtaaggcagagggcaaggtatgaaaaaagtttttgttttattttttcttcaagtacaattttaagcaaaagtaaaacacaaagacaaataaatgtggatatgtcagcatgagtggcaatgccccctccttctttcaacaaacattggttgaatacctgccacgggccaatgagatacagactctgctcttaaggaacttactgcacagaggacagaggaggaaatacaaataagttaggcaaagagaattatgacacagggtggtaagtattttactagtgggatgtgtatggcactgagcaaggcagggaaggctgcctgcaagaggtgctgaaggctggaagaggagctggaatgaagaataagagtgatatgggtgagacatatttcggacggaggggagagtgtgtgagggtggggaaaaaagacccgcccctgtgtgctcacatgtggttatgtggcaaggggcaagggcaccaaactaggtgtggcaagaagagacaccaaggctgcagactgcaggcacatcacgaaatgtagtgctcggtccactgagaagctggacttggtgctagcctgttggcctcaaatcaatgaggatcatgatcgatttggggtagaaacatcaccttggaattcgcataaagaataaattccaggggtcaaggccacaggtggcaaggtccaattggtgaacatttttgggaattgaaagatgagatggtgcagagtatctcctttgggaggatgtctcatttgagagaatgcccctgcctcggggctacccctgtttccttctccttctgtccaacttggtccaggtctggtgtcctggatgtgctgctgaagagacaggttccgggggtggtgagcgcatgtacctgtggggtgggctgcgcagactggatatggtcacatagtgccagccactcaccagcctgagatggagatgatgatgatggagagcttcagaggggctgctcaggcttttcccagatatactacaagcaagagaatggctggcaggcacttggtggcctttttctgtcttccataggaagaattttctaacacaacaaacaggtgaggacacgactcgtctttacaagctctctgtggtgcttcccagcatggagcagatccacaaaagaactctgaggggcgtagcaaggagaccaaacacaggcacccagggagagcgcctggcatagccacagggccattgagatctgccacagggggtgtttgcccgctctcagtcgtctcccgagctgcagagtccccagcctggaaacaaggtttcagcattcccttacatggtaactacgccaggcccctgctgggctgaacacctggctgtggcattctcctccctggaggcttccactggcaggtcaggctgcaaggagggagttcagaagagaggagagaacacctcagtgcagggaagcggcacttgttttccatctcttacccagggcatcttcttagtcacagggagggagcgggagacgggaggtgggagtgtgcgggaattgaacaggaaatgggtttcaaagatgtgtgtggatgttcaggagagcacaagggatgaaagaggcagagcagtgtgctgacagctgtgtcccctgccgggagttaaggactccagtgtgcaggacacgtatggaattgtacggtgtgattcacgcatatgaagctatcttcatatgaatgtgaacactcacagtgttgaggcaaaacattcgacctggcttccataaaggcctgctgggccatatggactcagaaccacccttgtcgtctcagagtcctcagcctcgggcacagacaagggccttggttggaagaatcttggagttgcctagaggggaaggacttacgcagagcagagaaacatagtctctcacccttgaaggcatccggcggaggcttctctcctttgattccaaagaatgtgctctgtagatgacagagtgagcatctacaaagggggaacgtctggtgatggtttctgtggacacatagtagttagattctagaagacacaaccagttagtgaccgatcctaaatgacaagcatttctgggttgagatttaaatccgcaggagctttacaggagtgctccttggtcacctgtatcctagcacagatgcctttggttttgtgttttctccttaatgcagggtagagagaataagtatcccctgggcttctcagcatggggatctgcacctctgagaagttccggccttagggatactgtgaatcagacaccagggaaacatgaggttgatgacctattgcatttcaatctcatggctacctatttagccacgcccccaaattagggatttatcccaaaaggccaagacataaaatcatatgggcactgcctcctagccaggagttctagacttgatggaataatcccacatggaattgagaagcctgttttgattttgatttgttttagccagaaatgtatccaacgctgagcatccaagtcaggcaggcaggttctggctttgttccttgttccctaatccaggaagacatggacttagtgaggccaccagctttaaatacctctattaaattcaatgcaacagagtatgccagagcaggtccagtctgaggaggtggcctggttccttgagtagctaattcatctgggcatccaaacttatgtactctacagaaatcaaagctccactggtcatggggtttcttggccacaagggccgaggtagccagaaaacgtatgtttcagaacaatagggaagctgctggggaactgtactgccttgcagttctcctgcctcctgtgtttgtctccatctccatacactggggcaggttctgcatcccagtgtcctcattgatctccagttacatccacatgcacaggaaggcttcctgttcctttgtttgactcacctccatccatgtgggctggcttcggccttgcaggcatgtgatccttgagctgcatctgctcttaccccatccagatggggaagaggtcaagtgctccaggtggaacccaggtgccctgccctgagatagagtgattggcaggatggcctctgtgcccaaggaagcagaagcagcaggcagacacattgttttgtccaacaggttcttttctgagccacaggccaagcagctggagggtgggtgagtatttcaggcaggcagtgctcagaagtggatgggtgatgaggcactcagcacagtagtctgactttattaaagctctgtgtaggatattaatgaatctgccaccttcttcttgaatttgagcctgagccatggcctttgcatgttatgacacagtaaggaagaaggcccaggacactttaacctgagcctcatgttctctccttgcaggggaaggcttcccgttatctagtgtgtgtgtcttggggatgtgggccatagaacgttcacttctaatgctggggctggaacaccatgtgtttcacttagagggatgactcaccaggggcaaggccaaatgacagcagaccaggcaaccaccgggctttccttccattttctcccagaccactcacggcgagtgtgttctctccacaggtccaggcgccgtcagcgaggtgagcaacggcacgtcgaggagggcaggctgcgtctggctgctgcctcttctggtcttgcacctgcttctcaaattttgatgtgagtgccacttccccacccgggaaaggctgccgccaccaccaccaccaacacaacagcaatggcaacaccgacagcaaccaatcagatatatacaaatgaaattagaagaaacacagcctcatgggacagaaatttgagggaggggaacaaagaatactttggggggaaaaaagttttaaaaaagaaattgaaaattgccttgcagatatttaggtacaatggagttttcttttcccaaacgggaagaacacagcacacccggcttggacccactgcaagctgcatcgtgcaacctctttggtgccagtgtgggcaagggctcagcctctctgcccacagagtgcccccacgtggaacattctggagctggccatcccaaattcaatcagtccatagagacgaacagaatgagaccttccggcccaagcgtggcgctgcgggcactttggtagactgtgccaccacggcgtgtgttgtgaaacgtgaaataaaaagagcaagaaagaaaaaggaaacaaaataagaccgtctgacagcaacaacggtcccacaaacaagtcacaaaagataccgttaaacttttttttttttttatcattttactacatgaacatcatggataacaagggattctgattcattattaatttcattaattatattttctgatatgagtctagaacttactgcaaaaacaagacaaaactaaaaaaatacaactgagaagggtgaagagaagtatgtttgttaaacagtaaaaatgaatagtatacttcttaactaggtttacaactggtggaccacacaccaggcactaatcacctggtgaggatttggcatatccaccaaaaaatgcatccgatttaaccaacatctccaccagcgctacggactcctcccaattctgacatctcttgcagacaatactatgctctctacacactgtttagaaatggaaaggtgatctgcactgtatcttgggtttgttggctatgcttcctttgatgacatatattatacagtatatatatacatatattttttttgttagagttctagccattttatttctccgcagggtcctttctcagacattactgcatgctgtatatggcgttagctgtgtgttgatcttctaaaagatgatagagtttactggtaattgtgtaatcagctcctgcctttttattttcttgggttatttacatgtcagagacatttataaaaagtgaaaggataaaaaaaaaaaaaaacaactaataccgggcgcagcatctttccaggtgtggctctgcgctaggccaccccaggtggccccgctttctccattctgccctgtggcgttaacagacagcaagcagctgaacaagcagtaccgtcagtacccacttgctttagcccattatgggaatctctgatgcctttgtgaccactggagagtttaatcctcttggtttattttatttcccacctttgtgtgagtgtgtatgaaagagaagaaaatgcaatttttaggtaatcttttttttttttcccctcccctgaaagtctgggaacctgagagtcctcggggaggggtcctggatgtgatgagggaaagggggattgggggatccgggagggtggggttgtctctgacttgacattaaaaagtgttccatgtccctcttca

SEQ ID NO: 1265 - DNA, 426005 bp, Homo sapiens
gcggccgcagcgcgcatttgggctccgaggaagttgaccgaggcggctgccgcaggatcccgggcccggatcgcacgaagcccgcgcggccgtctcctccgcgcgccacccctgcgcctcccgcgagctccacttcccatctgctattgtttccgattgttttccggtggcgagcccggctccgaaacttacaaagtgttggatgtcccccgttcgaactgagggactgcagaccgcctctgggtagctggatgaagcccaccccgtccccttctggtaccaaagtgcttactcctctccaaagtgccgtgtctgaactgccgctgggaagaagcggctcctgagacgcgcccacacctttcacctgccgcgcgcttccccctcctcggccaccttcccggcggaagcagcgaggagggagccccctttggccgtcctccgtggaaccggttttccgaggctggcaaaagccgaggctggatttgggggaggaatattagactcggaggagtctgcgcgcttttctcctccccgcgcctcccggtcgccgcgggttcaccgctcagtccccgcgctcgctccgcaccccacccacttcctgtgctcgcccggggggcgtgtgccgtgcggctgccggagttcggggaagttgtggctgtcgagaatgggggtctgtgggtacctgttcctgccctggaagtgcctcgtggtcgtgtctctcaggctgctgttccttgtacccacaggagtgcccgtgcgcagcggagatgccaccttccccaaagctatggacaacgtgacggtccggcagggggagagcgccaccctcaggtagggagctgacattgttctgcgaactgatggtttgtatggggtcggggtaaggggcaggggtgcaggtgtgtgcactgaggcgtgcctgggttggcggagaggtcgctggttccctgggctgcacaatttatggctgcgctgggggctctgcccgggaatgtggcagtcgtagggaaaggctcagaggttctggcggtgagctttttcccaaaaactggcctctgcggctcaggcacttgttaaaggtgaggggtggctggaccaggtggtcgccgagattgagggacttgtgcctggcactgtctgtgcctgagcctggtggccgtggtgacagggggcttggaggggctccccgcgagcagtcttctctgaagttaatgagccccaaaggaggggtctggcttggagtgaatgcccccactcgcccatgccatagggctttgccagccctggctcctgcactctgggagagccgctgctttgtcctgggcctgactgtgcccgggctttcctggggtgccttcatgccgtgagctggtgggcagacagagatgctttctcctgtctgaacgtggctttctgaggcccaagtcatggagtctgatttgtccgtggaaaatggcatttactgtagtgaactgtgttctgttcctgctctccaccaaaacggtacatgcaaaactcgtctactgaagagaaactaggtttcagtgttgggttgggtcctgattggcttctggggttaaggcttacaggcactgggggaggagaagaagaagaatcttggttatgctttgtgtaaggtagaatgattctatctccctgattaccttgcctgcagaaacgctaactgaatttccagtgttgataaaccacacctctcatatgcgggcaaaacacttaatgattgcgatgggaaattttattctctgggattttataagagaataagcatgaggtggacgttaagaaggttcatgggaacgatttccctgcctctccttggtttagtctgccctcctaaataaagttttccaaactaagcgacagaactaaccacaaggcaacatggcaatattcctgtcctttgcacatgaagatttctggaaagataaccctggtgctggtgtctactgttttgcccctctgatgacttcttctaggattgggttgttttggactgtatacttaaggcaatatctataggatagaaaatggtgaagaggaggcaatgtcaatacagagctgagttatcaggacattgccaaaggaagtgtgtaatttagggacccgtgcagggctacaagcatccagtgatcctttgtctaggcaaagcttaacctcatggctctggtgaactcctagttatttgttggctcacgagacccacctcttccactcttctgagcaaaaataaagcaacttccttcccccactcagaaatgattgtgtatctgctttaaaaatggatttcaggggagttacaaatatgcagtgatttcagactacttaaataaaaaaccaaaaataaatgtctagagcagtaataatcaaggaaattttcttgttcaagaaatgcttgttctctggatgccctctttgtccctagtccttggctgcaaggagggcctcccagggacagagacattctgaatggggaacattttagatataaatgggattttttttttcaaggaaaaggtgtaaggtagctctgtagagacttgaagataaataaacaggaagtgggtcctggcagacagagaccaggccagaatctggtctccagaaggtagtcttcaaggcttatcaaagtcaggactgtccagagggtggctgcattcagcagaggctgaatcacgggacaggcctgatttaggaggagcttctttttgaaatcgcgttatcatgtactggctgacttatctttctttgtcttccctttcatggttcttttttctcattctgccggtccccctctctctttcagcactaatgtttgtttgcattttcacatgtgttctcaacccagtggtattgtttgggtgtggatggagatgggaacatggtggagcttcctttctagacccttgaattgaccccaacccagccaagttccttctggaacatctcctgccattctgtgccagcctcaggggctgaatgtcttcctgacactcaagagaaaggccctgacagtggatggagcactacagggcagggattagatgagctagggtctgagcgacaccagcccttgaccacaggcctgacttaggatgtgaatcaggcaccaggtgtaacaagcaaccagtatggaggatgctcaggcctctcaggattgccctccttctcagactctgatgcgctagaacaaggaagggctgccctgctgggatggactttggtggggtggaagcccctgaactctcaaacataggtcctgcattttcttgttctgtgtacagagaggcaagtaggaatttcagaacgtattttgtttgcataaaaattgctgcattttcacgtaacctgactgtaggttgcaaccatctagtagttcagagttctgagttattttctttttgctttgtattgtgtgtgtgtagggggacagaggacccttccttccttccttccatctatctttctttcttcttccgtttgtttttttctgttttgactaatcatataaccaagctgtaaggaaccacaactaggggagaccagagcacccgtgctctggcctggagggccgccatatccatcttcctatgggtgattgggtgatgatggtgatacatgtagttttcttcataaccagcagaggactttttgctctaatttcattttattctgctttgttctcaccaacatcatattttgaggatcttttgcagtccctaaagaataaatgctcagcagaagattctaatttgaggaaactttaaaaaatgttttatcttatccaagtagctctaacaatccttgtggaggtattgggaaatgtttcaattagcatagcactgacagcctgaaaagaattacaatttgcagtctcccactctttctgccctcccgctggcattctgtaggcatatttcttaaaagggtgaggtaaaacagaatctgcattaataatactattagccaatgttaattgagtgctcactatgtgttggggagtatctaagtgttttaataatatctcacctatcattcagcctcatgacattaacactttaataacagccctatggtgtaggagttactattatccctattttacagacgaggaaactgaggtgtggagagtttacatgctttgatgaaggtggcacagctaggaagctttgaagccaggctatgaagcactggtaacaatcacgttaataagatacatagtactatcattggtctgttactgtgtgaacattttatgtaaacagtaacatttactcctcacacctctctgaaatagacaattattcccggttaaggcctagagagggggaacttacctgaaatcacataagcagccagtggcagaccagtatgctagctcaggactccattccttgactttgtacaccaagcttcccaggactattcaggaccctttggattcgtgttcctctcattcctctgtggcacttaatgtcttccctattcattttggcttagaccctgttttccagtgttatctctctgtcttctttcttcccttgggctgcagagcacctcttggaaagcaagaatcatgccttgtcatggcatgagcactgtgtgctggcagatgcttactcaaacaaaatgaatgaaagccaaacaacgatatcccccagctatattcagtttatctccttaccacatttctctatcattttattttaaatttcaactacggtcaatcagaaatgtattgagtggttctttcaagaaggggactgtattagtccgttaggcagtgctgacaaagacatacccaagactgggtaatttatagagaaaaagaggtttaatggactcacagttccacgtggctggggaggcctcacaatcatggcagaaggcaaaaggcacattttacacggcggcagatgagacaatgaaagccaagagaaaggggaaaccccttataaaatcatcagatcctgtgagactgattcactaccaccagagcagtatggggaaaactgccccgatgattcaattatctcccactgggtccctcccacaacacataggaattatgggagctacaattcaagatgagatttgggtggggacacagccagaccatatcaggcactgagctgggtgtttgggtgtggaaaggcgtacggcctggacttggcttttgggggcttgggtccaactggaaaagctggctgtggacaaagaggtcatggaccttgtgaggcagagtacaccatgaaaacgtgggcgatcacgctgtccgtggctggagcagagcccctctgttggagtgaaggctttctgtgggttggcaggactgcactagctcctagctcctgggtggaagtgagcagacatcagtgaggaatcagagagccccagaagccccaatgcatgggtgtcattcacttagagaccttcactaagcatcaacacacctgtcacttggcagtttcaatgaatgctttccacatttcagagattccccaattaaggcagcagctagtaaagtgcattctttcctggggatcacttggcaggtgggtatcagaggctgaacgctgcattccatcgcgcctctagaccataggcttagcgattggatgatgttgtttttcccgggtgagttaggaattgaaggtctgagaaatgtatgtaattttggttgagttttgatatgggactccatggaatcacacagactaaatgtggttttgatacttgagaggacgcgggagtcaccctctagatgaaggaagctgcggcactttgctcatgtcatgtaaggtgcttggagtttcatttgataagcagatggattctctggtagtccctccagctactccacagcctcttaagggcggaactaggcctcctccaggcttgcctcctaatccgcagcacatggcttggcctgtggaatttgccaataaaatccgaaggactctcatcctgcctttcctttcactcactctgttgtggacacccataaacacagcttattccagctgcaaagcgtttcctcttgtggtccgccctgctgggaacacccctaccctgatcttcccatggacagctgtttcttgtcattttggcctaagctcacagagaattccctccctgatgcctttcctgataccaaatcaaaataatcctctaccactaccaccagtcttactctggcatatcatcctggagtttttcttcagaacaatcatctccatctgaagttatcccattcattatttggttatctgtgtatgggttgtcttccccaaagggactaaaaattccttgagaagagatatgctctgtcttgttagcagtgtctggcggatagaaggtgttcaataaatttgttgcatgaatgactgcaggaatgaaggcctgagatcacgtcttcttctccttggagtctgtgtcctttttcctgaattgtcttgtgttgtccttgccttgggcatgttacttcctcagtgtcatttctgactgggcagctgtgtgaggctgctcctgtggaggtgctggagacaggttacaaatacatagaagtcattgaacttgtgtctgtctgtccaggccacagatgaggtgtgttggttgtccattatttcatatttgcacccatgacacttaccttccttctgctgggtcacctccccacccagtccttaagtctttgaaggaacaatgatagtcaactccagggaaattagcattttcaaggtaaggagggacacagaaaagcactctgctcatcctttctctctgtttgtggagtctgctggcagtggttgtggtggtataactattgatccgttgtttatgagttcacccgttcagaatagcaatgctactcaggaggcctgtgctgctcccactgccctgccccctctcaggacccgccactgggcactcacctctgggcttgccaggcatccggctggtgtcctgtggctctgaggagcaggcacagatgggaccaaggagggaggctcctggaagcacattcagctgttgaggagccaaaaactaaaatgggaaaactaaaaactcaaccaaacatagggcagaaggggtaggagtatgccagttgtcactgaaagctagaggaggctacagggggccagctcagttctctaacacccctcatctaaaccgtaagtgctttgcagaaaaacgtctcctttctccctcttttaaatgcattgcgttcttgaatttgaaaggtttgcagagagctgggaggtcaaccacctggttttacagatagtggaagtagtgataatcagtcttgcgtaaggaggccttccagaagggtgagagggccggcagccagtacactttccatccccaggctgtgagccctcacttggggctatgcatgctgaaggaaaggccatgtttccctaagtgcaaaagcatcctcctgaccatgaatgctttcaatgcatttagctgacatttatcaccgtattctctcctgactgctggtttagtccgtaccacaccttgcgttcttatgctttgactctcattccatgtgggacagctgtttgctgtgggtcaggtcctgtgctgagcagtttaccagaagaacctcatttaatcctcacagatactccatcaggtggacacaatgattactctgattttacagagcaggaaaccaaagcgctgagaggcacagtgaaggtattttcccagctcacatactcaggtgggtgctgagcctgggactcaagatgggtggtgtctgactcctaggcaatccccctcggttccatagtactggtcttgttctgtcccttgtattcttcattgccaagttcctctcccactagagacccagtgagtttggttgtccctccttgtcgtggtgcacaggaatcccctctcctgaagcatgaggaacagggcctgggagtgtttaaggtttcatgtcatccatggcgtggagacacagggacccaaccgacctctagaggtcccttctactcacagaatcctgcaatttctatagtttgttcagaggaagactcttattccaggttcttccattgatctttggctttaggtatcagcaatcttggactttctcacctggagttagtaataccatgaacatttccacgtacttctctggaatgcagtattgaaccagtcaaggcagacaccaattctaggaggattctacaggccagtcagtggatctggatgccatagcaccaggggaacaagagggaccagctccaaaacgcttcctttttttttttttaaattagtaataggcatctctcctggggaatcttgtaaaaaaagataattaatggtaatggcatgtttgttctcttaggttgaaagtctccactgatgagtaaaatagaacatcgtccttgtgttatttaaggtcattttgcttcctcaggagtaagttgatgggttcccactgtgtaatagataactaatactaaataaataataagcaatactaccaacatcattatagatggtcaaatatttttaggaaaccaaggacttattgggtttaggatgcaatttcaaattgcatgtgtgagctgaagggagaaggaagcaacggggaagtttactaggagtacaatcattggagacaaacatctccaacacacaagaccttactgactcgtaggtaccaggaggggtaggctagaaagaagatagagtgggagacaggaatctacaaactctggctcaggcagtttgtttgattgcaggcaaaatttgtaatctctccaccctgcatttaaacaggaccgttattacccatctcacagtgttgttttaggttaaaatgagatgacacacacaaaacatagtatatagttataactttctttctctatatatgaatatatatgtacatatgcatgtgtgcatatatgtgtatataatatacacacatataccaattttcattataaactattgtagcttaaacactttggcagatataccatgtcttgcttctgaaagatccaattataggtggacaaatccccctttgtccacctataattgtgagtttttttgtggtgcctctcctacacatctgtttagagattcttcagtttcaaatcatttcttgagatgtttgatttctgagagggagcgagaagaaagatatttctttgtttttcgtaaaaagattgttgcatagcaggttgtgacagttcatggctctgaagatgcatttcccatcagaaaaattcatccagaaggttctgtggagcaggttttctgtgaattcatgcatagatttcggagtgccagaccccttttccttggagaaatgatttttccatgataattccagtggagtcaaatggtaaaaaacagggtctgggataacatgtgttggggaagaggtagtttaagactctcgcagctgtaatgttctctaattgtaagtcttctcttcattcatatctcctgatgattgggaggcaggctcagggcttgagtggtgatggtgaaaatagagaaggaggcttctttgcatttgggaattttacttttggtcaggtctagggcaacaccagtgcatctggcattagaaactgatctcagcattcactgatgggatcacaggaagagtcctgtccattttaacccaatgtcaaagggcttaaattagtttaaatgtagtgaactatgaatagccgtcttgatctttcatgatctgtttttcttaaatctcatttattcacattgttgaattatttggttttatttgggtgtatttgggcaacttgctgtcctatcagtgtgaaatgttttggcttagaaagcttttggggggttagatttgtcttataaaatgaacgtatgaactaatcttacaatcttgctgatggatttcttaaaataatagaatttttaatgaaaacagcatcaaccaacagactgatggaaaattaaaaaaactaaaattgaccttcaaacaagctttgttgggttcatggagtcaaaggaagatgtatctgtgtgaaaatagtttcttaatcttctgtgctttcaaacggcctctaatgtgctggatgagtgaaaaaaatgctctcacattcagaataatcatctttggacaaatttacctgtcaggagggctcaatccaaaattctaacccttcagaagctataagtaagaaaaagaacgcatgcgaattatttttaatttagtgcagtttttatacagaaaagctggaaatagcaatgctgtggtttacgggttgaattttgtcccatctccccaccataaaaaaattatattgatgtcctaacctccaatagcttacaatgtgactttatttgtaaatatggttgctacagatgtaattagctaaggtgaggtcatactagagtagagtgtgcctctaaaccaatataactggtgttctggtaaaaagatgcctatgtggagacacagaagacacgcagagagtgacaacaaaggcagaggctgtagtgatgcacccacaagccaagaaatgccacagattgccagcaagcagccaggaattaggaagaggcaatgagggaaacttccctacaagtttcaaagggagtatggccctgccaacacggtgatctccatgatttcagacttctgggctctagaactgtgagacaacacatttccactgttttcagcccccagttttgatactatattatgacagcagtaggatactggaacatttgcatattaaaaaaataattttgttaaataatagtaacaatcttgcaaaggatcgtagataggcctggttagatcacccagttcccagctgtgacacgagccactgcagtccacagaggaagtgccagagtccagaatgcttctgggtctcagtcgtgagcccagcctctccattacaaatcctaaagaagccaatcagggtggaaatgcttgcccttttattcctcagaggccatcagcacaaaccctattgtatcttctcagttatctcgaccacctgagaagtcacagacccccaaccccagggccatgcatcgttttctagattcatatcccaacatccaacagcccaacccagttacaaacctcttcctcatcctccaaacctttttactctctggacttaatgatctgtcaccagcaacatttttacatctccagtctctgctttgaatgttccccccttattattatttttttcttttttgctttagttgaaactcggctgttccctggattatttccactcctggagtcctcaaaagtggctgtttttctcccacaccttgcttaccctgaggcctgaaagttggataaacgtcctccttgctactcattatggctgctggacatttctttttcacctttctcgacatatccagttagggtgcagcaaatgccacttggctctgttgccctctgccccttccttgccgtgatcatctgccatcagttctgaccacgcttcttcactctggtcctccagaccgcacatcctgctgctcatctacagagccttttaatgatgacattcaaactgggtcctcccagccagtacccttgacgcaaggcccactggaccacggccagctactccatcctgcccttccctcagtctttctgatcttaggaactgcaaacctagtacatcctttatttttttcattctctcctgtgcttcatctaattcaccactaaattctgtttgtcttttcttttaagagttatcctgaatcagaccactttttaccatctcaagcactacctccgtgggcaaagccaccaccgtctctcctcggctcttctggtggcatcttgcctggtctccttgtttctactcctgttcccctggagtttattatctgcctggcagccccagctaccatttcacaagaattacctgactctgttcaaaacctacagtggcttctggctaaacttagaatgaaatgcaaacacctccatggagtagaggctttttaatcgcctggtgcctatgtaagcctcataccactgcccacgtcgctgctgcctcgctcgtgggaatgcagaacgctgaacttctctgctgttcctggaacttactaagactgttcttgacttaagaaatgttcttccctctctcaggatctgctataaacttatgggcctagaccttcgttgaattcatgcatctactccagtaccccgtttaaaaaaaaaaggctttacagatcatcctgtttgaaatagccatgtcctcagcccccatctttctatccctctacctagctttaactttcttcatggcctgtaacacctagagaagtctgttatttatgtatgtcttctgttatttatgtatttctcatttattgctactccccctaaaatgcaaggtccaccaagctgctgagtttattgctctcatttatagtgattacattactgcctgggacatgggatctattacaggatatttgttgagtgaatgaaacgtttgttaggaataatagtaagctattaatagtgaaattatttatcttttactagaaagaggaaactcaggtctgtctctgtattggcatgggattgggtgttattaaacagagttcagatagggtgtgcgtgagctggcgtgtttgttttctaggtcagagagtggaatgagacattgaggaggaaattgtcaggcaatgtgacacacttcataaaatctacacatgtggaatctaaagggcctttaaatatccacttttgcaaggggttttatggaaaatctaataaacactggagaataaggattattctgctcaaggcctacaaactttgggggaagggaaggaagtgaagtggcagctagaaatcaggctgtgagcctgaagtttcacgcgtcattcaatgtccaatctttcatgttaacctttctttattaagagaattgtaccttagcgctctagaggataatgattaagtgcagggtctggagcccgaccctcctcccatccccagtttcaaatgctggctcagccactgggtatatgacctttggcacatggattagccttgctgtgcctcagtttatcatcatttgaagggactaataataggggttccgggccagtgtgaagcgtgaagtactcagaacagtgcctggcactctgctcatacttggtgttagccttacatagctgaggaaggacctggcctgcagtgggcccgtggtgggcagagggcagggtgtacctctcgtgaccctggagctatgtgtggaaatgcacagtgcagggcacggagctgggggccgtggctgacactggtgcacactctacagttacacagacatctggtggtggggtggtttttgaaaagtatcaacgcagttcattgcttttggcatgtgacttgtggtctcggggccaaggtgacctggcttttagtcctggctctgtcccaacgcatcatgtggggctactaagaaaatgagcattcccaggcttcaggttcactctgtgaagtgagaatactgctctgtttcgttcttgagttttgaggaagagattactagctgctcaaatcatatataagtttttttatttttcccctgagcacaaactcagctgcctttcccagcctcttttgaatttagaggtgaccatgtgacagctctacccaaaggaatgtgagccgaagctctgtgtaggttggcccagaaaaacatcccctgtgaaattctttatgttctttcctttctccttagaccatctggatgttgatgtccaaaattaccttggaaacctgtgtcctgtttggcgagctccatcggccaaattcttgaatgacagcacagagcagggctcacacccccacccaccagctggccaggaaccttgttaaattattacctaaagaaaaaacaaacttgtattcaggcttctgagagttcagagatgatttgttacaatagctagcattatcctatctaattcaatactcaaccattataatttatattttctgatttcagctgcatagaaatatacagatgtagtttctgaatccagacctaagcacttattacaatttcttggcaagacttttggtgatttttgcatgtgtctgaaagtgagaaccatggccttttcaaacggaagtctcaaatgtttgattttcagttgcttgactgtttacatctgtggtccaagtaacatgtctgctttattctacaggaatgtgaaaaccagtgacaaggaaaagttttaccttgaggcaaatgagcacatatccataatggacttaactcaagacatgctataattggtgaaaatacctcttagatgataaattactcattaatggctggaggtcacttatttagtttaaccttttgtgccagaagtattctaatatccagtgttttaattgacacacactaaagagatagataggatgatttgtaggcttgttctcaaaaatgttaaagagaaagaagagaaaaccactattagagttccttttttttttctttcttttctctttttttttttttttttttttaacagggtctcgctctgtcacccaggctggagtgcagagatgcagtctcagctcactgcagcctcaacctccctgggctcaggttaccttcccacctcagcctcccaaatagctgggaccacaggtacatgccaccatgcccagctgatttttgtatttttttgagagacagggtttcaccatgttgccgaggaggtctcagactcctgggatcaagtgatctgcctgccttggcctgccaaagtgctgggattacagatagatgtaagccaccacacccagccagagttccaagccttgaagagaaaccaggtggtggagaaatcgtgtatggatttgggtaaaggagaaaggaagctgtggaaaggggaagaggctgagccagagttgtgggtaggagacgtacaaggaatggaggcaatgcagagacacggggcaagattcaggtgcctcgattccaccttttgtaattcaggggtcagggatcttgtcttacttttgttgttgctttggtatgctgcacagtgcctggcacataataggagctgaatgtatccttggagaatagatgcatgtgttttgctgtgttgcttcagtagtgcctactgtacatctcctatgagccaggagctgttctaggtgctaagttcctctcttgcagagtgatgtttagtgaaggagatgagggttgcaacttgtatggattagaaaaaaaaggcatcttctcctagcatgcaacttgcacagaccaagtaggagtaggcattcctcgctgacgatgttgttcactagagtccctggctgagtaaacagagtgccagctgcattattttgttaccttcttcagcccttgagcagcgcacaagctgcacaactgtacttagcaggaaccagctgtcggaaaacaaataagtaaacaaacaaacaacgcatcacatggtggaaagtattggggcaggaagtaaactgtaggttaggggacagagtaacctggtgtgcagggaggggtaggggcttgcacgatggtcaaggtggtgaactgtggggagagccatgcagggaatagcgtgctgggcagagtatcggcaagtggaatgacctagtcaaagacgagcaaggcaaggaggaggaagggtcaaagctgaataaggggcaggcagtcagcaaagggatctggggggtcctcggtgtctgtaagtgctctttccatgtcaagattaagctgtgaatgatgataggagcacagctctcaggagatgggaattaaataaaaatcccacataagcaagtagccccaacacctgtgtggattcacttgctgcgcacagaggcctggtagtttccgtgtggactttgtggatttgtggcaacccatatttgatgtgtcacccctgcagcacacacatccagccgcgaggatccggggttttctaactgaaatgtcatccttcttgggtccactcttgtcattttcacttatcacatctgcaagttataaacgtttaaaatgtgcatgatatccaatttgacgttttacctgttgccatttccaagatattacattgtgaaattaagctggcattttacgatcatgtatggatgtgtgtgtaagtataagtaggcacgtatttggaattaatggactcatagaaatcagagatggattaggcctaatgagctgttcagaagaattatttagcacatatttcatctctctattcagtaatcaaacctacacagtgtgtatgctaaggaagtgagatttttgcctttttaaaaaatttcttggattatctccatttgtggctgaaaatttaacattgcatcctagggcattttgcaccaactttattaagcattcagtctgacatttccctgcacctggggttgcctttgttatttaaaaagtagttgctttcctagttaccattaatatataattagtagttggtgctgggctccaagcaccacaccaggatcctggcctggccttggagccattgtcaaaaacaaaatcttgcccaagtctctaggaagacttggagagttaagcctagatgggaagtgtatatattttgtttgaatttttatccacagtaaatggatgcagctttgtcttttcacctaaggcctatggtcaccttcctctggaagccacatgcacttgactgttgccactttggcttctgctgattcctttaagcacacagtttcaacagactttcaaaatactattcacaacatggggttccgtacttactaacaggaagaaggaaagcaaatgtgggatacttgatagtgtagaaggacacttgatacccagagaaggatttcattgacactgttacagagacataaaatcacagagccctgtggtagcatcagagatggggtcacacatagtcagctcccaatagccaggagtctaccctatgaattttctttacagcatggctagatacagtatatacatatttatcctaaacatatatactcaacttataagtctgcatgaaacatgtgaattgagaatatgttctatattgggaacaaaggattctggtgttgggaaaaacttaagctgggacttaatttgagctgtaaaattattaacctaatctctctgagcctttgttttttttttaatctgtgaaatggggctaaattatatcttaatacctacctgacagagttgttacaaaaatcatcaccataatattaataataacaacagaaaccaacatcggtagaagcacttaatgagaacctatgcttacatgataaatgctttacaagggttacccaatggtctaccctgtgaattttctttacagcatggctagatacttataatacttatcgtaagtatttttaataattacattaagacaagatataaattcttaaggattgtacctggcatatatgaggcactaaacaagttatttcatattgttaatacattccattagcaaaaacaagttaaaatgcttaggcatgtatagaggatgctggaagacgttctggctgttgccagaatctccagacacaaaccttttctgtggtctcccgtctgtgttttgtcccactacaaactctgtttgttttctgtggtctcccgtctgtgttttgtcccactgcaaactgtttgttttctatggtctcccgtctgtgttttgtcccactgcaaactctgtttgttttctgtggtctcccgtctgtgttttgtcccactgcaaactctgtttgttttctgtggtctcccgtctgtgttttgtcccactgcaaactctgtttgttttctgtggtctcccgtctgtgttttgtcccactgcaaactgtttgttttctgtggtctcccgtctgtgttttgtcccactgcaaactctgaactcaccattccccatggcttgcttagcctggttgcattttccacctccttctccctgactctttctcaaccacccacccctcagcaagtcaggtgaaaatcctgcaaacagcatcattctcaccctttccttcattttttcaatcagtacaaacctcttgttttctcatgttcccatagtgtgtagtttagaatcattcaattatttcttcaggaaagaaagtgttccacatctgctgagtgcctaacaccgttctagaccctgagactcgagaagacaatgaagaagtaagtggccgcacaatgcaatgtccggtagtgctgaatgctctgaagaggagagcggcagccagggagggaaaggaggaagtgtgcgagtttagactccctggttaggggaaggccctcctacgcaggccttgagtgagatctgatgaatgagggcgtgagcctgcccacatttaggagagaggtttccgaggcagatacaaaggtgctgaggagggatcatccttggcctgaaccaacgggggggcacatgtgggcggggcctggtccaagccacaggccttggtgatggctttggattttattcttcgtcttatgggaagcccctggagcagtttgacagtttgagctgctgcatgttagcagttttttttttttaattttttatttttctgtaacttattgcccttataaaaactttccgttttttttgtatacggcaaaggctgtattttctttgcgtttttgtgttagagacaggacacagccctcgtgtagaacctcctctgcactcccacaattccctgtgccacgtccattgttttaagcacttaactgtgatacaggacaaagctcatttctgcagacttcctctttttttttggttcacactgattcacaaagtaagacgccacttccaatggtcatatcgtgaaggtttcctcgaaggatcgtgaaattccacgaagtccgcttgctttcctgggtgaataaacaccaggccgctccctggactttccttgtcgtttgtgatcaaaggctcagctacctcgtgctcatggtcctgcgatggctgaaatccgtgaaatgtccagaaagaatgatttgtcatgaatgcatcagcaaagaggctataagcttctattcttattttcttatctacttttaaacactttttcattgctttaaaaaagtatataattactgttcatttggtgttgatgttattgccttgctcggtgttgggggttgtttaaccattcagtgtacaccagtgactttttggtctgtatttcccaacaattacactgagttgcagagaaaatattaattaaacatacttctattttaaaaggcaataataatatataattcccattagaaatgcatttgaaacttttctattaactctttactgttgtcaccaaagccttcccttctagacagtggaagtgagtgggacaggtggccatatatggtttgagcaggtgggcagaggaagaatgcagggtacttgttgccctctggttggtcctccttcctccatgcttattttcaaccttctggcccctcacactgggcccaactcatgccctgcactcggcaaatgtttaatgaaatgcttcctcgaggagcacaatattttatgtgtacagggagccgaatgcatattattgcatagtattttccttttgttatgaaatattttatataccagcatgtgcataatatatctatgtataaaaacataatacattgatcacctgtgttctcttggcacaatctaagaaatagaaccttctattacctgtgaaagtttctgcactcccacctattctctaccctttcttgcttgaggagatcaccactggcctgaatttttgtttatttcctcctttcctttagacttttaccaaatatataattattctcaaacaacatattgtctagtttttcttgttcttccctccaaatagaaagaaattttatgtattctccttcaaatgtttttcatttgatgttatgcattttctaataatttaaaattaacgtagtcctgaatgtgaacaaaggcagagctctaactcagtcatttcaggtaattaactggtctacaacccatcagtcagaagtgctttgatgctctttgactgtgtgtgtgtgagtacacaaaacacctgctaaaatattaaataaaagcagaaaggctttgacatcaacatagtagtgttcataacgtttctgcgtagtggaattgcgagtgacatagattttttgtgttttctctaattattaaattaaaaaattaaattttggattttcataaccagataggattagtgtcataaaaataggttcctaggccaggtgtggtggcttacatctgtaatcccagcactttgggaggctgaggtgggtggatcacttgagcctagagttcaggaccagcctgggcaaaaccctgtctctatacaaaatacaaaaattagctgggcatggtggtatgcgcttgtggtcccagctactggagaggctgagacaggaagattgcttgagcccaggaggtcgaggctacagtgaaccgagatggcgccactgcagtccagcctgggctacagaacaagacagtgcctcaaaaaaaaaaataataataataatatatacgtgtgtgtgtgtgtgtgtgtgtgtgtgtgtgtgtgtatgtgtgtgtgttccttttgaccacacactgatttgtttaggccatggggctttttgcacacacatccccatgtgtagggcgttgcactaggtgatgtttgggctacagaaataaataagacacagttcctgtcttccacatgcccatgacctggctaggaatggggagcttcagaagcaagacctcaggaggtgactgagaaggagccactgctggtctagaaggccaccttgtaatctggcatgtggtggggggtggtgcaggagcacagaagggacactggcggttttggggagaagtggtggcgggaaggggcctgcatctatgagggccagggcggctgtgccatggcagccaaaatacaatagggaactggagcagcaagaggccaccagctacagctgacgcatttctggcgggagagaggacctcagagttgtgcgtggccttcacgagtctttcccaccacggcggtgcctcgatctgtttccagctaagcccagagcagccagggctgtcagaaccaggaagactgataagcgtgtctctggatggcaacgtcaggttcaattttattcagcaagtatccactccatgccaaccatgtgccaggcactgttctaggctttgtggaatccagtagttgtcaaacataataaaatccctgtcctcacagcacttccctcctggtggaatgagacagtgaacaaaatacatacaaaacatagaataaattaactggtgacacatgctgtggagtggggcgggtcgatgggaaaggaagatgaagcctatgattccaagtaggatgtctagaacaagaataatcccttgcttatcggtatagtttaaattgtcaacaaaaacatgcattattttgacataagaagaaacatcaggaaaaaggtaaagaccacagtttattgcaatatatgcttttttcaacatttgaggaaaagagattgtacatgctgtattggaaatacgttttagtgtctaaaacggtgcagagccagaatgttgatcttcatttatcaccccaattcttcctggatcttaattgccccttcagaaagaataaaaaatggaagcacttcatccagcttctgcacagaaagcctgtctctgatcagcagacaaggaataggagatgatgctgatggtggtgatgatttataccttaatgagcaggcgttggtcatcagtatgtgctgaaaagggattcgctccctgcccacaggggactttccagatgctgctgagctgggcctgagctgcaggaggtacagaggctggttggaacagccgatccttggggcatcttttaggccaagggcctttggaaccgaattgagtggagcaatttaactgcccgggacacacaaagcctcttaaaagcaatggccggtgaataagccagaagccataaatagataaagtaacaagcaaataatgggattaataaatagacaggggagcagagccagggctgtgagctgagcgccactagatcaagaaatgtcagcttttctctcagcttttcctccacagcgccaactgtcagtaatttaactaacattttgtaaataaatgtggcactcggacagctgtcaacgtgcctgctatgaacactccttttgtcactaaaagctggcagtgacgctgtttctcctgcaagtgcagccagcactgccaattggctcctggtcctgggactgtcagggagtgcgtggggccctggggcagggaggtgggtgcctgccctagagacctcactcccctacacccgcaggcatcacctgggctcagctctttctggtgcacttggccggtttgtaaggtgcttccatcaaaaatgagactattgttttccaaacaccttgtgtttcagctgggagttccatgtgcctgaccatctagtttccccgccaaggatttgctctttctaaataagacattcatttatctaggttaaaggtacgaaacgcactgttttccactctagctgctgggtgattatttaaggttatgcagtcagtttccttgtgctgtggtttgctcctgaacttgaaactaatggctctggactgtgccttaggtctcccaggtttaatcacaaagttttattaagttagtgctttagtgtcctcttcctggaaagactctatctcaaagcttcttaacctatacccaagcagaataaggagaggaagaatctgtcttaatatcaaagtcccgtgggcgatgaatttgggttattgaaatagatgaaatctagcttggtgaggaaaagcgtgaactgggtaattaagtagtcagaaatatatttaataataatataaattctagtgggcatttactgaactctttttttctggggggggatgttgttttacaaagtgccctacatattacctcctttaacactcagagccccgtgaccatcccaattttaaaaatgagggtctgagatgcagagacgtggaggagtctttatgaccagcgtgtggctgaatggggatttgatcccagacagtttaggccctttgatcccaaggtcctgtgttctaaacaacagcactggtcttttttatgtatagttaccatgtgcacggggtatacaattactgatttttaagaagcaagaacacaataaaatgaactccatacataaatgaaggaagcatctttgacctttttttcctggtgaatgagaaggctctttattgtattgtggtaacccattgagaacgttattccctagagcgtatcacagagtaatatatggagaatacaaataaatgattaagtgaatgggctctgcagtcagctgagaagtttacttagcttcagaggcagaatagtagaagtaattaataggaactaccttgttgggatgttttgaggattaattataatcatataaagtctttacagtgcctgacacagggtaaatattcattcattcattcattcattgaaatttttattatgtgcatgtgatgtatcatggattctgcagtgaatgagagagacatgatgtattcttggagcttatggtcttgtgagaggagatagtaacaaacaaggtaacatatacaaacatcccaggtaggggaaagtgctgtgacggaggctgcctgggtggctggtgggctagtggatgtctctctgagaggaagtgacatttgagctgagatgtcaatggagagaaggagctggcccagcaaggatctgagagcaggacaccgcagggagcaagtgtccggtgctggagggagagaagagagacccctgtgtgtgcagcagcatagacaatggggagaggtggagcagacagacctgcagggtctgtaagccaggccacaggtagggatctcttttcattgtgcaagaggaggtcatcagagtgtttccaatggagcagtgacatgctccgagcctctgggtgacaacaggacgctgctgcctggcctcttggagactggcttataagcctcagaagtggacactgcagtattcaggtgagggatagtggaagatttggcaatgatggaggcagtaacaattgagagatagtcacagataggtttgctggtgaagcagactaagctgatggggttgataagttaatatggagggtgttactgactgcagtgcttatattctcggctaccttaaagtaacagagtaacggtggttttgttgtattagtgttattggggtatttacataatgaactatttacagcttgagaagtactcagagatttctttgccacattactactttgaattaaacatggacaacctatttgggaaagcatcactagccacctgccctacttaacactgattcagaatgtcgggctttttgtttttacttccttttcctacttcacttatgagatcgggattgatttcttgtgtttattagtcataaatatttgtcctaaaaaccagttttgggccacttccatgtccaaagttccctggtggagttatgttggaattggagggttacatgcatgagtgtgcacgcatgtgtgctgaccacagataattagggttaagagaagggtgtcatgaggataggtgggggagggaaggggagggttccctggcctgttttatcagatttcctctgcagctctccttcttactgcaagggccaggtacaatttatgttgcctgatttcctcatccatagaatgatatatttttaattaggacctctttcactagtctccttacctgtagaattttagatcaaaattacagaagaatctgtcctaggttcacaccctgtctcatgtagaacaaagaacaagaacaggcagaggaagacagtggcaaatctcactttttaataaaatagtggcattcaccatcattaatactgatactttgttcttagcttaaatcagcattaaagtaccagcattgtaattttgctcagttattgcaataactaagagtgataaaaagaggggaatcatggaaattttatatatatatgcataaaaatggattcttaaatatctcatcaactcctaagaatatcaatataaaaattggtgttgagagtgatggtcgagagacagcaacattttaaaacatgcaaaatcacattcagcattctcagtctctcaaggtattcaagtgagccatatgttttaagcaacttgtcattaacgttggttaaaattaaaataataagtttgaacatacaggattaaacttcagtttatcttggaattcatttctatcctatattgcattcctctatataataccagaagatggaggtattactgtaagacacatgtcttttgtccgtcctaaattttgagagccttctgtggaagtgctgttttctcccatgcctttttatcaagccttgggcatcactaaattctgggttaccaaaccactggccaaaaggaacttgttgctgagtggtataatggacattggagactcagaaggagggtgggtaggaggtgagggttggaaaactacctaatggatacaatgtatactacttgagtgatgggtgcatgaaaatcctagacttcatcactataaaattcatctgtgtaaccaaaaacaacttgtacctccaaagctattgaaataaaaacaattttttaaaaaactacgcacatgcatacacacacaaacacacacaaacaaagggaactggtttccaagatcagccactgttctggggaaaaaattctcactatgatacgtcaatggatggaactgaggcagacacagaacttactctgtattaacagcagggttatcaatcacttactatgtatcaggcactgctccaagtgcttatgtgcatctcataacaactctaggaggtagattctgttattattctgtgacgggtgatgtaactgagaacagttaaataacatattcaagcaaactgcttagcaaagagtcaagcgcagttttctattcagtcccaaaggtaagctttatcttaggtccaaagaaaaaggtgccacccacctactattttaactctttaggtttcagctatgaaaatgtgaagaaaggaagcaggagggaaattattccctgtctgtattgtgtatcaaaaacgtctactcttttatttctgcagaaacagaagttctgcgttttcactcaggagtagagtcagcagtttatgtgtgttttcttaataccctcttagcagttaattattccttttaataaatgcaatgaaaaagaactgttattggagtcatactttagttgaattagtaatttattctagctcttaatgtttgttaatattctgtgtattgcttcttgttctattagacagatatgacagggaggtaaaacgtgagctcacacaggagttgtgtgggtggaagtctctgggcgatgcatgggccactgacaggtattggtgggtgggggtacatgttgtagagagaggcctggagatgcagcgatgccttctcattactgcaaaagtgactgaagtcgtatggacaatttcttggtcagaggtgaatgaaatagcaaagtctttcatataccacataaaaattttcatctgaaagtgacttctggaatcattaagcctcttcccatttctctagttacagactgatctaagcacaggtgtattctacacttaatgcctcggtaatctggttctgggtctaactctagcgataaattataattttttacttctagtagaaatttacatagttttccatttagaaagctggccccatgttagaattataataaagggcaggaggtatggattaatgttattttgtagggcatgttcagcaaagtgtctcaaagggcgggtaaaaaatgagattctttctttaggttgcacgtagcaagtcctctgaacttgagtgcctttttggtgagattactgagccaagcctgaaaataatgtcgtttgctatgtctggatcctaataggcatgctcttaattaatttaactattacccatcatttgttcattccttcagtcatttctctaacacgtatcgggtgcttactacgcactggacaggattgtaagtggtcagggtacacaggtcacccagaaaaggtccttgccctcatggaagtcaccttttagtgggaaaagcagatgataaacatataattacacaaggaagcttttgacgacaagggtgggaagaaaaggacaggtgatgtgatggaaagtaactggagtgtgttggtcaggaaaggactgtggagacgggaacagtggacctgagccccgggggatgggcaggaggcagccatgcacagagcctgagaggaagcacagaattctaatgagagggaaaacaagtatgaagctgtgtggctgaaaccgtcttggcaagttagggaaagaaaacggaagtcactggggctgatcacagtgctaagcatgagagcactgcaagatgaggtcacggaggtgggcagggaccggcttgtgccaggccttgctggcagggtgaagagtttgccttttctctgcgtacaatggaaaggagaagaggttttaagcaagagaatggcttggtcatgtgtatgtctttgagacaccctggctagtctatgtatgatgcaaaaggtgggtggggcagggtgacaagaaaatactgttccggagcttcctgtggctgtgcctataagaggtggtggtggtggtgtggaaggaggtgtggcagtgaataaacagagatgtagaaacagcgtgtacatatattttaaggaacactgaggacgtgatgctggaatttgtgatgagagagtggaaaaaatccaggatgacttccaagagctgactcaagcacctgttgggttatgattcttttaacccatgtagagagactggtggagtaggtgggaaggagagaaatgagggagcaagaggacccttagatacactaagtttatgatgtttgtttagcatcaagaagagtttgcagatggatttatgattgcaaagctcgggaaagagatgagacttggggatttaagtatgggagagatcagcttatatttgttcttaaaatcttgaaattgggtaaaatcaccaagataaggagaaattgtagctagagaggagaatggcggatcggagtcctgagcttttgcaatatttaaaggttggagggaaaaggagcagagaattggcagccaatgaggtaggaagcaacccagggagagtttgagaccaaaaaatacaagagaatgaaatattttatggagacagtgaccgattttgtggaatgctgccacaaccaggagttctggaaaaggagaagtgaaaagtatccatgggactggataagatgatagcttgaggattttggcaagagaggtttcaggagaatagtagagaagggaagaaaaaaagatggtagtaattggagaggtaaatcaagtcaaaataattggtgtgtgtgtgcatacgttcagacccacattatctagtgcatgactgcatacagatgagaaagttccatctcatctgtgcagatggagggagtatggcgctggagagcagaggtgagaggtagagtacaagcagagggctggcacacctttggtgtgaagggatttctgttgcttgttttgtaaatctttcttctcttaatactcctgattcttgcaagctgctcatctggaacaatctggttacatatttttatgaattttccaacaggacagttgagagcatgaggaatttaccaaatgaagaagtggattttcaagattcttcttttacccccttgaatgatgttatgctctgtgtacagaggggcaaattaggagagtagcaaggagggatgccaaattggagtaggagggatatgaggcagtgacagtggatgtgtgaggataatagaaagtttgatttgaggaaacctcaccgtgggctacttcattacccttaagacttttagttgtgtgttctctcttgtctaagtagttctgctctagaggttcaagctgaacccagaaggaaaagaaacctatttgaaactgtgtaaaacacctcccttcagagagcttttctcactgtttttagtctcactgaagatgatcccagtatgggatgacgattctgcagagatctggcttgtctttacattacatctctaacctggagagtcttgctggatgtttccccaggattgtggtttcttatatttactcctgatctaatgcaaagcaccacgtgcaacttatgtacagttccacgactaaataatacaatggaatcaccacaaaatattatcagctcctcccaggcctctggttgttgaggaagaaaagtgggtggtgcttgttggagataaaacaagacgttagtgggtatacattgtgagataaatacatatgtattttaaagtttactggagggtatctgtatttacttggttttccccagtgttttacagatggtgcaaagtatacaaacatgcacaatgtacatatgactgcctgtcttagcagacaataccttatagacatatagacatagtccagttaacctgagctagagactcttaccttacaaatgattgtcccaaagcgttcagtaatgttttcttattttatctctttaagcaatactaagtgacttttgggatgagactgtcttttatctgaatctaggtttatggaatatttgaatatctgataccagacatggggatccacctctctttgtgcccagccaatattcagtgcagaaggggatttgtcactgaatctggcatgttgccctaacattactacaagcctgaattttgataattatcgcaattatttaagtaaatggattaaccttgctttgacaacatagtttatgagctgatacagtgtctttaaatagcatttcttaatacgggtgcaaatgataaaatttatcaaagtaaacccctgcatgaaaggtttcctcttcgatgattctgctgactggaagagcaggtccccatggcagtgcgcatagggcacgtggaggggttaaaggggagagggaagatattctcgagggtaatgagatgacaggcacattgtacaatttctcacacatctaatttatatctacataattttaaaaatgggcagtaacttataagtctgattcaatgccacttattagctgacatttttcaatattgtgtttgtgtggctctattttctaagagcaacagagtagaaacctgttatcctatatcatttctctgagtgggaattaaaagcctggagttgcatcctgggcttctgttcccttctctgccatccctgccccagccaccacccttttggggagagttagaataccatcagcaaaagagccatggggatatggattcaaatcctgtccatagcagggtgtggccatgtgaccttgggcaagttacttaattacttagctccttacttctgtgtagtgtcttacaagtgacaaagcatttcctcatattctctgtgcttgtctgtctctcccctggaactttaagcacctggaaggcagggtgtatgtctttgatctctgtatctccagtgcagaacactgtggaacaaaaacagggtaaatgaacgatagaactttgtttgactcctaccacaagcccgtgaggtgtcaggaagattgggataaccttgtaaagcacctaacacagctcagtaaaaatggactcttgttattattgggtaacagatattattcacttggagagataaaaacaaaaccaaaacactaaataatgggcttggctctcaacccaattcttctgtttccactctacttcattgccctttagtctaggtgaggtgtagatccattctaatgggcaggtgttttctgcataatcatccatattaaagaacacacttacagttatggaacatcatctcatattatctaactcatttttctttctttgcttgcttccttttcctcttttcttctcctcccttctggagatatttattgattatccatttaatgccagagttttgttaggtgctggggatttaaaaaaatgaataaaatgaaagaagttgtcatatcacaggaagatgggcatttaaacagccagctgtaaagtaaatggaacatgatgtggcagaagcaggtaaaactgctatgcaaaagcagagagagagtggattagtagggccagctgctgtaataacaacccctaaatccctgcaaactaacacaacacatattaattcttacttgtgcaatgtccatgcatagagtggttctcctgcatgacttcttccaggggatgatttggggacttggactcccttcttcctgtgatccatattgcagtccttactttgatgcaagtgggcagaggagagtagagagtgatgtagtatcttttggggccagtcctggaagcagcacctagaactgccatgatttcccatctggaagcaagggggctgggaaaggcaccctttctctgggcctggaaggggaatgatggtggtttggtggacacataacattgtctctgcacagggaacagctatttctatatgaaaagtctgtggatccaggaagatgatgcagaaggggggccatttgtctcagctcttcaagaatgcatagagtttaggctgggtgtggtggcttatgcttgtaatcccaaaattttgggaggccgaggtggatggatcgtttgaggtcaggagtttgagaccagcctggcccacatggtgaaaccccatctctactaaaaacgcaaaaattagctgggcatggtgacacgtgtctgtaaccccagctactcgggaggctgaggcaggagaatcacttgagcctggaaggtggaggttgtggtgggccgagatctggccaccgcactccagtcgggtcaagagagtgagaccctgtctcaaaaaaaaaaaaaaatgcgtagagtttagccatgtggggctaccgcagggcattcctggcagagagactaaaagctaggcatgcaactctgggtttttggaatccagtcaaggtgttggagtcgtcaagtggaagaggcatctgcagcagcctagcatgttcactgtggccttctggcctcttctcacctcccctttccaccatctacttggtgttgagttgcttatcagtttggtttctcagtctccagtctcctgtgcttgcagaggccgcatctccactaaggaagctctcttgctaccatgccccttcccctggctggtgtggactcaatttccaggctcactcacatggaaactgcacccaagtcatcaactctgggctggtgacacaacaaagaatgggtggctagaggtcagtcccagagccggctctgctgccctgcagcacccagttgggagggcccagtaacctgtgctgcaacaaaccttcggatggttctaatgcagctagtttacgagtcaccacttttccctgtttctcttttctgagtccaccctccaggtgtctgattccatcagtctgggttggcgccctgccagagtgaaagagaccagtggggcaggtgtacaggctgtcacttctacttctccggctcgttttttcccttcactctctgagcacctaccctcagttccacctatcacttttcccagctagttggcccaagcatggataaagaattttagaaatgcaactttccttttttttgtctctctctgtaggtgccagttctgtcattagaaatgtcttgccaaattagaacacaaataagccaagaatattcttcaaaatgcagataatcaaaagcacagcactggaatctgatcatcccccacacatccatggtgacagcccgagttgctctcttagagcctggcagacattctaattccaactcacatttttctaaaaggaaaaaaaaaaatacctgttaggctgatattccttaaagaagagtctttcttagagaactttataaaagccatatttgggcgttatttgtatgtgaaaattgtgctctttctgctcataaacttttctgaaacattttttttttcttttctgtgagagcttagaaaacggctagtaatttgaagacaacctatgtgacactgatatgcttttggtagcagataaatgccactggctggtgcaaagacaatttgcttggaaaatgtgaagtgctttatatctagaaatactaggtacagagtaaaattctccatttgttaaaatcagacactgacttgcagtagtgagttatgtgctgggctttattaatccttctgctcatattgctttagacataggagacagcggcgctgattagtggtgagctcttgatgaactatatttgggaggccccagttttgcaggagggggctcaggcaggtcactgcttcatgcacaaaacatagggaacacaagcagcagtttggatgtccacagctcatctcagccttgcttccacatgaggaacaatgatatcagcatgtaatctcagcattttgcccttgaaataaaattctgcccgccattgatatccagtagctcactcctcactaattcaaaataggtcccagtggattggcatcccctccatctgaattgcaacatgcacttcatctcctcctgtttaaaatgaggatgagcatgcttagagtgtttaagagttggaagctgcttcaggggtaggtatttgtagtttcatgaattatttatttaagcaaatgtgtacagcacatttatgtgttggagtatatgcctgatcacactcaaaggggtgtcgtggaaatgtatcatgccacggcatcaccattttgacatgtgtagtgcggagaaccaaaacactgctcctgggatagaacaggattagttcagtttggaatcatttggctctcatgatgcaagactaagtaaatgcgttttatcatcttccctgttgtgtaaggataaaacccagcctggatctatttgggcttcatgcctggagttttgaactaaacacagtcccattggtgtgtagtcagatttcattgtttttggttttgttttattttcccctttcaccaagcacaaatccggaaaaaaagcagtatgtgcattaaaggtttgcggtattttccttatagggcgattcacaaaattgcataagtcaagtccaatttttagctatttgtgtaaaacaaacagaggctgtctttccctatttccttagcatctcctgtctcacgcacacacacatagcaagaggtctgctgtagcacttaacggtgcattcaggggtttaatttgaagcagtgcaggaagtgagatgcctgaactccacagcgctctcatatctgggcatacacagccttgcgtcaacctggaaccctttatcccactgggtgtggttagcagcaccttcttgacttgctggtgggcacctccttgactttttttctggtccacttgaggttaaaagttgaggcggggtgaatctagaatgagcccctaacacatgtaagcctatacccttctctgaaaatagcaaaaagtgaaatatccaaactaacaggttaaccaggttcaatatttacctaaaattgccaacatttcaaaaatcatttaagaaaataacccaaataactcatcagccagccagtatttgttaagaagaaaggacaaattgcatacttgttaatttccctgtggggtagtctcagaactgtgcagtgacctctcgctgacattcctgcacctttactgatatgctcccaaagtctcacttagaagagtgaatataattgctcactctgatggctccattcaggaatcttcaggagacacaagtattaaaatgaatagatggcgtctggcaaatctcttcctgccagcgataagcaatcttgtctattaaatgtctcccagtgcaggcggatagtatattccatgcctggtccgtagcagggtgcaggctgatggattgaatgtatctatacattgtatacagctaatgaactggggttagttacataagaggaagattgatagaacccagaagttatagccagattcagtccagaaggagaatgagaaagcgatcccggaaatctgggtaaagggggagataaatcaggtgggtagacgttataaacaggcctgggaagctgggtcatgcaggcagtgggagactcgcgggagactgggagatggggagacgtgggggaatggactgctgatgactgcttcctgcctttcctccttagcacacttgggctggacagacatatgtgctttttaaacaagaatctttctgaaacctggaagcattagtctaaaaagatgtcagacaccttctggtacccttattttagagaggagaatgcacctaaggcacatacattgccacaaggtcaaataggccatttcctgatctttgccgctctcaaaataaaaagaaaatgtaaaacatatatgcaattgttaagacaaaataaaaaggagagaaagagaaggaactgtgcctgttgctaaaagctagagttcagtgttttaagaaatagaatggaaaagtttccttgaagagaactttatctttcttctccagaggagtccacaggttgtcatggattttacattcatctctaaccctacacaatgcacacaatatgaatcttcacaaatgaaatatgttccatatattgatctgtgatttcttttctctacagatagtatatcaacaatatgctcccatgtctgtatgtataaattaaccttgtttcttttacctagaagaataatactctattttgtaaggttccataacatatttcactagttccttataaatttatgtgcatattatttctaattcttcttctctgtcaaacaggctaccatgagtatcttcatgtatacaggaaagtgcctctgaaagcaaattcttggctacagagttactaggactaatggtatacaaattaaaagcttatgaaatattgaaaattacctaatataaaggttattggaaggtacaatggaatggaatgtacatggatctgtacagacatttccagaaaagctggtgagtagtggggtgtttctaaaatgtgacatttgccacactggtagttaaaaaatgtctaatttatatatatttaattatgaagtttagcatcttttcatataggttccatgcagctggccagaaaaaggcccccttcctttgcatgatggtggtcttgacttgtttaccatgatgccttcttacattgtgttctccgtacctggtattgagggactgggtttatcttcccacctgatgctacttatcctctgcattatgtgtgagataacttctggaccgcttcaggaaccctccctgcctgtggagtcatctactctaattgtccgggagttctgcacccctgccagaccctcccctccccgggactgtcttcctgtctttatgaaatcccagcacctacagagaaccaggcacatagaaacactcagaaagtggttggtgtaagaaggaagaaaggaaggcagggaggtgggtgcagggatgatacacgctggtatgaaacattcacagtgaatagaacatctgtaagacacagggccctggggtctgtccatggaattcatttttttcaatttatttagtgccttagccctcaggggccttgtttcctcacatggaagccagtcagttacgtatatgggggtggctaacatcccagttaataacagtgatgttggcttcagtcagatctgaatgtgagtgatggtgttctctcctagggttttgtgattagtttaatttacttaagcctgaatgtttcctcctgagattagtatgaggtttagatgatacaatatattgaaagcacttgatgcagagcctaatgtaagtaagcacacaataaccattggctgctatgagtagtacttattattagtagtagtagtatgattatttttattatcaaatggtaagatggtccatgcaatgctatctttgtccataaggccattggtgcccatgatgagcaagttattgtaatagaaattaagctcaattggccgggtgcagtggctcacgcctgtaatcccagcactttgggaggccgaggtgggctgatcacgaggtcaggagatcgatactatcctggctaacacagtgaaaccccgtctctactaaaaatataaaaaaaaaattagccaggcgtggtggtgggtgcctgtagtccccgctacttgggaggctgaggcaggagaatggtgtgaacctgggaggcggagcttgcagtgagccgagatcacgccactgcactccagcctgggtgacacagtgagactccatctcaaaaaaaacaaaaaaacaaaaaaacaaaaaaaagaagtgaagcccaatcattatcacatccaaaggcttattttgggggaactgccaacacttagcccttctcatttactgaatcggtggtgctcctctggtgatagaggcttgttcacagaggggagagtgttcctcaaagctgacctgctttgcttctaggaggagtgattgcttgtcctaaaatcagtgtgtccggttcagccctttagccacagggcttttgtacttgctgttctctctgcctggaaaggccatcctcatggtatctcaagggcttcttttcttacttctttcaagatggcaacatagcagaggcgtccatgctggcaactgatataaaatggccccaccgccccagtgctaggcaatctttagcactcaatgccctgagaaatgtccatatatttttaggtttgtaaaactttattttattgtggtcagattacctaacatgagatctgccttcttaaaacattttaaagtctacaatacagtaccgttaattctaggaacattgttgtgtagctgctctgtagagtgtatcttgcataattgagactttatgcccatttgacagcaactccacgtttctccctccctccagcctccgggagacaccattctacggtgactctacgtgtttgagtatttgggatacagcgtgtaagtggaatcgtgcagtgttttcccttctgtgactgacttatttcacctagtgtgatgtcctccaggttcatccgtgtcgtcacatatggcagatttctttctcagttaagactgaattgtgtgtatattgcatactgttacatgcattagtgtatattactgcgttttctttaatcattcatctattgattgacatttaggttgtttacacatcttggctattgtgactagtggtgcaatgagcatgggcgtgctaatatgttatgtacatttattgtttacctattgatttccaattgttcctcactaaaacctaagctcataaaggtggaagctttgttttgttcactgatcctgtgtcttcagaatctagaacagcacactgacctagactctaatcccagtacctgtttctttgttcttatttactagaataaaaagcaatctcagttgagttttaggcgttgcacaaagagaaacttccagcatgattggagacatcattgtctctggcacccttggggattcggggtcttgtgttgggtccaccttgagtactggccctatacctagaacagtgacccacattcccagggtctccaaggtccatcctcctgagtcacgaaaaatgtcctgtatggccaaagtcacttgtaagcctgtttttatttgaatgtcccggcccactccagctagtgctgtcagcttttcaggtccttttcagaagtcctgggagggtagaaagctctgtgctgatgttggatggacatttcctcttccttctaatgccccaaactcctatccattcatcctattgagactctcctagctactcacacttttctcttctgacactttgcacacttactagtatttactatttataattattctgttattgttttccttaccaaaatgaaggatgcttctctgttttgtttccttccctatcttgactaccttggtgcttgaccatattcagtgaatatttcttgaacattattggtggattgactttgtttcctctccccttccacaccacatcccagtagtggtacaatgggaatcccagactttaaatctgtcttcagtgccacttgcctgggttgccctagaggcctcctgtttttcatttttcctttgccctgcaatgtatggcaggtgacccagaagggtcccagaaggatgctcctgaagtttggcccacaacaccttcctgcttttccactgcacacaggtctttgcagactaataacacgtggattcccttgcctggttttctgggcatccagcatactggcttcaacttttctttccatcttacctccactatctctgtcctcttgcttctgccaagccaggcagttcacctgcctcacctataccctggcttttctctcgtacactttgttcactcagtactctctgtctcggaagcccactcactcccctttcaccctcatccttcctttgcacgtttaggtcctacataagctgaaaaagaacagagtctggtcaaatcttgactccgcttggccaatggatggtacttctcttagcctccgtttactaaaatgttaagggggaggagataatggcacctaccttatcaggatactgtgagagttacattagatactgtatatagactgcctggcatacatgctccgtaactatagactattatttctcttcaaagcccaactcaaaaaatgaaattcttctctatgaacccttctctaatcctcccacgcatggcctctcttcttcctccacttccttctggttctcttggagttgctgagcacgttgccatgtcttagaactcatcaggaacctgttctgtcttcccctgtatccaaggtgggaggcaagttgaagtcaggaattattcttgtgttctgcacagtgccctggacattgctgttgtttggtaattgtttttttttaatggactgaatcattttgctgctgcccaggctgctttctactacaatagcctgtagccttaagcaaggatgagctattttccctttagtaatgggccagcatctaggccttgattttgagttcttagtatggtaccgtgaaaatcactagtgttgaaaggaataggatcagagggggaataaaaaggcatttgatgaggctcttagtgtaacagtatgtctcactcatctttttttttccttagcctttgaaatagacaatggccttgagccttctcggcagatggaccatgtttgtgccttagccacttaacagccattagcctaattccatcctctacagccaaattaaataataagtaaaggcctatgaaaagctggtttggaggcagtgttactgcctttcacttgacagccttctctgaagcagatgctccctctccaccctattaacctgctcctctgaataaggagctgtccacacagaagcaaagatagaggcctgcaggagagtggtctggattctggagatagggggaaaatcctgatgatgaaagtccagcttctttggaaggctgaggcgggaggatcatgaggtcaggagttcaagaccagcctgaccaatatggtgaaaccccgtttctactaaaaatacaaaaattagccaggtgtggtggtgtgtgcctgtattcccagctactcaggaggctgaggcaggagaaatgcttgaaactgggaggcacaggttgcagtgagctgagattgtgccactgtactccagcctgggtgacagagcaagactccgtctcaaaaaaaaaaaaaaaaaaaaaagcccaacgtccatccactactcccacctcataggccacagaagatgagagctttaacccaaagtcatgataatgcgatttctgctttgattggtcaaagctgctatttgttagtagatagtatatgacctataaaagttcacaacaagaaagtaataccctggtcttactcctaacaagtctgataatacattctcttttatcacacttttttttcctctgtgtccttgcttatagactcctcctcctgaaatacttccttctattccgaaatcctggatacccctcaaggacagcctaaatgtccctatcctcataaaacacatctccgattctcaatctcattctctgactcaagtacctcctcctcctctgagcacccttcacccttaatctgaacataatttctaactgtattactattttcaaacttgaattatagatgtatgcatatgacccttactaccaggatctatgttccttcagggcaggaactctatagtcatctaaatacttcctacaagtttaaacttatttgtattgtgtttgtgtgtgcacacatatatgtacatgcacgtatgtatatatttatatacatacacatatactcagtaaacattttttgcatcaatgcatacatacttatgggcattttaattttttatttacacactctctctctcagctatcccttagtggcctcagattttttctgcatgtagtcaaataggtctctgtgcttgtgaaaatgtttctatcaactgtggatacgcataacctgattgttaaggtgttactttgagagatctagacagtgtgactgcatttttttcaacttaaagactggcagaaatctaaagcattcaactcaattaattttctctaaaaaagaagaaatttattactccaacacaaagatacctattacaatggttatgctttataaataagcaaacatggatgtcaggttgggatagctctgactggtgaccaatgcattatctctatttctctcttcttgcccttgctatctatcatgataggccttgatgccccagagaacagaaaggaaaggcaccttagagacattttgctgttgttattctgatcttgtggtggcatatagacttaaagtctctgatataagaaatacacactaacttgtttgtttggtgccagttttaagaattttgaaaattcagaaggtagccattcatcatgactcttaggtagaaagcgccgtgttcaagttcctccagctgctagcaaggacaagcatggggtaggtaaggcagaccctggttggctttcaggcatcagggaaagaccggaccatctgttgccatggcaacattcattggttttacaataaacatgaacaatgaggtgctaagccttctaaaaatagaggcacgctctatttttttccatatttttataagatagtttcacgatatatcttaggactaaaattgagatctatcctcctggttacaaggggcgagtgtagtatccatagctttttgaatggcagactccaagtttgtgtgacttgagtatgcgtgtgtgtctatgtgtatacacacagttaatattgagaacagacccttgaagaccactatacctacctatggagcatgacataaagtgaaatgtagcattaaaattatattaaaatatttgggaaaaaatagacaattttaccacctgatccaaaggagggagctttttctaggcaagtaatttcactgaagtgatggctttctgtgtcagttttctttgctattactggcctgggcaacattaaatctggctgaggctcagcactggacaaaatacaaaatgatcacaggcactcaggcttctgtagagcatcaattcactttctaatgaaaaagaaggagtaaagagagtgagggaaaaaagaaattgttggcaagctaaaaagagtttaagaaatgaagaggagaaaaggtaaagtgatcagaggtgagaaaaatgaggagaagagagataaatggtttgccatgaggagaatgtagacctttaacgtgaatctgatgaaccaagccactccgtggagatggagaaagccagcctttctttccctccttagccactatttctggtaatatcaagtccatctgtaaggcaggcaaggtgaatttattgtatttaatagcttccaatttaacaagtcgaatcggagggatccccaaactctactccccatggctatatgctcacagtgctgtgatttatggtaagccctcctttttcctaaaacaaccacctgagaggatgtctcctggcacgcgatgtcctctgaaaaccagaggccagtggttttgggagccagacacaggcattgtaagtagcacaggacgcttcactcagcagacagggcaggaggcctcggtagatgtgcagaagtcggggagaggcagggctagcctgctgctctgaccagacctagtgaggcaggagggtgactgtcgctgcttggtgtccttcccatcacagcagtgaggctgcaggccaagccttcacctggacacgatcagggactctggctctctgaagggaggtggtgatctcttttctaatgcacttcactgggtccacattaggccgacaagtcaggttcctcagggctcccgatgatacagcaggaggatgtacattcatccctgtccatcagcgcctcccagggaacctgcgtgtctgattgaagtaatttcacccatagtgcacaaagtgtacactcaatcaaattttatagaatactttttttttaacgaaaacattatgtttgttgtgcaaagttttagggagcagtgataagcaaaagcaaaacagaacaattaaaaccacctgtaattccccatccacattcgtcattgttaacacagtagtgtatatgcttctgtcggtattttctacagttatgtagttatatttttcatttaaaaaaatgaattcaatcttttgttacctactcatataacttatgtatatacacatctttctgtttcattaaatattttatgttatattttattgctacacaatattctattttctaaatggaccatcatttaagtagtaatgctcagtggtgagagagttagattgtttccagtggttttgctgttgtaaatactgttcagatgaacatcctcattgtctttattcacaagcatgattacctccttaggatatattcttccagtggtattgtggcagagaatatgcaaacagcagggtttttgacacctgctgtcaaattgcccttcaggaaggtaccctgagcacctccaccctcagcctcagcctcagcccgcttggttcttcctgctgtcacccctcaccaatgctacctattatcattttgtttaggtttgctgcttgataggtggaaatgccatgcctttgttttaaactgcgttgcctggaatagtaatgagtttgaaattttccccagatgttgaagggctacttgatcttttgtccctattacctagacacatggatcctagctgggctctgggaagtggcactatggcaactgctaggccttccctctccttggagaggaattagcgagaaaatgatgcctcttcaagtgtgtttttaaaagagtttaaaatgtaaaggggaaaatgtagatggccagagagataaattataaatggaggataattatcgtagtttttaggaaaggtaaaacatcaaaagatacataaatgacaaaagaactaaatatcttaggaagccgactttcctaaggtaagaatcgtgtgctgagtatgtggcaccaagacctggaaggacccatgtccctcccaccctcccagtgccccgacctcccacctctggtgctgtgctgtgactccacagggagattttgtgccagtgcccccaccagggactcatcaccactctagcccaatgactccaaaattgccttctcctaaatataatgtccgcgctttgacttttaaaaatagcagcagaaaatgaccagggggcactctgtgatgtccaagattcctggggcaaagcagcccctggagcctgttcttaagatagctccatccttgtcttgctgaattatttacagaacttgtgagggcagaggctgagtagaggtacttcctttctgaacatgctcaggcactccctgggccaggcagggaagccagtgtctggaggatgtctgctacccggtgtcagggagtctgccattgattttctttaggacaaacctctctgcaaatgccacagatttacattagccgcactatagagacccagtcagggccaggcgcagagacgtggggaatgccacgtgctgatttcttttctgctctgggcagttgcttcttttcacttccacgtctgaatggcagggagaagctgggtgcccccacatgtgagtcagaatgtgacctctagcatttgaaagtcctagttattaaatatatgatctgagttgtccacattaaaaaggcatttgggagtgcggggatatggagaaagatgatgagcttgatgtttggattgatttattctcagtagaggtgatttcagcaggctttcccaggcaagttaggatactttagcattactctgggtatctggccagagttttcaggggtgttaaatagtgaggctcttaagaatgcaggaagcttgggtcatctcctgcgttcctagggtactgccgagactgggttcctttcatcggtgtctcggggggttgggggtgggggagctgagccacagtggagcggaactgtctgcatggacccttccctttcttccagctccggtgtttgcccacaattccactcacttaaaatttgcctttgtcttctagccaggtagcttgccaggggaaactgggtgtgagtcaatggccttcctcttcactctatggtcagcctctgtttttgtgggacagcatcagcctgaagccaggcaaaaggcccaagtcatgtagtaaaaagtgtgcagggctcaggactggaagcaaaactctccaccaaccagcttggtgctattaatcagatactgtaactgcctggaaagatgagcaaacaagctgtattcctcaggctcctattttgtgctgtctacattgtgtcctctgtgctacctcatttaatcctgttaatcatggtttagatgggggaatatcatctctaatatgcatatttagtaactgaggtttatagacctccaaggtcatgtaaactacgaggtggccatgctagaatttaaacagcagtttttatttttgtgaaagtcttgttttctttccaagatattacagctgtcttacttcacaaaattgtcctgaggaccagataattgtaacatatatgagaggtaaaagaaaaaagtctaaccaatgtttggtagtgtgattattgcttttatattctagttaatttttctgtgatgaaaaagcaagtttccaaaggccctggctttgaagggaagtaatgcaacttggcccagtctctgggtttatcccagaaagccagttcccctccaactccctcctgcaggtgcagttttcagctgggccctcagacacagtccactttgcatcccacttcttgggaaaatttttcttaatgttcactagcgctaagatcattctgaaacctctccctgcaccactgcaagactagtgcattcttaaaccctgcagcccaaccgttacctgtgatttattttattgtcatttattcccacagacaatacacataaaaataaaggtagtaagtgtaagagcattttaattgccatcccactagtcttaaatgtccactgtttttatatctccccctcctaccctagaaaatttcagaatagagaagatcaatttatcatcttatcctcgtttcctgatctcaaattggaagatggacagtttttatgttaatagagagtcgtttagagtcagggaatttttcgaaggaaagtcgagatagatggatgaataggtggttgtgtgtgtgtgtgtattatatatattaatattaatagagaggcttcctttgtggcctcatgcagaatgcttaaagatcctagaaatgttgctgtaggaatggaagcagaagaagccgcaggcttcatggttgattgcttttctgattggtgccataaaaaaaatgcattagcgagagaatgtttgatttaaagagcgcctagatgccgacaccacctctgtttgttttccttcctttagcagaaaccttgtaaaatttttatgaagtattaatggatctgagattttctccagcaaattttatgaggtgagcttaatcccacacatccgacccaatttagcagtctttagagacatagaacgtaaaaggcactcagaaagtatcctgggtgcctcagtaccaggggagtgatggggcaggggtagggtatttcctccctctcagtgctttggtagactctcaggggttgtgggagaacagagtgaagaggtaccccacccacagagaagaccgcacaggtaagccaaaacttcagatagtaaatcttaattcataacttagcactgacttcaagaacttccctatataactgtagtctttgatgagaaaatcgtgtttagggaaaacaagaaattatttgtattaacagtttctgtgctgtcaacctggaatcactggctttaatctaagaaagagacatgaacaccgtccttcctccaccccaatttgttttctgtatttgaaacaaaagagccttgaagaagataagttacatttttgtgtatgttgatgagtgcagctacgttttgtaatgtgaagtttggcctcccacaaaccaagcaacttgatgagcctcagcacactagtgagcatttagcagttcccatcacttacctgtttatgctgattctgtactactctcgcgagttcttgccctgtaatgtgtgaattccattagatttatggtgacgaaatgaaggaagagaagttttttggaagagaaataggagccttcgccaactaagaaatcactgtggcctattcaagaatggtcaagggtttgggattttaccctactttcaggcaaacaagtccacatgccactgtttcaggggtgctggcggaagaaacgagactccagggtcagagataaaagactttgttactcgtggcacagcaggcagcatgagctccatgttcgtgtcagtgctttttgttccccaggtctcaagagggtgatgtgtatggcccaagtggatgttctgtgctgaggtggtttgcaccacaaccaagtaacccctcatttagcaaactcaaatcttttgtaatgggctgcccgcagatttgcccaatcttttctcagaagagaggtgttctctttattttactggacataaaaatctgccttgtgccatggagggagacaccatttctgtcttaaagttcttcgctgtattaacatccttgaaaagatagtcatggccaggcatagttgctcacacctgtaattccagcattttgggaggccgaggtgggaggatcacttgagcctaggggcttgagaccagcctgggcaacatagagaaaccccatctttacaaaataaaataattaaaaaaaattagccaggtgtagtggtgcatgcctgtggtcccagctactagggaggttgtggtgggaggatcacttgatcccaggagttctgggctgcagtgagttgtggtcacaccactgcactccagcctgagtgacagagtgtctaaaacaatactttaccttgttttcctgcgggtgaatattctcatgagtaaaccacctcatcaaccactctgactgatcaaggttggtagcaaatccattcaatttgtctaatacagcatttaattaaagctactatcaacagggttttgtgcagcaggatgaagctgttctacagtattgacctcaacattgttccccaagatcccagacctaaccagatgaagaaatgccacagacaatcatggtccaggtgagaaacaaaagggaaagttttccttacgtttctatattaactttctcacttgtctgaggcatgaatgcaggtacaacagcatgtactagagattgcacagacctgagtaggcttgcaaagaggcagtggagggtagttgtgttatccataacaatcctggccagtgcattgaagctgatttgaattccttccagggcaagggtgttatctccttaaatacttgaggttctctgtgagcacctctgagcgtaaaagtcacagggtgttcagaaggggcaagttaaggcctacttccacacaagaagtacaagctcgagggtgttcatggtgcccctggatggaaagtcttgtttacagttgttgggaccctcccaggtaagacctccgtccatccagaatcacaacttgacattgcctccagtgtcatctcctacatgatcgttaggacttaggggcttcagttctgctagaataattgagtctaacccctgtttttgagggacttcctgccctgtatatccatgtcaccggctggatgccattcatctggcctgtggaaccatggagcagtcagtgactctaggaagggaatcggggagacaatggcagatgttgacatatgttttgtgatgatgttccaggagctggccccatcccctaatgttcatataaactgctcagttaggttaaggggaatcgtgatcaaattgtgttgagagctgtcaggaggggatgctggacccaagagtcagttaaatgaaggtatttgcagcagattgggagaactgtatcaggtcattttcctcatgaagaggatttatggagtggttctatgacaaaagatccatcctgttcccttccagggtctacagcgttcctctccaagtgcctgaggttttggtccgtactctgcaaaattggtctgttacatccagtagctctaacttcaccttttccaattattttctgctgatacctggaactttcatcctgaagattcaggtgcaggagggtcaatattgctttttgaaattcacagagatgcgtcatgcctcctactttggcctgtttgagcaccgtgaggggatttggacaacagcgtcttcaacctactggccatcacctttttcatccaggagcatgtcaatccaacaagagaattcaggcagcctaaccagatttaagcatgagtcccctagatccttttgtagccaggttgctacccaaagggtgggccaactatgctggcctggggttgctgtcaagggaagaaaataactcatgttcccaggaatggtcaagcagaaatcctgaatttgaaaaaaccttcattgttccctccatttattttgtcctgttgattatgcaggaaatggcaggaaagagatgatccctttcttggatcagccactttcgggggccaaagcaccctattaaggtgtgtggagtgggaggacatgagggaaaaagagacagaaatctttctgattcaatttttcagaggctattccaaagcttggtgataccagatgcctgtggatgatggggagaattaaagcccgtcaagtaatccttgactatcaaatccattatttaatcatttttgtgatgaaaggtgcagcattgctagactgaagatactctggaaagcctagcacatgacacaggttggtctgatgaaaggtgaagcattgctagactgaagatactctggaaggcctagcacatgacacaagttggtctcaaaggccacactagcatggggagcagaatcagattacactggagcagcagcactgtatcctgcaagagtggccggcagtgaggcagcatcaatagccctgagagggggtcaaaagtcagactgagtgagtgagtcttccagaactgggcaggggtaattccccatgccatgcaacctttcccactgagacagagatcaccttttgtcaggagtcaccaagtgtgaaatgcagtggtagtccctgcattcgaaacatagagtcttttactgtgtgcctagtctaggaaggcggacatgttgccacatctaggatgatgatggatccatgcaccaatggtgtccatgtttcaccaaggctccatcagcaacttgattttgcctggtctcatgagggaacaggcgtttgttgtgtcatctctgtgagtggcctaggtggtttgtgggtgcctacacccatcagattcccttcattctgagccccttccctccttatggctccttagcatactttcctgggtgcatatgtcctgcaatacctcttgagggagcaccaagaaataccagcccctctcataatcatctttctctttaaagcagttgaggtcagagtagagggggtaggaaggatcaaggggtgtgaaggtcgagagcagtttcatgccaataagcaaggcacaaccaaacacatttctaatgttatggactgcacaattgtgtccttccaaaattcacctgttgaaaccctaaccctcaatgggatagttttgggagatggggactttgaaggtgattggatcatgaggttggagccctcataatggaattagtgcctttatacgaagagacacaagagagctccctctctgctgtcctccctgtgagaacacaacaagaaggcagccatcaggaaaccaggaggcgggcccttgccctccagatctgctggcatctggatcttggacttcccagcctcaaaaaccctgaggaacaaatgtttgaaccactctgtctatggtaatttgttacagatgatctaactggccaagacactaatgtttgcaatccacacaaagttccgtgtcctcattgcttatgccatttaccctgactgtggacccttgggctcagcagctgcagccttcttgtcagctggggctcaggttgccaccccattttcatgaaaacatccctccctccttccaccccaagtagtgtgagcaatgaccacactgtccttcagcagctcgttttattcctacttctcactgcaacctccaaacgttcattaataggtcggatagtgaagatccttactcactgcatcccccacccatcagtgtgaaatagcgtttgctacagggtgtcaaggagtcatttcatatccctgacacagcctgggacgcccacttccttacttttccagaaagctacatctttgtcagcatcccattctcatcactgaaatctgtcaggaactgtgatggatctgagattttacccaacaaaagacacgagactcctgggtcctaggcaaaagactttattactgtggcacagccagtggtatgagcttcaagttcacaccagctcgccatgctccccaagcaccccaaatccacaggtgtgacccagagcagcgcaaatggaggctagacacttgggttgtgtttgcatgacagctggataactctgagtttggggaacctggatcttttataatggactgcaagtaaacctgctcaacttttgcctgggagggaaatattatttttgttatactgggtgttaaagaaaacatgtcctctgctcagaagggagatattatctctgtctttcaggttgttcagtctacaaatatccatgaaaagataggtcctcttcttgcaatatgtgcagaaatgcaagacacccatggagaatatctcctgtgaccttgctaaaaggattctagccagaggcactgagcaggttattgttggagctctactcctatgttgagagcatcccttgattcagccattatgtaggataacatgccaggctctggaataggcacagggtagtgaataaataacacagtaattgtttctgccctgacagagcttatacagacaaaataataatgatgacagctacacttatatagtgctcactatgcactaggccttttctgagtaatttatatgtacctacttatttaatcatcagaatgacactttgaggtagatactgtggctatcattctcatatttatggatcagaaaacagagagagagtgttagagtcagaatccaagcccaggtagtttctgaatgtatgcttctaatctgtcttagtataactaagtacgctagttatacttagtataagtctgtcttacatggcttctagtggaattaccacacaggattataaattcagtgattttataataaaagatgaactggggacatctaggaggagtttctaagccagaccaaagggctgcccagaagaagagatatctaagaacagtccagaagggtgagtggacattaaccaagggagctggagaagacagttctcagcagggaaaccgcgtgtgcagaggcccaggggttggttgggggcttcctgagatgacagtaacatctacttagatgggtcatttgttgtaaggcacacatttatttggaatgagtcagctggtgaaatttcccccagacttctaattcacagctctttgttttccgtgtatttttaactaaaatatgcaacacttctactgttgagatatcacagcagcctctaaagtgtcagcaaaataagccagggcatagccaaagtgacaagtgaaacccagcattatttgaatttattttgatttttgtagaattcaagtgtctaattattaatattaagcaagtagagaaattaaggcaagatacacatgggattatgggacacaagaaaaaaataaatattcaaagcttcaaagactttttggatatgaatagcttctttgatggtctctcttcattatggaatcctgttaggcatcattgtccctgtgatcaatggctagatctggccatcatcgtcagcctcccagtagcctgggtgaggctccctgggttgtgagtgaagactggttatcctggtctttcccatgctcattccacattttaatgcagtatcaccagcttgagagtgccatgtgatctgacagctttgaataattgatgcccctcatactaaaggagagtttaggttttgtggttcagcaggatgctttactcttgttgaccttaaccttcagaggcactcgggcattaccaagagatcaataaaacttaccctggctggtctgtgaggacaggagcctgacagagagtgatgatcaagaggagaggatgggaggattacgctggaacctggggaagaaaagggaggatgtgtggggtagagtggggaaaggggtggaaatagaataggggagcatcgcagaatgagggagacaggagctccgaaaacgatgaagtgcatgacaaagcaatggaaaacaagggttgaacagaggagaaagagtatcaggaggaacatatacagaagccaagaggatgaatgagggacgcacaggccaggaaaggagctctgatctgtaaccctcctccagtctgtggttgcaaagctgtacagtggagggaggtcaccagggactcaacgtctcctggaaagcagacaaggaaataacttatagagtgaggcagaataaaataagggttgtaagaaaggaatgcagtcactgctgggcattggaggcacataaaagggactttaatgcttgaatgccaactacatgctaaaagggcatcggcacattattttaattaattattattaattgtattattaaatattgtaattattacataatatttagactaattgtcaaatgaaagtctcaggtaggaattattgtcctcatgctaatgatgaagaatagaagcttaacgaggttgagtgctttgagtaagctcgctgatcagtggtggagctggaggaggcttgtgactctgaagcatctttcaactcttgtcactgtctcaggctgccgcccagaaaggcaaacattggagtgatttattcttacaaaggcactggagaaaacttcagtggactatcagctaattgaaggtgaggactgtgtctgagttttcaaatctgccatggctagcatagtaaacactgcataagaatactaaatagtacatggaaaaaggaagggttggagcttgggtaggtaggtagagagcaaaggagggagggagggaagggggaaggaaaggagggagggagggagggaagggggaaggaaaggaaacatgagagggaagggaggaatggtatttgtgctgaatccagaaaaacaaattgcatttttctgggggtgatggtaggatgaagaacactcgagggtgagttaatagcataatcaatatagagtttgcatttgtgtgataaaaaaatgacaaaaattcactctagccagagtctagttggaagaaaatagtgggagatgagtttgctgaaacagaatggatcctgattcattcattcattcaacaaatatttaccgaggcagaataaactaagagttgcagtaaaggcacagctatgaataggcactgctaaaggagcctaggatacatcagtgaacaaaaccaacaaatacactttccctcacagagcttacattctagtgaaaagagacagacaataaacataatacatgaataaagtctacagtatgcaaaaggtgacacatgctattgggtaggggaaaaaagcagaatagttgaacaagagatacagggacaagtccaaatagtatatttaggttaaccattatggaggcgatgtttagcaatatcttgaaagaggtgaaggaatgattaacgcattttcctaggaaataaattccaggcagaagggacaggctatgtaaaaacctgaagacagaagtggacctggagtgtccatgggcaggggtggctgggatgcagagtgtggtgtcaggtaagtagttggagaggtgacagcagtctcgatcaggtcaggtctcagggaccctctcaccatgacagaaacaggacccagtggatggctttgagcagggtaggggtagaatggaatgtgttctaaaatgggacgctggcctctgtgtgaggacagacatggtggcaagtggtcagataggaagctgctgctgttgtcactcacagatggtggtgaggaaggtgcccagggtcagattgtgaatacctttagaaggaagagccagtaagacttgctgatgggttacatgtgggatgtgagggaaagagaggtgtcaagagcaattccagggcttctggccaagttgccactatctaagatgggctatgatgtgggcaaagcaagtttgctggaaaagatcaggagttatgttgtccacattaagatgaaatgagtgttagacataaaagcggacatgccaagtggacaggtgaatataaaagaggctggcacggaagagtgatgtcttgtaggagatttacactggagtggggtcatcagcacacacatggtatttaagactgtgagatagaagagatcatcagatggagaatagaagaggtccaggcatcgtgggtggtctcaaatgccatacccacagttcgaaactttaatttatgatcagtggggggcaactgatatatacttttggaggataggcatatcacggtctcagctgggcttgtttcattgatgcttttttttgtttgcctgttttgtgcagagaccacgctgaggtcatgtgtaggttggccctgggaaggccaaacaggaggctggtgcaccgagccacatgaaggtgggatgaggaccaagccaggaccattttaatgggccagggaggagcaaggagcaggcagagataaagggaagaagggaaaagacaaccaacttccctttcactcagttcaaaacagcaatcaccagatcaatagagaagaaaacataatttaagcctgaaacgaaggtttttgtgttttcttctctctcttttttgctgcttgaggcatggcaatgcttgataatgctttgcttcctgggggcatagctgacaacagtggggaaggaaatagagacaaggttttcagtattttagaaatctggtttctatctgaactgtggagggtgaggagcctgcttttctcattaactggtcagcatgttcagaatctgagagggaatttttgagacaaacagatctgaatgccttcagatagaaagatggaaatgtttctcctccccaaagtcccttgaccttttaaataattgccattataccaaccgtatataggaatcggctagaaataacataaataaatgcgaaaccatgtgcctacacgtgctagctagtgttttaccaacaagaatgggtacaatttaaaatcacctttatacaattatcacaatgcactctcacaatgatcttgtaaagtgaataaggatctcctcccctacatattttactgggaaataaaaaacaaaaaactaagacgtaagcaggctgtgacttgctcatgtcagagagaaacagaaccaagaatcaaaccaatttgtgagcggaggtctgcttctccacggtgtttgctctctggagacagagggaccatgccactgaatacactggaccctggtatccagtgcatcctcaggcccataatttgccattgaacagttcatgatcctctaaacttggcgtcctccccagcacctgtttcttaaacatattaaggttaaagagtggcaggtggcggcccttcttccaatcgtacccagcaaaagtaggctcaggggctcacatctggagatacaaagggatgcccatttctgtgtctcttgcctgatcttgaaattacccatcttgcctgatcagcgtttctgtcttcctgactccatgtgctttccttctgagtctttctggactgccctcatgtgctgtagtaaaagtgtagcagcgtttcaagctatggggttattgctgggatattttatatctaacaggcatgggggtgataattcctttttcacttttataattcacacatatcctcccccgaaatgcatttcgtatagagcttttaggcaactgaacacaaagagccttccacccccttaattctcctgatccttatttcaactattttcccactggctttttctcttactgcactttgggccaactgaaagccagtggtgtttaagaactcccttatggattatttgtcagtaggcaaggggatgctacctctatacctgaaacttccataatcaagcacagtttattacagagcaaatacaggacagtagcagggcttttaaaaatcaattagtgtgcaattcaagattaaaaacagaagagggctaattctatttttcatttggatggtaggctgcttaaggaataatagtacaaagactgaagtcattacaggaataatcagaagtttacccaggtgtctttctgagcccctttcctcctcaaggctcagtagcttactttcctgggttcatgtgtcctgcagttcctcttgagtgagcaccaagaaatactagcctctgtgaatgacaggtgggggcttcatgagagctggaggtgatcgaagacaggtcacattctcctaaaacctctgatggtgttttctcttcctatgctagaatctactccattcttttagctgtactctgtatgaatcatatgtacttgttcatgtttttctgcaattactcaaaactgtgtcttcttgacatatgctgtttgtccatcagctccagagagcaggctcctttaatctgttggctttggagactgagcaaggggaggcagggtgagtcctccatgcctttcactatggattagccacataatagatgttggggtttcatagtttggggttttgtggcatatgatgtgaatagaagcactttagactctcggcagatctatctctttgaagttctcttattatgtctaattttgagtactgcacagaatagctataaattttgacaatgataacctgctctctaaccccaggcaacctgctcctcttcccttttcaatgttttcattttagtataaagaaagagcgatgataaatttttttatttttattttttgagacagggtcttgctctgtcaccgaggctggagtgcagtggcaccatcgtggctcactacagccttgacgtcctgactcaagagatcctcccacctcaggctgcagagtagcagggaccacaagtgcgcagcaccatgcctggctactttctttttatggacatgacgtctcactgtgttgccatgctggtctcgaactcctgggcccaagtaattctcctaccttgacctcagaatgtgctgagattacagatttgagccactgcacccagctaataattcttatataaaggcaatgaaagcaatgcaattagaaacttcacctgcaccctgtcacaaccaaatcataattgtcctcatgcatccaggtcaagaataatggtgttaaaagccagttatcatggctccaatttttctatgttgacctgaactcagcttgtgctagtcttgggatttgattgtatgttttctgtttggcttccatgttctacctgccagtgggcttggggacctcttgccactctgcaccaggtaaactggaactccacatggaccttccgatttggtactgagctgtcattcatttgtcaggcctaatgttgctaatcctcttctggaaactttatccttcccgaattgggccacctgattcctagctgaatgttcacatctgctccccattccttcctaggacctgcagacagaggcagcaggtacagttaaactgtggtcctagcctctgggattcagcaacacttccgcctcgctgcttatctgaccatttttattcccaggcttatgccagttatgatatacattccaatcttatacctgggctctcccctcattcttcattcctgatcccactcattattcttcattatttttaccacagatgcagggtggctgagggttgagttaatcacattcctcagttcatagcacatcatcatccctgacaaggggatcattgatccccaaaagtgttatcttatttttcccctcatctctgattctatgccttgtccctttctgctacagcttcccacaccaaagcgtttcataaatttcattaaatgtgcatgtgtctttataaaatgtgatggtgcattgtatgcatatgtcactgatttatccatttatttgatttatcagggctgtctttccaattcccctctaacccaaacaagcctatgacaaacaaccctttacaaaccaatgagaaatttccctagtttcatagccagcggtgattttgctgggtcatgggactccacaggcttaattgtctaaatagctgccatattgcttttcaatatggatttacaagtgtacactcgccagtagagtgcaagagtgcccatctgcatgcatctccaacaaaacttagttttctctaatctctgattcccatttttaaaaccatgttcacgggtgtaaaatgacacctcactgttattttcatttgcatttctctggtcactggtgtgagctctttaatttgtgtgctttctcggctttttcttatgtgtattaccgattctttggcctattttttgattgaaccacctatctttttcttgtagattttcaggaaaaaatgcttggtatattcaagatgttaattacttctcagttgcagatattgaagatatgtgtcagtagatattgaagatatgtatcattttgctttgtcgtctcttaccatttgtcagtggggctcttcatttgcggtatagtgattaagagcatatatgctggaaccaacctgcctgggtccaaatcttaactctgcctctgagctatgtgacctcagtgatggtccttaatcttctatctatatgtaaaactgatatattaaaatgaccatctcagcttgagcaacattctgagaccccacctctacaaaaaaaagaaaaaaaaaaattagctgggcgcagtggctcacgcctgtaatcccagtactttgaaggccgaggcaggtggatcacaaggtcaggagatcaagaccatcctcgctaacatggtgaaaccccgtctctactaaaaatacaaaaaaaattagccgagtgtggtggtgggcgcctgtagtcccagcttgggaggctgaggcaggagaatggcctgaaccctggatgcggagcttgcagtgggctgagattgcgccactgcactccagcctgggcgacagagtgagactccgtctcaaaaaaaaaaaaaaaaaaaaattagccaggtgtggtggcacacaactgtagtcctagctacttgggaggctgaggcaagaggatcccttgagcctaggagtttgaggttgcaatgagctgtgattgcaccactgcacttcagcctgggcaacagagtaagactctgactcaaataaatacataaatacatacatacatacataaaaataaagttaccttcttcatagggatttactaaaactgaatgagttaaattgtgtaaataacttacaatagtgtctggccaaacacatacatacacatacatgtatatatataaattatatatgtattttcaaagaaaacaaataataatttcttttttagctttataattttgccttttccatttaggtaattaagatgaagtctatcttacataataaaaaataatcttaatgtaacaaaaggtagggctatagctttgtttcctcccacgttgtgagccagttttccagtatcatctactaaactgtctgtcattcccattgctttgagggactactgttttcatatgttgggttcctgtatttacatgcttctttttctgtgtttctgctttggcctccacattgcttttctgttcatctgtgctgatggaacccccgcataatgtggctctcttggtttccataaggctctcaataaccaccctggaacagaggcagtgtcagggtattaacataaacatgtttttaaagataaaaaagagtgccacttacaatctcatgtataattttaaatgaaagaaagcctgtgattttgggccactgttgagtgaattgtgtgtcagcattctcattttgaacgtgtctcattcagcgatgtctaaatcactttgtgccatcttactaagtagaaacaattcaacaataaccaggcagataaacaaataatcaagcagaccaacaaaaacaaaataaacaacatgtacttaacagtttacttaagtaaagaaaagattcgttctttaggatctgtgaagaactctaaatgtattagaatgactccactttccctaaagagtgttctcccaatcagggctgcctttttcctctgttcccatctatagtcatgtcaccagggatgactgcgcacaagtgaagtggaaaaaacacagtcagatgtcatatcacctctaatcctttttgtgcatccagttcttccaataggatacagagggggaagttgagcacaagattctgcagcggtaactcaggacttttgggaatttcaaagcctagaattctaaatgtgaggcctctcacttagctcttactttacagcatgtggaatagttcagcccctcaccatccaaggcaagactggtgaacctttattagtgcttctcatgtgaagcatccatgcttgttcctccactccacagtgaatccctaagggcaggaggggagtgctttgttcttctcatcttgtttttagaagactaactggcacaggccaggcgctgtggctcatgccgataatcccagcaccttgggccacagtgggcagatcacctgaggtcaggagttcgagaccagcttggccaacatggggaaaccccgtctctactaaaaatacaaaaattagccagatgtggtggtgagcgcccgtaatcccagctgctcgggaggccaaggcaggagaatcgcttgaacccgggaggcagaggttgcagtgagccgagattgcaccactgcactctaccctgggcgacagagtgagactcagtctgagaaaaacaacaacgaaaaaagaagagtaactggcacagcataggcattcaatatgcacaacatgggcttggactgtgtggttcactcatatgcagattttcttctgcctgtgccacccctgaggctggaagaccaactcctcagcctactccagctggagatggtgaggacgaagacctttcagatgattcacttccacttcatgagtagtacatatattttttctttcttgttattttcttaataacattttcttttctctagcttactttattttaataatacagtatgtaatacatgtaacatacaaaatatgtgttaattgactgtgttatcagtaaggcatctgttcaacagcaggctgttagtcattaattttgtggggtgtcaaaagttatatccagattttcaactatatgggggcttggaaccctaactcctgagttgttcaaggaacatctgtgttcaaatgaatgaatgaatgaatgaattgtgttaaaattgtgtctgtgataacttattccttacccaaaatgcatttaggctagctttttttaagataggagtccttttgcattttccttagcacctcagaatatttgtcctatagacaatttgaacagtgatgagcatttgcatatttataatctacatgtgaacttatacctctttgctctcatgttaatgagttcaacacatagtgagttagcatcttctgtgagcatagcataacgtctgagaggtgcacaaaagatacgtgtaatgtgaaaagagattagaagatgtaagcatgggctcttggatctgactgcctgggttcaaattttgaccctggcatttataaaaaacatgaccttgggtaagtcactaaaatgctctttgccttagtcttttcacttgaaaaatatttttttttctcatagagttattgtgaaaatttagtgagataacatatgtgcaaggcttggcacatacttagcactgcataattattaggtcctagtgtttttacagtctgacctacaaaactttcaaatttagagggggaaataagacagagactggaatagtctaaacttttgaaaaggctaaaacatatcacaaatgtcctaaattatgcctatatcgtgtccttctgcgagcctccactccatttattaatagtttgcaaaaaccttcagtagatctccctgcattgacaagtgagttttcttttcttagtggagttcttcagacaatgcaatctgacctatcttgtgccttaaaaaatattcaggtacagtaatataactgcctagtttccttgtttttctttcttcttattttttgccttttcaggtaacaagtgggaccaaaataagaatcttgccttctttttttttgagacagagtcttgctctgtcaccagtctggagtgcagttgagcaatctcagctcacttcaacctctgcctcccgggttcaagcaattcttctgcctcagcctcccaagtaacaggactacaggtgcacgccaccatgcccagctaatttttgtatttttagtagagatagggtttcaccatgttggccaggctggtctctatctcttcacctcatgatccacctgccttggcctcccaaagtgctgggattacaggcgtgagccactgcgcctggccgaatcttgccttcaatggaaagcctagtcttctagatttataagccttaaaatgttaggggaggggggaaaaaaaacctccaaacaaaaccccaataaaagcttaaataagggcctacgtgaatgaatttgtcatcagatgtgtttgggttgcttgccaccctatttaacggtgtgtttgttttgtgccttttctgcctgagttggtgtaaatgtcttttctccacggtttccttcctgtgatgacatagatgggttggattcgagagtcctcagcttaccgctcttccacttgaaaggaagagggtcatgagaggagaggatttctggagtggaatttcaatctctggtcatcaggaaagggaaaacattctgcccaggatttcctgtcatttattctggagagctttgtgttgtgctctgtgcaggatccgagatatgattaactcaactctggagtctgttggcagaaccaagcagctctggcatcagaagagagatgtccttaggcctaacctgccctccctggggtcttgttacctgctcaaaaagaacccagtggcctttgaatgcattttaaatctgtgattggtgcagtttgatggtccttccttccctccttccctccctccctccctcattccttccttccttccttccttccttccttccttccttcctttcttccttccttcctttcttcctttcttcttcagtttaactcagctttcaataagcttaatgggatgaagtccaagcgatgaaaagagaggtgataagagcacaaaggggaagcttatacccgagcatgggtgagtacaggagatgggttgttctgattattcttgctcctgttttgccttggccaccagttggccaggtcggggacagtatggtttatggactgctgtcacttgactcttccttctcagttgccttttaccttggatgaattttcaacgttctcttcccactttcaatcataaggagttgttgaatagattcatgttttctttcattcttccttccttttgtcttttttaactataggagatgggcacactgttcaacacacagataatttagaagaatgtttcagtgtcagttcttcctctccaccctctttcaccccagttcagtcataactgaaatcacaaatgaatggatccaattaatagtaaaaataaaatgtccaggatgctctctggagttctgagatccataggtcacggacagactcaagaatacaaagtcttcttcaggcctctgtttctaatttgcagaagaaaacaagagggtgagtagtattttgctttgaaaagcatctcagcgaaagtgctacatgataacacagccctcatttccataattctgctccctccggagcacaggtacatttaatttctcacaactgttccctaaatgaagagcagcatgaggaatacacagagaatgaaaaatatcggtgtgtgtgggtagtacatgaccactaatctttcctgacatttactttcactcatgagcacaggggtgaccagccccaccagtcctagatgctgaagataaatgtcagcaccatccattggaagctttctatgcatacatgcatattggaaatcaaatatatttggcttatcacacactgaggaacccatcccttcagaaatgcatggattgatctctgctaccccactcaccagtgccatttggtaaagttggggaatggtaagatagttcgctgcatttttaatggaaggaaaacaaaaagcgactacgcgtaacagtttttacattatatgccttcagtgctgtgtgctgtcaccccacgtgttgtactgccaaatttcccaagagcgtctgctcttcctattgtgaaaacaatgagctggtgtatgtcatgcaaggctattctgcccatgccaaatagctctgtatgttttaactgtcttcacactgggctccaccaatcactcaggcgcatacctcttcctcagccctaggcaatagaagttacagcattcatgagcaattgctttcctcacataaaggaaaaaaaggattttggtcttaaggtcttgccagctcattgactaatttactcctaatcctgaatgtataaagccacttgaacatttcatttgtgtgacatggttaaaggcttacgtaaatatagctggtaagggctaggattgtagattaaagtcagaaagaggtgattttgttctttttgactagatactgtaaattctgatgtccaattaagatctgaaggagaaacctttgtaacccaatgcaatgtgagtttctcgaagaaaaggaaaaaaaagggaaacaagtctccattctcagggacccattaacagctcagtacaatgactctttatgtggcctttgatatgcaaaaacagcccaaaataatttatggagaaaatcaattatgagctgaagagaaaaagaaagttgcccagattaattaccaagtcaggaaggatggcagtgcaagcacctggagttatgtccaagggggacgcccttctgcaaaaattcttcatggtcagaagaaggctctgtggtcaggagagaagggagccacatgaagtcagatgagctgagctgtaccttctggaatgctgagaatgagagcgcatatcatctattcagtgagataaaaaggctgcttcaaaactaaaggtatatttcataccctcgagtgtgaagtgcaaattgacaatggatggaacaatagcattggctagaaagcctggaataaaaccatcacaaattgaatttagagaacttatgaaagctaattttatgcatgttttattttattacatatttttctttaaaacagtaatagactcagggatgttggcaatggaggggattttagaacacctagtctggtggatttcaaattattcgggtcagagcacctattcttttgaacaaatcttactcattattaagaaattaaagcaaacaaagtcagaagaaaaaaaacagtagacctgctctggctaaggggctgatgaggttggagtctcttccctatttcctatgactgttcccgaggctcctgcagcagtaacctaaggctctagagtctcttccctattgcctatgactgttcccgaggctcccgcagcagtaacctaaggctctatggaacactatcagaactcagtgattcctaatattagttcccacactagaaccatgcatcctctaccaaaatacgtttccttagtttaataagtttgttaaatattgcttgcacaacccagagtttggagaattacattagcacattgaaggctgtgagagtaaaacttcagatttgaaatgcattaacctatgtttaacctggtttttcacctgcatacttgaatgtacctgaccgggaaacccttttatcagaaacacgtattaacattctgtggcagataagtcccctaggatgcagtttagaaaacaaaactcttgtctgggttccagtctaactcccttgttttttaagtgagggtacagagcctccgagagcatgtaaatcgctcgctcttgggtacatacttggaagcaaagttaggaaccagacataggattcttgaatccatgaagctaaggggattttcaaacatattttctttaatatttccacatgtctgtgggcagggagcagtcatgttctattcttttgatgctatacactgaaacacagaaagtcaaggttacccagtcaaactctagtataatccttccttcagtgccctggtcggcttgcttggtgctaaaagaaaaaaatcaatccatctccctgctgagtggaagaggataaagctgtccaatttttagatcttagatatttaaactaaagaagtgtgtgatagcattattaacaattggcgtagtaatttcttgaggtttagataaactagtttacattcgcaacatttagtgatgatttaagatgctttgctatgttggcattcaaaaattgggcaaacctctggccaaagtgaagtacagcccatgtgagctatggaaatgcaattaaaaggagtcacagagccttctcaactgcctgggcttaattaagatatgatctgccagtctcttagtggccattaattcattgtctggtaatccaataaggggttattgtttgaagctgtttgagagccacttgcctcactattaactcaaaattgcccaaaaggcggtactacaatgtcattctccctgccccaaagaggacatgacattgaaagacatttgacatccacatttgacaacacttgaaatggcaacattatggcttaagcattcacaagtctatggatatgataatggaactagtgacatctaattactaactggcaattaatgataatagccctttgtgaatatgtagggccattctctatagggagctccttgctctttgcacatattaattaatatagataggcaggtaggtgatagaaaggtggctttataacattattgctgctgagtaaactgagtcaggttccaactgcaccttgtagatgcacaacgattccttgctgttttgaaactaaatggattacaattttaagagtaattaaagaggaatgagaactgtagggaagtgaagggaatggatgtcaaaggaaaattcaaggtatcactaactatttgaattcttgatttacttccacccatgtttctggaataggaattggtcatttttcccggattggtagccagatatgaaacattaagtcggctttcagcaaaatgatgtctggtatattcagaataaggccgatttattttctccccacagagccccattgatgctgaatttttattgcccaatagaattcaacctggttgtgattatcccattggtcctgctagataaaacccatgtgtatttgccaaacacccacttggaaatggaaaatttaattaaagacaggaaactgaatttaatgatctctactgatctcttaaattccccaaattatttcattatggcttacttattgaattttcttaaggaattctaaaataaatgaacaattacctgaattttgcagtgttgtacatagaaatagagtgagttttcaccacactttcaaaaacaagtgagagtctaccccactaattcatatattctttcattcataagcatttattgagcacatacagtgtgccaatgctgtgctgagctctgggtgtactgatagaaaaagctttgatgtggcccttaagatgctcagtgtggtgatagaaaggaagttaaacaaataagtacaatccggagtgaccaattctacaacagaaagatgagcaagttatggggagtaatgagggcaaagaggaatgagagttaactttgtgagtagcccctgcctggctgtgcgataggggttcaaatccgactctatgtttatgggaagtactttgttccatctgcctatccacctgtcattacttcaagttgatttaatagttctgcagttgggacctgtggggtgtgtgtatgtgtgtttataataagtttaaatgaggtaatccttttataacctcactactccctattgggatttgtttgttttgatggaagggagggagatgagatttggcacatagcaggtatccagcaaatgcaactgcagcctgaagagtcaacgtggacaaatcccaaacaatgtgagccctttgggaatgctccgctttgtgtttcctctgaattgcatgaggctaccagatgaggacaggaggagaaagaattaaagtgtcctgacaccgtgttccaggttgtgtagcttttaagtgggcacccatttttccacctaagagctccaatgtgcctctgtttgaccacatggctttccggttagctgtgtgacagctggatgtcccagcatttctttctctccctttccaatcacgagctggagcagtcttgatgaatctctgcaggcacgtcgtcctcaactgagggatgattcattggcatgaagctgttaagtgattaaaataaagcacttttatggaaacgttctgcttactctgtgttcccagacacctctgtagtgtgtctgtggcaagagaggactgtaggggacacacatcgtcttatcattttctctcttgttacaatatccaatatttctgtgctagggcagaatttgaaaattgtagttcaattcagataaccttgcatgtgctcttgggcccttgaaaggagagaaaacaggcctggtgcggtggcttatgcctgtaatcccagcacattgggaggctgaggcaggtggagcacctgaggtcaggagttcaagaccagcgtggtcaacatggcgaaaccccatctctactaaaaaatacaaacattagctgggcgtggtgtcaggtgcctgtaatcccagctacttgggacgctgaggcaggataattgcttgaacctgggaggcggaagttgcagtgagccaagattgcaccactgcactccagcctgggtgacagagcgggactccatctcaaaaataaaaaagaaaaggagagaaaacaagcaaacaaaaaaacccacagaaaacaacacaacaaaaaacactaaaaggaaaaaaaaagaaaccgtgcagtttgaaattatctcctaggttgcccatctgcccaaggggaaaagtctatgagaaacatactggggtggagggaggggggacttggaggcagcaacacactgttctcatgggaagggaggctcctttttgtttgttttgtgcacaggaacttgccctgattggagtagagtttgcaaccctccccagtgtggggtttctttgttacgaagatcaagagaaggcatagggaatgcaagaatgtaaagagaaagaaggggcaagaacaaggatgaaaggagctggagaagggaaagggacagcgatggcaggaatggagagacacgagaggtgggatgaggaaacaaggagggtcatggaacagacacagctgctcctgaaagttcaggagcagctgggagaggggcttctggcttcttccagccagggtgctcccctatggaaagcagagtttctgggtctgtcccgtgtatgtgccctttaaagcaagtgtcactggagacacataaaatgaaagggggggcagggtggaataaagggaaaaattattgtaattcttaaacagacaactttaaaaagcagtgatttaggttgttttattcattacacgtcataaaggactcaggctgtggtgcccactggctttaaaatctaggaccctattaaaacctttccttgttagtaactcagagctttggaaatttgataagaaaaaaagccaatttaatcaaggcaagatttaacacaaagaaaggacctggtcttgcctttctgcagaaaaactttcaggatcaaatggcttatgattttcatttacctaaagaatcccagtggaatcagcagttggggagaggaggggtcatttcattagcttgcagggcatgcccagattcagtttcttcacacactactggctgcttccttagctactcaaaggaaaatgatttttttttttttttagtcatactacatggaagaacacccattgtctaaagaagaggcaaaagcaaatctgcctaatatctgaaagtaggaaaagattggttggtttatcttgacctcagtagatcccattttcaataacctgtattgtaccttcaatcctcaaatgataatgtggcatttgtggcatcacaaaaagagatgctggagttggggagacacagggttgagtccaacctctctaaattgtgtaaattattaaaaataaaaacataacaaacctcatttttcacctctctaaaatggagagtataaaattgtatctttttttttttttttttttgagatggagtctcgctctgtctcctaggccagagtgcagtggtgtgatcttggctcactgcaacctctgcctcccgggttcaagcgattctcctacatcagcctcccaagtagctgggattccaggcatctgctaccacacccagctaatttttttatttttattagagatggggtttcaccacgttggctgggctagtcttgaactcctgacctcaggtaatctgcctgcctcggcctcccaaagtgctggtattacaggcatgagccaccacgactggctataatattgtatcttctattatataaataaaattctctgagttgactcaatataaatttatgacttgctcactcaacaatctacaatgaatgtttctgattgttgttgaggagagaggctctgctccatgtagtcactcagggatccaggctaaccaaggctctgccatcttgaacacatgacgtccaaagttccctgagcattagcttccagccaaaggaagaggacagaatatagaagaatacataagggagattgttaaatgtcatatggtatatatcactttttcacattcttttggctagaatgaaattacttgatctacctgcctgtagagccaaagaaaaggaatgtaacctaattaatgccaagaaaaaatagacacagattttggtgtacaggtagcaatcatagctacagtaggcatttaagtaaatatccatttgtacccttcttcacatactcagaatacacagccccaaggtagactactcaaaatccaattcaattactgcattcagctcaaagtccgagttcacctggtggtatttactcctttttcttcatgatcagccatggctgtttatggatcactgacgtataactgaaaagattgccaccccttattccaaagtccttttaaatggggtagcaagatgggattatcacagtaaaacaccttatttggaaaatggaagcattgaagatacacagcagttactggttcatgggtgatatttttgccccggcagtggagaagcttcttatctatactctgattctgttctccaggaggagatttcttacctattgttagtggtggctccctggcgtcacacactggatagttcttctttgttcagcatcctccatggccacatctgaagtggtcattgtggagtacgccctacttgggggctgaatgaattatctagcccatttgctgtgagtgcatgttggggtgtttggcagttggtttacagttccaggctcttttaaaggaaaatcatagtttttcagctacacaaaaactgtcaaaagtatcataagcttcttccctatttattttcaggcagatccatttgccacatgaaaaaaaataaaaaatataaatagatataactcatagacctacattattgctttctttttgtgttactgtgccctttttcttctcttaatgtggatacattgggatactctgaaagaaagggcgtggaaaggaaggtaaaaaccttgatttgataattgccacgaaggtgaggcctttcgtcaaatcgttaagtaatattgagcctttgctgcttagaaccattttttttaatcttcttcctgacatttgagatccagactgagttggtgttctcaaacatttctgaaatcagtctctcattccctcccccttcatttgcttgaaaataggagcatctcttctgagctcatctcttgtgatcatcggtgtaaacaaagaggagtaatcaatcccagaaacgctttggctctttctatccatttcttctagagccgcaggttcagtaggcacttggtttgtcatagaagttatcacaagggacagttttaccaaacattttgctatttcacaacaagggtctacagacttctatctcattctgttttcttgacacccattgcccaagtgcaatctgtgaacacatttttgatttaatcatgccagaatcctactcttggtaccactttcaaaattaactaggggcacattagttgttataacaaataaacctgcaagtctctgtggagtaacaacagctctccatcctttgcccatgcaacagtgcaacaccgtgctactggcaaccacgggtgtcaggcttggcctcaggcggcatccgggaatggtgcatcaggaggggttgcctaccctcagtttgtgacttccaagatcaccacgagtcttgacatcttcctggggtaaggggagagcacgcggcgtcataggaaaaagttacgaagggcccgggattaggcagttgtgcatgttactcctacgctcattccactgggtagaattcagtcacagtgtcacgtaattgtaagaggtgggaaaatggcatcgagtagggtgcccaagaagaagagaaaacaagttttggtgagcagcaaccaatctctcttacaatatccaccacatataactgttgtgaggactgaattaggcctgtaaagagtctgtcatcaggacacagcacatagtgagtgttccacgagtgtttgctctgttcacctccctccgccctctaggcagccccgaagtacccaataagcacttaataaacacagaataaatgaatcagtattcatagttatttcccctctgaattggagagctttgaaatctgaccctgttttggattgaactatgctggatctctttggatctgatttttctttgaattagaaacatctcttaggaaacctagactatctttcaaagaaccccatctggcctattggaaacagtttcaaagttgaaacatcaaccatgacaggtcctttggccgctaaagatgcagcccctagggatatgtctctgctggctgttcacatgaaatagcatagcagagattggatgagagtcatctgctgttctggattttgcatcctctttaaacacatctgcctttaaacatcctttgcacaaaagcttaattttcccttccctaggttttaaatcactttgcagactacagaaaaagattacagaaggcctgtttttgttccattccttttctatacttgactatcacgtttgcttcttctacctgacattcattttattgtttcagttaattaaacatgtatcatgtcatgaaatatgtgggtcacatttatacacaactcaccagagttaaacttgctgtaaccatcctatctaaaattgcagccccttctgtccagaactttctatcttatactcctattttaacattttccttaacactttagctgctggcatgtgacttatttatttggtttgtatttgccttccttattaggaatataacctccatgagggccagagatttttacagttttcatttagggctctattgccactgcctagaagagtgcctgactataaagggggttcaataagtattcattgaatgaaaaaaatgatccttattccttagtcttaaataacttaattcttatgggggaaatctgacacattccaacataattataattccaacacaactccaacataattattaggcaaagaagattatattggttaatttatgatgtgtcagtgttaaccaagagatgaaaggggaaagaagggagaaatggttgttgttgaggatcttttattccaagcaaattttgcttacattatttcatttattttaaccagtgtggtagttctaaaaacaggtggtaaatgtcccatattactaatgaggaaactgatgcactaaaaggcagttatttgtctaaagttgtataactagcaagtggtggaaacagtattcatcaggtctgtctggctttagtacctgtgccaattatttgcaaagttgttcatactaatccttagaaataagcatattttaactggaacacactccagacaagtacacacatgcacactcccacacagactggaattatttaagatttagctatttgcaaaacatgttattctgtcctattcctcctattctattctattctattctattctattctattctattctattctattctattttcattccagcccatcccatcacttttatctttcaaaatttgacccattaagctgtttctgcagtaaacaaatgtattgcaatacagacttcgaagatctttgcttttaggcacattacctggtgaggaaaagaactgaagatttagaccacaaagtgaggactagagaatactttattgtggagacagtatttgaggtaggccttgcaaaatggattgagtataaagaaaatcttaataaaactttcatcatttcaagcaatattacttcacttaggcttctatcaaataatccaaatgctctgtattttatgatgaggctgaaaaaaagtccaaacactcaaatgtgtggctttcttcatttgaacagtcagccactcagtcaaagattagcaatcatttgcttaggaagtaaatattgagcatgtgctatatgccagccagtgggctaaatgctggaaacgcagagatgactcatgcacactgtctacctgtaaggaacatatgtttgttgccttagtccaatctggttgctgtaacaaaataccaggctgggtggctgataaacaacaaacatttattcctcacagtctggaggctgggaagtccaatatcaaggcaccatccgatttggtgtctgttgagagtccatttcctcagatggtgccttcttgctgtgtcctcacatagtggaaggggcaagcaagcttgctaggagctcttttataaggacactaattccacttatgggggttccacactcattacttaataattccccaaaagccctgcttccagataccagtaccttggtcattaagtttcaacatagaacttttgggagacaaaaaccattcagactgtagcattgaaggttattgtctgattaaatattaacctttccctgagttgatttgttaaggaacatttgcacaacggatatccaactccattccactgtcagaggaattggtggtctgatctggcatcctggggacactgcattgctctctctcctttcttccatcatgatataggatttgtaagttacaatggagctatcctttgtggcctggtgacatagtgactggcagtggtggatattccatgtgaatgatggctgtagacgtggtgaggtaggttgatgggttttgtcatcacttcttttacctgagatcaggttttttctccaagctgggaaaatgaacattgccacatccatttaaatcagagattcgctagagaaattgatatgtgtggttccataggcagtgccttcattttgacagttttctgggtctgatgaattgatggccagcagaggcagttaggtaggcagctgagcttacacaaaaagacctctgtctagaaggcttctaacaagagcctccattaaataggctttatgtgatgaaaacgtagtaccaaaaacactgttatatttctttattttaagcctatagtagtgagctcatattattttggaatggaaaaacagagaaagtaaaatatataaaaactgaataaaatagatatatcatcttcctgattctttgaatccagctatagtgggtccataaccttctgcaccagtttttgtttgttttattttgatttgttttaattgatacaatagaatttattggtactatgtttgatcactgagatacatcgttaaatatgctactgctgattcctttttaaaatacactggactgaaagtcctttgaggatagttctttgttattatgtctcatgttatcccctgcatgatgtcttccaaaaagtagctgctcaaaaacatactaattaacaaattagtatcaactgatatttcaaaacagcaatttttaatttataaaacactttcatatacatttcatcatttaaaaaatcaacagtaatttatttagtggtttgttcttattggtgtgtttaatcatgtttgacttactcattgcagaattaaattacgatgtgatattgcggtaatagttatacatggcataaaagaaacgaactcataggaattattcacttaactcgcgggatcagaaaaatgccaatgtactaaatgttagcctaataactatgggcttttggtatgttgtttagaggaaatgacatcagttaatctggcaggatatcgaagtgaaaagtagttaaggggttctaatgtgtatcagtcagattggctaaattatactgcaataacaaatgctcccaatatttcagtagcttacaacaaaggtgagttatatacacatgcatatttagatacatgcacacacacacacacacacacacacatgaacacatacacatacacttacttactggaccaaagcatataggaataggttctatttaggtcatgcagtcttgcttcagagggaaaagaatggtacaaccatgtgaatgctcttaaagcttttgttttgtagtaatacgtgagatttctattcctttttcattggctcaagcaaatcaaatggccaaaactgatgtcagtggggatagtaatgtaattctttcatgcaagaagttgtaaatatttggaacaataaagacatccatctattactgttattatatgtagctggaattttgagactggggtagaggaatcagtcttattgattttgatccccaaaagcaacctgtacatttggcagaataaattttattcactacattttatggagaagaaaacctaaggctggaattatttttaaacgttttcaactctcatagctgataaatggaaaattctagatttgaactgaaatctaaatctgactttcttcctaacctcaatcgaaatccagtactcttcataatgtggccatgctgcatatgtaagtgtgtggatgatgccagtaactaaaatgaaaaatgaaaatgttcagtagaggatgctagagaatttgtttttaaattttcgcttaaatatttcatattcttttaggtgaccaatattgaacgttcaaggtagttctcactgtacatgggtataatcatgattttcagcattaagattctcattttagcatttgtgtgggtctgtgtgtgtttgcatgtgtgtgtgtgtgtctataatgtgtgtgtgtctataaatccaggttccttcagtcttacacaaaaccttaacaaaatgttcctatagatcctgctagaactgctgactttcaaatcaggaattagttctgattctgttgatgtaaacctgaagagagaagaaaaacataattcaccttcctgcattattaagatttcagatacacagtttttataaaagcttgcaagtgcaaaatttgctatcaagcctaatgtagcatggaggattttgtctgagctagcaaaggatcacattttcatctcctgtgagtcagggactgagctctataaactattttccacatatatgttctattaaaaatagtatctcattttgactcttagtctgtttttatagtgagcgggctctgaaccgagttacctgataaattactttctgtatgtgtgatatacatactgtctaacctgaacaagaacactgacttcaggtacaaggaaaaccagtactgcacaataaatgggctcaacgactcattcagttcgattaatgtttactatacattaagcactgtagtatgtaccatggagcagatgcaatgccattctaactactgaggagcttttattgaagagatgagttatctaatctttgatagatagccttgaaataggacttaaaagaggtgtttttttgttgttttttgtttgttttgttttgtttgttttttaccttctttcttgtccctgccataaccatgcatctcttgcattgcatagttgagaacagcagttccacaataagagagtcttgtttgggagtcagagattgagttactgtagtccacttttctatccttttctccctttgacatcttcttctgattaattagtaattaataggtgattgattaaatgattactttagtctttcatttaataaacattattgaggacattctatgtgtccaacactgtgccaaataatagagagccaaggacataagcatagcccatatccttcattttaagtcaaatgagagaaacagacaagacaagtgtcagtgttgatgccacatgaccaaagccatgtcaagtataaacattttatgtaaaatgtagctattttaggacacagggaaagagtgacttttccgcacttaaagggcctggtaaggatttctaaatgaagtggttcttgaaataagtcttcatggatgataaggctaattacccagataaagaaagggggaatgcattctggacatgtacctgccattgcattcacaaaggcaggcaagaaacagcaggtccaggcatgcaggacaagtagttaagcttggtggaaatatgggaaatttgggaggaggagaaaggttgatgatagtggacaggtaaagacagaagtcatattttcatgaagtgcttatagtccgtgtttattaatctgcatcattctggatgtatatatggaaacctactcaatctaacttgggaaagaaaggaaaacctgatgaaaaatacacagttgattcttgaacagtatgggttttaactgcatggatccacttatacacagattttcttccacctctgtcaccctgagacagcaagaccagttcctcctcttcctccaccccctcaaactactcgatgtgacgactatgaagatgaagagttttatgatgattaactttcacttactgaattgatagtaaatctacttttttctatgattttcttaacattttctcgtttattactttattatacaaatatgatcaataatgcaatacatataacatgcaaaatatgtactgattgactatgttactggtaaggcttctggtcaacaattggctgtaataatttagttttgggggagtcagagtcctacctggattttcaactgcatgggggtccacactcctcacccccacattgttcgaagttcagctgtagaatgagctctcggtgtatgaacataagactacaactttgcttcaaaaacaggcaccaaggacaggaatcgcatcagggacctcaattctgctgttttctcatggcttttttattctcctctttatgcagaactgcttactctacttctctaatctacatgatggaacacagaagtaagagcatctaagattaaatcttacacacacaattgcctgaaaagattgaatacttttctatgttcctcttacaaattcactttgaaaggaagtctgtttggttagcttgggtctggtgcctacacttgcactggtgtaactatggccagggtgtgagttgtgtcataagagcatttttcctgtgaccatgagactggagaggaatggttgcattggaaatacccagagaaagacactggaaattttacaaaagatacccattatataaatggtcccaaatgccaatccacagagagggtgcctcatactaacttctgggagtttgggaaacatactcagtacttctgggggtttacccactaagtattctgatttgctagatctagggcagggtctgagaacctgattataaaagttcagtaagttattctaatgcctagatagattgggaaacattgtaagaaatttagaagagaggaaaccttaacaagaaaacaaaatcctcatgggatcaatttgcgtcatagtacacccactggcaaatagtttgggagagagaggctgcaggtgaagcaacttcttgggagtgcattgcagtcatccaggaggggagaaaggtcttacctaaaggaggagccatgcaaacagagaggagggctatcgggaaggtggagtaggcagttcgttgtcatcagttgtatctgaaggacaaggaatgcatctagaacaagtcccatgtttttggcttgggtaatgaggtaattaagtgatggagggggagaaatgggacttgtagtagaggatgacaagctgggttttgacatcttgtgtttgaaatgcctacagggcctccaattgtgcaagtccaggaagcagttgtatatatagggattctgagctaaagataatgcttttgtaatcattgtttgcaaatgatagatgaagacagtgtgtgcagatttcctagggtggatataattaagaacaaagaaaataagtctatgaatttcagagacatacaaaaattaaaggggattgagaagaatggaatagagcaaccataaaggagagacaggctgagcggtggctcatgcctgtaatctcagcactttgggaggctgtggagggtggatcacctgaggttaggagtttgagaccagcctggccaagatggtagaaaccccatctctactaaaaatacaaaaaattagctgggtgcggtggtgtgtgcctgtaatcccagctactcaggaggctgaggcaggagaattgcttgaacctggaaggcagaggttgcagtgagctgagatcatgccattgtactccaatctgggccacaagattgaaactccatctccaaaaaaaaaaaaaaagaagaagaagaagaagaacaaagacataaacagcagcataatagaaatcaagggagctcgtgtctctaaaggtggagaaagacattaaagaagacagtattagccaatggtatgaaacacttgttgcaaacatgctcattggatttggctagtgacaagtcagtgattaccttgagaagaacagttgtattctttattgttatttacatacatatctgtcttccctacctaatggtaaacttcttttgcagtcaatgagtaaacattctgaggggtgggaagggagttctgaaatatgtaatttctgactcaaagagctcacaatttaatggaaagacaagtaaaaagatgataggagaaagtgagagttgctgatggaagtctaaacaatattaggggagccctcaggagggatatctaacctctcaaccaagtaagcactcaataaaagtttattagcacaaaatacatgctgggacaaaaacaagtggtatcattagaaggtgcacagaaacaggagcatctaatgtgagcgggtgtgttggtgagattttgttgagggaagcaacttcttgtctgtttttttatatgctcgtatttttcagggtttcatcataagcacactagcctcctgtggctctacacagacacctaggactatttcatcccacttcagtaattttagcttttgggccactaactccccagtttatgtttctggccttccctggacaccagatctatttctccagctgctgtttggatatttcccccatatatctcacacatacctcatattaacaaggcccaaactggactctgtatccaacttcatattctgaatttctactcctaaactcattatgcacctattcactagatacctaaaagctgtcctagattcctccccctctcttattcctcattgtttgcagtttatttgtaatgtcttttatctgccatgtgcatttatgctgccactgtggtagttcagactgttgttccctcttatttgcattattgaaatgagccagactgcctgccttagatccccctgtcctctagtgcaccctgcacagcatgcccaatctcacctttctatctcctttaagcccaagtcctgcttcagtcatggatgatccatggtaaggatgggttatgatctaagcacttagcaggtcatgaaacatcttctttacctgttttcaatctaggcctattcagcaatatttaacagaatctaaatttttcattctttgtgccacacagtggtccaggtgctaggatgcaagcacccttgctctgatgggactgccattctactgcagactacaacaacggaatggaaggttgaggatctagtgagtgtctgaaagaaggacctggagggatggaactgtgtaactgtgcatctggtttggtctgggtgctgtggtggtatcattgaggcttctcaaaggaagctgtgctgaggctgaggcatcaagaatgaggagtcagccaggcaaagttgtaggggagcagggcatgtgccaagatcccaagtggaagagagtgtgagatggggaagcggggccaaggctgagagaggagactggtgctcagcaggggccagatcatgttggcttgggcatgttactgaaatgccaggggtttggtctaggtcctgttgcttgctacacagaaagccaaccaccaagacaacgaatgaagccaacaaagacggctttattcaggtgtcatcagcccaggagacagatcagtcttaaattcatctttccccaatcaactaaaattgggggtttctacagtggaaaatgaatgtagctacatgcaggaaaataggaattaaggcaggtaagggagcagtcctgctgaatgaggggtctggcatctcattgtctgcatgtggtgacctggtgagtttcagttcctcgacattatctgggaggcctgagggtcagtttcctgagaaaggaactcagataaaacaaatgtcagtttcaagctttaagactgggagcattaatttccatgttaattaaaaaatacataaacataaattctatagggaaattgggccagtttcagggggactgccctaaagaatttggactttctcttatgggttgcatcacacatctgaagagttttcagtagggacatgatcaatctgtgttttaagtacaggatgctaagggttgtgagaggaatggattggatgagtccaaaagttaaggaaagaaaagcagtcaccctgctgttcccctgaccccctcccctgcacctgccatacccagcacagcgcctgacacacatgtagagtaaattaatatgtacatatccactacaagagatggacgcgctaggcataacagatgtctgtatctgaaatgtgggttgttcttttatatcgcctgccactgtgcagttccctctacctgaaatttcagctcttctctgtaggtgctggaaaactcccgtccattcattaagatgctactcaaatcccacctacacaccttatcttctctaatccttagagcagccatatgaggcaaatgttttatctccactttacagttgaggaagtggctcagaaagattaaggacttgcccagtgacacatagtggtgtcttgggatttacagctgggtcttgtcgtcttcatacttgctttacccgccactcttcaaggttcctggaagcatgagtgattaaggaggaatcattgccagttcggtgtcattgctgccagccccctctgaggcacacctggctccctgggagtgtgtttatgctctgccaggactctccccagcctgcattctgaagcatctccttccttgctctgccacatccccgcccctctagatggagggaaacactcctgtaaatgggaattcacccaatagttcatccaaacatatcactggcttcctacctttctctccttcccagcctggacaacccatagcctccatgatcaatcactttatgaacatggtcagcttcaccatggcctctcctgggctggctgctaggctggcctaacagctgcagctggactctaccctgggcattttaaaacactgttacctctgtttctttgatattctctgaggtctaaagtcagcatacatcacttctcctgcttgtttgggttctgtatgtaggggcttgacagccagagtggctttgcagaaactcatgcccctggcccacccagcctctcgccctgcctggagggcagattacccctcagtgtgcttctgctaggaatggccatactgcatcattcctgttcctctgtctatgacttctgcaggatgactctggctttttctgggtacgtgcggaacactgggccaggctaataagtttagaagaagatttaagactccagatcaaggcacaggatcacattgtctcagtaatcgtgacttgaaaggaccctcgatgggcctcagctaagagctggcatggtggtggtgagcatgcgggcagtgggtttgcaggcatagcacaggctgtggctggataaaaaggtgttcacaccatcattgacaaattttctgaaccatgtggaacacttgtaatgatctgaactgtgtttctctccattttcttttcctttttatcttttcgctctctttcttttttcttcctggaatgcagctgtcacaataattggaagatgcccttgaaaaagtgctctcgagcctgtgattccctggcagcttcatttttcatctttccaatgaaggtggcatttgcccagaccctgttagctatgaggctgcctgtagaaccttcaactaccattgtgtgtggtgaatagtactggggttttggcatttcagtgctttgaactgctgaagaaccctaaagccaggctcatatgcacctctcctccctctctcccacctccccttgcttcctttccgcccctcccctcactccctggttcttccaccccaggacccacctttgctcaaggcaacccctcccaccccatggtgttcccctcctctttcctggaggccttgtaaatgtacagaccatttagactttaagacagtggggccacttttcatctcaggccaggctgctgcctggttttacggggtcataaaagtcctgacaggagtcataaaagcctccaattgcactgcagaaacccttggagtatattttaagggcccctgagttttcattttgctgcttttatggggactcgtaaaagctgcgtggagtgagcccactgattggctgctcagcacggaggtagttaaaattacagctttagacaaattgttccagtcccaataaatcagtatccggcatgtggcagggggaaggcttctagctctgctgcatcctgggccccccttgtcctaccacacaggcaaggctctgcttggggccaccctggccagccctccaccatttcctgaagccattctttgcaaaggggatagtacttaaccagctgtttttatgcattttaccacgtagctggttgacttttttttaaatttccaaaaacctgatctttaaaaccagattgacttatttttcaattcaattgttagagagacacaatctcatactccgtcggtcaccctggccacaggtactacagactacagcctgctttctccccattggtccccacatcccatctccctatacatggccttcttgccttaccttctttctactgttgccttggtatatctgttatacccctacagtgggccagtgcagggcaagaatgatcggtggggatgccattctcaggacccatcctaatttcccactggttatgcctggcagagaaccataccagcgtgggtattatgggagactgctgtgttttgtgccatttcaactttttaggagcttgtggctcaaatatatcaccagtctggcggatttccaagacactgattggagaagcagacattgttttctcttcccttctttccagatccagaatcactcagccccagctgaactgccatgctgacaacctgaggatcaagcatactcttcatttgtgatgtggaagtttaaccattaccatcgtgtgtgctcttccttcgcaggtggagaaagctttcaggagaggctctgagggtgcagaagcaaggaggggtccctgcaatgtgctactcctgtttgtgtgtccgcctctgttcccatggcaaccacctctttcccttgctatttctaaaaagcacgtgtgcttgtgggagtaccattctgaaaaaaatgatgcttactcctccctttctggatcttagccaagtcaataattcaagcagcacgaggtatcttagtacttgagcaatgcccgactgatgtcaactgttaggagagccaactgaagtagggagaacagtttggggtaagaaaggaagaaaagaaggtactgtcaagctgtgggttaggagaaggcattagcctgagaaataagaccaagatacatgtgaggaagactccaccaccattagttcactttcagagtcatggctggtagatgctcccttccttccagagcagggaggaaaagggacgcagtctttgctgcaaatttcctgcataagttagtggagaaaacaggttctcttctgacatatgcctctgttttgaagagccttgttcttttcttaaataaatgaaccaatcacaaaggttacaggctatgtgagagaaaaacacatcttatttctgtcttgctctagttttatataattattatatcaactgtggctgatcaaagcattcattaaagagaaactatctctcccatgcttttgttacagtttggagagatttgacaggctttatacatctctggctatatttccctttctctttttcacggttgatttcgctcttcttcctctcctcctccccttcctgcgtactagtgatttctaacatgactttttttcttttctttttcttttttccccttccacctagcctaatcaaatctctcataagacatcaagggaaccctgaaccaaagcaactcttggagttatatcggtacattcaggtgagcacaggctgacttcctgcctcagagcagccctcagcccacctggaagccaggcaaggcttctactgcacacactcccagacagtccctgcctttcccattgtctttctcaagggctctgatttctaggctgagcttactgccctgttccaatagcctcctcccaaagataggcacatatctgacactcctttgtcaatccttgggggagttctgtggccagcaaaagatttccatatcatcaactccttgtctctttgcaaacgctcatctttcaatgtggtttttgctactccttctttcattatcctcatgctattcttcctgaggaggttgtttcagtttatttaccataagcatgttcccaaggggatttcagccatgcaaatgaattacggaggatatgacttcaatgtgcaaagcatttggggtgaatgtgtacaagtacatttttcatattatgtgcccctctatcccattgtgtggcatgattttatctcactctgttctggactaatgacagactccttcagacatttataaaagtctgctttgatcgttcctctatatttcatcttgcatttatttgttcactccctcaacacacaaagcatagactatgtgctgagtaccatgctggtaccaggggacatggagataaataagaaatagtctctgtcatcttggaattcataaacaaatagaacaggaaaaaatgtaatcaattacttactaaacactgtggaatatgcaatgatatatcaggaggaagtaagggtaagaaatgactttttactggcgtttatcttacctggatttttctcaggaggaaagaataaggaaagggcattccaggtagataaagcgaagtaggaaattcccagaaacatagaacagcgtggtatgtgtgtagcattcatagtcatctgccaaagaagaataggtgggaaaggtcttgagcagaaaagagtctgaagaggaatccaggaagcatattgtgaggagcgtttgttttgcaggttgcaaaacatgagtttgaggttgctaaagaaaaaaagcggcattgtatgattccatatcaaagtagggcattgtggtccctttaagtttagcaaatactgaatgcctgctgtgtacaagagtatactgggtgtagaagaaatacaaagatgatgcaaagatggtatcttagtaccactttttaaggataagaaattttcttgtatacatagggcataaacatatataaaggctgatttatagtaagctgttgtgtgaggccattctggcattactataaagatatacctgaaattggataatgtataaagaaaagaggtttaattggctcctgtttcttcaggctgtacaggaagcaaagcatggcaccggcatctgcttggcttctggggaggcctcaggaagctttcaaccatggcaaaaggtaaaggggaagcaagtatctccacatggtgagagaggaagcaggagagagagggtggggaggaggtaccataccccaacaacagatctcatgaggacagcccgaagctctgagggatctccccccattacccaaacatctcccaccaggccctatgccaaacactggggattgtaattcagcataagatttggcagggacatgtattcaaactatatcatgcatatacacacagacaggcacacacacacacacacacacacatacacacaatcggtcaacagtgtaaaatgagatgacaaaaccatacttgagcaattgccaaatgatattaaggacaaacaatgatggatgtagaggagagtgtaattagacaggtatggatggccaaggaaagctgcagagaggaggcgaatgagtggataaggagaatgggtaagatatggagaggtgaagcctcatgtgtagaaaaacttgaataaaagcaatggcagggacagccaaagaggaatcagaatcagttaatgaattaggctcacaggggtggagagttgatgctgtccatggcaaccggggctggaaattatgctgcctgaagagggtggaggctcttcaaatgtccgattaaaggtattggacttttctccattggcaacagagagtcactgaaggttttgaatagggaagtgacttggtatttggctggacttgtcttgtgagctatttgtggcagctttactgtacaaaagcgatgaaatttaataattatttagttatttggaacattaatatgctggtgtatcatatattttaataagaattcagaaatgggagttttctaataagcaactgagttgggaaggtaacagaaggggaaattttggttgaataggataagaatgagaattttgagtgtcagtgatcaacaattaaccctacgtctcaattcatcataagcaaatacaattactactctgcaaatactatgtagaagaatgaaatgatgtgttggtgtctgtcccccaaattggaggcttctggccattgcttgaataactttctgcctctagtatccccaaacttatgttttgttttttctttttctcttagtatccatgcttctcctgaatcattcctctcgttaggaatgtcagtctactaaattttgtggcaatacaatgcctgggtttgaattcaagttctgccacttccttactctgtctctttatcaataaactcattgggaaaagtggaggaaatcatagtaacgatttattaaagttgaagattgagttttatacatttaaagtcctagaacaaagcctgcacatagcaagctcttagccaatgttagcagccattattactgtttactgttaataacagaaattactattaaaaaagaggaaacaggaaaaacctttgtcttcaagaagcttttactgtccgcctgtcaaagttcctgagcagcagctgatttctggcttagaagttagggttaggaaagtaactagtgagcgcactaaacagtaagatgcgctgccacagttgtgtgtgtaattgacttttatagtcaattctgcttatatttcctccttcaccctaatgctagcccggttctgagccagagttatttcgctctgccagtggtgcacttcagaaacacctggaggcttgttgaatccggattcctccacccacacccttagagtttttttttcttttttttttttgacaggttatttgttgcccaggttggagtgcagtgacgcaatcacagcttactgcagcctcaacctcctgggctcaaatgatcctcacacctcagcctccctagtagctgggaccacaggtgtgcaccactatgtctggctaatttttaaattttatgtagagacagactgtccttatatttcccaggctgctcttgagttcctgggctcaagcgatccttctggctcagacctccaatgtgctgggattataagcattagccactgcgcctggcccatgatttgcatttttaacaagttcctgggtaaaactgatccttgtggtctggggaccacactttgagaatgtgctttcagctcagctctgttgttcactcaagaagaaaaggcttttcctggtaggtctgtctgtagctcaatcacatgtcccacatggagcccactctttcccatggtacaaaaccctccttaattgcctccttggaatctacacagagaaatccctgagctttactttttctggacctgccacttacagaaccagcttcattgagatgttgtttaaaattgatttctcacctagccacacagattatctaaaaggtcaagattctcatgtagacttctttttgaacattctttagccactcgatggcccagagccccatcctcattgttcaggtttcatcgtctccttaatcaaccattagcataatgtattagcatatctatagcacaattatattttgattgctgtggtcccagtcagactaaaggctgccttcaacctagatataaataatttagaatgtttataccaaagggaattataggggagggaagggaagaaaggaaagagaatatttgtgtgtgtcaggggaatgaggggggcattgggagagtaaagatggtggcaaaaggtaacttaggttgccactttttaccacaacacttttctaggctattctcaataagaaaatgtgaattatatatattcaaaatacagataccattttgaattgctttaaatccactcctgcctttaatctcattacatctgtcaaaatatgtctcatttactaagtaaaaagtagaagctggtttccagcacctctttctttattatagcctgatccctgtgcaaatgcattttcctgtggttcatctttgaaagatctctcttctcttgtctggttaacttcctcaatgaccattgatatctttgtgctactttattgtccacttggaaacctgatttccctttattagtgtcctctgtaataggttagcagaaatcttatatggttccaaagaagtttctctctctttctctctttctctctctctctctctctctctctctctcacacacacacacacacacaacacacacacacacacatagacacatacacaggtgcattgtatcagctggaacatcagcatatgtgtggtaggatcacaatcattcagagcttctgatgttcatggtacctaggggattgattcagctttcaaggagctgtggacagtaagattaaaagaactgctctccttggggacttttaagtaatgacattattggtagtcctttgagcagcatggagagatgtttgaaatatgaaattgctgacagttttaatagttgcatttagaatggatgatatttgcaaaaattgctacttctttaccttaccacgcagaatgacaacgggatgctaggactaagccaacttcagtattcttctgcaagtgatgtgaaaacgttatagttgatggctcaggatcagtgcagggatggtaaaggggcagaggatggcactatgaaatcatagtattgacacagctggtcattagattaagcctagtaagggagtctaaaaaaatatcactctccaggtcccatgcatggagattgtcattctgcacctctggggatggaatcccatcagctgagtgtgatagctggccagaattgagtagtttgggtttagatggtgtcagaaagactggagaataaatcttctcttgggtgatgaatatctacaaaaccttaggtaagacacattttctgagtctcagtttccttattctgtggacattgtctttactggatggtagacgacttgaaggcaggagctctgttttctctttgtcatcagctacttgcattgtggcagacagatagatagtaggaccctagttaaatggtttggaataaatgattgaatgagtgaaagatgaatgaatgaatgttggaaggaagggatatatgaatgatatctcatcaatttgttgtgtgtattaaatgaggtaattttatgtattactcctgacagatagtggggattctaagaagtttccatctcccttttccattttcatatcctaccatccaacatgctaattgtgtggtgttgttttcatatttctatctcttccttttctctttttgagagaggaaagaggtgctcagtccttattcctcccattttctgtttcacctgcatctgcccacagcagtttccttagcatacattattagctcacctagacttaacaaactacctttctaactcaaatccctcctgtttccctaaagaaaatgcttcttttttgttagaaaattttaaaacaacaataacctaggttttgaagaaataaaaggtaaagattttaaccacatttgcgtgtttcaattattagtgttttccctgtggcccattcatgtggataagagacatctctgcattattatcttgtcagaaatacagcccctttcccttcccctcatctgattaggcatgcttctctttggaagcctcatcccatttggctaatgcatcttgacaactcctttaataagagtgcttggtgttcgcattcaaggatgtgtaggagttgacagaaatctaccttgtaatctttccatggcttgaaaataaaacccagggagacctagcacccgcatctctcaactcaaaaatggcgagaaagcttgaggggagagggatggccattgatttaacagaaacagttttatttgtttgtggtttttttcccttccttctgtgtgaaaaagctagcagagggagggaaaatttgggaagcagaaaatgtttcaatctacataaaaaagaggaaaataataacccaacaatgagaagagccaagagaatatgagaaggcagcctctttttgaaatagattaaaggctttattgcaagaacatcgtaggacaaaggtgtctctgcaggactgggaacttcagcaaagcacataaaacctcattctcagacttaaagacagccctggaagaggcagtccacaaagcagtgtgtgcctaggcacctattctaaattcaggagagctctgcagtcatttcctttgggggtgaggcttatgaggctggtgtaatcagggatataactaggaatctcctccaaagaatgagtgtagaccaggtcaaacagaactattgtgatgcatttgtcctccacagtatcaggatctcaagccccttgtcctctgtggttatagaatagcctggggcaccactgtgggcctatggtgatcatgggtgccacttcctgagcacttcctgtggtaggattgtacttcctcctttgtggagaagaacattgactagtgctggccaatgagaggcagctacaaatgacgtgtgtcaccctgtgggtgggctaaacattttacttccagtgcgagaccctcctgggcactctctttcctctgtcatgacatccagtgactttcaagactgtgactgccccactgggggttcctgagtgaatggatgaaaaaagctcctccctgtcacacctgtgatggatgtctactgtgaatgagaaatagtcactgagactttcatgttgttgacgatttcggcataacctacttatcctgactgttacagagtctgatcttaatgcaaaacctagccaggaattgaaggcttttattcagtggccctttatttttgaaggtgaacattctacagggtagtttggataagtggcaataagggaatggtgctcattcatcccaggatcacttaagagcacaaataagaccgccagctgatgccaggctgcacagcaggacactaggtcactaggagagtcaggagggcataactcctgctgagcgttacgaagcacagcaacttgtgatttggggcctgtcaacagctatggactcagtaaacagccctgaaatgtgaggtttccaggcagatatttctgatgctctcttttgttgcagcctgctttgctttatttatgcaaagagtgtatccctgggggaaaaatcaagtcatatcataagtgcatcagagaagcttactatttaaagaaatctatggtgaatccttttgtgaaggaataatcatccacctgatttgcatttgctttgtgaattgtgtttgtgtatcaggttttatgagtttggggcacatcataattcagagcatcaaacatagagtccaacagagctggattttcatctcaggtcagctaaaacacaaagcttgcctttgtcctgggggacaaagtgaggggccaactgaggatgaattttttgcctagaaatctctgcaacttgagaatggaggtaaaaggtagatggtgagaataaccctggatggagttagagttgatataagggaggtcaaagaagggaagggctatgaggagtagaaaggaaaatgttaggtgggcgttgcttcgattttagaataagccttatactgtaacaaggaatttggggaaatacacctagtcctctgttcaggccccaaatgaagcaaggcaagagggggcacagtgtgactaagcagggaattggggttagctcttgactccactgtatggggatcatgacgtggtggactgttgtctaagacagatgagagaacaaacgctcactttacccctcgccacttatgggatgcatctctttggacaaggtttgcatttgtaaaattctattgtcctgactttaatctttctgagtcttggttttccatccatatgcttaaggtctttgtccctcctggcaggacttgtgtgaggatcaagagaccatgaatgtcaagtgcctaatatagctgacctcagataggactcaggaaattaaaactatcaatattgctgactatgtatttacttttttctaagattctgaatgttaaagcgttagtatagtgtggagtctatgacaggtttttatagatatttgtggaaagaatgaaccatctagtagcctaagaagtgtggggaatgaacaccagatgtgagtgctgaggggtttggagcctctgtctgtgaatcttatacctttcctccctggcattacaaatgctccccatttccccctgaaaacatgtctgtttcacagaatccacattgctcacaaagattaaaatcattttcaatgactccatggtttttgttttttttgtcctttctgtcttgccacatcaggttatctgaccgtttgatttcagcaactcaaagagctcttcatttttttcctttctttccttttttcttttccttttctttctttccttgttttcttttttttttttcctgttgtcagagccctaggagtttcttttccctttttaattaagagcgaatgaaggtaacaaaatgttttataactggagagaattcaccagcaggacaccaaggcagaaatccacatcctgaaagaaaggcaggcagacaccagatcagcgctgtggggaatgtgtcctgcacacactctgcttcccgctgactgatggtccagccctccctctgccatcagcctggaagctttacctctggcagaagtctccctgtcttttgttaggaaaagctacaattggaaacctgcttttctaaagcatttttaaacacacagtgtgctcccctgaaatacgcctgtgcctgcaagagtcctgtaagttaattcctgccacccagggaagtgtcctaattttccctgacttttactgacctactcctcattgtgtacctggctgtctttaagctgggggacagtttgagattggaacagcaaatttcatgggagagcctgtcagatgggtatgtatgtgccgatgtaaagccagattgagcctaagagaaagagtgtgagcagaagaaagggaataaaatcctactgcagacagtgatgtggaaagggatgtcgtttctggcactgacactgtgcctggtccagtgccctggctgtgccatcccggcagctctgaggctttctgacagtcctgagaatggagcacaagcccccagggacgtctttggagccctaattccggtgcactgctttcgtgcactctgttttgcacgccacacttggaagatggcattataagactgcttccaaggaaagcgtgcttttattaaactcctagaccaaattgcctccctgttgacctctttctttgtcatgagacgtgatgggttattacatttgtgattaaaaacatccgtcatcggtgtgttttgccttttcaattttgtaggaaggtgatcatgatgctggttctcagaggaacagaaggatggagaagagagaccatattttgtggtttaaggaacttgcccctcagagaaggttaccctttttttctgagttcactgctgaatgtgtggctcaaatggccgtggaaggtcactgagctgaccgaatacacgttatatcaattctgcacagcatgagtgaagaaaatggacagacaatttcttaagtcactagattgtagagatcaatacagataattttggaatttttagaaaatccaaacacttatcctcaccacggctgttcatgtaatacctcagcagcttcttgcttcatattagctttgatcttactctctatttggaactaagtgtttcagaaatgatttctccctcctataaaacatactgaacacagaactgagttcttcaaactcaacttatgtatgacaaagctatagccccagcttttagctcaccttggtaactccgatggtggagaagacaaggataaggatttcttttctctgaggctagactggtgaagttataggatgacagatacagtctaaaggtcagtccctggctgctcttcccagagaccctctgcctcataccttcccagcctctagtctccagtctgctcggacctctgctatacttctttgtgctagaagagtgatttggtcatgtctctcctctccttgagcaaaccttaatgaattttccctccaatggccagtcctgtcttatcttggcatttgaagctctttattaagtgaccatttctactgtctttttttttttcctccattctcttctgctaggctctaatatgaactctttacggcaactgatgctatcacagaaggacctcttgtacttgctccagtctggggacttggtcaggtgtctttctgtctccctgtaaagcgtttccactctgcatttttgcctatcacaattgtacagtttcctgaaggcacagctgtgtgctatctctcttaagaattccctgatggaagtatcatttattggtgccaagtgactgaggttatattcgcagctcttggacagggctcctagactccccttagtctcagttacttatctgtgtataaccactaagcacccttcatcttactcccataaaatgaaagtgacctgatatttacatgtcgatctcgtatgggcattatcacaatgtatgctctgtggcattgagttgttttcatacatgttaattataagcaccagcaagcatggaaccatttcttatatgattaatatcccttataacaattaggtctacaatttgtaaaatttgttccattaaatatgtgattgaagaactgaataaagtcacctctagtgaaaattctacttgatattgatactatgatttgaaaaataataaactgagaggggaactccttgacaacagtttactgcactgtttctaacatttaacttgaagtataaataaatggattttagcaaatcaacctctctttgaagttaactgaatgctaactgtgttctggaatgaaagggttcatgcatctctgttaagaaatggaaaacagataatggcagcggagtcaataaagtcagtgcctcatcttgaactgggtgagcggtccctaaacatttgttacgtagtttcttcagcagactgtttatgtctaatgtgttctttttttcttaaaagaaaaggatatttgcatttttgatttacaattttattacttactgtgtacctgacctttacaagcattatccaaattaattcttataacaattctatgacttagagttataatgcacattttaaagttgagaaaactaagggtgtaagtaagttggcctaggtcacacagctaagtgagctgtagagcaattattccaacccaagcccatctgattccaaaatttaggttctctctagtacctcaagtggtttctacatgtgctctacattttcctgcttcttggaatctgtgcatgctcattcctaagcttgtaataccttttccctattctgtatctcagaaggtgtccttctttattcccaatccctgttctctctcagtttggaagtaattgttcttttattgcaaattctcacagcacttagatttttatctcaaactctttaatgtaattaattgttttcatccatataatatagtcatgtgtacctttatgtaccacatcttcctttccacataggaagctccttgagggcagaagcgatgctctttgattcattttgtattcttcaagatggactagaacagcgtagtcaccttgtaaacctatgtggtggatagggtcggggaagaaaggaaaaagagggaaaaggaagagaggaagaaatcaaagaacgatagaagacagtatataattcagtgttaaattgtgtggttcagactaattataaattcctttaaaagaaatgcaattttattactttcaagaacataaagttaattaatggctaacaaaatgttatcaagtagctgtcttgtcattcccactgtaattaatcaatgcttttggaatgaaaaagtggacttaagcctagcccatctccagattattgagaattttaaattagcacagtctgaaataatgaggttatcgccaccccttggttaaacagacgtctgaagatgaaagcatatgatgataaagaagacgtataagaaatttctaaacatgttttttctctttagtggtactaataagggattccttaattgttaaagcgcatacaggaccttatttgccaaaaattgtagcacatttgcttagaattttgagttatttcttaattcctcttctcttgattaatttaatggctcattaattcattttttaaaaaagagaatctaaaaaggttatttagaacaagctaaatccatacacagtagtgaaggtgctgtagcccatcacagagtgggtgggaagaaggggctagaagaaggatctagaagtggtaggagaggatgcaggagccattcagaatacgcatcaggaagaggaagcactgctgagtagcctcaggtttctttcttaggtgacttttcggagaagattagggaatgtagagggatagagagatttgtgaggaagaatatggagttaattttggacttactgtgtttgggatgcttatgagatatctaattggaattgttcatggagcagttcacatacagatctgatgctcagaagtgagggttacttgaagataaccaattttcgaatcactgacatgtagtaaaggaagattttcacaaggggcagctgtgtgaagtcaacagagactagaacaaggaagggtaccatgaagattgaaggtaaggttcagaagaagttgaagaaattgttttgagaagtgatatccaaagaagtcagagaaccacttgaagagtggtgtcaagaaacctaaaagaaaagatttttaagaggggacctattaaataagaactgaaaagaagccgttaaatgttgtgcttagagagtcactgatgctggcagcttatcatcctagtggaaaggaagcctgactggagttggttgtgaaggaagaagtgagaaagtagcgatgtctgtcatagaccattctttaaagaaacatagcagttaaaagaggtagctagtggaggacttgggagaaacaaggagatttgggagtaaacagaatctagaaaagtggtggtaagatcagtcttgaacagggacagcaccaactcccctgctgagagaagagtggcatagtcctgaatgtttatgacttcaagatagatctgatgaagagttcagctcactatttcatttgtattagctttgtttaggcatattttatggaccataaaatttatccactttaagtgtacaattcaataatttttgtgttttttgttgatacatagtatttgttcatgtttatgtgatacatatgatattttgttacgtgtatagaatgtgtagtgatcaagttggggggtttaggatagccgtcacttgggtatttatcatttctgtgtgttgagaacatttcgagtggtatcttctagccatttcgaaatgtacagtacattgttgttaactatatttaccatacactgctattgaatattagaacttattcctatatcgtatgtccttattttttattcctatatccattagccaacctttcttcatacccttcctctccaccccttcacagccctcacatccttcggtaataatcattctactctctacctccgtgagatttttggctcccacatatgtgtgagaacctgtgatatttgtctttctgtgcctgacttatttcactgaacataatgacctccatgtcaaatgaaagacatgatttcatttgtttttatagctgaataatattctatctattctattttgtgtagatgccacattttctttatctattcatcagtcgatggacagttaggttggttccacatctttgctattgtgaacagtgctgcggtaaatgcgggtgcacagctatccctttgataaactggctttttctcctttgaataaatacccagtagtgggattgctggatcatatgatagttctatttttatttttctgataaatctttgtattgtttccatagtggtcgtactaatttacattcccaccagcagtatgtaagagttgccttttctctgctttctgcattattttttgtctttttgataataaccattctaacctgggtaagatgatatcttgttgtggttttgatttgcatttctcagatgatgagtgatgttgaccatttttttcatatacctgttaatcatttggatgtgttcttttgagaaatgtctattcagatcatttacccgctttttaagagaattacttgttttttttttttttttttttgctgttgagttaagttccttgtgtattctagattatttccttattggataaatagtttgcaaatactttctcccattccacaggtgtctcttcactctgttgattgtttctttggtagtgcagaagctttttggcttaatatggtcccatttgtctatttttgtttttgttgtctgtgcttttgagatcttagccatataattcttgtctagaccactgtcctggagtgtttcccccatgttttcttctagtagttttatagttttagttcttacatttaagtctttaatccattttgagatggttttttgatatgatgagtgatggggtctagtttcattcttctgcataggaatatccagtttttttcagcaccaattattgaacagtgtggtctttctccaatgtatgtttgtggcaactttgtcaaaaatcagttggccataaatgggtggatttatttctgagttctgtataatgctccattgaattatgtgtctgattttatgccaataccatgctgtttttgttactatagccttttaatatattttgagtccagtagcgtaatgcctctgctttgttctttttgctcaggattgccttggctattcaatatcttttttaaagttccatacaaattttaggatttttttttctatttctgtgaaaaatgccattggtgttttcgcagggattgcattgaatctgtagattgctttgggtagtatggtggttttaacagttttaattcatccaattcataggcatgggatacttttccatttgtttctgacatctttaacttttttttgtcagtgttttgtagttttccttgtagacgtcttttacctctgaagtaaaatttattcttagatattttattttattttattttattttattttattttatgcagctaatgtaagtgtgattgttttcttgatttcattttcagctagtgcattcctggtgtatagaaatgctactgatttttgtatgttgattttgtattatgcaactttactgaatttttaaatcagatctaataggttttttggtggcatctttaggtttttctaaatacaagatcatatcgtttgcaaagagggacagtttgacttcctccattccaatttagatgccttttatttctttctcttgcttgattgctctggctaggacttgcagcactatgttgaataggagtagtgaaagtgggtatcctagtcttgttccagttctgagaggaaaggctgtcagcttttctcattcagtatgatgttagatgtaggtttgtcatatatggtcttcgctgtgtttcttctctgcctgttgttgagagtttttttttttcacgcaagggtgttgaattttatcaaatgctttttctgcattattgaaatgatcatatggtttttgttctttgttttgttgatgtgatatattgcatttgttgatatcgtatgttgaacaatcaatgattttttaaagtgaatgtatagagttgtgtaagcatcaccacaacccagcttaggaacatttccatcaccccagaaagttcccttgtggctacccacagttaacctccatttctaaccccagccttaggcaaccactgatatgatttctgtatctataatccttttctggacacttatataaatagaatcatgcaatatgttgttttttgcatctgacttcttttcatgtttttcattttccttcttattgtgtaataatattctattataaaagtataacacattttgtttattaattcactagttgctagacatttaaatagcttccagatctgagttattatgaataatgctgctatgaacattcacctacatgtctttatgtgaacgtatgttttcatttacattgtggagatccctaggagtggaattgctaggtcatatattaagtttattttaactttgatagaaactgccaaccttttttccaaagtggttgtaacattttacatttccaccaacaatttatgagttttctgttttctctaaatccttaccaacacttgttactgtctttattttttattataaccattctagtggatatacaatgttatcttctagtggttttaatttgcattctgttaatgatgaatgactttgagaatcttttcacatgcttattactactcatgtatcttcttgtgtgaggtgtctattcaaatattttgattatttcttaattgagttgtttatcttcttatgttgtaagaatttttatatattctggacacaaatcctttattagctgtatgatttgcaaatatattttcccagtctctgagggcttttcttttcattttttaaatggtgggttttttttgaatcacaaaattttaattttgatgaaagtcagtttatcacttttttcttttacagatattttttactttgatatctaataattttacaatccaaagttatgaagatttttcttctacattttctcctagaaatatcacaatgttagttcatacatgtcgatctgctgtgtattttgggttttgtgtttgacatgaggaaagggtctacgctcattttattcacatggatgttcagtgtttctagattcatgtgttaaaaacagtctttttcctcactgagttgtcttaacacttttgacaaaattcagttgaccgtaaatgggattcatgactcttgatttgctcctgtgaatgggattaattttggaatctcaattttatgttattgatctaaatttctaactttgcatcaatatcacacattcttgattactgtaattttatagtaagtttgaaattggatagtgtaagtcctacaactttggttttcttttgttttagttttttctatatcttttgcatatctatatatagtttagaaacagactgtcaatttgtatcagcctgctgagattttaatagggattgcatttagtttatagatcaatttggagagaattgccatcatgatatattgagtctttaaatccatgaacatggaatgccttttcttttatttagatctgttttaatttcactacacagtattatgtagttttcagtgtaggcatttattgctgtttaatttttctcgatgccattgtgaatggaattatcttcatttcatgttcggcttgtttattgtcagtgtacagaaatacaatagacttttgtatgccaatgctctttcctgaaaccttgctaaattgtttactagttctaatagttttttgtgcactctttagaattttccatatccagagtgtatcacctgagaataaggacaattttatttctttattcaatccttttccttctttgtccctctctccctctgtctctctgtctctcttttcctccctctctcgtttcctgtctccctcccttccttcctgtcctttctccctccctcattcactgcctccttctctctttcttccttttgtcccatattgcatgggtagaacctctaatacagtgttgaaaagaagtgtcaaaattagacattcatgcctctttcttgatcatgggggaaaacatttagtctttcatcattgttgtatgatgttacttgtggatttttctaaggtaccttttgtaggattgaacctaatcctcttggttgagaaatttttattgttcattttaaatcatgaatgtgtgctaaatttttaaaaatgtttttctttgtcttttgagatgatcatgtggctttaaaaaatttattatatactatatttcattaattgatttttagatactaagtcaagctatcatttttgcaataagtcccacttagcatgggtgtatgatctgctttaaatattgttggattcagcttactaatgttttattaaagagttttgcatctatgtttatgagatatagtaatctgtatttttattccttatgtttttgggctttaatattggatgaccctagactcatgaaataagttgagaaattgtttgactttttctatattttggaagagtttgtgaagtattgacatgttttgtttttaaatatttggtagaattcacttccgaagtcacagaagcctggcttttctttgccgaagatttttcattgctaatttaaatgcttgatttagttttattcagattttctacttcttctggagtcatttttggaaatgtgtgtctttctaggaattttcacatttcatataaattatctaatttgtcggcataaggttgttaatagtatggtcttctaatctgttcatagtctgaaaacgtagagtctttactatttttcttctctctttttcctggttaatccaacaaaaaatgtgtcagttttatcaaggagcttacttcttgttttattgactttccctaatttttttgttttttttcattctcttatcattattatatcacttgttctgtttgatttgaatttagttttctattccagttttttagatgtaagcttaggttattggttgagatcttttgcctttttttaacatagacgtttacaggtataatgtcccttaagcaccgatttaactgcattccataaattttgaatatgtcaagttggttgatagtgttgctcaagacttgtggttctgttgtttcttgacagtggggtattgaaatctccaactttaaatggtgactagtctattttttctttcaattttgtcaggtttgcttgctgtattttgagattgtgcttttaggtatgcatacctatataagtattacatcctcctgatatatgaactcttttatcatactgaaatatcccagcttgtctttgaaatagttctagtcttaaagtttatttttttctggtattaaaaaaatttcctttccaatttacatgccttctttcttatggttactgtttgcatggtatatatattcatcctgttacttttaacctctttttagctttgaatctaacatgtagaaacctgagattattaaatattttagatttttagatagcttataagaaattggatcttactttttttatccaatctgacaatctttgcctttattttattttatttttgtttctatttatttggtttttttttcagggggtacatgtgcaggtttgttacaaagggatcttgcctgacgctgaggtttggaatatgattgaatctctcacctgcatagtgtgtatagtacctgacaggtagttattcaatcctgtactcctcccctccttatattcccccatgtctattattcccatctttatgtccatatttacccagtgtttaactcctgattataagtgagaataggcaatatttgattttcagtttttgtgttagttcacttagggcaatggcttccaactgcatctatgttgctgcaaaggatatgattgccttccttttttatggctgcgtagtattccatggtttatatgtaccacattttctttatccaatctaccactgatgggcacctgggctgattctgtgtctttaccattgtgaataacactaatatctgccttttcattgtgatatttatattattcatatttactggtacttatttttatgactggatttacatttgacattttgctatttgatttctgtgtgatttctctttttaagttcctctatttcttttacattgtcttattttgtattaaataaatatagataaatattatagtgtaccatttaattattgtattaatattttgtctatttgagttaatgtttagtggtaactctaatgagtatgctacacattttagcttatcacaatctactttagattgatagtaactaaattctggtaaaatgtggaaaatgtctgaatttatccctcatatttgaaaaaaaaggtttttctgaaaactaaatttccggttaatagtattttattttccttttggtacttgaatatatgttatcccattgccttggccttcattatttcagatgtgaggtcacagccatcttaaacttctcagtgttcccctataatttttttggatggctatcaattaatttttcttatatggttgttttatttttttctttggttccaaaagttggatgattatatgtcaaggtgtggctctttttgtagttatcctaccttggatttgtagagttttttagatatctagattagtgtttttaatcaaatttgggaagttttcactattattcattgagtgtattttttgcttcctctttgctctccttatgggattcccattattatatatgctggcactctgaggctttgtttatttttcttctgtcttttttcccctctttttccaactgggtaatttatatggatttatttctacattcatggattctttcttctgtcatctcgaatctgctgttgggtcctccagtgagattttaattttctcattgtactttttgtttccataatttgcatttggttctctttatacttttgtttcctttgttagactctctacatatggatttttttgttgtcatatattcctttaatttcaaaaacatggttttctttagttttttaaacatatttataagaatggcttgaaatttcagctggtaaattcaacatctggggacaatcagagagtttctattgcctactttgttttgtatgggtcacagtttcctctttccttgcatatctcatactttttttaagtgcacgttttagaaaatatattttagcaaatattcctagcctcacttttcccgcaaaggttgtattttgctgtttttttctgtttatgtctttccttgtttagcaaactggctaatctgtggactctgtcttctttgctatgcatgaacagtcactaatgtcttagggattttttgatgtttttaaattttctttaattttatatcctgttttaattttcaagtctctcttcccataggttgccccccaggactgagttgacatccaaggcttaaacagaagttgtgctcaaccatcttgagccagttagtccccttctgatagatttgtgtatgggtagtgaagcaccttcaaagtgcggaccatttccaatgtctcctgatatttgcttcctactgagtcctgtcatgtcctttctgctcaggtttccagcttcagtgtcaactaagaatataggcctgacttgagccctctccaggctatggtgtgtttgcatgcagatttgtacttgcctagccctgagcagaacctggggtagtcattggccctcccctctagcctttgagagaatgacttctaccaacagtgccactggctgtggtgtcactcaccattcaaagtaagtgagcctctgaaccagggcagagatgccactggtcctcaggtattaccctaccctggaggaacctccatgactgagctggggctggagtcagaataccacagagccccacagttcttaaccgaagttcagaagtttcacaagaacatatgcttctcagattgttaagatttcgttcaattaccactccactggaatggttgattttgtcaattttgctcgactttatgctctgttttcttggacagaatatttgacagtcttctttctttgccataacagaagtcactggtctttatttagcactgttctcagacatttatatttgtagctttgggtgatgtttcttcagagtccgcatgatattcgttatcacagctctctaaatttgtaagtacactcttagtcccacgtggccctgcaaaggacactacccactctttgcgagttcccttgtgctcaactaagagccctctaacacttaggtccctagatcctacctctgactgtgaagtaaattacaagttcatgtttgttgaatataataatgtcaaaagacagtccctaatccatgcttctcttgaattccctggttaaactcaggggaaacattccacagacagctttatccctgaagttgtcatgtggactagatacctgtaactgcatggaatcaagtacagcaggaggaatctaagaaaatgtgcactgtggtcctttaagatttgaaagatgcaattcaaaggctgttaagaccttcagctggtgataattggatttgtaagtcagtgcaacatgtgataaaaatgctcctgctggatgggatcccggttttcttctatccttcctattaatgtgataaatgttactgtctcagctgatagggccacgttggctaatcagattggaatcaagtttgagttcctcaggctggctccatgtgaagctcatgggaagatgttaaaaaaatactatagagaatacaaggaggacctgggtttgcagaggggaaaattttactttgattaggaggctttgcagcgtggggaagacacatttaccatagaccctagtcacgtgctgccgcctgggcatgttatatctcatgggggactgtgggacattatctccattgttactgggcacatgccatcgtggagcctggggagaaaacaacagcagctctccatgtgggttttggggcagagaggagccaaaataatgttggaaaattaaacctctcttaattaaagctgatggcaaacaaacacaagtaataatgcactacagctgggaagcacaagttcaatatgaagctgaacagctgtgaaattgagccttctggtcacagctgggcctgtgagaaggccagaaaccctggcaaaggtgttgaccctggctgcagggctggcggggctagggtgggcagccagagtggcttgctctcctggttgttttggagtttgcgcccgctccagtgtctagctctctttgcatttccagactccttctcaccaagagcacccctctgtccgataggattattcagggttcttctcgaagtgaacagcgttattgcaagcactagaattgaggggatagagggaagatatgctttgttgttgttgttggttttgttgttgttgttggttttgttgttggtggtggttttgttgttggtggtggttttgttgttgttggtggttttgttgttggtggtggtggttttgttgttgttgttgttgttgttgttgagatggagtctcactctgtcgcccaggctggagtgcagtggcgcgatctcggctcactgcaacctccacctcctgggttcaagcaattctcctgcctcagcctcccgagtagctgggactacaggtgtgtgccaccatgcccagctaatttttttgtatttttagtagagatggggtttcaccatgttagccaggaggtctcgatctcctgacctcgtgatccgcccacctcgggctccccaagtgctgggattacaggtgtgagctactgcacccagcattttttttttaatgtaataaatttcccacagagagggaaggaggatagggtatgtttgttttgtgtttttaaaattgtttgctctctgcatttccccaaagacatccaggctgtgcctttaccgtcagcttgtttctttggtcagtgtctgccactgtgttcctgacctacagacttgaaaggcttgtgcagttgtcctggccttcagtatctgaggggcactggttccaggatttccctccaatattaaaatctgcagatgctcaaaccccttacctaaaatcggaaattatttgtagaaaatctatgcatatccttctgtatacttttagtcaactatagattacttataatggctaatacaatgcaaatgctatataaatttttactgtattgttttggatttttttgttggttttgtttttgaatagtttcgatccccagttggttgaatctatgcatttggaacccgtggataaggagggccagtcatatagggcaaatgtgggactggcttctctctaaagagagggataaagtacacctcagatgcgcagatacagtctggctgcagttacactgggataggtatattccggactttccctgaagttgtcaacttctgactcagtcacattcttgacctctgagcatgtagctatcactttcacttgcatattagccttagtcctcttactcatttgtctgtcagatttagttgttctctgtggaggttaggaacacacaccgactacaggcactgagtgtcaggattgtcaggatggactagactatgctgtggaaacaaatacaccctgagatcctagtggcttcatgcgataaagtgaattactagtctccttattgcctggagtaggttgcacagacccacagaatgtctctccactgactggagactcctgtgtctgaattccttccctcgtgtggcaccagcaccttggagtcatgggattcagctacagaggggagagagagaggctagaaggctgagcagtggggtagcaggaaagattgagcaagatgtttcatgtccaggcctaggactggcctttctcttcatcttccattgtcatgtagtcattcacatgccgttgggctcacggtaagggaaattggagaaagaggtctgccatcctgtgtgcccagaatttggtgggcaggtggtcagtctgttctacattttagcagtctacccaattattgaagtcttagtgcctgggcttgaagggatctttggaagcaattttgtaattcttttatctgcacctaaaaccttagactagtgcttctcaaaatgtggtcctgggacttggcagtgagcatcacttgggaactagttagaaatgcacatactcgggccccatttctgacccattgtacgagaaattcttggggttgagtcaagggatccacttcaagcagccctctgatgctccctaaactttgagagccactgtcctagaccggcagttctcactccactgtgactacccactgggattgcctggggagctttggaatgttctgatagctgggtccatagccacagattcagaccgaattggccgggggtgtggcctgagctgaagatgagaagcattgccctagaatgattattgaggaatagcttttatcctgaagttctctgtgaaaatagatttcatatggctccattggcacttactaatcactcaaaggccatgggagcaattgattttcatgtcctaagcccttcccttccctttcaattggaagcaacctcccagctttgcataaagtacagacaaaatagagatttgggaacttagacatggaatcctgattctgtcactgactcatcacgtggccctgagtaagccaattaatttctctgtgtcgtgtgtctgtaaaacgggagtagtaacacttgcccacagatgttgccagcattatctaattaatgagcacagagtgtttgggaaatacaaagtactgtacaaatgctaatcattatgatgaatgcggtgcattttgcagatataaaagtgctgtgtatatgctcataattattataattattgctaataccgataatattcctactgctaatgtatttccctggcagtaagagcttagtgtattctttgggttaacatcttgccccgcatgatcaggaagtcttgctaagcagctgttaaatgcccctggctttccacctttcagaaaagtatcattcatcaggagtacaaatagtcacgtatgtaaaccatcctggggtccacttatatgagacatccctggctgtcaggtcactgccagatcatgttcaagaagctctttttaggttccagaggtacccagaatgtagagtcatctgctttttcttgtattttcatcagaggtattttttttccttctactggttttttatctacaatagctttgtcatctgctttcatatggtgctaaatgtgctgaagaaaattctagtgtgtgttggtgagtgttactaggttccaatgctgacaattcacagatattatctgcagcaattggtgttgagaacaagacaattatttttgctgtggttttgtttgttcagttttaacttgggttttgattggaggagaagtgttggggaaaggcaattgtttctctcttctcactttgcaagaagggaacggtattgaggattgtgggactggtttgaacaaagcaggcaggctagaaataaagagagcaaatagatgactttaggatgcagtcagcagttacaagaccattgtttctatcctcatgttccttctgtccttccgacacccatttcctggttattagatgtggacctctgtattttgtagaccttgtctacgctactgcttcctgaattattcatagcaaattgggcatgaaacttacaaaagaaactcatcctgagaattatcccaatttagtacaaggcttgaaaaacaaacaaaaagcagagtttactgactgtccataccatagatccctgatggtccaactcttgtctccatttcaaaagccctgatgatccttttccttttccccttttgtggccccacatgatatatgaaatttcaagtttctttgccttgggctggaactacaacaactgatgaatttgtgctgattgtcttatgctgatctgaatctctgattgatagaggaatccctgataaataaaaatggggaaataacgatcaatttatgtagatcagaatttcttaacgatatcattttcattttctctgaagaacatattttaacatttattgcaaggcaagtatcctggcaacaaattccctcaacttttgattgtctgagaaagtcttaatttctctttcacctttgacgaataattttgctggatacagaattctagattggtggttctttagttttaatactttaaatatttcactcgacgctcctcttcctgtatgcatggtttctgaagagaagtccaatgtaattcttatccttgcttctctattggtaagccctcttccccgaccctcagtttctcaagtttgcctgtctttgattttctgcagtttgaataagatatgcctaggtgtagttttttggtattttgattagtgttctctgagcatcctgaaactgttgtttggtttctgtcataaatttttggaaattctcagtcattattgcttcaaacattttttctgcttctttctcccatctacgtctagtaatcccattgcatgtatattacacttccttttgtagttggatattctgttccatttttttcagtttttctcttcaaatttcaggtttggaagattctattgatattcttcaggttcactggtttttccttggccatatccagtctattgatccatggcattcttcatttctgttgatttttttttttatttctaccatcttcttttgaattcttttttacagttttcattttctgcttacattccccatttgtccttgcaagttgtctgctttttccattagaactcttagcatattattcatagttactttaaatcctcaatctgataattccaacatctctgcgatatctgagcctgttctgatgcttactctgtttcttccagctggttttttttttttttttcgtcttatagtatgctggtggtacttttatctttaaagccagacatgatatactggggtaaaagaaactggagtaaatagatttttagtttaaagttttatgtttctggctagggatcaagctgtaattattgcttgttgtaactgtgtcagaggttaaagtttcctctggtgttcttgtttttgatttccctgttgtccctagaaatttattttcaaataccatctgagatacagaattctttcatttccattcccctcttgttatgatgagctactcctatggatgtgaccatgggtgtggggggagggaaatcttctatagagccatgagtaggcctcagtattttactaagcctgtgcccctgcgccgtgagcttcacaagtgtgtctcagggttgcttttcttcccccgctcaggtgagacaggaagtgtagaaggggctgcagttgggtattttcccttccctgcatcattaggctctggtaatataatttctattgagggcaggccttcataagaacaggatgcatgtgtcatatttcaaaatggctgcctttgctctccccctgctggatgcatgaggggatttttctttgatccttactgtgagaacctcctagggctcttgaacctcctagggctcctattgaagtgtggagtctcccaaagtctggagctctcatgttttgacccctaagacttgtgcacactgaacctccagcaactcatcagttccattttagtttttctatcctgatactggctcccgtagagggttgtatggttggttggtgtgggtttttttttttgttttgttttgtttttttgctactgggcttctgctcttataagttgtgattctctgtatccacctgtcttttccaatttaggggcagtgttttgctctgtgacatctctgaggatctcttttttttatttttattctttaagttttagggtacatgtgcacaatgtgcaggttagttacatatgtatacatgtgccatgttggtgtgctgcacccagtaactcgtcatttaacattagttatatctcctaaagctatccctcccccctccccccaccccacaacaggccccggtgtgtgatgttccccttcctgtgtccatgtgttctcattgttcagttcccacctatgagtgagaacatgcggtgtttggttttttgtccttgcgatagtttgctgagaatgatggtttccagcttcatccaagagttgttgactttcggtttggtcagctttttccttttcatgtgaaaagcatgatgatgatgactccagcctgtttaggtgctttaatggaagctggaaggtgtttgctccaataattatcacttaacaaattcagtccacatagtccatcagtcaaaaaataatcatatgggcctttagttgtgaaaaagtgggaaatagagtgaacatcggcttatagttactactatttgttcttattaatggacttttttgaaggaaaaataagaaaagcatataagggagggagtggaggaggtagtcagagacgaggagtgggtataaagtcatttctgcctgttattcatgaggaaagaattatcaggaccttcattaccagtcctcgtgtttacatagggcaggcttatttaggaggcatcagcagtgttccacatgaatgaatttgtcatataactaagctatcatcctttaaatggaacttaaaacattgcaatcctttttgatagagttctttttctaaaatatattattgttttgtcttattgagcaaaacatggagattatcatttgtcttattttgttactcaggtcattattgaaaacatcagtcacagagtgactctgttgtaatgtggagtaggtaactgaggccatctacacctaaacacactccctgtctggcttcataatgcctagcttagttacccctctcctcaaacactcctaaaacccctaccccacctactccacctaaaataaaattaaatttattaattactattttatttgtgtctaagctagtccaattatctcctaaaatcatctcgtatatcactttgtgatatacatacaacaattaggaaacccaaaccaaaacactgtgctgtaggatagggagaatggagcctattatttaattactcaccagactttatgcatgaaaatcgttttctggcctataggctaaaaagtaaatacatgcataatatgtcatttgtactgtggtgtactatggagaaaaataaaccatggccaggggcttaaatgggactagagatagaggtggtcttggaagccctctttgttaagataatatttaagtagagatctgaaggaagtgaagagggaagccatttggatattgtggagttggaagagggaacctcatatgccaaagccctgtggcaggagtatgctttggatcaggaaacttaagaagaagatatgattctgagaaagggaacaaaagcaggagtgagagtgagaaagggagaagaagcaggagatgagagcagagagatagtgggaagctagatcactgaattagtcagctagtgccacaatagtgctgcataaaactcatgggcttacaaaatagcattttttctcactttggacttgtaggttcgctgggaggactatagactgaaaattgggctcaggcttcttccacatatgttcattctggggcccagactgaggagccagcagctactcacccagacctggttgatggaacaccagggcgcaaaatgacaagctagccactcatgcacattgcaagcctcaatcctgtctacaaacatcgtgcaggccaaagcaaggcacagagccaagctccaaacacagtggtgggaaagtataccctgccaacagtaggaggggaaaagatatgtgaccagttattcaatctaccacacaaaccagaaagagtgtggtttttgacttttactcttagtgtgaacatctttaacttttactctttttgtaaagggaagtcattaagtcatattgatctgacaagtgacttgttcttttattttcaaagagtaactctgggaccatgagaatagactccaagggtcaagttggaggcaagaagaccagtaaggagactgttgccgtattccagatgagaggggatagtggctttgaccatggtgtaggagtggggatggtatgaaatagtcatcttctggatttgtttttcaggtagagtttcgagaattggttggtagattgggtgttggtatgagataaagagatgggtcaaggaggtcttcaaggtttttgggtggaatgatgagtagggaagactggatgaagttcaagtttgaaggttgagggcagggaatctggagttctactttcatcattaaggcttgagatacctcttaggctttgcgtacagataccaagtagtcagttgtatacatgaatctagtgctcaggacagaggtgcaggctggagacagggttgaatgaaaattgataatagacttagacatgtcttggatgttgaaaataatattttactcagtgagagagcatgatttatataatctcttatgtgtgaaagtctttaaatcttcttgttctcatctagtttttccctccaaaatgacatgctcaaaggccctcccactcattaatctttctccttctctatctctgtgtttcatttttaattggcatttttgaagactagtctttctttatttttattaatttattgatcaactgaagtctgtattatgactgctgaggttattaaaactgttctgaccaaagttctcacactctgcacacatcccaagtggactctatgctgctgactccaccactccatccctccgccactgaccatgcatccactactgtgttcaagccattccaccgcctgtctcttctgaagccctctcccactttggcttctgcaactctgctctcctggtcttgttttcttcctgctgttctgtgatgctctggctttgtctccttgtgcatgctttctctcctgtgctaaccccttatatgttggttctgtccttgacttgaagctcttagcccactctgtgggaagtctcatccattccttggattttcactgctgtttgggtataggagctgcacacttcattgtctctgaccctggcccctcccttgaatgtagtgaaagtatttccaactacatgtaggatatatccaagtcaatgttcagtgatacctcaatttcaacatatccaaaatgaaacatcctctggtgattggggaggtaagagccatcgctcttcctctgtgtcttagtgactaggaccttcttgtaggtgtcatactcaccaatccctactccaacatctgttcagctctgaattgtcttataatgctctagagtgggaagtcctccaagtcaccccttcaagttttcatttactcatactttaagatatctgattcaatcggtatctcctctaagaaggctcctctgggtttgtaactaggatacagcattcttccttggtattctgccaacattttattcacatctcatcatattatgttgatgttatgtgtatatatttttccctaacatcctaagttaaacttctccagggaagaatgctgtatttatcatctcaagtacctagatcagtgtctaacatttagtaggattttagtaaacatttttgagcttgacagaaaggattaatttggattaatgaacccaaccaaaggtaagtaaaggctcagatacagccatatatgcctggtcttctaaacctcatagctttacctctgggattcatagtaatgttgatccatgcaaaagctttttctttgtgcccactatacacagataatgagagcacgctcatggctgcgggcaagtagcactgcatgattgacatgagttctgacaactcctccgaaagagaaagtagcccaatcatccccagctagatgatgagtgtgtctcatgttattttcaggcaatgtaaggttttatttttgtcatgcaccaaatggacttggtgtcaggccgtcaaatgtctggcaatctgcctagctgaagagataacatgagtggtgaatagaacattattgtgtgataatgatttccagcagctattgaagataaattccaatgcaaagtagaaagctttatttccaggggaggagatattgatcctgtggccactgtaaatagaatgagaattgcaggtgtagacagaagtccagtcttgtcacaaacattgagatctgactagcagaaggaactgcctcctgaaggcaaatgaaagcccacctgtttaggaattgctcgttgctccccctaatgctgtcactttcctgtaggaatgtaccatgtgaaccagatgcagcgtgagaagcatattaccaacacaattcttaaatgaaaaatcaaagacctctgcagatcagccataattggctgtggtatggtccctgggatctcgcttggttctttaagaaaaatgtttttatgagtcagagataaatccggagactggattacgggatttgttttatagacttaatggttgattgaaaaagaatctcatattctttatatacaatttgagattgatgatgtggttagtcttcattaggttttgacaaactggtcattacaacctgtctacttcatagaatattcagttttagaaagaccttaaagatcatctcatctaattcttttatttttcatgaaggagacagtgaccttaagatggtcttatagttaacttggacacttttttgaggcattatcaaaatacatgactttcttaaaccttactaggattgtgcattaatgcaaagctgttttctttgggatagcacttatttcagaatgagaaaaatcttcccagagaccttgcaaatgcttcaaggtctgggaattctaactctctcttgtttcacaggctagtgcacatagtttatattccttctgtggataaatgtagactatctggtgctctcatctctttcctgcctgcccagagatcacctgctagtaggcactacccgtcctggattgcctcaccacgatttgcttcacccgtctcaggggtgtcctgaacttcagtgtgacaaacttcaggatgtatgttaagtgcatctgtgcacctcttagtgaaggacatttgcaggatgttggagatctgtggctggaagattagcaggtcagaagctagctcaagtgggcaactggatagtggcagatgggtttacattcaatccagatgaaatcccagagggcatttgggttaaccctcagcaatggctggatggtaactctgtcgtgtttctccacctttgacacctagttttgccatcagatggttgtgagtttagggacaaaggaacctggagagaggagtagactttctttttctctcctcagagtctcagagaaatgacctccctgctcctgcaatggactatgccccactttaactgtgccgaggctggatgctttgccaaaggctttccttgtttgttccattgatgaccacagttctccagatcttgacctagttgctaaatccctgtgctgatcaaaaatgttcccactactgagggcagatgatatacattcatgatacaagcacataaactccagagggatagtgccaataggagcatatttctggtctcctagcatcttgattattcagttttaaacttgtttatgctcatatttctgatgtttttcttcccatggttttcattaacaaaaaataatctgttttgctgttgtttgctttgagtaactgagaggactgtggactgagagaaatttaaaatgttcctttctaaaaaaccgtacatgaacttgatattcaggctctcctagatgttcattttaatctataagaagctgtgtttatgattctgtcataccagagtgagtcccctcttttctctacttccatagctcttgttgtctgtaccagtcattggcaattaattatatactgccttgtggcatgataatttcagtttgtgtgtctttatatcattgatgtaagtggactcggatccttgagggagagaattgagtgtcatgcttctttgtttcctctctaacaccgagcagaatgctatatgcatagtcggctgtcaaacaatatttgctgaatgatccaccacacagaatttcttaatgcctctgcataatggtcccagagataatgttgcataaaaagagacaatattcttcccagtattaaaatattcggtgaaatgccacaatagtgatgtttcaaaggtctgcagattaaatgtttcagggaatgtaaattggctattgggctattggcatgtgtgtgtgtggcagtgggaggggtgtgtgtgtgtgtatgtgtgtgtgcccatgtacatgtgtaatgttcctgtgtgcgtgagccccattgctttcatcttgaattttggagccctctgtcagtccctctgattgaggaaggaggatgctggctgggtaatggatgtcttgctctagctggcaaggcagtaatgcttcaactggaaaatcattaaatcccagatttcagcctgtctctctgccacctctcatcagcagcaaatctgctttaacagctaagaattcccttatctctccgtgagtgtggaccatgtgctgctgctctctgtagatgggagatagagctgcatcattacgcgggggtgacaaggatgtaatttacaggctcaatcagttctagttaccatgtaattacagagttattacatggtcatttgttcctgatggacaccagtgatctcttatcctgttctactgtggtctgtttcttgtcttatgctactaaggatatttagtttcttctgcatggcgtgttaaatggtgtactagggaggaaggacagaaacgagttgggataagatgttgattatgctgtgatgctatttgttctcctcaattggcctggtgataataacagcatgctgtggctttcctcccctaggctccaagttcacattttcttcataagagagactggagacaatattgtacttggcagcatgggggaaattgggtgtaaggaatattctgacccattccactcagcgaggagatgacaatatcaaccccaagattatgtcactgcctcttgtaatttgaagctcatgttaatgcagtggctgttggagaaaaattcctttttataatgaaaaaggagagggaaccatttaagtgtgtaattcagtatcagggagaaatgatgagaaggttcagtaacctgcccaatgtcaccaagcgaatggtgtatctgggacacaaatgacagagcttggccccctccactctaactcatttcagtgaattcctgtcattaggaggcaacacacttttaatagcacaagtactggaaaccatgtggagaaatctgaatattccctcatatttgcttgaatgacctgggataagctcctttcttaactccttgtttttattaattaagaattgatgtgtgtgataccatgacacattctgaagatgtctaacataggtggattcctaatccttgggaaatggactgaagggccatgtgtcttgctattagaaagtgtggcatccatatggtgctgtgggtggtatcctggggtcagcactgaatgcacgtcaggagacctgagtcctgtctcagtgtttccactgagttgtgtgattcacagtctgctactctgcctgcttaggagtcagtttccttctccagatgctatagtttggatgtttgatctctgcaaacctctgctgaagtttgatccctgatgttggaggtagggcctaatagaaggtgtttggaccaccgggatggatccctcatgaatagattaatgcttcctcttggggggtgagtgagctcttgctctgttagttgctatgagatctgcttgtggaaaagagcctggtaagagagagggggagcccttctctctcttgcttcctctctcccctgtgatttctgcacatgccggctcccttcacctcagccatgaggggaagcagcctgaggccctcactgccacgcttcttgtgctgcctgcagtaccatgagccaaataaaccttttttcattataatccatcttgggtattcttttatagcaacactaaatggactgagacactggacaatagtcaaataggccagacaattgctgaagtcctctccagctgaccatcgtctgtgactccatgatttaagttgacctgcgagaagagtcagaaagcactgtggtatcattaaggctgaaaaacagaggtcatgggatgaggatattcagtgttgttatcagagaagcttcttcccactgggagccagaaaggtgcttgcatgccctctctgcatttcagttgatggaatgctgtgagtcattaacacgctctcctacttccctccaatgaaaacaccttgctgatttaattaaaatacatttttttcttcttttggatgtctttgaaaatggcactaattataacatagctgctatgtaactaatatgtgcaggtaatattgtgattatatatagacagccatatgctactatgcagccagtctcattgctgttaaactgctgaagcagataactccatgtccgtgcacacaaagtaattgcaccaaactaatttgtgtttgcaaacagatcctaaattaactatgtaaataggcagatctgcaaacaaaatattagaccgtgcatgtgtgcacacacatggggcagagaggaagtggtttttcacctgcttgaaagatgtcacaggactggggcttgcctgtggcatgtgttgccttgtgggcctcttggtcccacctagctcctgtcttgcattagtaagtctgagttattctgttccgacacaggtgactgaaggcaacctgaatttgttttctctaggggtaaagggttatcttgatcaatccacctttcttgatggtgctcgctgccctcatgcattctttgaccaaagatatttccaagacagctggccccggctgtgtgttgtatgtggagtggagatgttcttaatgcagagaagttcacgggtgtgattgaggacagtttggttcctcggcttgcaattgttagtgcccggaggagtgtgtgatcctttgagtctagcagggctgtttgaaatctggttccaccttgggcaagtcacatatcctttctaaggctcagtttccctgactgtaaagagggggtgagattggagtttcctcctggggctgtttagaggattaagtgagcaagtgtgcgtgtgtagcgtttagcacattggatccgtgttcagtcaacccttgctgctgttgctgcacttactgatgttgtcacccctggcagaccagcacgcttccctgtgggccctggcaacagtgtgctgactgcttgcatggatattccaggtgaggaggtcagcctcaaagaagaaagcccactttaatcaggcaagttgggccccaaaggacgtctcgcctgtctgccttcctcacgtccctgtgtccctccgtccctcctgcactcagcgtctccctctccttcagcgtggagcctgtggtctccacctccacaatgctctacttagacctctgctcttccatttcccaacatgcttcttgtgttgtaaaccttactctccccaggcttattctctcaagtcttgctccgtgtctgagtggttatttgagtgagggcaccagtcgggtacagcagccacactggtgtccatggggtgtttgtgccaggtaatccctctgtccagaacactctgcccagggagatgggtgaggcccggccctttgggctttgaggtctgtgctccaaccttgccttctccagcagcactgcctcccacccaattggaccgcagttggccccactcccactctccattcttcttaccctgtcctatttttcctttgtttcatagccaacctcaccttctaatattttgtgcgcttgacttatgtattgcttactgcctgttactccctgcttgcttgtaagttccttgaaagcagggccttttgttcattaatgtttgtcaaagatctcagcctgagtctgtgctaggaaggcccctcataattttttttttttttttttttttagaaagacagggtcttacaatgatgctcaggctggccttaaactcttaggctcaagcgattgctgtaattgtgaatctgtttcctgtctggattcttttgctttcactctcagaagccaacagacttcaatgggaaggacctgagggccaggaagaggagtggagaaaccttcgcagaggtggtcagaggacaagcaattcagggaccagatgaggctgggaacttaatgggcagagaggcccaaagggggcctgaactggaggaaacagaggcaggcaccaaggcaggtgtgtgggaataagacagcagcaggaatgtgcgagtcaactccatgctcatattgcagatgtaaccaagtgacttactttctctctctgcggcgcagtttccgcaccagtaaatcaccatgaaatctaccatattcacctcatcgagaatttgtgagcgtcaactaagataaccacctgaaagtcattcccaaagcagatattacttttttttttggagacagagtctcgctctgtcacccaggctggagtgcagtggcgtgatcttggctcactgcagcctctgcctcccaggttcaagcaattatcctgcctcagcctccctctggagtagctgggactacagatgcatgctaccacgtccagctaattttttgtgtttttattagagacgagatgggggtttcaccatgttgccccggctggtctcgaactctgagctcaggcagagttctgcctcccaaagtagtaggattccacccgcctctgcctcccaaagtagtaggattacagacgtgagccactttaaatattatagttgcttattattatttctgtttgtatctcagtttactagtctgggaaatgggccctagcaagaatggccattaactagaatggaggtaaagtgggaagtatgatggatatttctgaaggattctaagacaccattgaaagctgcatgcaccaagaaatggggcagtttgggtgacacatttcaggagaagagctttcactttcctcagcacacctgaaggcatttcttatttcattaacctaagattaggaacagccccatgacaaaaaatgttggcaatattgatatgaacaaataattaatcccaggtgctacctgctttctcccaggtccccctgtgatccttctccttatgctaaggggtcttgttcccactcccatccccaggcttagggagttgtggacaggacagtctattataacacttatagccattaaaatgtgagaacaaagcccgctctgctctcctgttttttaacctctttgctgaagcataacttctgtcaataggtgacctaattaacctgttcaagtcttgaggatttttatctgtgcatgttctttgatttcagattaggattctcaacatcagttcaccactagctagctatgtgaccatgaacaagttgcctgacactcaatgtccttattggtttaaaaaagggggtcatagctagctccacggtgttatgaagattaaattagttaatatttgcagaagtacctaagacaattcctggcatccagtagatgtccagtaaattttagttttgtcctttgttcctaaaataagcatgctggagtcttcaataccccacatttaaaaagaactgttgcagttacatttttctggattggaagctttctttgtgtgaaatacacgtatcacctgtacctttttgttatttttgctctgcctttttgtttgtgtgtgggtgtgtgtgtgtgagagagagagagagatagatagagagagagagagagagagagagagaaagtgagaagtggtttgttttggggatatcatttttgttcctttttgttgttgttttttaaatttgtaagcaaggtgatggaaaaaaccagaggagaagccaagtgtatctgaagacaagaatgtggaagtgaagaatgtttatgagactcactctaacatgctgatagcaaaggacttttgttcatcagattccctcacatgtattcagaattaaccttaagcacatttagtcagtcatacattttatttttgtctctgggcattaatgtgctgacttgtgggattattaaactataattccccaagatatatttctgtctctcagtgggtatgaacgtgcaatcattagcaaatccaatatttaggagtctttcttctctctccacggtaaatgggagcagaggaaggatcatggctgatgacagcatctgggtcagacagcccccagtactgctgagttgctgggcagtcctgaatgatagtggaatgactgtggcctttggaagcataagacatgaggcttgcttctggctctcacgtttactagcagtgtgactttcagcaagtcactgacccacactgaggcttagtttcctcataggtaaaatggggagaatacctgtcatattgagaaggtcaaataagtgtcatgtattagtatattaatgagctgtgaaacaatgactattgttatatgttgttagtggtgttgagttatcacttagatttccaacctgaggattgagtaccaggattgtaagctaattatcctgaaggcctggcattctattgaacttgttaaatttatgactgtgtattgttttaaatgagtaagcagtaggttgccacaatgtaatctcccttttatacttcaaattgcaggtgcatgtctacacgttttcctctagacccaaaatgaggaatgcatttgggtcagaatctagaggaggtgttttgctttgatcatagatgccaaatagcagcccctcgttcctgttctgtgagagctgtgccccatgtatcagtagaagaatggccccatttctagagcagctatggctactgggactggaaatgcccaagggatgtttatacttcctgctggtcaatcagatctttgtatgggctccagatgtgttgctgaagaggaaaaatttgaccaaacaaaaacaaaacaaaaagctgatgtgagcccaaccttttcaatgtcccagatgctgggattttccacagcatcactcttttcaatgagtgcctttaatgctatgctgaaatctccctggacacctccagtgaaaaggctctcgctgttgggcactgccattgtctgcctccaagaagacaaagagcctttgagcttagagctgggaacacaaaattgggtatgagatgggtcctgccatcagaagctcgcagacatcatggtcagaaatacctgttcacaatgttctgtcacagtcaagtattgtacagaccatataaggcagggtagaatagataggatacacaaagctagattacttttttaattaaacaattatttatgcaacatctgctatgacattgtatataatgtctgccatccccattacatcaaatctccataaagacagtatctcttgttcatcttatatccctggtttgtaggactctatctggtatatagttggtgcacaaaataaatattttagagccatatttcattttctgagcttattactgttgatttatgcctctgttacataagtggaagtatgaagaggccttgattaaagtggaatacattgtagaggcaggggcagttcttatgatgctgtagcataaaattgcaattgaggaatcctattccatcattctaatggccaagggatgggtagaagacattgctttttggtcgtagctgaggaatcctaggtttagtctcacattcttgctactgcttagctttggttagtctttctgcaagctcctacatggtcactaaggacctgagcttggttttaagatttgacctaattcttcatccttcaagcaatatgtgttctggttaatgagtttgtcagaagcaaaatgaacaattctaaccacctgtcccttaacaaaggccactttaacaaatgtgagccatgtgcatttcagctaagatgagggagggtgctttcagccaactgtcaagagctcatcaagccccttcctgcatcctctgtcactgtacaattattgaagtccagggagtagcaaagcaagagacctgggtgcacgttggccccacatggagccacagactctgactcagccagtttttacagattgttgatttgggttcagttatagtttctgcaagattggaaagtggtcacccgttatggctcttggccactgcttctgggtcatctcaagcacattattcaagtattctcttcagaatgagctggcagacgcaaacaagccacagcatcaggcttcatgggaagtctggggacttaccattgtcgagtagtatcaggtggtgtctggaggggagaggagagaggtaagattgaaaattcaaagaatacagagttttggtggtatgaaatatatcatctggaaaatgtcactttgtcctgagaaccattctcctggttaaagaaggcccaatcttgggataaatggcattactgccatctcagcattttaagaagacagacaccaactatgtgtgtgtgtgtgtgtgtgtgtgtgtgtgtgtgtatgggtatgtgtatgtgtgtgtatatatgtgtgtatgtgtgtatatgtgtatgggtatgtgtgtatgtgtgtgtatgtgtatgtgtttgtgtgtatgtgtgtatgtatatgtgtgtatgtgtatgtgtgtgtatatatgtgtgtgtgtatgtgcgtgtgtgtgtgtgtgtgcttatgtgcatgtgtatgtgtgtgtgttatcatttaaatgggtcttatgcactacctaccacaaggtcattctataacttgtggcacttcagtctcaataacctctgccaataacagggctcaagtgataataagtttgcctgtgtgactctttctttcatgcaaatataaggcatttgtatgttacggcttaccttttccctgcaatacctggaaatcagagtcagtgagacactgtgtgttttagagttgggaaatctgaggccaaaaagaaaaataaattgtagaattcagtagatgtgtctgttcaagaggaggacccctcttctgaatttcctcatccagtagcacctctttgtggatcttctcatgagtccatatattttcttatttccatgttcctgaggtggccgacaactgagggaagcaacaagctgccccattgctatcatgggtgtgataggaacgagcctccacattgggaccttcgccagtgcatgtcctctagtgacattttatccctgagctcccagtgcttttcccgagcacaactccatgggacactgcctagtggaagagaccacagcgggatgaaggaagaactagaaaatctagacgaaatggataaattcctggacacaggcaccctcccgagactgaaccaggaagaaattgaatccttgaatagaccaataacgagttctgaaattgagacagaaataaatagcctaccgaccaaaaaaagcctagcaccagacagattcacagctgatttccagaggtacaaagaagagatagtaccattcctattgaaaatattccaaaaaattgaaaagaaggggacttctccctaactcattatatgaggccagcattagcctgataccaaaatctggtagagatacaacaaaaaaagaaaatgtcaggccaatatccttgatgaacatcaatgcaaaaatcctcagtaacagcgttagtgtttcatatcaggctgtctgttgcgttctgtttattattgggatacagtgcttttgtgataagcagttacacatctctttgtacttgttaaagggttaagtgctggcagttctgggaggcaactgccatttaaaggaagtagaataaaagatgatgttgagaaggaagtgaaatggagaaggaagaggtcagaggaatgagggggagaagctgggagtaaaggagcctgcccttacaaatgtattggtaattaggctgtgctctttaaaaattaataacatttttcccattgattattctacatgtagagatatctgaagttattatttttgtgtattcccttatattcggcttcttttacaaacatactagtatggtcttccatgcaagtatttatttttcagacacaatatgaatggcaatttaatattctagttcatgattcatccaccattttcttaggtttaatccaaccagaaaggtacgggatatacttagctcccaaatatgagtacagctagatcagagacagggtttcctcaaagcacgtttctcagcatcagtcaatagcagcggggttgaggttttcctttctggactcttcctttttcccacggcacagcacgtgggacatggcagccatatatgtcggtgttcctggctgactttcttagagaccctggaactggtgacccttttctctgagctctttctgagcttcttccatctctggaaatctgtccgaggatctggagcagtgttgttttggatgggaaagtaaacaatgagtgaatactgctattctcgttctgcataggttgtgtgtaaaaatagagttgcttatataaagactccaaaatggaattttatctgtgcatttctgtgtcatcccttccccttttagactataaccatccaaactgtatgacctcgagtgagttactcaacatattcaagcctcaatttctgcaaaatggggataataatagtgcttacttcctaggatggtaatgaggattaaataagataagtaaagtaatatgcgtgaagtgctcagcacagactggaccagtgtgtgcacagctaatgctgacagttcatgctattttgtcattattgctatcatcctgagctcttccacaagacaaaccatattgtatttattttttgttgaaggcattcaatagatatttgttaaattgaactaactgttttaagtaaaaataaataagaaaaaggaaaagaaaaaaaaaaacccacccctttacataacaacacagcaattctactggccaatggggaaatcatacatctttactgctgtgagttattatactctctgaataaacataagcctttcatatgacctaatgattaatggcttatgcaaagaaattttaatgccattaataaaaaattaagcagcaagcttcccccacttttttgacagtgtcaggctttcacctgttctcctggggacaacaggtttccgggaacatgctgagtacagataatagatcattcccaggcgacactcccctgtgtgcctcatgtcttcctgggcagcatgtaggatggatacaaggcactctttagagaaaggcaaggggtctttgtggtgaggaacagagatcacagctgagcactggctttatctatctatctgtctgtctatctatctaactatctatctactgtttatctatctaccatatatctatcatctatttataaatcatcaatctatctgttatctatctatcacctggttattctctcatattgagtatttattctgtgtcaggaattacattaagatcttattcagtcctcatagcagccctaggaatttcaaagttaatctccgttttacccatggaaccctgggctcagagatcatttcctgttcatggtcatatggtgactgaaacacagatctgggattggaatgtaggtctgtctatttcccaagtgtttccttatccttctttgcctccatccagtcttctgtgcccccatgggctgggatctgacataggtatcattcattctaagaagaatgagcaggattctgacactgaatgctccagaagggaagtttatccttttaactaaatactctttcagtgttgaggtcaaatttcacacaaagtctccaggccagcctgatgctgaattctgaatatcccttatgaatattttgtcctattaactaaatagtctttcagtgttgaggtcaaatttcaagcaaaggctccaggccagcctgatgctgactcctgagtatctctcttgaatacattgtctctaagcctttggtcagctgtgcttccaattcaaatgccagttttcttcaaaggattgatctcagcacctcttatttattttgaagcaaaagctccacattttcaaaactgggattcctggtctgcgaggcaggggagtcagctagagcctggtcatcactggcattctgagcagatagcagcctcctagccatagctctgttcttgacccggtggccaggcagggcagtttgcaagctcagctacagacacatgccctccacaggcctccttcctcttaggccccactgtttttccacataacttttctgagtctgagagaagaaaactggttttctctaaatcaagagtagggtcctcatttaggaaagccagaattttctgtcttacgtatcatattacatccttgacctgtgtgagacctcctgttgaggtcaaagttgggtggacgacccgcttgacatctcagtgtggagctggattgcccttcaatccctaatgccctcactttctacccaacttagcatttcacttgtaattagttcctattaacttttttttttttatatagctgagtatgtctgcgtgtgtacatgggctcatgcttgcatgcctgctctgcttagctatgtttaaactgttagaaagaagagaccattccttttttatgtgtcttttggatgagctcaaaatctaggggtatatagaagaacttcagatcacactgctgcctgaccaatccctggggatcctctctgctgccaaatgtgaaggaacgcattgttagacagcaataccccccatgccgccacctcctccctcccttcagcggcaaagcagagcccaagagcctcctgcaaagagagaaaacagattatattttgtagtttgtaaagatctctgggtccacacgatcaatacatttctggtccctgtgtggggaattgttaagtcattctttagcaccaagaatagaggggccagtacttcctggggactaacaggacaaccatgacagccactgaagcttttcttgtgttcacctctggaaacaggaaaagaacagattcttctcacccttcagagtgcaaagggttctgcatttcttgtcataattccggagtctatctgaagccttgtgtgagaaagtagtgtgaacacggttgatgtttgtgtcaagatacaaccacagtggctcagggacccagaagttgagaatcccagcacaggtcagcctggtctcagcattctcattctgacatcctcaaaacagacagacacccccaaccaaaacccagcaatatcgacaacaagaacacaaaactaacaaaaacaccagaactacagagctgtttttcttttcttttttctttttttttttttttttttatagcagctattacatgaaaaccgtgtactctttccttctgcacctatttgtgcacggtgctggatcggggcttctgaagagtcggcccttaccctgtaggagattcaaggctgactgacctgagagagaaggacttctgcattgctgctcaggatttttgtttttatttttctgttaattatgagcccagaaaaagggaatttcgatttttcagatatgaccaggtcataggaaatgcaattgaagggaaatataattggagggagatgtagcctcctgactttgaggccacacacctcacatacctgaggacaagaaacaaaagaggaaatcagacacatctgacaaaagtgagacggatagagcataaagtatgtctgaaaacagcaacaacaagaacacttcctccaagtgacccctggaggaagacacccccaggcggcccaggcatggagactgtgagactcacatctacagggcacacttcctaggagaaaggcaagggcacattcccccttcatgctatggggctggccgcacctgaggagggagccacaccctttcatccatgccagtctcctccctggaagagaggctaggctggggcaggggtgcggttgtgaggctgaagagcagccaggaggaaacccttctagtgagcagaggatcagctcctccaacacacactggctctggggtctcttgcaggggttgtcagtgagaggtgagcgcccttggctgtgagctgggagttatcagcatggctggagatgagatacacattgctccatcaccctcacctgggaccaggttttgcctatctcaatggcagcgtgactggtgggatgtgacacctctggggaagaggaccaatgctgtgttcagccatgggtgcagggtgggaaaacctgatgggggaaaagacaaagcaaggagggacatttcagtctagctcagtcatgaggatggccaccaaggtttttgccggtcagacatgtctctgatttgatggaggaggagccactttctagggaaaactgatgtctcatttttgagagtctcctttgctgggtggggggcccttccaacagtttttgatacacaaagatctgcagcctcctgagcaggtgattctgaaagatgcagtgtctctctcccagctttcccactgacctttactgaatttcagacttaggctatcccaaaaggcagtcggaaatttgctcagtggcatttacctaactgaggccactggcagcatgacacagttgggtgactttagggtttagagagaaaatgctggcaggggactggggaagggagaagggtgaggtaggagggatgagcttctctttctcgtattgctatgcgttgctgaaaggcaagctaatagttacccagccagggtcaagcagctggagagggaagttagagaaattcacagccagggccctgagagcagcctgggagcacagctctgtcctgcagcagcagaaccttccatggctggtcctcagagccctgtgaaccagcccacccctacgaggattttcttgctctggaaattcctgaaattgattcctaacaaagttggggggaaaggggctgggcaaatgatttttttgtatagcaggcactgtgttcactgtggggaaagagagaaactgcccctgccttcacagatcttaccatgaagtggggagacaggcgaaaacatgcaattacacaaataatggcttccaattgagatctgtacttccaaggagaggtgcgtgctctgagagggtttatggcggcaaagcctagattggggcatctggaagctccatgaggatgaaaaggaggcagctagggaagggcaagatagagaactgcctgtgagcaaaaggtgcccaggccaccagatgtggggcacacagacacctgcagggccagtgtgtcgagagcagaggcagaggcggagcttgcagggctggctggtgtctcttctcttttggccttatttgcctgcttctggcagttttcttttcatacttacatgtcttgcctccagccttgtctggttcttcttctgcataactatgcctgccttgtaataggaacttgataaagaggacttgatgaaatctgagccctgcagcaagtcgggggtggtggaaaggatgtcttggtgccagtgggttggctgaccttggtaaagacagatgccttgctccttggttaaggattttccctgtggagtcagatacatgtcagtttgaattgtaaccctgtgactttggtcgagtaacttaatctctcaaagtctcagtcacactggtggaaaaatacagatagtgcctacctttatttatttgtaacatatgacgatgatttttttttatgccagacaccgttctgactgcttcacagatattagctcatttaatccttagagtaaccctgtgaagcaggtaccattattatcctgattttataaatgagaaaactgaggccctgagagattatgacatgactactctgtgttaaagtcagggttcagaatgatggaatctggatcttgaatccgcagtctcaactgcttatatttttcttatattttcactccgtgtgggttctggaattgctgggataccaagtgtctacagtgaccaggagggaaggaagtaagatttttggccacagggagccttatccttcttggcatatcacttaatattttcctgtgtctccagtcccccaggctccgactgcctggaccagcagcccctaatgatggtcaggctgacaagctgctggcaggactggcacaggatgccaagagccccctcctccccaggaggaccccttagacagcagtgtcagtagaatgctggctaagccctggccactcctcactgctcatctaactactccgtctacagttctgatccggaatgtgaggaacaaagccatatgtgagctttatcaagtgctgagtctatttcagaaaagactgtggagaatgcatcaaagctggttgcttattgcaccatgatccctgaagattggatccagttctgtggaagctggcagaataatgggcccagactgaccagtgagctcactgagggatgttactagttggtccattgctcatctgccaggtcagagacaggtgggaggcaagagaactaattaaattggcagtggacattttacctctaaaatgtagggcaaaaaaaattgcaaacaggccttttatatagaagctaattattaaaggaaagtaaaaatattggggtgttaaagaaatatgtgactggtttagaaaatcctcaacagatatttatcccaaggagggagatttacaaagccaaatttgctcttaatccttaatccacaaagctgtgatcccacaatttcaccaggaataactgacatgaatgctaattggaactctccctttttcccttcctcctttttatgttcttggacaccagcattccggcattctctctaagtttgggagtcctggtctatttccccccttagacagtgatgtttgagtaccactacccaccactcttttggcattcatagtgtaaatggcactttatcagttgaaaatgtgaatcctgtcaacagcccccagctctgccatgcttatcagggcaaggaagagggagagtgagattcagagagatgtactccaccctgttcattccagaagagtgatagataataacattttccggcaagaaacagcaggaaatctaacagacaggaattaaggcaccaaatgggaaagtcaattgcttattcgctccaagttttgtatttgaagggaatgttatttgatttggggattccctcattctccctttcttttttctagggggcaagtggaatagtagaatcaattatctcttcacaaacgtattttccaggctcactgtgtgtgtgtgtgtgtgtgtgtgtgtgtgtaaatgctcatttaaccttttagtaatgtttcacaaacatatatttctcaattatgtcaaagctccccataagtaaaagaaggaatccctggatttttttttctcatggtgtctcttgtcactctaaaatggacctaaactaagaggtagaataacaataatgaaacaacaacaacaaaatactgcttttgtagtgctacccatcttgtttgtacagtgtttgatagctttccactgcattttccttgcatttcatcaacctcactagttgctgtggtataccgatcacaacaaaaatgatgagcatctcagccctgggcatgcatgattcagcataatgcttgcaatggccttatcagggggtagctgtcattgtcctcctttaccaatgaagacacaggcttagagagattgagtaatgtgtccaaggtcacccacctgacaagtgatggagatgagatttgatccgaggcttacccgatgccagggcctgaccaggtaaaatggtcattctttcggtgacagaattgaggcagaggacttgtgaggtcacccatagatgaagaacggatccaggcacagaactctggtcttgttaattctcacagctgctcttcttacctcaccaaggctaggagaaaagagcatctagtcaccaaacaaactcatgctacagagactctctagtctctttcataatgcaaaggaaaagaattctgaaattctataccaagctgttaggtgttttccttggattggggaatgtagagggattaatgaggacaggaggcagaccttatcagggtgaaataacatgaaaaaatgaggatgaactactctttcttcatctactacccaacctctcaaataaatttcttgcaaaattaagtgaattcttgcttcaaatactcaaatagaggatttatcttgtttgttccatcttgtgtgatgaatccaggtgttttctaaagcagaaggcacttaatgtaggttctttatttttttgtgctgattaccctaattggtgggtttccttccaggatcagcagccaattctccactagagtagtatcactggaccttagggtctatttacagtagcagatgtagtggtcacccaataaaaaagtcgctgggtgcggtggctgacaactgtaatcccggcactttgggaggccagggtgggcggatctcttgagcccaggagttcaagaccagcctgatcaacgtggtgaaatctcatctatactaaaaatacaaaatttgccagatgtggtgacacacgtctatagtcccagctactccagaggctgaggcaggagaatcacttgagcctgagaggtagaggttgcagtgagtcaagattatgccacggtactccagcctgggcaaaagagtgagactgtctcaaagaaaaacaaacaaaataaatcaaaatattgtttccacagtgcagttttagcctgctgtctcaaaagggcctgagatttgctatatagccaagctgtgtggactccacaggagactcaggattagcaccttagagtcttgactgggttttcttctttaaacgaagctgtagatttagctataatgccatttgtctgcgcttactactggatgggcacagtggattctgattcgtagtcctattcagtgaaaatagccaaatcattgtgaatacactttaatgtgaaatccttcttctgaagagcccagagcaaattcccatgttagggagaggcagatggatggaggcagagttagctctcaatgagttaaaggaatgtcagcatcttcttgactatactggtagctggtagaatagagtgtattccatattgtaaatatagaatacagtcaatctagacccaaagaaagagaaaggaggggcagcaggggatatactaacttatgaacttgagatttataagcattatcaatcttgaattgaaaaagtgaatctcttgagggagtactggtggcattccaaaagctaacccaagtatccatctagtttatagcaaatctaggcacataattcccttagatgatggaattgagatggaggacatggaaaatgatcagacacccttcctgcctggagtgtagctcagaatgaattatctgtggttaagggaggggtcaagggaggaaacggtggtactggtgaggcattccaagggcttggtgtgaggttgcagtaggaagtggattccagcttttgaaaaccactgttacatctacattgccagcagaaagctgaatgcctacatggcattggaatggagtgaggcagattgcaaaggatggggctggccttgaggttggatcatatgtggctgtttctttgactgtcaatcttcattcttaaatcttctcacttgaacaccttttattggcactaaatttgttttaggataatgaacgcagctgttccaattatggtgctcaccccactcacctccatgtttcacctctcaaagacactgcctctcccttgggactagccctgagcatggtgaggccggcatgcccagggctgaggctggcacttggagagccctagcgtcagaggggttaacacattatctgggcatactcaaatagtatgagcccatcaaataaacaaacacaccaacttgcaaatgaatagaaacatgtttattagagtagaggaaaaacagctttttggcacattaaccctgtggcatcaggagtggcagctgcagcctgggacgacaggcagggaggaggagacagtaaacgtgcattttgaaagtgcttaacatcaggagagggtatttccaagcaaagaggtgtgtgtgcgtgtgcatgtgtgtgtgagagagagagagagcgagagtgagagagagagacagagagagagagagagaaccatcaaagcagtacaaaggccaggaggcagtggtagtgtgcacataagacctaggaggatgtgggtttgaatcccgtctctttcaggaattgggtggccttgggccctgtgcctctctgagcttctgtctccacacagttctcttataatctgtccttggcaggcttgtaagtgaagatcatatgagatgacctgttttaagcatctagcacagaactcggcactcagaagctgctggataaatgccactcctcactgtagttctacgttagaatattccaagttttccatggttcctgaggaggaaggcagctgtgtgttcaggtagaaaagtatgaggtgtgggacagtgggaaattctcatgagcaggtttcaattgaggaataattcatttttgcagtaggcagattaattggaaatgataaactcctcccattgtaaaattaagaattaaaagtgtttatttttattcagtaaataccaaaccatgactgtagtatacttgtattccaaactttgatgatttaaaaagggaagagagaaggagggtgaagggaggagagagagagaatggctatgagaaagagagcaagactacattctgagttcctacacgtcatcccctatccccaaaatagcagctccacttgtatacattgataaattttcaatgtagcagttcattggcagagagatgtccaatacctaaaaatagcttgatagctcctagcatagatcatctgccatatcacctgatatttcatcttccccactaaaatgtaagctccctgaaggcagagattaataatgcatataggaggtaatctttgatatttaggatgaggcaatgaatacatgaatgaatacgtcaatgaatgaattaatcaatgaatggagagacaaggagaatcagactctcttggactcagggaatcttatatctttgaacactaaaattatgcttctgtcttttcttgctcttctcaacccaccttgcctgacagtttgttacattgtcaaactctgtcatttcttcatttagcctgcccctatttcactgttagccaaattcttacacccacagagatgatcctcaacctttgtatgttcaactcttgcacagtccacaaatcccccagtgcactccacggaaaccactttgcaaatgccaagcctagccttgtgtgtcgccttgatgaatgagtcaccaccagctgtgctgcccaccagacagcttcttggttccaggggcgccgcctgctttgtcgtatagcagtgttagtacgattgtttgaatacttcactgcattcttcccccacagaaaaatgaaagtgctgataccagtgataaaaaacataggtttcataaacttaacacaattgaggcaaagatggaaatcatttggcgtgcaaaaaagagcaaatgtttagcctcaatcgggtgcttatcatacttgagctatctgattgtgtgctcagctgtaaaggaaaagaaaaaagaaaagaaagagaacagacacaatgcagtaaatattgtcagagattaagtctaaaatatacggtgtattttggattttttttttttaggtttctagaaatgcagatataaatctagttcgttttcactctcaggcatgttttagcaatgtgatgtggtagtgcaaaaacttcttccctgattttcttgtcctactttgtcaaacagattcagctgtgtgtttatattttcaagaattgtagtaatgtcctttcagttgcctagtttttaagaaaacatctttgaaaataaatacttgcaatttttcctactcctcccaacatgagtgtccaccacgagtcccctttcgccaaacacttcatgttcctctgagctgtgctgccccttcctttcctctgtacttctgcatccttagtgttttctcttgaatcctgtcttctccttcatggtctctggaggggacactgcagatgcttaatttgtgaggggaatcacacaaacatagtagaccctaaagaaacatcttagttggattttgaagtgggcctagactccgcgtgtttttttctcaacatctttctttcccttactcaaaatatcctgcagctggggacttctctcactggcgctgttggttgttttttggtttgtttgtgcctcatcagcttcctctacctcattttgtgatcattttgacctaagaccattgcccagtggcttctcatttccaagatctctacttgggtcctttttcacaagtctgtgcttgtctcataactcctagccttgttcatgactgaaatatttttttatctctctgtggacatgaaacctacatatacagtcctattctcctttccctgttagctctgatccctctgatttgagttgttctgtctgttgagcctcttttattttgtttctttatttgatgttcatggtggcgttctttgtgaaatgtttggtgattctggattgaacccatctctgtaacgctgaatgaccatttgtctgcttgttgcctgtccttgcattctgatggaggaagtgggcgggaggtgctgctgctggaatgtgtgctggtttcggtaaaaatggggaaggcgtggaatgtgctatggggcagtgctctggtcctggctgtggtgagtccttgatcctcccaatgtcacctgccttgagaactctgccctgcgaagcggattaagtctccttcctagccttaagccatgcactccatgtctttctgtttggtgtagagatttagcctttctgacttctcccactgcaatgagatgactaatgctgtgttgcttccaaccatctcgagactttcatccccctcttgacatgggcacttgccatggttggttctctctgcttgctatctttcagggattattcaagttcctattcttagtatgtttctcttcccttattttgtgtgggtttggctggggcagggagttcagaaaggaagagaagattttatttagcaagccacctaaaacaggaagttgccttcttcgctgagtctgagacatactgacttccagaacatcacgaaaccaataggatcacagcccagggcctgaatcctcttgtttgaaccttgttgtagatgcacaacctgtgcatttcaaacgtaggaagcagggtgcacagtgggtacttgctctatattgaatgaaattaagccaatgtttcccacaatgtgtgtgatagatattgtgaaaatgtgaagtagaggaggagtgagagggaattcagtgtgctggtggtatcaagcgtgcaaactctgtttaagaactcctttcacaaaagttttaagattatcctttctagcttaaaaaaccaatatagacagaaaagaaaccccactctggtgctttctcccttcttccattcctgccttgaccatcccttcttcctcatagcctagaagcagcctctgggcctccaccttcccttttggttgtcccctcaccctagtctaacacttgcctctttgtagagaggagcttgtcggacacatgggattcacgggccaggtggttcagcagcccaacaacctggatcctcctcaccctcctctcctcatggccagcccagctcagggccgcctctgagagtctggcctccacaaaggaagatgaaatgtagagacgcatttgctgcctccaagtaacagtgcttcaggtgtttacctttcctcaagtcatagaactagagagcagggcgaggccttagggactgtctgttgaccgattgacacattctttgtattttgaaatgaagaaactgaccctaaacccgtcaagtgactttcccagtaagtgtgtggtaccggctgaactcaagttcagatcctaggttagcagtcctataaattgagaaacagaacctcactactcaagccaagctgatgtctaccccaaaccaaacatccaagtatgcactggggtaggtgctttgtgaccagttcccatggactccacttgagagcccttcgaatcctcccccgccccacaccaccccccatcaccccctgccacgagctctgcatcagcctcagagcctggtttgtttcttcagggtatttatgtcaaggattcccaaatttgttattcagttctttccccactgattcccagctccattcctcagccacacaccaagctacacagtgcctcatggactcccctcctgcaatgggttctctggagtccctcctgcagccttttgagggaggtgcctatttcttccagattagagaccctcctgtcctctagatacctgtagctctccaggatcccccagcttcctctagacaagctcatatctcaagcagtgtgcatccaggaggggattcttccctccacatgagacataggccccaggttgagtggcagaactgcctcttcaggccaaaacccaggcgtgctgcctcaacacgaagaccacactttggcattatacgtcttcccaaagttacaatacatccaccccctgggcttcgttctagattctttcaacacttaagtgtcttattacaagtctctttcctgtttagggaacgggcaatgaaattgtgtaggcaaggggtgctccgtttacctggtgcattcgaggctgaagacaaggagacattatcctccaaaatacttttttttaaagcaagtctgccctagagtaaagtcttcctaaattttgattgttactgcgctatgaacagaggttgtatccacatttaatggaacatagcagtgagagaaactggaatattggaactgctgtcctccgctgatgaaaggaggttgtaaataacattttgctgttggtaaacacgcacaataaatacagaaatatggagccatgcaaaaaactttcgactctgtcacatgttattggtggaaaccactcatagaaaatcaaacacagactttgacttgcagtcacagaaatagtatactacctggagtttctttaggatttgcaatctctgtgcggttgcaggctctgcttgtgttatcttttcatgagggtctagacctgagtttgcagaatgattcagaaatcagtgtatttcctgcttcatatagtgtgattaatcttttttgattttacatgtctacaaatggtgttagtggtcataactgcaaatgattgtgatttttattggtctagaatgtgaatgtttgtgttagagcatctgcaaaagcaaacacttttgctatgttgaaaaaataatgaagatctaagtgattttaagatggcattttgtgaatgcatgctaaaatgctgctagatttttatttgttttactgttaatgctgcattgaagatatagtagtgctgcagcacaatttttttctatttcttcttttcctttgtccttcaaaaaatacccattctagttgcaatttttgttcaaaaatcaagatagtcacacactaagataagttcactatctaagaagtaaagaaatgtaaaagtaaagcatctcatagcagttatcagctgttttgtgtcatacataaataacattttgcttagcattggcatattttttgtgtacgttctaatagaatggccaataaatcaaagtcatctaaatgtctttatcaacaccttaggtattacactcactgatgtttagcatctttcatattgcaattataaaggtccctcaaaccctggctgataaattattttaggtttcttgtgaagaagggttgtgtttaactattaattttcataccagcttatacctaatagagtgtgtggctaatgaatgtgttaaattaaattgagttagattgaatcaaattgaattgaacagaaataaattgaattgtattgaatgataaaccggagagggataatgcatggtgatctaatagcatctgataataacagaacactgaatttacacgcctaacttaggagatatttgataactcatgagtgggaaaattgcccttctcctatgttcctgggcatccttgccaagtggagatgaatgtcacaggagacctcaggcagttatacagttcaagcatcttctgtatttgtgtggcaggaaattgtgccagaagggtcacaaacctgctttattattctgtatgtcaccaagcaggagctccattttttaaagatttttttaaaaattttcttttgttcagcagcagctggctgtgtgtgggcacttaggaacaagtgatgtgagtgcgtgtgtgtgtgtggatcagatagggggtatcatttgctagttttaattggtagattcaacatcttccactaaccatgcagaagccactggctgaggagttaccatggtaaatcaaactccgctgtgtgattggtagacttctgaagcaggtacagtcactctaatcaactccaggaaagttgaggccatctggttttgcctcacttggaagtaatttaccaccccaggtgcaaaaaatttaccctgaggtcagtaacagtaaacctgcctcaaagatgttccagctgagtatggaagaggagtggtgtgacatagtaatttctgtttgtttttatattttcaagcttgggaaagtgagggggctaatcatgcaagccagagccaagaatagatttggcaggtgctgacccagctagtttcagacagcaaagtgaaaactcctgaagctcattctacagcacttctttaatggtccagttcagaatgtctaactaattgagattttataaaaggaactttgactaagcatcaagttgctgaagaatatgatggaagagataggcttttttttttttatttgagtagtaaggagtgaaattgggaatatttgcaaggaagggaatctttcaacaagacttcactctaaaaaaaataaaagtatgttgggccacaaacattatgcatagctatttaggattgtagatattcttgtaatcagacaggatgtagccagccctaaccaaaatatacacagtgagaagacttcagaatcattagctctttggaatagttagaggaatgtgttcggctcatatgacattgatttgttttggctgcacttgaaatgtgtggtctttgcaagtcaatagaaatgaagtcctttattgaatagtagaaactccatggagtaaattatacaaagaaatggaaggccagggttctcagtctcttgtttatttgtgggagtggataccaggcaggatgggtggggctttcgaaaggaaagctcaggggcttgggagaaaggtcagtgttttagactttttgggctcctagagcaaaataccatagactgggtaggttaaaacaacagacatctctttttcacagctctggaagctatgaagttcaagatcaatgtctcatcaggttctgtgtctggtgagggccctcctcttggtttgcagatggctgtcttctcctgtgtcctcatgtggtagaaggggcaaggggactctcctctcccttttgggagcctctgggaagtctctactctccttacctaattacctccgaaatgctcctcctccaaatacccttgcattggagattaaatttcaatgcatgaatttggggacacaaacatttagcctatggcagtaggaatagcaaagtcagattaacggacagccatggagaaggtcattttggaagctggattcttccagaagtgtgataatcccacaaagctggaaatgggaaggccctgaaaaatcagctggtgtgacttctccgtctattaatgagagggtggaaggccagagggcaatatagataaggaataatcaaaatagtggtggattccaattttacagtaccctgttcagagatgcactgagccagcagagcctgaaaagctactggaatcgtgtgtctccccaccctccggtgccctaattgtgcagttatttcagacttagacttcaatcattttacaagtttaatactgatgtggaaggactgaggtggaattgctctttgtccagattctctttgttctttggctcaagagcagtaaggaatggacagacgtgtccttctttcccctgcctggagagggaacacaattaggaatcctggtatgtgagtctgtctccacttcatctcctctacaaaaagaggcagacatagcacttgtgataagccagctcctctcaccatcttcaccctctctaagcttttagtcaactctccagagagtcagaatctgttaaaacacacttaacatgacccacaaagcaacacaaagttaaggagcagggtgctgtgtactttagcacgtgggcaccacaccattccctctaaaagctaactcaacaagggaaagtgaggagggacatcatgttggaaaagcagtgtgaggaagagaggaggaggcagaaaagcacaagaaggggagatgagagagaaagaaaggaggagagaaaggaagaaaggtaagagtgagtcttttgtgggttgcacactctctttaagaatctgataaaaattctttctttctctggaaaacaaaatgcataggatcacatattgcaaataatttggggttcagaagcccatatatagacttgggtaaggagatctaatctatctatctacctatctatctatcctaacaactgcaatttagcaaagttacatatatatatgtgtatttgtgtgtcagtgtgtatataattgtgaaattgccattaagttaggtacatgttacatgcattgaaatatggaatatatgtcaaacccaatctctcattatccaaaaggtacaagagtgaataatgggaaagaattgagcaaagacacattcaaggtgactgtcagcaatgaagagttaatagtgaggcctcctacaatgtagtgacttctttaagggaagggatttgaagccatgggatttcggatgatttaaaatgagcctcactaaagccctggatcacacagtgcaggaaacaaacctgaaaatagccagagtagcaggcagagaagactaactgatctctactctttgaaccccatggttccagtccatttaattgttcttcaggctaacaacttcactttccataggggaggcagtgtaagtgaccatggcctggggttatgggtcagaacatcatacctcattattttaaatgaataaacatttcaaacaaccactgcatttcattggttttccagaacatgattcattttacccgtgtttcctcatttctgtttaaaaatccagcgcaatattatggatttattgtcacactgacaaggatgtgtgtgtatgttaagattcaaagatcacatttgcctctgctctcacaggaagaggttaggggaatggcacattccactggtttgtctgtgcacaggagtgcagggcatgtgactcttggggaaactcctacagctggctgtccggatcaccaggaatcatgaaagcaggctttgtaaacattgcatgcattcccagacattgaacattgtgacatttcatgaccagctctctcagaagagatgccaagtgtagatgtcctttctggaacatccgtgcataattaggctgcccccaactcctcaccacatacatgcaacattttcctgctgttgagtaatcatttgtgcttggctagttttctgtctcctcaaacatcatctcagggcaaaaaggcacagcgtgtagaatatgcttcttatagcagagttaaccagggcttcctcatctcattactagaatctcctgcaccagattccacactgtctctcttctcacttcatatcttgttcatatgattgttcatatctttctaccactagataatgatgtttagaagacagatctaggttacagtatctcgtattttataattattctatgaattaaaactcataaagttagaaacccttgacatgccattcaagaatttaaattctgattggaacctaacttttctagcctggtagtggaaaaatgaaagatgataaatcatgggttctaatcctgacttttcctacttgcttactttctgttactgggtacttggttaagtttaaagaactgtgtaggcatgtgacatacattagttcatcgtaacaattgggtgaagcaggtgctcttatctttattgcttacattaaactcagaaaggtacagaaacttatctgtgagcacgtggacttgcttcatttgaattcacatccgtctgatgccaatagccatgctatacagcctttctttgtgtatgcctgtgcatccttggtaagtctttattttttttccaatgtaaattggggttgtggggagtgtagactagaccagttgtattcaatatttttagttctccatgtctcccatgaagcacaatttgaaaatcactagaatacctctaacatgatgcctactctaacattctaattttatctctttgtcattatcatcccccttccaacccttttcagcaccatgaatttcatgttcctccatttgaacagtgtcttcttctcagaatgtgctggtcatttctgtgcctctacttcttccaaatgctctgctctctgtgaatctttctcagtctcctccacctgaggaactgttccaaggcttttgcattttgcttacgtctttattgttgtcagccatccctgtattagagctagctggatattcatctggacccttctataggttgattcataaatttttatgatggagactgatgactttctcattttagttttctgtaggatctgtgttagtttcccatgcttgctgtaacaaattaccacaaactgggtgacttaaaacaaccagaagtgtattctctcacagttctggagcccagaagtccaaactcaacttcactggccccacatcaagacattggcagagccgcaggagcgtaggggataatctatttctcatctcttctttcttccagtggcttccggtattctttggattgatacattatctcattcttcaaggccaacattttcaaatttctctctgatgcatattcacattgctttctcttctatatatgttcaaatttgcttctttcttgctctgttatgaattaattgcattgcatttaggacccactcagatactccagaataatcttcccatctatggatccttaacttaattgcatctgtaaattacccccaccccaacctcctccaccaaacacacaccatataagctcatgtccacagattccagggattaggatgtgcatggcttttgtgaaacattttttttttcttttgagacagggtcttgctctgtctcccaggcaggagtgcagtggcacagtaacagctcactgcagccttgacctcctaggctcaagagatcctcctacctcggcctcttaagtagctggaaccataggcatgtgccaccacactcagctaatttggctaatttttgtattttatagggtttcaccatgttgctcatgctggtcttaagctcctgagctcaagcagtctgcctgttcccaaagtgctgggatgaccaggcatgagccactgtacccaaccagcttttgtggaatattttttagcctctcacagtgtgcccaacctttggcttccaaagattcttgtctgtcccacatgcaaaatacattttccccataccaacatactgccaaatttcagcctgttacagcatcaactcacatccaaaatcttacctaagtgtcatcagccccaaaagtcccaaactcagcatctagatcaggtatgggtggtactatggatatgatccaccccaaggtaaagtttctgttcacttgttgacctgtgaaactagaagacgggttatctgcttctaaaatttaatggcagaataagcatagaataacagttgtaggcactcctattccaaaggggagaaaatggaaggaagaaaaggttacccagacccaggcaccttccaaatccagtagggcaaattccattacatgcaaggcctgggaataatcccctgaggctaatttcactgccctctgggcccatagctctgccttctggccttgcaattctgggctctggttccaaagctcagccctcacagtcatctttccttttttcatgaagggtagcacatgtttgcaactttgtagttttatgagcttattttctttctatggaattttgggagtctagcaaccttctttcatttagtcatgtccttgatcctttcagtctaagctggacatgtttctactgatgtaatattctcaaaaacctggtgattctcctgtatgtgtcatagggattcatattattagacaaaagggtcctccacagaatttcttagataatctcatctttctttctgacctatgctgatatccattcatatccaagggtcacatacccattcccttcagttctagcaacagggtgttcagtcatatacttggcgttctctccagaggacattttgttaacagtggatcttctaattttagcatattttgcaatttaaacaagctgttaatttctaaatcaagggtctttttttgcgtaacacttctttcctcaattaatctatttttgctcacattttactataagcagaaagaagaaaccaggctgcaccttgagtactttgcttggaagtctcatcagctaaatgtccacattaatggcttaaaagttttgctttacactaactgtaaaacaattcagctaagtttctgcttctgtataacaaaaattgcctttcttctagtttccaacaacatgcttctaatttttttctgagacctcaccagaagggcttctatggattcgctggtaaagacaatctgggctttttctatcatgcacttacaagttctttgagcctctactcattgtccaattccaaagccagctgcacatttttaaagtgtatttcttctagcaataactcacttccttgtagcaaaatctgcatcagtcagggttaaaccagagacacagaactagtaagagacatcaaaaggggtgcattgcagggagttggctcacatgatgatgggtgctggctaggcaagtctgaaatctgtaaagcaggccatcaggaatggcagctggagctttctggcacaggctgaagctgctgtccacaagtgggatttctttccagaaacctcagttctgcctgtagggcctttcagctgattgggtgagacccacccagattatccaggatcatctcttttatttaaaaccaattttatttttgaatgttaatctcatctacaaaaatggcttcacagcaatgacgagattagtatttgattgactaactgggcattgcagcctagccaagttaacatgtcaaactgaccatcacaggttagtaaacacgtcacacagccaagttaacacaacaaactgacgatcacaggttagtttacacgtcacacagccaaaacacgtcaaactgaccatcacaggttagttaacacgtcacacagccaagttaacacgtcaaactgaccatcacaggttagttaacacgtcactcagccaagttaacacgtcacactgaccatcacagattagttaacacgtcactcagccaagttaacacgtcacactgaccatcacaggttagttaacacgtcacacagccaagttaacacgtcacactgaccatcacaggttagttaacacgtcactcagccaagttaacacgtcaaactgactgtcaccggttagttaacacgtcacacagccaagttaacacgtcaaactgaccgtcacaggttagttaacatgtcacacagccaagttaacacgtcacactgaccgtcacaggttagttaacacgtcacccagccaagttaacacgtcaaactgaccgtcacaggttagttaacacgtcacacagacaagttaacacatcacactgaccgtcacaggttagttaacaggtcacccagccaagttaacacgtcacactgaccatcacaggttagttaacacgtcacacagccaggttaacacgtcacactgaccatcacaggttagttaacacgtcacacagccaagttaacacgtcaaactgacgatcacaggttagttaacacgtcacacagccaaaacacatcaaactgaccatcacaggttagctaacacgtcacacagccaagttaacacgtcacactgaccgtcacaggttagtttacacgtcacacagccaaaacacgtcaaactgaccatcacaggttagttaacatgtcacacagccaagttaacacgtcaaactgacgatcacaggttagttaacacgtcacacagccaagtaagttaacacgtcaaactgaccgtcacaggttagttaacacgtcacacagccaagttaacacgtcacacagccaagttaacacgtcaaactgaccgtcacaggttagttaacacgtcacacagccaagttaacacgtcaaactgaccgtcacaggttagttaacacgtcacacagccaagttaacacgtcaaactgaccatcacaggttagttaacacgtcacacagccaaaacacgtcaaactgaccatcacaggttagttaacgtgtcacacagccaagttaacacgtcaaactgacgatcacaggttagtttacacgtcacacagccaaaacacgtcaaactgaccatcacaggttagttaacacgtcacacagccaagtaagttaacacgtcaaactgaccgtcacaggttagttaacacgtcacacagccaagttaacacatcacacagccaagttaacacgtcaaactgaccgtcacaggttagttaacacgtcacacagccaagttaacacgtcaaactgaccgtcacagtttagttaacacgtcacacagccaagttaacacgtcaaactgaccatcacaggttagttaacacatcacacagccaaaacacgtcaaactgaccaccacaggttagttaacacgtcacacagccaagttaacacgtcaaactgaccatcacaggttagttaacacgtcacacagccaagttaacacgtcaaactgaccgtcacaggttagttaacacgtcactcacccaggttaacacgtcacactgaccgtcacaggttagttaacacgtcacacagccaagttaacacgtcacactgaccatcacaggttagttaacacgtcactcagccaagttaacacgtcacactgaccgtcacaggttagttaacacgtcacacagccaagttaacacgtcaaactgaccgtcacaggttagttaacacgtcacacagccaagttaacacgtcacactgaccatcacaggttggttaacacgtcactcagccaagttaacacgtcacactgaccgtcacaggttagttaacacgtcacacagccaggttagcacgtcacactgagaatcacaggttagttaacacgtcacacagtcaagttaacacgtcaaactgaccatcacaggttagttaacacgtcacacagccaagttaacacgtcacactgaccatcacaggttagttaacacgtcactcagccaagttaacacgtcacactgaccatcacaggttagttaacacgtcacacagccaagttaacacgtcacactgaccatcacaggttagttaacacgtcactcagccaagttaacacgtcacactgaccatcacaggttagttaacacgtcacacagccaagttaacacgtcacactgaccaccaccgtgcttgcctgtattaagcccttgatgcctgtgtatctgttaaaatgaaagactgtgatagtagaatgttcccttcctatcagtgaggagatcatttgattcaaatgtgggaaaaattaaagatcatgaaaatacattagccatgattataatgggagtgtggggaagggcatggtaaatatttagaataagctaaacttctaatgaaatgagatctcctcagctggggctggtggacccagatgagcttcagtgggtcatgaacctcccagaattatatggggtgtgcgtttttgtgtgaaagagagaaagaacattttttttttctggaattagagttcatagcttttatcagattcacacaaaaaagtgcgttgtattataaatgtaactacctcatatatatggtaaccaggtcatccatcagtagcaataggcctgtattaggagtccttgacggtggatctaataaaatcttctgtgctcgtaactcacacctacctggatattctagaatcagctcttggagaactcagaggtaatacagatagtggttcttatagggattggctagggcaaaattaggagatgcttgttgtaccaaagtctactggtatgtttcctactaataaatcatgcctgatgcccccaagtcaatgactcgatagaggaagtgagtgatgaggcaggcagcataactctgtgaatgagccaaccccagcccttcccctgacttaaaaaggggttaatgaacacagatggctgcaaaccccccaagcagccagcatactgtaaaacaatattaacatcattgccttttgaataccatgtcttgtaaaccccaggatatgacaagcctctttagaatcttctttgattgtgttactcagactcccgtagggaagtagggaggggtaggggtagataccagaggaaatgtgtaattaggagtctcttagaacaataagggttctcaaacacatatgtgtgcaactgatttgttgcttttggtatttctgttggtgagtaattaactaaccatgttttgggggcagtctgtgcaagcttgggcaatctgatagttgtgaaccatggggaaagaatagttgcctttagctatattttcagaaaaatactaagtggagatgtgaatggaaaggaaagaacagactttctggagagatgccattatggtaatgtcagaacttcctttcagtctcagataaatctttcttgttatcacccttatttttagttttactcaagacaggaggcccagttcagttggagagtgccgtgtacacagatatccctgccacctccccgggagagaggcacaggggcctctgcgggactctggccccttattttacggttgtgattcctcctcactgtggtgcctgtgtgtggggtttcagggagaggggccttttgatttgactgctgagaggaataggggttttctcctgggaactcttctgagagaataagcttttgacaaacactctttgaaagttactctatggccagatgcgtgcagatccaaagatggtgtcatttgtgaaaaatgaggctggcttatgagctgggtccatttgcacacagcctgcagccacggagtccctcagcttggagatgtgctagctccttctgtcctgtgggctgctggggctttgtgtcactggcatcagaaaacagaatttggcagttctctaggctaagggtttccaaactaagtgtcctctgtattaacaacgaggagccaaaatggggacttttctatttgtgaaggggatccagtgaaaataaactgttttattttggtgactttgagtataggaattgtcttctctggacctcagtttatccaactagaaaaatgggagcagaggtgcctagttatctttaggaatgttctgtgacttaatgaagcaatatttatgtaatgatttggtggtgtaaatgtccccagcagtgcatgatgttagttgtatgtttgcaaagtacctagctcccctggtaaaggtaacctttgtaaatggcaagctatgagtattgttaaaaggacatatggctccaccttctttccaaaaaagatcactgaggaatatagggccagttaaatagcatagaaagaggttcagagtgtcttgacctggagcagtttttaaaacctcaggccaaaactccactaggaaactcaccaaactaaccattatggtcaatttcattttgaaataaagcaccctaattcatctgtccaggagtccaggttcctgtgtggcccaaggttgcattcggaggtcagagtaaatcctgtcgctaaagagccactccttctagaaatagctttttttaatgtctgcaatttctcaattcagttctttgactctttagttctatcccatttctggccacaaacctgtttggggtttgctccaccataagtcaacacatgcacatgctttcccatcagttcccagaatgcagaggacactgtaggtctgctaaggggcttctttcagaacttctggggttaacgtggttggaatgtgtgctaacaggctgctctcacagtggcagttctaattggctgaggatgagtcttgaaatgtcacagaaagatttatctctcagcacagattctccctcaactaatttttcagtaggccaccagataatgggttgtttggaaaacaatatgcagttctcagatgcctttctgtgttggaatgaacttggtaggctatttgaagcaaaatggctgatggcaaggaaactcttgactgacttacaggccattggacactgggaacaccaggccttgcttgtgagggatttggctgagtcagtttctcagggtccatcaccattcttgtggggactcagcacacaggtgggtggggaaacctgcctcagaagtttggcttataaagaaatatggggattgatatctggatccttttatatcagcagcaaggattaattttagagaagatatttcataaaaaaatggattcttccctactctcagtttctcaggaaaaatatatttgcttgatttgaaggtaccattgacagttagctgcttgttgatttaataacagctttttttttttaggattaagagaaatagaaaaatgggcaccatgttcaacatacatacagattagaagataaatttctatttcagaaacattgcaacactgttcgcaacaaccaagatatggaaacactaaatgtccactgctggataaatggataaagaaaatgtggaatttacatacagtggagaaatttgttaaagaatagaaacttacagctacacagtatggataagttctggtgttgtataccactgtaggatgactataaaaataatacagtatgtagtttcagatagttagaaggaggatattgaatgttcctaatgcaaagaaatgataaatgcttgagatgatagatatatgaattaccctaatctgatcaccataagttgtatgtattgaaaaatcactatgttccctataaacatgtacaattattaagtgtcaattttttaagagtatataaagatgcatacagggaatgctgcaatatgtgacatcatggatggaccttgaggacattatgctgaatgaaataaaccagtcagaaaggacaagtactccatgattccactgatgtgagatatctaaaataagcaaattcatagaatcaaagagtggaatgatggtcaccaggggctggaatgagaggggaatgagcatggagtttcagttacgcaagatgtgtaagttctggaagtctcctgtacaacattgtacctctggttaccgtattatacactgaaaatttggttaagagggtagagctcatggtaagtgttcttgctgctataaaataaaattttaatcaatacatattaaaatgtgaaaacatattttgtaaaactaaggtgcaacaatatttttggtgactcaccattaaaagtcctacatacatttgctctagaatcctattccaagatgggattccaagttgattttgcatttctaaggttagcaaacattttgtcttttattggttgttttatacatatgtatacctatgtagcaagaaaatttctgatgatctcaggttcatacacagctcttgtcatttccaaacagctctggatttttcgagctattattagcctggagagtatagataattgcagtctacacagaaatctaaaaataaactgtttattcatttttctaaagaattcttttagcacatagcctcttcccagaaaggtttacaagtgcttagattaaaggataattcttttctctccctaccattccactctaaatttctgaagaaaatgtgaaacagcctaaaggcagaaaaggaagtacagtaaaggtcttaatctgtctctcagaattattgaaaattggctgaaaatctaattcttcttatgcaataggtaacctttttattggtggcatttacctgaactaaggtaaatgtcgacagcattggtgggtatgtaatcaatagcatactttcatcatttattttttttaaacaacagatacaatagtattgattactccatacatttcatgctaaatagctgtattaatctgacttaatgagtatgtgttgttgaaatagctgtcttccaactgtaacctgtttttagcaagaatcctgcttgccaaatacttctttttttaatctatagcttctacttgattcttgtgaaccaggggtcagcaaactttttctgtcaagggacaattagtaaatattgtagactctgtggactacactattactgctgcaacaactcaactcagccatgcaatagaataagcatggcatcccaataaaaattcacttaccagatctgcaggtggttgggacttggaccatgggctgcattagctgatccccattgtgttccaaggttggagaaagaaagcaaaatcaacatcatgatttgttgaggccaactatggagaaggcatggtttaacagtgtagtggacaagctgggcaagtttcctgcttttctggagctaacattctcttggagagtggggaaatttgaaaatcaaatctaataagtcagcaaaataatttcagttgacaataagttctatgggaagaaaagatgatttggtaaagaacgacttaagacttaagaggacataatttgtagggggtaatatgggagtttgaacatgcatccatgtttttgagtcccacaccaacatttttctaaggaatctctcaacctcattttttctatttataaaataattaatatcaatacttattgcatagggctacattgaagatcagataagctttatgaagggtcttctgtaaaacagcaaagccaattacaaatttattatatcttatcaatattggtcttgtcatcatttttattacccatctctttattgtgtctcatgttttctttgaagtctttttttccaaaacataacagaatctttaaacgggattgtgtgaactgcaattctttcccttcatattccctagaagaggatttctctaagtcactgacaagttgaaactgctttcttcacattaagctgacttgagaaatcagtgtttaatattcacactttaccttaccctactagaatatcagtcattgccgccagccaaccctatggacttgttggtgacacatgcgaaggcacagggtgagctggtccacaccttcagatgaagagtgtgaaaagacttacaatttggtcttgcatattggaagccttagaaagacatctgttgataacagtgatgagtgacaaacttagataattaaaccttcttgtcttcaagtctttacttgatttaaaatgatgactgaaatgtctactactgtgtttccacttactggaggaagatctcaataaaagtttgggccttgtaagaaattcatgcctacagaatggaaagggcaagagggaaaataccagcagctgtcttttgctgagcccttagaagccaggaactgggaagtgtgttggattcaacttttcttcaacccccactatctaacccccatcacaaccttcaaaggagtaaaattctccttttccacaagaggaagtggagactcagagagactaagtgtcttctcaaagctgtctgactgataaggggcagaggcaaaattcaagcccagacctgcctgatccatagccaatggtgtgtttaccagacagtggtctcaaaatgtttttgattgcttatagccaacaatagaagaacaaagcatgaaaaatcaaacaagcaacaagaacaaactttattttttggtagagaaaggatctccctttgttgcccatgctggtctcaaactccttgcctcaagcaatcctcttgcctcagcctctggaagggctgggattacagttttgaactcccacacctatccaacaaaaaacttttgagtatcactcataatatacgtatatttattggcaagttaaatccttataccattatactaatgtgtattgaacaaataatcaaacacttgaaaaatagaaatgtataaaaggatgcactacaaataaatatacatggaaaaactcatattttcttgccccacacgaggggatcatcacttgcttctcagtgtctactttgaacaccatgacactaaaccaaatggacacatcaggtctaacaatgtttgttctccccagtaaagtcagtttaatctctgtttagccttgcctacataggcttagtttctcaaggattccaaatgaggactgcttggcctggtgaggctagtgcaagctgctggaactgacacactcacggatgtgcggcttcgaacctcagcaaattggtagcacagggttagcatattgcctagagtcgggcttagtttccctcggtgtggctcaggctgctacagcacacttagcactggggtacctgggtgagtgccaccggtgacgctagcagtaggctctggccatttcagaaaatgaactgcttcttccagcacacaaatatcttgctaattagcaattagccgttaagggagaagaaatggaggggaactgggagtctgaaataatctcctaagagacatgaaagaaagcagcacttaaagtaagccagatagaaactgggagctgcttcatttgggcaagatgtctctagacatttttctaaacgttttacattcagcagaggaccccagtgcattctgccaagtgcttttccctttaatttttagatgcattcaaatttcaaggggaatttaatccgtatgtttctggttcttttacacttaactcatcaaaatgttgttctttaagagccgttggatctgtaaggcttatgagcctttgttataagccttttcaaaacctctttcccctttttgaatcagcaaatggaattttgccaattctgaatgggatttcaataaggagaagtccaactttaggattaaatgcagaacctcaagagcatccgacctgattttgcagagatgcacacttgacccttgcatcctaggaggaccgacagcatcatggggtcgacccagtggctggagcaatgcttggtgagcgcgagcccacggaagacaagcaatgtggttcagggcctgtgcttctgttacagaaccagcaaaccttagacttagacattctctagcccatcctcccacccaatgagatttgtgacacataataatgaaaataatgatactaatcagtagccgacactcatggaggccacctatatttccagctgcttttctacactctttgtatgcaacatccatctctcataatccttatcagaatggtgtgaggtagatgtggagttagtaaaacttagtggacacaagtttaagatttagaatcaggcaacctgggtttgaatcctagcatcaacacctataaactctagcgcccgaagaaagttctttaatgcttgccaaagggtgctttcatttccagttgctcctgttaccatcgttgttaaggatgatgttgatgctatccttgttccagtgatggaaaaagtccctatctcctggtgcagccatttttattggtaacttggagttttccatattttctctttatgtgtcaaaatctcctgttttacaaagtatgcccattttttctaaaatagagttaggctaactcctcttttgcatggcagaccttcacattcttgatgacaattgtgaacgtaacctggttgcatgttcctgacactaaaagtgtacacaatgttctggatggggtctgtccagtatgaagtaggaccttgctctcttttgttttgtattttatactattaatatgattgcataatccattaacttttgggaagccacatcacacctttttgttcatctggagttaatatcacctaatataagttttcctttgcttgaactgttcatagggcagtgttccatctcttgtaattctgtagttgattttttaaatttcgaaatatgacattttctcatgggctctaatttaataaaaaacaaatatggatttggtggagaaaaatatacatggtacagggttttgatgttaagtgtgggtatgataaatgtgaagagtttctgcattccagttcctatattaaattcatagcccccaaattttaaactttcagagcctcatcctgaagagtcattatgaaactcaggtaagttttatcatgaaagaatgctgaaaaaaaaaatcaatgccccctggccctcccattgagtaagcaactgaaagtgagcttacagcctgtgtaggacatcttttaatttgccaagtgactaaatgtgcagtcactgcagcaggcatccaccagctgtgcccacatggcccactcagctgggctgcttttcaaagagcagacagggcttatcttagtaccaaaactccatgccaaaaagatcatcactgggtttgagcatttgcacaaaatccccagcagccacgggtagacagctttgcttgacaaaggcagcttcattctccagactaatgggcaactttggctactactgggcaccatgataaaatggctgggcatagagactgtcagccctactggtgattctagccatttggccatttaccttttacctacatttcatctctgtattcccttgggctctgggaagccctttaagcttcaatgacctgttctgtatgagtgctggacagtccctgcaggttcttacttaacctgagagcttgttaaatgcatctccatggaatatcttctattgttaatagttgctggtttggattttaatctaaaaaaaactgtgaaatgtgcttgtttcatatgatgcttttctgagaggttgcatggagatctaatagttgggtagctgatggcaagtgggaatgaaggtaattgattaagcagcagcacctgtgttcctgatatgtacccagtccagtgctagatacagtaaaaatgtaaaagtttagggcaaggtcccatcctctacccagttttgaggactacataacatagttgaagggagaagtttcatgtaaaggaagtaagataagtatataaaagaataagcacatagatgctaagggatttggcacaggctgtaaatgctgtagtccctcaaatgaggaagagttcactgtcactgagaatatcctggaaggtaagacttcatctgggccttggagctgcataggaattagactggtgcaggaaatggtgagacttggaaatgagaatggataattagaaatttgtcatgtggaaatcaaacacacatgcatacctatgtatacatattacactacagaaacaataacccaatactacttcattttcctttaattccctaataactaaacagtacctgattgtgggttccagtagtgatgtacattgacatcttgtagtaagaccttttttcctatcctaagaggatggacaatacatcttcaaaagccagagtggttggccaggcacggtggctcgcgcctgtaatcccagcactttgggaggctgaggtgggtggatcacaaggtcaggagatcgagaccatcctggctaacacggtgaaaccccgtctctactaaaaatacaaaaaattagccggacgtggtggcgggcacctgtagtcccagctacttgggaggccgaggcaggagaatggcgtgaacccgggaggtggagcttgcagtgagccgagattgcactccagcctgggcgatagagcgagactccatctaaaaaaaaaaaaaaaagatagaagccagactggctctttaaatctactaacacttgtatgaagtaatagctttcaaagtagtatgtgaaccagctacttggagggttgtggcaggaggatcacttgagcctaggagttcaaatctagcctgggcaatatagcaagactaaatatatatatacatatattcacgccacacacacacacatattcatatatatatatttatatatatatatatagtgattaaaataatgcaattgctggcacagagaatatgaaaagcaactatattatgagaggacttcaaaaattcatggaaaaatggaattaaaagataaaaaaaaaaacccttcatttctcaaaaaaagcttcatcaaggttaaaacacttttgtaggtggtgatcctagccatttagtccatccctaaagaattgatggtcctgggaatgatgcagaattttcccccctttgttcagctaaatccagttcttgtttcatgaccaggaaaaattaggcacacggacacattgaaaggtgaggagggtggaatttattaagtgaaaggaaagctctcaacaaaaagagagatcctgcattcaggtttccccctcacaaattgaataccaagccaccattcatgagttgaagaggcaaggctcctcccagcataaggcatgaattcctggtggctccactccattcccccggtatgcatgcaggtccttagtcttctaaaaaatcaatgcgtactccatattgatttattttccttactgggcatgtgttaagggacagaattttccatcatgggcatgattaggcaagccccctctgcacaatgacttgggcaggtcagaggttctctggagactcctccctatttgcctaggcatttggctgtctcctccctctatgattcccccatgtaaagaagtacatataactgctgttagaataaggacaaggatgaagactgatcttaactgatcctgctgacagggggcactgtttggggaaaatggcagtcagaggcctaagggtccctggtaaaatggggccattgttcaaggctctggttgcatgaccgtttggagtttgatagcctgaagccaagaaaggacaaaccgggttattagaagacatgtaccaaaatgaaacaaaagcgagggtaaggacggctcaaaaattctgaggctgctggcaggctcagataaccggtggctatagttatttctgctaagatttgggtgcatggcccttggtttgtggttagctcccttggtcttgattttcccaaaaaagaaacctccaggttatgggcactctattactcccatcacctggcaggatttgcaggataattgcccagaactggaatattgattcagatttttatattacccatccctttttgtttcttctgagttgcagccagacatcactgtttacttcagaggaatgagcaggattagtttaaaatgtagatgaaaaacttaatgaatgagtctagaatttaatgacaaatctatgattagctttgaaacagaatttctctctccagtccttatttttgttaaaaacaaatagtgataggactgagttgtttgcaaaataaactttagttttatacttggcctgattatttgcataaagtgcagcaagaataattatttttacataggcttttaaaattggctttgagggaagtttgttccacaaggaatctcagataggactttttaaagctgagcctagccatgggtttctatcctcaaatatacctatgagttgggtgaattcctctcttcttgaagtcacaagaatatggagttcctgggcctgtgagaaagtgacattctttactcaccacaggtgaggaaccctgtaaggggactgtgtagacaaggtatgaggccaatatccccagggggcttttattggctctgcaagttgagcttgattccttaaatggaagcatacccttacagtcaaacccttagcaaaagaaccagtgtctccaattgcatcctcttgcaaaagaaaatggattcttattgcactgatgcaaataaccatattgccataagataagaatactcacagatagttttcaaactctagaggatccaggcagagagaaacaaatgtgctccaaattttttcacaggagtctaccttactcaattattaaagactttaaatagttcaaaataaaagtgcccttgactcagaaaaaaaaaattagcaatattttaagcaaaagttaaaaaaaaagattacttcagttttctattacttcagtctattcagataactcttgttctgcttgatattcgtgaaattttcagctcttcataagtcctgtatgtttttcctttattccgatgtcacaattttcaaaattatcagaaaactgcatttgacagcacctgtcaaattcatgtagctgattataaaccatcttttgaaggggataaaaacaagacaacaattgtctatgaataagaatatgtacagggtcgctacaatcaaaaacatgattgacaaagaaatttggttatctttgtggtttataatacttaacacccttaattatgattgatagcatatactcagacattaggattttagaaatctcatacaattttgtgacatatactaatattatttactaaaatataacctgaagaagattaaacacattttgttaattctatgtacctaaacatgtcagataatcctgttcatctctcatctggatgcctcagggaccctccatggcatccaaaagagagagttcaagaaagacaaccttgaagctgaaatttgattttgggaagcctgttaaatatggtagaggtttaaaacacttgatgttgtgaactagaatttcagattaccataagttatttattttgccaaagtgataacttgaaaattattttagaaagacaaaaacctttactcattaagaggaaatacttagctttccaaaaaatgtctcctgtctttctttcttttccttggtagtctatgcatgaggcaaacaaaaatatttcattatcttttactattacatgaaaatcttgtaccagggagagaaagccaaattttacccttgcattagtttactattgatgtcaaccccaatttattaaatgaaaccttatagaaaattctatgcaatcttaaccagcttgaccatgagctgagattcttgtaaatcttttataaccctttacaaattttgctaatgagtggattagtgccttaagaaaacctttgtgcttttatttcaatgctcaatttacagagtttagtcaatgttcacacacagaattttgtttgcaagattaatttttagaaaccttctataacttgtttaaacctttgtctttatcttatctaatttaaagcaatattttatcccaaggcaaaaatgtacattttcatgccttcttataatcttttactaaagacacattttactgttcttatacaccttgcatgtaaatgtattttcagtggtctcaattacatgttataatggtacttcttagcaatttttaactttaacataaaatctggtagattgttttaattatgcagtaggtgccaataaagttttactccttcttgcatggtgaagggtgtggttaattccatatatccccaggccttaacaattgtgaagcaggcaagtggagcagttctcaacagctaaagaagcagtttataaccttaaaacatttagcaaacctagtatctgacccgtataatttagaccacctatttacattttaacaacatttgcattttaccagtaatctttaagactgtttttatttctcaaagattaaagtcacatgaactaaaaggcgttaaagcttttatttttccttcaaaagtatttcagttaagcacttatttttctttagaccaattaattagagctcttttttatagatatcatgcacatcacatatataactacacagacagaagaagattcagttgttacaagatatttcatttgcaaatctcctaattggattattggtctctgggtggtgccctttaagagcagggttaggaaagcatgctgtttgtaggccctgataaacagacacagctggaagacaaaacatattttgagagggatttatctgcctctattttctgggggttccaagaggaaagcagaggtctctttcaaaatggaatccacggtgccttttctgtttttcccaaggagtctcagagcatcagaagttatcttagggcctttcatacatgcattaagagtggcaagacaaggcagggcacggtggctcacgcctgtaatcccagcactttgggaggccgaggtgggtggatcacgaggtcaggagatcaagaccatcctggctaatatggtgaaaacccgtctctactaaaaatacaaaaaattagctgggcatggtggtgggcgcctgtagtcccagccacttgggaggctgaggcaggaaaatgacatgaacccaggaggcggagcttgcagtgagccgagatcatgccactgcactccagcttggatgacagagcaagactccatgtcaaaaaaaaaaaaaaaaaatagtggcaagacaaggtggagaaaggtaattcagtcgattgaggaaaaaaaaacttttctccagcaaaacaagatccaagaagagaaaaacataaaggccttttaaatatacctataacttggatacccccttttaattaagctgagtgctgtttaagaaagtccttttaagtcccttattacccgatgttagccacaccatgtgtccaatgtttctggcttttgaactttaccaaacgtgacctcacaggtgaaaccaacaagcctcaattaagacgctaaaagcacaccagattagctacagcttaagcccagtctcgtatattctttttcattaatcaaaactttacagtaaatataaacagtgatccttatcattccttttactggtttgcacagggagagaggggccaaaagtccaacaggtaaaaaatattttacccttttgtcagtgtgtcaggcttctgggttctcttcccctgagctcaattctaagccaaccagtgtcaggttttggaaattaacttttctcagtctggaggatgcatctgaggggagtgtcctatagtacagggacacagttacccatctgtaaagaggggacagaggagtaaaaaagaaggctttcttcttccaaaggagcctcagaggttcaggatgcattcaaaaggaaagcagactgaagatgaatggctgctcacctagaaagaggggagccctgcatccctggttcctttctcttcctagggaatacccaggatatgtgagggagaaaagaaaaaaacgtcctttttccttcttctgtccttatattcccaagtcccagtgaccttgatagggtgccacccatggttgtcagtgtggctttcacccatgctaaggggaggcctagagggtaggattatccacttttgcccacgtactgcctttccctctgctgtcagtagcctttgagtttcctagacctcatttatgccatggatactagcatgacctttatccatgaaacaggaggcttggcttaatcagcaagaattagtcatgctcacctacattgtgccttttaactactgttgtcatctccctctggatccctcatatccagttttctttcctaggggttgaacccaaggcttggaattgagtttgggacaaaggaactgcctcaaggaggtgcctggtctcatcaatcccccagtgacccacaccagactggctgctacctccttatcataagcccagtgctaaggtataactgtggaatagggtccttctcaaacaaggaaggggaaaagggtgtcctgtgaattgtggtcctggtctaataagatgcttttcaagaaagaaaaacctctcacataaaagttaactcccgacagggtggagcaaagggaaaaaaaaaagcttaagtgctgggccaagaagacctgggggaagaaccttttgttcctttgcaaatgggtttctccaacagggagagaaacttttgattgctgtcagatcaagttggattaattgaccaggggaagagaagactctgtggatgtggatgcatagtgggaaatgctggccagccggctgcacagggcccaggtccctgaggcccccttgggtccccggcattggctgtggctcattcccatcctgcatggccattggatgccacatagacatgcagtggacacagccatgcaccccagccaagagggaagtggggcagggagccaccactcacccgtatatcccacatgcacacctgtggccattgggatggtggtggaacacccccaatattgtaaaagaaaagataaatgctgttacagtaccaataaaaggaaggaaaataccatagaaaatacagggttggattgaggccaacattcccgacccctgagagtgagtggggtgggggacgtggggcagcttcccctgctctcagaaaaagtctgaggatgagaaagctcagaaatgaaagggaaagatatttttgggttcacattttacttacccttcctcatgtccccatactggccaccaaaatgatgcaggattttttctccttagttcagctgaatcccggttcttatctcacaaccaggaaaaattaggtacatggacacactgaaaggtgaggagggcagaatttttattaagtgaaaagaaagctgtcaacaaaaaaaggggtcctgcatgcaggtttccccctcacacactgaataccaggccaccacatacgagtggaagaagccacgttcttccccagcataaggcacacattcctggtggctctacccaattcctccagtgcgcatgtgggcccttggtctgagccagtccacattgatttatttcctttacagggcatgtgctaagggatagaatttttcaccatgggcatgtttaggcaagccccctatgcacaatgacttgtgtgggtcagaggttctctgaggacacttccctatttgcctaggcatttggctgtctcctgcctctatcaggaatttaactctgtcaatgcagtcttttttgcattattaactgaagaaaaatgggtcccctttaaagattttttttttttaagatttggaaacaaaaagaagccagaaacagccaaatcaagactgtaagaggaatgcctaatgatttcccattgaaactcttacaaaattgcccttgtttgatgagaggaatgagcaggagtgttgtagcagtagagaaagactttctggtgaagctttcccaggtgcttttctgctaaagttttgactttctcaaaacactctcatagtaagcagatgaaatcattgttttgtcctccagaaattcaacaagcagggtgctctgaggatcccaagaaactgttaccatgagccttgctcttgactggtgcactttggctttcactggagcacctccactttgtcttggtagccattgctttgattgtgccttgtttttggaatcatactggcaaagccttgtttcaattcttcaaaaaaatgcttcaggatcttgctcccacttgttcaaaacttccattgaaagctctgcttttgtctgtagcttatgtgggtgctagaggtttggcacccattgaggggaaagcttgctcaatattaatgttttaagtcagaatttggtaagctgaactaattgagaagactatggcatttgctattgtttctgctgttaatcatcagtctcttcaattaggacacaaaaaagatgaattttttcataacaaattgatgtgaatatcctgccctgggcttcgtcttcaacattgtctcctcttttcttaaattcagttattcatttgtaaactactgatttctttagggcattgttctcataaactttttgtaaagcgtcagtgatttcaccattttccacccaagcttcaacataaatttgatgtttgttcttgcttctattttaccagaatttgtgttgctctgttaaaggcttttttcaaaatgtcttattgttcttagtgcctcaaactagatcctgttcagaagttttataaccagttagtatgagtttattttgatgcaaaaaaattaaaattcaaggttttttttataataagtattttctatgatcattttaaatacttcttgtatttacacttcatggagcccttagtgtatgctaatcactcttccagatgctttgtatatattgtttcatgtcatcctcacaatatccttggagggtaggtattattatccccattcacagacaagaaaatgacttacagaaagattgagtaacttgcctaaggaaagacagttaaaaagtgacggaatgagactataaaccaggtattctgactctagcagaaggtgagcacttaaaccatgggctatatgtaggaaaataatctaaatctgcctggcaattaagcacttgcaagtcaccttcttataccttgtctccttggcccttcacaccttccctatggcagagagcgtgttaggcccacgaaaaagctgggacacagagaaagtttctcttaggttttataatctccctttctgctcagacctcctgtacccagggtatgagtcttccagtgccccaccctctcagtgttaccttcccatgcccagtaacttcatctgccctccgttttagggtgccatctatggttaccctctgaactttgtgatcgtgcccgctgtctctagctcttcagtcactgaatcagaaaatttagtgaaattcagtcactaaatccttcccagcttgagttatttctcttctttgacctcactggaacctaaagctccttgaatgccctacttttcctcaatcccttagctacaccctttcttcactttcttccccttcttccccatccagcctagatgtggcaatgcatggcttcatctatcactgtcagactcttcaacctccttaccccactgtcctcctatcacattctcctggaaaaactccactccagaaaaaattcacatcttaagagtttacacttgctgctgttggggaaaatcatatatttctatacagtggtgctttcacaaattcatgatctctcacctcacccagacctaccaaaaaaagtgacagtcctctgtccctgtttttctattcctcccattctctatagcggctatttccaattttctccattccacacaagcctttactgtgtctttcttactcaagaggattattggcatttttcctttggcaaactctttctaggtttcagctcaaaaattattttctcttctggacatggtgagaaaccctagcttataatcctagcactttcggaggttgaagtaggaagattgcttgagcctaggagctcgaaaccagcctgatcaacatggcaaaaccctgtccctactaaaaatacatacacacatacaaaaaaacaaattagctgggcatagtggcacatgactgtaatcccagctacttgggaggcttaggcaggagaatcatttgaaccagggaggtggaggttgcagtgagccaagatcgtgccaccacactccagactgggtgacagtgggactctgtctcaaaaaaaaataataaattaataaaataataaattatcttttcatagttgactatatttctcaattttaacacataccacatatttattttattgagacaaggtctcactctgtcacccaggctggagtgcagtgtggtgatcatggctcactgcagcctcgacctccctgcctcaagcaatcctcccacctcagcctcccgagtagctggggcaacagacctacaccacacacctgactattttttaaatttgcttgtatacttggtggtctgcttacattacccaggctgatcttgaactcctgggctcaagcagtcctcctgcctcagcctctcaaagttctgggattacagccgtgagccaccatgcccagtcccacgtgtttttattacctgtttaactttaccattatcagtaagtttcctgaggtcagacaacatgtattgtacctccagcaactacacattttagtagatgcccaataaatatttgttgagaaaacagatgaataaataaattaatgaatgaagaaaacataagtataccatcatacgagagctctcataactttttgccaccaaagctgtgagtcccgcttcccttccaccttcaatcctcttaaagaaaagctattccacccaaagctagatcttctagcaatgctatggactttgttcacacctatcttctcagtaacgccatttgataatttttcttgtctttcctatgccttcagtctctcactttctatttcccttcagcaatggaacgtgatcaaatctatttcatatttaaaatcattgatttcttgtccaaattctgttctgtctcttccctgtgatagccacaaagaattcctaggcattatttatacttgttgtcgcttctttttcattctgcatttagtccttcctcagagtgcctggcctctgtcctgccactccactgaaaatgggagatctcaccaagatgaccactggctctgctcttgttctttccaagggggaactttgcacttgacccacctgacctcctcaagtcactcagcacctatctccttgcttctgcaaaccttagttcccggattctctgggcctatctccctgtctttcatggtgttctttgggattctacttcctctgacagtaacagcagtattggtgtcccccaggcgttgcttgttgagtccatcatgctccaaggttccagtgccagctatatgctgatgactccctcatcgatggctccagcttagtctctcccaaccctcagtcattgttttcttgatgtttccatgtaaagatctacagacctctcaaattcagtgggcctaaactgacagtatgatcttttcctcaagctcagtttccatatagtagtggtcccttgccaagaggataaaaccagagaccttggtatcaccccaagtcctccattttgacttcccaaatctgtctgaaaactaaacatttctttccatccccatcactccttggataactcaagctgcctgatctctcattgggattattatggcaacccctaactggccttcccacctcaggctggccctgatccaattcattctccatgctgcagctagaaagagcctttgaaatggaaatatgattctatccttacactttttagaagtttccattggcattctcattatatttgggataaaatctcacctttatagcttggttttgggtgccctaagccttccatcatctgatgtcttacatgtttcatttctaccctcgaatcttcacctattcactctgtacctctccacatactcctgataacccacattcaactctggcaatacagactctttcctgtttctctccatgttctctcttgcatctagacctttgcacatgctgtttcctctgcctggtctgtattagacatgcatgctttctgagcccacaagggcatgaaacactagaaagagcacaagatttggaaccagagactcagcttagcagcttatttttcatctctctgtcattcattgttccatccaacagatattggactgagcagtcttctcttcctcccttcctccaaaacacactttgcctggtatctcctgcccatcttcatgctgcactttagacatcaaccacccagaatagctttctttaacacacacacatacacatttataaatctgtcttttttgatattgcattgtaccctgaaattctctatcagagcaatttctttcagtcagcaaatatgtgttggatgcctttctttgtagaaggcattgtgttgggcactgtttacttgtctatgtcaccaacagggtggcatgcttcctgagggctgtgacagtgactatttcacaatttcatatgccagtaactagtactactcttgggttagggtagattctcaaaaatattgtagattctcaaaatatatgtatttatgttgttaaaagaaaaactttagctgaattaaatttcagagtttaattgagcaaagagccaattaaatccggtagtttcctgagccagagtaggctccaagactccagcgcagctacgtggtgaagacttatgggcagaaaaaggaaagtgatgaacagaaaacggaagtgagatacagaaaccgccggtttggttacagctcagcgtttgccttatgtaaacatggtttaaacagttggccacctttgattggccaaaaacccagtgattggcacaagagtaggctacagtctctttacagttttatctaggttatagttcacaatgcacagagaaatctttaggctgaacttaaaatatataaggaggcagctttaggctaaacttgattatttaacaatgtattgatttgctggctggatggatagaaaggtggaaagataagttggcaagctggatttctggttccatgtcttgtgctcttcctagggcaccttgctcttgtgggctcagaaactatgtgttcctatgacagaccttcagatacccctcagggagcacttgctgtcctccatgggtgcagcacttcctgtctgtggctactcgggtgtctctctctcatttttccctgccagactctcaacccttaaagattttagtccttctctttaggaagaccaaaaatgaatgagagtggcatggatttgaaggatgagatgactgaaaggaagagctgactgatttgtttagattgagtagtgcattgaggacactggtccccaggtgttggtaaatagaagccccttaagcagaggagcagcaggcttttcctcctctttcattatggtgatgattattatttttgtggttcccatggaaacaaccagagagagagaacaaaaatgtcagggaggttagaatgatgagatggcccccatatgcttaagaagactatgtgagtccatgtgtgcatcagtgtgtatgtgtgtgtgtgtgtgcactgcctgcacgttctgctccagcacactgctgggtcaggagaagttgtgatgcttattcatggcatttgttacagtcagtctcagcaaggagacaactctcagcttttagtggttagggagtctctgtagtgacagctccatcattgcagggagaggacaaacagagatggagacattcctcatgtgagccagaggagtgtcaaagaagaagacagctcaaaactggagttgccggcctgctcggcgctcccctctttttgtctgagagggctcactctgggcacctactttgtggctgcagtgggtacattgaaggcagctgtctgcagatctgaggatccttgagctcttcatctgctgctcacacttttacttctccccgcctttctgattctttgcctaatttgggagtgggaagaaaatccagcctagggctcttctcagaatggtcagccagagcattaacatcttgagcaccgagagagttgcaggagcccctccacaggaaccctttcatccactgtctccgccaaggctctgcagggactggcggctacctcttccgcatcatttgtggccaggatgttcaggaagcacaaggctgtaagtggtgtcttaaccacagaaggcatagagagaaacagacttgaaagccctgaactgagagggaattcattctgattgagaggagaacacagaagaccagaactaaagaagacattgggacaaaggcagctgctgtccatttcaggctgagttttctcttcagtagtcggcatgcatgtccaaaaagctcaggactccatcccccagccatccttgtgtctaggcgtggttgtcacccacatggttatgtgtgctacttccagactttccaccagctgtgtatcatcatgcagcgtgatcctagaagacacgtattagaaagggaggaaactccattaacctggggtgcttcaaaactgcccagagcagatttggctctggccgtagccctgcctaatgaccaggaacacccacactgtactctacctgggccaaaaagactcttctcgtgtgtcagctgcggacactttggagttgattagttccagtactgactactgccctaactgctgcagcatcccgctgtgggaggaagcaggatgtcatttctatcccaacccctctgcccccaggccccatgatctgccacagctcctctctgacagagtgcagtcaagcctcagtgacagattctgtctcctaggccactcttcttttccttcaacaccattccattgactttctctccccatactttttagtcttttttccccccttgaatgattttcttctttatctttctgaccagcgacctttgattgcaaggagcaactcagtttcacattactagagtaacagagtgtgttgtaattggccgggcattggtcttgaaatgtcagggaaagatttatttcctagtgcaacctctctgggtgctaattttgctataggctgcaggataatggttcccgctcacaatgggcgagagttcctaatcagaatacagggctgtaattgggttgaagggattttaaatcattaaagttgcatttagaatggggaatagaaatagaaccccaagattgaatgactcacttagtatttaatgagggagccatggagtattacttataatattcgcctaatgatcttacaagcaatgtaactccccccgccctctagggcctattcacaaggcacaattctgcagtctcagacccaccactctggagcaattaattactgacccatcaaggagcaatcaggctccgctcggccagcagaagcgctgatttcttcccccagtgtctcctcactcttcatcttcctgcctgccttggtctagggcctgcggggaggggagtcgacatttacaagccataaatcatcatgcagtttttggaaaacccagctcactatgagaggaacagggtgaccaagggtacctgtggagagtctgagaggagaaggcatcagaaggaggctatgctggccctgggagtgtacagtctacaggtttcagaggatgttctctggtgctgcagacactaagtgtctagcacatagtaggcactaaataaattgcagcttcccatgatatgactatgaccaagggttactaacccagctgaatagatttgtttcaggtggcgtgaagctccagcagttattttggacttaatctctaggtagatctgtaagaccaatgttcctgtaaatggaattcctgagaatttaggttacagagaggctgcttaagacatatgtaccccttccttctgcaggttcagaaacagctcagctctctagagagagcacgcaagtgttgtgtgtgtggtggtcgtgtcattgctaatggtccttcctaaagggaacacacatttgggagtgtgattgacctggtcgagtggcactggaaccacagcaggtcactgatcctgagttagcctcacttggctgttggtgccacgtcggccaggatgctggggacactcagtctgtgttgcactggaggccaggatgctcctgggtgctgatggctcactgttctaaatctcatcagggaatgtcacttgtccgtcctgtgtcaggcctcagaaagacgacttccatctcttctagtatttcaagtaaaacaaagtctatgggtttctttggtgatacctcagttgtaacttctattgtgttgacataacaactgagatatcataatgagtaaataacactgatatgacctcctaggtcaggctggcctgggaaaaagctttctatttgagaatgtcttgaacatagagcctggaaggtagtagagacttcgtgaacactcgtgaacttctgatgaaagggcttctcctcaaatacttggatctgatagcttcatgcaggtcattgtgatgaggaccttttccataaaggagccagagggaaaagggttccggcattggttgagttcctcccacttgggcagatggtaggctgctcatcacactaaagtggactcatccgtgatgcccgttttgcaattgaggcaaactttacccttgggaataaactaaaatattctaccagttctgcttttgcccaattaaggcaaagaaagattcgtggcaagtattttgctgtaacaggtattgttatgaatatccattgatcctgctagaaataaatctgtcatgatgtggaaagttaaaacagctaggatattctttaattatgaggtgttgactgatttaaatttagtaactgttaaaatatcagtagttatatcattagtttaccaaaaattaaaagtgataatgcctgcttcatacaaatcagagccaaacagtgtaactttgtgcatgaaagaacatgctgtgcttgatgtaattagtatattcccccaaaattgtgactcatgataaatctaataatatcttaaatgcaaaaaaggtagtccaatattttaaagaatcccatagagaatcttttgtgtgaagagcctttggcgttgcggccatctccattaattcatctattctgaaacttctggggtctgtgcttttcctataaagaaggccacctctgtgcatgcttcatgggtggcagctgtctcctacccacgtgcttgaatgacgagactaatgctctagaccacgcacctcagttgcctgcagatagtgtccctgtcccgatctaatgccaatgtcttagctttgccttttcagtcttctatttcaactccaggcaagtctggctactagcccataaagtgccttttaagaagtgggagacttgcccccgtaggcaaatatagccccacaagtacaaggcgtggtgaacttgtagcatctctatgtgaattccgtcaggagatgtagccccaacctggggttgatagcttaacaagcaaatagtacctggacttcagcctcacatgcttccttggccaggcacccttgtgcagtgaacaacctgcacaacctgtatacagcagccctgcagcttggactgttttgatcacaaccagagcaatgtccaaataatctgccaaatatttgtgcaaacattatgttcatgtttaatcgggagcgatagttttgtcttctttataaaaggagcaaatccccagaagctggtcaggagcaccagctgtttactgcctgcagaagccgctgcttatctccttgtaaccacctgcctcttagagatcatgtcttaattaactcagtgttatcaaaactgaaattgtagcaacacctgtaacatcaaattgtaaatgagagataaagggggaaaaactctgctgaccaagaaagggagcttggaaactctctcttgagctgtaggtagttggctccaggttgattggtggcagtctgctgagaattagaatcagagactcatacattattccatttggaaagtgtcttggaggtcttctaatccagtggtggtcaaatattttttatctcatgacacacaacttattcttctgatgttcaatatatgctgatattttctattttatcttatttatttcattttaaaaactcacggataaaaatcattccattgatttcatgacccactacagattcacaacacaaaaaaactggaaaacagtgatgtagtctaatttctaaaatctaaaggactgagggacaaagaggtgaagtgacttgccccgggtaggttatcagtgggtattgttcttaaacccaggtctatagactccctcccagtggttctgttccctgaaatctactaaattctgccactgcaggacagctccgagaagaaaagcaagtcttaacttaagaaacaggtcttcttgggaccctgctactttccggataacaagcctgagtacctacataatacaaaatgtaccctttgaggagaaggtcaggtgctttctcacataaaaagcattgtaacaactggtggtttgaacgcctcactgcattcccatgctgaaacagtaggggcgccatgcctcctagtcttggtgagcctccttaaaaccttaacaccctgtgctctaccccatccttttcttcctctttcatttccttcccccactttgcaccattgagatccctttctactcaccaccccctaaacttctcctttgagacactggactaaaatcgtgaacaaaataggcattctcacagaaacagtaattccaaattaaaacaaaaacaaaagcagtaacttattacactatgagagacctttttacatttctctgcctatatttgcatgtttttaacatattgaaagaagttttccaaatgaaagctgtctgattggtaaccacacccatgtgtcccatggcagtcactcgtgggagcaatcttgggatctaaacagagtttgtttagtatctttgtgtggtattgatcagcatcattgataaagtatgcactggatgttgttttcccagatcagggattgatttggaagatggttagccagcaccactatgatctgactgtgggcaggcggatcatcacactggggggacacataggcccaaagaggatccagcagattgaatttgcattatgcaagccccctttgagtttcacccactagcacatgcttctgtgacagttgaattaccagctatagaactggggtggcaggaagcaggccatctccattagcttcttttgaatccatttcttcatttcctttggccctgggcatgtgggcacaaacttactcgaatggccatattcacagaagcacaactttctacagcaaggtattatcagctgttgctgtcttcggaaaggctttattgtctcctagctaagggaatccctcctttccttccagggttcactaccagcgccccacccccacgcatacatatacagacactgagctgtgttttgatatgtgaggtgggctatcagctgtgatttaatgacgagtatcactgtcagactttacaaaatggaatttcatcagatggtgagggaagacttctgcatagaaactacagagggaaatttgacagctttttccattcagttatcaaagcatttgcagttcaaagcaggtgaaacaataatgtaatcttagcactgaatgctcatttgtatctgagtgtttcaataaataaaatggtcagggaaatgaaagcagacctgttgtctccaatccactaaatttaatatccagggtattgactgacagctttttatcaccataattagtatggattgttcctgaggccattgatcaatctttcctacctctatggacttgagtggctgttttcttcctctcctgccctccccaccctttattttaatattgatcgtgccagttgtgttccaccgcagagaggctgctcacttaggcaaaagaaaactcaggatgaagagagatggctgagcagcagccatttctaggtggcatccacctgtgacatcactctacctcatctatgttgaccttgtaacttgacctcttggtaccagtgaccttcagctcctcaatacgataaccaggcacaccgtcttccccactgggtggaagttacacaaagactagctacagaagccgtggtcaggaaatatctgttgaattcatgaataccccttctgtaatgttgtcaagctaaataagggagtttggatagaccaaggaacacaaccttgtgtgtgtgtgtgtgtgtgtgtgtgtgtatgtttgaatgtatgtgaatatctatgatgtaacctgttccatataatgcaggccagaaacctaagaccttcttatttctcaccgagctcttccaatttgatgttgtcctcttctcagtctgtctatcactaggcgtatacggtgtgtaggtatacacctcactatctcttgccttaactgttgccataattcactatctcatttccctgcctcctgtcctgcctcacctaactccaaccttgcatcttcaaatcttccacacagaggacaggcaggtttttgtaaaatataaactattatagtccttgactgtttcacatctaagatccttgtcatggcacaaaaagctttctgtaacctgatctctcctccctacttctcagccccatttcccaccattcctacaggtcacactgctggaaggtagaattgcaatggatccgttcagtcattgcctgcttcacgcctctaagtcttggcttatgttctgtattttgcctgcagtagccttcacattctttttctccttggccactctttctcattcttcaggaattcattcagatggtatccctttcaggaaacattactttagctcccaaagtatccgaactatgactttttctgtcttctgagattttaatagaatatatacatatacttttttatgcatctctatcctatactagagaataaacctgaaggggacaggggctacgtggtttttcgttctgtctccaatgcaaggcacaactcctggctcctaggatgtgtttcttgcactggaaagaagtattcctaagaagagagtcagtgtgcctgaagagctggggcatacattatgtcaaactggatctgtcttgggacacacaacgtgctgtgccatataactgcaccacgaacaaaagcgaggtggatctcacttattctcagggtggtgagaagagatgggaaaatatcccttcttcttataagcaggtagcaaggtatctttctgaccttaaagaattcaggtgttgtcaactggttattttccacagtgtggaagagttttgctatctatacactggagtagttttctcattggtcttcctaatggaatttccctctgccccactttgtagtacagatcacccatttgcataacttttcggaaggatgcttcctgaggggagagatgccatgcatttctgggagtgccccatgagcccacactgaccttagacagcccccttgctcccaatctgcaagctgtgtggagcctgtcttccctgttcctggcacagcagcctgccccaacagttacaggtgctcgcacacatcaaatgcctcttgttgaggcattaaaccaagtgcaacttttccgaactgagcacaacagagccaaattggactggaaaggccacaggttcctcagggcctcagggagcctgtggcatctacattgcaaattggccccatagaaaagcaactgatgccagggccggccttcatttcatccctaccatgcctattgtggaaccgcaggggcagatgtttctggaggtgaccgcctgggcgcacacaggcgcaggcagcacctcctcctcaccggcctctctccaggcttatgtaagacagattggacagactgataccaattggcacatcgtccctgccagattggaatcaggcccttctaccatctttggggtccacggtggctccaaataaaatgtacagaaggaatgtgattcttagctacagccaattttccctttgctattgcgctggcatttctaatctcgggcattttgttgctgtggagcacaccactacaaatacagtctccagcttaggaacgttgagatttgcaatcatgtgaaaatgccttttcgtattcctacagtttgtctggataatttatttattttaatgtattatttagtgcaaaactattaagtgagcttcaggttatattgttacgttgttgctaattcagttacatatggctggggcaggtgacaacaaggagggaagatacctatggcacctgctctttcctttcctgagatttctgcagcttctgcatgtagatacttaaccctaaaagggaaggtagtgtgcatattttgcctcctggattcgtgtctcaactgtaccactgagtggctgtgaatttagtcaagacacttaattcttccgagacttaatttccttacctctaaaggtcttcccaggctggagggttaaatgacgtggtgcagatgaaaatgcagagcaaggagcctgacacacaacagagggtgggcaaatgcctgtcctctcccttgctgtcccttcaagtggccttcatcagcagacctaggcatagcacctctgaacttcaaatagtctattagtagcaggaccacatttgaagttatgcgtatggtatacaccaacttgtatgtgtgttgtttaggaaggtcattctacagagtatatctgatgcagaccgggactgtgtttttcgttgttgttgttctattcccagttgtgcaaggcacaactcctggcacctaggatgtgtttgttgcactagaaagaagtaatcctaagaagagaatctgtgtgccttaagagctggggcatctttatgtcaaagtggatctgttatggtgcatgcaacaggctgtgccgcatgaggctatgtaccaaaatatttacagtagaaatttttgagtgatgagattataggataatttccctccttccttccttcctccccttcctccctccattttcccccgtcccatcttctttccttgcatccttcctgttcatgtatttttttcgtaaagtttatatcttataaagtagtaaaagatacaaaaataccctagctctttaaaaattgatttcagccaggtgcagtgactcacatctctaattccagcactttgggaggccaaggcaggaggattgcttgagcccaggattccgagaccagcctgggaaacatagtgggacccccccccaccaaaaataataataactaatagtaataatcataataataataatgggtgtggtagtgcatgcttttagtcccagctactcaggaggacaaagagggaggattgtatgagaccggcctgggcaacatagtgggaccccatttctacaaaaagaaaagaaaaaaaataaattatctgagcatggtggtacatgcctgtagttccagctacctaggaggctgaggcaggaagatcacttgagcctgagaggtcaaggctgcagtgagctgtgattgtggcactgtaattactgtaattactccagcctgagtaacacagggagatcctctctctctctccatatatacatatgtatatatatatatatatatatatatatatatatatatatatatatatatatatatttcatgggaagccaaatgaggagggcaacatttgagtcaaacaaggaagcccatctctgatgagctttcacaatgtcctccttctttcaccgtgaggagacctcaggttcactgtgtcagctcaccctatctgacccacatccccatcactttcctcccagtgggtggaaggattcacccaaagctccaacacgcacagctgaaggagcacgagttgagacctgaagtctgaacatggcttaagatggaacgccgtttcctgaaaccatgccccgtatctccagatgaataaacttggaacatagaaaattcccaagggtgtggaacactggtaggttcagaataaataaatatgtctgcttattaatatagtagtactgttagctcagaaaactgtagaaaagagagctattaaaattcaatgattgggagagaaacatgagaagagaaatcaaaagaaagggaagaggagcatagtaaagaggcccattaggaagtggagaaagaaagaagaggtgggagaaaggaaccagaggaagaccacggtaagcaggaggaatggagaaaacagtgggaagagacaaaaccccagcaggcagcagagaagcgttgatcctgtttccagggtcagtatgagacttaggcactgcagcagccagaccacgtgactaattgtccttaattgtcatgagttgactctccaggctgggggtcccaggcacttttctcagattggttggctgacactgcaggcttctgtcatcatgcagccttgctgtctgcttcatgctggcagacattggcttgaggtccaccttcactctaaccatcttctccgttttaacctaaagattgtttccatatcgagaaagaggggatgttctagatggcacctgtgcatgtgtgggagggaggcagagatagagaaccttgtaactccctccaccagcctgccaagtccctgctgtaatcccaggcccagctcagcaagggaagcttaaacctaagtcaatttgagggtggcctgggatcatgggctccgtggcaaccagggtggatattggtctgtaataagtcagtgaaatagtgaggttcaattacttacatgttccctgaagctgaaacaattgccattatcccacataatattgcttgacctacatttttacttgaaagccttcagctaacaattagtttgaatgttgagttataaatgaacacattcatattccagaaatgaaaagggaaaggggagtgataccaacacggctccctctcttcccgccctctctttcctttgccttttgtatgatatttcaacttagcttttccaagatggaagtcattggagagtttgtctaaagggggaccattcagaggtaatgagacaactgggctttatctgggaaaggggcagcttggtcggtgccaaggagatttgagccatctggattaaaatggtcaaactctccgcaggaagcaattaagcagctccatgtggagaagccacgtgaccacgccaaaggagctgccaagaacaggagattagtaaacaaagtacccagcaggaggtgtccaggttggtcactgctctggccacttggcatttgcacagcttcctctgtctttggcatcccatctgtctgtacccacagcctacctataagctatctgcagagtttaaacaaactcaggcagaactgagtttatttaaaatgttaaaagtccagggctcgggtgatcgtgatgatacatcttagactcacacagcatcccttcccaggtgttctggcaatgcctcggatgtctttgatgactcttcgctgcctgtgaaaagcccagaggtgtactgccattgagctgcgatgtttaattccctgagcgtgatcatttagccatagatagtcacaactgggttaggaagcatgtacctagattattttagtgattattttagtgccggtctttgtgaaagcttgagaaaaagctgagttctcctttcactctaagaatctttttgtttaaaaaaaaatccataaaaggcatgtaaaactcccagacatatgccttttttcattcagtgtacatttattagccaggcactgtattagcccttgtggttagaatagagacccgttctcatggatgttacccctggccaaaagaaagacgcagaggcattgggactgtcagctactccctacatagagtcctcttctgatttccagtcaagtcagtttcacacaacacaaaactaacttttctcaaggatttgtaacatcttgaagttttcatgtgacctgcaatgggctaatgtagaatggtagttcaagtaaaagatttatcctttttttttttttttttttttttttttttgagacagggtttcagtctgttgcctaggctggagtacagtggtatggtcagaacccactgcagcctcaactccccaagctcaagagatcctccctcctcagcctcctgagtagctagaagtagaggtgcaccactatgcctggctaatctttttttttcctttatttaaaaaaattttttttgtaaagacagtgtttcactttgttacccaggctggtctcaaactcctagggtcaagtgatccccctgccttggtctccaaaagtgctcagattactgacatgagccactgtgcctgacttttactttttttgaatgagttaacggcagcttactgtgcagcaatgtatcatgggaacaatctatgatatgttctcattgttcctaatgttcttgacttccatgacacataactccctagttttctttgtccagcttttctaagctctgcatggtgcactacaccatcttgaatgttgtcatgctaaagacttcatcctatgtcttctgtaccctgtctgcatgtacacacctggaatctctttcataaattgatatctttgctccaacatctccactgagttcctgacttataggtatagtgatctgatagaaagtcccacacaaacatataatgatcattttgttttactcaaaccttgttaatgatgcctactccttctcaataaaggacaccaccttccacgttgttgctcacaccaaaatgccgcatacaaactttatccctcctttatctttcctccccatctcgtaatatccattgtttctaatcgattcacacattttgttgagtgaacttccaaaatatatccccacttcatacctttacctctatttcaacaggctttagtttaatccgctgtcatcaaaacgacaatagctgcatgagcctcctagctgacctctttgttatcttgactttcccttgatactctgttctccaaaagaaaggcaaaaacatatttttaaggaatgaaatagtgccatttgtagcaacctggatggaattggaggccattattttaagtgaagtaactcaggagcggaaaaacagacatcatatgttctcactcataagtgggagctaaactctgaggacgcaaaggcataagaatgatacaatggactctggggacttgggaggaagggtggcggggcgaggaacaaaagactacacattgcatgcagtgtacactgttcgggtgattggtgcaccaaaatctcagaaatcaccactaaagaacgtatccatgaaaccgaatgtcacctgtccccgaaaaacctattgaaataaaaaatttaaaaaaaattcaaatatttttattattattatactttaagttctggggtacatatgcaggatgtgcaggttttttacataggtatacatgtgccattgtggtttgctgcacccatcaactcatcatctacgttagatatttctcctaatgccatccttacccccactcaccagcccctgacaggccccagtgtgtgatgttcccctccttgtgtccatgtgttctcattgttcaactcccacttatgagtgagaacatgcagtgtttggttttctgttcttctgttagtttgctgagaatgatggtttccagcttcatccatatttctccaaaggacatgaactcatccttttttatggctgcatagtgttccatggtgaatatgtgccacattttctttatccagtctatcattgatgggtatttgggttagttccaagtctttgctattgtgaacagtgctgcaataaacatacgtgtgcatgtgtctttatagtagaatgatttatcttttagttatatacccagtaatgggattgctgggtcaaatggtatttctagttctagatccttgaggaattgccacactgtcttccacaatcaatgaactaatttacactcccaccaacagtgtaaaagcattcccatttctctacatcctctccctcaccccttccaccatgtgaggacacagcgagaatgtgccatccataaaccgggcagtggggcccaaccagaccctgaatctgccagcaccttaatcttggatgtcctagcctccaggacaatgataaataaatttctgttgtttataaggaaaaaaattaaatatttttaaaacatgaatcttctattatattgctcccctgcttagaacctttcatacttaaaatccagtctacttatcaaggtgtcaagacctacacgagttagcccctactttcccctcacctccatgtccactgtgtcccactgggcctcttggccagccatgctgctctcctctcggctccgggacgccacattttctcctctctcagcacactgagtgtgcacagcattgtgtactgtacccaatgtgtagtcttttatccctcacctccctcccactctttcttccaaatcccaaagtccattgtatcattcttgtgcctttggcatcctcatagcttagttcccacttatgagtgaggacataagatgtttgggtttccattcctgacttacaatttgcctggttctcccctcttctgtcccccagtcctccacctgacaggctcctgcttaccatttgggtttcaggacaaatgttacctcctcaaaatggacttccttaaagacataacaacctttcacttgggctcaactctagcccaatgccctgtgtgttgtcttcggagaacttactgctctctgcaataaacttgcatcttttttcttcctgtttctcttctgagtagtgcataggctccaggaggggagggcctatgccctgtcttttgtgtgctataccccagtggctagaactttgcttggtgcagatttgatgctcaaaaagtatttgctgaacaaatgaatgaatgattacataagtgaataatgcactcttctttccataattttggttttcctggcaccaaaacacttaggaaataatatggtcttcaaagtttctgcatgtcttatctctgccaaggacagttgcctctccggagaactgaattgtcgacatatggctgaagtgtgatccagtggactggaggtatgcactgagtatattcctaatatcacgttgccctgtggcatggggcttaatgcctttccatttttggctgaagggcttcactgcaaatgctttcaatcatatccatgtttggttgaaattttatggcaaaagataacttagagacaaggatttttatttgaaaattacattaaaatatactgttatttctaaatatatgttcaaaatttcaatgaatcaacacagagtttttattgaacttctctattcacatagcatatgaattctcactttctgtcacaagagaagtaaaacttaggccaagcatggtggctgatgcctgtaattccaacactttgtgaggctgaggtgggaggatcacttgagctcagatgttcgagaccagcctgggcaacatagagagacctcatctctactaaaaataaaatttaaaaaattttaaaaaatatttttataataaaaataaaaggcatggtgatgtgtgcacctgcagtcccagctactttagagtctaaggcaagaggattgaaaccaggaggtcagagctacaatgagccatgattgtgccactgcacacaagcctgggtgacacagcaaggccctatctcaaaaaaaaaaaaaaaaaaaaaaaaaaaaaaaaaaaaaaaaaaaaaaagagacagagagaaagaaaactatggtccaaagtttaatccctgtttaaaacagaacgggctagtctccttggtagcaatgcatgtggcaggaagtccccagaaatttatgtgcatgcctatgtgtgtgtacgtttgtgttgtgtgtgtatttatatatgtgcacatatataaatatatgtattttttatatatacatatatattttttcttgattccttgactttttaatctcctttctctctatgtttaaaagttttagaaaacaaaaacaaaacaagccttccagtcaaaaaattttcagcacaagataagtgaacagaagggatctatcatcctgaactgtttttcataagccttcatacagctttaatgcaacacagaggtttggacacaagggtaagcatcaggcatcgaggagctcaaattccaattcgtgatgctgcagtcctctgcagtcctaagcaagccagtatggctgctcagtgtcacagtatgccctgtgtaagatagggattgttttaggaagatcagtgaaagtttaagaactgacctcctgaaaacagttgtagattcctcagacatcaaagtcagctaaagaaaaataagtgctaggcttcagattcatcgcaccaaatgacttcctatctaaattctacaataggtaaaatagaatacgtttcttctaaccaatcaacaccacttggaagctggatctgtctccataatcctggttagtaataaagatgcttcaccactagtttgaattttctggcgaggttgtcagtgattcgtgcttgaggcagaaggaaaccagtttgattctcgcataggcgtttggcaaaggaagagagaaactttgcttttctcaacagaggctagaaatgactcagactacaaatagctgctctgccatacaacaaaaggtcatccctccctctcatttttcctttcccatttgtcctgaatgaaggccaagctatatttccccatctctctcttctcatctcaaaatgcatagccttctttatgtggtgcattctagttcggattggtgtgtgacccaggctaagacagtgttatgcagattggagcatcttaaacagaccacaattgaatcagtcttgccaccatttgtcctgtccactataaggcattgaatggtaaatgaaagaaactagtgtcttttattcagcctagttctcttcttgcacacatgtttcacagaagggtacagctcaactcttaggggaaaaatttctaaggaagaaagaaaaaaatgaagaaagacattttcagaaaccattcccttagtaaataatgagaagtcttagagaatctcttgtgtttctctgatttgatagagaatgatgtttcagctttggtatgggaatgactggtggagtcaacagcaagaaaacgagactcccagtgggagggtgtgtactgccaagtactatgtaggcaacactgaatgcagccaagaggcggccttccactagagaaggcatcccgctctctaatcatgacgtccccccgggctctcagagggcaaaacttggaccgaatgctgttttggtctaacacacattttctgggactgcacacttacacacacacacacacacacacacacacacacacacacacattacatggcaagtcttctggattagcaggagaggctgctgatcaaatgcacccctgggcttctattcagattagctttgaatgaaaacaacaccaactctgttttcttattttaaagatcacagagataatcttccttggtcacagttggggaaacagccagagggggtcttgttacctccagaaaagccgtggaagatatctgaattcctgctgggcctattggaccatcttttatgtttttagacagaaagaatctaccccagtgagattctgaaagcagctcctcccagtcatcctctcctaggtattgtttatagctgggcccgtccctcaaagtgtttatttttccgtacatgcatacatcatgcacactacctgattgctttgatcaggttaaggatgggagcaggctctacttgcgagtcttgtggcacttccatgcagcccgtgcccagtctcagcgaggcacttctcctgggtggttggtaagatattcaactagagacttgcttcttaaataatgttggaatcatatccacggttgtaatgaacgcctctgtgatttgcatttaaatagtattttcatccagagatcacaaagaggaaagctatcttaacatcctgactctaattctctgtatctgaaagccagtctgtgtgcaccacgtacacattttccctctaggtctctttcagatctgtgtaccctactgatcaaaacaagcgtttgcttgcattaggatggaagaccccgacagctctggcatgcactggattctctcgccgcacccgcttcatcaacctggatccccatgagctctgattgaaatgcctccaccactggctgggatgtgagaggcactcccagatggtgtgctcagtgccaggcagttaacacaatcatttcttgggttgtcaatgaagccaattggatctggaaatgattgagaggcagtaaatatagacccccaaagtcaccttagcagtctctttccagagtacagttgtgcttcgaaggactccatgcaatcctaaggctcactttccaagccctgggaggactagagagacaaagggctggctgggctcagagacaggaaagggcacagaagtcaacatcaggccctagctttcagccccactgatggctgctccatgctgattcctcagtttacccatgctgcggctctttccacctgactccaggctttttgtttcttttcatgtcattcttcatcatcttgtggaaggatgttttttcatattgtacagttgaacttatttcatcatcaacaaatttttctctttcccatggattctttaaaaggcgtcttttgaagatttatttctattcggatgcaagcttttgtttaaaaaaataaaagagatgtaaatatggaatgttattgaaaagatcttatcttgcttttgacatgacatctaaaaatgtgtttaaaataaagagcaagtgttgttcaaggcatgtatcaaggcagttggcttcctgcagtgagagctgggtagtacttcgaacacttttctgcccctatgaaagcctctcacaggttaggcccctgcgacccagtgtcctcctccttaaatgtccctttctgatcagccacgagagggcaatgcagggcacttggttggctgccttggttggattgcagttggcaagttactttcagtgagggaagctactcagactatgacagtaattatatcagtctcataaaaaccctgctctccccaacttgctgctgccctttttcctttgctgcctgccttccttcctttcccatacccctggccattggctttgtatttgcagataactcactcatgatcctataaggcagagaagagtatgtgaaattaatgtttgcattttaaactccgaactagaataataggttgtttctagggggaaggatcttggagatcatcaagtttagcctctttaagatgaggaaacctaaattgggaaaggtggcctgactggttccaggtcacacagtatcacgggtaggctccaggggcatagacattctacaaatgcctacattttctttatccagtcatctgttgttggacagttaggttgcttccatatcttagctattgtgactaatgctgcagtgaacatgggagtgaggacaatcctttgggatagtgatttcattttctttggatatatacccacaagtgggattgctagatcccatggtaacattttcggcaacatggatgaatggggagggcttcaggctaagtgaaataagtcagacgtagaaagacaaacactgcatgatctcacttatatgttgatctagaaaaatccaactcataaaagcagagtagactagtggttgcctagggtgggtggagtgggagagaatggggagatgctggtgaacgggtacaaagtttcagttacgtagggtaattctggagatctaacgaacagcttggtgactgcagttaacagtactggatagtatacttgaagtatattgagagtggatcttaagtatcctcaccacaaaggaaagaaaagaaaaagaaaatggtgaggaggcgaggtgatagacatgttaattagcctggttgcagtgatcatttcacaatgtatatgaatgggaaaacatgagattgcacaacttaaatatatacaagttttatttgtcaattattccccaagaaagctgaagaaaagaaatacaataagattagggccgaaaacaaaggaaaggtagacataggtaacattttcctgtcaggaacacacaaacttccagaggaatttgggaaagaggagatgactctgtgggaggaggctcagccgtagtctggatggtgatgctctgttctacgcacagtagcctcggtattcagccagggacccaggagctattgaataagccatgactcagtgtttctgtgaccacttgcccttgtctttctaatgtttgcttaatttacaaaatgatgatgttgcgttcctctcccttcattgattatcactcaaaccttgtaggagcctttacctgcaaatcattcacacactatgtggcaagggctggtgagccctgctctttcatcagctctcaacctgggaagatcctttctctattggggcaaataagcaaaacaacctaaaaatgcctttacacaggctcatcctcctccttgtaatgctctttgccccattcatccattggttgactgctatagcttcttctaaactcagctcaggtgtggccttctctgcgtctctctgagcatttctcctttctcccagttccctggattaggcaccgtatcagtcagaaaccactctaggtataacagtagttggacttggttgcacatgtgatgcaagggctgagaagcctaccaggagagggtgaggcaaccaagggagtaaacaatggtggacttgactaccctattcccacttccacacactccatagggctggagggacacagggtgagaaactgcttttaagtaggggccaggccaatccagcaagtgctaggaccatggaggtaggggctggagccactgggagacactgcccatagatagtacccaaacagaagtggggggtgatactttctcctactcttccattgaccaagacagtgctgaagccagagggagaggaagcctgggaattatagggaatgcagtttctggatacagagcaaggcagagaatgttgggaaatgaaggggacagatacatgagtgcccgcacctcttctctggactcttactgcatcttgtacttaaccaccctcatagtagtaactatagggtgtccttaacatcattcagagcaggagtgttccttctacctcaaggacctagcatagtgcccagcaccaggagatatggaaggaaggcatgcataggtttgggaaattgtgatatgccatggaaatgcaagtcatgattattaagatccagccaaaagcgtgagctctgctgaggatgacagttatagacctttcttcaccacatctaacagatggctcagcccctttccgtgatgctatcctcatttgcagacttgaaaactagtgtagttaattaaaataatatgagtgaatgaaatataggtgtagggaagaaagaacaattctgcaaggagcccaggtcgaagaaaagtaagggggaaactatccatcgaggacaacacagagcttcttatgctaatattttctcaagaggtgagactatttcctggcatcatttgatcaaggcagactctcatcagcccccaaagtcatagaagtccaaagttccagaatgactcacattcatttctaattctgcattggaaaatttctattagaaatcgtgagtgttcatttaaaatgattgtttttttgtattgcaactgctttctaccagtctagttaaccctctagcaatgcaaatgttgttcattcttgctacacgaagacaaagagagtgtttgccaatgtctccataagggaagggagcattgctttttgtttcttctctagttgattgagtttgaaaaggttagaaaagtgtgtcagtcttcagactggaaactctgagcatgggcccctctccctagtctgtgccccaccttgcttggcttcctggccatgtgatggacaataccaagctaagcttctgctgatggaaggagtgacaagtctttgctctcagaagtgaagggctgtgatttgacaaagggctttgaaatattcttatatataaagcattaatttcattaatgtaatcaatgctaaagaagcagaccaaccgggccctttgattcttcccaggctaaaatctgttgggctgatgtgatataccaaaaataaaatagtacccctctccatacttcctgttgtccacacaggaatttattggtctgcattggatttactctctgatgtatttgtttatttggggttttgtttgtgtaagttccatgagaacaggggcttagcacttaaaaaatactttactgctctgtttctgaatctaagaacaagcacacagtgggcgctgaataaatgagcattgtacagaataaaaagtaccccagacacctgtcctacttcagggcaacactgagctgttagttataggtatctgtccagttccttgtctgtgctcataccctcaagtacctaattcaaaactgaagaagaacttgggctgccttgggaccaatgactccgcgctaacttgaattaaatcaatcttgtcactcccatctgcctgcctccatgtcatagtagattaattgcaacataatataaaacacatttatattgcatcttcacaatagtttcagggtcctttacagtcttacaatctaattaagcggtagcttcaaacatgaatttctttagtattttaaaagcgtaagttgagcagataagcttttttttttaacttccctattctaaaactgaaagaccagctgattccaaagtccctgagtattattaattaccagtggctgcaatcaatgcacaaggcttgtctagaaagctatttcctccttaggtgaatggttgggaatacaatatatggtaatcaacaatttgagagggctgagcatggattgaggctgagaaaaagctgggacttggcattgcatctctcctgtgcagatggcagagaataaatcttgactttgcaaggaagataaagcaaggtggaggtgttttcatcgcaatcgcacagcacataaatggcagagagaagaaagaaacctcggaacacgggcttcctctccaaggacagctactgctgttttggagaaagcttatctgctcttatttcaccatgagagaacttctgtcctcaagagccacggaaagggtaccagaaatagatgagagcccaccaacaaaaggaatgatgaagtggccctttaaatataaatctctggcacccccaaactctctggatgttcccttacgtattcaaatgagatcgcagcgtcagattggtatgcattaggctggtttcaatgaaaattaacatgtaattgcttcaaatgaagtaagtgaggaggtaatctgttcttaaattggattcccgggattttgtggtaccataatgcagctgtgaaatgaaatatattttaaggatgatgtcctcaagggggtgaaggggctgggagggggaggagtagagatagatagtgtatagtagaagcgcctctccccccagcctgccacattctttctctgtctcattctccagtttccagcggatgaaaagatgttctctcatccatgggtggcccccatgctctgggccctgggacctgggcagacagtgccccacattggcatcagccggtctcctctacttcttactgtgtctggagcttattcccagaggctgtagctccccagggctgtagctctgtggtcaccctggacactggatttgtaaggagaaggtgctcgtcctgcaagtggtgtctactgagatcatcaatggctgaagggtgcactgctacagttgggcaaattttccaaagcacactgtgcagtaagaaaaaccatcactccttgtactcctggaatggggacatgtgcgcttgacatcatgactgacccttctgatatcaaagagtggagctggggtcgcagcagcaggaacagccaattccattaccaccaccggcctccacagcctgggttcagccagaccaggcacccctgccagcagtgatgatatggtctgtgaagtctgaagatgagcctgggaataattaaccttcttaccgttcaatcaggacgggaagcagctgggtgaggagtcagtgcaggttaatgcattaaattgtttgcctttgccatcctaggctgaaatgggattttcagtcacaatggaaataagctggcagtcttctggtcccgtggcatcacgcctctctgccaaagagccatatctgatgggctttggggaccttctgcaccaaggctacagaagggcagagctgttaaatgaaatgcaatcacctggcaatgcacaggcagtgctgggttagggttcacacagcagagcagtgccactggtctagaccgagtccccatcaagggctagcatgagaatggcatggctgccttgcatcagctcctggggagatgcagatttataacacgctatataaagagtatatgttctggtgtaaaaagcccccatcagagctagagagaagggaaattgacaaatctcagaagaatgcgattctgggcattctctattgcacgcgaatcaggacccccgtctgagccccccgcttgccttccctcccagtcacagcttggttctacagctcggctgatgattttttttttttagttcttgtctttgtttcctcctgtttatgttgctattttctttctgcacatgttgagcagctctggctttaaaactgatcagagctcatggctccttcaaatgtagacgttgtattgctacagtctctcaatatatgggaccaagatttttgagagaatgccagaatgtttctgctcttcccaggagttggtagacttagaaatttgaagaagagaaaagggaaaagaatgagagtgaggggtgacaaaactcagtttacccgactgagtttaggtctccctaaaaacagtggcctgagacactttagacccagctaatggcttttatttcctcctctaaggttgcaagagacagtgtctttgctgtgggcaaaagagggaccagactatgaccaatgattaaattttgaatcactccatataaagaataggacctcttttgaagaccaaatctgtaaaccacattggataaatcatctatgttgctggctcctttctttcttcatctggtagtaggcatagaatagtatttgcctccctgcttagggttctgcaaggattagtaggcgttaatatccacaggagtccccagagagagatatgccaatagcaagaaaagagagcttagcgtccttttctagattctccgtggatgtggaatctactgtacagtttatttgtcgtctgaaccccaaggtgcctcttggtagagtatgcataggctgctgcaagcttagctctgctggaagaggtgggatggaatgtattttgtggggagtgcgtgtgtgtgtatgtttgagagagagagagcacgtacactcgtgatttttccatgatctaatatcttgaattaatcattgtaatgcctttttctgctatcaaaatatgtccagtggtcaccttgatatgctcatctggtttaactctcctcaaagtttgcagtgttcacaggagaaaagtagaaggggccagcggtttcattcccattttagagatggggagggtttcaccgcaggagcctgaggatatgcaattcatcttaatcactaaagttgtctcaggcaatgacctctataagcccttcttccctggacctcatttgctttgaatatgaaatcagggtcagggtgttaatgtcctactcttaaaatgcaaactaacgtcaaggtctaagtataaaaagtaaaatataaaacaaaatgcataaagttgtaccgactgtagataccacagtataacagaaaatactgaaaaaaaatatgaatctcgtataagactcctggggtcaacagaggcgtgatgaaatgcaggagatgagggacaaatggaaaatgccccagctccatttatttaagtaaaaagactatgaagtacagaaaatatgagtgaaaagctggttcattataggatcctgttcccagctctattcttgccaatctccctttgacctaagaaatcctctcctgtttctctcttaaattctacctcagaacctttaattctcattttattttcctttcccatgagtcatttgtgtcctcacacagctctgtgtccctcgattccaatgggcagacccacccctctgttcctcccccctctctcgaaccagcctagactattttgccaatagttttcatgcataataacttaagtgcatcacttttctacaaacatgttatcattagagttcaattcttctgctcctagcctttgtgcctggtaaatatacttctttgacgagtgttttggaagatggctccattttatgcatgtgcattagtgccaattgcacaaagcagaaacacaaattacctgtattctgcagacagatctaatcacctagacaccatgggctggcattcattgcagcctccacctctatgcatgaaactgaaaggggagcacctaaactgcctattaatttgaaatgtaggcaaagtgctataggcgctgaattgcgtgtttaggaaagctgtagcaagccattgtgctaggagccgtgcactcggtgtgggcctttgctccgaatagacagggcttctctttgggaagatgtagggctggggcgctgggaccctgccaaagtgatctctgcctgagactggaagagaaatgagataaataaacaagggaggccaaagtggggtgtgccccctggataggacacttggaggggtagacgtggattttccccactatggtgttctgtaagattcttttccaactggttttatttcaacaactctgtagtcagcaaatcggcctcccctggggctgttaaagtcaaatccaggaggttttcataggaatgaatacttgtaacctaaactggggctgcgcctactgtcagagttcgtgagttttttaaggatgcctgaagatgtgcctcaactacctggcggggaggaaaagaagtcccctctgtaaatgagctgacacttgtctgataaaagtggtgcctttggtctgatcatctgaggacaaataagcagcagtgccacctcataaagggaaggggtacctcagagccccaggggtgtcctgagcaaagggagcactttccacaccagctgtatttgggaaatctctcagccagggactcacccctttctcccaaatctcctgagctccttagttggcgtttctttaaagatacttaagtttgccctgttcagaatttttctgggtttgtagcttgtcacagtggtgcccagaattagattcctgttgccttgtctcacacacactcacacacactcacacacacagactcactcattcatctaattggaaacaaaaagagcaagggagatggaaaacatggactctagttgttctccttcctcgccacgttgaatgtatttcctcatgctccccctggctggcctcctcctggcacacttttcctatcttctcttctgtgcatctccccgtcagccttgcttctctgcatctcactccccctttgcttctctctcttttctctcatctgcaatgaggctgctcaactgccagagggtcagaactgtgagggatcagcatgagggccacattgacaaggaaagctgtcatcaaattttacagcttcatgtaaaatgcactgtccatggcaaggacagagaagggactggaaaggcacagggggcagtgtggggagaaggggtagttagaagagaggctctctcgtaggtgaagggggaggtaaacctacgtgctttctacagaaaggtattcatggaggcaaatctgccatcttttctaaacacaaccatgtctctggaagcctcactaggagaccaacaattaataacagtgtcagttatggcatgtctgtgtggtccattgcatagaacgacagaggaagctgatccaagctttgagtaccaggaagccaagggtagcaatgtggatgggcctatggccgttctgttttcggcgagagctagggaaatcccctgccactggtccttcccatacacaatgctatatgcgcatttgatgagccagccaacaggtgcctgagtacctgccgtgagaccagctggcaatagctcctctgaggcacagcagaatggaccgtgtgctaaaggcatcaacagcctgggcaggcaaacaggaccagcccaggagagtccattagagaaccacgcatgtgccggttactgaccaagagttaggttcctacgtgtgcacagccttcccccagattccattccttaggactctgcacccatcccatcccactttctcaggacagaaaccacgaggcagagttgtaccttgccttagagtgtccgtctcctggagaccgtcagtaggatccagtgcctgctttgtaatttagtagctttgtgacccgaggcaatttattaagtttcagttcccttgcaggtaaagtggagatatttttgtttactaccacacagagtggccgtgtggctcacataacatgatctgagtaaagtgctttgcatagtgcctggcacactccagtgatcaataaacgttagtcagggtcattattgtgctatgccccttcctttctgctattgcccctcccatccccggatcttcgatcgggccatgggttctacttcccggtgtctcctgtctccatcccttcctgtccagcccctggggccctgccctccctgagatctcagcagccgtggctgggctggcttttggtggttttgtgagtgctctcagtctgcagggagagacaggctccaaaacacaggtcccagcacagtgccgccctgttggaagctcttggcacctgcgccttagattccttaacataacttaaaatgcccttcacgaaagtacttctcttcacctgtccaggtttgttgcccatctgcctccccatttctacccaaatcctactcagcagctgctcacaataatgattctcagttttgcacatcagaaaaagttgtggaaattgttctgaatattttttgtgtacgtgtgtgtgtgtgcgcgcgcacgcgcagggcggggttgcttgggtaatttataaagtacaggcatttatataaagctccacaatggctgagtgtggtgtctcatgcatgtaattccagcattttgggaggccaagtgaggaggattgcctgagtccaggagattgaaattgtcagcctcagcaacataacaagaccctgtctctacaaaaacaaaaaaacaacaacataaagaaaaatagctgctcctggtggtcctagcttctgtactcctaggtactgtagctagcgccagttgtctaagctactctggaggctggttggaggctgcaggggtgatgattgtgccactgcacttcagcctgggtgccagcatgacatccatctccaaatgaataagtaaagcaagttctacaggtgggcctgatttgcatcttgagttctagagcacaaccttcccagacacaccctgccttcctcacactgcccgcatatctgtctacactcagtcccagcaaacgcaaacggatgggctcacagtggggatgcaaacaaagatgaggcgactgagtgagtgaatcaggaaaggatgttttcattttattgagtgaattagactaagtcaaaccctcccttagagtgtaaagtagaagataaataatgtactggtgtgtgtttgtgtgtgtgtgtgtgtgtggtgtggtatgtggtatatgtggtgtgtggtgtggtatgtgattgtgtagtgtgtagtgtatgatgtgtgtgtggtggtgtatgtggtatgtggtatgtagtgtgtgctatgtgatgtatgtggtgtgtggtgaggtatgagtgtgtatgtggtgtgtagtgtgtggtgtgtgatgtgtctgtgatgcgtgtgtggtgtggtggtgtatgtggtgtgtgtggtgtgtagtgtgtgctatgtgatgtatgtggtgtgtggtggggtatgaatgtgtatgtggtgtgtagtgtgtggtgtgtgatgtgtgtggtgtttggtggtgtatgtggtatgtgtgtcatgtggtatgtggtgtgtgtgtcatgtgtagtgcgtagtggggtatgtggtgtgagtgtggtgtgtagtgtgtggtgtgtgatgtgtgtgtggtatgtggtgcgtgtattttgtgtgttgtggtatatggtgcatgtgtgttgtgtgttgtgtatctgtgtgtgctgtgtggtatgtgtggtgtgtggtgtgtgtgtggctgggtgtatgctgtggtatgtggtgtgtgctgtggtatgtggtgtgtgtgcgtgcatgtgtttgtatgtgtgtgtgtgtatattgtgtgtgtgtaagagagatcaacaggggtcccaggcaagggggatgagtgggctgttggcagaggaagaagcgcagcccagcaaaggtggagcctcgctttccataagcagcttgggtccccaggcgcccctgcgcgatgtgggagtgggagagactgagtgggcgcaagggtctcgccacctgggtgtgtgaacgagtgcagaaatacaaacagctccgagccagaggatccttagtccatcaattctttgcagaagaaaagtctgatggattgaaattgtcacacaagaacgctgtgaacaatagcagggagatactgtttctctccagcccagctgtggtgagttacttcttaatggcaaggtagggagacacacaccacggacaatgctgagggtgacaggagatgcctgtgccagttatttattatgggagaggaaggtgttccttctactttttttccttccatcacccccttcttttctgtgataagtgggggctgagctgtttgtgttatgcagaggctgacaaaatgaggcgatcagattggaaatcaaagctctcaccatggctggcagtgtgcggggacttcgcagccacctcccatggcgggggcaggaggagggggaggaagcagctgctgtcatttctcccctagcagttgtttttggttttacttttatttctcccaagaggagaggagctggagagggcagccaaactagcacaagaaagaaaaggagaaagagggcaagaatggaaatgcggaaggagaaagagccctaccaggaggcaaagggagagggaagcgagaaggagggaagaagcctccagaacgtgcctttttccgatttgtgctggctgcgaccttgcagcctgtttctctgccagctgcccctcctttgctgtgagaggtgttttctgtgacccgcaaagcgtggtttaatttacagggtgagttggaaatgattcaagcatctgctcctttcaaatgttgggaaactgaggcacagcacattaagaactatttaacttgcttctttcgggccttattgtcagtcttttttcttgagagttccagaaactatttccatctccagctttcaggatgaataacttattcaggcctttgcttttctggtgcgttctcccaaaactcctcctatttcaaactgccccccaaagtccctgagcctgagtcttatgggttgactctgccctctggtggatcgaaaggtggtgaatgaggcagaaaagggagctcgttccagaaaaacataccttggcaggcttcccaggaaagtctttggttaaagcaacccgaacccaaaatgaatacagctcaatatgctgtgatgtattaatatcctgataagcgagtcagaatgtgtttccaaatagacctattacataagtggcaataaatactaacccatctctcaccttgctgcggtgagcgcatagagagggatctgcagtgtgggattccaggcagtcttggcgatgctgaccttctgacggatggggaggcctgagccctctataacacaggtcccctgtgacatccacatcacacaatcgtgccctttgcccacctttttaatgactttctattttgttttacaaccagcaatctgctgcatgtgctggtcaacagtatctatcttttctgctgtggcttgctgcctcggatgcttttatgggcattgattccctccactgcttccccaaagaggttcttttccttgagccagagcggcattccggcggattacagtgtctgccactctgctctccgatttattgccatcctgggctttagtctccctacattcacagccaagcctcattcattttgttttctggggcgagcaaattgaagaagttgctattaataggagaaagagtgtcatgccggcagacttagtagtgtctaacgttatagcctgcaagtcccagagccaagctcttgtcttagatccacccttccccatccaagggactgaaccaggtgggatgctggcctgggcattggctctctgaaagatttacacttttctggcttttgtcgacaaaggatattctcatatttgggcactctcatccatatgtcctctccttttccctgtgaccatcagtttacatttggcagaaggctgtctggggttgtagatgaagtctgagggcagatggctggggacaggacgctggagaggagaagcacatggcagtggtataggatggtttgcttctcagctttcccagacactaaagtatatgaatccaattaaagttgttctgtgagtgtgtttttttttttacattgataaacatgtttgctaatcatttatcacaaattaaatagtagagcaatttctaaacaatgtcctacagataatgaatgtcttttgaatatgcatacacaatgttacatctcaactgttgctagtcctgtttactctctcagctgtagaatttagaggctgcctggggactgtagagagcaggacatcagatgttgcctctccagggaccatcctcagatctttgtggactggccccaggctgtccagatgtatatctccttcatgcagaaacaggagcctcaaagaatcttccagtgggttatagttgtgggtgtaggagttcacccaaccaacttaacttgccaggtgatcacacaggtacaagaggctgataaggggctgggcatggtggctcacacctgtaatcccagcactttgggaggctgaggcaggtggatcacgaggtcaggagatcaagaccatcctggctaacacggtgaaaccccgtctctactaaaaaaaaaataataaaaaataaaaaaataaaataaaattagccgagtgcggtggcgggcacctgtagtccccgctactcaggaggctgaggcaggagaatggcatgaatccgggaggcagagtttgcagtgagctgagattgcaccacttcactccagcctgggcgatagagcgagacaccatctcaaaaaaaaaaaaaaaaaaaaaaaaaaaaaagaggctggtaaggtcagaaatcactatcgacagtgtagaaatttttctttgggatgggttggtgtcacaagtcccagcaggttattgagtgaacaattctctttagaaagtgccgctggaaaagtgtagtttgcaaaagatgtgtgtttgtgtgtgtgtgttggtagggtggatagggtggggtctattggtcatatattctagaagaggaatttggaggtggctgtatagggacttggtatccaaaactgtttgcatttctggaagagcaatgttgtatagtgcatacagctgtgtacgtattgttactattgatgctctaagtgatagtttagaaccaacttaggggatagttttcctgtgtctcacacatatattgattcagagtctctggcactatcctcagtaaggtaacaaagggaagcaaacagatcccaggagccctgagttgaggtcttgctgttcccaatcagccgatgtatcagaactctgggtaacttgacccagtagcttaggccctgcattcccattctggctttgaagacaggagaaatgtattttaagacagaattcctaaagacagacctcaggtgggtttttcatgcctacctagaagtaaggttagcttcagttaatctacagcttcctgtgggctctacctcaaagtcatggaagggaagacttcttaggaaataaaaactgatttttgtcattatttttcttcagtgcacacacagaatatctgtcctccaacaccagtcatttcaaaatggggctcctaggactgtattagaaagaccaagaagagcatacagtacaggaggtaccaaatggatacagcctcaacattctgagctttgccagaaatgtctgtctgtcttctcccactgtttcctcaattctcttcccctttttcatcttcacctacctccattttcttgagttttcttgtgcagttttggtcaggctttttattgagaacaacctcaactcctgccaatgactttacagccttcctctttctctctggatgttcttaacaggtttggatgaagctgaaatgtaaatgtatctgattcttaattagaagaattcaattccagagtctgttaggactttgggagtaggagatttgttttcacagtaaatattctcagaaggagaagggaacctagtctgatattcccagaggtgaccagtaataggaaatcatcttgacagatgaaaccactcgtatctagaaatcagatgagtagcgggatgagggaaagacagtgaagcctcggaagtgggagttggttcagctttgttagggagatgcaaggagataccacaccagtcagagaaagtcataagatcaagaggtatggaatgtggctctcaagtggaaaaaaaaaggaaggtaccgcattttccattctctgccttgtttttttaattcccgtgataattacaatgagaggagcaatcatgttgctaattttacttcatgcgtttaagttctaattaatactatctggttcttctgcgttctgctgaggtgaaatacagcatgctcctttgcacttacacctttctttctctcaagaatttgcataggaagtgaaggcatgtttgcatgtatcgtattttagtaattggcatccctgccttcacagttctacaccactttctagtctaatctcctggacctttcctctctccattcaccttggcaaaagtggaacagctaggggtttcaaacagccctgcccctcagagaatagggaagtctgatggagttgccggcagcagacctaagccgccagcaggctcttcatggatccccacagagcaagatgggagatttctcacggtgagaactgcacggctgaggccgcatagacattaccattgtcctgtacagaaaaggaaaccgaggcccagggtgatgaagtgacttgcccacgatcacacatttcatagcctcagatctgggatttgagatgtgtctctgcctccaactttcttatgatgatgctgtgagatatgaattatatgagaaagggctttgcatgctgtcatgtgcaaggaaagtttgagctattatttttctggttaattaacaaaaacattgtcatgaaatgtctgctgcattctccgttctcattttgaaagcttttgtggagcacaaaatgttgctttgtgacttctagtggcatagctcacatgtgctatagatgcacgcgtgttatgcttctggcagcccggtgtgagtaaccatggaaaacagttggagaggtgccagtgttggggctgagtgtggggccagctattgtctcagagacacctggtttaggacagatgcctgctgcagtgtgccttcacttcaagcaactgatatttactgactgcctgtgataatgaactaggtaccatggaaggcacaataggttgcaagaggattatggaaagaaagataaagaaaatacacaggccctgccttcagaattgccatatgggctggcaaaggttatgatggaaccctacgaaagtgcagccttgttgggtcagagggagccttgtgaaggaaggggtgtgtgggcgagtaagtagggaggggtgctgtagacagaggggcagtgtgggaaatgggttggggcatgggagagcatgccacactaaggaagctgcaggatcccagacctcaaggtcctggcatgttcttctgaactctttgagcttcatcctgaaggcagtgggaaccactgaaggctcttgaacaagtgattctcaaacagatttgttagaaaggtccctgcggcaaaaagagtgactggactgaagagggttgcgtgtgggaccaaaagagcaggtggaagaggccccccgctcccactgcctggtgttcagaagatggtccattgaagcttaggaaatgatttgagcttgtggttggaggttcaaaattagagagaatgcatgcagggaaataactagctcttctacagcctggctagagtcccttcctacagagaccagttaatagagagcatcatcaaaggcaccaagagtttccgtaaaggacttagataattatttgcccagtgttggttgaaggaaattactttggaatgaaccagctgatgcagttcaagtgcccgaggatacattcctctgcctgacgttttatacctgtgcgaccactgccccgcccccatctgctcccccaatccccgtcaggatcctgcctgctccttccaccagggtgggaactacagcagagtgaaggaaaacagccctctcctaacggcttcctttgtttggttcagacttggtcattgtactttgagagttaaaattgggtctatttctttctgtatccgtccggtgtttgtcattcaattgcctgtgcaggttctctgctttatttcatttaagtagctgttatcttctttgtatcataagctcctaaaatatagagtaaggaatatgttttgttctggagagtgaacactgcatcttcacaggcatatgagctcaataaataaatgtgtaatgttgaacatagtgatgtagccatgtatttggttacttggaaaataatagggaagggagggaacgatagcatccgcactcagaaggtttgtaaacattaacacctccatgctcctgcggagtccttgatactcttcccctcaatacttacatggaccctcattacaataagaacagggtggggtagagaccatttttccccattgacatatatgaaaactgagtcacagaaagactacggactcaggcttgtcgcaacacaatggaaaaagagagaagcaccccactggactccatggaaatcaagctactaggcatggttgctgcctctctcaaatatgaacaagcaagctgaggtgatcgcaggtaaaatatatgaatgcatggcggcttccagatggcagaaatcttgttaaaatctgagtaacacccagtgcattgtcaagctttcaaaatgttcattgcaaaatcttacaatccactcaccccagaaaagactattactaattttgggtcaaagaatcaggagatgctcgctgtcatccaaaatctttcttgaagtaagtagctaagtagccttaggcttatgaaagaaagagctgcacagacttaacctctgtaggttccttattgataaattatctcccatgtctctcccagcaccatatttatactcatttgtaaagttctcagcagaaacttcacttctacaagcccttccctgacccattagactaggctgggttcctccacacacgtctactttctgcacaacacccataatttcctatcataagaaacagcacacttctgcattataatcctgtctttctgtgcctctctgcatgagtctgtcttgtttgcctctgcattgaattccttaagagcttaacacaatacatggcacataggaggtgctcaatgaacatttggcaaataaatgggcatataatcccatcctaatgcacttcagttcatccacatctttggagataactgcctgaagtgaagtttaaggggtaagttagaagcacaggtcgggggatggctgtgagttgaaaggttccccgggggacctaaagaatgggccacagagacccctgacacacagccctccctgccagccctgtttaggtggattccagcaccttaagagcatgtctgtttatatgtctgatggtgagaacgaggcctaacgtatttgggaaaggcaactcccaggaagaggacgtttccatgcttctgtttctggcagtgatggacttccctgcccccattatctcttcaccctggcttacttctttattgcttccaaatatgatttttctcctgccattcggctctgcttatctgctttgctgctgatgggagcatacttcccagcctggcatttgagggcagctacagctgactctagtctttcttcctcggtgttctctctctgctctcatcagaccaaacctttaaacatctgccccagagccacacccaaatctttattctttgtttgtttaattaattaattaattttaaacagtctcactctgtagctgggactataggcacatgccaccctgcccagccattttttttctttttttgtaaacagggtctcaccatgttgccctggcttgtcttgaactcctaggctccagccatcctcccaccttagcttctcaaaatgctgggattacaggcgtgagccaccgtgcctgccccatacccgtatctttggatacctttttcttcctagggggaacaccttctcacctcttttctgtttattcagctgatcttttgtttgtttggttggcttttatttatttatttttttatttcagtaggttagtggggaacagatggcatttggttacgtgaataagttcttcagtggtaatttctgagcttttggtgcaccttcactcgagcagtgtacagtgtacccaaggtgttgtcttttatccgttgccacccctgacctttttccctgaggccccaaaaaacaatgtatcattcttatgcctttgagtcctcatggcttggctcctatatatgagtcatataggaatatatatgactcatatgacatttggtttttcattcccgagttacttcacttagaataatagtctccagttccatccagtttgctgcaattgccattattttgttcctttttatggccgagtagtattccatggtatatatatatatatatatatatatatatatatatatatatatatatatatatatctcacattttctttatctattcattgattgacaggcatttgggctggttccatatttttgtaattacagattgtgctgctatatacatgcgtgtgcaagtatctttttcgtattatataatgacttcttttcctcctggtagatacctagtagtgagtagatctacttttagttctttaaggaatctccacactgttttccatagtggttgtatttttattattttattatatcctttattagtttactgtccacatgctcctgccacccactgaactccccaaatcctcctcccctccccacagaatgtccctcgttagtacctaagcctggctggattgtgtcccctcacccctgtgtcagtgtcccaggagacagaaatgttcttggcactccaaggtctcttaggccagggccagaagggcccccactcccggcttctggctgcaggctctaccttgccccgtgtcctctctcccaggggcagggctcacctgtggttgcctgctcccagtgcctgactacagaccaccctccatctttctagcaccttcctttccttgcagcctcccaaatatctcacactccctctccagaagagttccttctgatcacaaagcatttgtgagatttacacataagattgcctttgttccagttctctagaggcagattctgggatacggatttgtgtggtcatgacttattagggaagtgggcctaggagaacaggcagaaggtgtaagggaagccaggcaggacagggcaagaagccaagtggaggctcgattttaggcaaagacccaccagggtgaccaggcccttttacaactcccacacaggccacacaggctactgctaggggccaccctgggggacgcaaaccctaggcacttgtggctgtctgtggaggtgggggtgcaaacagagtctcaggctgggctgtcagaagcagaagcacccagaacccagggagcacacagaaatgatggaaggggccgaggggcctgggctgaaggctgacttcctgctttgtcctgcacagggagagagagacagggcagtggctgtgcaaatgatgaggcccccatcgaggtgagggagggctctggaatgacaacaggccccagcaaaggtagtgtcctcccactgggagctttcctctttctggggatgcatcttgttccccaaggtgccacgtcacctaggttaactatctggagagatccagttaccttttctgcacttaattactcacattttcttgttttagtgagtgttgtctttccagaccctggggaccccttcctctcagcctcctcacagtccactagagagaggagaggcttctgtgggctctacaggatagggacagagaaggatgagcctccagcccctgcagtgtgtattgcatgttggtcctgctctcctgtcccacctgtgtctcacctccgtagatggtagaaatggagctcagaagccagcagcctctctccttggaggatgccagtccactcacctactgtgcctcactctcacctaggccccaggcagtcatgtgggcactgtgttaccaccaaaggtgagaggatgtgttgccaaggtcacttagtgagagaacagacaaggcccacctcgaacccaggtgtcccctttgtccctctggagttctagttgtatttgacctttcttcctgtgaactgtggggtttggatacagcagagactgtctctttggttgtgaaccagattccttctttccagccactccctcccaccacacatggccacacatgtacatcatatgtgtacatggtccctggggcaaagatcaggtggacaggcagtctgcctgctgcccagttcgcacacatgggtgccaggcttcacacacactaactggaagggaaatggcagctgcatgtggtctggggtatgattttggtctcctaagctgtgatatttttttttcctcttcaagtcatgttcaagttctaagtatggatggtgctttagggtgataggagtgtgctagaggcaggatccaggtcggattctggggtttgctggttaaagtgtgtcttgacaaagaattggaggtggaactagccccagagatgaagccaggagtgacacacatgctggcttccccagaggccagtgcatctccttcatagtcgcactaggccttgggcatgggaggagcaaggtaattccagccccttttctagtgtgactccatgtggctaatctatactgttcttcctagtttgcctgaatacatcctggtttaatcagtgtaatcgcaaaaagtgtctgatttgaacaataatcagtgtaacaatcagtttaatcagtgtaattgcaaaaaaaagtgtcgatttggacaactgccaggctggcctaacttgtccagggactgaatgaagccccatttcttcatccagtgtgtcccatagtatggggtgacacacactggccagtgagggcaggactggagacaaagcaaagatggaggagagcctgcagatggatttgtttcagggactcctgtttcttcttcgcagctccttccctgccaaggagggctgtcccctggagaagaaagagacaagctcaagtgtgctaccatctataaccatcagtgattctttgagctggcctttgcagagttcttcattttggttccctgcctgctctttgtcttcaggataaaatgcagactctttctttcacgagggcttattgcacaacgaacctgtaatagtcagggatcctacagggaaaagatggcatcctcaaactgggtaatttgagcagagtttaataaagtggatatttatgaaggtgcagccaaggtgtaggaaaactgtaagggacagtcaggaccctggggccacgaacaggaaggcactgttaacacttttaggcctgaagggataaggggaagaggtcatggctgccaccagactttgatggagggatatagacagctggtggatggaccctgcttcctccccaaccccgactcctgccactgcttcccagtggcagaacaacaggaggccagagggcagggagcctgtccacgcgatccgtgctggtcggcctgcactgggtggtggacttgcggacacacagagagcaacgtgctagcttgctggctttgtccctgctaaattttctcttctacccatgccttctattccataagctccccgtttccatccttccacaaactcgccagtattttccccagctcctttgtgctttgctcatgctcctcctactgctggacatgctgcaccttactcctccttgctgtttaccaagctctttccaaccttggcagccgcctcaacacttaccaagatccaaattgccctgaaagcaagcacgagtcatgtgtgagggttcttggagtagagaaaaaaattgtatctacttcctgccttcccagagttccacatatgacaaaaagataaagcatggacatcctgcttccagtacacaccaagataaagtatgtctggaaaacactcatgggggaacagcaaaattttgcagagaaaagcttgccggtatatgaattaatatttaagcttgaccttggtgtggcataggaatttgtctaacaaacaataaggaagggcattccaaataaagcaggaagtcacagaattcccaatgtgaacagaatgtacaggaaacagtgaaaagtggtccggtgcacctaatgaatgtcatgttcgaagcagtgtggggtgggagtgtgtattagtctgggttttccttttcaacagaatctatctatctatctatctatctatctatctatctatctatctatctatctatctattctaatctatcgagagacttataagaattggctcatgtctgtagtgtaagtttcagtctcagtccaaaggcctgagacaaaggagctgatgcccaaggacaggagaggaatgtcccagctcaagctggaagagtgaagtgcccttcctccactctttcattctgtccagaccctcagtgtattagatggtgccctcccacattggggagggtgggtcttatttatgaagcctgctgatcatctcttctagaaacacctcacagatacacccagaaataacgtgctaccagctgtctggcatcccatagttcagtcaaattgacacagagaattaatcatcaccgaaaatgaggtggaactttgtagggatcactcactgaagtccaagctccaatggcagatggagtccagcgtgaattcccactgaactttcggcacttctgggctctttcctttatgaatggttggtctccatgacaggattccagagaccactcttctgtgtttggactgttttgaacatgctagggaaagaaaaggaaagaaaaacatccaggttacctagctttggtcacctaggggaaaaaggctccactgtctgtggctctatgagatgatgaagatgccccaccttgcccaggttaccttttgctagagtttagaatttagagttcttggctacatgtgtgtaacagagttattgaatcaaaaaaatggcttgtgggagccgtgacttacaaacaagatatgacctattgagcaagcccattcttgcttcagcatttaaattagtgttgggcttttgttgtaggtacaaatcaaagtgttgtgccattcatttcagaaaagtcacggcccaccaaactcaacagagtttgttttgagaggatactactgtatttgacagggacaggaaggacaggtggtaggtgtgcttatggagaattttctggaggtgcacagagcaaaggcttcttgatttatccctaggacattacagaagtggagggggactgcctccttgcacgattctcacacacagtgaccaggtgttgggggagatgtgtgcatttgtatttgtgagtgcaggttggtggggacatgcagagtaattatactcacacactgggcctttattggatgcaggcctcatggtcttttatctctcgggagtttgtgaaagatgggagattttaatcaaataattaatcagtggacagatatttattgtgtgcctacgttgtactctacacaatgttctgtagagacacaagtgaaaataagacatgatccttgcttttcaagaacttaaaatcaatcaagtcagcaatgttacatccctaagatgagaaagcagtacatgttatagactgtacaataggtttatttgttgaatttttacaataaacaaaagaatgtatttacatgcatgtttccatttaatcttctcattaaccccatgcaagaagagaggttatttctactgcaggtgatttaaatgaaacccagtggagtgagataacctctctgaggcctgaggggcatcaggaacagagctgggacattccttgtagcagtcagacttcagaccctattctctttgctctcccggagcctctctctgactacaactacctcctagcggtgtgggactcacagtgcagtgtgtgtgctgctgcttttggttttgtttgtttcctttttcctccccctaatcctttcacctgtatcataagtgtgctgtctgcttctacctaggcatgatgagccctcttactttcatagctaggaaagattccatggcctacctccgttttcttatgtcatgcaaaaatggtaatagttgggagacgtaagaacagtgtgcaatgtgagtctaagtctagtatttttgtctctctatgacccagatcaattttgtaaacttccacacaagtttagagtctaaaagaaatccagtagggtcaaaattagcagcctcagtagtgacgctttctcttacaataaaggagtaaggtgctagctgatatctgaatgttcagtgtcttcgtggggaagtatcctgttttgttaatttcttagtttcccccagagaacactttctcacaagcgcagatgtggaagatgtacacgccaaccccatggcagcgtgtgtgggtatttctgagccatttgcgtcgtgatgttcccctatgatgcttgaggggaggggcagggcacaagccgaatgctcagaggcaccaaacttaggggcagctggagcatttctgtgtgataagaggcaattgtgaccaggtgctgcgaagggcgaaagcacttattttgctgtggcttcaagcattgcttgagatgcgctgcctttcagacacagttaaagggccatttgatagaaggaacggttggaccgcacactgtctgcatccattattgccctcagatcttcaggcaggtgtgtttaagaaaggccaagcctggatgtttctctcttttttcaataatctatctccttattgcaacactctctttgcccatctttagaagattccaagcagacacttttgcttctttttttcttccaattcccaggttctctctctctttctctctctctttctgtctctctctctctccctctctctcccccctacccctctctctctatctctctttctcttttctcatcctaaatccaaaagtagcttcaggacctgagtccatactttcatggttctatttctgcggtgcacatcttgggcttgcttaatcatttgtttttgcttttcctctatgtgtaaatgcagcatgtgtaataaaacaactattcatcagagagatattcaggacacagagggttgcatttttagagcattggaacaataggtgcagctgcagaaaattacaggtatggcagtgttctttctctaccatactcgagctcccatgcatgagtgagcatgtgcacatgtggctggatcctcttttggccaaatacaccctgaatattgacacaggtggggcaccctcaataatccctgctcaaacagtataggcctattctctaaaagaagacacttatccaaaaaaggaacatggtgcagacagacacacacagactaagaaggggactgtggctcggtactgaaatggaaaacacatgccttttccaggctttatttctttttgtctggattcttccaggatgctgagtatgctaggccatgggctgtccacgggggccacacacaggaggggaaggccgcaggagggatgctgatgggaaaaccattcacagagacacagaaggctaatggccactgccagagggctgcagtgcggggcaactggagggcaacattgaagctggaggacagaagggagctggagttgcagggcccagtccagaatcctcaagggaacctctgtccctctattcttcatatatgtggcaggatgggcagagaggatgccagcggtgggagggcggtatatctggaggttgtggacgaaaggggagaggctttgcaggtctgatctgggaacatcctgcccttttgatcgcccatctcccacctcttgttggcctatgttacattgacttgtgactattcctccatatctgatgagcggccatctccagttcagctcacctggatgagtcagggacagtggagtttgaagccttactcactctgacttaatcaccagttaaccaccatcctgagagaggtgagataccgtaccgtgtttcaggagcagttttgtagaaggactatgtcaagggctgtctctgcaaagagaggactcgttgtctgaatgtcccacctccagagccttctctgtggctgagagagcaattatgctcattttcacttttctttttttaaccgaggagcgatgtgtcctctgcattgttgaggagactggatcaatgagacagatagatgggggcaggtgtgaggaggtgacagagttggctgccgaggtacctttgtgatccatctctgcagaagccggcattcattccgtggggattcagcaagactgatacccagcagtgacagtttggacatctaaacatgaccttggatgtgttcagaaccgcagctggaactgtgccaactcctcagagtagtacatcacaggagccgcagaaccatgctggaaattggctgcgttctgagtgctagtgcatctgcagacgaacctctctggccctgtagtgcggtgcagtgttgggggacggcttccgtttctgtcaattttcaataattagatgctcacaaggaagcccaggacagtcctctcgtgttcatcgggaggttgtgagatgccctcgttgtgggcatcaaaaataattattcaagcagtttagtgtttgtcagtcagcgtttcctgcaccatggccactcacctggtacttgtcagatttcagctgctggggaagaaaataaaggactctgcttctggtttccctgaacatatgggttacaggaaagttctctcctgtaacgtatcagaaaactgtttcataccagggtcctttcctagtgcctattcactctgcaactctcatttttgccaggaaacacacgtctaggttagaggttctcagggagctctccagaccagcatcagcagcatttggaattttgtcagaaatgcagcctcccaggccctgcctgggcctactgaatcagaaacccatggagtaaggtcccaggaatctcttttttatcaggtctttcaggtgattctgatgcacagtgaatttgagaagaactgatttagatgttcttttgggagcacctataagaacactaaatttggaaaacaaaacaaaaactggcatgaatcctgcttctacagtttaatatcagcatggtttcagtcaatatggctaatgttttttagcctcagctaattttgtctgtaaattggcaataagtgaacccaaccaagtttgtgagatgataaaatagtacacatagtgggctcatgtagtcaattaacattgaccatgaatgtgaattcatccagtccctgcttggacccaagtgaaggtcagagcagtggccacccttcagattattaatataagctatcctagatacattactagcaaagcaagctgcaaagtgtgtttttgttcttgagagatttcaaacttatgtcgttccaaattcatgtttcagacaaggcagtaccagatggcagtcatggggtctgcaaggagcataagggaaggtacacccttaggtgtagtaagagaggtgcaccctctatcgactgtagttttctccttcttgctcaccctcagagtccattctggatattgtcatcaaagccacaagaaaggcttggatcagttcaaacttcatgtgcattcaggttacctggacatcttattaaaatgcagattcaaatttcttatctctgagaggagacctgagtttctgcatttctgatgagctcccacccaagtgatgctgatgttggtggtttgccagccacacttttgtgtagtgtggtgctagctcagtgcttcttaaaccctaatgtgcacaaaactcatgtctagatatgaacttctagatgtgactcaaggaatgaccaggggccatcagctttggcattacctgggagcttgctaaaaatgcagaatccaaggccctacctcagacctactgaatcagcatctgtacttcagcgaaatccccagggggctcatgtgcaccgtaaagcttgagaaacatgtggagctggcttcacaactttgtttatttccatagaaatctgtggttggtttaaggctgtgttctcaccaccttgaaatccttattcatgcttgagcaaaatattctgtgttcttattttgcactgggccccataaatgatataagttgtcctagacacactgctccatattagtggttttgaaacattagtgtgtgtatgacccaactgagatgttgttataaattcccaaatattctgaatcagtagactgggggtgagactaagaatctgtaataaacctctcctgtgattctaatataagtagtccatgagcactttgaaaggtagtccccagatcttctccaagctaggccttcactcatttccatgctgtatcaggatggtgccagagagagcccacctctcatctgcattgccagaaaatgcaatgagctgcaaaaaacttgttggacacctgtgccaaggtgtttctttttgggcagtatttcccacaagaactctcagcaaactatccctgtgcacctaagtgatccttacataatgttgagacatttacataagcaaagcagaaaggatgcacagtacaggatgtctcatggggacagggggtctcctgaagaagcaggtgtgtatagtagcacttgttagaatttttatggtcacaaaccattttgagaatccaatagaagccatcacccatcctcaatgaaaaattcacctttgcacattatgagtctcacatagtaccaggaattagaagacttgactgagaggtctgacttctatacttctagctctcattccttggacaagtcatcaggctattcagaaccctagtgtcctgatctttaaagcagagaatgggtaagagtgtcaacctcataaatttgttgcaaaacatcaaaggagacattgagctgtaaaagtgctttgtacactgcaaaataatgtatacatttgagacatcattatacatcctatgctacattgttatttccagcattatagtcaggatcaggacactgcttgtaaatttagcctaaggccatggaacagacttgctgtagtaagagagggaaatgaatacagacagaaagacatgatgaggacttggcgagagttgctgggaaatttaaaagtgtagaaaagagaagggagattccacaattcaaggactccagatgcaaaaataaaagaaagaaaatctatttttatatgtgcagacagttttgagattttggaaagtggctttagtctagcagttaaccgaacatttctgcccctgggtataatgaagatgaatagcaatagtggtggtctgtatttagttttgactgcagaagccttctgtgggaatttgctattctgagatgagaggaatgatgtttagtagttaaaagctgggtctctgatctaacacataattattgtgtgacttggagaactagtttagtttagtttctctgctcttctaggctttttccaataaaagattcttcatagggttattataagtattgaatgacttagtgcaccctaaacagctagacataactatgaaggattatcatcacccaaatccttgagcaaagggagaactggtagtattcgaagtatccagccatcctgggcatgcaaggtacctctaggttataactgagatcgtatttgaagtggttctgtgctcaagtggtttgagaagctccgagcaacattctgaggctgtaatcccataagacctttgctgtgttccagaaaagtccacccctgacaaatcaaaggaaatgtatgtgttgggggaagggagaaagacaagatattctagccttgccatgaggacctccctctgatggctgctgtcgtctctcagtcccttgacgtacctgtctggtcttcccttcaggtgcactattgacaaccgggtcacccgggtggcctggctaaaccgcagcaccatcctctatgctgggaatgacaagtggtgcctggatcctcgcgtggtccttctgagcaacacccaaacgcagtacagcatcgagatccagaacgtggatgtgtatgacgagggcccttacacctgctcggtgcagacagacaaccacccaaagacctctagggtccacctcattgtgcaaggtaggtgggcggggcttggcggggagatctggctggccagcctggaaagccttcaggtaaaggtttgttctctgatcctcaacagagatgagttatccttattctacgcatctggggtccagggcacatttctggttgtcattttgcagttagaagctaaattttccagtcattttcattgagtggaactaggaattgtttttttcatttttgttccaataatatattttctcaggaaattatcttgtaattattgctcttcttggcttttttctcccctaagttttagttatttttgtttgtttgttttttgttttgttttgttttgttttttagatttcatccaattccaagactgtgttatgtttaaaaccagacttttaatgcacttttggaagtacaggtatgccatgtccccctccagccttgaacgaaagcagagccaaccaggatgcactgggcactgccctcagctgcatccttcacaagcacctgcttgtttccagctcacttgcgcctcctctcctctcccagccaggggttttggatgccatttctcccatataatactggtgtctgattctccctgttttgattccatcccaactctcctggccttcttctcctcccctgactcctagttcatgaggccttgtatgtttgtgtgtgtgtgtgtgtgtgtgtgtgtgtgtgtgtgtgtgagagagagagagagagagagagagaatatgtgtgttggttatgctctcttagaccctgggaatggagctcacctcttcccacaaggcagaaccagtcctggggcattcagacaacacttaacccggttgaaggattcctagttagtgagcaagagctggcatcacacttggccactttctggctgtgagaccttaatcaagttattaccgtgtctcagggttctctttctgtaaagggggtcaacgtgaggattgaactgtaaacgtactgacatagaaaacacgtagaagagggcgtggcacatacaagtgctatttcagtgttagctatggagctttcttttctcttttttaggacttttgtaatttttaaaatttttgagcatcttttacagtgggtcaaatatcttattttgtgatgtcagcagtatagcccctgagcagcggcatgccagatccagtgctggagccctttcccaggctgatcccgaggccctttcaaccagggacgtgtagctccagggtgacaaactcctctcctaggggctccttccaccagtccccttgtcggtgtgttcaagaaaagggtaaagaactatgggatgattggttagagacagaataggaaggaaggcagcttgagaaggaagaactgaagtgagccggaagaaggaaggggaggcctgctgtttgacagtaggggaaggcggaacttgggtcgtgatcagcactgttgagtgaggcagggtgagcaggactgagaggaggacacatgagaacaaggtgatgctggacctggctgtgggcagaacgtatgccaggggacatgggaatccttgatgctgtggcccaagtttggtcatgccaagtttttattatattttgcttactctttcttccccaaaggaaattacaatggctgtttaaaaaatgattctataaatgaatactttttgaactgatgcatgcaaacagcaattttaaagaaaatagaattgcatagaaggtatcagagtgtattacaaagagtggagtaggtattgccatgtgagatttttgtttcagtttgtgtacattttttaatgtaaaatacattttttattatggatagggaggccaaaaatgcttgagaatctccactctgtgggcagggctggtgaatgccctggtgccaccatctgcatactctaccaggtggtggtttggaagctattgctcagcccccctcctgtcctgccccaacccctgcacacttagtgttgagaaaagaatgcctagcattgacaatgagagactgggaactaggaactattagagatatttgctttaggaagcagggcctcatggaactggaaagtggaaggaattgtgaaaagtgctaatgtctccttgaaaactggatcatatttttgtcattttctttcttcagccacccccactcacacacacccccacacccctgccctgaacacctcgcagaatgcctgatacaaagtgaacatttaataaatgcttattgaagcaaatggctagaattagagccaggtgatcttatatgggctccaagagagacggctgggtgtttttgggggtgagatgatgggagggggtgagaggatggagtctacatcaatcttcactcacatccaagctaatggaaaatgtctaatcccttgctaggtgtttacatctgtgacttagctaggtgccctctcgcatgacacaccacctcaagtattggaatctcatcttgggctaattttcgaatgctgatgggtgtattgatctggaaacaagctgggttaaaaaaggcattggtcttttacacagactcagcccaagctaatccgctgtcgatatgcctggactgagtattatcgacactttaatgaatagaggaccatagttttttcagagccaaactgaccccctcttcaaagcgatcagacaaactaaatagagccagattcttgtgtttctgtattggaaagaggatgcaccaccatcctggattacaaaaaaaaaaaaaaagggaaagaaatatatttatcttgggatcgtttattataccaaacataaaccctaattcccctagcagaagctgactctctggatttgaagttgctattcagccctgagcttctggaataaaagttgggcatattaggttttcaaaatggtattatgatcctttaaaaaaagaaataaaaacagcaacaacaaaaaggaactaaattgatattctgcccatgagtatgtgtatttatgtatatgtagtcaccttcatatctaaataaatccacacagaaggaaggtagtggcatctcacagcattgcacaagctgcttcaggtctggggtatgtctttccccttactgtcaaatatcccatctaccccctagttctctgtactggattttcttcccctgtggttctgatccaatatggttatttcttgcagacagccgtgaggccaaggcgaccacatggagcaagtctctggggcaagctaggagcaaagggcatcctgggggaggagggtgaccctggagccagtgtgggagggagatggagggggaaggcggcagaaaggaggagacaagagaactgagccaagtagctacttgccagggtggctattttaaattaaatttaaattagctacaaccaaacaacatttaaaatttacttcttcagtcacactagccacactgcagtgcttccatagtcatgcaagactactgttcccttgtgttcattttgcattactataaaggaatgcctgaggctggtaattcacacacataaaaaagaggtttatttggctcatggttctgcagcctgtacaagcacagcaccaacatttgcatctggagagggcctcagaatgcttctattcgtggcatggcgtgaaggggacccagtatatgcagaattgcatggtgagagaaaaagccagagacagcagggacggtgccaggctcttttttaccaccagctttcgagaaagctaatagagcaagaactcacttgccccaccccctgcatttatctatttatgctccatccccatggccagacatctcccattaggcccccacctccaattttggaatcaactttccacataagatctacgggaacaaatacccaaactactgcactcctgtgttggacagtgcagagagagaacatttgtgtgaacttccattgtaaaaagctttattggatagtgctataaggggttaccattatggatcagcaggtgttaaagctagaatggctttccatggcttgaagggctaggtatattgtggaaaggagagtggaattttggaaagagaatggaaattttaaatagatggtgctcttttaaaaacaagagagaattgttgaaaaagatggagtaatggatttcctaggttagcttcaattgtttaaaaagatggagtaatggagttcctaggttagcttagacagagaagagtctggagtccaaggatgtacctgcaggagagtaggcagagttcgagggttggttaagtgtgagcatgggggtgatgactccaccaggacactgagatttctacctgtgagctcaggggacatgaatactaacatgtctaaagatcacatggcaaaactgattcatcagcagaggggaatgagttcagatacctggatttcttgactttgagatgccttgaatacttccttcaaatgtgaaatgtaagaaataccacccgtggatttgcatgtcctgaacataatctttttgtccagaataggggagattcatctaaaatttattaacatttaggtctaatgatttccatctctttgaccttagggttttttgcctaataaacataattaataagtggttctctctggagtctagcagaatattttattcctttcaccctcttaatcctgctaccaaaccgagcatattgtacatctgaaaaagccatactactgtctccattgttcctttggacaaggttacatcttggaaaacagagtggataaaacattcagtgggaatgaattgtttggcaagttaaggacagcttgagaagacgtctaaaaggccccgtctgtgtttctaagaacccatgaatggtggtagagcaaaagtgtgccatggttgtgtgcagagtgttaagaaaggtcctccttatccaagtatggaaaactgacttctccattttgactggtgtacctgcaggaattcactctcacttagagacacatttgtatgacagagaacagtagaatacagtgcttataaaaacagggatattagtgtaataaaaaatgttaaaaaagcttttagcctctttgtcagttttccaggccctagctaggtttctcttttgtcactggagtatctaatcatcccctcccttttgtttggtaaaatgagttttcctatttcttgctgggcagaattaatctgaaaatccctgctattgtttgatagttaattacctgcctttggagtcaaacagctccgaagctcaggtaaagaagggaaacacaaatgtctatggaatagggcaggaatgagggaaagaagccaggacattctgttcacttcgtgtgttaaagtaattccagagagaaagggactagactagggagacacccagcccaggcagtgacttgcaaataatggaagtatggccacatcagcccctaatttacctttgattgtctccctatttctgactctctctcttacccacttgatatatacaaccgtgtttctttccaatcctgaataattagttgaccttgtcaagcaaaagctcattattatgattcagagaacaggaacaataacttttaatttctaggtagctacaccctagagacccctccccactctgaatctgaactgaaggtaatttgaaacacaaaatatcaaaggaaataatgtgacctaatccttactttgaaagcaaagctttctgcctctccagacatgtcacccagaaagcaccatgcccttctggcaggacaaggctcccggagagctctgcagatctttgcaccaacacttcccattcaagcgagtcaatggtagaggaaaacatcatgatccaattcgaaatagactgaagtcaccttctgagaacatctgtgttctctagatgtcagtagccctgtgtgacagatagtgggggcatactgatcatcccaaactgctttccaatgacctctctttttcctgtcccattcaagaaatagatgaaaatgtatatttggtctggtcataagactgtgtgtctaaatttgatagaactttgaaaaagtcaggaaattaaattccactataaaattggagctctcctcaaagcaccccggagaatgacaaggaagtagggcattttacctgcaattgatgtacactatctagacagcatgcagatgaggcaactctgttctacctggtgagttttaaaatttcttgaagcagttgctgacaacggagggacaaaaattgacagaaaggctagagcacatttcagtaaactcacctgaggtatcgtctgtctgctaagccaagtagggcaaaatgtaaagactaaagtaatctcagaaaaatgccagaggaaaagttatattcattgaataatggcattttcttttccttttggtatggctgggaaggggtcctcatgttctctacagagtttggaaaacttggcgtcttttgcagaagagtggataaaaatagggtcccctgttctagcctttcacacccactcatagagaatggagcagaaagtttagatgacccttatggctttacagcaagcacttacagaagtcaggcaacatctctccaggtaagcagttagggctcccatgggaaagtctgtaagcagccactgagttcttaccccttaggtgcttttccacagggagtcttggctgcttctgagcggcctcagagtctaacaccataggattgagaaacatggctctgattccttctggatcttgattctttctgcagcttccaagtgagaaatgtcatttattttggggaaaggacaaacaccagatcctgaataatcagctttttcaagatgtatgcctttagactcccattcccatatgagagtgctgatttattcaagctgcacttgaagaaaatcttcttaattaagggttggatgaggtctctttatggtctcatgacccaacactacagatctgtctaatcctataatatatccaaaattttcctcattaccgtattcctaatggtttcagaaggtcacccatacagagtgtgtgatacagcaatatcaagagcagctgacttggatgccatcactgttaggagaagattcttagacactcaaaagacccaaagattctggttgttcctctcttcttaataaaattaaaatgcgtagcttcttaggacatagggagtagttgatgagaaaggtttccgtccatctgttgtcagatcgaagacactctactgaccctgttgaattccatttaacagtattttgaagccaggtcctggggacacaaagattcagacagagctcctgccctgtccagcagaggagaccactatactaacaaatatctgtcttataaggtaacagggattaggatgtttgagggtataaatgctatgaatacattgaaatggagtaattgaatttacctgcaagattagacaaaactacaaagttatatttcatgagggtcttcaatgggcagtagagttttttaggggatctgagaggaaatggcatcccaaacaggatcaatcatgtgtgcaaagcttggaaggctgaacgtgtatgttgtgttggacgaagagtgaggacgctaatatggtcacagggcagagttcctggggtgaaatcactcaatatatggctagaaaggtaggctgcatctcagtttcaggtggaaccagataggcttccaataggcttatttttttctggttgtcctgctagaatgctactttctttcacaaggaagtgcacattagattgttttgacaatggacaaatactcaaaagattatcagtggaaaagaacatgacaaacacctaagtcaataaatcttgggtagaaaggagatatattggaaggaaagaatacatccaatcccaactggttctatgcttcttgcatggttaagacacaaaggggaaagattgccaaagacttttctaccaatacgtcaattttcaaaatctctccaatgtatgtcttacatttgaatttgtaataatgattcttcttccatagtatagtaaggtgcatctctttgtgtcttagcaaatagagggtgtggtactgggttttgtgctgtcatggtgatgatcatggcagagagggtgaggatgctgccgaggatgaatgacagctgcaagaagcagtccccagccctcaggtcctcagcagcctcctacctgagagtcctcatacaaatgagaagacttcctgtttctgatatctccaggctaatttaggctttgaggtgtcaccacttggagtgtatgttaagacatgttcctgttgaatgtcgcctgcagtaaataattgtctaacattggtatgaaatctaattggcttccgctagagcttggctcagcagaggaattcactcctggagtttttggagcaccacactttcttcatttcatgttatttgagaaagaatttattgatgcaaaatcagggcagtttaatttggtggcatgttttctttatgtctcaattatatattcatgtctttgtggtaaactcagctggtggggggattaagaattcaaaatagaggattttcacttggcaagtagtgctttctactgtgattaattgggagtctgcacaatgaacccggtgttggctccgttggggatttaatagcttagtagaaagaagtaaatttcaggatttaagagttttgggttacagtctgaattttgataattacctggaaaaatgatctccttgttttagttattccagattagatattcccaattagataccttttatagaagtgtttttgtgtcccataattcgatttggagaagggtgtcaagtaggtgcagggaagcagaagagcacccctcattgttgtgatcatccaacagccctaaagacttccaggtgcttacatccatttgtctttttctgtcttctttctatggatgcaatcctctagatggggaatgcacacatgtcctgccgctgatgtgggtccctgttcccagaaaccggtctgggtcgcatcccgtttctccagcctcagccgcctccgcggagctctattgctcctggctttctggccttctgacctggtgctcttcctcagctctcttgccaccatctcctgtgttctcacagttttgtttgggcatgttttatggtgttcttatcgtcctaaaacctggatttcacagaggggacctgtgtgctaacactgttcctcattctgagggctaggctggccaagccatttcttcctactctgagaaagaaagatgagaaattttgattattttccctttcacacataaaccatcatgtgtcaagtcctgaaattgaggttggaatggatacaaagatggatgagatgggtccctacaatggggatgtgcaaaggagtggggtgcaggtagggtgtgtaagggcagcagctctcacagccactggagagtccctgggctgagagcgatggctgcaagcttgggagccaggctttgctgttgcagaaggccaagaaaataataaagtcttttgaaattgagtaatgtggcgtttcagctcccgactgttagaatgaaaatagcgattctgccacacccactttgcacccctcacccctcatttctgcacttgtagcctgagtgatcttttcaaaccaaatctggaggttcctcaaagacttctctttagcccaagagagccaattccttatgaaggagttgatagtcctggaggccaggctccaggggacctctgctcctggttcatgccatgtcctgcctcactattttcattctagtgtattttttcttgttatttctggtcataggccctttgaacgttcccttccctcttcctggaattctcttttgcttttcacccagtcggtcctatttatccttcagactttgactcaaatgccatttccatagagaactttcccagacctgctaaccactgccactcccacctctgccaggagctagagccttgcccttcttcctgctttttgccacagttaaaatgtggcatttgtctgtgtgattggttgattatgtcattttttctgaggtcagggggcccgtatgcttgtgcattctatccccagtgcctggaatttaatagagctcagggactatttgttggataatctatctgtaaagtttcttttttattgtattataattattaaacaaaatgattcatttttttttcattactagttgtagtaggctgaataatgtccaaacaaagatcagattctaatccctggaacccaaaaatatactttgcatggtagagtctttacagatgagattagtttaaagatttgagatagggaaattgtcctgggccctaaatgcaatcacataaatctttacaaaagggaggcagaggaagatttgataggaacacacacagaggagaaggcagtgtaaagacgggagcagagggatatgaagatgctgaccctcagggttacagtgatgtggccacaagccaaagaatgcccatagccagcggaagctgggagcaccaaagaccagatatcttttgagagcctctggaggaatcacagccttcctgataccctgatttcagcctagtgagagtcatttttggacgtctcacctccagaatcatcaaagaatcaatttctcttgtttgttaagccactaaatatatggaaatgtgttatagaaaaaggaaacaaatacactgaccttcaatgttttgaatccttaatggatggaaataggaaaaacaaaaattgatatttgaaatctgccccaaatttagtctttgtcactgtgagagatgaagtaacactcatctttttcattatttctttttaaaaaaaatctctttggagatgcacccttgtcatgtaaatgcaatgaggcatcagctttttgtccttggggtatctacaggagcagatggagtcatccacatttcaaaactaagatgatactttttgatgttgaaaatttctgtcccaggggccctagggtatggaagcagggagggaaagacacctctgccaaatatggttttaatgagaggaaaccattgatgtcgcctagcattaagctgtgagatttggtttgtgaatgtgggaccagagttgaagattaaaatcgctaaacattctcttgttaactgggagagggacctcgtatttgtgttttttctccactatgtgtctcataggcatctcaaactgaaaatgtaaaacatagatctcttgaattctagccttctttcctgaccatcctctgactccaaccctaaacctgctcctcctggagtcttgccatctggtaaatggcaattgcattcttctagtggctcatgtgaaagctgcagtccgtcttcactgttttccttttcccgtcctcttcctcaatcctgagcacgtcctgctagattttctgaattcggaggtttatccagtcctgcctcttctgccctctcccaagctgctgttacctttgtctggagtgttccacagctttctacctaactggcctgctttttttgttcttattccctatcgtctgttctccatgctcagcgaaagcatttctgtgcaggcttcgttgttcctgatttagtcgcttcctggctcacctaaggtctttaacatccctactgtggcctaaaaggtcttccttggtccggccaccagtgtctccctggcttcacctccacacacactcccttttccttaccctgtctccactacttcctgatatgcctgtgatacaccaaggtggcctcctggcttccaggccttaaagctccctctgctggtgcccatgccaggtgtccttggggctctcttcttagatctctgttcaaggtcaccttaaggcagaggccttcttcaccacctgcataaaatagagcttccaaccccacatcatcacaccctagcacctttcttgccttgtttgttctttataaagtaactcacctattggcataatggatatttccgtgttggagagtggtagcctgtttcaacccctctagaacatgtgtgccatgatggtggggcttgatctggcatgttcattgttgtttcccaagtgcctagaacagggtctggtgcatagtaggcactctgtaagcatttgtcaaataaatgaatgaatgaaaacaaaggcctaccgttaagtggacttgatcatattttctcagtgtttgctctctctttggtcaggcgtgagagcatgaacttctctgttacttctatcaaaatgttttggtccctctagtctcagaccaggtgacattcagctgagttttgcagtgtgcattttcttagcaaggtaaagaattgaaccagattgaaggaacaaatcacacagcaggaaggactctgagagaccaaagatgagtcactccaggtcactgcctggaaagaaaacaggaatgatagaggcgcaccacagcctggatagcaggagagggccagatctctgccacccccagggtgtgggtttcactgtggaggggatggggaattataggaagggttgaacagggaaattaaattagttgtatttcagaaagatctctggcatcagaatgaagggtggattggaggggagttttgcagcagggagactgagagagaatgaaaacaaggctgagattgtattatcctgtgttcctgaccaggagacccccctctctccttgaggggctggacaaacagggctttagagcagccgatccatggccagagggcacatatacaggaagagtggaaggggtcccgtggccacatggttccagttttcctggatgatcctattcctaagagacgcgtttattctccatgtgtggttgctaagggagtaagtcaatggaatttaaagttgacacctttgtaaaagtttcaagtttatatatttacaaataagggaaaaaatgtgccagactttgtttctgtttggaattctgggaatatcgcctttggattatggacctgaaatcatgtcaccaacaggagatgcagtttgtgtgaacaaagggtaaagcttgaaataagataggataagacaggataaagaaccaggagagctttttaaataggagaagctatttgaaagcagaaaggagaacaggttcagaggataccaaaaccggagttatcacagaatgtttgtctgaccactcattcctgctgcctgccttggaatctctggaggaacttcccagaaaaaaaagaagagtggagaccactccacagacccaccgaacctgaagagcctaggtgcaggcgtgggtgtgggggtagaactgggaatcacaggctggagcccagcgagctaaggcccgaggcagctgaaggtcaaattgggaacatttcttacatcaaatcctaaatgaggttcatgctgattagtaggaactgtgtcaaataggtgagcaggcctgttctgggtttctaattacggtgtggctttcatctccctgagcttgttgctgcactgttgttcaaatgaaaaatgggaaacagacatgaaaaagagctgctcccctaagtgggtcagtgcaggcttcttccaccttctcccaccttgtttttctaaagagttacctggctttgttccctcactgatactcactgaggcatggcagccattcctttgccctctttggacagggcagcatgctgcccatttgggactggcagtagaatagtcaagaaattctttttacctttttctggcattcatatggcaaatgaatttttcgtgcaaaaaagcttcctgtgattgagtcggtctggtagcacaggtgacagctaatgcaccaggaagtgccctcaagggtcagccttggccacagcactgcatgaagctcacggtctggtggggaaggggagctgaagcaggcccttcacccctctcctaccaacacatgaaatgcctgcctcatctttcagcccaggacctggttgaagaaagatgcatatatagcaatcatcttttcttccttccttcacccatcaaatattccatgaacatctactatgagccaggcatcacgctacactcacggtagagcacgaatgccctagttacccccaaagaaataatatgtgggcgggtgactggagaagtcagtaactccttttaacatagggagagagctgggctgaataccaggggctatgccagcagccaggggaggcccctgaagaagcccagggactttggacatgaagttttgcccagctgagagctgaggaggattagctgggtagcatcaggaaggtgaaaccttctggacaaaaaatgacaagtgcaggatggggcaccgctgagggcagggtccctgtagagaaggaaaaagcatcccccgcaggcagtgagagaaggaggagggtgagaggagagacccgagaggggagccacggcagatggcccagggcctggaaagccctgccggtgacttcgggatatttcttaagggcagaaggagccaagttaggggagagcagacccaattcaggagaattcctcacttggtttcagttttgacaagagggtatctgggagcaatgcagagaccaaaggacctccatggttcacagctttgtgggatccccccttccttcttgcctggccagggctcctcagcggaggtgaggaggagttgagctcctggtttcatactatttgtgctcctccagtgaggcttcatttgtccatggattctcccccactggagtgagtgcagcaccctgtttagaagatcggcagaatcagcagatggacacccttcttcctttccatagacagttctcttctttgctattttccacctagctcttggaggctgtttctcatttggtctttcgagcagctttttttttttttttttttttttttccccacaaaatgttctttttgtcatcttctgcctgtcaccgtttttcatcctttttttcctgttctttttcatggtgtcctatttcactctcttaggcacgctctatctgatactcccgttctctcacgcatcgccaaccccgtttttcatgttgaccttcgattccgggcactgtgcacccgggctcatgcgtcctccaatttcacatttcccacagtcttcctccccccaactttctttgcttcctctcctcttcccctggcgcccccttgccagttgccatccctctgtttcacccagtgtccgctttcttccccgtgcgcagccctgtgcacccagactgcgattccctcctcccgcagctgcgccatccccggacccttcctgctgggctgcttctccacggaaggtccccatgggtttcgcctccaacactcagagcccacatggccgttgtagagaggataagataatcagatgcacctttttaattatttatttttcatttcacttaataagcacatcttgaaattgagctgcagtttcactcgtaatagatcatttcccttagggaacccacatccaaccccggttgaaattctctccgtgcgcagtgcagggaaggaagacactaggtttcaggtgtctttcttgagatccaaacatgttacgtcctaatgtaaagtgcgtgggtctgggagtgtgtgtttgtgagaggagtgtgtaagtgtgcatactttgtcccttctgtaatgtgcttgggtatagtagggtatttgtgttttggggggagtgtgtatgtgggggaagatgtgtatgtgtttgtgtgtttatggggagtgtgtatgtgagtgtgtttatgtttgtgtagggagtgtgtatgtaagtgcttgtgtatgtgtgaagagcgtgtatgtgggtggagtgttgatgtgattgtgtgtgtgtttgtggggcatgtgggggggactgcgtgagtgtgtgtatgtgtttgtgggtcatgtgtgtatttgtgggacatgtgttaatgtatgtttttgtgtagagcatgtgtgtgagtgcttgtgtatgtttgtgtgggaagtgtggatggggggagtgtggatgtgtgagtgtgtgtgtttgtggggggagtgtggatgtgagtgcttctgtgcgtgaggagtgtggatgtgatcgtgtgtgtgtgtgtgtttgtggggcatgtgtgggggacatgtgtgagtgtgtgtatgtgtgtggggcatgtgtgtgtttgtggggcttgtgtgagtgtgtgtgtgtttgtgtagggaatgtgtatgtgatcttgtgtgtgtgtgtttgtggagcatgtgtgagtgtgtgtatgtgtttgtgtgggacatgtgtgtgtttgtgggacctgtgtgtgtgtgtgtgtttgtatagggagtgtgtatgtgatcttgtgtgtgtgtttgtggagcatgtgtgagtgcttggtgggggaggaggtttctatctgtctatgagtgataggcgtgatggacatgtaacacttagcccaagtgaatgtgaagaccacagagggaaaagggaagagcagctactcaaaggggctgatgatttacctaactctcccctggtccaccccaagagaaggatcggttgtgaaagttccaattactagaagtgtgatggccactccaccagccacctggagcccagtggaaggagcgtctgcagagaggccctgcctgccatttgttctggcccagccacgggcaagcatctcaggaaaaagggatttcctggaacagtgcagcagcaacaggactgaattgtgggttgagtcccgaggatctcctctggctcctctaggcccagaggcctcttctgctccaggctggggtcctttcctagggcacaatgactcgggtgcccctagctagtctagtcatggaagattgtaaatatagcttctcatgtcgtcgaacttttagaggcaactgtaggaaaacagtagcaggcaggtttcatcatgcaatgataatgctatttttatgtatagcttattgaaacctgattatgtggcagccaagaactagatgaagctcattatgcacactgtgtcatttaatgttcaaacagccctgtgcgatagatgctgtcatttcccttcctttagaaatgaggagaccaactaacccaaggaaggttgcacattggtaagtggcagagccagagtttgaattcagaaagtctgactcttcacagcctccctcaaacactaagcttccccttatgagcaaaggatcaggttaacctgactcaaaggactgtatcccaattgccagcacaggcatgggctcaagttgttgtagagacagaagcctccttggaggccacctagccagtgattctcagctctgctgcgcattgagatacttggggtattgttaggcaataccaacgttgaggtcctcctcagaaattctgactcagtttactgggggtaagcccatggtgtctttgtttttttttttatttttactcctggatgtttctgttgtttacccatgttgagaaccactgtcctaatttacagatgggaaaacatgaaactgaagaggttagctggcttatccaaggtcatgccgctggttaagcacagtagcaaggactaacccagatctcccatctctcttccagggcgctttctcttgccccttgatgaaagacaaatctttccttatgtgtgtgagggaacaaaatacaatatggtgggtaagagtttggactgagacaccaaatgggttggaaaaatcgctgtgtaatcttgggttttatgtgttctctggctttgtttgttgttgttgttgttgttgttttccatctgtaaaatgaggaaataataaatcctgtctggcgggattcttgttaggtgataacatgagatgataccattaaaaagtgccataatctagctcagcatatggtcattgtttttgctgtgtggaaaggaccatccattagacatcagcctcactgggcattctcatgagctcagatggcaatagtcagtaacatcaactttgcgttttcaaaagtagcacacaattaaagaatacatttctttatttgactatgaactcattaaggatgatgtgtgctatgtaaatgcactctgcacaagttgacgtcacctgtggaacctcggtgacgatggctgatggaatgtctggccattggtttggctgaggtagaaccagcatctaaatctactgttgccatgttgtccttctaacttgttgtcacaaatggggacacttgctgttcttccacaagttcttctcaatctcatcactaagacagatgtgaagacattcataatgctgatcacgggtacatctctgaccctgtgaactcccgaggcctgttttccatgggatgatttacatcaggagacacgattgtctccatcactggtttcaataccatccaacaaagatgccatggagattggagcttactccctaaggacattgtctctcagctcatgcaaacgctactcttcctgagtttccccttgcctccctggactctgtctagacggctgttttattctcagctccccctcccctgttggcctacacatagtcttctgttcttctcacttaggctacatgctgtccagtgacccacccaggcctggggctttacctgcagtgctttcacccatgatagtgatatctttatatccaacaccggcaaagctatgtttgtgggaacctaatggaatctcctctcaaaagtggcacaatgtattcaaaattaaacaaatcatcttgccccacctcccttaccaccccaaattcctcttgcttctgtatcagcagtcttggagtggtaaaacccaattctcaagatagatagaggactagagatcgtccttgatttatttctttctgtagcactcctcattcagtcatctgttcctatagatgcccgtcactcacgattccccatctttgctgtcatggccttgcttcagccatttatcccatttacctaacttattgccttcctacagcctgtgtcctccactgtgcatcctgtgtcacatggtcacagtaaaataagagcaaacatttattgggtcctttccatgtgacaggtactaggcttaacttacagaatctcatttaaatctcccaacaatcttaggtagtagatatgagtgtgatatgaacaattttaggtgaggaaactgaggctcagggggggtttagtcttgctgaagatcatccaaataaaagatggggcttgaacccttatctactattggaagaagcccgactgtggggctgttccatccctaagaggctgagctctctctgctttctcaaaagcatccctctgctaagtgctgcttcttgcagaggtcttcttcttttatttctttttgggctctcctgtttccttggaaatgttgatttcattgcattttcctaatatttcatgctttaatttaatttatttgatactactgtacagtgccttgagcacctcagaggaagtgagagttttataaataaaataattattacagcttgctctgatggcagcccctgagctatttagtagatatatcaattactctcagtgttgaaaattttcacctaaagctctttatggcccaagttttccttggcttttaatgctctatcctgcttgttgtagttttgacacaatcatgtagcacttttctttactatccccatcagaagtgaacagacagcagctcagcaaaagtgccatataatgtattctagagaacatgacctagttttcttaacctttttgaatcacttagttccaggtgtcatttactagacctataatgtcagttttgcaatgagtcaacccgccttgcccacctcatggtctctattagtgagacctcattatctattagtctgttgcagaaacctcacccacgataatctagagatgggtatgaattaaccacaacactgtttggcacccaggatttcaggattctaaactacaaggcttatgcagacaaaatgtttgtcaaaatcttgaaaggaagtgaagccccaacacatggaggagggtgagtggattagagagtgcagtgtagagaactctctaatgaaattcagttttcctgcagctcagaatgctatgcaatccacatagtaattagagagaactgaggtaattttgcattcctggacccagtattctcaagatgcattaatcagtcagtggcaatttgcattcctactaagtgcaagccactgttcaatatgctgcttttgctaaattagcacattcctccacagttcctcctttcacgatgagtgagtctggcacatgtcataagattccacctctcaggaatacacctgaatgtggcactgaccatcattcctagcattatggctactttctggatcctgcctgcctcacaatctcatagcacttcactagcaagagatgtgagaggaccgttgtcatctgtttagtgttttagaggcatgttgaagaattcagaggataaaccaatggtcaagctaagatttctccctggacatctcccactcatgcagttagacctgactttcctcctctcacttccatcatggcatatttttttattctacttaaaaaagatacactttattctatcctattttactctgttctatcttattcattcattcaataaaaatgagcttagcgcttgctgtatgccagttatatgactggcatgtacaatgatgagcaaaattgacattgttctttattttttggagtttgagttcttctcttccttttgtttttaaacattttttatttgttttgtagagatgggatcttgttaggttgcccaggctggtcttcaactcctcaagtgattctcctgtctcagcttcctgaggtgctgggattacaggtgtgagccaccatgccaagtcttctcttcctctcatcttgacttgcctccctctcaaaattctactctttgtaatctgtagttgtattaaggatttctaaagaagtttcctcattaaccagaaacaatacactgtgctgtctccattttgtgttttttagcaaacaaatgggagtagccaatctgtccattataaatgagttcattcccattcaagcaatggctgtcatgtatcttgcctgaggcttcttatgttatgagcaacatattggcttcagttgtctgtactttttcctagctgcacagagatccttagatgaagggaaggcacaataactcaaaataatgtattgtattatacatagtagtcattcatagttccaatgacaggaaacacaatgagcttgttcaaggtggatatgtgtaaccctctcaccaggccaggtagaggttgttagatgtctaacaactattcttccccctagccaaatacgaatctgaaacaaactatgacccagatatccagaccagaaagaaacagataggatgaagcctgttttgcccacaacgggaagaatcacttccgatgaaaaacgactaactggaaatacttcaaattgctgtagagagtgcagtgtggagaactatctaatgaaattccgttttcctgcagctcaaaaatgttttgcgatccacataggaatcagaggacccaggtaattttgcattcctggacccagtattcacaagatacattaatcagttggtggcaattggcattcctactaagtgcaagccactgttcaagatactgcttgtactaaatatgtctattgcactgcacttcatctgatgatgggtgaggcccaagcaactcatcagatactacctctcagaaatacatctaaagagggcaaatcctaggcccattcttttcctctcatttctccaaatagcttgtgagcccagttgaccttgcctggatcaggacaatcctgggttgctggttaaaggttgacttggtccatttgcctctactctatgaggtatctcatatcactttcattgtaattctgtggtagccctttaataaaaatggccagcaagcccacaagataacagaataggaatcaatgagacctgcaattgtctgcatgccagattctcctgtcagcctggcctccaatccatcctgccaactcaacctcctctgggactgagacgtttgaaaacagtgcagcagcctcatctcctgggcagtgtttttctccatcatttgctttattaaatattgattttctgttgcattattaaaccttaagtccagagcataaattctgggctgatactttaatctgactcttctcatttttttggcttttagaactgattttcaggccagctctcctggggaatctttaagtcaacttagggccagagacaaacctgcctgtaggaaagggaggagcccggagttgagaaggagcttgccttgccagtgcactataaataaggctgtggctctgtcaagcagatcttcactttacacatgtcttagacacagaggcttatgctccctgggattcaggttgtagtgcaaggaaggacttttagattcccaccaccaaaactatcgagtaggcaaatggtatgcagaactgattttagagctctctagatattatcaaactcattatccatccaccccctccttcttttggtttctaatattcctaggatttgagtcaaaggttataatcacacaggcatttggatttccactcactttgggcctctggttcattcttgttttctcttactgtctcttctctctaagggccaatggttgagtaatcagctgtagccatccattataggatggagccatcacacactttatgaaagtctttctgagagaggcaggcattctcaaccagtcatattagccagagtgatatctaggtttaatttttttacttttttttttttttttttttttttttttttttggagatggagtctcactctgtcacccaggctggagtgcagtggcgggatctcagctcactgcaacttctgcctcctgggttcaatcaattctcctgcctcagcctcctgtgtagctgggactacaggtgcccacctccacgcctggctaagtttttgtgtttttagtagagatggagtttcactgtgttagccaggatggtcttgatccctgagctcatgatctgccctccttggcctcccaaagtgctgggattacaggcgtgaaccactgtgccgggccaattttttacttcttgaatacttcttagactggcagtatcattgactgaggctagggttggtgattttaaagataagaagcagaatactgacagacaagcatgagaaaagaaatgcaagtcaacatgtatggagcttctctggcaggactggggtatgttgctgtctacatggatgtttgcagagagctgtgcctatctccctgtctgacttctgttcatcccatctttctattcagttcaccccatctttctcctcagttatcccacctttgtcttttaggtcctgcatctccagaaatctagtgttaggaagttattccaggacctagcagagcctctgtttaggaaaagagtgaatttgattcgctcttcactctgggatggagagggaacacaggtagctcatggggctacagaaaccagcaactacaaaccttcagatgctgtgagccaagtgctgactgagccgggatagccacatcaggtgctgttgaaaatgattcttggggaatatttgatagaaacaatgtgaagatcagggtggaagaaactgtgtccttcattttcaccaatactcttcatgtcaccaataaccataggcctctaaagaataatacatgttctctttaaggtcatggggattccagatcatagatcttcctccaattccatttccaaagcctgaattccctctacaataggtatacagctagggagtatctaccatttatttgaacactgtcagtgatgagcaactaactacctattcatctaggtcttacttcctttagaaaagctctattagatccacatatacacctctctccctctaatatctacctcttggttacttctttataaccacataggataagctgaatcttttgtaatgataaaaaaagtccttggcatttaattaagagctatgaattttgaatcttactgtctatgtaaatgtctacaagttataggtcaaaatggctgaatattggcagttgcatatgtttcaatctaatatttaatttctcagagctccagctttctcatttataaagaacttgaatataaccactcatcagtttattgtgagggggaattgaaattaggtgggatacctagcattggaaagcattcaatttaaaaaaaataaataaatttaacaactatttactaaacgcttattctgtgtcaggcaccgtggcaagtgttgggaataggaaaatgagtgataaatggtccttgacctcatgatggggattgcggtatttgaggatgcctattgtagtccttaagtcttcccttcttctgctaactaaatagagcaagtatcacctgcatttgtctttgtactcagctcattaaattgtagttatctcttcacccaaaagttatacattttggggtgcaagaatcgttcactaaatgtcacatgtttttctccataaattctggttgttggacctgtttgtagttcttcatctttccttgtctgaaagattctggtgtcttcacttatctcttcagatgttagctgacttttccccagggcagcacaagctcaccgaggtcaaacaagcatgagcatgctgacttccattcagtcacctctgcacgtcctgccgctgatcctttatctcctgtcttaatctgcccaagctgctatgacaaagtaccatagactgggttgcttattaagaacagaaatttatttcttacaattcaggaagctaacaagtccgagatcaaggttctggcagatttggtgtctggcgtgggctcacttcctggctcattgatgacgacacctttttgttgtgttctcacatggtgagagtggtgaggggtctctttctagccttttttataacgacactaatccgattcatcaaagctttgccctcataacttaatcacctcgcaaggctccaccctcaaaaaccatcatcttagagtttaggatgtcgatatatgacttttggagagacattaacattcattccattgctttgtcctttcacacacttggaatgcctctattttctctttgattcttcactatttctgcatattcaatttttgtaatgattaaaaactcatctgaattgcaggaattcattggaatagttcaagaagatttattggatagatagatcagaatttatggaaacaaatgcaggaaaaacagatgagccctgtctgcaggggatacctctgactgctactctctgcccctctcttgttgggactgtgtagtctccttattcatgcttctttctgcaaatctcctatggtggtctcttcaatctcttacttggggtttctctaatccccactaacttcatttcccatgtggccttggcctatattggtgctcattcagacagcttgatagaccacagtcaactgactccacattggtgccttaaattccacatagcagaacaacaagtcagactgccttcatttgagttaagtgaccaaaatgagttaagtgagttaagtttggaccactcttggtccaaacagctattgttgagatgaacatagagatcatatgatacatgatgcgatttatgtctattcagtgttctgctaattcagaaacttggtaaaaatacattattaccaattgacagatctcatacagagatgtttgataatgtccacatagtcaaaaccaacgatggtctgcttgaaccttctctgcctcctgtctagttcttctcatctacctcactcattttctggacatatccattgccaaggagatgtctctgcccaagaaatggtctgaaaatgtgttcagaacctacaagccttctctttaaaggacaggatgtgggggaaatgcattcagtggctggaaatcaccctcacttgaaatgctttggcctgtgaaagaaggagactattacaatctactgaaatgtcaataattaaaagccaaaaaagttattggaaaggctcgccatgattcatgccaactcccattctccccagcatgtagcctcacaagatatataattttccatttgtgtatagtggagagttccaggtcacataggaatattgaaaatgggtgtaggacccagggtcttcaggctatttctgtctcaagttattttgattttcccttttgatgctgtcagaaactctggacatgatcatttgtgctggaaaaagcacaacttctgccctttgtttcgatcgcttttgccatgtgtgattggtgaatttgattgctggccacagaaaattgcatttgtgtcgggagcattctgaacagatcaatgtaggaggaaaccaggcaggatcaattgtaataccaaaggaccagtataaaaagtcatgcaactcacatgtcatcctatagctctcaatgtctaaacatcacatggatttttggccacaattcattaattaaacctcacaatatgcagtgaggtcaagtaatgtttgatgctagacatctagaagagtgggaaataacaccatgtcaatccaactgtctttatgcagagaatctgcaaaaagtgagacaacatgtaataatacaaataattattatagtcactccatatattttccaggggctggctatgtcctctatacacatttctaattttaacttcaagagaagttaaatctatcatttctattttatgactaataaatcaaacccagaagggttaaataatctgtgattgtccatgagtgtgcagcgaagtggggtctccggaattctgttctgactggctctgaacgtcatgcttttaaccgtctctatttattgtctttgtgtttttaaaccacagtgctatataccattaggaataagcattatcattgctgccactattcttgttagtttactaatactgccagatgtgtagtaaactaagtatttcctcttctccacaaagggatgctagggttctagggaggcagttattcatgtgattacatctgtaatatttgtatgcatccagcttgatcaagcagtttccctgtctattatgaaaaccagcttgtggaggaagtagggcaagtatcattcattccatgttccaagtgaagagagtgaggctcacagattgtgacttgtgcccaggaatggagagtggagctaggacgagaagtcaggcctcccagctgcagagatactgttgcttccactctcttgttcttctgtaacaggtagcagttgtttttgaagatatcacagcctaaatggaattaactttcttcttaaaagttggactgtctccagcctcccactttcttaaaaatgtgaaaaacaaacaaaaaccagttcagaacactttagccaaagagtgtgtcctaaatgagtgtgtcctactctctttaggcttggaccatgtcttatacacctgtttggtcctatctggtccctgataggctgccttcaacggagggaagcagtggaaaaagagcttaactgactgctagaagacaaaatttatgtcttaatgatacttaatgatttagtttcaacactgtttattagcaaaaaatgtttagtgatggcatcctacattctaggccctcactgggcactgagtagctgggcaaacttatacaggacacttaagttttctgggcctcaattctgtcatctgcaaaatagacttatgaatgcctttttccctactgcaaagagttattgtaagaataaaattaaatcatggaagtgaactgcttctataaactaatgacccctgtacttatgtgatgcattattttaggctctaaaaaaatcgtaaatgtatcagcaagttaagaatgtaccttgctacatgccccagggtaacagaatcgatgctagtgcagtgacttcatggactcagtatgctgggtgaggagcggactatgatgggcattgctgtgtcgcctctttctccctcttatggagggggctgccttcagcagggtggagctgctgctctttgtgcagccattctcttggaactgctttctctgagtggtgtgatttttgtagcattttcttcctttcctttctctttctggcaatggctctttgaaatattatttttgcttcctcgacggctgggctgtataattgatggcctctcggggttgctggagtcgtgcatttaaaccacgatcgccttggattcaacgcctcagagttcattactttttgaaatgcttcacgtctgtttgtgttcagattattgttgctctggagagagaggttattgtcaggcaggaagaggagtgtggagcagaattcatcataatcacatgctcttctcttctggacgaatatttctgggtaacaagacttcatatttatctggcatggctgttctgaaccagggaacccaggaccttcactttccccctgcagcctgctggagggagtttagcagcattcggtcttggaatgtgggaggctgctgctttgcaaataaagtgggtaataaaagtgcccagcgctcatactagagaatgatttagtgcagaatgtgtacatgtaggatttttaattaaaggtttggggtgcacttggttctcagcaatggtgttggtggagggagcatgctctctccacttgagctatgatcttctctcagttctgcagtggtcgtcccatccttcccagctcttgtctctctgtcacctcatggtccacccacaccattatcactcatgtatgtccacaccctggctcctgctctccacgctgcaccagctccataagcattagcaccccaaatttggtaaacccaaacaagtttgtgtaaatttggaatatactagaacctagtctatatggcaaatgaagaataactcctctaggtttccagaaatggagattcagagttgttggggaggctataactgagaacttttaattcagattctgccattctgtgcatttttattctcagactaaaaaaatcctacccaccccccttttttttttcagacagagtctcgctcagtcgcccaggctggagtgcagtggtgcagtctcggctcactgcaagctccacctcctgggttcacttcattctcctgcctcagcctcccgagtagctgggactacaggtgcccgccaccatgcctgggtattaaatcccacctcattctttaagactgaaattatccaacttcttgagcagccacccttagaagttccctacccccacctcattctatctcaggaaaattctcgggttccccattgaacttccagagctccttatttgtatcatggctgcaacattctttacattttttttgtaattctccatcttatgtctgttctcttttctctcactgtatctcttgaagacaggagctagattttttgtttgtttgttttatttctgaatgaccaccatctagtgtggttccaatatatgcttgacactaaagaaaggttcattgaattaatccatgaaagaattctgtttgatcaagtcacatttcgattttcctgttagttaagtgtaactgtatgtggaagagaagcagtgttgtgtgcgagggacacgctgattcatctgtcctttggaaatacacacagctcctcattccagagggacaggtagtcagatacagtttgttgggtggggctacttatacaagaccaggtggtaaaaagtaggcatttctaaaagatgggtttggtcaagtttggtcaattatggatatagaagcaactttccaggaaaaaaaaaaagaaaaaaaaaacctgtttgagaaaggtttttcatctcaatagcagatgaagtacttataagttgaaggcagtttcttttctttttgcaacatagcaattagaagatattgtcacatcttgtcatttgaaaattctaaattaggttatgcatgtaacaaaaatatatgctggtgtttaacaaaaaataaatatttgagggactattttctgtacatttctcaataggacaccaagtatagatatcctctcagattatgcttgacatgtgttattatattcatatatttcttagtattctgggggtgaggaaggattttagcctctgtgaatcctagttgagtatacatgcctaaagttttttttttttttttttttttttagacagagtctcactcttgtcacccagtctggagtgcagtggcacaatctcggctcactgcaacctctgcctcctcagttcaagtgattatcttgcctcagcctcccaagtagccgggattacaggggcccaccaccacatctggctaatttttgtatttttaatagagatggggtttcaccatgttggccaggctggtctcgaactcctaacctcaggtgatccacctgccttggcctcccaaagtgccaaagtgctggggttacaggtgtgagccgtgccgcctgacatgcctaaagtttttattgttactttgttactcaaacttctccttgacacattacaggagaatgctggattgcatggattataacagtctaaagctcagcaaagtgaaggtgattatcagcattttaaatgctgtgacattttgctgccaaaaagtaattgatttattaaagacattacaatacatgcatgattcaacataagaagttcctttgaatttgttcagtaccaaatcctgtgggagactatttgctttcagcaccacggacagaaactctttttcattcagattcagttggccttacacaagtaaatattatagctcagcagtggcactccaatccactggccacagtatgatccaatagctttaacattccaactgatgggtactggaatgttaatacattgttttccacttattttgccacaaagtggaataggggacacaagtggatgactttataatgcattattattaccttcactttgctaaaaatgaaggtactaatccataacaaatcagatgaaatacataacattttagaagatgactgattttttcctaacaagcaacttcttggcaatgctagatttcaaaacactaaataagaagccataactgagttcagtgattccacacctgatcactgaaccaaagagactaatgaaatgcctaaagctaataaaaaatcttgttgttgaaggcaatgaagccccaatggggcatggggtaaaatactgaaggatcaggatcttcatctgtcgtatgactatgactaatgcactcatcctgactgggtaaacctctagttaattcccaattgcttcaggcaatggatcaaaacttttaaaatacagggacacagtcttaatccagagtactgtttgcttccttattcactgttgattataaatgttccaacgcaattttatttctcctcactcacatgacaaaagaaatggaaaattttgatggagtaattcaggagttttgctgaatcgctcacatgaaattggattataaaatatatagccacattgatgcccaaattaaaaatatttatagaacacaagctgatagacgtcttagataacgtgaagtccaacctgtctccttacagatagggaggctggctccgcaggatctcatctcttgccttaggtcacagagataaacacatggttgggaggggcttattgcttgatgaaacaacaaagaagagaaggaaagataaactttaataatatgtaagttattttgtttccatttttattcagaaaagctacaaggcttcctttttactcaacaaaatgccatataagtaaacataattcccactttgcctttctgtcaggaggcttaaaaagaaatttccagcctaacctaaaaatttatattgacatttatggtttccataagaggtattctctttttccttggattttattttatgtgtttacccttttgttttgtgttttcattataagattcctcaaatttattggggaaatggtgaaatataaataattatgaaaagtttgatagacagccttttcaaatgtaaagtaatcatatataaaatatgacctggacaattgacgccttgtgtattttttgggatcaacttggctgtgaatcatttgctcgtcttaaaaattggggatgggggaagaatgttcatcatttatctcccaagaatgcatgatgaaggtaattaaaaatgaagtgaaaaagaataagaattttattagtgtagatataggttatgtaagagaggaagtatttttattcagaacaaaaatgtttgtaaaatattaaatgaaaatgtaggttaatagaatttagcatttaacttgtcaattgtattaatgaattcaaagcaaagaaaaacttgggcgtttcagttattcagttcaaacaattacattaattaagtaagcgggatttacttttttattcctggtcttatttatttttccgttcatttattgagtacctgctatggtttcaggcactctatactgtctgggtattcagagataaaagagaattgctcttctcaaagagttttcaggaaactccaccctctgctaaaatataacacaatgaactgctgcaagatgctggggaaacaaaaaagaggatcaaaaccaaaccggatcaaggtggagtggagcttgaggaaggctcctaggaatgagtctagatttaaagggctaagataaatttgttatgtaaagattgagagtctgccaatccaaagtaccctaatggatgcacaagagaaaatcctagggagagaggggcaggacacagatcttaatctagtttacagtgaataatggttgaaagatggaagtgggtaggcaaaggctctggtgtacgtgtgtgtggagagagagacagagacagagagaaagtttgggtgcattatggtaaaagataagataggagagctataaaatggggcagtccggaagggccttgccttacacctccagttaaggagtttacatcctgtgaaatgaaagagagtacttcaaaatgttataagcagatgagatttgcatttccacaaagatccttccaagtcattttggaagacggtttgaagagggacgaagctgacccactctattatagtaattcaggggaacagtgtggatggcctaaatgtagataattagccttgatgatgcaggagataccaagtggaatgtatctttaccagcagggactcatggggcttggcgactggtatgggaagaggaaaacttgaagaagaatgaggaatttccttgactggggggtagcatagcatagcagtttagcatgtggacactgggagcagactgcctcttctaaaacctcgctgtttgatcctggtatgcttcttaacatctcagtgcctccatttcgttattagaaaatagtgtaacactaacaatagtaatgttatttttcatacattttcagaaaattattggaaaatcatcaccgtttcttaaatctctttaaaggcctatgggaaccccgtttgaaagcttttgaaatatacaaaagggattgattgtctatggagagaaagtgattcattcaatatgggacttcacattcactttgtattgtgtattcacagtctaataaattattacataatttgtgaaaagatgaaagagaaaaagaacatcttcagagaggatgaaataatccaatagagagatgttggagatgattagtgaagacattcagaaggtagagagaaactgacagtcatgttaagtctaacatgactttcaaagaagctactaaacagtgatggattattattaaaggcagagattagccaagaagtaaagcaagcaacttcaaaggaacaagcaaaatgggaaaaaaaggcacttcaatccttaaaagaaaaggacaaatgatagaaatttttatacaactgaatggcttcccataagcaagtagctctggtcttccctcaagtctagaactgcaaactcacaggttttcaagtctagaaaagtaaaaacaaaaaacaaaaccaaccaaccaaccgaacaaaaaaacaaaaaacccacaaaccctctcaagctctcagacttttctataacttgtgtcctgggcagctgggtttaaattccatcaatctaaggacctgagtttccaaacactataagtctaatatgattaccaccagagttggtggttcagctcaccacctccactccacccagccttagagaatgaagaactaaaacccggtgaggctctcccatcagattttctttccattgtattcgctactaccagccccaggccaacataggccccttcctggaagaagcttcaggaaaaaaaaatggggagaagataaaagaagaaagaagtgatcaatttagttcatcatcatgtatgtaaagtcaataaatttaggctatgtatttaacttaaggatctcagaataagttatacaagtaagacaagtgattgtgctcaggacacaagcaattgcctattgccaaatctcatggcattttttcagtactctttctgtcataattgatgcagttgctaccactgtccttactgatgatactttctttaccaacttttcatgaaactactccctcttgactttcacccaactctcaccactccatctcagtttcttttctttatccaccttaatccttctcatgagtcatacctgttggctttcctctgggttccacatttgaatcttccttttatgtttttcctaggtgatgctactccatcatggcatcagcatgaagattatgatttaggcagtcatcctgctgtgttctgcctcatttcttttctaaattcccaaaggattacaagttgtctattgagattcttagcttttatgtcctgcagacaacttgagctcagtgtattccaaactgtttttattatccttggtacctaaccaggtttttggtttcaatcaatggggattgattcaggttgacttaacagaaacaaggagttgactaaaaatatgttgtataactcatggaattgacagaggtttgattcaaaaatgggaagggggtcaatacatagaaaaattacaatgcaggaagtcctgccagggcattgcatccactacagcttaatagtggcactgatgttggcactattgaaacactggcatttgatgcctcttctgttccttctgatacctctgaatgctggacatcccaacaggagtgaattctaactgtctctgtatctttgcatttttaactatgtatgcaaattccttgaccagagcatccagtagacagagaccaggtgacattcctatgctgcacctattagagtactataaggcaagtctgaaatcttatcagatttcaaaatggagtcacactatctagtttattattattattattattattattattattattattttaatctaggaagggtgttccgattctgggtagtagcttaaaggaatggcaaaaacccactccatatttcatgaggaaaccttatcttcaaccgttatttcccatgttaactaatgccaccaacatatatcagtcaagctagaaacctccatcatttgctagtttttctttcacttctttttaacacacctgttttgttagtagtgtttatttaagttcctaaccttacaattctatctaccaaatattcctttcccttgttttctattctgctctttccactcttatagaagccctaggtcatgactggagaggactttcatatttttaaacagtgatgtactagctaaggttgcatgctccagtgtctgatcacctgcatttgtatcaaactgcagatcatgctcactcattgtgcaaccctgggcatattatttaatctctctacgtgtcatgtataaaatcaggggaataataataatacctgccacacagggtctctgcaagaacaaattgaggctgtaggtgtaaagcattgtgtatgcccacaagcaatgtgcacacaatgatggtaaggtgacactaaaactggaaagtaataatgaggggtgaggtggtgaaaacagtaatgatggcagtagtaatctggtagctatctctaatacgtactctcttgaggatgcagtctgcattgctgccagcattatctttccaagcaaatctgcttcgaatccttggatggtcctcatttcctatggaataaaatccaaagtctttaacaaagcatataaacttctctaaaatggggccccaagttatccttttaccatcaaattctaccactgaccttatagtacaggaacacagaccacctcattttccaacattttaaagattttacttacaggtttcacatatgctttctgcttcctagaacactctcctttgctgccttggaattcacattttctgtaaggcccaaacacatggtgcctttctttgcattttcctccctgataccctccctgtgttcctgtcacactctatatttgcatctcacacggtgctgtacagtcctcattgcatatattgtcaacttctacacctgctggcacacccttgaacttaatgttcctatcttacccactcccatctctgttacataagaccagcacatagtagttgctcagggaatggttattctatgactgtaataatcaacacatttgtaatgactcttcaaggacccagaaacctggagaggcatgcccaccaacttgtcccagattagttaaccataccccactggccacatttggcagtgaccaaacaggctcagcatttgagggcctggactcttgatctctgctttcatcgtttccactttgtgcttggcaccaggcaccatggagaaactttagcatgataccgggaagacacagtcggtcatttttttctgaaggaattttcatgccaccataaactctaaattagcaggcatcatagttatgagactctggagccaaatttgcaatcaccattaagacaaagaggcaaaggactgtgcatgtcccagcaaggtattctaaaacagaaatcgctactccctttgacaacacaagtgtcatctgaaaaatctccatgttctttgaaagcaccagacaagtatatcttctctaggtctacctggtcatagaaactttagactcaccaactccaaaaagtaaagtgtggaacttggtgtaaagtgcttccattcctgtttctggaacttaatattcaatacaaatttaggccatcactagatttttcaaatgacacctgtgttgttaaaggcagtagcgatttctgttttagaataccttgctgggacatgcacagtcctttggctctttgtcttaatggtgattgcaaatttggctccagagtctcataactatgatgcctgctaatctagagtttctggtggcatgaaaaaatccttcagaaaaaaggaccgaccgtgtcttcccagtatagtgttaaagcttctctatggtgcctggtgccaagcacaaactggaaacgatgaaagtggagctgaagattttgtatttcaaacattttactaccgtttttgagagcctcttttgaaagcagtgagtttacgggggtgtccgtagatcttcctgttccatatgctgtgtttacccacagaagagggaactttccctgacacttctgcctcctcaccaaggcagagaaaagaggtcctctctttgctcctttgctctgttctcccgggctgaggctggggatccagttgatccagacagttactggctgcctcccaagcaagttcctctctcagctcatcctctttgtgcttccttggcacagctgtggggggcagtgcactgccccagttcctacatctcacacccatgtgagtgctgctgtttcttttaagacttttctactgactactgtataaatggatcagattggcttaaggtggagagctgcttcttttttcttgaggcaggacacaggaaattctttcctgcagacccccacactccagtcgtccggtcctggtagttaaaggtggtgaaaccctctcattcacctgaagcctggctcttccctcaatggttcagacctggaaggaaagaccagagaaagactaggatttgggccacaaagcttcaaaactgcattttttcttttaaatgtaaatttagattatttgtaattacacaagatgaatttgatgaacaatgagctacacaaattttttgggaaaaataatattcatttctaggcagttgaccttcagtcagatccacacagcgtcatgaacgtaccatgtcattgtgaacctatgctacggcttcatggcgtcagaggtgccaattcagaaacggtgtggctgggccttctgctttcagcttacctttttttgttgttctaatttttcttgatttggattaatactgtactctgccacagcacgctggattattttgctgcgattgtttataaggagtggcatccttatgagggtatttgatctgttattatcccactttctcttgaaattgtcgtatctaggctcagtgctatagaaatagaactttaaaagtgaaaaacaaaacaaaaaatctcactgctggaagacatttcacactgaaacatctctttctgtgtcttgctttctatcactgtcactctcactccccccatatgtgtgcacatgtacatacatgtgaatgtgtatgtctgtgtgtgtacacacaagcgaatatccaaacagacatttatgcacacattttcttgagatatcaaggcttttatgttccccataatgtgtgcctcttctctcacttttctttcttaagggaggaaattttcttccatcagaatatcactctgagataagccctgcatttataatgcacacaaagactttttccagtacttgtctaatgagaagcgatgcccaaaattagagcttgatgccttccaattatcctattgcacatgattttgttataccacaaatagttattttcttccttccccaacagctacataaatgggtcgtggtaatccactccaaaacaaatggctcagtattgctaactttgctgcatataacgcaaatctctccattaataaagaaaaagagtgtctggtcatttcataataattttaatataattatttttaaaagatatgttggtttaaaagatatggaggagggttggaagttagttctcaagagcatagctttcatgaaaactgggagagagcccaggatggagtaggaagggggctgcagggctgggtggcatccattactttcactttatttttgggctcggattctttaacgttgaccctgctttgtgctcaggcaaataatgggtcaaggcacttcaaagcagacagctgctctggacttgattcatcctaatcagaaataactgccgcccttgcctattcatcgctttcccaccctagaaatgggggattacgggaagaatgaagtcaaatctaaagagttctgccttagatagttaagaggatgattgaaatcaataaatcccaggctttcgggaagcccacttgattccaagtttgctaaagacggaaagaaagaactccaacaggagcctctggtgaccagaactccaccactgagccactgcggtggctctctcatcactgggacttcccagcaggagcctaagtattactcgattccacctcattatggtactctccccatgaggagtgtaagtcacaatgacaggacaacaaaatggttgggagacacagccaccaagggaagcaggcagtggatggccagcccctatgaatacactagcttgcctctttccagcagcccaaatctccttggagggaatcccagccagtcttggatctctaacgcagccttctctttttagtttgactggtatcccagctccccgaggaacctgcaggccacttgaaattcatgatgacagcagcagataaagactccatcttatcatccacgtggccactgctttagacagcctgctttttaaatttttattttttaatgttttgttttgttttgaaatgttcgggctttcaggtcatggcattgcagccattcctcctattttttttctttaacgatatgtaaatactttcatggaggttgtcttatttggttctcagaaggacactataagacaaggcagttataataatttcagttttataaatggagcaaatgaaccctaagacatcaaaccactggccctcaaatgcaccagggataggactcttgcaggtttgcccttcttccagttctcatcccattaccgcttccgagccccctgtggggatccggatgatttcctcaaacgctaggtggcgccctgtggagtgcccccatgctcacactttcagagggggtttgtggcagccatagctctatgaatatgtccattcccttgactccgtgtctaggagaacattgtctacatctgagtgccaggatccacatctgttcaattgaatagactccactgaatacatcagagaagcagggccagactggctacccatgccctttctaatctcactgttcaattccttggggaaatatgctactttgaggatgtcttcagtgccttgcttctcttttcttcattttcactggaaaggaggttgctcagatggcgtgtgtgtgtgtgtgtgtgtgtgtgtgtgtgtgcgtgtgcgtgttttaaggattgaatgccctgaaaaaacaagatgagacctagaagtatgttcagcaacaccatatctggcttctctatactccccttcatatttttcttagctgttctgttttagttagcaccaatatagtgctccccacccacgtatccctttagggtgaaacgcctgctcagtgtgcttgggaaaggcagtatattttaggcagcctgataaaaggctctaatagccccagattaatgcattcattcctagccaactgaaggattcattacagtgctcaggctgaggctcctctgacaaatttgccctgggtaatgagccattcagcagctaactaccctgtgctgctggtgacctccagaaggggcagtgagatggagctgagcagacacaggtggagtacaaaagaagggagagatttgaggcatctctgggctttggggagcagttgtaagagcaagaaggtgcttctgagaccacatctgcctctggagctatgacaggagcgtgatagggtatgtggcgcctctgtactttctgagcctaacaagtgaggttcagagcaaggcaatgtaaatctctgctttgaaagtgaacatggattgggtaactaaaaagagagtgatacgtaggagaaacttccaaagaattgcaatctgtccctctgactaacatgtctacgtggagacttccaaaatggaaaatgagacatagcataacagaaagcaagaaagcctcctaaagataagctagcccagcagctctgcagagtatgactttaccctccagggaacatttggcaatgacttgagacatcctagtttgtcacaactctgtgcgtgcgtgtgtgtgtgtgtttgtgtgtcagggaagaaattagcatgaagatgctactggcatctagtgggtatagaccagagattctgcaaaacatcctgcaatgcacaggacagccccacacaacaaagagtcatccagccccaaatgtcagtagtgctgaggttgaggaacccggactaacccaaacgcctccttttataggagacaaagctgaagacttgagaaaagtgcctggctgaggggccagaaacctgtgtcttgtctccctccaggccatgcaaggcttgcttttgaatgctgtcctggacagtactttcagaaatgaagaggttccttctcctcccagactccagggcacccttcccagctcacatcttcagaaaggaaaattccactgcctgccttaatgaacttacgccggtctctaaacactttagtctaggaatatctcttctgggggttagcttattatctttattatgcattttagaggtggatgttactgcagataaaaataggaattcccagaggaaccagcaccagcatcatgatatgctgtatgtgcaatgttgttgcaaacagttccccatgagggtgagatggagacccctgcatatacacataactgtatctcacaattattaaatattgattcatctcagcaggggcctgtgtctgatttaaaataaaggcaagtgcattaactgatgctaatctaatctagacctatagcactgcaccctgggctgtctccactgaccctggttctctgattgacagtgtgcatgggagccatttcctctgccaaccattttgactctagaaatgcgcacacatgagtttatatctggagttataggatatgtgggatgtgagcataagagcttaataagaaagaaaggaggcctacatgatgatgaatagcaattacagggaattagattagtatcagcatctggagtaattgtaaacattttctggtgctgatgtttgatagtgttgggaaggggggcaggtggtggatgatagaaaggaagagaggccaaagataagaacaaatatgcaagtctatagtgtgtgcttaatggaactgagatttgtttctctgtgtgtctttttaagcctctagatagatcatgaaaaatacagccagctgggaaagaaatagcccaaatgtaatttaaaggacagctttttaaccaatacttcaacttggagacacctgtcctatgttccttaaagatgctcagctcaggggaggagtattaaagttgctgatttatcttcaggagcacagacctatttttaatttattgcccagtgacaggtttcttgtttagcttttctgtgttactcaacacaaccttctcagtaaagaagagctgcctgcaggacattgttttatttcatgttccagagccttagaagaaggaaccgaacttggacttctccaaagcatgttgacactctctctagcttcatggcaagcagcaaattgtgcaccaggaaatatagttgccttgcccactgattcacggcagatacacacacacacacacacacacacacagacacacacgatacttgagtgccttttggagtgtgtgtgacagcaatggtttaatcactcctgtgtcaatagttatgtcatagaaacctttgccagaaatatgtcttttagtactgtagagccacaagaaagaaaatgtgtgtgattcggtttatgcatacaaatgaacaatcgtttgtggtgctcctactattcgcaagaaacactgttccatgctgggggccataaaggcgaagcacacaaaagagataaaaacattataggtcctgccttctagaatctcatattcttgtgggaatgataggtacatatacgaatagttgctaagacaaactgtgatatactcgatcagagtggtttgaacaaagggcaaagaaggaataaattaattctggccaggggagttcctctgttcaacaaaatgatttgagcccttgttgtgtgctgggaattgttggtggaagggacagagtgtgcacaatacaaggtttggttctcatagctgttacattccaatgagaagagagagacatcagacactaaacaaatgagaatttcagagagtgtcatgagccatactaataaccaaagcatggtaatgagataggccaggaagctatgtgaggtagcatagcaaggaagggcactgagaaggggaaatttgaaatgagaactaaatgataaacaactaaatatgtgacactctggataaagagcatttcaggagaggaaagaaactataaaggcctgaaggttcttaaccttagcatctttaagagatagaaagggccgggtgtggtggctcacacctgtaatcccagcactttgggaggccgaggcaggtggattgtgaggtcaggagttcaagaccagcctggccaagatgatgaaaccccgtctctactaaaacctacaaaaattagctggccgcggtggcaggctcctataatcccagctactcaggaggctgaggcaggagaatcacttgaacccaggtggcccaggttgcatttagccaagatcatgccactttactccagcctgggtgacagagtgagaatccatcttaaaaaaaaaaaaaaaaaagagacagatagcagatcagggaactgagtgaattctgggcaaaatagtccaaggtaaagtcagagacttccttcaggggttagctctgtagcatcttagagacacagggacacaggtatggattgtgaatttaattctaagttcagtcaaatgccattggaggtttataagcaggggatgatattatttgtttttttttgtcattttgctttgttttaattactctagtcatgatgtacagagtggaatgtccgtgcaaacagtaaaaacaggaagaccacagatgtagtaagagtagaatagacttggatagtatttaccagaggggaaaaaacaggtcagtgtccacaaaactaaaaagcattgttgcagccccctacccctgcacactgcccctctggaatgcttatgcttgcggccaccacccaacgaagtgctgttgctggtggtctgggagcagcttagccacccaaccccaccaccatgctagagtgctttcaaacctcagctccctctacaaagtgctggtgccagtgatctgggagcacctcgctcccaccttccagtgcagccagtgctcaacctcaaggagacagaggacaaagccacagaccaagttccagcccaacagggttagagcacactgcccaggagtgatcagctgagccttggccctctgaacacctctggaaatgaagccatttgactatacccagcttgcatcgcagtcaagccctcaagggctgtaaagaacataaaaacaaaaagccctatccaaagacagtaacttcaaaggatagaggaacatcagccttcacatgagaaagaataagcacaagaattctgacaactttgaaacccaaagtgtcttcttacctccaaatgatcacactagctacccagcaatggttcttaagcagatggaaatggctgaaatgtcagaaataaaatttcggatctgagtggcctggaagatcaacaagatacaaaagaatgttgaaacccaatccaaggaaaagagtaaaatgatacaagagttgaaagatgacatgaccattttagaaagaaccaaactgaactgctggaaattaaaaatttactataagaattttataatacaattggaagcattaacaacagaatagatcaagctgaggaaagaatatcagagcttgaagatcactcctttgaataaatgcaggcaaaaaaatttttttaaagaatttttaaaaatgaacaaaaccttcaataatatgggattctgtaaagagaccaaacctacaactcattggcattcctgaaagaggagagaaaacaagcaacttggaaaacgtatttgaggatatagtccaaaaaattttcccagtgtggctagagaggtcaacatgcaaattcaagaaattgagagaacccctgtgagatactatacaagatgaccatctgcaagacacatagtcatcagactctccaaggtcaaagtgaaagaaaaaatattaaaggaagctagagagaaggggcagatcacttacaaatagaacctcatcaggcaaacagtgaaactttcagcagaaaacaaacaagccaaaagaaattgggaacctattctgagcatcctaaaagaaaaaaattccaacccagaattttgtaacttgtgaaactaagcttcataagcaaaggagaaatacaatctttttcagacaagcaaacactaagggaatttgttaccaccaggcctacttcacaagagttcctaaagggagtggcaaacatggaaaagaaagaatagtacctgccatgcttaagtatgtagcccactgacactataaagcaactatgcaatcaagtatatgtaacaatcagctaacaacataatgacaggatacaatcctcacatatcaatattgacattgaatataaatgagataatccccccacttaaaaggcatagtgtgtaagttgtattaagaagcaagacccaacagtctgctgccgttgagagatatatctcatgagtaacaacacccataggctcaaaataaagggatagagaaagatgtatcagtcaaacagaaaatgaaaaagagtaggggtcgccattcttatatcagataaaacagattttaaaccaaagttggtcaaaaaggacaaagagaatcattgcttaattataaagggctcaattcaacaagaaaacttaactatcttaaatatgtacaaacccaaaatcagaacatccagattcataaaacaacttcttagagatctacaaagatatttagataaacatgcaataatagtgggagactgcaacaccccactgacagcattagacagatcattgaggcagatatctaacaaagatacactgacaaacatgacacttgaccggttgaatttaattgacatctacagaacactccacaacaacagaatgacaacagaatatactttcttcttatctgtatatggcacatactctaagatcaaccacacactaaaccataaagcaagtcgcaataaattcaaaaaagtcaaaatccaccaaccatactctcagaccacagtgcaataaaaaaagaaattattaacaagaagatctctgaaaaccataaaattgcatggaagttaaacaacctgctcctggatgactttggggaaaagaatgacattaaagtaaaaataaaaaaataaaaacaattttcgaaactaacaaaaatggaaaaaaaaatagatcagaatatttgggacatagttaaacagtgttaaaaggaaagtttatagtgctaaaaacttacatcaagaaattagaaagatctcaaattaacaaccaaatgtcatacctagaagaactagtaaaacaagagcaaaccaaacgccaaagataacagaagaaaagaaataaccaaaatcaaaacttaactgaacaaaattgagatgcgaaaatccatacaaaagatcaacaaaactaaaagttaagattattaaataagagagaagatgcaaacaccatcagaaatgacaaaggtgacattacaaccaaccccatagaaatacaaaaactactcagagactattaaaaacacttctatgcacacaaactaaaaaacctagaagaaatggataaatttctggaaacctacagcctcccaagattgaaccaggaagaaattaaaatcctgaacagaccaataatgagttccaaaatttaatccataataaaaagcctactgaccaaacaaagaccaggaccagatggattcacagtcaaattttaccagatgtacaaagagctaataccagtcatactgaaattattccaaaaaataaaggaggagggactcctctctaactcattctatgaagccagcattataaagacacaatgaaacaaacaaacaacaacaacaacaacaacaaatcttcaggttattatccatgatgaacataggtacaaaaatcctcagcaaaatactagcaaacctaatccagcaacacatcaaaaagttaatttaccatgatgaagtaggctttattcctgggatgcaagggtggttcaacatgtacaaatcaacaaatgtgtttcactaaatagaattaaaaaaaacaaaataacatgatcgtctcaataaatgctgaaaaggctctcaataaaattcaacattccttcatgttaaaaacccctcaacaaattaggcatcaaaggaacatgcctcaaaatgataagagacatatatgacaaacctacagtcaacataatactgaacggacaaaagctggaaccattccccttgagaaattcaacaaggcaattattaccactctcaccagacctatgtaacataatactgaaagtccttgccagagaagttgggcaagagaaagaaataaaaggcatccaaataggaaggtaggaagtcaaactatctctcttcacagatgatgttattctacacctagaaaaccctgtaggctctgccaaaagcctcctagaactgataaacgaccacagtagagtttcaggatacaaaatcaatgtacacaaatcagtagcatttcttccttttttttttttttttttttttttctgagacagggtctcactctgtcacccaggctgcagtgcagtggtgtaatctcagctcactgcaacctccacctcccagtttcaagtgattcttgtacctcaacctcttgagtagctgggattacaggcctgtgccaccacgcctggctagtttttgttcttttagtagagatggggtttcaccatgttggccaggttggtctcgaactcctaacctcaagtgatctgtctgcctcggcctcctaaagtactgggattacaagtgtgagccactgcacctgactgaaatcaatagcatttctctacaccaataacttccaagctgagaggcaaatcaaaaacacaatctcaattacgatagccacaaaaagagtaagatacctaggaatacgtctaaccaagaaggtaaaaaatctatacaatgagaattacaaaacactgctgaaagaaatcagaaaagtcaaaaacaaatcgaaaaacatttcatgctcatggataagaagaatcaatattgttaaaatggccatacttcccaaaccaatttacagattcaatgtaattcctatcaaactactaacatcatttttcacaaaattagaaaataaaaactgtactaaaatctatatagaaccaaaaaaaaaaaagaccccatatagccaaagcaatcctaagtggaaagaacaaagccagaggcattatattacttgacttcaaactatactacaaggctacagtaaccaaaacagcatggtgatgttacaaaaacagacacgtagaccaacagaacaggatagaggcctcagaaataaagtttcatacctacaatcatctaactgttaataaagttgacaataacaagcaatgggaaaaggactccctattcaatagatggtgcaagataactggctagccttatgcagaagattgaaactggcccctttcttttaccatatacaaaatttaactcaagatggattatatgcttaaatgtaagacctaaaactataaaaacccttgaaaacaaaccaagaaaatatcctcctggacattggccttggcaaataatttaggactgagtccccaaaagcaatagcaacagagccccaaattgacaagtgagacctaattaaacttctgcacagcaaaataaactgtcaacagagtaaaccgacaacctatggaatggaagaaaatattcatcaactatgcatccatcaaaggtctaatgtccagaatctataacgaacttaattcaacaagcaaaaaacaaataaccccattaaaaaataggcgaaggacatgagcagatatttctcaaaacaagacatacatgtggctaagaaatatatgggaaaaaaaagctcatgatcgctaattgttagagaaatgcaaatcaaaccacaatgagataccatctcacaccagtcagaatgctattattaaaaagtcgaaaagcaacagatgttggcaaaattgtagagaaaagggaacaggtttactctgtttgttggaatgtaaattagttcagccactgtggaaagcagtgtggagatttttcaaaggacttagaactacctttcaatgcagcactcttgttactgggtatataccacaaggaaaagaaattgtcccactaaaaaaaaaatacactcatatgtttattgcggcactattcacaatagcaaagacatggaatcagcctatatgcccatcagtggtggactggatagagaaaatgtggtacatatacaccatggaatactacacatccgtaaaacaaatcaaatcatgttctttccagtagcatgggtggagctgcaggccattatcctaagtgaacaccaaatacggcatgttcccacttataagtgggagctacacattgaatacacatagacacaaagaaggaaacaatagactgtagtgactacttgagagggggaggatgggagaaagatatggggtgaaaaactacctattggttgctatggtcactacctgggtgactggatcattaatacaccaaatttacccatgtaaactcacaatttacccaagtaacaaacctgcacatgtactccctgaagctgacataaaagccaagagaaaaaaagaaaataaaaagcatcgaatccagtttttggcctgtgagagtgaagctcaaagggaggttaaggctgatggcatgaatttggaaaccatgggtatctgatagcagttaagccacagatgggatggaagggagttttagttaaagaacagggctgatggtcatgaaatagaccatgtcagcatttagagtttgacattaaggaggagtagccagtaaggtaagtagagaataaggacagtgtgatagcatcaagccaaagatggaagggtagatctgctcaagtactgctgaaagattaaattatattgaggacagggaattgggcattagatttggtaagatgtacctcctgggatttggttacacagagattggggaaaatgattctattaatagttggattggtgagtgcatatttgtgtgtgtaattctatttttgatcttttaacatgtcctgagtactatgtaaataatctaaattaccatttgtcataaccaccctattaggtattgttttttttttaattttgaaagagagatgtttattgatttttaatttttttattatttaagttctagggtacatgtgcacaacgtgcaggtttgttatatatgtatacatgtgccatgttggtgtgctgcacccattaactcgtcattgacattaggtatatctcctaatgctatccctcccccctccccccaccccacaacaggccctggtgtgtgatgttccccttcctgtgtgcaagtgttctcattgttcaattcccacctacgagtgagaacatgcggtgtttgcttttttgtccttgtgatagtttgctgagaatgatggtttccagcttcatccatgtccctacaaaggacatgaactcatcattttttatggctgcatagtattccatggtgtatatgtgccacattttcttcatccagtctatcattgttggacatttggattggttccaagtctttgctattgtgagtagtgccacagtaaacatacgtgtgcatgtgtctttatagcagcaagatttatattcttttgggtatatacccagtaacgggatggctgggtcaaatgatatttctagttctagatccctgaggaatcgccaccctgacttccacaatggttgaactagtttacgatcccaccaacagtgtaaaagtattgttattatttgcattttgaaaacaggacactgagaaattaaataactttctgaaacatatgtctgtttatacatttattacttatttatttgagagacaaggtctttccatgatgcccttgctggggtgcagtggtgcagtcttggctcactgcagcctcaacttcctgagctaaagtgatccagcctcctgagtagctggatctacaggatcatgccagcataaacagctaagttttaaaaatttttttggaaagatggtggtgttgctatgttacccagggtgatctcaaattcctaagctcaagccatcctcccacctcagcctcccaatgtgctgagattacaggtgtgagacactgcacctgcgcttataaatgtattgaatacgactaaactgtatacttaaaagtggccaaaatgataaatgatagatacattttaccacagtaaaagctttgaaaaactatggctagtagatagtagattcaggattggagcctgagtctacttggctcccgagtctgagttcttggctatggtcatattctgcagatttgcatagagcccttactgaatattaatccattcagatagagagcaatgtgtgatatttatcaagcataattagagagaagactagaagataagtggggaaggaggagtgcctaatgtctcaggacatgtactttaaaatttattctgtgggtggacagagttggcaaattttgaacttttgaattcattcactcatttagtatcagccatccagccaatatctaataaggccctaatggaagacaaggtgtgtttagctaggactaaatgatcagcaatgtttcagacatgtagacctgaaaagcaagcatcttgtaagacaagataaacattatcaaccaaggcaggaagtacggaaagtggcagtgaattctttggtagaacagtcacagtctagggtggctagagtgctaaatgggagagggccttgaatgacaaagcatgggtttttaaatcatgttatgtggacagctatgattaatgaaacataaaagatcatgaaacatcagcaggagaaatctaagaaaggcgtgacaccacaggtagggatgtttggtgactgcaaagcatggtacatagagtgtagttcacctaattcatatggaggaggtttattacatggttaaagatacaaagggtcttaggttctgaatttttgttagttttgaggcacaacgtttgcttctatatgcttttctgtaattggacatattttggattgggtggtcaggctctttgatgtgcagagataaatgaacgctgttcagtggcgtacatcttttacagttctcaatagcaagagaagatgctggcataaaacccacacaattgcatttctcatagtaagtggtcaggtgacctcttcccctctgtatccatagataggggagaaattccttcctgagtgataccggggagtagatggccttgtgtcaagattcactgacatcctgatgggcctgctttctcctgctgggaactggtgagcgagaaagaagagttattgtcaaattcccaacttgccctttttgatataaagttcacttgtaattttttttttacttgtgttgctaatgcattttgttctcccaagtgtgagagacctagcttcctctgtagcctttaattagtttctgaatgatgacatgtctactgagaagcaactggttgcgtccctccaatctcggggggagataaaggaatctaataaagacattcggtatttctaggtgatgtgtttgacaagctttgtattaacaagaagtcatgttgaaacttctctctttccccaactgcactgcctcactcgctccagcactgtgacatttcacagggggattaacagagctgccactctcgctgagaacttgtagtttaaaacagacagacctgtgtctctacccctcatgctaaaggggaaggagcttcgccttgatctattcaccagccataacctttatgagggatttagtggcaataaggtcttggaacacaaaatcaacggataagtttcctttgacagcagtgggaccacctcccaggattcaagattcaaggtcggataatgagatgtgtcttcctcgcagctgcctagttattccctaagacggtggtcacaaggagtgtgggaacaactcaagttttaattctggcatgagcaatattgggactgtagcactagagagaggctgaaactcttctcagggctaatgaccctcctttgctgaactcaactgtgcagttatttggagaacaagagaaaaatctctggaattatttgcactttactgcagtcatggggtgaggtgtggtggggacttcaccacagccttcttactgcagtcagcataattccctgctgcatacagttttatagcttgtgtttgagtgcataactaccagtgcttttaggcaattaagaattaaagtgccgatgacgccatgaaggcagctgagaatgtaagtgagcttggcgctgttggcagccagcagattgacagctcagaaatgcaggtttctgcagagctgagagccgagagcggcgaccacctggggacaggggcttagtctctatctggttgacctccatttgacctgagtgaggcagcctaggagagaggaatgattattacctgagtatctcttaagggcaagaggagaacattagcagaatcatggctcagagtctaagaggttaccatgacctatacatacatacttacatatttgtttacctgtatgatatcaagatgtagaaatacaaacttcatcccagggtagagtaatggcacagactattatagcaaaatgttttttctctctgtgaagtgggtttctgaacagaagcaagggcatccaaggggcagagttagctaacatcttcctgattttgcagacaaatgacccctattgaaaaggtagtgggattacagaggttgaagtccttagaactagaacagaagtgtgtgtacctagagtgtccctctaattgaggctggagctgccagtggcaccctctacccatgagttttctaagcctaatggaatggggtcttgttccatttctatgaagatcttttggagattgtggaaaaagtctgtctaggggagagaagcaactaatggagtctggtatatgatagaagtggcagtcaccattgcacagcttacagtatctggtcacttgagtttcatgaacatcagctgcattcttgctttgggaaaggaaagtcacagtaaggtgccagatgccaaaagagcgaaagacacagcttaacgaggccttgcggttgagcctcaaaggatatggcaaggctatggcggttgggaactacaggaatagacaattcctggtgagaagaaattagaaacagtgatgtcagaaatctcttgccagcccctggctctgaggagaggatggatgtgaagaaaccttgcatgtcaggagatgttgctgagcactataaataaatcctggtcagcacatcagggttggtttttacagcaaacaattatgctgtttaccactaattcattgaactctgaattatctcaatcacaatagcattcatttgcagagtgattagtaattcactaagtgctttcaattatacctacatattttattggatcccaaatccctgtaggaagagcttgggtctgagaacagccactttctagctcagtggcttcgagcacatcattagcagggtaaaacctcagattcctggatgaaaagggagagtatatgggaagcccttattaggtcttcaacaaatattagttttctcccatgaggaataatattaaaaagtcatatttcctctgtttttacttctgttctcttcctcacgaaattatgtaatgaattagattaattgattcctttctcattgtgacgttatttcacgttttgaggatcttttgcttgtatacattttggctgtcagttttcagggacaccttattagagaatctgcagtgtgtctgacattctccatgatggttttgggttacttgtgtaacctctccaagcttcagtttctcgactacacggtggggaatcatgccttaggagttacggtgaggatttacaagggagcagcaaatgtggaacacctggcaaagtgctcggaatagaaggtgtttggtgtttcttttcttcccaccccatctatcctcccttcgtgaactggtccctaaagagagaggcctggtggtgaagggcaataaagccagtcatatagccccaacccaaagcatgcactgccatacatggaaaacacgcacagctgggaaacagatggccctgtctggatggcaggtccacatcatgatcactgatacaccccttatgtttccatgttaaaaaattgatgaagagacacttcttagtaatttcttagatgtgacccacataatagggcacttatgattacaggtagttgctgtgaaattcaatttttaccattatgccccgaagccaagaggcatggaataaggaaagaatggtatggactgcactctcttatgtctccatcaggaatgactaaaactcggtcaagaggcagagctcataaagacttccttccacatttcagttgatcctgaaaggaacaagttccaatcttcagaagcactggtttatgactaatcctgaaaaaatcactaggtttttttcctagagcttcagggttttctagccaacatgaatggttttactatggagggcgagagaaggaatgagatgtaacaaatgacaaaagggttctggtgaagagaataataatccactgaggttatgccattaaggagctttctacattttcaagctctcatttggaattctgattgactgtaatctgacccttccgttcttgaaaatgatggcagcaagcgcattgctgacaaaagaatggggtcctgttgcacagcgcaccctggcctggggcctgagtcctcatttaaagatgctgtttatcctcaaaccttgagcacatcagcagggcgtgtggtgcatcccaatgtccaaaccaaaacagccccctactgcactaaaaatctctatttctcttcgtattggtctctacaggtacacatttttagtaacactaagaaaggacatttgattaatgctttatgtataaaaagtgatttcttaacattttaatctgatccacagaacatctattttgaggagaaaagataggtgttgatatataatgaatacaatcagagactctaatgattgccatgcacttatacagctagtaactgtggggtgtgggcttaaaacctcggcttctgatatgaagcttagggttctttttttatcaaaagagaccttagggatcttcatgtatattcccatgattccatgtgcgtttgttatttttctaacccatattatttccatttgaaaaaacactgcgcggtggcacatgcctgtaatcccagcactttgggaggctgaggcgggcagatcacgaggtcaggagatcgagaccatcctggctaacacggtgaaaccctgtctctactaaaaataacacacacacaaaaattagctgggcttggtttcaggtgcctgtagtcccagctactcgggaggctgaggcaggagaatggcatgaacctgggaggtggagcttgcagtgagcctagatcgcaccactgcactccagcctgagcaatagaatgagactccatctcaaaaaacaaaaaacagcaacaacaacaaaaaaaaaacactgcaattttcagctgtatgtccttgaacaagttccttgactcctctgagtatcggtatcctcatctgtaaagtgtgggaactaattaggatgaccaatgcatccccatttgcctgaaatgcttttggtttcagcagtgaaagttttatgtctcaagaaactctccaattccaggtagacctgggcagttggttgccttagagagaatatctatttgtggggttcatacagtgaaaaataaaataaaggtaatatagccaaacacctgttatacagcaggtatttaataaatggtaattatcaacatcattatgttcacttacagtccttgggggcaatttaaagatcttgaggaaattcagtcatttcaatttgtttgcatttgcatacagccttgagagaatacagtaattcattcactcagaaaaattgttgaacacaaacgatgccaggcattatgatatgtgatgaccattttcaatgaacgagacaccagtggagcttacattgtacttaggagaggcagacagttgtgtagcaagccaggcaggctgggggttctcttgtagaaagggggtttgaggaagccttctgtgaggagctgaaattgaaataattagacagaaccaatgtgagtagcaggagaaaggcaagtgtgaaggatggagtcaaaggtgggcttgaggcatttgaagaggacaggtggccagcagggtgaggaagggagaatgctgtgggaagagcatggagagggaggcggcatccagagtgtgcaaggcctttgagaccaaagaaggagtttgccttcatgctccatgacagattcatctctccgttcagtgtggatgagagaagggaggtcctaaccaagcacatttgccacagcctgaatcccacctgaaccactcaactgtgcctaggcttcgcttgggtacacagtggcccttgggaaaagatggatttttctcaaaaccaacacctgcttggttgcatctttccaagctttccaatctgggttggacattcatgcaccaggctgttctcataggccttagtgtctctgcacgtggtctggaagccagaaaggttaagagcactccagatttgtcccattaattctgtaaagacaaaggtccctaaagaggccttagcagtgaagcagcccttgctgtgagaactgcccggaggagatgcgggcatctccagtcttcaagatagaggagaggcaggaggggaacccccactgccagccaaggaagccatctgggatctgtagatctgcatgcgccgtgcagttacctggtccaagtggcttatgtgcattctcagccccacaggactgcacagtgcttcataaagcatcctgatttggatttaataggatatccactgtgtgctaaaaacagcaaattgctatttattaatgacataattattaaaactcaacacctgggcagtggaagctaaaccaagagtagggaagttcctcagaatactgttttaataattatcttatttaattatttacacatttgaattaaaattcaataagagccggattaaacattaacctaatgtattaaacatggaactgtatccaaacagcatggctcccttggcttctgtctttcttcctaaacataccctaaccactccttggtctttcggtttctataattggtatattttctagattcagctctcagaagccaggaggcaccacatacatgcctgtgggtaaaagccaatgaccttttcaaaggactcttccactcatagcaggtctaatttactattggcacgtcagttcttacccctctgctctttacctttcatgtggattctcaaactgggatcttgcccagacctccgatcctctgattccaactgctaacataatagtaatattcttcctggatgtccctcatcatctcaccatcagcaagtctaagatagaattaatcacactaatgttctccccaaaagtagttccccctagaaggtctaggggtctccctgtgcagccgtccagatgctacttaacagaacggcattcctgctcgaccccatctccctggttgtcctcctagcaaccatttgtgcatttttcctgggcatggctctccaatccatcccttgcttttcatcttttcagagccaacagtttaatccaggctttgaacatcactgtcgattgatttctgtgactccagtttctgtctattttactccatctgacacaatgttaacagattctttttcttaaaataaatttttaaaaaattacgacatttcttttaaaaaacttcaaatgcttgtcactgcctgtaggatagagctaaaacctaggcactaggcattcacgcccttccatcatctggctgtcattcacttcatgatcttgtatcccatttttcattgattctgtcaaaatttatggactgtccattctgtgttgacactgcatatatgtgtttgccaagcacatacaatattaaaactcactcattgagcacttcacattgccagaaactgttctcaatgcatttcataacttactcctatgtctttgaaacagtctttatgaggttcagacagttattagctccattttataaatgtggagagcaagacacaggcaggtgaagtaacttggccaaggttgcccagttagaacatagtagagccggatctcagcccctgctctgcgttgcctcttgtagtcaatagacattgtatttcttcagtttgtggatttctgccttcccatctgtgcccatgcaattctgtcccatttgaaacagcttcactttttctgcctagatacctgtttctcatttgttgagacctaaaataaactccaatttgaggtgaagccatctctggaactctctctagctgttatcctccctcctagtaactcatagcacttaaagtttgtactgttcattcacattcaatcatacacaattttccaacatattttgccttgttattcaactctctggaatgtttacatgccctgtttcctcaaacagattgtaagttcatagagggccaggcaaattggtatatgtctgcatgtctttcatatacctagcacaccattgtgtaacagtaggtgttcacaaaatgttcattggatgacttttggcccagcttctaaagcaagggtctccaaacctcaggccacataccgatactgctctgtggcctgttaggaaccaggccacacagcaggaggtgagcagctggtgggtgagtgagtgaagcttcttttgtatttacagccactccccattgctggcaataccgcctgagctctgcctcctgtcagatcagtggcagcattaggtaggagcacgaacccttattgtgaactgcccatgcgagggatctaggtcgtgcactccttgtgaaaatctaatgcctgatgatctgtcactatctcccatcacccccagatgggaccccctagttgcaggaaaacaagttcagggtttccactgatcctacattatggtgagttgtataattatttcattatatgttacaacattacaatgtaataataatataaatacaatgcataataaatgtaatgtgcttgaatcatcctgaaaccattccttcccgcatccccagttcatggaaaaaattatcttccatgaaacctgtccctggtgccaacaaggttggggactactcctctaaagtagacttcttccattaacagttgtgcctggccacaaaatgtcttactgatagtgcttgccttatgttgtctcctttgcctaggatatctttcctccttttctctccagatatgattaatttttacttactcctagggcttaacttaggcatcacatatctaagaagcctcttgtggcatccatgtcaaggttggcttagatgtatatcctctgtgtctccataacacgtgattcaccattctgtgtcaccatacattagaatattaggcttctgcatctattttgatatcttgaggctgtgaactccttgaggaaaaggatggtatcttatttagtttatgtctctaatgcttggcacaatgctggcatatggaaagtgatcaatgaatattgaagaaggagtgaatgaatgaaaataagcaaaacaatcctagtatgtttctaacagtctgagtgatgagaagtcagatatagaatgtatccatggaaacaatataaaaatataagtagccctatctcacacttggtcagaagcttccttatgaggatggcttagctaaaaccacagtgcaccctaatcaattcaagtagtcttgaatactgacaatgtactagaagttgccacctagaaaatcatattttgactcccttagcatcttaggcatatgccaatttgtttctgataattgggattgctcccctagtcaaaccacctcatctctatgccatgaatgatctgtctttctcactcacccaagggcaatttgcctccttcaaactgtattcttaggcagaatttaaaggacagcaagcacttctcaacttctacctcatgagttggatattttccaattattagtggggggagacaattctagatgattcttccaagcatgaggtgcgattgtctcatttaatatacttactgcactgacagctctggcccaaaccaccttctgtcctgcttggggactgtccattgttctctagtgtatgattagcagattacctatcatgcaggaagccaggaaaatgaactcacagtaagcccttccaaagcaagagtaattcattacccggcctgatttccacttaaaatgtactttaagcacacttccaactacaaaccctaaatcaccctgtgttcacaaagtccatcattttttattttattgcatggcattggcgtgacataatcccttgcagagcatctcggagtgctttacagatcaataaattacttacctgcacagttgaagcaacgtctgcaaggccagcacagacattctgcaggcagcctgtcctccaggaagcaagcaaggctgtgtgggtgctaagagtgagcagggacagggaccagcaaacgtatgggttggtgttggggggtgggggaaggaggtggctggtgcatgagatgggaatgctctagttaaaactctgaataaaacacatcaaagtgtctatttttgcaatgatcaatttaaatgattccagaactaagagaatttagaagcttgtacccttcaggcagtcagcaaatcaaatgctcagtcattaactcatcagttacctttctgtcctggaaggctccatgtagcttttaaaatgatataaccataaatggcattgttacatcttaaaagtcccagattatagagctagcattctctctcctccaacccttgtccatgtccactctccattatttctgtcccaccaaatgcttatgggagtgcaattgagtgtgtatgtgtatgtgtgtgtgtgtgcatgcatatgcagagacacacacgctgcctatctgaagctcaatgaggatggaaatctaaaaatgattaactgttgcttactctgtgtaacataccctatttaggacagcaaaaaactaaaaagttaaatgaggatcttttcaaatatcttatattaatgtaatttatagtataaaaggaaaggtgggaacatgttacataaaagtttactttaaatgccgtataggagacactacagtgctgtggaatccccaggaaggagaggtcacatcctcttcaggttcatctggacagccttattaaaggggtggtaattctctcaggccttgaacaattttaatagatgtggataggcacagagaagagtgtaagcactgaagtcagcaacaagggcatggggataaggagatagctcagtgcagcacagataagtacagcacacgcttattaatgatgagcatttcaattgggtggatgcaggacatacatggaaggtaacactggagaaggagagaaggggaagaaggctaagatatctttataaactcccttttcatgaaggaaaagatccaacacaactaggaatgagtgagtaatggttcaagtagaggcaagaccagcattaaaatttgcaaacccatctgattttagtgtgagggccccactctgacctcgcaacaagcaataaagtcatcgtgcagcttccctgggctctccggcaggcccgatcacattgtaagccaggtggatggtgtgctttagaattgcacagcatggtggctctgaggaatagttattcaaggaaagaatataacatgaagaaacagaagagtgctggatggaggggacacttaacttgccaagaactaagaagtcaaaaccagcatcaggagggttgaaagaatatctgccaatgacccaactctgaggttggtatggacacgttgcacacaggttgggaaggtggttcccttgaataaccattatcactcaattctgtaaatatttgttgagctcttagcgtggatacagatataagtaacacattgttcaggtcatcagaaagctcatggcctagtgggtgatgctaagcacataaccatagcatagtgaaataactgtctagaattggagtgtgggagctcagtaaatgacatctttactccatccacttgaatgttaaaacacataagacagataagtagacacatggaaccaaatatcacatgtttactagtggtaaagctgagactggagaattaggctcagatgtgcagcaacaatgaggttctacgactggaccccggaaagaaacgcacacacatgcaatggctggatgttccacaggccctatccagtccttgtgggtgctgcttctgaaaataagcacatggaggagcacaacataatataagcttcagaaggttccaaaatagaagaccaaaggaagtagacatcctgtctccaactttacctattagaatgaaccccttctctccctagggggagtcatttagtggagaaagaaggtgggggagagagagagagagatgttatggctaactgaggcttaatttgattccccaccaggtgtgtagaatgtgctctgggcacatggatgaagaagcagcagtcaatttgagatgtccaaaagggcagagaagtatagagggtagggaaagtttcaacaaagaaagtggcatttgctttgggccttaaggatggctgcgcgtgcactttgataggctgaggctggtgaattgcttgagctcaggagtttgagaccagtctgggcacatggcaaaaccttgtctctacaagaataaacataaacattaacaaggaatggcggcacatgcctgcagtcccagctacttggactgaggtgggattgtttgagcatgggaggtcaaggcttcagtgagccatatttgcaccactgcactccagcctgggtgacaaagtgaaaccctgtctcaaaataaaaatgaaaacgagaatggctgggagttgcccaggaaggataaaaggaacaatatgaacccaaatactttatgcccagacagggcatgatggagaacaagggagtcagcagaggtgggatcactggggatggccatggaaaggtgggctgatgcttgattctgcatggcctcatgcctagaaggagtcaggctatgaccaggtggccatggggagccactggagctgtttagacagagatgtgatatgatcagaattgcattctttcaagacatcgctgaatgcagtgtggaggatggctcgtggatatgtgttggaggtgggtgggggtgagtggatacaggaagagggtggaggctaggagaacagctattccagtgttgcagtagaatttattcccattcggactccctgactttgtgtttaaataggaggaaatcaaagctaaattaaaggtaagacttttttatgtttaaggtaattcctctaatttcttatcgttaacttactgtagtccatatattttactctctggactgttctgccaactaccatgttaagacaactaagaaatgtttcaggaggatttttattttcattctgtcttgtttccacagtatctcccaaaattgtagagatttcttcagatatctccattaatgaagggaacaatattagcctcacctgcatagcaactggtagaccagagcctacggttacttggagacacatctctcccaaaggtaagagaacagtttgttgcattgcatcatgaggataaatgggggaattttgggcctttggtaggaggttatgggtgctgatacctactccagaggagtctacgtttttggtggcttgatggtaatctactcatggctctgcagagaacgttgatgttctctgcaaaacagccataccctctaagatttcagaattcatacctcagtatctctccagtcccttggaaattaatctctgttgtctctgggtgaaatggtggtaaggtgttctgggtgaactttacatgttgtttgatgatggaacaaagctttagtggcaattgttcagctggttgttttaaaatagagaaaacacataatgatgggtgagagctttaaatggccatattcctaaaaggagattctccaagtctgtgcctctgcagccttgccaaaaatctggtcacgagctgtttttgtggttttgttgttgttttactccgattgatcctagagaacaaatataacttaatatgtgactaaattgcaaaaatttactttatctgaatgctcagatgttacgtagaccaaagtgttgttttgtgctttcatggattgtacattaaaacctttagaatttgagacaagatgtcatttattattaagctagcttttatttgggaacaagaaagataaaaatatttcattcttaaatatttattgagtgcttgtaatagtccagcctctcttctaggcactgggggttacagcaataagccaaagcggtgaagttttcacactcatgaactcacattctcatgagacagatgacaaaaaaaaaaagagtatgcaatataacaggtggtattaagggtgagaaaatagaacaggatgtgttgacagaatgacaagagctttcttcagagaagggctctgaaaagaagatatttgtgcagagacatgaacagtggtccttaattgtgttgcttattgctgattaatgtgaaatgtgtgtatgtgattatgtatgtatatatgtgccggtgtgcacagatggatgaaggtgtgtgattggcatgaaagacgcatattagggggtgcttttggtctcaactcccatggaagggaaaagtgggaaacagaattgggcaggttagaagctggcttgtgcagtaggacatctcggctgagcctacggggagctctgaagctaggattgcccttcagaaggttcccttattgaggtgatggagctggtcctctacatcggcacagcagtccaaatgtaggctgatccccaaacaggtgtgactgtgggccaggcatctctcttcacatgagacacagggggctgaccaccgagggctatccaccagcagccggtccttctgtgaggcataagtcctctgctcctgaaggtgactgtgcatgacagtgtccactatacttcaacattttaataaatcagagtaagactatgaaggggccccaagtaccaaattctagacagtgacagttggccctaatggatgttctcagagaaggcgtgacattttcagttgtgtgtggcctgaattcctgggagctgtcctgggccaccattcttttttttttttttttttttttgagacggagtctcgctctgtcgcccaggctggagtgcagtggcgggatctcggctcactgcaagctccgcctcccgggttcacgccattctcccgcctcagcctcccaagtagctgggactacaggcgcccgccactacgcccggctaattttttgtatttttagtagagacggggtttcaccgttttagctgggatggtctcgatctcctgacctcgtgatccgcccgcctcggcctcccaaagtgctgggattacaggcgtgagccaccgcgcccggcgggccaccattcttgacactgtaactgtgaacaaggggtctttgaaagctattcatgtgtctgccagtctctccatttgaaatgacctcacatgtggactggcccaaaatcagggaggaagcttcagctgtgcatgagatcattagtgatggaaaatggccctgggcccttctgaaggaggggccattcagacaggtgcatgctaagtccgcggtgtgcaccattcatcacagcctgatgtgagtccccagtgctggcggatgccagcccagtctgtgcctttggagtctgcagaacatttatcatcagggtaagcttcctgtgcctgatgtcaagaggctctgtcttctgtttgatgtctcttctcattccctcatctggccagttctttgtccttttctgggtgtttcttcccccacttctcctgcatgcgtctcctttttgtcctgccattttatgcctataacttcccgataagttatttttgttgttgttctatgctttggctttctcttgcagcgtctgaaatgtttctgctttaatttcattattttccacattctctcttccctccttgcaattgtttgttgtcttcccctctgacatttgagcctcttgggtttgcctggctgatgttcacaaggctgtgtgttagagtcttttgtttccccttttgtgaccatcgaacagattcatttcccaagggaacttttgcctgagcctgggccaggtgtcccattttactgaggttttagctgctatggaaacagaagatggagcaaggaaagaggagcaggacaatcagaatgtacctgtggattaatttacatgaacagtgttttccagatctcaggtccagtttagttatcccggattcaaaatgatgagacatgccaagcaataactaatcacctcagaactcaccagagtgccatttcccagtgactgattatttggagatcagagatgtcacttggctgctgcccaatatgaactgaagctggagaccctcaacagtcaggccttcatctttccccagtagtatttcctaaaggaggcttattctaaataaaccaggatgggcttggtgttccttggagaagaagatctgcaccttagcggaggctccaaagaaagagcgctgttgtcatcttttgtgtcattcttcgagggtagatcacagttccatcaagatctttcttacatgcgaacctgccaaatccctggatgaacagctgatcagggctaagctctttcagcaaccctgatgacttcattgcattttttctctccagactgatctgtttgttctgtacatttcttaaaagtccttgtttccttcattatcacttatgtggtgctgcttgcgataaacttatataaacctctttaaattgtgcatttctagtcttgactaccttgtgtggaaaggagtacagaaatgttaaggactattttagacgtggctcatacactttgatataggggcagcttaggagtgaccatcaggtggaaacggagatggagggccctgtgtagcactttatatcagatagagaaaatgtcagttgtgcatgtccagtacagagagggaggtaggacctccaaggccacctcttggcacttccattgattgtttgaataatttccgtatattattatgggcattatgcctttgtagttcccttcaggaatttatcagaattcaaagagaaagtgagctagctttttaaagattcctgccctgactctgcacaactggtttgagatgggccgatgttgtttgcatctgcagagaccttggtcttttcaggaggaagagcccccatctcactcctctcactagcaggagccatctccatccacatgaaggcttattgaccccaagccggagtccttctaagtgctagcatagggtactaggtgcacaggcaccgttggtggaaccctaaccttctgtaggtagaaaaaaggaacagggcagccaactgcccactgtgcctggtgtcatgactctgtgctttgccctttgtctacatctagaccttcaagaatgtgttttttagcacatcccttaaactctcagctttctgtctccaatagaaaaacgttcatgctgtctggttctcctgagtcttcactatgtaaatagaagcatgatctctttcaatatactccaaaagatgctgtgttggacctcactcttcatagaaaagcattctgaaagccttattgttatgttaccagtttcagttggattgtaagagctttaaagacaagtctaggattcctacattgccacattcctgagagcccaaaatgaaactcaggtgagggagtgagtctcatcacttatctgtgggtgtcactatccatttgcagccagggatcactgagtgtcctaatggagctcccatcttgggtgcacttaccttcacctttctgtcatcaaacaagacactgacaataaaaacctcatctaggctacctagataacacgttgtactgagatattggtagggatattcagcaaagccctgcaaggtgttcacagaaatgtcctcctttccagtttattttcaatgtccctgtcccatgagttctttgagatcagagtttgcatctcacttctctttgattctctccttctagcacaatgcctagcacctaggaagtgtttaataaatattggtcagttcagtgaacaagcactgatatttgccaatgccccaaagaggcatgcctgttctcccagttcaaagactatcttgatccttcagaagttgtccttcactttgatgttggcatggagacctggagtgtttctggctggcgagtctccaggacattttctctggtcttcacaagatctccaagcctttcctgaagtccccttgaggggaccttgctgtggcaggactcaacttgtccttgaagaagaaactccttttcaagtttccttttgcaagaagagaggaggctcacaggtgacttggacagtgggtcatccatgagcttccttctgctgtcatggctgcctcattgcaactgctcttcatctggccattctagtgggcatctggcccttttggtgccttgctgtaccaagtactcctgtgtctaaaccccggatgactcccaaccactatttcctaaggcaatcccgatatcacctgggggattatttcaactgtatatgaaaatttgccattccttataggttaactaaagaaaaaggaaaagaaagaaatcaatcggtagaaaaaagaaaagtactttaaattcagttccactcttgtgcctctttctctctctctctctctttctgtgtgtgtgtgtgtgtgtgtgtgtgtgtgtgtatgtgtatgtgtatgtgtggggtgtgtgtgtgtgtttctcaggttctctctttctctctttttccttctttctctctgcctcctgatatatgaattgaggtgggttagagatcaaaagagatcttccctagggtgatataaagaccctgggggcagaattagagcagagccttctgtctgttggattccaagccaagcccttgttctgcaagcctttctctttacctaacgtgaagtgggtacatctgcgtggcctactctccataccaacagggctcagtaaccttcctcagctgccagatctcttccttcccacctcagttctccttttctacttgaagaggtccagtggacatttgactgccctgtttcttttttctggagttttaaaaggcaccaaattgatggaggcaaagtgacacccggataagagttctcctggccaatgccctgagccctgtgctccccctccccttccccaatatcctcaccccaccatacatccacctattttcctatttgtaagcactgacaaggccttctcctagccaagcaggacactaaagcactaattggcactagaggtatcacagcttgagttcaaccagagctggcaggttccatgactccagtgacagctctgtgaaaaagtgtcaggagcagagctctggcgtgccatcggctgactgcagcaccctggaactaatgagcagcctgtcagcaccagcatccggggccccgtgtggcgctgagatcattagaatggcagaggagaaagacttcctcagcaaagaggagctggggaggggagaagagggcaaaatggaactaaagatatcaccttacccacagagggcaaccacccaacaccaaaggactgagaagaaaaagggagaaagagagaaagcaaaagtttttctaaatccatctatgccaattctagacaactcttggaatctccttttggttgggttgccctgtcagtaatcaatatgggctgtaaatccttgcaataatccaagaaggggcctcagtgattaaattaactctttagtcttggctgtgctctgaaacctggaagtcgcccaagtctctaggaaagagggacctagggcgtaaggcaagacttgagatcttagtctttttgctatttgtcagggcaggctctctacctagggtatctcctgcactgccagctgcctgcctatcttctgctagagtatcagaatccaggagagacaattaatagaaggagttttcgctctgttattccttcccagagggaggtagggggactagtcagtgtgtccactctgtatctgcttcctgaggccaagtatgaattatccatcttgttcgttcttctgcttcaggaccagaactgggccttcaggtctgagcattaagcaatgcctggctcttctctgaggcttctgctactaacaatgactgcatttccatgagcaaaggcagcaatgtgtctgaaagagataggctttgaaggcaggtccaaggggatttgtattcccttgcactactcactggctgggtcatgctggagtagtgataaacctctctgaagatgtgcttctttattaatttcattcttgcttcttggcgtgaaccctggcgttttcatgatttggttctagaccccattttctccacacaccacagtcacactaacaacttggcattctccacacactagatgtctttgactttgcacaccccatctgttctccttccatcccccctacttcttttggtttgagttctgcccttgtttcaagaccatactcaagtgctaccagtttgaaagcctctggtgactttcttcaggcagagtgattcacccatttctttgagatcccacagcactttgcgtgcatttccaactatggcacctcttacaggtactcaagggcctctgactactcctgtcatgccagggatcatggcagccaggaaccaccctaatgctgttttgtctttagtgtctgataaagcaccagatgttttggggtcttgtaaatgattgttgaatgaggaagtatctgatactgtagatgtagttttcagtccctttctaaaattaagtctctcttaatttaatatgtataatattatattattaaaggtaatataatataataatgtatctctttgcatcagtttggactgtggatcatctcatatttcccaaaccaatcaaaggaattcataagaaaaggccctccccccccactgtcttcctcatgtgtactcaagtctgagctttagactctgtgaaatagagataataataccttcccacatggatatgacaaggattaaacacgtgcaccaatggaaagctcctggccccataacaacacatagtatgtgtccaataatgttagcttgcagaccttcagccagccccctcctcttcactcccacccgtgagaaaagaacggaagggaaggaaactcaagttattttttttctgaaaagattgaatctttataaaagctcaactcagtccattgccaaaatggatagatattcaaaggtgcttaatcagcaccactatcatctccaccattttctaattaacataggtgcttgattaaaattcccagtaccccaagaagctatcccaggagggccaagtaattgccattgcaaaagatattacagtagtcattgatggtgggagaacaaaaaaataattgcatcataatggaaagtggccagcttcctgttcagagtacctgtgaaacatagagcattaggttcaatatatacagaaaaaaagggattaattgtgacaaagataaaccagtggtacaacctcaaattggggaaaagtgtccaggaactccttacataagtggcttaaacacagacaggcagaccaaggtgggagagaaaaaagcagaggaagacatttatagatcactctttaactctgtcattctctttaactgtaaaattactgctagatagatgcagttagggtaaaatttgccagtgtcaataggggtttttgtaaatttaatatttatgatctggtttaaagcattattatagctgtgtaacttcctacttcaaagaagagagaaataataaaaagactagtggggaaattaatgagttcaatgtgctgaattgagaacatatgaaatcaagcctcattctagaaaccaagggcaggagtgcataccacagacactgtttgtggttttacccaattattttaaaacccttggaaaatattgtagaatcagatgtctgctgaattcagacattgctaacagcatcctcccccacactctccagagtcttaagctatttatgcctgtacttggtgaccgttaccatgcagaactgtcttgatggaacaaataaaggaaacataatagcaagaagattgtatcatcctccccacagaagccaaccagccatagctcagtaagatgcaaagtctcattaaaatggtagcccctacagggcaggagaccccatctctcaaccagcacccataagagtcagcaccgcctgggagtatgagaaggtccttagtgggatgtcccaccgcccatcacaaccagggtacctcctcgagtcacaccgctgtagaccagctaaaggcttggggagtttcttgtgtaggaccctccgagcactgccaaccaagctgggagaaactttcggatgaaaacgtccatatcactaggtcctcaggtgtatttttctgactttgtgcctactttcagatcctgagtcttgttttgacccatgacgactgcctttctcctggagtctaaataacaccagaggcagtatcattcaatcataacaatagctaacagttggtggatgtgcaagaatgtcgggggctctcttctaaaaacatttatgcatagtaatatctattcttcacaactaggcgagacaggtcttcttattagcccaccttatcaatgagaaaacttaatatgtttttccatttgaatgaggcttagggagatcaggctaatgggcccaggctaatgggctaatgtggcacagtgccacattgcagacgtgggttccaagccaggtagtcggtctgtccccagagtgcaggggcttcattgctgtgctgggtagtgtagttctcaaagggcagtctctggaccattgcatcaaccagcatcacctagttcatgccccagccttactgaacgacagctgtaagggtggggtccagcagcctgattttgacatttcctccaggtgattgtgatgcaagctcaagtttgagaactgctgctgtgtaaatgtgctctgtgcccagcaatcttcttcatcagcattatgttacttaattctcatggaggtcctaataagtaggcattatttttattttagagacgaaggcatgaaaatcagggggcaggagaaggaatttgcccacaaatactaaacggcaaaggtgaaattcaaatccaagactttttgactccaaaatccatattgttaatgcatattgatttcctgcttgatgtctagcccactgcttcatcttgctctctgggacatgtctattctctggtttcatcccacctaccagcttggggcacccggtctttgggttatgcacattctcacagcattcttacaaatttacccgcacctgtgtcatcgcgctggactccaggctctgctgtgtgccaggtctctgcattccaccctccccagcaacctcaggcttcttccagtaggtctggagatgagcacctcagtggcaaaggacagagcccttgtgtggaggttggacttcttcctcactggcagctgagctcttccaactgagtcaacctttctctttcctctcttccacctggatggccgtggcgcacaggacggacacagcctccctctgacctgacttttgttttcctcatgttaaatgctatcactcactcaaataatgctgtgtcttgtgcattgattattattagaagattgttttataccttaacagctttagacatgaaaagaaattgccagactccagggtatgtgtgtcctttcttatctgagtctgttcagtttccccacctgtctttgtgggagttggcattcttcatcttcctagctgtgtaaaatgcttttctctccagaaccaggacagttgaaagggattgagcagagcatcatttcagttcctcaaggccccagtctgccacctggctctccaaataccatggcacagccgcagcctgccttttgcactagaacccggagtcctgaagatgtggccccttccctgggaggctcatcttgccccttattctacccaacagtggtgggttcttctctgcttactgccctcaccccccacgcaccccaccctgaaaaacaaacctcttttcctcctcctaatccagagttaaacaaaatgactttggactttacagttcttccataatagattcaggactccccctgtttaactgatttgcagcccgggaggcgtttcctcccctaattcctttcatcactgccttgccctttatggagtgctttgctgagttgactgtggttgaagatatctggccagttatctgcaagatagaaaaagacaaatggctttctccctcattgatttatttatttcgacacacaccagtccagaaaaggatttaagcagagaaaatggtatggattttgtccccaggaaaaccttttggtaaagcaattttgattaacttatttgttcagtaattgtttattgagcacctactgtgtgtggggcaactctctgaggtactagagacctatgagtgaacaaagcagaccaaagccctggcctctcagaacttgtatgctagtgggagggagagaaaatcaacacatggctgaggaagccctgtaatatgttatatggtaattgctttagggtaagaggcaaagagatgatcaggtgtgtgtttgagggattgtagacttaaatagagtggtagaatggattcattaagaagatacctcataaaaggcggactgacatttgcatagctcggcaggagtactcctggcagggttcacagtgactgcaaaggcatgatatcaggacccagccggcacgctcacagaacatcaacatagccacatggtgacagaacctatttaaaaccttccctgtctgcactagactctaagcttcatgagggcaggaagcatgcctatccttgctcactgctatgtgcaccaatgtttagcaccaatttgcctctcaaatcatacacattcaatacatatttgtttaaaaaataagtgaataaaataaacatgagtttatagtttgagtacttgagcaagcatgctggaaagacatgagtttcgagtcagaaatggcagtcccttaattagtgatttcaaagaatgacaagttcaggccaatggcgggggtagcttatggctaagacagaggggaaggcccatgagaagatgaggccaggtaggtgacagcgcaggtgtctgaggactcatcacaaggagcgttgcagtcaccccagataatggctgaggctagtgacaagttgggctgtgagccaagtgtcaaagccctcgatgaatcttgagggactcaggatatcagtcattggcagaaaagaagagagggcggagcaacattgccaggtggcaggagcttcagaccagcaggagcagggctattcaataaaagtgtgaaagagaaaaggtctccacttgaggaggatcctccactacgaggaggatcatagacccaacctctgcatgccaaaacagacaactcaacattttcttgagaaagctaccgaggaggcactcccctcaggaaacagctgggtttcaataaatgaaggcagttcagggagcactctgcctgaaggctgatggtctcggggagcatcttgcctatgttgtgggtgttccagagagcccagtggatgggtgtggaaggtgggggagagtgaaagattggccagaagggggaaattcttttctctaggggaatgaatgggctggagagcctgatgatgttaggggagcaggagcagatgcacatgcctgtatgcaccctggcaataagagatgaggtgtgttggtgttaatcccacatgttcccagtggaaggtggtgaaacctcacctcacagatttcagcttcaacctgtgtctgtggcagggcagaaaccccttttcttcctgcccctgaaggtacagcagtggcagtaagtgggtagctctccataggccaagtcttcctgtggtccagagtaagaagaccaatcttcaggaaggcagtaaaaggtcaagggcagaggtcatgagatagtgggagtggagaagagagggtagggcttagagatatgttgggggccaaactgccagaacctgatgcttggtccaatgtaggatgggagtgagggtggaggacaggctgggaaagacgaccaggtttctggtttggcctcccttattgcctattcgggagaactaggggttctctgtccagcttttctcctgtgtggcaataggtagggtattatggacttgctgatgtctgatttatttctgcctgctgatccatgtgggttagctctcttttctacaaaaatgatcataacaactccagactcattttttaagagaagagggatttatcagattgaacagaaatgatagaatacagcagatatatgataaataggcagaatgaatcatcttttattcaatagatatttattgagtagctaaagcacaacagtgtatacttaggtgctgcagattgcatggtgaattcagcctttgcctcatcgggctgcagtatgggagtgtaggcaatattcaataaataaatatgcaacccaatgccagggagaggtagtgccatggagaaaaattaaaaaaaaaaagacatgggtgaagaaagccaggaggagctgcttttgttagagagtgactttagtgctgcaagaaagccagctcagcacagagcctagagacccaagcgagatgagacagcaagggcttgtatgaagagagggtgttccaggcagaggtaactgcaaatccaaggccatgagtggggaatgcatttggtgcgtatgaagaacagcaagaattctggtgctcagggaagtgatgtaggatgctgtgatgagagcccctatagtcagttcatgcatgaacctgaaaaccatgtgcaaaactgtgggacttgttctaataaaaatacaccagcacattttaagcaggagagcaaaataatttaataaatgtttccttttttaccttttttatttaaatttattttttattgtactttaagttctgggatacgtgtgcagaaagtgcaggtttgttacataggtatacatgtgccatggtggtttgctgaacccatcaacccatcatgtacattaggtatttcttataatggtatccctcctctagccccccaaccccctgacaggccctggtgtgtgatgttcccctccctatgtccatgtgttctcattgttcagctcccacttatgagtgagaacatgtggcgtttggttttctgttcttgtgtttgtttgctgagaatgatggtttccagcttcatccatgtccctacaaaggacatgaactcatcctttttatggctgcatagtattccatggtatatatgtaccacattttctttatccagtctatcattgatggacatttgggttggttccaagtctttgctattgtgaacagttccgtaataaacatacaagtgcatgtgtctttatagtagaatgatttataatcctttgagcatatacccagtaatgggattgctgggtcaaatggtatttctggttctagatcctttaggaattgccacactgtcttgcacaatggttgaactaatttacactcccaccaacagtgtaaatgttcctatttctccacatcctctctagcatctgttgtttcctgactttttaatgattgccattctgactggtgtgaggtggtatctcattgtggttttgatttgcatttctgtaatgaccagtgatgatgaggtttttttcatatgtttattggctgtataaatgtcttcttttgagaagtgtctgttcatatccttcgcccactttttgatggggttgtttttttcttgtaaattggtttaagttctttgtagattctggatattagtccttaaagaattactttaaccatgaagagaaagatggaggggagggggcgtaaagatagccagtaaaggcataaaggtatgccagttagaatactgttgatttcgtccatcaagaattgatgacgtcatggactgcagtggtaggatttgcaatctaagagtatgttaatctggaatatattctgaaactaagctagaaagttcattgattgattagatgaagtttgtgagaaagagctcagtattaagactgactataagatttgtggcctgggctgctggtgtataccatgctggtaatatactattcttgtccatcaaaaactccaagaaaagcatgcttgtggtaggaaagactttggtcctttagatatacaaatgaaaatgttgagtagatagttgactatgccagggagctagaaaaatgcatatgggaatcctaaccatacaggtggtgtttagagccagaggctggctatcccacatgcagcgtgaaggcagacaacagctttgtaggccaggaacagtggcactccaatagtccagtgtcaggaaaaggatgatccagcaaagacaattgggagatgagaaggaaatctcaaaaccagttcaaggagaatgtttcataaagagcaggtgtgattacagcacaagtgttgcttagaagtccagggagatgaggattaagatttggcaaaatgcacttatacacatgagacattggaaagaagggttctgatgaagacggtagataaaagattaattagaaagagggagaatgggttaaagaagttgagatagtaattaattttgctgagaagtttcactacaaagggaagcagaatatggagggtcagtggttggaggagagtgtgagttcaggattttttcctctaaagtccaatctgcagcctaatatcccttggtcctttactggctattattgcggtgtaattacttgtctcggtgttctctgttgttcctcctcctcaaataaaataggggaaagagttagccaagattggcctctgctttttgagcaatctatacattttgatcttcagccaaatgacctcaaaatttttatgtgtggcttttgggtgctctgggaatttggaacaaaagtcactatgttgctaaagcaattgactgtggctgacactaggtgctttgtctggaagtgagactatctgctgccagccctaatgaggattccactggggattgatagttgtggcacttacgggaaaaattgcttggagtgggaaccagcttataagaaggggcaggggacacagaacgatttctgctcatccccagtccctccccaaggaccaaggcagaagttctcaaagtcctcaatatttaaccctgcatgaccagatgctcacctgaagcaggggcgtatgaatgtatcttttttcaaaaaagatgccacagcaggaatcaagttaggcttttgaagccacccctctggcccacacacaagaagtcccctccttgtccaggagaagctctgaagggagtggaagtgcaggggcaacccaacgccacagaaatgtggacaaacactgcccaagtcgtatcctcaggggagtagggctctggggaaaatacctctgctctacgtaggtccatgccctgggaattctgtgaacatccctgctgcctcagtgctgtgaattctacatcaagggggcagaggaagcaggcagcctcagtgtttaggtttcaataatgttagggatgagggagagctcaccaacctggaaaacgtacctgccgccataccttgcccatctaatcttggcttccaggtgacttcctgggtattcatccaaaatgctcctcttcagagtcctaacaaacctattctcattgccaccattgccctagaggcactcctttcttggagagggaaagccagttgattgatagaacattgtataagatggggaataggagagaatagcttccatccctctctgtacccaccttctccccagaactcatggctcttgagaaattagagcaaattagtgagtgaccacagtgttttcctccacatcattctgctgtctttagttttgcttccagctgcccacactgaccagcccctgtgctgcttctgagcggtcacgttcctccgtgtgctgacatgtcttctctctgcatcaccagtttcctagacctcttggtttgggtcactcaggtgttgtcatggcaatgacatcctcagtagagtagcactgctcatgttgtcatggttatcaggacctcttgatgggagccccactgcactgttgtcatgcggagagcaggaaggaaccctaggaccttctggtaagcctggattcttaggctaggcatgagtcatctgtgcctgaaaatgaaggtggttatgattagggaaatagcagctgcctaaaatggtgagattctaactacttgagaaacgaataactgaaagagggatcatcatcctcatcaccgtgatcacctccttcccacctcctcttcatcctctgcatagtgtctgatatttttacggtagcttggctatgttccaggcactcttctaagtgttttccatttgagaactcctcatttttcttgacggccttatgatgtaggtgttcttgctgttcttttgcagatgagggaactgaggcgcagagcacgcacttagaccgcttgctcacaggtgctccctaacgtgcaatatggccaagacttaaccaggcaacctggttccagaggtttcactccgaactcattacctattctgtttcaatactaacaagaaaattcaagatgaatcaatctagttactgaaggcgttactaaattatatcaccttctttttggctagaatccatatagtttatattttttactacttttaagttttaaaatattttcatatgttcatttgattccaacaactgtctgcagttagtatgtctattaacggtattttacagaaaagaagatcaaagttttgagagttcataattccccaaggaaagttgacgtctaaactgtgttggacgaggtctgaattcatgacaatctgtagattcagaagctagtgttttgtcttgttctactgcatatcatgtcatgttatatggcccagagcctggctctggggaggaaagtggttcaaccatctaagataaatgggtagcagcagtcacctctatggatagaaggaccacatggcaagtcttggcatgttcactcaaggagccattcaccctcttttgccctcattattctatgcctaaaaattccactgtacagtagctactttatctattgccatataggcaagagagcagcaaccttccttccatggcaactgccgtcatagaatctgggctgccttgagcaagtcatttaacctgtacatgagaatcccaacagaaggttaattggctctgtctctaatataaatgacaattaaacacaaataagttacttagtagctggcctgtgagaaagtacagcttttaagagagaggaagctgagccctgagagtcgatgtatcttctcatttgagtacaaagggattgattggagggggacatgctgagtggggaacagcaaagctaataaagacgattataaacagtagcagcaaagacttctcattttttaaagtatctgacagaactttacctatatcagcatgtttatctttagagcagcactgtgaagtaggtaataatgtcatattattatctatattcaaaaaatagggaaagtgaggtgcagaaatgttagttaacttgctggaggtcaagtcagaggtggagatgggacctgcacccagcctcctggatgtgtctggcggcatcagcagctgtcttttctgcatttgaactgggtttcaggacctgggcctggagcttaatcaggggcataacgatgaacctcaacgctccctttctgctcaccactctccaagcagccgcgccttgcgcactttgcccaccctctctgagccttcgccatctcctctgtcaagttaagaccgtgataggatgtatattcctagcttgttgtaaggattatatgaggtaactcatgtaaatgcatgccggggcctgatataaaacaaatgctcaggattggtgtggtggcgcacacctgtaatcccagcacaataggagactgagggaggaggctcacaagcccaggagttcgagaccagcctaggcaacataatgagacccccatctctacaaaaaaattttttaatcagctgggtgtggtgatgcgcacctgcagtcgcagctgaggcagaaggatcacttgaggccagggggtcgaggctgcagtgagctatgaacacactactgcactccagcctgtgtgatagagtgacaccttgtctctcataataattgtaataataatgctcaataagtgtcagagtggtgacatcacaggtggtacacagagtgagcattagaattggtagttattcctgtcctcagcaaatgtgtcttcttaatcttaaagatgaacatactgtttatagcacagagtaaagtgccggatgtggcaagctaagatgcaaatgtccatcttcaagaccttttcacaatactccattttctctaatgcagagtttggcctatactattctcagatgacctgttggtacaagggctaccattttcttttggcagtgtttccaagtctccatgtcccctcaagtgaaatccataatgtcttctaagtttccagtggatttcaaagcctcataattaacgtccatttaatagcgatagcgaatgactgcttgttgctttcttaacatcctttcttttacaggtaaaagggtaaatttacaattagcagcctccaatttgcatagacacagaagttttattaagggagcaaaaagtgattgaaatttaactgaaagtaatactatgatctaggttttaataaaccaaaacaaatggatacattcttatttctattctaaaagggcattttattcaaaatgtgatggtccagtcttgaactgtgatatgtttttcgtcattgctgggtaagcaacttcctagccacattacacaaagtgaatttagctatgagctgtgagctatgagctggataccagtctgcccagtgacgagcctccttcattcctacttccataagaaagtaacttgggaatagtcagtgctgtccacaggccttgataatatcaagatgctgctggcctcatttgatattaaacatcagctctgacgctgttttcatgcacttttcaaatgaaagttctccccctgcctagctaatggatagggcagtgcagtgggaggagacccgtctgctgtcctccctaggcgatgtagctgccaagtgggtggaaggcagagcaagagagccaggaggttcacagcagtgtctctttccagatccaagggagacacaaaagggaattaaaaacttcacgttgcgttgttgtcactctacctgcgtctcgcctgggagagctctgcagctggagagtgctgagaagtcagcccttcagagcaattacaattcatattgactataaacttcccactgtgcgaggaaaggaaaggaggtgcttgccaagcgctcagaggggcgagtgtaaattatttcaccatctgatgatatataccacgttggcaaacattaggggaaaagaggaggagagaaagcaaagagtgtggggaagctgacaactgatctcccgcattcatgaaaggaactgggacccgggcacactgctgggacaggacgagtcgcccacctgtcgctgctgcagctggcttgtctatggtctacacttgggtgaggaaagcttttaacctgatgtcccagctcacacataactagaggagagggcagggaatacggggaagtgaagagcactttggtcagaacacttggtttgcctctttgctctgccagttactaagtgggtgactcttaacaaaccaattaacttctctgaacctttgttacctcatctgtaaaataggatcagaatatgaagattagcaacagtacattggaggtgctttgtaaacatgaacacattacgcacattatcctttattaaaagttttgtattaattatgcatattcttttgggcagtgccaagaaaataaaaaaggcagacaggagaggtgtaaacccaccacagagcaatcttctaagataaaggtgtttttacatttttgcaacacaaactcaaaaagcaaaaaacgtaagcggcgtttatgaccgttgttataacaacagcaattatcatttgttctcattatcgtttgctaactcctgcatttatttacacagcacaattaatctgaaagttcacctaaccatttcacaaatgctgtggtggaagggagtctaaggaaatgaagagagttgaacgttaggacacagctgggcagtgcaggaatcaaaaggtaaatcactgggcaaaaggaacaacgggattgataccagttttagaatggggccagacaggcacggggactcacgcctgtaatcccagcactttgggaggccaaggcaggcagatcacttgaggtcaggagttcaagaccacctggccaacatggtgaaaccctgtctctactaaaaatgcaaaataaaattagccaggtatggtggtacacacctgtaattctagctacttgggaggctgagggaggagaatcagttgaacctgggaggcagaggttgtggtgagccaagaccgcgccactgcactacagccaggatgaaaaatatctcaaagccagtgttgactcttattgtctcatttcatgtcactagggatcagcagattaaggcaggtaggtttacgaatagcttgtgggctcacaatgaatttcatatttttaagtggttgaaaaaattaaagaagaatcatatttcatgacttgtgcaaattatttgaaattaaagtgtcattgtctctaaataaagttttatcagaacacagccatgcccatttgtttatgcctgcttttgtcttacgatgtcagagtggagtagttgcaactagattgtaggtataggttggcaaagcctgagatatttattatctggtcctttagagaagtctgccaatccctgcactgcatgaacatggactcctgaaggttctgaacactgttattaaaattcttatttttctccatactccctttttgttgcctttcctcagcactctgtgaagttgcaatgaggatagttctcacatccattccaaatgatgcccacttctctgtcttccaagagtggcccctgccaccctccaggggtcctccctggcttgtagatgttgtgctccagtcgacagctatggctcaccttattttcaacctcagctacaacaagacactttcttgcctcgtccctgactagtcatctctgcctccatcttcattatgcaaacaattctatatcctgcccactttggcttttttggagtcattcttaactggggttaacaaaaatctgattcttgccctggatctttggttatgctcactggtctgcagttggttctggttctatctatggggaagtttgtttttggatagtggcactggttgctttgtttctgtagcatacagcattctgtggcagcatctgagtcggtcttcgctagtactgccttagagagggccatcatcttcccaggaggagcacatttgcctcaatcagcaccttcaaccaaaacatatcattgcatactccttatctctgctggtttcaaacccatattttaccatcaccaactcttcttcctgcctcttcaccctctctccctgttttctgtctggaatctctctgtagcaaaagtttatttgtgaagcagaggtggcatgccttaagttgaccagaagaccatggtcaaatgagccctactcaatttactacatttcttttgaattccttaggtatctcctcaggacctctcagaatcccgtaattacgatttcataatttcaaaaacactttacacgttataataataatgatttcaacaagaagagaaagggaccactttgtcatagagatttcttttctattgagatggactttgaaatcttgtcactttcaaaagtgaatctcaatttttacatcaaaaaattactagttattgttaactgtttgaagtatgtgtcatttatattcttctacataactttgttacttttgaaaatgtgtaatatgtgtttgtgtcaatcttgtagtcataaactgagcctttagaaatagattttcaacgttagattccagtaagatatgtttagctgaaacagatattgaattaaatcaggacgggcctttggtgaaccagcaggcaacatgcctgcctgtattaatgtggttctcccctttgctgtgatgcagagcgctccatatgatctgaagactctgttgtagcagcagtctgactcatgacattccctagttgtcaatgggatgaattctggaatgaagcccagattctaaagtcaacccacatgggttttctaatgcagggggagtcatctctgcttccatcttcattaaataccattagaatcatcttccgacccctcaaggagatgagaaatgttggagcctccaatgatgcatcaataggaagcaaggtgggttatcaaacccccatcaggctttaagtgttcactgtgtgtgggtgtgggtgtgtgtgcatgtgtgtgagcgtgtatgcatgtgtgtgtccagtcatcacgcatctccagcctccagaacgttcttcctcttgtgttgtaaactggattgaaaggtggtcacatttcagaattagcagatgcctagaatgtagtacttttggtagcactgaaataggagaaacaaaactataaaaaggaagttctatttctttcctacttttctttttcttcctctccctatgtagcactaactcatttgccctgcaaaagtcccttgggctttttatcaattagctgaggtaatgcaggctgagccacatggggctcagagaccaccctgccataagcatcgacatctgacagggtggattttccaagataattccacacaattctatatgggcctgtttattatcccattattagtgtttttaaaagtgaaccccctgggaaaattttcaactgattaatattcacctctggcatatgcagtctatttgaacaatgtggtgtttttgacaattatcagaactacttagtatacccccaggaagtagtcagtgatctgccattgctgtgaccctttttggaatacatgtcatcaaaatgccttcgatttggtttaaaaagtcagccctcaattttttgacaggcacacacacagacacacacacacacacacacacacacacaacaaaattgtataactcgcttaattcatgatagtttgagccaaatggctgtttgcaaaataaagcctatgcttgaaaatgatttcgttgtcattgaaggcatgacaaagtatcattagccaacttttctggagcatttattctttaccaagcctgagtgaagtgctctacatctgtgatcacatttaatcttcataatgaggtaagtaccattgtaatcttcattttacagataagaacattgaagctcagagaggtttggtgatttttccaaagttatatagtaataacttttgtggcaattttttagtagctcatatcgtatctatagaaactaattttacttagaaggaaaacagcactggggaaagataatagacttggaatcaaacagacctgtgtttccatctgcttcacatttgtcagccgcttctccaattgtaacttgggaggaatatacacctctaaaagtgggacggcataactattccacatccactgtaggcataatggagcactcatccacagcagccatgattactagtgttattaggatgagaagatggggagagccttacctatacttgaatcgacagggatggacagagcaatgaaaaggttttgaatcaaaatcagaggcagggaaaccatagcactgctgtagaaaggcagagcaagccagactgaagcagtgggctgtgctagtgctcagaagtgtccgagaattctttgcgccactctcacccgtggcagtctaatctcccggcatggagaatggctggccttactgactccctccgaaagaatggagtgaggtggaaggaaggctgtgtgatgtcgaaggccaggttaccgaaggccacacagcttctgctggtttttcctggggacaccacatggcgagaccttcaagagaggggagaccaggggcccagatccccgggcccagctgtcagagtctggaagtgcagcagccctagagaggaccccagtcctccacgatctggccagaaacctcatggaagaccctgatgagatctgctggttgagctcattccaccccggattcatgagcagaaaactaagatggccattgctggtgtaagcccctgttttggagccatttgctcctcagcagtaaacgtccggaacatgggtccatcatcctgaagaaatgccagatgctaacttagatgtcctgttgtcctttgctcctcacgtcaccttctctgtccctctgcacttgcttcctttggtcaagacaaggtggacttacgctctcggctccacgagggcctttccagtgccctcagtttgcgatctgacctcagggtttttctttgggatctcggtacgtcacagtgatcccagagtttctgtcagattcaggtagctctagaatcacagagtcctgaaattttgtcttgataattagctctttactctctcagcctttgggccactgaccccatccaaatggcggaaagtgaaagaagccggtcccgtgaagaggtctacgttttcagcccgtttgtggacattctcactgcctgacaaagccgcactcagtctcagcatctcaggctgagggctacactgtggagacggaggtggggtgcgtcccaatgctagtccctctctctggaacccacaggcagaggcctcaagccaactgtcctcccctgtaaatcagaagcagggcaagtaaaagcttggatgtcttcgtctctccgtagccagaggaaatctgggcgcgcagagagatttggagtttcatcctccccgctcagccagtcccaggcctcggctccgaggaaattcgctgaaccctttcaataggcttgaattctgtcggcagcccaaccatccccttgtttactgttgaaataattactactttgccataatattagctctgagccgtgactccattaccattatcaccggaatattacccatttattatctcccagcaaccctggaagatgaatactgggcttcagagaccaattgttttacagcagacaggatcttggtgtgcattgtttaatgaggtaaactacattacagccagcattaatttggctgcagtgcactccactaaatcactcttaacctggaaatctgccactctttttgatatacccttaatcggcgaggatgggagacatcctttgagaagaggctggagctgaggggagaggagaggaaaggttacaggtgagcgagccccgcccagagatgtgtgcataagatgggggaggattgtggagtgagggaccaagggaggcaggagaaggaagcaggcagagggcacgcatcctctgttctgctggtcccaaacgcctgggaagaggcaaaggtgatatgatggctgaaaataatccacatgcctcccctctctaagctcaggagttatgaatccacagaatccattttctgaccacatttggcttttctcttctgtttggcatcttcagaatcaccacagcaacccacaatagacagaagacagaactagacaatgagattgtcttttggcatgaggttgtctttcggtatgagaggcagggcagcctcccagagctctggccatttgctgagctcatagcagcctgcgtgtggactcgcggagctcattgccttaggtgaaacgcagctggagacacaccaagaaacagaggagcagatgaaagaagtttctgcataaagcctcccttgtcacttacattcttgctgtaagctgcataaagtcacctgaggactttgttaaagtgcagattctaattcagcaggtctggggtagggctgaaaagtcttcatctctaagtggctcccaggggatgctgatgttgcaggtccacagcaaaaggagccttgtttctctaagaaatgtctgcactgccttgttcaagatcatgctccatgcagtctaataaaacagcagcatagctaccatttttgaggtgggcaaacagaaatgaattccttttgctccatcaaatgctgacaacatctatacaggtcctggggtgaatgaagcacaaaaacttctcagaaagaatatcccagatacaatagacaccagagacactgccgtaagtcggtgacttcagatttttagggcagagaacattgtagtcctaaaatgtcgtaagaaattacttttatattaccaattgagaaagaatcgaaagggcttgaacttcggactcttggaatccaatctaatgtttttctgtaaagagaaataaatacattttctgctatgccactggtgagtttcccaaaattatctgttttcctgatgttgaaaaccttttctctgcacagcctaaatgaatttaaaacttaagcaatcatcccataaacctagcccaggtaatagtggttgaaattttaaaaatggtttattagaaaattccagggtttcttctttaaaaactaaggtggggctgttatgtttctcaaagcctctctcagtttaccatgttcatctgcccaagcaccaccatcattgcattttactgagagagacagaaaaaaagtctttgtgatttaatatgtaatctcaagaatagcagaacttggccaacggtataaattgggaatgtcttttactgtacatcttccctcccaaacctttttattgtacccatcttgaaaacttataatgaatagtttttatctccggccatacatatgaagtgtgaggggtgtgtgtgcatgtctgtatgtgtgatgtgtttcatcctctataagagtagcataacaataataattcttcttttcaaattttatcacaattaaaggaaaaggacatcactaatttattttcatattgtctaccaaactgttccactagtgtttggattacatttatctggtttgggagcattatgcctctcctagttcatttatccatccattcatccatccaaccacccatccatccatccatccatcatccatccatccattcatccatccaaccacccatccatccattcatccatcatccgtccatccctccatccctccatccgtccatccatccatccatccatccatccacaaacatttgcttagcatctgctaggttctggtaaagctggaaaaacaagtaaaaattagaaaagtaaaaacaaatgagacatgatttctgtctttggggatttcataatttatcatgagagacaaatataaataactttttgtgataccatttggtggtgcattttagtccttctcttttttcctcaactctgtaagcagttttctttgtagagataatgtctaattctttttattgaaccatagataaaagacagagtggaatctagcagaaagctcagagtataaactgggtctaattttgaaatggtgattctaacagtcttcttgggtgagtctccaatacaactacaactccagttctttcttgtagcgtctccaattttaaaactgggcattactaacttgactcttccatctcaagaatgtttttacatattccaatgagggattgtcctgttccaaacatgggtggaaccctcagcttagctctagagagcagctgttcgctggagactacgcatttgccagaaaaatgccatcctgttgaagatactttgccactggctttttcaagcacccaaaaatggaagactgcactgaaggaaatttgttcgaaagaacttgagagattagggggtgaaattagatagagaaaaaaattctaaacacgttgagatatgtcgtcagtaaaatgcgctttggcataacaaagttgtgaattgaaacagttacagaaatattgtggctggggaaatcccaagtgtttctacagttgaacatccctgattagaaaatccaaaatcagaaatgttccaaaatccaaaactttttaagcactgacatgatatcacaaatggaaaattccacacctgacttcatgtgagaggtcacagtcaaaacgcagccaaaactttgtttcacacaaaaaatatttaaaatactgtctaaaattacctttaggctatgtgtataaagtatatatgaaacataagtgaattttatgtttagacttgggacccgtccccaagatatcccattatgtatacacagatattccagtatttcaaaaaatccaaaatctgaaacacttctggtccaaagcatttcacataagggatactcaacctgtattagaaaaattaagaaatttgccttctgtaaactttaatatatgtatttcatatataacaaatttatatataatgttttttccttttggcatataaagcctattttatttggttgataatcatgtgattggtgctctgaggccaatttaaccgtttttactgaatagttaccatgtgttggatgaaatgctatacaattaactgtaatattatttagtcctcatcccccccagcaatacaattcagtgacgtctagttacatgagccaaatcaactaatgggatattttcactgttgagcagggacatacaatcagagtaattcaaagtcgtaaacacaaacagcacccttttggtaactggctctgtccaggcatgctcacctcttgccatgacctcttgcatgtgtctctgtaaaatgaagctgataatgaattgttccgtactcctaatactaaaaatatctgtgatatagatgtaaaacttctggggtctttcttaaaagctatcgtgaaagtgcacaattattttgcatgtttgtatacaagcctcatatccacaagtgcacttggatgcaccctccagtcctgctccctgatttatagtacattcatcaagcccaattgcccatacacagtacaattctctgttaagaagcagcatttgggaggaaaatgtaaactagcctttgttgtgatggtcgcagtatgtgtgtgctgtgttttctctccctctgaggcaaattactgtgagtaaaacctatattatgctatcagatgcaatcccagcctttgctcaattgtactttgcaatggcacaatagattgtggttgtttgatgccatctcattcggttatttttctcacgtttgtttgtctctcagctaatcggaagaattcaagagccttcagtaggcctctcagtccttagcctcagatcaactagtggagccttccccatcctgggtaaccctctggaagtcaagctgtcttgatttgcattatcatctttctttatccgctctccagagagtccccatcttaacaattaaagtacacacaagaaaatgactgaggatttccttttggctttcctggaaatggaggatcaagctgagtaaattctccaagcttctcaatttgtgaagaaaaaatgttacatttaggggaaaaaaggggggctcctgcttagttaaaaaaatggtgggtggggacagagtgcaagagggagaaagaaagaatagcaaagaaagaagaggtgtcatttgggcgtctcgctagtttttcttctatcctggttatcaaaagagcaaagaaattctacttccctttcccctccctcaggtgcccttaggcctgcgcagcctgggctgggtttgcaccgctttcacacggcccgagtagccaccctgtttgaaagtaaagcaagagcagccacaaagtgtctgagattcatgagatcactccacaaattaaaaccttttatcagcctctaagagctgtgcaaactaattagactttggccgaactttgccaatgactccctcgaggtattattataaaattttgagcttggaaacgcgtccccattctgtcaacatcaggttgtttcagctacagaaatcgagctccagctcattttagcttccatgatgtgctttgcataatctgtggcattttgcactggtgtggcagggaggagagtagcacagctgtatttgaaaacacataaggatgtttcccagcaataagacttcagacacagggactgaatttcaagaaaaacccatttttgcccctcaattttaagaagacgctgcagagttcttagcttaagctataaaggtgagtactcaacatccaggtctaacagcttctaatttagggaggacatatcacttcccttctcaatgtttttggctcttcatatgcaaatgaagagctcttactaacaaattactgctcaaatctttgatcatgttttgaagcaaagtctgagagaggaggctttctggaagagcttggtaagaagtcagtaaactttgatttgtctcagagaatttaggttcataaatagcaagggtgcaaactccatgtgactcaacaaatatttgaatttgtcattcaaaaaatatcaaacatatataggctatttcgcattattgggggtacgtcgaggcattgacagtgccatgtatgccagtggagccgttcctactcttgctctgaataattctctgtggggctggcctgggagtgcagaatccctctgcagcagatgtggccttctgcacgctcagagccccaggacacagtggacattgaaggggaacagagaagtagagggtttccctcatccttagcccatgcctggagcagggggccaggaaatgagaggtggtatttgtttcctttgctgaaaatggagtgaggtgaccttccgatgtacccaagcaccttatgacagtgtgtttttaccacttcccagaactgaccatctgcccaacttttggaccaatcctgggccactggtggagccaggaagcctggagggtcatggaaggggagactcttgcccagtagtccacaagagggctatgcagctggcatattggcccacagaacccccagccctgcagcatggccctgagccctcacaggcccagagcagaggcaggagtggaggctgccagggtttagaccctccttcactaaagggtccccaggttcatttttgtctccgccgtctgccatcccgtctcatgggctctcatgatgggctcatcaggttcttgaattctttccagttgtcactaattacactgcagatccgtaaatcattccaggctggggctgacagggagagacgggccctctgccatcctgagctcggggcttcctgccacacctgcagccagtgaccctaaggcagccgctgatcagtgctcagtgtagaagggagggatggccagtccctcagtcacccatccccaggctctagccctggctgtggccacatatgtgtgctcatcctggaactaggtctcaggtaatgcaacccctggaagaatgcagctactgtctctgcctatgggtttttattgctgtttgaatattaaagacagctgcgaggaaaggtgagcttatttcatctggagtttgataaagttgagacagcactcctcaaacttagtttaataacgcaacagactgattcatcaattctgggattgggtctaccaatcttcattttaaatgtgtaccccaggtgattcttgggtggtgattcagtaccccactttaagaactactgtacactaacttacactttatctctctctggctctaggctatcattgaccctcttgtttctggatcaggtgagaaccttctcttttcaaccttgctattctaatagggacacacatgtcttctgatcaaaaccacactagcttctctgtacataggagctattcacaacgcaggtgcacaggcccctatgcctgtcactgagagaaagcctgtgacctctgggtgttctgcagccagtgtggtgggccgagagggagcccccagttcccccagcccaccggctcactgcacagattgctggctaatggggcggagctagctgaagtgccttctattaatggagcagaatataaacagaataaagccttcatttcccaggctgtggtttcattattaatatacttcacaggttgtacgtttgcgcccgtgttttctcagctggtgtaatctgcggctctgagtgagaacagtcataaaattttcatttccagttgaatgtgcgtccaattcgccgtgaaatgttctatctgtcgtgaatattaagtgcactgaagcaatggctgctggattaggcagagaggttccccggcccctgccaggcctggcagaggacagaggtttgccggggcatgggtggaactttaacagggaagctgcaccgtgtgaagtctgttttcttgtggccgcctcctggagctttggtggaagagaaggaacctactgtccaggcgggggagaggtcagaaataatggagactgtgcacctcagggccaataaaaagcattcagacgggaggtgaaagggcacaggaagttcaagtgcagagtagagaagtggagggccaggtaatgccaggacagaggtgaggagggaggggattgcagaggagagagcaggcctgaggggagcgtgcaccggggaggctggttgtcaggcataatattagaaagagcaagcggagcattttatgcacggtgcctttttagatacatcaattaagcgctgaggagagagcacgatggaggaggtgcagggaaaggctgggagtgacagcaattaggagagcctttctgtacgacggcctgcagtcctggtgcggggcagagcgtcacggggactctgtcctaagaacaaatgtttcccactgccagctggcctgcagtggatgttatttgcctcccagcactgacttagtatcccttcccctcatgccactactcggctcagccatgccagctggctcttccctccaaacccttcctctcctctttcttaggagttgcagcattgtgccagtttcagggttgaaactcctcggttgctcccacagtgtgcagagagactcggggagccaaggccagtaggagtagaaagcccgcaggatttgatcttctctactcatcccagctgccgcgtcaggatcttttctccccgggcggccacgtgcccctgtcctataggggtttgatgagagagctgccccgggctagaggagaatgagaggcaaataggaagactgagtagagaaagtggagtctccttgccttgggcccacagcctccttagcagcactgagcggaactggctgtgccctgcaggagaatcccaggaagacacccgctttgttttcccagaactaaagtgctgattcaggcaaaggggcctttgccgcacctcccgcacaggtgggactcctccaagcctgcccggtggcccacggagggtgtgaatgcctgtgcgcgtgcgtgtgtgtctccaccgacacaatcgcacagtgaaagtcaaacagttcgttctatatctcttggctttttacagttaaagctcccaacagcccagtgaaacagcaatggtgattttcctcctttacaggtaaggagcaccgcacggccacagattaagtgattctgccgaggtcacagagctgaactcccagtggaggcagaacaaaacccttttattccaatctggagccatgtgcactctccccctcctccaattattgatagttgactccctctctggtttccaattgttttgctttggataatattcaaataattttgtgtttctgaaacgcacacctgcggtgaggagtgagttgagaggaagaagctgaaaaatgagctgagctgagatattaaagtggtagaagaagaataacttaccaagtgacatcctaaacacatgtagttatagctcgggaaggcatcgtctgtttcgtatgtcggccgtcctttcacacgccagtcacataccgactcaccttcattgtgagcagaagccttgagaacaaagctcagcatccagcatgatgcctacagcaggcaagagcccggccaccctctctagccccaggctcattccctgcccttgctccccactgtcctgcgtcttcccagggtggactccagacatttaagctttgcagatactgttccctctgctgagaaaaccactccatcctcctcccctccccaaacctggtgcccaccctcacatccttccagaggcagcagacaggctgcctctttgggaaaccttcctgggcaccagttttcacccccaagtgtggcccctcctcctgggctccccatgaacttgacatgcacacatctcaggctcatcattgatcgccctgtggtttgccatctgcgtgtatgtccagctcacagaagagacagggaggttgtcagagaccctagaacatccatccttggacacatactcagggcctgggcattggaattatacaaatttgggttttaagcccaatgttgccgcttagttgctatgaggctcctgatgaatcacaaaaccggcttaggcctctgtttttacatcgcaaaaatggggatcataacttcctcagaggcaggttgtaagcaagcaatcagtgaggaaatatatacgtgctatagaaaacttagatacttttgcttcccttctctttaatagatgtctcttctttccaataaatgtttactgggtgaataaatgaataagaaaaaaacatataatgaagtgcaaaattgtttggttcagactcaaactatactggagattcagaaggaaaatatcatcaaaaggaagtatggccagggtcttcaagcaggaggtgggccatggagggatcctggattcggggataagaaccctttaaagttggatctaggagaccaccctctgcacattctcataccttcctcctttcctttccttttggatttcccttcttttctctgtctctttctctatccctgtctcttttctactctctgatttctttcacttgttggacctgaacacttagtagacacttgctacctcattttaccccctgtgtatctctaatcttaaatctgaactagttaacccctgagaaaggtcatttccagctcttaaatccttggattttccaagagcctcaccttctctccacaggccctagagagagcacctgaaatgccattaaatggtcacagcccacagcatccaaacatgggagaaaatggagaaattaggagaaagtgctcccaaaatgttcttgtctgatgaatctttaattctaccccttgtgactcagaactcctgcccttaaactgcattcagaatgcatttcgccagtgtcccattctcagggagggagagacaggggaaaaaactgctcatccttctcctggcttgtcactgtagagttgagataataatagtctttttctgatcccctgaactttcccatctgcttcataaaacaatggcaatttttttcccttgctctgtcttcctctctctcttttatttttatcctcctacactataatttaaaactgtggcagtgctatagcccttgaggttttttttttctctttcttctccccttgctttaatacatgactgttatttaaaatggcctttcatctgagcaccaggaggctgcctgagcaagctgcctcctgcttttagagagggagggtagggccagtgtggtccctggtctcacctagcacctagttctcttcagtactgccatgcaaatcagaagtgttgtttgttctttctgaaagaagacatcggaagccaaggtctggaagtgcccctccctcagaaatggacgtcatatcaagctggtggctgtcagtggtccaccacgcatcaggtctaaataaagcaatttcagctgaaggcagtaaattcagtgtgcccattgatgccaggagggaaacatgtatcagccactcagcatggagactcagccgttgctatgcaggcttttgctcagctgcactgccaatcaccattcagatgcatctctcctcagctggatgggcactgcataggaaagggtggtggtcagggacttctttcccgggggaaatgtcatctgttttggggatcagaaaggaaggtgtcggacactggtgtttcccataccaactctgcagccttccctgccatggatgctcgttcagctgctgctttggagcactggctggaacatgctccacacacttcctgtctctgtgacagttcagttccatgactgcacctgtacctctgaaagtgattttggccttgtcttttctctccaagctctctccagagccccctctgaactggcatcagcaaagcaatcatattctaaatgagcttcatgaagaatatgccattgcagtaaaacaccagagacaggataaggctgaaggctagaaaataaatcgtgtgtgtgtgatgagagggtgtgtgtgtatgtgtgtgtgagggtaaggtgtgttccagccctcatgaacgtggtgatcacttccttcttgaattaagcagccctcctgtcagctggagaaagaactccctggagaaggcagggaccgcctatccccagctgatctgctgaggaggccacccacctgcaggagatggacaacattttaatcctggctacgtgggttgtttccttgtgtgatgcccagaaggactggcggcaggaggaaattcctggagaaattgtctcttgagtcaggttgttggatttcaaatcctaggtgtcattgcttcagtccctccttctccttagaatcctcctttcctttaaacactggaaatgattcttaaaaccatgtacaactattaaggtgagaaaggctgagaagtcaggatccaggattttctcctgaatgtgatctctcaccctgatgtggtgaaggtcatggcctccagccaggcactttctctcggttttctcttcaactcattaaaggaccattttaatcaatgtttttaccttccccccgataatccaaggatgtccaaataattttaattttctctctcttggcccaacttcattgccattgctggtatatagcttaattaacaatctattttaagatattgttttaaatgattttcacttatcaccaatttatcaccttctttctgtttatttcttcctgcatcttagaccttacatctgggattattttccttctgccttaatcctctttcgaatttcctctgggagagctctgctgctagtggcatattttctcagtttttgtttagtgaaaatgtcttattttgtcctgattcctgaacggtacttattctgatacagaatgttaagttggaagtcattttctttcagtttcctaaggaacatttggctctcagttctgctgttgagaagtcagctgtcaatcttatttttatttccatgaacgttttctgcctttctgcccaacctccaacaacccctgttgcttttaagattttttctttggatttggctttttgcaagttcacgatgctgtgttagctatagatttctttctttaacttttcttcagatttgttagtattctggaatctatggattaatttttttattacttctggaaaattctcagccattgtctcttcaaatattgcctcttgtccccttttccctttcttctctccttttgggactcctcactaaatgtagacaagacccctccctctgtcaatgcccttatgcattgtttggcattcttcatctctttgtctcttcacactattcacttttttttttttcgttacttaacttacagttaattgattctctctttagctgtgtctcatattcttttacacctttacaccagtatttttaatttttcttttctagaagtcctatttttactttttttcctcaaatatgctagttacctttaataggtttattttccaatattattagtcaagtttgtcatgcatttctttatataaagatatttgttttacagtcaatgtttcatgattccattatctgatatatttgtatatgtttctgttttctattttatgctgttctcactcttagtatcatgttttcttgtgtgcctggttacttttggctctgtgaggctcattgtatttttttacaaaaagctgaaaaattttgagccctaaaatgaaagcaccttccctaaagaatgatttatatttacttctgcaagatgaccgaggtctatgtaaactccattaagggtgtctaatttctgagctagcccaggtaattcaaaccgtaacacaatttcttggagagaatgtttgtcttttggttcactcccaccttggggatgcagctttttgcagtctccacttattgtacagagcttttcctgttagactccatcacttcaaaagggtgttgggctttgattcctgttcccctgtcctttcagattgtcaaacaaaggcttcaatttacctgactcagcaaatgccctcaggtcaggaaccagctgtctcttggttcatgttttatctttaatttagggtctggtaattctgtaccaggaaggaagcttttgatacttttaagaaagatgtaaactgtctcatccagttcctttggtagttttcaaagggagggtagcctgaataacctaatctgcagtacctgtttaaaccacatcgcacatctgctctccatccacagcttgaaacttccttatgcgatgatgagcctacctatgaggaaagggcaaggcatgtggaagccactccactgctcaccagctgtttcactttgtacaaagatcaaagtttatatctttctgtgtctcaatatccttggatgcgaaatggcgggaccaatagcctgaagtgcctgtgcctaccccacagggttattccaaagctcaaaatgatcctcggtgtgtattttgctggactcagtggtacgtatgaatgtgccgtttggaatttcaagcctactacttatgtgtgggacttggaattttctggcttgtcaaagaggggagggccaaagggcaaatgtagggccaggaagaggcgcaggcttccacccatgagaagaaaatctttaggctaacagtgacaaagcacagcagcagtaaagcacaggtgctccaaacctgaggcttgcctcaccctgcctttccgcccagacagagagtgatgactgggaggcaaggccgtggccttctgtttggaatgtcttgaaagcaggtttgtccttggagcactccctgccataagcccctcagcctccctcctacctctccttttccctcccctcttagccagggctggccgctcagcgtcagttctacttggcaggccttcttttcctcatctttatcttagcatttgtttcccatcttatgaaaaattgcttatctacctacaatcaacctttcagctcagctccctatcagctcctttatcagctctaccatcctaacttctcatttgtttctgacaggcatcctgtaacaaattcttaatttgatgagcttgatatagcccactggctaaacagtgagctgaagccagggctggctgcaggaatatcccatactgttcagccacccattttcttgagagcagagagtccccaaaaaagggtggaaatgggagaggagcaattctgtggggcatatggcagcaggaaaagaaagcctggaacaacagttttccatggggaagcctggaagacagtgttggacagaggcacctgaggccagagatgtagatgggtagatgaataagaagttggttaataaaagagagagaaaaacaacttgcagctttgagatacttcttggtaattatagatgggaaacacaggctcggatacatgaatacctgggtctttttgtcctgatatatggctgggtaatcagagcagccgtccatgtgcaccatgatttctgaaaccattgttcagagtgacattgactgtctctgaaaggttaatgggtatttacgtagggaggaaaaatgtaccttggttaaataagtttaagcaactgtgtgtgctccatttcccatttggagatccataggatataagaacttaaagattctaaaaatcctgcccttgatctaacgaacccagtttccccagacttgtgtgacaaagatgtcctctttgcagaatactaattacagtaccgtcttgcaggatacttagaagaaaatgttgattctaaagccatagtaggctctgttttacctctgctgctattaagggattctctgtccaacaacaatgtttctagaatggtaactgtgagcaaaatgtcctttctggaacacatgccatgtcctggagcttaggatctggtaatcttctatctcactatctgatgatgataatgaccccccatttattgagggcctgttaatctcctaggtgctttttctatgcatgacttctaatcctcactatgatcccacaggagagatagcattaccccatttcttctatgagaaaattgagagtcgggcttattaaataatgtgcccaaggtaagcggctaagccaggatttcatccaaggtctggctaactctaacataatgtttgttttcatcacactatacccattatgaaaatggggcagatttcaaaaaacagagaagaatgatttaaaaagcaaataaatttagcagcctgtctagttacatacaaggaccacttattgattgaatgctagctctaggaaaacaaaaatctgaaaattatctagtcctattgtttatttttccccttgtaaataaagaaactgagatctgtagaaagtaaaatgacttgctcaggctcacgtggccagctggtttcagagtcaacatgatcactaccaattaccctgacttccagtccagagttacttatacccatagtgactttttccccctcctctcagagactgtttttcaggctaagacttgccaaaatgctcaatttgcagtgtgaagatgataaagacctcctcaggcctgccctcagctcggcccctctatgaggaggcatcaggaacaaaggctgtcctttccatctgcatatactgaggacctcgtgcagaggacataggagctcagcttgccatcgtgctgcactctcctgagttctccctggatatggagtctggagaaatgaggcagtctctgcaggtttagctgggaactcaagccaagcaggggctggaaggcagctctctggactctgccaaagcctcctctcacctggtgttgtttgctatccagactcttcctgtccaccaactcttctagatttgagctgccaagtaaagccggcagccaggcacttagcccttagacgcactgacagggcctgtgtgttctactgagcacccggctagagacagaccttatctcctgcctgcccctccctggggagtgtctccccgcaacccgtcttcatccccagcattcttcaatctccttctcgcccacttgtctcctggttgcttctcctattatttctgtgattcctctcttccttttgtctttatctagaactgttgctttgtttccccctcaccttttcccatgtttcacagaaggccagtctccttttccccacgtctctgtacacacccactgtgaatgcactttgttttcacctctcctcagctgctcagtcctcctaagtgtctctctgtgctccgccgtggcattgttctcaagtcccatctaccgctggccttcctttggccactcttccctcattcctttaattttctttgacctctttgtatatttttcttctccaatgtgatcccttctctctctcccacttctataaaagactcggtttctgcatcactggaagaccgcaccaccattctgtggtgatggtgatggctgctgggttaaaggaaatcagtgtctcctcttctggatgggtttggatggtttccagtgaggtcagaatcctgttgcccctgctgggattctccagcctggggttctcattcttggcgccattgatatttaggctggcgaatttcttcttgtgggggctgttctgtgtatgatgggataccgggcaacaccccttatctctacccactagatagcagtaacaagcacatcccaattgtgataaacaaaaatgtccccagacatttccagatttcccctgggaggcaacatcttccccatttgggaagcacagccctagcccacagcctgcagccttgcttctagaaccacatgcggagttgaggtttctatgcctgttggataagcagaaaaagatgtggaagtggtggatgctgtcagtggagacacaagaagtgtgtttgccaagataaatttgagcctgaacattttttttatctctttggtttgagtctgatctctttctactcctttcttttagctctttagctctcttttggctctcttttagctgtcttttagctctttcttttagtcttctttcactgtaatccaaacttctttctctcctgacaatatgacgttcttgagttgcagactgctaaaaacggctctgattaagccctttaagtgattcctgcagaagtggctctgacggtgttccatctgtaccctcagaaaggtcaaggtgtcactcggctgctcgagggaactctgcttctgggctcccaggtggttaatgcctgtttgattagctgtaaaacaaaatccagaaaatgccaagaggcaaatctcaattcacctttcagaatgaagctcactgcccagtcagagaagggggtgcggagtgggtggtgagatccacagctgttaaattcgcaacaggtaagccagcaaatagactcagtcctaatgcggctgccctcatctgctgaaccacctgagtcaccttcacctttctgctgctgactcttggctggaatgtggttcagtcctatttgctctgctttccatgcagctctgccttccacttgggtgcccacttccattccagtcagcctcccccttccctgctccactgccgtcctgttgctttccttccaagctcacctctacacccaggaagctggtctcggttgcacatcttcacctcgctcctctcacaaatgcatctcactcccaaatctgctgcaaaacatcagaaccaaagaataataataataataaaaatagacatacccagtgaacgtcctcctccattgagctcctcccaccttctcttctctatccctgcaccacatctgtgcatactccttcctagaaggcaaatgtggaatattctgtctaggctatgcagagggtgggctcctaggaagcatctcctcattcacttctctcttgcacataccacacacaatggttctaacaccatggttgtcttgctttccaacatccttttcatattattttccaaatcccagtgtggtcctcccacgtgcagcccttcattgaggaagacagcattactgaccagaccacagtcatgaccatagcatctgaaatgagcaacgcccatcacccagtgcttccctcacccctccagtgtccatcactggggcagcatgccaggaatgttgaccaggatttagagtgcgggccaacctaatcacttgcactgttcggcctctgcaatggatacactttcctctctcacagagccaatcagccaccttccacctttgagttccatcactttgccggctttttctcattctctgtgctcttcctctcattcctggctctccaggtcctttttccaccatgacattcctaaagagaggtgcttgctggatgcgagctggctctcgctctgttggttgattttttttttttttttcccctgggcttgtgtggactggcagggcctgttctcagatggaaggtgtgaaagtggcataaacggcacatgagtgcatctgtttgttcccagtgacttcaggagaggcagaggtgggccaatcagccccactctcacatatggccccagcgattccagccgcaggagagtgggcctgccgcccacggacccgtgttatcgtcgggacccctagctcccacagacaggatgtgtgtgtttgtctggctgcatttctgcaggagcatctgtcactctccaatatttcctttatcattgcagcaaattatttaaacactacccactgaaccccatctgtcaccgcgccccatcactgtcagggccctgcctccccaggtctgcaaagcaactcgctggcaaaggctctgtgccaaacaacagggcaaattaaatcaaagcgcgctctggcacccagggggaaaatgcacatcagttttgacttattgcatgaagcacgcttacaagagagaaagcagcggcttttgtcactgcaaggggccatgagaaatgaattagggcctctgctgagagggcatggaggagaatctttcattctgagatgttgtcctttctcaccttgcaagaaggaaataataaaaggagaacttgtggtgggtctaagtgtctccaagctttgacactatcctgaagcacttctgggtgtagaaaggaagtgaccagttggagacaaaaggactttgagaggcttggaaatagcctgagttacatggtgccaccagagggtgagaacttgagcaggtgcaggtaagagctaacggcatctgtccatcccgggaagctggagcggggagggacagagggaaatgcaggcctcatcctcactctgccctgcagtgtggcctgggaactcctgaagaagccagcatgacaagggagcaaaaccaatgtcaccaaaccctcactacacaccacttgctgggataactcttcttcacacttgatctctttcaatccccagattctcatgagataggaattatttttgcccatcttacagatgagaaacctcaaaaagtttaaagcgattgcttgcgatcatccaatttatgtgtggcagggccaggattcaaaactacatccatctgatttcgaagcccattgcctctctttataaaagaatttctcctctgtctccctgctccccgtgagacacagctcatttgttttcctataatgagggaggggccttcgatttcctaatagattgctcacctgccgtcctagtggagctggcatttactgtggcatttactgtgtagctgcagagccttccccaccagacacatttgtactttgtgacagcaagaacacatggacagctgctggggcatttctaacacagcccttctcaggcagagatcttggctggggacagcatgactccatcctccaggagaggacaagccatgcggcatctctaattagaacccaggctggaacattcagcttaatgagctgggagttggaaacgctcagctggaaacgagttggtctggcagaaaggacataggactgagggacacattttctaaactctgtcctcatctcagttgttaatcatcttctgcttctgtctatccatcagttggttattagactgtgttattgtgcatttgcctcaagttcagagtgaacatgcgttaaatatattggacgatggcttaaatggatgatttttcctatagtcttctaggaggtcgctcgatgttgccaaatacttgggcagttcttggactgctgacatattttaaataggatgtgccaccctaagtagtgtctttgctttttgcactctctcaaaactagggaagtccaggtcaattaccatagtgttgtgctttgccatagtgattttctcacctaggcttctctctatgtatttcttgagagtttggacccatataactttagccgtcttttgaagattgttggccacaaaagagaaagcggacaactctagacctagggccacagtgtcaagggaccactgatctaaaatgagccttttgtgtggcccactatttccgttcaacacaagtaagcagggacaccacgtggaaaagagaatgatgcttatgactttgtcaaaaattcataagcacattattgtagtgattgagtattcacctgtaagatagtgacagacatccttcgtgtgtgtgacagtcaaactgaatgttcagttcaattcagtcaaaatagtccaattcagcaaacacccaatagttctgtttggaagcatcttctgtgtttaattccataagtttcctatttgtgtcctgcccctgatttaactgctagaaatattactcatctctttgtgattttaaaggaagcattgaccacctcccctgccttggtttctctgtgagtcactgctagatacggctgtgggagcaggctgatgataggtaagaatcatgtatctagaatctctctccccacaaatatatgactttctagtaaaatcatgctttcaaaatagttgccattttaaatatgaatgtaagttttgatatgattaatattggaaagagccttaaattccaatgcataaatttaaaagaaaaaaaaagaccttgaggcagggtgaggaacctctgaagaagctcaaatgaaaaaaagaaatgtagaaactgcacattgcagactgatggcactgcagggtcagctgtaaaatagttttttaggccaggcttggtggctcgtgcctgtaatcccagcacttcgggaggccaaggagggtggatcacaaggtcaggagtttgagaccagcccgaccaacatggtgaaacaccatctctactaaaaatacaaaaattagcctggcgtggtggtgcacacctgtaatcccagctactcgggaggctgaggcaggagaatcgtttgaacccgggaggcagaggtttcagtgagctgagattgcgccactgcactccagcctgggcgacagagtgagactccatctcaaaaaacaagaagttttttagttgatcaccaataaatcaactaggacagttttttgtttttgtttgtttgtttgtttgtttgtttgttgagacggagtctctctctgtcgcccaggctgtagtgcaatggtgtgagcttggctcactgcaaactccgcctcccagatcaagcaattctcctgcctcagcctgccaagaagctgggattacaggagtgcaccaccatgcctagctaatttttgtattttttgtagagacggggtttcaccatgttgatcaggctggtctcgaacacctgcaactaggacagttttgagtagaatcagttgatgaaggcatttgcctgggtggcgggagcaggagagatgtaccttaggaaaacatggaaacttttgtgaatgggaaacaagggaggaggaggactagcatttaagttattttgtgactttctaattagcaaagaactcagcctggcaccaaactcaaagctaaaacctggctgaaacaggcagtctttctttagttaccacggaagcccatggatgaatcaatgttaaatctaaaaaatcacccagcctttttttttttaaagataagagaacataagttcagagaaattaagtgaatttctcaaagtcacacagctaattagtagcaaaagtaaggtttccagacagtgtaactatttttgtaacagtctttccacagcatcatgctgtctctgaattaccatgggaatgtttatttttgcttttgcttgttctatttgtttttaagaaagttctaaactttgctttggacagaggtgcttcaaaatgtggatgatgtaattagaagtaagagaaaccaaaaaatgaattaaaaagtccacaaaaaaattattaatatggcactcagtgttaagctgaaattctggtacaagcttgtgtcctcgggttttgacttgtctgtggtttgtacaactagactataaaatatttcaaaaaatgattttattcacaatctggccaaactggcttgttctggctgaagagctacatcaaaagagggtcaccagatgggaaagccttcgtctccggggcatggcctaaaacacagctgaattatccggtgttggcagtagaacaccacggaaccttctgttcaaatgtgccctgaacccattaagtcatgagcctcaggctggtttagagagtggcttctaggcatctcgccttgttttctcctgagcaccacttgtagacctactttctttaggaaagggagacagagccgttggcagctcagatgtgaaatggggtcatggaaagagagcatgcttaggagtcgaaggatttgggcactgttgctggttctcgttttagctgcacggtcatgcacatgtctgttagcctgatgtgaaggtgacgcaggtcactcattccatttaggggtggctgggtgcactaacccagtgtcttcttccttatctgtagaaaaggtgggctttttatggagataagaactctttggccaagagagtagaggtggctccacctccctgccagaacttccaaacaagctctcaagggccttaacatgtcacctcatttctctgagcctccatttcctcatgcttaaaatcaggttgtcttgaagcccaccccacggtggatggaaagtactgcatgggaatcgctggggcatgtattggaatgccagttatgagtgcacctggggggcacagacgcacggctcacagcactgcagcttcctcctcccttttgccgtggttataatactttgaagagcagggcataccagtagggcatgcactgggaagaggaaagatcctggtcttcttctttgtttagtcagaattggttaaatgcagaactggtagttcagactgcccatgttccagacctagttagatggaggcatttctgacatgccttttaagattgaaggcagaagcacagaaggccgtgccagcacaatggaagatagaatgcttgtatctcattgtctggagaatagataggttgcaggtttcagtagaataggagctgccagtcaaacctttttaatagaatgggagcagatagatttcaataaaagaaatgagtataaatattgtgagtggaggaagggagaaagcagacagatcatgtttgactagtcacagtggggaaactttgcacgaagtttaaactgaaaacccataaagccaaggtgggtgactgggttgaatccatcgacagctgcagatccagggcttgccccatgggcatccattaaggaggctccagctggataaagagcactccaagtctgtggtctttcctcaactctaagcccatcccagccaagtgcaatgagcattcagctatctgttttactggcatcctccacccccaccctatacagaatccacggaaccctgctggcattgtgcctgtagctggtgccttattagccagggggactctgaaataattcccccaggagtctctccagggcagtagccccttccaccatagtcccagagaattatttgttagcagctgcctgatttgtccccaaattagcaaaccaaccacctaccaaggccttttggctccttctccccactgcctcaggttcccaggatttctgtgtattttacccaagggtgggacttttggccattttgtttgccactggccacggttgactaaggctgctataacaaaataccatagatggagtggcttaaacaacagacatttacttctcacagttttgcaggttggaagttccagtcaaggcactgacagattcagtgtctggtgggggctctcttcttgacttgtaagttgttgccttcttgctgcttcctcacatggcagggggagagagagaaggatcatctctttttttatctattcttacgaggactttaattccattcacgaggactccaccctcgtaagctaatcacctcccaaatgcctcatctcctaataccatcacaatgaggattaggtcttcaacataggaattttggaggaacacaaacatctactccatagcattctgaccctgtcattcctcccaaatgtatgtccttcttacatgtgcaacacacttattccatcccaacagcctcaaaagtcttaactcgctccagaatgaactctaaagtccaaagtctcatttaaatatcatcttaatcaggtgtgagacaaaatttctttgcagctgtgaacatgggaaaacaagttatgtatttccaaaatacaatagtgggacaggaatggggtaggcattcccattccaagggggagaaattgaaaagaaagaaggggcaacggttcccaggcaagactagactacaaggcaaactccatgagatcttaaggctcaagaatagtcctcttttgctacaggaatatatcttcttttgtttgatgctctgccttccagacccagtggggtggcagtcctgcgcccacagttctgcagggcagggttgcagctccatggccttgggcagctccaaccccaaggctgttcaagggggccatctggcctgttgaaactgaggtggtgctcccctgacctcatatgaaacttaggaggctgccctggtgatctctgaatcacttttttgggtcgttcttcccttgtcttgaagaattgcacacattcatagctgagtagttctaggtaaaatccaagaaatcagacaaccttccttccttctgtttccttcagtttaaaccagaagttctcctgctaggtcagctgattagcttgtggttcacatccacgctgacttccttatcaagcaatgagtctgccacgcccttagtgttctttcttttccaaacatgcttttacattttgtataattcggaccagctgagaattttccagatctttacgttctggttcctttttttttcctgaacaattccatcttcaattcatttccctttctcacatgttattattagcagtcaagaggaatcaaactgctccctcaaacacattgcttagaaagttcctaagctaaatatccagtttcatccctcacaagctctaccttccacacaaaacactggaacgtgaacaatattcagcaaagctctttgcaattttacaacaaggattacctttcctccagtttctaataacatgtcctttatttctgtctgaaatctcgtcagaacggcttttaccattcatatttctaccaatattatgtacacgattattttggcattctctaagaagatggaagctttctctccagttttcctgttttctgttggaatcttcaccagaattgcctttagtagtagacaggattcctacaacggaatggcttggtcatagggcatgtttattttaaatgtttatattgccacccagcttgccctccataaaggctatgtcaattagcaatctcaccaacaaacagaaatgtctattttcccaccctttggcccataacagatactttcaatagtttacgtttctgccagtgtgataggcaggaaattgcacctatttcaattttcatattccagttactagggaagctattgtgcatattttttcatatttcatatatttattggatatttgtatttcttctgtgaattgcttgtccatattcttcatccatttttctattgggttgtttatcattttgaaaattgatctgaaaaagcagtgtatacattatggacgttaacccttttttataaaggttataaagggtgcagatatccctcccagttattttcttgtcttttactttattttatagtatcatttgtcatacaacagttttagatttgcatgtaataaaatctgtcaatctattcctttatggctttatcatctcgtgttttgcttaggcaggcttgcatttatacatacactgtattgtatatttgcataaaccatcttaaatctcttaaaaataaaggcaagatataaagagatgaatgaattaaaataagaagagttcctcccaggcatatcacatgtgaagacagtggtatcttatatttacataccacttttacttcccaagtattttcaactttattatctcattacccaggccttgcaatgtttccgacagacataactgccaaaggcaacctcaagcagctgctcatgtatttacctctgttgccctctcatggaaagggcaagagcatggatgacagctcaagtctcccttctcttcttataaagctgtgcctgtcccaccagcaggccccaccataatgaccttatctaatcctaattgcttcccaaaagctccacctccaatcaacatatgaatttggggatgaaggttccaccacatggaatttgaaggacacattcaaaccatagtagtagctaaggtgagaggattagctgcatgtgtaccagctatggagacttggagcaaataattttcacttttctcgtagtattgtcttttaaatactgtggcattagaatctactcttaatttgtatggtggttctgtgaatgaaatgggattacccatctcaagcattttaaacataaaaatgctcaaagagccagatatatttttattaaaaaataaaaactggaacagcttctggcatggttgaaaggagatggttttgtacgcaaacgtaggctttacttcttgttctgccattttccagccatgagattttgggcaaattacttaaattttctaatacgctaaagttcatttctggtccagaggagacatcaaatcttttctgaattcgttcaccagaaacaacccaaactctcccttgccttctgaacctcaaactggtagcaatgttgtaccagtttggattcttcccttgcataaaaaccagcactgatgttaatgtaatctaaggggaatacattgccgggaatctaggggcttatggaatttatgaaaagctgggtcaaatgcaggaaacatgacagtgaaggtggatgggaagtagggagcactggcatgatcattgtgatggtgatgatgacaccaacccgtggcatgcagtcgttgtgcatcaggcactatttcaagcattttttttatgtattaactcattcatttctaataacaacctgaatgaagtatgtgctattcttctccacgttttatagatgagaaaactgaagcacaggcagagaggagttaagtagaaagcccagggaaacacatccgcaggtggcagagatgggatacactgttgggatttcccacctgtccaggttcagggttcctagaagacagacacttaagccaaaatcatgtctgctacttccttaacacagggtgctgttctaggaggaagaatgaggaaaaacatgaagcaggacagagcaggagggagagcaagtacaggggtgacctttctggagctggttacaggttcacagtaatacacctgcctgcctggtctatgggatggctcaggagagtcacaagaaacaactgcacttcaggacagtcttttgtgggaaggagggacagggattgatcactcctggttgaagcctacagcaaggggcattaactctccgcaagtccagctgtgtcgcccagtctcccaggcagctagagcctccctgaggtgagtccagctaaggcacaggcatagccatctctcttgttgccagtgtggagtggggagccctggatctgtcctagtagtggcatctgaggccgcctcattacaacctcagagcagtgtgagccctgctaagattgctgcagggagggatgaagcagaaactgagacccaacctctatctaaatatgattttacatgaatataactctaggtagagccaaatagaagccacatgtaatgaggagaggcttttaatctcttcctctgagacagtagcatgatctaagttttaaagacagagaactcaagagctagaaggattatgtgatttgaatgaggttttattgctgtttagacatggtggtgagaaagagaatccaagtgccctagatctttctgaagttttgatttttgttgatagcatagatttaatatgctcataacagttttgggtctggtggaaggagtttcagagaggaaaagctgtgaatgtgtgtgtagatggaatttgcctaattgttttagaacaagcacatattgttgaataacttagttgacatttgaaccagagaaggccattaatagattttgaatgtaaatgttttatttgaaaccaaatgatctttatagagactacaagcattagaggttgttagtcctcatcagggaaagttggcgtatcaaatcatgacggaaataaccaacactgcagttcaaatagcagaggaaagacgggaggggccacccaccatttatcaacattttcatgtgctagcaccttgtaataaggacaagcagtatcttatacatgtctgctgtactccctttccctggagtagctagatcaaaggatttttcctctgaaaagctcatttagtctcatagcaaagattcagtagatgaaagactagaagtgcagtccaggagcataaaatcaattaacttaaaaaatacagtgtaatatattatagctggttacttagagatgctgctactaaaacattgcaaacatcatcggaagacatgctatcatttaaatatatacattcctcactctttagttacatgactctctttaaatctactgaaatttacgtatctccctccctcacactttccttacccatagttgatgggtttcaaatccacacgcaagcccttatcttgggttcttggatgatttttttttttttttaattttcattcagatacctttaaaaaaaaaaactcatgggagctgggtgcatggctcacacctgtaatcccaacactttgggaggccgaggtgggtggatcacctgaggtcaggagttcaagaccagcctggctgaaatggcaaaaccctgtctctactaaaaatagaaaaattatccgggcatggtggcaggtgcctctaatcccagctgaggtgggagaattgcttgaactggggaggcagaggttgatgcaggagaatcacttgaactggggaggcagatgttgcagcgagccgagatcgctccattgcactccagtctgggtgacagagcaagactccatctcaaaaaaaaaaaaacaaaaaaaacccagaaacctcattgaaaaatcatatcatatccatgaaactttcttaatggagtgcatatgggtgttttttttgcattcaggaaataaactaatagaaagaaatgatagtcaaacacaaccacaagaacactgcctttcatgttcctgttagggacaggctcttaggagtcaagaactagattgtagaatccaagcccctgggttcatacctataatattaccaaataatgactttaacaaatttttactgaatgcttaaatgtgtaaagattttgccactatggagcaagagttatgtaaaactttctccttacaacatagtagttagaccttagttccaataagacttatattaaaggtagacttctagaatcccatatttttcttaataactacaatttttaagtcatgatgcctcagcctcacatctgtgttgcactctgctagctacgtatacactattattttatttcaatctctatcacaaccatgcaaagtagacatcaccctcctttttcaaatgaggaattcagactccatgaatagttcagtcaaaatttcacaacacacataaaatcatcaaacaccttctgcatcttgttttatttttgttttagaagtttggcatacaatcgtgtttggtgagggaagaagctgcccatatgtttaggtttggctaatggttgtgattactaattcaagtgtgtgtgtctgtgtgtggtgtggatgtgtggagtgtggtctcctctgtgtgtgtgtgtgtgtgtatgtgtgtgtttgtggtgtggggtcctctctctctctctgtgtgtgtgtgtgtgtgtgtgtgtgtgttttagatagtgcgttaaatttaggataattttgcattatttttaaagataggtctgagctaatgctaatattttagttccatagaaggaaaaagtccagtttgctatgagaatagtaacattgtctacgctctctctagcagaaaggaaaggatggtgagtctcagtgggcagcctggggaaggtcagagaatgccagcttgttcctgagtggcctcagtgatgacccagacatggtcagtcatgattcctcagacttgggcataatcgaaggatcatctggatctctgcttctcctaatgcctttatcccctgcattccaaagcaagaggggagaaaagcaaaattgaatctgaaggcagactccatgtgaccactttaattaaatgtaagagtggctgctgtgtgaggcaaaaggaaaaaactcaggagaaagggcatgatattgttttgaagcagggaagccgaggacatacaatagaacaagaaaataaagtatggaagttgttcaactaccgtctgcttcgtatgcattctattgcaggtgtagagatctggagagaaggacagagagggcaatactagtgattttgtttttaaataagttaccaaaggtaattaagtcttccttttgtgcttcaatggaaacagaatgactcaagctccaaccagcaggatgtcatgcttcctgggctagactgcaccgtctatcccactaaaatgggcaaatatttcactaccgtttggtacttctctatgttgccttctgttaataaaatactcatcaataacaatcccatctaatatggcagattattatataggtcttataatgtagttcaatttatgtaaacaagcctgaagaatagatattttacaggccaggatttatatacaaattgcatcacccataaatgctacagccaggattggaatcaaggtttctgacttcaattcagtgttctcttcatgacatgatactgactgagagtgaccactgcactgtggctgttgagggtgagaaagcacagtcattgttgactgggggctcctggcaagccaacaatgtaaaaatgttccagaaaaatcccatcactcaggagtcaactctgaacatacacctgagagatgtgtcatttacttcatcaagtgatttgtgtgtggttttaaaactcaactttactgggctataatttacatacaaagactttcaaacattttaaggttgatgacttttgacaaattgtatacagtcaggtaaccaacttaatcaaaatataaaacctctccatcgagcgagaacattccttcatgtctctttacatttctttagtcattctctctcctcagcgtcctactccaggcaaccactcgtgtggcctctataactacggatagcgttttattcatatgagatcatacgtatatattctttagagtaaggcttcttcacttgacatagtctctgtgagatttgtctttatttttgcatatagtttacattttattaagagaccatatattttattttttattattattttcttttttgagacagaatctctctcgtttgcccaggttggagtgcaatagcacgatatcggctcactgcaacctttgcctcctgggttcaagcgattctctcacctcagcttccggagtagctgggattacaggtgccaccaatgcccagctaatttttgtatttttagtagagacggggtttcaccatgttagccaggctggtcttgaactcctgacctcaagtgatcagccgatcttggcctcccaaattgctaagattacaagcatgagtcactgtgcctggtcagagaaccatatttttaaaaatcagtttatttgtccaaagaaatttaggttatttttagtttaaggttattatgactaaaactgttatgaacatttttgtatatgtctttataaatttatttttatttttttttttacttttttggggggtaatagcaaggattagaatggctgtgtcacaagtgtatgttaagatataaaaaacaattttgaaaaatggttgagccgctttacaccaaaaatatataagccttccacttgttccacatccttgctctttggaattgtgctttgtgtatgtgtgtattacaattaactaattaaaaggtaatacatgaaaatgaataaatgcagttgttagcattgttgagatatgattaacatagcttacaccttattcatttacaaatgtataattttgtgagttttggtatatttaaaagttatacaactacccgtttattgttgtgcaatacaatcaatttagaaaaatgttatcatccccaacagaaacccataccttttgtaagtgaccttcatctcaccccccagcacattaccttccctaaggccaggcaaccactagtgtactttctttttctataaaattgcctgttcggtttatatcttttgtcttttgccactgctttgttgacttagcataatgttcttaaggtccatccatattgtagagtctatcagtagttcatttgtttttatgactaatattacactgtatggatccacattttgtttatccattcatcagtggatggacatttgggttgcttccaccttgggactattgtgagtaatactgttatgaacattcatgtacaagtttttgtgtagacatatattttcttttctcttggttttatacctaggagtggaatagctgggtggtaggttaactacatttcaccctttgaggaactgccagactattttgcaaagttgctgtaccattgtacattctcactttagcatatgactcttccaatatttcaacatctacaccaacacttgttattatccatcttttttattatagccatcctagtggggtggaagtgtgatctcattgtggttatgatttgcattttcctgagggctaatgataggaactgtttttgatgttcttattggccattcatacatctttggagacatgtctgtttagaactttagcccatttttaattgggttgtcttttttttttttttagtgagctgtaagagttctttatattttctatatatgaattcctaatcagatatatgattggcagatattgtctctcattctttgtcatttcactttcttggtattctttgaagcactaaacttaaatttttttgatgttcaacttatacattttttgttgcttgtgcttttgattgtcatataagaaacaaatcatttccataggaaaccattccaaggtcatcaagatttatccctgtgttttcttctaagagttatagaacttatattatgtatcttgagttaaattttgtatttagtatgtagtaagatacaactttattcttttgcatgtggatatctagttttccccagcatcatttgttgaaaagactactccttcccctaggaactgttttgatacccttgccaaaaatcatttgatcataactgtggggtgggagtgttgctcctaaactgtcaattttatcccattgttctatgtatttctccttatgccagtatcacagtctggattactgtagctttatagtgatatttggaatctggaaatgtgggttctttaaatttgttctttgttttcaatattgttttagttcttctaggacccttgaattgccatacaaattttatcatcagcttgtcaatctcagcaaagaagccagctgttattttgatagcaattatattaaatctgtaaaataatttagggaatattgccattttaacattaagccttccaattcatgaacatgggaagttttcccaattatttagatcttctttaatgacattcaataatattttgtagtttgcatagtaaagtttgtcactattttattaaatttattgctaagcattttattctttttgatactacggtaaaaagagttgcttttgtaaattcatttttagattgtttattgaaaatatatagaaatacaattgatttttgcatattgctcttgtatcctgcaatatttctgagctcatttattagtttgaattttttttagtggatttcttagttttcactgtatataagatcctgtcatttgtgaatagatttacttccttcctccagtttgctttttattacattttcttgcctagtagtcctggatacaacatagagtacaatgttgactagaactggttgagaggagatagccttctcttgtttctgatcttaagggaaagcattttgatttttaccactaagtataatgttagctttatgatttttgttttgtttttgtttttgttttttgtagatccacttctacaaaaatgttctggttcggattgaggaagtttcctgctattcctagtttgttgtgtgttttttttatcatgaaggagtgttggattttatcaaatgcttttactgcatctcttgagattattgtgtggttttgtaccttattctgttgaaatggtatattatattaatcaatttctggatgttgaaccaattttgcattcctggtagaaattccattgattcatagtgcgtaatcatttttatttgttgccaggttttgttgactagtgttttttttttttttttttttttttttcctgaggaattccacatatgtattcataaaagatattggtctgtagttttccttccttgtgatatctgcctggtcttggaattagggtaatactagctgcatacaatgggttgagacgtatcctctactatttttaaaaataatttctagataataggtatcagttcttcaaatattttgtgactttaccagtgatccatctatgcctaagctttctttgtgagtaacttttgattactaatttaatatgtttgttaaagtcctattttgatttttaaaatatctccttggctgggcgtggtggctcatgcctgtaattctagcactttgggaggccgaggtgggcatatcacatgaggtcaggagttcaaaaccagcctggccaacatggtgaaaccccgtctctactaaaaatacaaaaaattagccagcgtggtggtgcatgcctgtaatcccagctacttgggaggctgaggtaggagaattgcttgcacctgagagacagaggttgcagtaagctgagatcatgccattgcactccagcctgggcaataagagtgaaactccatctcaaaacaaaacaaaacaacaacaacaaaaaacacaacttcttgagcctatttcagtagtttgtatctatatgaatttgtccatttaatctaagtgatctagcttattagtatacaattattcataacattgctttatgatcctttttgttctgtaagtttggcagtaatgtttcctccttaattttttattttagtaattttacttctatttcttttgtttttttctttgttcagccttagtaaagccttgtcaaataaccaacaattgattttcttgactttttaaatttattttttatttcattaatgtcttcttttaaaataattttcttctttctgcctggtttaggcttagtttatgcctttttgtccagtgtattaaactgaaagtttaggttattgatttaaggtcactctcttttttttaatattatagacatttatggatataaatgttcctctaagtattgctttgctgcatcccaaaagtttttggtttttgttattttttaaagtttcaatatattatgtcttcatttccatttatctcaaagtataatttgaaataaattccagatgacctgctcttatatgtaataaattccaagtttcctttggctcattggttatttagaagtgtattgttaggttcatgtatttctgaatttctcgattatttttctgttacagatttctaatttcaatccattgtggtcagagaacatactttctatgatttcagtctttcaaaatttattggaacttgctttatagcccagtatatggtttatcttggaggataaaccatagcatttaatgtgttccaagtgcacttgagaaggatgtttattgtgctattcaatggagtatactatatgccagtctctttaaattttagccagtccagtgagtgttcagcgctgtttcattgtagggtgaattcatgtttttctgcttagtaatgatgttgaatatcttttcatttttacatgggccacttggatagttctttgcccattttcaaataaaatgcattatgttatttttgagttatatgagtatcatatatttgggatacaagcaccttgccagatatatttggattgcaaacatttcatttcattttttgggttacattttcattttcttaagttatcttttgataaacttatatatagttttatggcaagtctaaagatctttggctaccctaaggtcatgaagatgttctacgttctcttcaagatgttttatagttttagcctttatgtttagatgtacaatccatttcagttattttttatatgatgtaaggaaggcattgagatattttttcatttttctgattcagatatccagtcatcctagaacgtgtattgaagggactatctttttaacactgaattatattggtgacttttcaaaaatcaattgactttatatgtatgggtatttgggaactaactattctcttccatcaatgtatatatcaatccttgtgccaatgccacagtgtgttgattattgtaactttctagtaaggacttaatgagatagtatgaattctccaatttgatttctcttttttttcattttttgaaatgaattttttttcattttttgctcattctgcatacttcgcttttccacatatattgcagagcaagttagtcaattctttttaaagtactgtgttttttactggtgtttgtttctttaattttttattgatttaactgatacattacaattgtgcatatttatgaagtacaacttgatgttttatatatatatgtatatatatatgtatatatatacgtatatatacgtatatatatatgtgtatatatatatatatgttatataatgatcccatcagggtagttagtatagccatcgcctcatgtatttttcatttctttgtggtgagaacattcaaaagcctctcttctagctgttttgtaatatataatattttactgttaaccatagtcaccctgcaatgcactaaaacaccagaatgtatttttcttgtctaattgtgactttatacctattgatcaacttctccccatcctcgcctcctgcttctccttgctagtctctgataacgactgttctactgtttctgtgatattgacttttaattttttttttagattctacatatatgtgagatcatgcagtatttgtcattctgtgtctggcttatttcacttaacctgctgccctccaggttcattcatgtaatgcagtgaagtgacagattttatttttgtgtggctgaatagtattccattgtgtatagataaccacattttctttattcatccatcgttagtcacttaggttggtttcatatcttgtctattgtgaataatgctgtaataaatatgagagtgcagatatctctttgacatgctgatttcatttcctttagatatagtcaataacgggattcttggatcataaaagttagtatagcagacctgagactactgtcatttatagaggattgcttgcaagcttggcttttggggggtgtctcagactcaactggtaaacagtttcctaaatttataaaaaatactccttaactgaggagagtggcttactgtgcatagaatgatcacacaaaaattgtggttcatgctgacacctgctttccttctagaaatctggaattttggtgcaccttaggcaggaggtagctatgtgaccacttccaattaaaacattgtctgctaagtctcaaatgggattccttagacagcaacatcatccacatggtgctgcatttttgttgtgggggaagagtgtgctctgtgtgacccttcttgggagggaaagagcatagagaagcctgtatatgggttcctgcagcctctacctgtgcctttatcccttacgattcagcagtaagtcttactctaccattgttaaaagtcttggccaagagtacaactttatgctgagtcctatgactatccgaggtgtaggggtggtcttagggactcctgacagatagttggcttattctattccactatgttgttgctagtatatagaaatacaactgatttttttatgttgattttgcattttgtgacttcacaacatccacttctatttctagcagtgctttgtaaattccttatgtttctacatgggcaatcatgtgattggtgaataaagataattttacttcttcctttctaatctgtaatcccttttattactgtttcctgtcttattgccctagtaagacttctgttggctgaaagtggcaagagtgtacatttttgccttgtttcttatataaggtggaaaacattcatcttctcattattaatttataattgattttatcgacttacttacaagttaatgactttgccttgactggatgtttttctaagaaaaggttgcttcaaaacaggagataatagcaaggcatatattgtgctggtaccaggtgaccaaggattgtaggagaaggctctattgatgaggataaaaagagatgaaaggtggcattgcaatgtctaaaaacctacttgatacctttgcagattttcctctaatttgcttttcttcttttcccttatatatctctcagttcctagcccaatgtctcacagagttggttctcaaaaaataagaatttgggcgtacttgaattgaaaccaatcagtataagggattatttttaattttgttggatgccataattatatttgataacgtaatatcaaaagcattacttttagaggtatttttgaaatatgtctagggaaaatagtatattatttgggatttgttttcaaatattccaacaaataacaatagtaaccaaaatgagattgttacaatattggtaattgtaaaagcttggtgctatttctatcatgctaaaatatatatatatatttaaaaatccatcctctgtgctactgtttaatgagaaatgggtaaattctggtttgaggactcttactttctgagttccaagaaattgaaagcatatttgccaattacttttatataacagtttattgagaactcgaaaaataattggtattaacgaatcatcaaacagtctttgaaagtctgctttgggccacagtcaccgcttaatcactgtggtattcacatcaacatcggccttctggttgccaagtccaatggacacttcttccttaccttagttcaacactctgcatcctttacagcctacccaatacttattgaggatttctgttcctttgcttggcctctgttgtacttagctagtgctgtgtaagaaaccacccccaagctttgctgtgtaaaccaatcattgtattatgctctcagatactttgggtcagggatttgtgttggacacagagggatcaacctatctctgttccatgatgtctgtgggcctcagttggaaagacctgaaggctagggatgagttggcagcaggggggctggagtcatctagaggcatcttcacccatctctgctaatccgtcagccagaacacctacacgtggcctctccaagtagtctttgtgcatagccttgcttgggcttcctcctagcaaggtggctgggtttctagaacacaggcagaaactacattgcagccccacccagacacaagagacacaagtggaatgcaagggtgcagggtcatattctccacctctcagtgggaggactgtcaaagtcagtgtggtatggagacaccatccagagatctttggaaaacacattctgtcttagcttcgtaatgctgctttacagttctcctcctttggaatgtctttcttaaccttcatttgggcttctctctctctctctctctctctctctctctctctctctctttactgcttaaatgtcagtaatctccagggtggctctgatacagatcctttctttgttcactctacgctcctctccttgtatttcattcaaccccgcagctataacttacaccaatatgtagctgcaataaacatgtaacaagcagatctgtacagctcagtcttcactcctgagagccaaatccaaatatccacaagacgtccccttttgaatatcttacagtcacattaaacttagatcatccaaatggaatgcaacatggtgtttcttctgtctgcccctgatagtcttcctgttctgcttatcacagagaataccacagctatctgctggccccaaacagagacttgtaagttattttagatgccttctttttattccagctatcttttcaattaatatccaagtcccatcaattaattcttctaaatttccttttaatatattacattctgtccatttccacagccactgcctacctgaggcacatattatctcttactggaatcattgtgctatttctctcatgaatccatttgtctttagacttggcctctgcttcctcctccattctgctgctagagggcactgtttatcacagagatctgttcatgtgactctcgctccaatcttgcagatgatcatccaagattctcaggagtatcctacagtccttttgcttgtcatgtttagatgccagcccacatgttcgcacttaatgctcaccagaacttccactactgcacgttaaatcccaggctcaaacaattatgtataaatacttaaaaccatatgtcttcatgcctctgattttttgcacaggctattccacctgcctggaatcctttccgccattgatcttccaggcctttgtttatatttagcctttaaaaatctcagcttaagtgctacctcttctattaatatttccctaataactcaccttctccacccacacacatgcccatacccaccaaaattaacacacacaagatctctgtagatttgtggacttaacactctgcatttcctttgcataccttccatataaagattcacatcgtgttataataattgtatcacagaactctctgtgggctgtccatctcttaatggtgaggactgcctcagtaatcatccatttattaattcattcaacaaataatgaccaataactcctactatatgccggttactgttgttgaaacagaccgccatggtaaacaggacttcattgatagtctgtctccagctcatggtacatgttcagaacatcagcgttgaatttttaagtcatctctggactatcattggtgctcagtaattgttgttaaacagttgatgagagaaaattccccttgatggatctcaaccgaggtcatcagagaaatccttctgtacatatagggcagggattgtgatttactagtttgcctaatgccagaaaataaatttgaggtttgctagcaaagttccttggatttatcttgaaggctgtgttgacatcagtatcccccacccgaaatagtaatgtaacatggtgaaagtacaggacactccagcagaaacatgcagtttgctcgcctagggtgcaccagctctttagttttcgggtgaacttagtctcagcaccctccgagtctactggagacatctcctggcctcaccacactgtcctgatactctcttcttttttttttttttttttttttttttttgagatggagtcacgccctggcacccaggctggagtgcagtggcatgttcttggctcactgcaacctccacctcccaggttcaagcgattctcctgtctcagcctcccaagtaactgggattacaggtgcatgccaccacacccagctgatttttgtatttttagtagagacagggtttcaccatgttggccaggctggtctggaatggctgacctcaggtgatctgcccacctcggcctcccaaagcgctgggattacaggcctgagtcaccacccctggcctctgatagtcttcttattgtgaattgtagggatagctttcatttgtttgtggttctgtaaaccccaccccagatttcaaagccacctatagctagctgttcctcagattcaacagtcattgcccacagggcagtcattggctaagaaacctctggaggaaaatcacacttgaggcaaataacattctctcactattagcagctttgatcttttttaaaacctcattttctttttccagcccccattgcattgtagacatttttataatgagcataaatgttcatttaattttatttggcatatgctgctttgaaagtgccacatcaacatggagcatcactccttcagtaactaaattcttctaacagctttaaaggaatgaccttgggtgtgaccagtgggtcttcagagcatggctgcgttttgattagctaaattttctgttagcccagtgagtccacacaccaattagtggagcataatcacaagcctgaaggtttcaggagttttctcacagggaagtaacattgatacttttcttaatatattattatttttaagtaaatatctgacagtgtctaggtaatcaattctgtgcccacaaaagctcagtgtgcctccgaaagagttcaatatatacaagtatatgcatatacgtatatgtttttcacaattcagatgcaaatacacagaaacatttgttcatcttcaaatcattttaatagatgattgggttccttgtccacccactgcccaatgactgtgggagaaccttctttcatttacagaaccccagtctgtaagaatagatatctaaaaatacagaagtctgatgcccagaaattgtccttgaagcttgattccaaagcacaatatgtgcagcccaaagcatgaccagacagtaagctttcacatcatacatgggtcaagcacagacatattcttcttttagatttggaataagggttaattgcatcatctaggaagcgttcaggaatatagccttgtgaattctcacagttatgagtactatcaaaaattgacttcacacatgataaaaagaacaagaaatcttggaatgctttcaatctcaaaaaaagtattgtgatattaataacatagataaaatttatttttattaatttctgcttccaaactttcaacctgtgagctttaagcccacatcttatcatattgttatgtttcattgccaaaagcaactacgtattgatatttcagaaatgctgccaggcctttatgtaactagttgctattttacctcaaaaaataaataatgcttcctgtttttacttttacttatctggaataagtagctattgacatctgctgaagtcagtataaagatttatttacctgagtgtagatattgaccaatagggagcctggctcaatgtttacattgaaggacaataaattgccgtattgactgggctgagacatcaatatttgcattgttgtaaacatttttaaaaatcttcatgaaatattcctcagaaattctcttgtcaccagagcagctgagctagagctctttagggaatagcttgtgtctggaagccagtgggtaacttgaaatagctataaattgttctggtttccaagtttacacaaagacacattttttattgtgatgtataatgctgatcattaggagctttcagatgacagtcccagccccctcctcaaatagcagatttttgtctacaacaactctgaacagaaatacgctccccgagtagcttgtgtcttgaaaagctcatgttttccaaaaaatatctcattgcccaaacagtgaaacatcattaattccaaccagattaattaattaaaaatgtgggatgtttcaactcagttggaataagtttttcctttgtgtcaagagtagaaagaggaagatgatttagaaaacattaggacaggtaaagtgataaattgaatatttagcctgtttaagagagaaacataatctacacaaaatcttcttacaatctatgaatgcctattaataggcattaacttaacttcttaactccaagtgatatgtgtgtttatataatatatgccattttaattaagctttgtaatagatacaggttaaacaactttatcaacatgtgttcatataatttaatgtacttggaagaaatgaaacgggaaattcctttattcctttttttttttttttttttttttttatttgagacagagtctcgctctgtctccatgccaaagtgcagtggcatgattttggctcactgcaaccttcgcctcctgggttcaagcgattctcctgcctcagcctcctgagtagctgggactacaggcacgtgccaccatgcccacctaatttttgtatttttagtagagatagggtttcaccatgttggccaggatggtctcaatctcttaacatcgtgatccacctgcctcagcctcctaaagtgctgggattataggcatgagccaccgctccgggtcaacaggggcaatttctgtcatatggtgtaaaagctaaacatctggcaaattcttaattttttccaagttggtaaaatcataacctactttagccagcccaatagttctaagggagtggctcaagataattagcaccacctcttggagaagcacagattcattgttctagtgcagggtttggtgcctcatcgtctttgtcaagtaagacaattaggacagcgatcagagatcaaggagctcgggatgatgtgcaaaatgtgatgcctatttatgcttgaataacaatttggatgaaaaaattggcatcttaaaaaaatatttgcatcatggttatattcctaaatgatgaatgaaagaaaagaagcatccagttctctctgcagttgcttccacctctaggcggtacttcatagcaccctgttctaagttaggctcagggactgagaatgcttttagcgaagagggataggaggggaggctaagatgggcaagtctgaaatgtgccctcctgttcaatggggggctttagagggaaagtggaaatgtcctaccagtaaccgtgtctgcagaggagacactaagctcttgcccaggccccatgggagtgcctgtgctgtcatcaccccaggggctctatctcagtgattccctccatcccgcccttttcctggcctcctctcctcctcttgggcttctccctctcccttccttcctccctctgaggcaatgcccagtgcttgtagaaagccccaccacttccaaaggactgtcccagcccctggggcctcagccccaggatccctagaggatgattttgtggggattaaaatgaaatgaggtatgggaaagagctggcgcacagcaaaccctccaaggtgagccccctccctattctgggctttcccctggacacccactctactggttgctagcgctgaggtaacaaagtaccacagcctggagggcttcaacaacagcaatgcattgtcttacaaatttggaggccagaagtctgagctaaaacagtcggcctggttgatttctgggagggcctctctccttggcatgtagaaggtcgccttctccctgtgttttcacatgtcttccctctgcatctctgtgtcctgatctcttctcctaaggacaccagtcccattagattgggtctcccccagtgacctcagtttaactgcatgacctacttagggaccctgcttccaaatgccctcacactgcgatactgggaccctgcttccaaatgcccccacactgtgatactgggaccctgcttccaaatgccctcacactgtgatactgggaccctgcttccaaatgccctcacactgtgatactggcggttgggacttcaacttacggatttggggtgggagcataaatcagcccataacaactggtcagtccctctcctctgcctcctccaactgtcacattgtaaaccccacctgactcttccccgacagtggccttggggagaaggcggggccggccagggtttctactcctgcctcatggagacccgcctcagatgcccagcactgcgactgctgcacagccacgaggctgagccgctgcggatgcatgcgtgacttaggaatgtgtgctggtgtgtttgccacagcaacaggatgaggaaagcacagctccaagagaggtgggagctcatccacctggggaagcatgagcaggagcaggaagggtcactctgggactgtgctcatgggaccctgagatgcagcagaaagagcagtgtgaggagcaaagtgacgctgcctgcaggtgctgtccactcagaccttcccagcctaggcttccctgctacccacgtcttcccacctggactccccctctctcaaggggcatcctcagtagtgctctctcagcccatctgcccctcagaggcctggacccctgccttgccctctgtggcttcacattaacattgactgggagccatcctacctggttctcatgcccaccagccttcctctccaccctgtggtcacaggactatgggcagcctctgctctgagctccctttgtacctctctcttctcacctttttgttgttgttaattgtcatgcacatcttgaagaaggaggaatgaaatgctcccagctctgaccaactctgtttttctaagtgtcctccttcgtggacctgactgagatggcactgctactctcactgtcacagccacccctcgacagcctgaggcacactccctgctgttcaggagcacccagattggggcatcggtgcacctggacttgctatgtctcgggcaccacccattacacttatcactttttctccatgagttatattcacagcggttccccaggcatcaaattggcaatatgagtttagctcttaggaccaaaggacacacaagagatcatttattctttgcatcactccccttttctcaggtaggacatcaatcttccccgactctgctctggccatatttactgccagtcgctgtcccttagactgtctgcctctcctagccttgacagatgagtctcactccaccaggatctttacaattcaaggcacagtccagcctcttgtagatgggaatcttgctaatgtagccactctagcttatcctggctgcatcatgagaaaaatggagttcagctcaggactggcttcctcggtttgcagagtcagtgggcacctgcaaactaagagcttccatctgcaaggaagacctatcaccccaagcacttggcttggctgctggctgacatttgatcatcagtacctttagtttgagtctctggtttctgtgaaataataacttctaatatccacacagtggagtacaatttacagaatgcatccatatatttaaaatatttaaactgatctataaacttcacagtcgatattatatccccctcattttatcaggaacataaaataagagactcattcaagctaaaacataaacgagtctggcctatggcagtgcaggctatttctgtctgttacagcaggctgccactctgcacttcatctcaggagaacagtttaaaaatagtagttcttttcaaatgggattgtgtttctggccctttcttggaagaggacctgaatgaaggattgaaagattcaaaggaaggagatttaggagtaacacagaagcaccatttaggtaaatgctagagaagaacacgatattacacatactttgcctgtccgccccccccacccaaacacacacagcctcaatgcgcaactttggcccacttatttttgcctcaccactctgttgttgctactagaatttttgatacttctgatactcaatggttttcaactgggcaccatctctgggggatattcgaatatgcatgagcccaccagaatgaccgcatggctctactggccccctgtggggaggggccaggaatgctgaacatcactgtggctagagcagggcacagtgttgaatccacctgaccaccatgacaatggtgtatccaatgagaaaacaaactagggagatgcatcagacttaggaagctccgccatctgttcgcaggatccctgagaaccctggctattctacctttcctgcacttctgcctattgatccttctttgaagatgcttttcttctttggtgcctatgtccttctcactcttgaaatgactcaactacagaaaatcctttccctggtacatgaacaagggctttctcctttaaattcctccttagtgtgtatttattcttcaaaatattttctagaccatttgagacccctcaggctgtcgatggcagagaatgtgctgtctgatgctcatccatcatcctcccttgtcagatctgtctaaccagtccttaggccctttaggcaaggccagtttcagtcctggtgggtgtaaagctgagtaattttctcaggcacacataatggtgaaataatgatgatcatagtcagaattatgattttggtaagtggagtatgctgtgttttccaaacgcttatttttcattatgtatagaatgaataatggaagacacattgagctcaggacccggatgttctgtctgcgtacgtttccttctaataacttgagagaagcattcttttatccagctcatgtcatgcatgtcaggctgggtgtgcatgtgactgagcagaggaccctagagctgcatatgtgtcatgccacctgaggtttaagttatataaattcttgggggaaaagatctggtttatatttaaaaaatgcttaaaaggctggagaaaaggatcagagagactgaacagcctctaaaaaatacaatttcagggagtcaagtacaaatgaatcagggacttttgactctgcatgtttcccaatataaaacatctgaaaaatggatttaaactagaaataaatgaccagatctaaggattctgatagagaaagaaaaaatgtgctaacatgcatgtgtgagcatgcatgtgaatgtgtctctaataagcttacattgcatgagcttacaattttgggtcggtatgcatgtccaaatgcaggatatgggtacacatgaaaagcaggaaaaacatagtgtgctgaggatttgtttggtgtatatgtgtctattttgaagaatatggaagaataattgaggctactcatttaataaacatttatgtggttcaagggtatgatatacattgtccctagagacaaaaattagtaaaatttcagtttctttatatgctttgtgaaaaataatctccttttacaaaactctttagtattgtgtgcagcgcacagagcctagtgtcagtgtttctctggggattgaagcagacagttctgccaaccagcatggatgggggaatagcctgggcaggatgcaagccacatcgtgcagaatatgattcttagtggaatagaaagccaagtgccatggaagccaagacacgtgcaggcttaccaagatgccccaagccattggagagaatatggagtttctcagtgcacagaagattcagaagatttacttaaacttaaagggcaagtagaccttaagaagctgtaaaacttgaggacatccaagattctgacatatgaaatataatttctttggcacctatggtataccatacactcttagctactaaacttagctactttttgaatgcatgtttctgtgcctgtatgttttaatgcatacatcaattcatgtatagaacaccacttgaactgaacggaatacacaatagtttcaccccaaaatatttcttttgttgccttcccatcttttaacctctattgtttagattggatactttttttctttctttctttttctttttttttgggacagagtttcgcttttgttgcccaggctggagtgcaatggcacgatcttggcccactgcaacctccagctcccgggttcaagcgattgtcctgcctcagcctcctgagtagctgggattacaggcgcccaccaccacgcccagctaattttttgtatttttagtagagacggggtttcaccatgttggccaggctggtcttgaactcctggcctcaggtgatccacccgcctcagcctcccaaagtgctgggattataggagtgagccaccatgcctggtgcgataatttctatttatctttaagtttactgactttttactctatcatctctattttgctattaaactgatccaattagtacctaaaactcagtcctagtttttcttacttgcttcttgtgtatggcttctagttctgtcttgagaatgtccaccatcatatttgttttaaaagtgttcacctttactttgcagggcatagttttagcagctgctttaagatctggcaatttgcaacaattctcagggatggtgtttgttaattgtcttttcccttgggaattatttagcttccccttgctctttgtaggatgagtaatttttgattatatagtgcacatttttatcttactagactctagattctgttaagatcctttgagaatatacaggcagagttcaccaactaagactctgggtggtggtttacacaagagttcagttctcaaagcctttggtgtactgtcctgggtgagttccacacaagttcagagtgaacctgggactttatacattgctatacctgattcctttcttgagctccttctctccgtgatttccccctgctctccagctcccatgagccccctttctttgccatctgcctagaaagcaggagtattagcaccatactccatcccctcaccccctgccataaccttaatgttacaaatttcttgtgactgagtccaactccagggaaaagtggtgagaagaaagagaagaaaaaatgtaataggtattcctctacacttttcagaccacagaggctcctgtactcagttccgctggtcatgaagtatttttttagagttttagatgtctttgtggccactgctgctactatcaccactgctgcaagactgcagcgtcagcactgaggtttacctcagggcagggtcgagggaaggaaagaaagtggacttccccggactctccgtcttacaagccttatctttccacatcctcagaccaaaaagagtttatccaagagtttttgtttgttttgttctgttttgttgttgttgtttctgttggcatttgctatacagttttaggattctggctgttctaagtttaagccaggaaaggaaggaggaaaataaacaacaggacatttgccgctatattgttctttcttcaagttttcatttccctccacaagcttcctgctattgtttaaccttcagagctctcatatatttcatttatgtatttttgtcagttataatgaatgggagagaaaggataagatgtagttaccccataataacttggactgcaagtcttatagagaattaaaaataatagcagtaagactgactaaaagatagtctgatttttttttttttattatcactgtacacatgtaattttaaacaccatcagtgagcagacatctcccactgccctgcccttggtaaatcactgatatggggaaattgggagccgggagtaataggaaatagggctaaagagtcagctatgtttgtcatgggttattaaagaacttaataaggacggtgtccttcattctggagttctaaatatgcattggatactgagcgtattgttttaatagaccctgtgcataaaagcatagatgaagaattaacattgacctagtaaattataaatttattgagagtgaggaacatatcagctttatttttgtgcatttattcattcaacaactatatattgtgtataactatatgctacagatacagaaatactatctctctttaatggacctttactctgaagggagagagagataaataacccatccattttaatataatgtaataagtgttaccatttttaaaaagcaccaagtagttaagatgtacagtgaattggggatgggggtgctatcccaggggatgtgcagaggttacagaaggattcttatacgagctgaacttaagctgtaacctgaaagaaagaaggcgacaacctgaaaaatagagtgtttccaggtggtagtatgacaaaagataagatgacgttcttctagaattatgagttgtttccgttagatctgaaccacatgtgggaaaatgtgaggaagaaatgataaggaaatagaggcattagatcacaatgggccgtataggaatttatgctgtgtttgggatgatggtatcgtatggcctggtatgtgagtatggatcagatgttgacgcctacctaatattattattgaataaaaattaaaatagataatatttgtaaataagttttataaatgtgaaagtccagcagacccctccagttgtccctaaagtatcaggtgatagaagtgtcagtgaacagaagaggatggattcaagatatactttagaggtagaattaataagacttggtgatggatttgatattggattcaggaagcgttaagtactgagtatgacttctacatttttttttgagaaatgtgactggtaaaggtgccatttatgaataagagaaaaactgaaggagaagaaaatttgaaggaagataaatctagaagaatttcatgtcggacatgtcaaatgtgggatgcctatgagacttccatgtgaccatggaattgcctatggaagtgtagggttcatggaagagaaatagggtgaagatataaatgtgtgagttattgccataaacctgaatgttcaaagccacagaataaatgatattgcctgggaaatcattgtacagtgagacaagaatacctagaacctagccctgaggagaagccaggaaaggagattttgaaggactatccagagaggtggttgggcagttaggagattatgacattatagaagccaagaaaagctcatttaaaggagtgagttgtcagctatgtatattgctgctgagaagtcttttaagaaaatgctaagatgtgtgccatgaatttggacacatggaagtcattcagtgactttggaatgggtaggttcggtggagaggtgtgaacagaagctggattggactggttgaagtgtgaatatgaggggaagaatctgagacagcacatttggacaactgttctgagaagcttgactgtgaaaagaggctgtggagcctggggtcagtggaaaacagtggtgttaaggcagacattagaaggtgtgaaaacaaccatgaaaatgatccagtacagcaaaagcaggtgaagattgaggagaaagtccaggtagctgatgaagggaattccttgaaaaagtgagaaagaaacaaatgcatagaacaaaaggaggaattggttttttgatagcgggaagggaagacatttgttagacagttactgtaaagtatgaatagaagtgaaggggttgaggatatttccccatgagagttgcagtgatgggtcatgaaatctaagttttctaaaatgtaggagataatgagatggcaagcacaaatgttggtctgtacatttgatcatgagaaaatgagtctgtctgacggcttctctattctccctcctccggcccctcccccacctcagtggagcaggagacaggatcctcagcagaggacagcgtggatggagggagagggtggtgaggcactgagaagttggaagagcatgaagaaggggaaaaatgaaccttgagagtgctcaagtgtccatggcagttatgagtgcctgcttgagacaggcacgtatgagtgtacggagaagccagtttgtttttttgatgttcctacagcagacacagaggagacagacatttagattcatctaggatggggttttgccaggctagtggaacaagggagggaggcgaaggagttgagagtattttccagggagagagaacaatgatgcgttataaaatataaattttatcaaaagggatgtaaaagtaaaaaaaaaaaaaaaaaaaaaaaaaactaaaaaatgttggatcgggggatttaaatccctagtgaagaaaaataattgttccctcaagcgactgaacaaagattttaaaaaggtaggaagttatggacagagtgagatgcttaaattaatgccttcagaggtggttcagtttctgacaagttttaggtgtgaatgtggagtaggtcacagaagacagcagagcaaaaagtcatggaggtaagatcaagaatatgaggggccggtttttgacggattgtacttctggacgaggaggtcacagagaatagtggtaggagtgaggatgcagatggagactctaagaagcaaaggtttttattgaatagaaaaaaataataaccaggaagtcagtagagaacagaaatgtgatggaagaggaagaggcaggggtgtaattatttagataatatgagccttaaagatgtaaggtttgaaaaagatggagcaagctcagaagtttaactggaaaacaaagacaccaaccaacaaaaaaatatgtgcggtatttaaaaattgggtagcccccacttgacaggacacgtctccaggagagcccatgtccccgcctgagtatgagagtgaggtggaggcatctctccaagaattggatgctgtcagggagcgttgatgatgcaggagaggttcctgagtgcagaatggaaggactgcaaaagggtggggaggatgtggagtgcagtccgatgaagggttatatgaaacagcgggtgtgagactacaggaaatcatagatgactggagatttacgcgtctacaggagaggtcagcaaactacagcctatgggccagattcagcctgcagcctcttttctgaatggcctgaaatgtaaggttttttttttttctttttacatttttaaataattgagtatcaatcaaaaggagaatactatgttgtaacacattaggattgtatgaaaccacaatttcattgtccaaaagtaaagtttttttggagtgaagccacactcactgatttatgtattgtctatgactgcttttgtgctacagtggcaagtttaacagttgctctagaggccgctcagcctgcaaagcctaaaacatgtattatactagttggtcttttatagaaaacgttggctgaccctattttacagaattggttatggaagtctcctggagacgagtggtaactggagctgataccagggtcttcaaagcaccatgggatgctacagtggtgtgcaggctagctgtccccacaggcatcataggaaagcatggttaaggctaacacctcccgaaggtgtcactatgacttcgagctttaatgagaacacggtagtcacaggagcaagcttctgatttacctaagcaactgaataattaccttcagcaatcatgtgtgttctggttactttctctgtttgacgtgcaattttatcatctgcttgtgctctctggctctctcacactcccctcgccttcccctcccctcattccttcatcccagttttttatcagctgctaactccattggttaatgcatgagctcctgtctgctcttgtactgtaccatggaaggtgccattcaagtcttagagtggaaattcgtcttctgaagttgagatttagaactgaaataaaaaataacttaaaactcatcagttaaggttgctagttttttcacgccaagatccagtaaaatgttcctttattttcccttggaattatcgggaaggaggagttactggggttgaagaagtctagaggaatgggaattaatgcaacttacatcgagcagttgaggacaggaggaggcaggaaggacagcactgtcaatggcaggcaaagcccttagtcctgagaccaagcaggtgcaggaaagtcacaggagcatgttgaggctcattttgtagtgatggcagcagttttttccttgcctgtcccaggaaggtagagagtttaatctcactccttgcaatcattccactactaattacagacagacagagctgaatggccaggctgattccactaagaaaaaattcaacctaattgatgatgacataagaaagctctctgagaccatttttattagggcacactgcatgccaaggaagcagggacattggctataagagcttttaactaagaatatttgtgaaggtggccaaacctggctcttctcttattaattccaggcctagcttgatgaaggctcttttagttccccttaagaaatatggaataaaattatttagccttaggagattttaagacatctcttcatgaatccagccctctctctctctctctgtctctctcacacacacaaacacacacacacacagacacacacgagaaagaaaaaccttaaaaaatatacccactgttttcttaaaggtcatcaaagggtgttctgaatcattgatatgattaacaattgatatgatataacgatatcataatgaattatgataggctagaacagccatcaaaagtctagtcagctagtttattcattcaacctttgcccacatgatcatgtggccccttctacgtgctaaacctgctatagatattggagatgtagaggtgcataacagagtcactgctctcttggaaattagagtccagtggggtaaacatatataaataaataacaataccgtgtgattagcaatgctagagaaacaaataaacaataataaactaggtggggaggaggcccggaagtttgaatgtgacgaaagggttcccagagcagtgattgctgggatagttttgaaggctgcatagacatttgaaggtggacaaaagagaagacaaacaggcacagatcaatacaatgcctcgtgttttaggaacttcactggtgtgtccagtgggtgtagggggaagtgagatggcaataaagaacccagagatgtaggcaagagccagctcatgggaaccttcacattccatgccacggagcaatgtggagcagtggtaggatttaagcagaggtgggactgactcttatttttggcaattattttggcaataaagaaaagaataaatgggaggcgtggagactcataaagaggatattgtaataatccagagtagataatgagggcctgaattaagacagtaacaatgatgaggaaaagaagagaatggatttggaagctgtaaagtgagtggaaacagcagggtttgttgattgaaggtgaggaataagggaaagagagcaagcaatgtaactcacttttatcttacgagaatggggattcgacaatgctgccaagagagatcagatgcaggagttaagagcagatgtaagggcaaggtggtgaattcagcctgcggtgtctgggaagcatacagagtaggcatttcacaggcagttatgggcctggagctcagcaggtcctccaggacggccatgcagatgtggagatcatgagcacagctggccatctacagtgctgagatggcatttaaaagaataggtttacctggggagggggtagaagtagtagaggagtgggccttatgtgatgctgttatttagggattgaatgtcccaaacttttcctatagtttgttccttctaacatttttaaaattatttcccacgtgttaatcattcttccatatgtttgcacaacttctctcatataattttcagacccaatatatgagtatttgagtcataaataaacagccacattttactaaggagggaactgaggcccagttatttcctcaaggctaccagttcctaagagacgtcgccatactgaggattcaggagttctgtgtttgtctgcttgttttaatacattgcattctacccaagacccaggtgtgtgtgtgcctatatttagattttatgtgaagtgaagtagaaaggcacagtagtagtgtgcccagtgaaagagtaaatcggctattcttttccttcccatacaccgtctttttatagatttcatgtaggtgaaaattccacctggcagtggaatgctaagaacagaggggcaaggcattcaaaagtaagtgggcagagcccatgcacgtgtttccagcaggatgatttggcctacctgctggaaagtagctatggtgcagaatagattttgagaaatgtttataaagactcatttttttccagtcaaaggctttaattaaatgttacaaatacaagggctttcagtcatgtctccctttctcctgaggcccaaacaatcctactccaataggcttcctgctcttctgtagaattgtgctgtggtttcccaagttattcccttctgcacatgggctggtgtctgccctctccatgccaattgaaaatacacagatggcacttccatcttgagtattcctggcaccttgtagttttctcccagaatctgatctgaatttattcattagattgtcttaactatagatttgaccccaccccaggttttctgctccctctgtcccccaagtggtccccttgtcattgaggttttgcttgataccatcactaataaatgggattcttcaggaaagcctgcgttttgctctgcatctgaggatgctgcttgcaaagggaaagcctggcttccctcctccttctatgtgcaagaagcctctagttcatcagccagtgggcatgggcctctgcaggaatgggcagagccctgcatcctccgtgcatttcaacttagctttggtgggaaaagactttcccccatttagtgaaaaaagaactccccagatcgatatatctattcttcaaaaggattatttataagttatttcacttcccatcctccacaaaatatttaatgaaacatacgtaaggctctgcttccccgtggagtgatgttcttttgcctatcatcatctacatttttgcgggctttttcttggcagacatgtgagttgacatggatttggttctgcaccatcactaggggatgatccagaggatcatagcaagggggtaccaagccgtgtgtgtcctgggctccttttacatccttttcagagagctgtagaatctcttcttaaggaaaacacacaccaatgcacgtatgcataatattatttcctggtattcaaaacccctgaggttaacagttccacaattctcagattaagaacccctgccctacaaaatgtattgatggctaaatcataggctgccctgcttcccaaggctgttgggatccaggtagtgaaggtgacttcttatctgatcctgagcacaatggtgtcaggagaaccttaaccctttaggagcctcttaagtcaatagaattcccttaaattaatctgggtgaggaattgaaagcaattaactccttcaaagttatcagcactcagtactggcttatatctccagtgatttagaaaaagggaaagcaaacagccaagatactgaggcaatatgacattgcggagtgctatatttatcccctatcaatgtctttcagatcaaattggctgagtttacaaatcaaaagctgatttatttttttatttttatttttttagcagccatcagctgcactactgcaaatacacagttcccagacatcaagctgcaaactctaaacacccagctgtgtgctttctgactttgatatcatcacgcgtaatagagggtctgcatgcagatttgagctgacaggcctcctgagaaggctcacagcagaagagcacccaactccagggccagcccagcttctgaagccacatctgcaaagaaaacccacgtcatgttgttatgggaagggatgggcctcagaaatgcacagggcctggctctgtggagtacaaagggttcactttcttataattacactttaagttgaagcttctctttaatatgaagctaattattattcccagatttccctatcaaaaaaaaattaagggaatttgtttctacgtatctataaaatgttatagttgatatatgcgtagctatgcatattcaaccatatacacatattcagttccaactatcaaatgagttcttaatatgtgtcaggatctatgataaatgttttgttgatattgatagacacatatatgtgtgtatacacacacacacacacacgaaatttatagttggcaccagtttgtataatatttttattgaatctatatttattgctttatgaaaaaatctggttaataaattaatttaagaactattcatggccaggtgcggtggctcacgcctgtaatcccagaactttgggaggccaagaagggtggatcatgaggtcaggaggtcgagaccatcctggctaacacaatgaaaccccgtctctactgaaaataaaaaaaattagctgggcgtggtggcaggcgcctgtagtcccagctactcaggaggctgaggcaggagaatattgtgaatccaggaggcagaacttgcagtgagctgagattgcgccactgcactccagcctgggtgacagagcgagactctgtctcaaaaaaacaaaacaaaacaaaacaaaaaatactattcatttgcatttctagcttatgcaaagggtatagtgaacatggaagttgtttgaggaagggaacatggtgcaaaagaaggtatggcaaggtggaggagcccaggaagaagcagtttctgtgtatccaacagaaagggtatcctgagagaaaggaggagataagtttcccaggtataaaagaagttcaggtgaagtaaataggaatctgagctgacaaagaggcaatgtcgtggggttgttgccatatgcatactctacgacttacgcacagctcacaagcggccagcatgggcctatttaagaatgctttctcttatatgatgggaaccacctatttagaacaattcagctgtcccatttcccagagttgggctctatgtttgttatcaactgtgtgaggtctgtcctgcagtgttacaacaggcaaacgtaggtttgagcccttcagaacttttcctatgaaacatcttttaaatttgcccatttttggcaagatcatcagattctcttttccgccagccatgctacctgtatccaaaggaaatgtcaaggaactatgtgtaatatatatgtacgtatattacatatatatatagatataaaatatatttatatccttttatttttagttctgaaaccagagacattttttaagctctcagcagttcttacctgggctatgcagctatacctgcttttttaaaataaatgatcatgagaaattatatttattatcaatcacatcctgttttaagtcaagagagtagagttttctagttaaaggatatgtggtgaatcctttgtaagatttattattattaagttcctactggcaaagcagaggtctgattattatttcatttctgagttgagatgttcttgtatcaaggatcatgtgtattaaaaatgtgataaagcctaattagggttgcagtaaaaataaagatcatgatagctacgatttcctgagagcttcctatatgctaagtactttactcatatttagtcatttaatgctcacaataatactataaggtaatcttatgttctccattttacagaagaggaatctgaagtgcacagaactgaactgtcagataatactgtctatagggctcgagtgcagaaatactagagctcatcactgcccccacagtgcagccgggggaagtggtgcttacagctgctatcaactcttcaaccattgctccagcctagtatcaggcctacagaagctatcctatgcagatcattcgacatgaatgtcacattgtggaaacactttttaacactgatggtttcaccctgttgcagcggatattgctgtgtgggttatgtgggtagctcccatgtccccagccttgtctagcttagcggcacagatttgcattaattccatattactgtgcctctcagcacccatctgcctgcctgggaccctccgtttacctcagaactggctctggtatttcttggagtccctgttacgtgcttaaatacaagtcttcttgtgccaccccctttgacagtctctcacatggcctctgctgccacttggagtggggctgtttttgagccttattgttctatgctttccagctcccaggactgcactgattcctcaagggggacctggtgtgaagaaggccttccccagttcatcagcaggccttgacaccagaactcacagtggcaccatacacctctgtattagtctgttctcacactgctataaggacatacccaagactggataatttataaagaaaagaggtttaatcgactcacagttcctcagggctggggaggcctcaggaacttacaatcagggcagaaggggaaataaacacgtccttcttcacaaggcagcaggaagaagagtgagtgcccagcgaagtgggaagctccttataaaaccatcagatcttgtgagaactaactcactatcatgagaacgggatgggggaaaccactcccatgattcaattatctccacctggtccctcccatgacatgtggggattatgggaactacaatgcaagatgagatttgggtagggacacagccaaacctctaaagtctttcatgaaaacagcttctttcctttctggccaagcccactttcttcatgagacctcaaaatcagttcctggggcttgcacatgttggtattgaggaagaggagtctcacctctgtctgtcttatctcccagcatctgagcaaaaccatgccttcatccagtcaaaacagaaaaccttgaatgttcatcagccatcataatggcactgggggaatacaactgtccttgaggtcagcctgggtttaacaggaacacctgatgcaacctgagatggtggagagagcagaggctgcagagctggtgcaggactggaatgtcactgctagtcatgggatatgggctaaattttaaaaatgattccttccaactctccaattctgggattctatgttctgtatctttttcaatttctgacgtccaaagattgtatctcagctggtatatatgccataaaaatattaagcaaggaggcagctgtgtcctctcctctccagtagctacagctgtactcctgacaagcttattcttgggtatgataaaaatgatcactgtgggtattattattttcagttataaagatttttaatgcccaatctatgaagtcagaaatgtgggattttcttttccaaagggatgttatgcacacaagacagtctctgtcattcgattagttgtaaatgctaagctcagcactttggacaacaccaaaacccctgtggggatttgggggcaggtgtgatcacatatccagcttgcttcatttccctgcttcggttgtcgtattccacttaatgaaatagctgtatttccaaaaagttggctgtaaaacaaatttctgttagataaatcatacttcttcattgatctacacttttaaattaaggatgccttctcctgaggaaataattggccccaaaactaaatataaattatactacacactcgataaaccttttaaaatcacatatttaaagaaaatcttttctgttagaacactaatagtgatgatatttcctaaagtcaggaaatacaatgatcatgctaagaactacgactgtacatggtgttcttttgggattggggccacaggagggttaggtgagcaacaaggggtctctgactttttttcattgaattcaacgtgttgttctgggtctgtcagccagaagttagtcaataagaagttggcaaattttaaaattatgtaaactggtttcctagctgtcttgagagccagagatgtccaagaacctggtttctgctgtcaaaggccttcaatcgcattggaaaaagaagccccctgtgtgcagcacaagacagctactcaaaaacttgattacagttgcaggagcagtggattggacatcaggaggcctggtgtgctccatcactgaccagatgtgtgcccacagactcctctaagcttcagtttcccacaagaaaaatacgaggcttgagcgaaatcactagttcccaaacttgcctatttgtgagaatttcctaggaagattatgcaagcacctcatcccaggagattctggtttagtgggtatgagtgggacctagaattctatattttaagcaactactctagtgaattctactgcagacagactatgtactagcagagcaactatggaattatataaccattcatgtccccttaagctctttaattctgttatgattttaaagactagatgaactgaatgtgcaacaatagtgcagaacagccagaggcaccaagagttaggagacaaaagggaatgtattagtgtcccaggactactgtgacaaggcacaaaaaactgggtgctttacaacaagaaaactgtacagtgctggaggctagaagtcaaaatcaagtgattggttggaccatgctctctctgacagtgacaggggagaaccctccctcgcctctcctggcttctggtatgcaccagcaattcctggcgttccttggctcctagaagcatcactcctatcacatggtcatcttcaccctgtgtgtcttcacactaccctttctctgtgcatgtctgcccgaatccctttttataaggacaccagtcagattagattagggtctaccataatacctcattttaacttaattacctttgtaaagacctttttccaaatatagtcactctctgaggtactgatggttaggatctcaacataccttttttgggaggacacaattgaacccataatagggtgtttgcaaggaagagttaaaatttgaaagaaaggtggtatttgcttagatagatagggcacagctttctaggtgacaaaaaaaaaaaaaaaaaaacaatctgtgaagaacaaatcatcatgttggtccaggatgagaactagcatggcctggcaggagagctgcagcagtggcagtggtggcgtggtataccagttgtttagactaagttctacagagggcttctcctgggcccctcagtgtccccactgcactccacgtgttgtctttcacagcaaccctagaagtaggtaacgttattctgattgtgcagatgaagatatggtggtacaggggagttaggtgacctaccccatcatgaaactagagggtagagaattggtttcttctgatcccaaacttttgcctcttaggacgatgatctgttgccttcttcatagcacttgtgcaaaataaacttgggtgaatagatcagggctactttgtggagggctttgataataagggagtagagtttgtgtttgatgtgacagaaaaataaggagccatttctagtgtctgaagaagtggaccatgatgaaggggtatttcaggaagatgagtgtgttatttccacctgaggatgcattttctttacagaaagaaaaagcagacttataatgagaagctgttgaccgtgaagtttcttttcatagggttatatcaagtggtttgcctcttccccactgatgtctcttaaccaagaatatccttcagcactttaaagactatgcttgctttttttttttttacccaatatgctttgtaagttcctcacactagtgataaagcactgatcacttcatagccacagcacaaatgcttttaaacgaaacttttcgttgatttattaactctagaaagtcagattgcagtttagtgttttggggggcttgtttgaggcatctcctttaggaacctgattttgggtggttcaaagtttattttgttatgtgtaaactgaccaactttctctctggttttgccatatatgcctctagtagagaaaaaggtgggtgaggagaaaagtgagcataatgacaatgaaagcttaaatttattaagcatattactatgtacaagtcactttttacatgccttacccaacttaatcaaaaagtgtacatgtaataactggtgagcaatgaagtcattgtgatttctctgggattgcacatttggtccagggaacataggaaagtaggattaagcctcactgttcctgcaggatgacttgaggaaaaatctcctttctctggaattagaaatttggatcagtagagaccatacgccttccccaaaacttgagccacccaacgtcctttcctacacaagatcacctgacataaatatacaaaactacacataaattaatgtggcacccatgtccccacagaaaactgatgagttctcgattttgactgccttaatatttgtgtaactgcatttcagtccaggactgtcatgcctccaacaggcctttccatttggatgtccatgacaagttggcccctgcaaatctcgctgtggccacaaaagagcatatttgaattatggaattgaaacagatgcatgaactttagctggagagcacaagagatccagagaacctctgtctttttgtttgtttccccgctttggtgatgtaatacacagcttcacaggagacctgaggtcctatcagtccctgctccgaccctggagctcaatccagaaacagctgtccagagctaatttatttcctaatgctgcggcactgttaatttataaattacactggtaattcgagctattattaatttcagatggtgtagggcaagcctaattaaaatatgacaccaattgccacacatatgtaccaaggactaccatttaaaattaatgggaatattaagtgtgacactggtctccgagatgcttggcacagtaattatagcattctggcaggggaagatctgacaaatgtaagcccgtggttggtagcaaataaacaaggacaacacaagaggaattacagattcttcatttaaagctcttctcaattcttccacccatcctcaaatcaaggttagtacctttcccctaaagatgcttatcaaacaatattcataaaggctactgagaccattagaagtgtcttactggtaggaactatgagtctatttgggttaatgttgtttgtcctcttcacatcctggtctttttggctgtgttttctacttatgaagaggttccttctttgtcttgtgaatttagtatctctttcttgtttgttgtaatggacataggctgttcttttcctcttctgtatgtaacagaggcaagaaaccgtctgtacatacatagtgtagtttgcatatggcatgaagatgtatgagatgaggccccggttgggcctactgctgggcagtggcacagacttatcatggccaaagagtgctgatcgaatggaacaaggcagtggcccttgttcacaagaccatggtcttgttgttgttgctgttgttattgttattgtggttatcttgacaaaacagtgacttcaacactgttatggaacacatacaatcatcccttacataccgcacacatcatcccttgttgtatcggttttttacagctactgttttcgtgctctgggccagcagaaacacgtggcattatggaagggttttctcacctggagagaaatgtccctttgttccctttcttgggccactcatgttaatacagtgctgcaccccctgaagctgtgcctccaaccagattataggagtaataactaaatcaacaggtgggcagcacacgagagttttggagtgctttcgtgcatgtgtgtgtgtgagtgtgtacatatatatgtaggcatgtttgtgtgttagtctaaatagccccgtgaccctgtgaggtattaggattgtatgtatattatgtttgggaaaatgcttctcaattgctagggacagccttatgcctgttgtctgctaataatcattaattactagcacctcatttccttttaaaggtatccaggtttaggatgctgtctttctaattaccctcatttaagagagaagggaggatagcttgggatgtaagccctaacttttgtttttcattgtcttttggcaaggaagcgaaggctcaggtgcctctgggagagaactttgaaatctcctctagccttaaatatcttggtctttcaataactgagtgctcatggccagacgtcaggcacagagtctggtatgtgaagcgttgttattattactcataatttttcactgaagacaatgagtcccgcaatgattaggggactgagtggattcgcagccacgtcgcctgatgaatctctgacatgcttacaactaggcatcgagtgcggagtcccattgctggtctgtctttaggatcttgtacctaggagctctagcagatcgaagtttagcacgttgatttctgcctatccaattaattgtctgagtcaaaaaacagaaaattaaattttttatgttagtgtttctgctacctttgtgatgcacgtgtgtgtgtgtatgtgtatgtagctgctggtgtggcattttcaattaatttatgctcaagtgtgcagtcataaattttatattcaaggctcagtctaagtgataccttgagatcagaaagagttaaggtgcctgactcagatcccagagcacgacggcttggtaagatacaggcagtgtaaatgtcaaaattattaatcacttattgggaccagtaattctctaggcactgtgctttgttcagttaggaacacaaacatttcagctgttccactggggagccaaggaaaagttggtggtgcggaggtgtagaagagacggaggagggataacccacacagttcctcagaatctgaacttacaactggcaaattatctgcagacataaccattttatactttgttttctaagtgaacatgtttggtcttttttttccttgtatttcaccacacgttaccggttttcccgcagcggttggctttgtgagtgaagacgaatacttggaaattcagggcatcaccagggagcagtcaggggactacgagtgcagtgcctccaatgacgtggccgcgcccgtggtacggagagtaaaggtcaccgtgaactgtaagtgttctcaccaccacgcgccctgcacgtgcatcaggctggcctgttgtcacagccaccacccagagcccattggcacagccagctactgacttagggtgggaagaatgcagcaccactttccacactctgctttcaggagcaaacatttcaaactcgagtttttgacacttcaaggtgtcacagtgtcacgctgaaagaaaaagtagctaaagtaactgaaaataatgccaaacttgacttgcatggctggcagatcattaaatggcattcagctcataattttttaaacacgtcttcaaatccaaaattttcccataatttactcacacaatacagttgtgctggagcctctcactgtctagaccagacatctccataatgggacaagaaaccatgtgctagagtgtatgaaggaagtttcaaacttccatttatggtatgtctattatatctcattattttacaattatagatgtgcatggtatacatacaaatagttacgatatagatcttagaggatgtaacaataaatttgcttgttactaatagagatacagaatccaaaaagtttggaaggtgctgtgtggacccctcattctcctttctcagccttccagattgtctctgacatcaatcctacttgaatttgctacctcctttcactcttttccctctgggtccctcattatgtaccttgccttagctccctacaacattctggaggttttctctgctgtgcacattccaggaagacttacgaagcaatagaactcaataactaaatcggcaaacgagatgacttcccttcaaaacttgggtggcgtggagttaggagaaggatactgtatctaggagaatatccagtctttcagatttaggtttgtgttacaatgtgaacccagtcaatatgaagcggtttaagaagcaaggcaataggtataaaaatgctgtcattttaaaaatcatatcacaagtttttacaaagggacttaagaggatttacagtttataaagatgaacttaaaacataaagaaacagaagcaaagaaaaaatacgcttaggaaaatgagtgaaagctaggaaaacctcagcacatgaaatattaccacaagactgctaggtgcaggtgcagaatttggctcagccttgctaaagcaaagagggaaacatcacctgctttaagatttatgttgtccataagataaaagcaaattagttgcttgggagaaacactgcttttcgtggtactgagaccctagagaaaattctcttcagggtctccacaaatagagcactttgggagagagtcagcaacatcatgtacaatatttctgcattaaatagaatagccagtttattgtggctgtttttcataataccctttaatataaactggtagaatgtgaagagtagtttggtaaagacgtcaaatgaatgcaaaccaagtgcgtaggcctagcttggtcacttgctctggtttgattcagggatctgttttagaataccaagaatgactgatctgtatatccttcaggcaattctccttgaatattatttcttgcaactgagcttttgatgggaattgaatagttcgaggttatatacttttggcaagaacctggtgtgcagaaattctagaaggctgattaaaggtgctgactgtcaacccgtggagtgtagggttgatgggctggcatcatcctatgaaagttaaaaagtttaaacagaaaaaatgcttgagtacatggtcatttcaactctgtacagaggagaacaaaagcagtacatgaaaggaagacccagctttttcttagagcggcatcaaaaaggtttttattctctggtacaatttatgtagcagttttaccttctaagtaagcagagccagggcagagactgagaaacaaaatcaacaaatgaagcagccttcttcattttaaaatgctgtagatcaggtgcagtgccctgtaatcccagcccttttggaggctgaggcgagcagatcacctgaggtcaggagttggagaccagcctggccaacatggtgaaaccccgtcgctgctaaaaatacaaaaattaggcaggcatggtgccgtgcacctgtaatcccaattacttgggaagctgatgcaggagaattgcttgaacccgggaggcagaacgtgcagtgagccaagatcatgccactgcattccagcctgagccacaagagcaagactccatctcaaaaaaaaaaaaaaaaaaggtgggggggcggctatgagacatcttctttttgcagatccaccatacatttcagaagccaagggtacaggtgtccccgtgggacaaaaggggacactgcagtgtgaagcctcagcagtcccctcagcagaattccagtggtacaaggatgacaaaaggtaaagcttccttctttcctatcccacccctacccccatctccaggagaaacttttccagggtcctgattccacattgttgcaaacgagttctataaaatcctcttctgaacttatctctatagggggcaaatgtgcaaagaagtcttttcttaacattaatggatttcagctacgtttttaatgtcaccatgtagaattatcactggccaaccaacagatctgaaaggtaactttttttaggaaggcaaaatcacaaaggaaaggccaccaggagcattgtaaggcctgtgaattttttataggccaagaacataatgtgttctgcctgaagctatttttaccacattctcaggcttgcgtaaaggagttaggaaggctctcagggccctgggagtggctaataagttagctgcagctagtaggtctcccctcctgttccagacactatcagtagcggtgtataagagtccatgacccaatttagccctccctttgtgcccaagttgttcttttactgtaggagaaaagagaagggactattcccttccttcccattgtcacagcatcctcgggatatttgttgtgagtcactgaagatgatcatttccaggctttatcaaatgacatatcagtgcagggatcagtagctcagtacagccaggcaccatggcaattgctgttatcaaagagccatttttaagggggatgaacaacgggaaatgggcaagagctgcctgtgttcagaacattttcattgaaaaagaggtggtggtataggggatgctagagagtcctgaggtgtatgtggggtggagtaagagcaaggagtgggggaggccaggaggctgagaaggaaaaacaatgaagagggcattctgagaaggagagcagcatgagaaactgcaggccaggagcaagtgaatggccgcccacgctgtgtgcacgtcttcagccagccttggctttgtttccttatgaggtcagtcagaaacctaaagctctttctagtctctagatcgaaaattgaattttgtttagaaccacgtcaatcagttttaagattcactgggttttatcataatcctcccaaatgaaaagcagtgttttgtttttttaaaaaaaaatttttaaggacacattctggcagcttctagtgagatgtattatattcatgtagcccattttacagatgaaagaactaagacacaaaggggaaaaacaaactcatgaagaaatagagctggctttccccttcttccaagaaagaagaatcaagcagactggagcgtgtttttctgataaatatggtttccttacttagaaattctgtttcacttatgcgtttcctcttcgaccttcttattgtactaagaagtaaactgaggcataaaaattaattattgaaccaaaccaaacaaaaaacctattgagctatggggtcagttcccaaatcttcaattgtctaggtcttaatgaaaagtcatcagctgcgtcctattattccaattctttattggagaaaaatagaaaaaatacatataagggaaagcaaaatcttagaggaaaataaagcaaaagtggccaatggcgagtaaaaggatgagagagctctcctctgtgcagcatctctggtcacaatagggacagctgtccctgccaccattcacccaggaggagagagcaggctggcagggccagggacagtcttcagaggcccctggctcaggcagctttgtttctgtctttctttcagttcttctgatggcctctccttttctcccctttccatttagtggtttagtcagttttcccttccctgcacatgtatttatttatttccagtgtgctggcatgagacaggggctgtctttcctcctggcacccagctcagctgcagcatccctgcctctgaggtcctggtcacagcaagttgggtctgccaggtaggtctcccaaggcatattgtgtctgccctggggggaaggccagctctagcccatctcccattttcagtgagatgagcagactaccaaggcagattaaaggaaactgtgtggtgaggacaggcagttttctcaagagttagttaggtgagaagtcttttggccacatgccagaatgactcaactgcacgctattgtatgtgttatccaacaaaggaagaggaatggaatgctatacctacggaaggccacccatccaacaggggcattgaccaatgaaaagtccacagctttggtaagaaactgaggcctggaagcagtgcgggatggaggggatgtgtgcccgcacagagaaggggaaagcgtgtcctcccaggagctgcaaagcctgcaaagtgctgctggccccctgtgctgtttttagctaaagacatttcagagctgtcaagcaggagcctactttcagttaagtctctccccactgcagagctgaaatctcattcacagtttggttatgatgggaaagcttcctccccatggtggacgaatggtgtcaaaacggccagtgggatcaatcagcctgacttgctcgcagaatcctcccggtgagtggtatggacagcaccccctagaggatcaatgtatacatagcaagctggaaatgtaaaagtggcctgtggctgcacagccggatgcctcattccatttggacagtgctagcattttaatgaagccgtggactcaggccagttcattgcccctagcgtttggagaggaaggctcccagaggaacatctacataatgaaaagcaaggcaagtctgtccaacctatcttctgacttccctggaggcagatgttgggtgagaactccggccagaacctgcctctcttttctgatcaaggttactgtaagttgcaggagtggagaaattattctgtaatcccacagagacaggtcttcagataatgacaaagcagctgcactctatgccaaaaaacactgtgacccagggatgggcaagagtcatctatgtctaactccatagaaatacattatactgatgccattgtgcggtccgcaaagcatttcctcatcattgtcaaacagccttgagtactgtttgtttttctcaatagcatccatttgccccaaagcatgtcccctgaatctgttccagtgtgctcccgccatgttattatctgcttgctacaagctgtgctccagccaggccctaaacaggaaacttagctttgtgtccatattccctgagatccttcatcaagaaggggttttttgccccaagagtattcatctttcccatagcatagaatcagcttcagggcaaggattacagattgtttgtttcagggaaaaagtaaaaggttggcttaaagctcattctaagaaatggacatttcggaatcttgcaaaggaaagtaggtggtatccatgatcgccataggaattgctgttaacaacttcctgagaaggaggacatgtgcctactgactccaatagcagctttctccttacccttttatctgcctggtaatagaatccatggttctaataagcatacctcacttcccccaactaactaactccctgtggcatttctgtagtggcccccagaccaatgcaagtccttgtggcttactgggctgccattgtggagctcagggagactgtcctggctctaaagggacatattcttgggaacctctaatccttccagactaatcctctataacagtctgggcagatcactcctcccaagcccttcagagtcccctgatgagaaaaatgagaaaatgatgatttttctcctcttcatagccaaaaaattaagtattatctatacaatgcaatgcttctggtgcttcaggagaaattagattaccaggtgctcgaaaaacatttttctttcaaattcctcaggtggctcttctctcagaagtttgagtttttcatttgcatggttgtcatcatcaccatcaccatcatcatcatcaggcccacacatttgaaccacctactgtgtgaatcgtattgctctgaatgccacacagctggcaggggttatttgttgtggtgttgctgtcagactacaaagcaaggatgagaggctagggagatcagatgttctggtaggagtgcccctgggcacatgtgtgaaaatcaagaaacaacgtgtcactcactgtctgtgaactactactacattatggtgtggttgagtggatcaaataatggttataatgatgtcagaaaggggggcaaggagaagaccaggaatccctgggcctatcttcttcctatgaggacacataaccatcttgttttcttcttttttgtcttttgtttctctcagactgattgaaggaaagaaaggggtgaaagtggaaaacagacctttcctctcaaaactcatcttcttcaatgtctctgaacatgactatgggaactacacttgcgtggcctccaacaagctgggccacaccaatgccagcatcatgctatttggtgagactgtgctctgagctgggcaagaagaggggagagggtgcagaacgggagagctgggtgggagggcccctcaaggccagggtcagaggttagcagggtatcagtggacatggagagggaggaaaaaaaagagagagacacagaaagaaatggagagagagggacagagagacagggaggaggcagacagaaagagaaagaacaagagatacagtttacatgtatacaaagtagtatatgtatagtacatgtataaaagtagatctcagaagtgggaaaaggaaaatgaaaaagaatgttcatgtttcattctataatggaaaagatcccgagataggagaaaaatactttggaatgccaaaaatgacatttgattttttttttctcagtgatgatggctcctaagctgactgtgggaatcataattgggtaaaatagtcaagaactcagaggggaatgtttgctatttcagtctttgcttactggcttagtgtaaaattttcctttttccaaaactgtctccagtcgctgggacatgaagagccccaccttcgtcacatatctggctactgtattgatatcagaagaaagtgagcgagctcccttgtaaaccctgatgcctgcccctgctagcagacagctgtgcagacatgagcctgccttcctggtggtgccaccaggcagggccctgggcctctcatgatggctccatcccttgatgaacgcagattctccctaaaggccacaggattaaattccggttgtgttttgggcaaattccttcataccccatcaagttctttgagcttgagatttttcaaacctgtctccccaatccctcatgttaacaagcactcttgaatgtgatggggaagtaaggggaggcatttgacagataatttgcaagaacacaaattccttatattctgaaaactttgggataatcccatggcccagccatgtgccctcggtgctagcgtatgtggcttgctctgaatcacgagcctgcactgcttcaccacacgatctctgctcacccattacatcctcctgcattctacccggcacaaatagtaaatcccagctttatctgagagagctgggaaggagaaagccgcccttgatccccgagccagtggcttggaatgggcagagctgtgatttgagtgattgatgtgtctggcatctctcacacagggatgatcataagagccccttgcatttttcatgcctttttgcctttttggcaggcgtctgtctgcatgaacagagaccaggattaggaaggaacagacccctccttcccttgctttgcaaatctaaatctaaggctccccctcagtttcccattaacccaagtcctgctctccacccacagcactcctcatcctcacaggggtagtcttccccccgccaccccccactttgacctactctctcctgacttggttgcatgaaatggttcagccattggctttatcatgattgtatacttccccggcttcttctccttaagccatctcaggatgagaatagggagaagcagcaaacaaacagttctcgtaagagttgaatagatgacatttatgacaaggaaagcagtgaagtgcaggtcataaatatgctcttttcagcaggcacacatgtagcaattacaatgtctacttcccatgccccccaccctatgggtctatcaatcagcatctgccctgtgcctcctttgggacgtttctaccattgccagctctctggcgtccagggttttctaaaaaggacatggaaaagtagtagtatgtattcaaatatgtttagaaagagtgggtcacaccaagatgagtggggtacatgtggggatgttctttaatgccagaagtcccggagccttaacatgctaaatctctaggggagaaaaagtttgcaggatgtttcaatcagaaaccaatttaatttgttagcttcagttgagagatcattcctgaggagtccatcactagcaatgctgcctgggtaacataattctgtggagctcgcaaaccccattcctgtgtgagatgagtatttgcagccaatagttcggatgttattgtggctcctaggttcattattgaggctcaccatcaatgaggtcttttgacaaatatgaatttgtttgtttgttagggaattttccatgtcagtttccattaaaagccaacaagcacacttggggcaggttggaaagcagcatgtactttttgcgaatatacaaacttcttgatgaagttagaaaggcagcaaaattatcatcattttgccaccaacttgtgcataaactgcacgctctctccaagtggcctagacgttgagaagtgaggaattctggtgcaagagaccatagtcggcggtctgggaatacttaagccaaacgggagcaggttagtccttcccatcacaagcacctgatcgctaaggtgacagggcttgcaggggcctctgagagttctgctcccgcactcctgaatcacagtgctctggggagctcgttcgttcctaccgtggtgccaggggcaaaaatttctgaatttggtgtcctaagatgaaacgatgggggtggggaagtgggaaacaagtctcatctggaaggaaactttagtcctttgttatccagttagtagcatggctcagcatgagctaagagtgaatccaactgcaccagaatatgtatggcgtaaccagctccctgccttcccagtcacggcattcaatatggaaacataaagcatgtcagcgtttctcttgccgcaccttgtcctacgcctttggtttctgtcttccttttttttatataatcccccagaaatgtctgtgaaaggcagtatacaaactatatatgacaaatatatagcactgtatataatatatgtgtttgttctcatttttctctcctgtgtgtccctcaaccgatttagaactaaatgagcctacgagctcaactttgttgcaaggtcagtatcttccttgctttatgttttgtctccccttccctctatcccagaggcccccttcccctgctgtgcattacccgaagcacttgtctgtaaagtgtcttagaggatgtggaaggctattgaaggaggtgattgattgggagccagggagacttcaagctccctttgctttgctcatcccttgctctcactcccccaggagggctgggaaggggaaagaaagaaagaaaagtatcgttaaattctcaatgcccagggatcagcacaaaggcaaagggtagagagtgagtctgggacccataggaagactacttcaactgactgagcagttttcataaaaagggtcttattgatgacccctcagcagcagagtcagacaccaagcacatgataattcagatattctgtcaaacgcatcaactggctcatgaggttctccaaaggaggaggataggcatggcactgcatgagtggttgccaatacacagtgatttctaggggtgctactggggtccaggttagggcctgacgtccagtagctctttggtcttgggtgactcactaagcctcatttagactcaatttcctcttctttacaatacagttgatctaccttatccaccgtacagagttgttccaacagtcaatggagaatgcatgttacaaaggctttgaaaactgtgaggtgcatgttgaatctccaggcataaactgaaagacaaggatgcccctcagtggaacatcatagggggtccttcactcatttctcagccccttctccacagtccctttacatcctcttccacttccagtcctcccctgcaaatatctcccgcgtctcttgcctgtctttgcacatcccttccaattttctcactagcctagagtgagtgactcattaagactatgactatgactaagcatccaagcaagcagtggaataaaatgggtgccgcgtgcactgctgtcaccctgaggacagtgctgaccacagcagtagcctttcaggaaggcagctgtgaagccagggaggggaatgcttctcccaccttccatcccaatcccctgacctcctctccccacctcaccccaccctgttcatcccctcacattctggccttgcaaactgtcatcagaggatggctgtagactttggaggtggagggggagatgaaaagaaatgcattacatgggaaggtgcatgacagatgaaaaaaagtacctttttatcatggaaagagtgagggctgcattactcactttagtgatgtacagcaccacagcgatgagccacaagcaagaaaatgaaacaaagaaatagaaaaagtgaagtcaatagacttattcagattcaacctatgattcaacttacgtttattgaacctccatgtgactgtattcacagacgtaaaatagagagcagtagaaaagtggctaacagctgaggagccaagatggccgaataggaacagctccagtctacagctcccagtgtgagcgacgcaaaagacaggtgatttctgcatttccaactgaggtaccgggttcatctcactggggagtgccagacagtaggtgcaggacagtgggtgcagctcaccgtgtgcgagccgaagcatggcaaggcatcgccttacctgggaagcacaaggggtcagggaattccctttcctagtcaaagaaagcagtgaccgtcggcacctggaaaatcgagtcactcccaccctaatactgtgcttttccaacgggcttaaaaaacggcacaccaagagattatatcccacacctggcttggagggtcctacacccacggagtctcactcattgctggcacagcagtccgaaatcaaactgcaaggcagcagcaaggctgggggaggggcgcctgccattgcctagttagttgtttgattaggtaaagcagctgggaagcacgaactgggtggagcccaccacagctccaggaggcctgcctgcctctgtaggctccacctctgggggcagagcacagacacaaaagacagcagtaacctctgcagacttaaatgtccctctcagacagctttgaagagagcagtggttctcccagcatgcagctggagatctgagaacaggcagactgcctcctccagtgggtccctgacccccgagtagcctaacgggaggcaccccccagtaggggcagactgacacctcacacagccgggtactcctctgagacaaacttccagaggaacaatcaggcagcagcatcagtggttcaccaatatcccctgttctgcagcctccgctgctgatacccaggcaaacagggtctggagtggacctctagcaaactccaacagacctgcagatgagggtcctgtctgttacaaggaaaactaacaaacagaaaggacatccacaccaaaaaccaatcagtacatcaccatcatcaaagaccaaaggtagataaaaccacaaagatgggataaaagccgcaagatggctgaataggaacagctctggtctacagctcccagcctgagcgacgcagaagatgggtgatttctgcatttccatctgaggtactgggttcatctcattaaggagtgccagacagtgggtgcaggtcagtgggtgcacgcaccatgcgcgagccaaagcagggcgaggcattgcctcactcgggaagtgcaagggatcagggagttccctttcctaatcaaagaaaagggtgacggatggcacctggaaaatcgggtcactcccacccgaatactgcgcttttccgacgggcttaaaaaacggcgcaccatgagattatatcccccagctggctcggagggtcctaccccacggagtctcgctgattgctagcacagcagtctgacatcaaactgcaaggtggcagtgaggctgggggaggggtgcccgccattgcccaggcttgcttaggtaaacaaagcagccagaaagctcgaactgggtggagcccaccacagctcaaggaggcctgcctgcctctgtaggctccacctctgggggcagggcacagacaaacaaaaagacagcagtaacctctgcagacttaaatgtccctgtctgacagctttgaagagagcagtggttctcccagtacgcagctggagatctgagaacgggcagactgcctcctcaagtgggtccctgacccctgacccccgagcagcctaactgggaggcaccccccagcagggccacactgacacctcacactgcagggtactccaacagacctgcagctgagggtcctgtctgttagaaggaaaactaacaaacagaaaggacatccacaccaaaaacccatctgtacatcaccatcatcaaagaccaaaagtagataaaaccacaaagatggggaaaaaacagaacagaaaaactggaaactctaaaaagctgagcgcctctcctcctccaaaggaatgcagctcctcaccagcaactgaacaaagctggacagagaatgactttgacgagctgagagaagacagcttcagacaatcaaattgctctgagctacgggaggacatttcaaaccaaaggcaaagaagttgaaaactttgaaaaaaatttagaagcatgtataactagaataaccaatacagagaagtgcttaaaggagctgatggaggtgaaaaccaaggctcgagaactacgtgaagaatgcagaagcctcaggagccgatgtgatcaactggaagaaagggtatcagcaatggaagatgaaatgaatgaaatgaagcgagaaggaaagtttagagaaaaaaagaataaaaagaaaccagcaaagcctccaagaaatatgggactatgtgaaaagaccaaatctacctctgattggtgtacctgaaagtgatgggaagaatggaaccaagttggaaaacattctgcagaatattatccaggagaatttccccaatctagcaaggcaggccaacattcagattcaggaaatacagagaatgccacaaagatactcctcgagaagagcaactccaagacacataattgtcagattcaccaaagttgaaatgaaggaaaaaatgttaagggcagccagagagaaaggtcgggttaccctcaaagggaagcccatcagactaacagcggatctctcggcagaaaccctacaagccagaagagagtgggggccaatattcaacattcttaaagaaaagaattttcaacccagaatttcatatccagccaaactaagcttcataagtgaaggagaaataaaatactttacagacaagcaaatgctgagagattttgtcaccaccaggcctgccctaaaagagctcctgaaggaagtgctaaacatggaaaggaacaactggtaccatccactgcaaaaacaggccaaaatgtaaagaccatcgagactaggaagaaactgcatcaactaacgagcaaaataaccagctaacatcataatgacaggatcaaattcacacataacactattaactttaaatgtaaatggactaaatgctacaattaaaagacacagactgacaaattggataaagagtcaagacccatcagtgtgctgtattcaggaaacccatctcatgtgcagagacacacataggctcaaaataaaaggatggaggaagatctaccaagcaaatggaaaagaaaaaaaggcaggggttgcaatcctagtctctgataaaacagactttaaaccaacaaagatcaaaagagacaaagaaggccattacataatggtaaagggatcaattcaacaagaagagctaactatcctaaatatatatgcacccaatacaggagcacccagattcataaagcaagtcctgagtgacctacaaagagacttagactcccacacattaataatgggagactttaacaccccactgtcaacattagacagatcaacgagacagaaagtcaacaaggatacccaggaattgaactcagctctgcaccaagcggacctaatagacatctacagaactctccaccccaaatcaacagaatatacattcttttcagcaccacaccacacctattccaaaattgaccacatagttggaagtaaagctctcctcagcaaatgtaaaagaacagaaattataacaaactatatctcagaccacagtgcaatcaaactagaactcaggattaagaatctcactcaaaaccactcaactacatggaaactgaacaacccgctcctgaatgactactgggtacataacgaaatgaaggcagaaataaagatgttctttgaaaccaatgagaacaaagacacaacataccagaatctctgggacgcattcaaagcagtgtgtagagggaaatttatagcactaaatgcccacaagagaaagcaggaaagatccaaaattgacaccctaacatcacaattaaaagaactagaaaagcaagagcaaacacattcaaaagctagcagaaggcaagaaataactaaaatcagagcagaactgaaggaaatagagacacaaaaaacccttcaaaaaattgatgaatccaggagctggttttttgaaaggatcaacaaaattgatagaccgctagcaagactaataaagaaaaaaagaagaatcaaatagacgcaataaaaaatgataaaggggatatcaccactgatcccacagaaatacaaactaccatcagagaatactacaaacacctctatgcaaataaactagaaaatctagaagaaatggataaattcctcgacacatacactctcccaagactaaaccaggaagaagttgaatctctgaatagaccaataacaggatctgaaattgcggcaataatcaatagcttaccaaccaaaaagagtccaggaccagatggattcacagccgaattctaccagaggtacaaggaggaactggtaccattccttctgaaattattctaatcaatagaaaaagagggaatcctccctaactcattttatgagtccagcatcattctgataccaaagctgggcagagacacaaccaaaaaagagaattttagaccaatatccttgatgaacattgatgcaaaatcctcaataaaatactggcaaactgaatccagcagcacatcaaaaagcttatccaccatgatcaagtgggcttcatccctgggatgcaaggctggttcaatatacacaaatcaataaatgtaatccagcatataaacagagccaaagacaaaaaccacatgattatctcaatagatgcagaaaaggcctttgacaaaattcaacaacccttcatgctaaaaactctcaataaattaggtattgatgggacatatttcaaaataataagagctatctatgacaaacccacagccaatatcatactgaatgggcaaaaactggaagcattccctttgaaaactggcacaagacagggatgccctctctcaccactcctattcaacatagtgttggaagttctggccagggcaatcaggcaggagaaggaaataaagggtattcaattaggaaaagaggaagtcaaattgtccctgtttgcagatgacatgactgtatatctagaaaaccccattgtctcagcccaaaatctccttaagctgataagcaacttcagcaaagtctcagggtacaaaatcaatgtgcaaaaatcacaagcattcctatacaccaacaacagacaaacagccaaatcatgagtgaactcccattcacaattgcttgaaagagaataaaatacctaggaatccaacttacaagggatgtgaaggacctcttcaaggagaactacaaaccactgctcaatgaaatcaaagaggatacaaacaaatggaagaacattccatgctcgtgggtaggaagaatcaatatcgtgaaaatggccatactgcccaaggtaatttacagattcaatgccatccccatcaagctaccaatgactttcttcacagaattggaaaaaaaactaaagttcatacggaaccaaaaaagagcctgcatcgccaagtcaatcctaagccaaaagaacaaagctggaggcatcacactacctgacttcaaactatactacaaggctacagtaaccaaaacagcatggtactggtaccaaaacagagatatagatcaatggaacagaacagagccctgagaaataatgccacatatctacaactatctgatctttgacaaacctgagaaaaacaagcaatggggaaaggattccctatttaataaatggtgctgggaaaactggctagccataagtagaaagctgaaactggatcccttccttacaccttacacaaaaatcaattcaagatggattaaagacttaaacgttagacctaaaaccataaaaaccctagaagaaaacctaggcattaccattcaggacataggcgtgggcaaggacttcatgtctaaaacaccaaaagcaatggcaacaaaagccaaaactgacaaataggatctaattaaactaaagagcttctgcacagcaaaagaaactaccatcagagtgaacaggcaacctacaaaatgggagaaaattttcgcaacctactcatctgacaaagggctaatatccagaatctacaatgaactcaaacaaatttacaagaaaaaaacaaccccatcaaaaagtgggcaaaggacatgaacagacacttctcaaaagaagagatttatgcagccaaaaaacacatgaataaatgctcaccatcactggccatcagagaaatgcaaatcaaaaccacagtgagataccatctcacaccagttagaatggcaatcattaaaatgtcaggaaacaacaggtgctggagaggatgtggagaaataggaacacttttacactgttggtgggactgtaaactagttcaaccattgtggaagtcagtgtggcgattcctcagggatctagaactggaaataccatttgacccagccatcccattactgggtatatacccaaaggactataaatcatgctgctataaagacacacgcacacatatgtttattgtggcactattcacaatagcaaagacttggaaccaacctaaatttccaacaacaatagactggattaagaaaatgtggcacatatacaccacggaatactatgcagccataaaaaatgatgagttcatgtcctttgtagggacatggatgaaactggaaaccatcattctcagcaaactatcgcaaggacaaaaaaccaaacaccgcgtgttctcactcataggtgggaattgaacaatgagaacacatggacacaggaaggggaacatcacacactggggactgttgtggggtggggggacgggggagggatagcattaggatatatacctaatgctaaatgacgagttaatgggtgcagcacaccaacatgtcacatgtatacatatgtaacaaacctgcacattgtgcacatgtaccctaaaacttaaagtaaaataataataaaataaaaaataaaaaaagtggctaacatacagtatcagggaagtgagagagcctagagcatggacatgcattgctatggctatgctttcagaaggaccgagctagttctgaccactgagatcttcattctcagaggaaattggagcttttgaaactcaggtaggggtttttaacaagagagtatttaacagaaggtgtactcaactcacagagagaacaccatcccatagcaaagtcaattgcaggaaaaccaaccagaaacacaaattgaaagcaaacaggttactttacctggtcactgagcaggggcaaggagcccccatctgctgagacaaagctgggctgctcacttctctcctgtgaactgatgactctggttggaaggctttctgtgccaacttgctactctgattcttcggatgtgctcagcccctcatctcagcaaccttcttgggtgtaggagaatgggtcagcgaagaagactgtggatatctaaaacgttatgacagttggattagtacagtcttcagtagagctgctagactcttgtacaatgagaaattatttagagaaaacagcccttgcacctgggctcatttactgcactgatgtgttcattcccccgcctcctttgctagtcttcgatacaatagagagctatgtattttctcaggaaatacgctccaagttatacttaccttacctcagaaataccaggaaagatttatatgaatgcatggatttccactgacagagtacacttggctttaagagaagttcaaagctattttgctaaccaatatctggatggactagaagtattttgataagagaatttcattcttcctcagcattttctgccaccattgaagtattttactgcttcccttctgcaaacaaaacagattgcatgtcacctctcctattaatatttggtggtgcaggactctcacggtgataaataaggactcaaggatgttccaccatccctcactgggcttctgcacagtaaactgtactcaggccactgtgcaaactcagcggctccgtggctgttcattttccacccactggtcctttgtcttttatctcctgggcattaagtcagatttgatggtatcagtgggctggtaaaggttgactgattaatgtctgtaaacctcaaagtgaccatcaaagcaatttattaaagaatggggactaaagtaaactctgtatatcagaaggaaacaattgcagcagaagagattattagttcttccctgcagaggattaaagacagttaattaggccaagtcatccagtggttaagcatttctatggtatatgtgtgtctagataacagaaagcacaaaagaaagaaaattccctcaccctcttgctagaaggtttgtatatccgtcttcacatgaaaccagccctcctctgcccactagagccagacaacagccctttgcttatctggacactcggattcagccaaactggctttgctggcaaaaatataactttctggattgagcagacattgaatattgacttagagatgggatgggagggttctttttactgttgttttcttcttgttgtattttctgtccccctctcccctttcctctctccctttcttccttcctgtctccctccctccctcccttccttccttccttccatcctttttcttcctttcttttcaacatattttcccaccctccctgacctgttgttaatataccattaacaaagagatcaattaaatttcagttgaagtcttggtgtggaaaacgcatgcttgacaagcttgaattttcagggattgtttatgttcctgatagtcaaaatgttactcaaagactggagtttgtggccaggactagctttggtggctcaagcaaggctcctgcttctggaagcaggacacaacacacactggacagaagcatgtcaagcatggcacagaggacagtgccagcatgtgcaccttctccttagtaccaaagcaaggggggtggactggaatgagcatgatgggtttagagtatatacgaaaatatcctggcatttccacctcattgtggcgggctagaagtgggatcaaaaggaccctctagttgactggaaaggttgaacaactgctacctggaaaagcccaaggatgagttctagctaaagtcaaggatgagcatcacattttctttacctatgtggacactaaaaagagttggccatctttcaagtagtgtgtgttggagatttagaggaagagaaaaaaaccccatctggatggaataattaagctgaggtttttttgggggggtctttgtttatagaaaacctcttttattttcagcaggaatttgtgctttcaatgcattcttctttctgatagtctcaactgccaggtgaaggctcttcctgtgtccttcctccagcacagtctgaaccagtacgcccatcactgtctggatgagccccccaaaactgcttgtggtttgggggtaaaagttttatgattactttatctccccaagtctgtctttagtctgtccttcctccttccagttatctttttttcttggcacagagaggatcaaaaatcaccggtacctaaataagacaattaatgaaaatagcccctccccctccttagcttctgaacttgtttctggggcccagcaagcccttcaagggaccatccttgttaaatgcacaggcaccatggcatcatcacccctggcttttccctaccgtcctgcagtacatcagatattttctcaatcacaaaacttttgatcgtcgataaaccctttccctctttgtaccttcagggtggcttctcagggccgctaatgcccacttaaatcaagagggatatcgtgtgtcaggtgattttaaagagtagattgaaggtgtgaatgcacaagtacgtattcatctgactttgagcaaatgttttagttgcttttaggatgagttatatctaggttgtctttctgtatgcgaggacctttgcacagagaacacagactcccaaggcatcactttgatgcaaaaagctttagtgccattttccgtcctctctgtatccagggtgaacgacaaagagggaagtaaaagattagagatcattccaaattcaggccaaacaaggcatctgctatccacagaaaaggtggagagactccataggttgttctgagagttgaagctggtgaaatggagacctttcacagcctaggcagcagagaggggccagcctcccagcatttctacagggaggtcccagcaagtgcaactgtagcagcacgggtgtgggtcagagccgcaggctgccccagagagatgaagccctgtgggaccagcttggtattgtccagctcatcaagaaaagtcaaatgtcaatggtttggtctcctctggtacatggaagctgactcaccagtgtttctaaatgcatagctaaatgccagttaaacttttgcatttcaaatacagcatgagcacctacattcaaatgctgtagtataaatccatatgtagcaatcaactttatacgtaagacctacaggcttcaactaattagaggatagcctgatgaccaaagaaagtaagttgttctacaaagcctatttggtttggtgtctcaggctccaaaggtgcagctgtgtcacctgctaaaatcaggcggacatcttggctctgcttccatctgtggtccaatctgactgtcgttcacatccttctccagccatctgctcacctcttgaggcaactggctgcccaagtaaaccagaaaaccagaggggggtcacataggagggctgggcagtggtcaggacagcaagggacatgggcaagaggcgcagggacgctgctgcgccaggagcgccagcttcttcctgaaatcatctgagggcaaagtgagcatctccgtctgctttcgaccttaacagtggcttgtttttaatttcttttagaagtgaaaactacagccctgaccccttggaaaggtttgtatatttttcagacagctgctgccttggtgggtgtggggtatgtaaaactcttcaccttcctcccagatgccttctttcctgagctaactccaggaagcagcgcagagggaaccctcccccaaccttcaaccatctccgtgtcaatttagattaaccccatcctcaaggacatccaatccttcctaggtagatcccacttgcagtagcctaacttctctttgctggtggcactaatgagcacctgtcagtgcccagaatagctccatctctgggctactctgcaccaggcctgcctctttcctcacacacggatgctctaatgcagcgatcttctcagaccttggccctgcatgctgcccttgcttgcaccattctttctatctctctaacttggagctggaagggaagtggcaaggggaggggaagatgggaggaagggggaggttcttgggtgagtcacttggctacgaataaaatgcatcttatttgaagctttcattcctgccagatgtttccgatggataattgacactcatcaccgttctctgggaccctaactgtcctggtaattagtctctttaggcctccgcagctctctaatgagatagaggcaataaaggcattcactgtggagtggaggcgtggctgaatgaagaatggaggcctcatctgcgtggcccatgtcactaggcagatgggctgagctgtagctctgaccagcactggctttgagagggccttgatcccagggtgctgtggtccacgcccacctggacctaaggtcttcatctcatctcatggaatccttccacatagcattcattcattcagtgtgggatggcctgcgggaagcagcccagtggcacgcctgcggttctcaccttttaacctgtacccaggtggagcaggccatgcagccacactctcttctctttattctctgaagatgcatctctgagatagtgggaagatagttgcatttgaagacagaagtcaagagacttgggaaagtcacttaagcttcctgaagttcagtttccacatggtagaaagggagataataattctcatctcctacatgagtgtcattaaggtgttgtgatagctttcccagtgcaagcgctctatctgaaatcctaactgacatggctttgcttctatgtagatagacactcagccacaggaattctcagtaagttgtattggatatagttagaaaaggggaggaaaggtatttggaagaggaaattgaggtaaggcagagggcaaggtatgaaaaaagtttttgttttattttttcttcaagtacaattttaagcaaaagtaaaacacaaagacaaataaatgtggatatgtcagcatgagtggcaatgccccctccttctttcaacaaacattggttgaatacctgccacgggccaatgagatacagactctgctcttaaggaacttactgcacagaggacagaggaggaaatacaaataagttaggcaaagagaattatgacacagggtggtaagtattttactagtgggatgtgtatggcactgagcaaggcagggaaggctgcctgcaagaggtgctgaaggctggaagaggagctggaatgaagaataagagtgatatgggtgagacatatttcggacggaggggagagtgtgtgagggtggggaaaaaagacccgcccctgtgtgctcacatgtggttatgtggcaaggggcaagggcaccaaactaggtgtggcaagaagagacaccaaggctgcagactgcaggcacatcacgaaatgtagtgctcggtccactgagaagctggacttggtgctagcctgttggcctcaaatcaatgaggatcatgatcgatttggggtagaaacatcaccttggaattcgcataaagaataaattccaggggtcaaggccacaggtggcaaggtccaattggtgaacatttttgggaattgaaagatgagatggtgcagagtatctcctttgggaggatgtctcatttgagagaatgcccctgcctcggggctacccctgtttccttctccttctgtccaacttggtccaggtctggtgtcctggatgtgctgctgaagagacaggttccgggggtggtgagcgcatgtacctgtggggtgggctgcgcagactggatatggtcacatagtgccagccactcaccagcctgagatggagatgatgatgatggagagcttcagaggggctgctcaggcttttcccagatatactacaagcaagagaatggctggcaggcacttggtggcctttttctgtcttccataggaagaattttctaacacaacaaacaggtgaggacacgactcgtctttacaagctctctgtggtgcttcccagcatggagcagatccacaaaagaactctgaggggcgtagcaaggagaccaaacacaggcacccagggagagcgcctggcatagccacagggccattgagatctgccacagggggtgtttgcccgctctcagtcgtctcccgagctgcagagtccccagcctggaaacaaggtttcagcattcccttacatggtaactacgccaggcccctgctgggctgaacacctggctgtggcattctcctccctggaggcttccactggcaggtcaggctgcaaggagggagttcagaagagaggagagaacacctcagtgcagggaagcggcacttgttttccatctcttacccagggcatcttcttagtcacagggagggagcgggagacgggaggtgggagtgtgcgggaattgaacaggaaatgggtttcaaagatgtgtgtggatgttcaggagagcacaagggatgaaagaggcagagcagtgtgctgacagctgtgtcccctgccgggagttaaggactccagtgtgcaggacacgtatggaattgtacggtgtgattcacgcatatgaagctatcttcatatgaatgtgaacactcacagtgttgaggcaaaacattcgacctggcttccataaaggcctgctgggccatatggactcagaaccacccttgtcgtctcagagtcctcagcctcgggcacagacaagggccttggttggaagaatcttggagttgcctagaggggaaggacttacgcagagcagagaaacatagtctctcacccttgaaggcatccggcggaggcttctctcctttgattccaaagaatgtgctctgtagatgacagagtgagcatctacaaagggggaacgtctggtgatggtttctgtggacacatagtagttagattctagaagacacaaccagttagtgaccgatcctaaatgacaagcatttctgggttgagatttaaatccgcaggagctttacaggagtgctccttggtcacctgtatcctagcacagatgcctttggttttgtgttttctccttaatgcagggtagagagaataagtatcccctgggcttctcagcatggggatctgcacctctgagaagttccggccttagggatactgtgaatcagacaccagggaaacatgaggttgatgacctattgcatttcaatctcatggctacctatttagccacgcccccaaattagggatttatcccaaaaggccaagacataaaatcatatgggcactgcctcctagccaggagttctagacttgatggaataatcccacatggaattgagaagcctgttttgattttgatttgttttagccagaaatgtatccaacgctgagcatccaagtcaggcaggcaggttctggctttgttccttgttccctaatccaggaagacatggacttagtgaggccaccagctttaaatacctctattaaattcaatgcaacagagtatgccagagcaggtccagtctgaggaggtggcctggttccttgagtagctaattcatctgggcatccaaacttatgtactctacagaaatcaaagctccactggtcatggggtttcttggccacaagggccgaggtagccagaaaacgtatgtttcagaacaatagggaagctgctggggaactgtactgccttgcagttctcctgcctcctgtgtttgtctccatctccatacactggggcaggttctgcatcccagtgtcctcattgatctccagttacatccacatgcacaggaaggcttcctgttcctttgtttgactcacctccatccatgtgggctggcttcggccttgcaggcatgtgatccttgagctgcatctgctcttaccccatccagatggggaagaggtcaagtgctccaggtggaacccaggtgccctgccctgagatagagtgattggcaggatggcctctgtgcccaaggaagcagaagcagcaggcagacacattgttttgtccaacaggttcttttctgagccacaggccaagcagctggagggtgggtgagtatttcaggcaggcagtgctcagaagtggatgggtgatgaggcactcagcacagtagtctgactttattaaagctctgtgtaggatattaatgaatctgccaccttcttcttgaatttgagcctgagccatggcctttgcatgttatgacacagtaaggaagaaggcccaggacactttaacctgagcctcatgttctctccttgcaggggaaggcttcccgttatctagtgtgtgtgtcttggggatgtgggccatagaacgttcacttctaatgctggggctggaacaccatgtgtttcacttagagggatgactcaccaggggcaaggccaaatgacagcagaccaggcaaccaccgggctttccttccattttctcccagaccactcacggcgagtgtgttctctccacaggtccaggcgccgtcagcgaggtgagcaacggcacgtcgaggagggcaggctgcgtctggctgctgcctcttctggtcttgcacctgcttctcaaattttgatgtgagtgccacttccccacccgggaaaggctgccgccaccaccaccaccaacacaacagcaatggcaacaccgacagcaaccaatcagatatatacaaatgaaattagaagaaacacagcctcatgggacagaaatttgagggaggggaacaaagaatactttggggggaaaaaagttttaaaaaagaaattgaaaattgccttgcagatatttaggtacaatggagttttcttttcccaaacgggaagaacacagcacacccggcttggacccactgcaagctgcatcgtgcaacctctttggtgccagtgtgggcaagggctcagcctctctgcccacagagtgcccccacgtggaacattctggagctggccatcccaaattcaatcagtccatagagacgaacagaatgagaccttccggcccaagcgtggcgctgcgggcactttggtagactgtgccaccacggcgtgtgttgtgaaacgtgaaataaaaagagcaagaaagaaaaaggaaacaaaataagaccgtctgacagcaacaacggtcccacaaacaagtcacaaaagataccgttaaacttttttttttttttatcattttactacatgaacatcatggataacaagggattctgattcattattaatttcattaattatattttctgatatgagtctagaacttactgcaaaaacaagacaaaactaaaaaaatacaactgagaagggtgaagagaagtatgtttgttaaacagtaaaaatgaatagtatacttcttaactaggtttacaactggtggaccacacaccaggcactaatcacctggtgaggatttggcatatccaccaaaaaatgcatccgatttaaccaacatctccaccagcgctacggactcctcccaattctgacatctcttgcagacaatactatgctctctacacactgtttagaaatggaaaggtgatctgcactgtatcttgggtttgttggctatgcttcctttgatgacatatattatacagtatatatatacatatattttttttgttagagttctagccattttatttctccgcagggtcctttctcagacattactgcatgctgtatatggcgttagctgtgtgttgatcttctaaaagatgatagagtttactggtaattgtgtaatcagctcctgcctttttattttcttgggttatttacatgtcagagacatttataaaaagtgaaaggataaaaaaaaaaaaaaacaactaataccgggcgcagcatctttccaggtgtggctctgcgctaggccaccccaggtggccccgctttctccattctgccctgtggcgttaacagacagcaagcagctgaacaagcagtaccgtcagtacccacttgctttagcccattatgggaatctctgatgcctttgtgaccactggagagtttaatcctcttggtttattttatttcccacctttgtgtgagtgtgtatgaaagagaagaaaatgcaatttttaggtaatcttttttttttttcccctcccctgaaagtctgggaacctgagagtcctcggggaggggtcctggatgtgatgagggaaagggggattgggggatccgggagggtggggttgtctctgacttgacattaaaaagtgttccatgtccctcttca

SEQ ID NO: 1266 - DNA, 404250 bp, Homo sapiens
gcggccgcagcgcgcatttgggctccgaggaagttgaccgaggcggctgccgcaggatcccgggcccggatcgcacgaagcccgcgcggccgtctcctccgcgcgccacccctgcgcctcccgcgagctccacttcccatctgctattgtttccgattgttttccggtggcgagcccggctccgaaacttacaaagtgttggatgtcccccgttcgaactgagggactgcagaccgcctctgggtagctggatgaagcccaccccgtccccttctggtaccaaagtgcttactcctctccaaagtgccgtgtctgaactgccgctgggaagaagcggctcctgagacgcgcccacacctttcacctgccgcgcgcttccccctcctcggccaccttcccggcggaagcagcgaggagggagccccctttggccgtcctccgtggaaccggttttccgaggctggcaaaagccgaggctggatttgggggaggaatattagactcggaggagtctgcgcgcttttctcctccccgcgcctcccggtcgccgcgggttcaccgctcagtccccgcgctcgctccgcaccccacccacttcctgtgctcgcccggggggcgtgtgccgtgcggctgccggagttcggggaagttgtggctgtcgagaatgggggtctgtgggtacctgttcctgccctggaagtgcctcgtggtcgtgtctctcaggctgctgttccttgtacccacaggagtgcccgtgcgcagcggagatgccaccttccccaaagctatggacaacgtgacggtccggcagggggagagcgccaccctcaggtagggagctgacattgttctgcgaactgatggtttgtatggggtcggggtaaggggcaggggtgcaggtgtgtgcactgaggcgtgcctgggttggcggagaggtcgctggttccctgggctgcacaatttatggctgcgctgggggctctgcccgggaatgtggcagtcgtagggaaaggctcagaggttctggcggtgagctttttcccaaaaactggcctctgcggctcaggcacttgttaaaggtgaggggtggctggaccaggtggtcgccgagattgagggacttgtgcctggcactgtctgtgcctgagcctggtggccgtggtgacagggggcttggaggggctccccgcgagcagtcttctctgaagttaatgagccccaaaggaggggtctggcttggagtgaatgcccccactcgcccatgccatagggctttgccagccctggctcctgcactctgggagagccgctgctttgtcctgggcctgactgtgcccgggctttcctggggtgccttcatgccgtgagctggtgggcagacagagatgctttctcctgtctgaacgtggctttctgaggcccaagtcatggagtctgatttgtccgtggaaaatggcatttactgtagtgaactgtgttctgttcctgctctccaccaaaacggtacatgcaaaactcgtctactgaagagaaactaggtttcagtgttgggttgggtcctgattggcttctggggttaaggcttacaggcactgggggaggagaagaagaagaatcttggttatgctttgtgtaaggtagaatgattctatctccctgattaccttgcctgcagaaacgctaactgaatttccagtgttgataaaccacacctctcatatgcgggcaaaacacttaatgattgcgatgggaaattttattctctgggattttataagagaataagcatgaggtggacgttaagaaggttcatgggaacgatttccctgcctctccttggtttagtctgccctcctaaataaagttttccaaactaagcgacagaactaaccacaaggcaacatggcaatattcctgtcctttgcacatgaagatttctggaaagataaccctggtgctggtgtctactgttttgcccctctgatgacttcttctaggattgggttgttttggactgtatacttaaggcaatatctataggatagaaaatggtgaagaggaggcaatgtcaatacagagctgagttatcaggacattgccaaaggaagtgtgtaatttagggacccgtgcagggctacaagcatccagtgatcctttgtctaggcaaagcttaacctcatggctctggtgaactcctagttatttgttggctcacgagacccacctcttccactcttctgagcaaaaataaagcaacttccttcccccactcagaaatgattgtgtatctgctttaaaaatggatttcaggggagttacaaatatgcagtgatttcagactacttaaataaaaaaccaaaaataaatgtctagagcagtaataatcaaggaaattttcttgttcaagaaatgcttgttctctggatgccctctttgtccctagtccttggctgcaaggagggcctcccagggacagagacattctgaatggggaacattttagatataaatgggattttttttttcaaggaaaaggtgtaaggtagctctgtagagacttgaagataaataaacaggaagtgggtcctggcagacagagaccaggccagaatctggtctccagaaggtagtcttcaaggcttatcaaagtcaggactgtccagagggtggctgcattcagcagaggctgaatcacgggacaggcctgatttaggaggagcttctttttgaaatcgcgttatcatgtactggctgacttatctttctttgtcttccctttcatggttcttttttctcattctgccggtccccctctctctttcagcactaatgtttgtttgcattttcacatgtgttctcaacccagtggtattgtttgggtgtggatggagatgggaacatggtggagcttcctttctagacccttgaattgaccccaacccagccaagttccttctggaacatctcctgccattctgtgccagcctcaggggctgaatgtcttcctgacactcaagagaaaggccctgacagtggatggagcactacagggcagggattagatgagctagggtctgagcgacaccagcccttgaccacaggcctgacttaggatgtgaatcaggcaccaggtgtaacaagcaaccagtatggaggatgctcaggcctctcaggattgccctccttctcagactctgatgcgctagaacaaggaagggctgccctgctgggatggactttggtggggtggaagcccctgaactctcaaacataggtcctgcattttcttgttctgtgtacagagaggcaagtaggaatttcagaacgtattttgtttgcataaaaattgctgcattttcacgtaacctgactgtaggttgcaaccatctagtagttcagagttctgagttattttctttttgctttgtattgtgtgtgtgtagggggacagaggacccttccttccttccttccatctatctttctttcttcttccgtttgtttttttctgttttgactaatcatataaccaagctgtaaggaaccacaactaggggagaccagagcacccgtgctctggcctggagggccgccatatccatcttcctatgggtgattgggtgatgatggtgatacatgtagttttcttcataaccagcagaggactttttgctctaatttcattttattctgctttgttctcaccaacatcatattttgaggatcttttgcagtccctaaagaataaatgctcagcagaagattctaatttgaggaaactttaaaaaatgttttatcttatccaagtagctctaacaatccttgtggaggtattgggaaatgtttcaattagcatagcactgacagcctgaaaagaattacaatttgcagtctcccactctttctgccctcccgctggcattctgtaggcatatttcttaaaagggtgaggtaaaacagaatctgcattaataatactattagccaatgttaattgagtgctcactatgtgttggggagtatctaagtgttttaataatatctcacctatcattcagcctcatgacattaacactttaataacagccctatggtgtaggagttactattatccctattttacagacgaggaaactgaggtgtggagagtttacatgctttgatgaaggtggcacagctaggaagctttgaagccaggctatgaagcactggtaacaatcacgttaataagatacatagtactatcattggtctgttactgtgtgaacattttatgtaaacagtaacatttactcctcacacctctctgaaatagacaattattcccggttaaggcctagagagggggaacttacctgaaatcacataagcagccagtggcagaccagtatgctagctcaggactccattccttgactttgtacaccaagcttcccaggactattcaggaccctttggattcgtgttcctctcattcctctgtggcacttaatgtcttccctattcattttggcttagaccctgttttccagtgttatctctctgtcttctttcttcccttgggctgcagagcacctcttggaaagcaagaatcatgccttgtcatggcatgagcactgtgtgctggcagatgcttactcaaacaaaatgaatgaaagccaaacaacgatatcccccagctatattcagtttatctccttaccacatttctctatcattttattttaaatttcaactacggtcaatcagaaatgtattgagtggttctttcaagaaggggactgtattagtccgttaggcagtgctgacaaagacatacccaagactgggtaatttatagagaaaaagaggtttaatggactcacagttccacgtggctggggaggcctcacaatcatggcagaaggcaaaaggcacattttacacggcggcagatgagacaatgaaagccaagagaaaggggaaaccccttataaaatcatcagatcctgtgagactgattcactaccaccagagcagtatggggaaaactgccccgatgattcaattatctcccactgggtccctcccacaacacataggaattatgggagctacaattcaagatgagatttgggtggggacacagccagaccatatcaggcactgagctgggtgtttgggtgtggaaaggcgtacggcctggacttggcttttgggggcttgggtccaactggaaaagctggctgtggacaaagaggtcatggaccttgtgaggcagagtacaccatgaaaacgtgggcgatcacgctgtccgtggctggagcagagcccctctgttggagtgaaggctttctgtgggttggcaggactgcactagctcctagctcctgggtggaagtgagcagacatcagtgaggaatcagagagccccagaagccccaatgcatgggtgtcattcacttagagaccttcactaagcatcaacacacctgtcacttggcagtttcaatgaatgctttccacatttcagagattccccaattaaggcagcagctagtaaagtgcattctttcctggggatcacttggcaggtgggtatcagaggctgaacgctgcattccatcgcgcctctagaccataggcttagcgattggatgatgttgtttttcccgggtgagttaggaattgaaggtctgagaaatgtatgtaattttggttgagttttgatatgggactccatggaatcacacagactaaatgtggttttgatacttgagaggacgcgggagtcaccctctagatgaaggaagctgcggcactttgctcatgtcatgtaaggtgcttggagtttcatttgataagcagatggattctctggtagtccctccagctactccacagcctcttaagggcggaactaggcctcctccaggcttgcctcctaatccgcagcacatggcttggcctgtggaatttgccaataaaatccgaaggactctcatcctgcctttcctttcactcactctgttgtggacacccataaacacagcttattccagctgcaaagcgtttcctcttgtggtccgccctgctgggaacacccctaccctgatcttcccatggacagctgtttcttgtcattttggcctaagctcacagagaattccctccctgatgcctttcctgataccaaatcaaaataatcctctaccactaccaccagtcttactctggcatatcatcctggagtttttcttcagaacaatcatctccatctgaagttatcccattcattatttggttatctgtgtatgggttgtcttccccaaagggactaaaaattccttgagaagagatatgctctgtcttgttagcagtgtctggcggatagaaggtgttcaataaatttgttgcatgaatgactgcaggaatgaaggcctgagatcacgtcttcttctccttggagtctgtgtcctttttcctgaattgtcttgtgttgtccttgccttgggcatgttacttcctcagtgtcatttctgactgggcagctgtgtgaggctgctcctgtggaggtgctggagacaggttacaaatacatagaagtcattgaacttgtgtctgtctgtccaggccacagatgaggtgtgttggttgtccattatttcatatttgcacccatgacacttaccttccttctgctgggtcacctccccacccagtccttaagtctttgaaggaacaatgatagtcaactccagggaaattagcattttcaaggtaaggagggacacagaaaagcactctgctcatcctttctctctgtttgtggagtctgctggcagtggttgtggtggtataactattgatccgttgtttatgagttcacccgttcagaatagcaatgctactcaggaggcctgtgctgctcccactgccctgccccctctcaggacccgccactgggcactcacctctgggcttgccaggcatccggctggtgtcctgtggctctgaggagcaggcacagatgggaccaaggagggaggctcctggaagcacattcagctgttgaggagccaaaaactaaaatgggaaaactaaaaactcaaccaaacatagggcagaaggggtaggagtatgccagttgtcactgaaagctagaggaggctacagggggccagctcagttctctaacacccctcatctaaaccgtaagtgctttgcagaaaaacgtctcctttctccctcttttaaatgcattgcgttcttgaatttgaaaggtttgcagagagctgggaggtcaaccacctggttttacagatagtggaagtagtgataatcagtcttgcgtaaggaggccttccagaagggtgagagggccggcagccagtacactttccatccccaggctgtgagccctcacttggggctatgcatgctgaaggaaaggccatgtttccctaagtgcaaaagcatcctcctgaccatgaatgctttcaatgcatttagctgacatttatcaccgtattctctcctgactgctggtttagtccgtaccacaccttgcgttcttatgctttgactctcattccatgtgggacagctgtttgctgtgggtcaggtcctgtgctgagcagtttaccagaagaacctcatttaatcctcacagatactccatcaggtggacacaatgattactctgattttacagagcaggaaaccaaagcgctgagaggcacagtgaaggtattttcccagctcacatactcaggtgggtgctgagcctgggactcaagatgggtggtgtctgactcctaggcaatccccctcggttccatagtactggtcttgttctgtcccttgtattcttcattgccaagttcctctcccactagagacccagtgagtttggttgtccctccttgtcgtggtgcacaggaatcccctctcctgaagcatgaggaacagggcctgggagtgtttaaggtttcatgtcatccatggcgtggagacacagggacccaaccgacctctagaggtcccttctactcacagaatcctgcaatttctatagtttgttcagaggaagactcttattccaggttcttccattgatctttggctttaggtatcagcaatcttggactttctcacctggagttagtaataccatgaacatttccacgtacttctctggaatgcagtattgaaccagtcaaggcagacaccaattctaggaggattctacaggccagtcagtggatctggatgccatagcaccaggggaacaagagggaccagctccaaaacgcttcctttttttttttttaaattagtaataggcatctctcctggggaatcttgtaaaaaaagataattaatggtaatggcatgtttgttctcttaggttgaaagtctccactgatgagtaaaatagaacatcgtccttgtgttatttaaggtcattttgcttcctcaggagtaagttgatgggttcccactgtgtaatagataactaatactaaataaataataagcaatactaccaacatcattatagatggtcaaatatttttaggaaaccaaggacttattgggtttaggatgcaatttcaaattgcatgtgtgagctgaagggagaaggaagcaacggggaagtttactaggagtacaatcattggagacaaacatctccaacacacaagaccttactgactcgtaggtaccaggaggggtaggctagaaagaagatagagtgggagacaggaatctacaaactctggctcaggcagtttgtttgattgcaggcaaaatttgtaatctctccaccctgcatttaaacaggaccgttattacccatctcacagtgttgttttaggttaaaatgagatgacacacacaaaacatagtatatagttataactttctttctctatatatgaatatatatgtacatatgcatgtgtgcatatatgtgtatataatatacacacatataccaattttcattataaactattgtagcttaaacactttggcagatataccatgtcttgcttctgaaagatccaattataggtggacaaatccccctttgtccacctataattgtgagtttttttgtggtgcctctcctacacatctgtttagagattcttcagtttcaaatcatttcttgagatgtttgatttctgagagggagcgagaagaaagatatttctttgtttttcgtaaaaagattgttgcatagcaggttgtgacagttcatggctctgaagatgcatttcccatcagaaaaattcatccagaaggttctgtggagcaggttttctgtgaattcatgcatagatttcggagtgccagaccccttttccttggagaaatgatttttccatgataattccagtggagtcaaatggtaaaaaacagggtctgggataacatgtgttggggaagaggtagtttaagactctcgcagctgtaatgttctctaattgtaagtcttctcttcattcatatctcctgatgattgggaggcaggctcagggcttgagtggtgatggtgaaaatagagaaggaggcttctttgcatttgggaattttacttttggtcaggtctagggcaacaccagtgcatctggcattagaaactgatctcagcattcactgatgggatcacaggaagagtcctgtccattttaacccaatgtcaaagggcttaaattagtttaaatgtagtgaactatgaatagccgtcttgatctttcatgatctgtttttcttaaatctcatttattcacattgttgaattatttggttttatttgggtgtatttgggcaacttgctgtcctatcagtgtgaaatgttttggcttagaaagcttttggggggttagatttgtcttataaaatgaacgtatgaactaatcttacaatcttgctgatggatttcttaaaataatagaatttttaatgaaaacagcatcaaccaacagactgatggaaaattaaaaaaactaaaattgaccttcaaacaagctttgttgggttcatggagtcaaaggaagatgtatctgtgtgaaaatagtttcttaatcttctgtgctttcaaacggcctctaatgtgctggatgagtgaaaaaaatgctctcacattcagaataatcatctttggacaaatttacctgtcaggagggctcaatccaaaattctaacccttcagaagctataagtaagaaaaagaacgcatgcgaattatttttaatttagtgcagtttttatacagaaaagctggaaatagcaatgctgtggtttacgggttgaattttgtcccatctccccaccataaaaaaattatattgatgtcctaacctccaatagcttacaatgtgactttatttgtaaatatggttgctacagatgtaattagctaaggtgaggtcatactagagtagagtgtgcctctaaaccaatataactggtgttctggtaaaaagatgcctatgtggagacacagaagacacgcagagagtgacaacaaaggcagaggctgtagtgatgcacccacaagccaagaaatgccacagattgccagcaagcagccaggaattaggaagaggcaatgagggaaacttccctacaagtttcaaagggagtatggccctgccaacacggtgatctccatgatttcagacttctgggctctagaactgtgagacaacacatttccactgttttcagcccccagttttgatactatattatgacagcagtaggatactggaacatttgcatattaaaaaaataattttgttaaataatagtaacaatcttgcaaaggatcgtagataggcctggttagatcacccagttcccagctgtgacacgagccactgcagtccacagaggaagtgccagagtccagaatgcttctgggtctcagtcgtgagcccagcctctccattacaaatcctaaagaagccaatcagggtggaaatgcttgcccttttattcctcagaggccatcagcacaaaccctattgtatcttctcagttatctcgaccacctgagaagtcacagacccccaaccccagggccatgcatcgttttctagattcatatcccaacatccaacagcccaacccagttacaaacctcttcctcatcctccaaacctttttactctctggacttaatgatctgtcaccagcaacatttttacatctccagtctctgctttgaatgttccccccttattattatttttttcttttttgctttagttgaaactcggctgttccctggattatttccactcctggagtcctcaaaagtggctgtttttctcccacaccttgcttaccctgaggcctgaaagttggataaacgtcctccttgctactcattatggctgctggacatttctttttcacctttctcgacatatccagttagggtgcagcaaatgccacttggctctgttgccctctgccccttccttgccgtgatcatctgccatcagttctgaccacgcttcttcactctggtcctccagaccgcacatcctgctgctcatctacagagccttttaatgatgacattcaaactgggtcctcccagccagtacccttgacgcaaggcccactggaccacggccagctactccatcctgcccttccctcagtctttctgatcttaggaactgcaaacctagtacatcctttatttttttcattctctcctgtgcttcatctaattcaccactaaattctgtttgtcttttcttttaagagttatcctgaatcagaccactttttaccatctcaagcactacctccgtgggcaaagccaccaccgtctctcctcggctcttctggtggcatcttgcctggtctccttgtttctactcctgttcccctggagtttattatctgcctggcagccccagctaccatttcacaagaattacctgactctgttcaaaacctacagtggcttctggctaaacttagaatgaaatgcaaacacctccatggagtagaggctttttaatcgcctggtgcctatgtaagcctcataccactgcccacgtcgctgctgcctcgctcgtgggaatgcagaacgctgaacttctctgctgttcctggaacttactaagactgttcttgacttaagaaatgttcttccctctctcaggatctgctataaacttatgggcctagaccttcgttgaattcatgcatctactccagtaccccgtttaaaaaaaaaaggctttacagatcatcctgtttgaaatagccatgtcctcagcccccatctttctatccctctacctagctttaactttcttcatggcctgtaacacctagagaagtctgttatttatgtatgtcttctgttatttatgtatttctcatttattgctactccccctaaaatgcaaggtccaccaagctgctgagtttattgctctcatttatagtgattacattactgcctgggacatgggatctattacaggatatttgttgagtgaatgaaacgtttgttaggaataatagtaagctattaatagtgaaattatttatcttttactagaaagaggaaactcaggtctgtctctgtattggcatgggattgggtgttattaaacagagttcagatagggtgtgcgtgagctggcgtgtttgttttctaggtcagagagtggaatgagacattgaggaggaaattgtcaggcaatgtgacacacttcataaaatctacacatgtggaatctaaagggcctttaaatatccacttttgcaaggggttttatggaaaatctaataaacactggagaataaggattattctgctcaaggcctacaaactttgggggaagggaaggaagtgaagtggcagctagaaatcaggctgtgagcctgaagtttcacgcgtcattcaatgtccaatctttcatgttaacctttctttattaagagaattgtaccttagcgctctagaggataatgattaagtgcagggtctggagcccgaccctcctcccatccccagtttcaaatgctggctcagccactgggtatatgacctttggcacatggattagccttgctgtgcctcagtttatcatcatttgaagggactaataataggggttccgggccagtgtgaagcgtgaagtactcagaacagtgcctggcactctgctcatacttggtgttagccttacatagctgaggaaggacctggcctgcagtgggcccgtggtgggcagagggcagggtgtacctctcgtgaccctggagctatgtgtggaaatgcacagtgcagggcacggagctgggggccgtggctgacactggtgcacactctacagttacacagacatctggtggtggggtggtttttgaaaagtatcaacgcagttcattgcttttggcatgtgacttgtggtctcggggccaaggtgacctggcttttagtcctggctctgtcccaacgcatcatgtggggctactaagaaaatgagcattcccaggcttcaggttcactctgtgaagtgagaatactgctctgtttcgttcttgagttttgaggaagagattactagctgctcaaatcatatataagtttttttatttttcccctgagcacaaactcagctgcctttcccagcctcttttgaatttagaggtgaccatgtgacagctctacccaaaggaatgtgagccgaagctctgtgtaggttggcccagaaaaacatcccctgtgaaattctttatgttctttcctttctccttagaccatctggatgttgatgtccaaaattaccttggaaacctgtgtcctgtttggcgagctccatcggccaaattcttgaatgacagcacagagcagggctcacacccccacccaccagctggccaggaaccttgttaaattattacctaaagaaaaaacaaacttgtattcaggcttctgagagttcagagatgatttgttacaatagctagcattatcctatctaattcaatactcaaccattataatttatattttctgatttcagctgcatagaaatatacagatgtagtttctgaatccagacctaagcacttattacaatttcttggcaagacttttggtgatttttgcatgtgtctgaaagtgagaaccatggccttttcaaacggaagtctcaaatgtttgattttcagttgcttgactgtttacatctgtggtccaagtaacatgtctgctttattctacaggaatgtgaaaaccagtgacaaggaaaagttttaccttgaggcaaatgagcacatatccataatggacttaactcaagacatgctataattggtgaaaatacctcttagatgataaattactcattaatggctggaggtcacttatttagtttaaccttttgtgccagaagtattctaatatccagtgttttaattgacacacactaaagagatagataggatgatttgtaggcttgttctcaaaaatgttaaagagaaagaagagaaaaccactattagagttccttttttttttctttcttttctctttttttttttttttttttttaacagggtctcgctctgtcacccaggctggagtgcagagatgcagtctcagctcactgcagcctcaacctccctgggctcaggttaccttcccacctcagcctcccaaatagctgggaccacaggtacatgccaccatgcccagctgatttttgtatttttttgagagacagggtttcaccatgttgccgaggaggtctcagactcctgggatcaagtgatctgcctgccttggcctgccaaagtgctgggattacagatagatgtaagccaccacacccagccagagttccaagccttgaagagaaaccaggtggtggagaaatcgtgtatggatttgggtaaaggagaaaggaagctgtggaaaggggaagaggctgagccagagttgtgggtaggagacgtacaaggaatggaggcaatgcagagacacggggcaagattcaggtgcctcgattccaccttttgtaattcaggggtcagggatcttgtcttacttttgttgttgctttggtatgctgcacagtgcctggcacataataggagctgaatgtatccttggagaatagatgcatgtgttttgctgtgttgcttcagtagtgcctactgtacatctcctatgagccaggagctgttctaggtgctaagttcctctcttgcagagtgatgtttagtgaaggagatgagggttgcaacttgtatggattagaaaaaaaaggcatcttctcctagcatgcaacttgcacagaccaagtaggagtaggcattcctcgctgacgatgttgttcactagagtccctggctgagtaaacagagtgccagctgcattattttgttaccttcttcagcccttgagcagcgcacaagctgcacaactgtacttagcaggaaccagctgtcggaaaacaaataagtaaacaaacaaacaacgcatcacatggtggaaagtattggggcaggaagtaaactgtaggttaggggacagagtaacctggtgtgcagggaggggtaggggcttgcacgatggtcaaggtggtgaactgtggggagagccatgcagggaatagcgtgctgggcagagtatcggcaagtggaatgacctagtcaaagacgagcaaggcaaggaggaggaagggtcaaagctgaataaggggcaggcagtcagcaaagggatctggggggtcctcggtgtctgtaagtgctctttccatgtcaagattaagctgtgaatgatgataggagcacagctctcaggagatgggaattaaataaaaatcccacataagcaagtagccccaacacctgtgtggattcacttgctgcgcacagaggcctggtagtttccgtgtggactttgtggatttgtggcaacccatatttgatgtgtcacccctgcagcacacacatccagccgcgaggatccggggttttctaactgaaatgtcatccttcttgggtccactcttgtcattttcacttatcacatctgcaagttataaacgtttaaaatgtgcatgatatccaatttgacgttttacctgttgccatttccaagatattacattgtgaaattaagctggcattttacgatcatgtatggatgtgtgtgtaagtataagtaggcacgtatttggaattaatggactcatagaaatcagagatggattaggcctaatgagctgttcagaagaattatttagcacatatttcatctctctattcagtaatcaaacctacacagtgtgtatgctaaggaagtgagatttttgcctttttaaaaaatttcttggattatctccatttgtggctgaaaatttaacattgcatcctagggcattttgcaccaactttattaagcattcagtctgacatttccctgcacctggggttgcctttgttatttaaaaagtagttgctttcctagttaccattaatatataattagtagttggtgctgggctccaagcaccacaccaggatcctggcctggccttggagccattgtcaaaaacaaaatcttgcccaagtctctaggaagacttggagagttaagcctagatgggaagtgtatatattttgtttgaatttttatccacagtaaatggatgcagctttgtcttttcacctaaggcctatggtcaccttcctctggaagccacatgcacttgactgttgccactttggcttctgctgattcctttaagcacacagtttcaacagactttcaaaatactattcacaacatggggttccgtacttactaacaggaagaaggaaagcaaatgtgggatacttgatagtgtagaaggacacttgatacccagagaaggatttcattgacactgttacagagacataaaatcacagagccctgtggtagcatcagagatggggtcacacatagtcagctcccaatagccaggagtctaccctatgaattttctttacagcatggctagatacagtatatacatatttatcctaaacatatatactcaacttataagtctgcatgaaacatgtgaattgagaatatgttctatattgggaacaaaggattctggtgttgggaaaaacttaagctgggacttaatttgagctgtaaaattattaacctaatctctctgagcctttgttttttttttaatctgtgaaatggggctaaattatatcttaatacctacctgacagagttgttacaaaaatcatcaccataatattaataataacaacagaaaccaacatcggtagaagcacttaatgagaacctatgcttacatgataaatgctttacaagggttacccaatggtctaccctgtgaattttctttacagcatggctagatacttataatacttatcgtaagtatttttaataattacattaagacaagatataaattcttaaggattgtacctggcatatatgaggcactaaacaagttatttcatattgttaatacattccattagcaaaaacaagttaaaatgcttaggcatgtatagaggatgctggaagacgttctggctgttgccagaatctccagacacaaaccttttctgtggtctcccgtctgtgttttgtcccactacaaactctgtttgttttctgtggtctcccgtctgtgttttgtcccactgcaaactgtttgttttctatggtctcccgtctgtgttttgtcccactgcaaactctgtttgttttctgtggtctcccgtctgtgttttgtcccactgcaaactctgtttgttttctgtggtctcccgtctgtgttttgtcccactgcaaactctgtttgttttctgtggtctcccgtctgtgttttgtcccactgcaaactgtttgttttctgtggtctcccgtctgtgttttgtcccactgcaaactctgaactcaccattccccatggcttgcttagcctggttgcattttccacctccttctccctgactctttctcaaccacccacccctcagcaagtcaggtgaaaatcctgcaaacagcatcattctcaccctttccttcattttttcaatcagtacaaacctcttgttttctcatgttcccatagtgtgtagtttagaatcattcaattatttcttcaggaaagaaagtgttccacatctgctgagtgcctaacaccgttctagaccctgagactcgagaagacaatgaagaagtaagtggccgcacaatgcaatgtccggtagtgctgaatgctctgaagaggagagcggcagccagggagggaaaggaggaagtgtgcgagtttagactccctggttaggggaaggccctcctacgcaggccttgagtgagatctgatgaatgagggcgtgagcctgcccacatttaggagagaggtttccgaggcagatacaaaggtgctgaggagggatcatccttggcctgaaccaacgggggggcacatgtgggcggggcctggtccaagccacaggccttggtgatggctttggattttattcttcgtcttatgggaagcccctggagcagtttgacagtttgagctgctgcatgttagcagttttttttttttaattttttatttttctgtaacttattgcccttataaaaactttccgttttttttgtatacggcaaaggctgtattttctttgcgtttttgtgttagagacaggacacagccctcgtgtagaacctcctctgcactcccacaattccctgtgccacgtccattgttttaagcacttaactgtgatacaggacaaagctcatttctgcagacttcctctttttttttggttcacactgattcacaaagtaagacgccacttccaatggtcatatcgtgaaggtttcctcgaaggatcgtgaaattccacgaagtccgcttgctttcctgggtgaataaacaccaggccgctccctggactttccttgtcgtttgtgatcaaaggctcagctacctcgtgctcatggtcctgcgatggctgaaatccgtgaaatgtccagaaagaatgatttgtcatgaatgcatcagcaaagaggctataagcttctattcttattttcttatctacttttaaacactttttcattgctttaaaaaagtatataattactgttcatttggtgttgatgttattgccttgctcggtgttgggggttgtttaaccattcagtgtacaccagtgactttttggtctgtatttcccaacaattacactgagttgcagagaaaatattaattaaacatacttctattttaaaaggcaataataatatataattcccattagaaatgcatttgaaacttttctattaactctttactgttgtcaccaaagccttcccttctagacagtggaagtgagtgggacaggtggccatatatggtttgagcaggtgggcagaggaagaatgcagggtacttgttgccctctggttggtcctccttcctccatgcttattttcaaccttctggcccctcacactgggcccaactcatgccctgcactcggcaaatgtttaatgaaatgcttcctcgaggagcacaatattttatgtgtacagggagccgaatgcatattattgcatagtattttccttttgttatgaaatattttatataccagcatgtgcataatatatctatgtataaaaacataatacattgatcacctgtgttctcttggcacaatctaagaaatagaaccttctattacctgtgaaagtttctgcactcccacctattctctaccctttcttgcttgaggagatcaccactggcctgaatttttgtttatttcctcctttcctttagacttttaccaaatatataattattctcaaacaacatattgtctagtttttcttgttcttccctccaaatagaaagaaattttatgtattctccttcaaatgtttttcatttgatgttatgcattttctaataatttaaaattaacgtagtcctgaatgtgaacaaaggcagagctctaactcagtcatttcaggtaattaactggtctacaacccatcagtcagaagtgctttgatgctctttgactgtgtgtgtgtgagtacacaaaacacctgctaaaatattaaataaaagcagaaaggctttgacatcaacatagtagtgttcataacgtttctgcgtagtggaattgcgagtgacatagattttttgtgttttctctaattattaaattaaaaaattaaattttggattttcataaccagataggattagtgtcataaaaataggttcctaggccaggtgtggtggcttacatctgtaatcccagcactttgggaggctgaggtgggtggatcacttgagcctagagttcaggaccagcctgggcaaaaccctgtctctatacaaaatacaaaaattagctgggcatggtggtatgcgcttgtggtcccagctactggagaggctgagacaggaagattgcttgagcccaggaggtcgaggctacagtgaaccgagatggcgccactgcagtccagcctgggctacagaacaagacagtgcctcaaaaaaaaaaataataataataatatatacgtgtgtgtgtgtgtgtgtgtgtgtgtgtgtgtgtgtatgtgtgtgtgttccttttgaccacacactgatttgtttaggccatggggctttttgcacacacatccccatgtgtagggcgttgcactaggtgatgtttgggctacagaaataaataagacacagttcctgtcttccacatgcccatgacctggctaggaatggggagcttcagaagcaagacctcaggaggtgactgagaaggagccactgctggtctagaaggccaccttgtaatctggcatgtggtggggggtggtgcaggagcacagaagggacactggcggttttggggagaagtggtggcgggaaggggcctgcatctatgagggccagggcggctgtgccatggcagccaaaatacaatagggaactggagcagcaagaggccaccagctacagctgacgcatttctggcgggagagaggacctcagagttgtgcgtggccttcacgagtctttcccaccacggcggtgcctcgatctgtttccagctaagcccagagcagccagggctgtcagaaccaggaagactgataagcgtgtctctggatggcaacgtcaggttcaattttattcagcaagtatccactccatgccaaccatgtgccaggcactgttctaggctttgtggaatccagtagttgtcaaacataataaaatccctgtcctcacagcacttccctcctggtggaatgagacagtgaacaaaatacatacaaaacatagaataaattaactggtgacacatgctgtggagtggggcgggtcgatgggaaaggaagatgaagcctatgattccaagtaggatgtctagaacaagaataatcccttgcttatcggtatagtttaaattgtcaacaaaaacatgcattattttgacataagaagaaacatcaggaaaaaggtaaagaccacagtttattgcaatatatgcttttttcaacatttgaggaaaagagattgtacatgctgtattggaaatacgttttagtgtctaaaacggtgcagagccagaatgttgatcttcatttatcaccccaattcttcctggatcttaattgccccttcagaaagaataaaaaatggaagcacttcatccagcttctgcacagaaagcctgtctctgatcagcagacaaggaataggagatgatgctgatggtggtgatgatttataccttaatgagcaggcgttggtcatcagtatgtgctgaaaagggattcgctccctgcccacaggggactttccagatgctgctgagctgggcctgagctgcaggaggtacagaggctggttggaacagccgatccttggggcatcttttaggccaagggcctttggaaccgaattgagtggagcaatttaactgcccgggacacacaaagcctcttaaaagcaatggccggtgaataagccagaagccataaatagataaagtaacaagcaaataatgggattaataaatagacaggggagcagagccagggctgtgagctgagcgccactagatcaagaaatgtcagcttttctctcagcttttcctccacagcgccaactgtcagtaatttaactaacattttgtaaataaatgtggcactcggacagctgtcaacgtgcctgctatgaacactccttttgtcactaaaagctggcagtgacgctgtttctcctgcaagtgcagccagcactgccaattggctcctggtcctgggactgtcagggagtgcgtggggccctggggcagggaggtgggtgcctgccctagagacctcactcccctacacccgcaggcatcacctgggctcagctctttctggtgcacttggccggtttgtaaggtgcttccatcaaaaatgagactattgttttccaaacaccttgtgtttcagctgggagttccatgtgcctgaccatctagtttccccgccaaggatttgctctttctaaataagacattcatttatctaggttaaaggtacgaaacgcactgttttccactctagctgctgggtgattatttaaggttatgcagtcagtttccttgtgctgtggtttgctcctgaacttgaaactaatggctctggactgtgccttaggtctcccaggtttaatcacaaagttttattaagttagtgctttagtgtcctcttcctggaaagactctatctcaaagcttcttaacctatacccaagcagaataaggagaggaagaatctgtcttaatatcaaagtcccgtgggcgatgaatttgggttattgaaatagatgaaatctagcttggtgaggaaaagcgtgaactgggtaattaagtagtcagaaatatatttaataataatataaattctagtgggcatttactgaactctttttttctggggggggatgttgttttacaaagtgccctacatattacctcctttaacactcagagccccgtgaccatcccaattttaaaaatgagggtctgagatgcagagacgtggaggagtctttatgaccagcgtgtggctgaatggggatttgatcccagacagtttaggccctttgatcccaaggtcctgtgttctaaacaacagcactggtcttttttatgtatagttaccatgtgcacggggtatacaattactgatttttaagaagcaagaacacaataaaatgaactccatacataaatgaaggaagcatctttgacctttttttcctggtgaatgagaaggctctttattgtattgtggtaacccattgagaacgttattccctagagcgtatcacagagtaatatatggagaatacaaataaatgattaagtgaatgggctctgcagtcagctgagaagtttacttagcttcagaggcagaatagtagaagtaattaataggaactaccttgttgggatgttttgaggattaattataatcatataaagtctttacagtgcctgacacagggtaaatattcattcattcattcattcattgaaatttttattatgtgcatgtgatgtatcatggattctgcagtgaatgagagagacatgatgtattcttggagcttatggtcttgtgagaggagatagtaacaaacaaggtaacatatacaaacatcccaggtaggggaaagtgctgtgacggaggctgcctgggtggctggtgggctagtggatgtctctctgagaggaagtgacatttgagctgagatgtcaatggagagaaggagctggcccagcaaggatctgagagcaggacaccgcagggagcaagtgtccggtgctggagggagagaagagagacccctgtgtgtgcagcagcatagacaatggggagaggtggagcagacagacctgcagggtctgtaagccaggccacaggtagggatctcttttcattgtgcaagaggaggtcatcagagtgtttccaatggagcagtgacatgctccgagcctctgggtgacaacaggacgctgctgcctggcctcttggagactggcttataagcctcagaagtggacactgcagtattcaggtgagggatagtggaagatttggcaatgatggaggcagtaacaattgagagatagtcacagataggtttgctggtgaagcagactaagctgatggggttgataagttaatatggagggtgttactgactgcagtgcttatattctcggctaccttaaagtaacagagtaacggtggttttgttgtattagtgttattggggtatttacataatgaactatttacagcttgagaagtactcagagatttctttgccacattactactttgaattaaacatggacaacctatttgggaaagcatcactagccacctgccctacttaacactgattcagaatgtcgggctttttgtttttacttccttttcctacttcacttatgagatcgggattgatttcttgtgtttattagtcataaatatttgtcctaaaaaccagttttgggccacttccatgtccaaagttccctggtggagttatgttggaattggagggttacatgcatgagtgtgcacgcatgtgtgctgaccacagataattagggttaagagaagggtgtcatgaggataggtgggggagggaaggggagggttccctggcctgttttatcagatttcctctgcagctctccttcttactgcaagggccaggtacaatttatgttgcctgatttcctcatccatagaatgatatatttttaattaggacctctttcactagtctccttacctgtagaattttagatcaaaattacagaagaatctgtcctaggttcacaccctgtctcatgtagaacaaagaacaagaacaggcagaggaagacagtggcaaatctcactttttaataaaatagtggcattcaccatcattaatactgatactttgttcttagcttaaatcagcattaaagtaccagcattgtaattttgctcagttattgcaataactaagagtgataaaaagaggggaatcatggaaattttatatatatatgcataaaaatggattcttaaatatctcatcaactcctaagaatatcaatataaaaattggtgttgagagtgatggtcgagagacagcaacattttaaaacatgcaaaatcacattcagcattctcagtctctcaaggtattcaagtgagccatatgttttaagcaacttgtcattaacgttggttaaaattaaaataataagtttgaacatacaggattaaacttcagtttatcttggaattcatttctatcctatattgcattcctctatataataccagaagatggaggtattactgtaagacacatgtcttttgtccgtcctaaattttgagagccttctgtggaagtgctgttttctcccatgcctttttatcaagccttgggcatcactaaattctgggttaccaaaccactggccaaaaggaacttgttgctgagtggtataatggacattggagactcagaaggagggtgggtaggaggtgagggttggaaaactacctaatggatacaatgtatactacttgagtgatgggtgcatgaaaatcctagacttcatcactataaaattcatctgtgtaaccaaaaacaacttgtacctccaaagctattgaaataaaaacaattttttaaaaaactacgcacatgcatacacacacaaacacacacaaacaaagggaactggtttccaagatcagccactgttctggggaaaaaattctcactatgatacgtcaatggatggaactgaggcagacacagaacttactctgtattaacagcagggttatcaatcacttactatgtatcaggcactgctccaagtgcttatgtgcatctcataacaactctaggaggtagattctgttattattctgtgacgggtgatgtaactgagaacagttaaataacatattcaagcaaactgcttagcaaagagtcaagcgcagttttctattcagtcccaaaggtaagctttatcttaggtccaaagaaaaaggtgccacccacctactattttaactctttaggtttcagctatgaaaatgtgaagaaaggaagcaggagggaaattattccctgtctgtattgtgtatcaaaaacgtctactcttttatttctgcagaaacagaagttctgcgttttcactcaggagtagagtcagcagtttatgtgtgttttcttaataccctcttagcagttaattattccttttaataaatgcaatgaaaaagaactgttattggagtcatactttagttgaattagtaatttattctagctcttaatgtttgttaatattctgtgtattgcttcttgttctattagacagatatgacagggaggtaaaacgtgagctcacacaggagttgtgtgggtggaagtctctgggcgatgcatgggccactgacaggtattggtgggtgggggtacatgttgtagagagaggcctggagatgcagcgatgccttctcattactgcaaaagtgactgaagtcgtatggacaatttcttggtcagaggtgaatgaaatagcaaagtctttcatataccacataaaaattttcatctgaaagtgacttctggaatcattaagcctcttcccatttctctagttacagactgatctaagcacaggtgtattctacacttaatgcctcggtaatctggttctgggtctaactctagcgataaattataattttttacttctagtagaaatttacatagttttccatttagaaagctggccccatgttagaattataataaagggcaggaggtatggattaatgttattttgtagggcatgttcagcaaagtgtctcaaagggcgggtaaaaaatgagattctttctttaggttgcacgtagcaagtcctctgaacttgagtgcctttttggtgagattactgagccaagcctgaaaataatgtcgtttgctatgtctggatcctaataggcatgctcttaattaatttaactattacccatcatttgttcattccttcagtcatttctctaacacgtatcgggtgcttactacgcactggacaggattgtaagtggtcagggtacacaggtcacccagaaaaggtccttgccctcatggaagtcaccttttagtgggaaaagcagatgataaacatataattacacaaggaagcttttgacgacaagggtgggaagaaaaggacaggtgatgtgatggaaagtaactggagtgtgttggtcaggaaaggactgtggagacgggaacagtggacctgagccccgggggatgggcaggaggcagccatgcacagagcctgagaggaagcacagaattctaatgagagggaaaacaagtatgaagctgtgtggctgaaaccgtcttggcaagttagggaaagaaaacggaagtcactggggctgatcacagtgctaagcatgagagcactgcaagatgaggtcacggaggtgggcagggaccggcttgtgccaggccttgctggcagggtgaagagtttgccttttctctgcgtacaatggaaaggagaagaggttttaagcaagagaatggcttggtcatgtgtatgtctttgagacaccctggctagtctatgtatgatgcaaaaggtgggtggggcagggtgacaagaaaatactgttccggagcttcctgtggctgtgcctataagaggtggtggtggtggtgtggaaggaggtgtggcagtgaataaacagagatgtagaaacagcgtgtacatatattttaaggaacactgaggacgtgatgctggaatttgtgatgagagagtggaaaaaatccaggatgacttccaagagctgactcaagcacctgttgggttatgattcttttaacccatgtagagagactggtggagtaggtgggaaggagagaaatgagggagcaagaggacccttagatacactaagtttatgatgtttgtttagcatcaagaagagtttgcagatggatttatgattgcaaagctcgggaaagagatgagacttggggatttaagtatgggagagatcagcttatatttgttcttaaaatcttgaaattgggtaaaatcaccaagataaggagaaattgtagctagagaggagaatggcggatcggagtcctgagcttttgcaatatttaaaggttggagggaaaaggagcagagaattggcagccaatgaggtaggaagcaacccagggagagtttgagaccaaaaaatacaagagaatgaaatattttatggagacagtgaccgattttgtggaatgctgccacaaccaggagttctggaaaaggagaagtgaaaagtatccatgggactggataagatgatagcttgaggattttggcaagagaggtttcaggagaatagtagagaagggaagaaaaaaagatggtagtaattggagaggtaaatcaagtcaaaataattggtgtgtgtgtgcatacgttcagacccacattatctagtgcatgactgcatacagatgagaaagttccatctcatctgtgcagatggagggagtatggcgctggagagcagaggtgagaggtagagtacaagcagagggctggcacacctttggtgtgaagggatttctgttgcttgttttgtaaatctttcttctcttaatactcctgattcttgcaagctgctcatctggaacaatctggttacatatttttatgaattttccaacaggacagttgagagcatgaggaatttaccaaatgaagaagtggattttcaagattcttcttttacccccttgaatgatgttatgctctgtgtacagaggggcaaattaggagagtagcaaggagggatgccaaattggagtaggagggatatgaggcagtgacagtggatgtgtgaggataatagaaagtttgatttgaggaaacctcaccgtgggctacttcattacccttaagacttttagttgtgtgttctctcttgtctaagtagttctgctctagaggttcaagctgaacccagaaggaaaagaaacctatttgaaactgtgtaaaacacctcccttcagagagcttttctcactgtttttagtctcactgaagatgatcccagtatgggatgacgattctgcagagatctggcttgtctttacattacatctctaacctggagagtcttgctggatgtttccccaggattgtggtttcttatatttactcctgatctaatgcaaagcaccacgtgcaacttatgtacagttccacgactaaataatacaatggaatcaccacaaaatattatcagctcctcccaggcctctggttgttgaggaagaaaagtgggtggtgcttgttggagataaaacaagacgttagtgggtatacattgtgagataaatacatatgtattttaaagtttactggagggtatctgtatttacttggttttccccagtgttttacagatggtgcaaagtatacaaacatgcacaatgtacatatgactgcctgtcttagcagacaataccttatagacatatagacatagtccagttaacctgagctagagactcttaccttacaaatgattgtcccaaagcgttcagtaatgttttcttattttatctctttaagcaatactaagtgacttttgggatgagactgtcttttatctgaatctaggtttatggaatatttgaatatctgataccagacatggggatccacctctctttgtgcccagccaatattcagtgcagaaggggatttgtcactgaatctggcatgttgccctaacattactacaagcctgaattttgataattatcgcaattatttaagtaaatggattaaccttgctttgacaacatagtttatgagctgatacagtgtctttaaatagcatttcttaatacgggtgcaaatgataaaatttatcaaagtaaacccctgcatgaaaggtttcctcttcgatgattctgctgactggaagagcaggtccccatggcagtgcgcatagggcacgtggaggggttaaaggggagagggaagatattctcgagggtaatgagatgacaggcacattgtacaatttctcacacatctaatttatatctacataattttaaaaatgggcagtaacttataagtctgattcaatgccacttattagctgacatttttcaatattgtgtttgtgtggctctattttctaagagcaacagagtagaaacctgttatcctatatcatttctctgagtgggaattaaaagcctggagttgcatcctgggcttctgttcccttctctgccatccctgccccagccaccacccttttggggagagttagaataccatcagcaaaagagccatggggatatggattcaaatcctgtccatagcagggtgtggccatgtgaccttgggcaagttacttaattacttagctccttacttctgtgtagtgtcttacaagtgacaaagcatttcctcatattctctgtgcttgtctgtctctcccctggaactttaagcacctggaaggcagggtgtatgtctttgatctctgtatctccagtgcagaacactgtggaacaaaaacagggtaaatgaacgatagaactttgtttgactcctaccacaagcccgtgaggtgtcaggaagattgggataaccttgtaaagcacctaacacagctcagtaaaaatggactcttgttattattgggtaacagatattattcacttggagagataaaaacaaaaccaaaacactaaataatgggcttggctctcaacccaattcttctgtttccactctacttcattgccctttagtctaggtgaggtgtagatccattctaatgggcaggtgttttctgcataatcatccatattaaagaacacacttacagttatggaacatcatctcatattatctaactcatttttctttctttgcttgcttccttttcctcttttcttctcctcccttctggagatatttattgattatccatttaatgccagagttttgttaggtgctggggatttaaaaaaatgaataaaatgaaagaagttgtcatatcacaggaagatgggcatttaaacagccagctgtaaagtaaatggaacatgatgtggcagaagcaggtaaaactgctatgcaaaagcagagagagagtggattagtagggccagctgctgtaataacaacccctaaatccctgcaaactaacacaacacatattaattcttacttgtgcaatgtccatgcatagagtggttctcctgcatgacttcttccaggggatgatttggggacttggactcccttcttcctgtgatccatattgcagtccttactttgatgcaagtgggcagaggagagtagagagtgatgtagtatcttttggggccagtcctggaagcagcacctagaactgccatgatttcccatctggaagcaagggggctgggaaaggcaccctttctctgggcctggaaggggaatgatggtggtttggtggacacataacattgtctctgcacagggaacagctatttctatatgaaaagtctgtggatccaggaagatgatgcagaaggggggccatttgtctcagctcttcaagaatgcatagagtttaggctgggtgtggtggcttatgcttgtaatcccaaaattttgggaggccgaggtggatggatcgtttgaggtcaggagtttgagaccagcctggcccacatggtgaaaccccatctctactaaaaacgcaaaaattagctgggcatggtgacacgtgtctgtaaccccagctactcgggaggctgaggcaggagaatcacttgagcctggaaggtggaggttgtggtgggccgagatctggccaccgcactccagtcgggtcaagagagtgagaccctgtctcaaaaaaaaaaaaaaatgcgtagagtttagccatgtggggctaccgcagggcattcctggcagagagactaaaagctaggcatgcaactctgggtttttggaatccagtcaaggtgttggagtcgtcaagtggaagaggcatctgcagcagcctagcatgttcactgtggccttctggcctcttctcacctcccctttccaccatctacttggtgttgagttgcttatcagtttggtttctcagtctccagtctcctgtgcttgcagaggccgcatctccactaaggaagctctcttgctaccatgccccttcccctggctggtgtggactcaatttccaggctcactcacatggaaactgcacccaagtcatcaactctgggctggtgacacaacaaagaatgggtggctagaggtcagtcccagagccggctctgctgccctgcagcacccagttgggagggcccagtaacctgtgctgcaacaaaccttcggatggttctaatgcagctagtttacgagtcaccacttttccctgtttctcttttctgagtccaccctccaggtgtctgattccatcagtctgggttggcgccctgccagagtgaaagagaccagtggggcaggtgtacaggctgtcacttctacttctccggctcgttttttcccttcactctctgagcacctaccctcagttccacctatcacttttcccagctagttggcccaagcatggataaagaattttagaaatgcaactttccttttttttgtctctctctgtaggtgccagttctgtcattagaaatgtcttgccaaattagaacacaaataagccaagaatattcttcaaaatgcagataatcaaaagcacagcactggaatctgatcatcccccacacatccatggtgacagcccgagttgctctcttagagcctggcagacattctaattccaactcacatttttctaaaaggaaaaaaaaaaatacctgttaggctgatattccttaaagaagagtctttcttagagaactttataaaagccatatttgggcgttatttgtatgtgaaaattgtgctctttctgctcataaacttttctgaaacattttttttttcttttctgtgagagcttagaaaacggctagtaatttgaagacaacctatgtgacactgatatgcttttggtagcagataaatgccactggctggtgcaaagacaatttgcttggaaaatgtgaagtgctttatatctagaaatactaggtacagagtaaaattctccatttgttaaaatcagacactgacttgcagtagtgagttatgtgctgggctttattaatccttctgctcatattgctttagacataggagacagcggcgctgattagtggtgagctcttgatgaactatatttgggaggccccagttttgcaggagggggctcaggcaggtcactgcttcatgcacaaaacatagggaacacaagcagcagtttggatgtccacagctcatctcagccttgcttccacatgaggaacaatgatatcagcatgtaatctcagcattttgcccttgaaataaaattctgcccgccattgatatccagtagctcactcctcactaattcaaaataggtcccagtggattggcatcccctccatctgaattgcaacatgcacttcatctcctcctgtttaaaatgaggatgagcatgcttagagtgtttaagagttggaagctgcttcaggggtaggtatttgtagtttcatgaattatttatttaagcaaatgtgtacagcacatttatgtgttggagtatatgcctgatcacactcaaaggggtgtcgtggaaatgtatcatgccacggcatcaccattttgacatgtgtagtgcggagaaccaaaacactgctcctgggatagaacaggattagttcagtttggaatcatttggctctcatgatgcaagactaagtaaatgcgttttatcatcttccctgttgtgtaaggataaaacccagcctggatctatttgggcttcatgcctggagttttgaactaaacacagtcccattggtgtgtagtcagatttcattgtttttggttttgttttattttcccctttcaccaagcacaaatccggaaaaaaagcagtatgtgcattaaaggtttgcggtattttccttatagggcgattcacaaaattgcataagtcaagtccaatttttagctatttgtgtaaaacaaacagaggctgtctttccctatttccttagcatctcctgtctcacgcacacacacatagcaagaggtctgctgtagcacttaacggtgcattcaggggtttaatttgaagcagtgcaggaagtgagatgcctgaactccacagcgctctcatatctgggcatacacagccttgcgtcaacctggaaccctttatcccactgggtgtggttagcagcaccttcttgacttgctggtgggcacctccttgactttttttctggtccacttgaggttaaaagttgaggcggggtgaatctagaatgagcccctaacacatgtaagcctatacccttctctgaaaatagcaaaaagtgaaatatccaaactaacaggttaaccaggttcaatatttacctaaaattgccaacatttcaaaaatcatttaagaaaataacccaaataactcatcagccagccagtatttgttaagaagaaaggacaaattgcatacttgttaatttccctgtggggtagtctcagaactgtgcagtgacctctcgctgacattcctgcacctttactgatatgctcccaaagtctcacttagaagagtgaatataattgctcactctgatggctccattcaggaatcttcaggagacacaagtattaaaatgaatagatggcgtctggcaaatctcttcctgccagcgataagcaatcttgtctattaaatgtctcccagtgcaggcggatagtatattccatgcctggtccgtagcagggtgcaggctgatggattgaatgtatctatacattgtatacagctaatgaactggggttagttacataagaggaagattgatagaacccagaagttatagccagattcagtccagaaggagaatgagaaagcgatcccggaaatctgggtaaagggggagataaatcaggtgggtagacgttataaacaggcctgggaagctgggtcatgcaggcagtgggagactcgcgggagactgggagatggggagacgtgggggaatggactgctgatgactgcttcctgcctttcctccttagcacacttgggctggacagacatatgtgctttttaaacaagaatctttctgaaacctggaagcattagtctaaaaagatgtcagacaccttctggtacccttattttagagaggagaatgcacctaaggcacatacattgccacaaggtcaaataggccatttcctgatctttgccgctctcaaaataaaaagaaaatgtaaaacatatatgcaattgttaagacaaaataaaaaggagagaaagagaaggaactgtgcctgttgctaaaagctagagttcagtgttttaagaaatagaatggaaaagtttccttgaagagaactttatctttcttctccagaggagtccacaggttgtcatggattttacattcatctctaaccctacacaatgcacacaatatgaatcttcacaaatgaaatatgttccatatattgatctgtgatttcttttctctacagatagtatatcaacaatatgctcccatgtctgtatgtataaattaaccttgtttcttttacctagaagaataatactctattttgtaaggttccataacatatttcactagttccttataaatttatgtgcatattatttctaattcttcttctctgtcaaacaggctaccatgagtatcttcatgtatacaggaaagtgcctctgaaagcaaattcttggctacagagttactaggactaatggtatacaaattaaaagcttatgaaatattgaaaattacctaatataaaggttattggaaggtacaatggaatggaatgtacatggatctgtacagacatttccagaaaagctggtgagtagtggggtgtttctaaaatgtgacatttgccacactggtagttaaaaaatgtctaatttatatatatttaattatgaagtttagcatcttttcatataggttccatgcagctggccagaaaaaggcccccttcctttgcatgatggtggtcttgacttgtttaccatgatgccttcttacattgtgttctccgtacctggtattgagggactgggtttatcttcccacctgatgctacttatcctctgcattatgtgtgagataacttctggaccgcttcaggaaccctccctgcctgtggagtcatctactctaattgtccgggagttctgcacccctgccagaccctcccctccccgggactgtcttcctgtctttatgaaatcccagcacctacagagaaccaggcacatagaaacactcagaaagtggttggtgtaagaaggaagaaaggaaggcagggaggtgggtgcagggatgatacacgctggtatgaaacattcacagtgaatagaacatctgtaagacacagggccctggggtctgtccatggaattcatttttttcaatttatttagtgccttagccctcaggggccttgtttcctcacatggaagccagtcagttacgtatatgggggtggctaacatcccagttaataacagtgatgttggcttcagtcagatctgaatgtgagtgatggtgttctctcctagggttttgtgattagtttaatttacttaagcctgaatgtttcctcctgagattagtatgaggtttagatgatacaatatattgaaagcacttgatgcagagcctaatgtaagtaagcacacaataaccattggctgctatgagtagtacttattattagtagtagtagtatgattatttttattatcaaatggtaagatggtccatgcaatgctatctttgtccataaggccattggtgcccatgatgagcaagttattgtaatagaaattaagctcaattggccgggtgcagtggctcacgcctgtaatcccagcactttgggaggccgaggtgggctgatcacgaggtcaggagatcgatactatcctggctaacacagtgaaaccccgtctctactaaaaatataaaaaaaaaattagccaggcgtggtggtgggtgcctgtagtccccgctacttgggaggctgaggcaggagaatggtgtgaacctgggaggcggagcttgcagtgagccgagatcacgccactgcactccagcctgggtgacacagtgagactccatctcaaaaaaaacaaaaaaacaaaaaaacaaaaaaaagaagtgaagcccaatcattatcacatccaaaggcttattttgggggaactgccaacacttagcccttctcatttactgaatcggtggtgctcctctggtgatagaggcttgttcacagaggggagagtgttcctcaaagctgacctgctttgcttctaggaggagtgattgcttgtcctaaaatcagtgtgtccggttcagccctttagccacagggcttttgtacttgctgttctctctgcctggaaaggccatcctcatggtatctcaagggcttcttttcttacttctttcaagatggcaacatagcagaggcgtccatgctggcaactgatataaaatggccccaccgccccagtgctaggcaatctttagcactcaatgccctgagaaatgtccatatatttttaggtttgtaaaactttattttattgtggtcagattacctaacatgagatctgccttcttaaaacattttaaagtctacaatacagtaccgttaattctaggaacattgttgtgtagctgctctgtagagtgtatcttgcataattgagactttatgcccatttgacagcaactccacgtttctccctccctccagcctccgggagacaccattctacggtgactctacgtgtttgagtatttgggatacagcgtgtaagtggaatcgtgcagtgttttcccttctgtgactgacttatttcacctagtgtgatgtcctccaggttcatccgtgtcgtcacatatggcagatttctttctcagttaagactgaattgtgtgtatattgcatactgttacatgcattagtgtatattactgcgttttctttaatcattcatctattgattgacatttaggttgtttacacatcttggctattgtgactagtggtgcaatgagcatgggcgtgctaatatgttatgtacatttattgtttacctattgatttccaattgttcctcactaaaacctaagctcataaaggtggaagctttgttttgttcactgatcctgtgtcttcagaatctagaacagcacactgacctagactctaatcccagtacctgtttctttgttcttatttactagaataaaaagcaatctcagttgagttttaggcgttgcacaaagagaaacttccagcatgattggagacatcattgtctctggcacccttggggattcggggtcttgtgttgggtccaccttgagtactggccctatacctagaacagtgacccacattcccagggtctccaaggtccatcctcctgagtcacgaaaaatgtcctgtatggccaaagtcacttgtaagcctgtttttatttgaatgtcccggcccactccagctagtgctgtcagcttttcaggtccttttcagaagtcctgggagggtagaaagctctgtgctgatgttggatggacatttcctcttccttctaatgccccaaactcctatccattcatcctattgagactctcctagctactcacacttttctcttctgacactttgcacacttactagtatttactatttataattattctgttattgttttccttaccaaaatgaaggatgcttctctgttttgtttccttccctatcttgactaccttggtgcttgaccatattcagtgaatatttcttgaacattattggtggattgactttgtttcctctccccttccacaccacatcccagtagtggtacaatgggaatcccagactttaaatctgtcttcagtgccacttgcctgggttgccctagaggcctcctgtttttcatttttcctttgccctgcaatgtatggcaggtgacccagaagggtcccagaaggatgctcctgaagtttggcccacaacaccttcctgcttttccactgcacacaggtctttgcagactaataacacgtggattcccttgcctggttttctgggcatccagcatactggcttcaacttttctttccatcttacctccactatctctgtcctcttgcttctgccaagccaggcagttcacctgcctcacctataccctggcttttctctcgtacactttgttcactcagtactctctgtctcggaagcccactcactcccctttcaccctcatccttcctttgcacgtttaggtcctacataagctgaaaaagaacagagtctggtcaaatcttgactccgcttggccaatggatggtacttctcttagcctccgtttactaaaatgttaagggggaggagataatggcacctaccttatcaggatactgtgagagttacattagatactgtatatagactgcctggcatacatgctccgtaactatagactattatttctcttcaaagcccaactcaaaaaatgaaattcttctctatgaacccttctctaatcctcccacgcatggcctctcttcttcctccacttccttctggttctcttggagttgctgagcacgttgccatgtcttagaactcatcaggaacctgttctgtcttcccctgtatccaaggtgggaggcaagttgaagtcaggaattattcttgtgttctgcacagtgccctggacattgctgttgtttggtaattgtttttttttaatggactgaatcattttgctgctgcccaggctgctttctactacaatagcctgtagccttaagcaaggatgagctattttccctttagtaatgggccagcatctaggccttgattttgagttcttagtatggtaccgtgaaaatcactagtgttgaaaggaataggatcagagggggaataaaaaggcatttgatgaggctcttagtgtaacagtatgtctcactcatctttttttttccttagcctttgaaatagacaatggccttgagccttctcggcagatggaccatgtttgtgccttagccacttaacagccattagcctaattccatcctctacagccaaattaaataataagtaaaggcctatgaaaagctggtttggaggcagtgttactgcctttcacttgacagccttctctgaagcagatgctccctctccaccctattaacctgctcctctgaataaggagctgtccacacagaagcaaagatagaggcctgcaggagagtggtctggattctggagatagggggaaaatcctgatgatgaaagtccagcttctttggaaggctgaggcgggaggatcatgaggtcaggagttcaagaccagcctgaccaatatggtgaaaccccgtttctactaaaaatacaaaaattagccaggtgtggtggtgtgtgcctgtattcccagctactcaggaggctgaggcaggagaaatgcttgaaactgggaggcacaggttgcagtgagctgagattgtgccactgtactccagcctgggtgacagagcaagactccgtctcaaaaaaaaaaaaaaaaaaaaaagcccaacgtccatccactactcccacctcataggccacagaagatgagagctttaacccaaagtcatgataatgcgatttctgctttgattggtcaaagctgctatttgttagtagatagtatatgacctataaaagttcacaacaagaaagtaataccctggtcttactcctaacaagtctgataatacattctcttttatcacacttttttttcctctgtgtccttgcttatagactcctcctcctgaaatacttccttctattccgaaatcctggatacccctcaaggacagcctaaatgtccctatcctcataaaacacatctccgattctcaatctcattctctgactcaagtacctcctcctcctctgagcacccttcacccttaatctgaacataatttctaactgtattactattttcaaacttgaattatagatgtatgcatatgacccttactaccaggatctatgttccttcagggcaggaactctatagtcatctaaatacttcctacaagtttaaacttatttgtattgtgtttgtgtgtgcacacatatatgtacatgcacgtatgtatatatttatatacatacacatatactcagtaaacattttttgcatcaatgcatacatacttatgggcattttaattttttatttacacactctctctctcagctatcccttagtggcctcagattttttctgcatgtagtcaaataggtctctgtgcttgtgaaaatgtttctatcaactgtggatacgcataacctgattgttaaggtgttactttgagagatctagacagtgtgactgcatttttttcaacttaaagactggcagaaatctaaagcattcaactcaattaattttctctaaaaaagaagaaatttattactccaacacaaagatacctattacaatggttatgctttataaataagcaaacatggatgtcaggttgggatagctctgactggtgaccaatgcattatctctatttctctcttcttgcccttgctatctatcatgataggccttgatgccccagagaacagaaaggaaaggcaccttagagacattttgctgttgttattctgatcttgtggtggcatatagacttaaagtctctgatataagaaatacacactaacttgtttgtttggtgccagttttaagaattttgaaaattcagaaggtagccattcatcatgactcttaggtagaaagcgccgtgttcaagttcctccagctgctagcaaggacaagcatggggtaggtaaggcagaccctggttggctttcaggcatcagggaaagaccggaccatctgttgccatggcaacattcattggttttacaataaacatgaacaatgaggtgctaagccttctaaaaatagaggcacgctctatttttttccatatttttataagatagtttcacgatatatcttaggactaaaattgagatctatcctcctggttacaaggggcgagtgtagtatccatagctttttgaatggcagactccaagtttgtgtgacttgagtatgcgtgtgtgtctatgtgtatacacacagttaatattgagaacagacccttgaagaccactatacctacctatggagcatgacataaagtgaaatgtagcattaaaattatattaaaatatttgggaaaaaatagacaattttaccacctgatccaaaggagggagctttttctaggcaagtaatttcactgaagtgatggctttctgtgtcagttttctttgctattactggcctgggcaacattaaatctggctgaggctcagcactggacaaaatacaaaatgatcacaggcactcaggcttctgtagagcatcaattcactttctaatgaaaaagaaggagtaaagagagtgagggaaaaaagaaattgttggcaagctaaaaagagtttaagaaatgaagaggagaaaaggtaaagtgatcagaggtgagaaaaatgaggagaagagagataaatggtttgccatgaggagaatgtagacctttaacgtgaatctgatgaaccaagccactccgtggagatggagaaagccagcctttctttccctccttagccactatttctggtaatatcaagtccatctgtaaggcaggcaaggtgaatttattgtatttaatagcttccaatttaacaagtcgaatcggagggatccccaaactctactccccatggctatatgctcacagtgctgtgatttatggtaagccctcctttttcctaaaacaaccacctgagaggatgtctcctggcacgcgatgtcctctgaaaaccagaggccagtggttttgggagccagacacaggcattgtaagtagcacaggacgcttcactcagcagacagggcaggaggcctcggtagatgtgcagaagtcggggagaggcagggctagcctgctgctctgaccagacctagtgaggcaggagggtgactgtcgctgcttggtgtccttcccatcacagcagtgaggctgcaggccaagccttcacctggacacgatcagggactctggctctctgaagggaggtggtgatctcttttctaatgcacttcactgggtccacattaggccgacaagtcaggttcctcagggctcccgatgatacagcaggaggatgtacattcatccctgtccatcagcgcctcccagggaacctgcgtgtctgattgaagtaatttcacccatagtgcacaaagtgtacactcaatcaaattttatagaatactttttttttaacgaaaacattatgtttgttgtgcaaagttttagggagcagtgataagcaaaagcaaaacagaacaattaaaaccacctgtaattccccatccacattcgtcattgttaacacagtagtgtatatgcttctgtcggtattttctacagttatgtagttatatttttcatttaaaaaaatgaattcaatcttttgttacctactcatataacttatgtatatacacatctttctgtttcattaaatattttatgttatattttattgctacacaatattctattttctaaatggaccatcatttaagtagtaatgctcagtggtgagagagttagattgtttccagtggttttgctgttgtaaatactgttcagatgaacatcctcattgtctttattcacaagcatgattacctccttaggatatattcttccagtggtattgtggcagagaatatgcaaacagcagggtttttgacacctgctgtcaaattgcccttcaggaaggtaccctgagcacctccaccctcagcctcagcctcagcccgcttggttcttcctgctgtcacccctcaccaatgctacctattatcattttgtttaggtttgctgcttgataggtggaaatgccatgcctttgttttaaactgcgttgcctggaatagtaatgagtttgaaattttccccagatgttgaagggctacttgatcttttgtccctattacctagacacatggatcctagctgggctctgggaagtggcactatggcaactgctaggccttccctctccttggagaggaattagcgagaaaatgatgcctcttcaagtgtgtttttaaaagagtttaaaatgtaaaggggaaaatgtagatggccagagagataaattataaatggaggataattatcgtagtttttaggaaaggtaaaacatcaaaagatacataaatgacaaaagaactaaatatcttaggaagccgactttcctaaggtaagaatcgtgtgctgagtatgtggcaccaagacctggaaggacccatgtccctcccaccctcccagtgccccgacctcccacctctggtgctgtgctgtgactccacagggagattttgtgccagtgcccccaccagggactcatcaccactctagcccaatgactccaaaattgccttctcctaaatataatgtccgcgctttgacttttaaaaatagcagcagaaaatgaccagggggcactctgtgatgtccaagattcctggggcaaagcagcccctggagcctgttcttaagatagctccatccttgtcttgctgaattatttacagaacttgtgagggcagaggctgagtagaggtacttcctttctgaacatgctcaggcactccctgggccaggcagggaagccagtgtctggaggatgtctgctacccggtgtcagggagtctgccattgattttctttaggacaaacctctctgcaaatgccacagatttacattagccgcactatagagacccagtcagggccaggcgcagagacgtggggaatgccacgtgctgatttcttttctgctctgggcagttgcttcttttcacttccacgtctgaatggcagggagaagctgggtgcccccacatgtgagtcagaatgtgacctctagcatttgaaagtcctagttattaaatatatgatctgagttgtccacattaaaaaggcatttgggagtgcggggatatggagaaagatgatgagcttgatgtttggattgatttattctcagtagaggtgatttcagcaggctttcccaggcaagttaggatactttagcattactctgggtatctggccagagttttcaggggtgttaaatagtgaggctcttaagaatgcaggaagcttgggtcatctcctgcgttcctagggtactgccgagactgggttcctttcatcggtgtctcggggggttgggggtgggggagctgagccacagtggagcggaactgtctgcatggacccttccctttcttccagctccggtgtttgcccacaattccactcacttaaaatttgcctttgtcttctagccaggtagcttgccaggggaaactgggtgtgagtcaatggccttcctcttcactctatggtcagcctctgtttttgtgggacagcatcagcctgaagccaggcaaaaggcccaagtcatgtagtaaaaagtgtgcagggctcaggactggaagcaaaactctccaccaaccagcttggtgctattaatcagatactgtaactgcctggaaagatgagcaaacaagctgtattcctcaggctcctattttgtgctgtctacattgtgtcctctgtgctacctcatttaatcctgttaatcatggtttagatgggggaatatcatctctaatatgcatatttagtaactgaggtttatagacctccaaggtcatgtaaactacgaggtggccatgctagaatttaaacagcagtttttatttttgtgaaagtcttgttttctttccaagatattacagctgtcttacttcacaaaattgtcctgaggaccagataattgtaacatatatgagaggtaaaagaaaaaagtctaaccaatgtttggtagtgtgattattgcttttatattctagttaatttttctgtgatgaaaaagcaagtttccaaaggccctggctttgaagggaagtaatgcaacttggcccagtctctgggtttatcccagaaagccagttcccctccaactccctcctgcaggtgcagttttcagctgggccctcagacacagtccactttgcatcccacttcttgggaaaatttttcttaatgttcactagcgctaagatcattctgaaacctctccctgcaccactgcaagactagtgcattcttaaaccctgcagcccaaccgttacctgtgatttattttattgtcatttattcccacagacaatacacataaaaataaaggtagtaagtgtaagagcattttaattgccatcccactagtcttaaatgtccactgtttttatatctccccctcctaccctagaaaatttcagaatagagaagatcaatttatcatcttatcctcgtttcctgatctcaaattggaagatggacagtttttatgttaatagagagtcgtttagagtcagggaatttttcgaaggaaagtcgagatagatggatgaataggtggttgtgtgtgtgtgtgtattatatatattaatattaatagagaggcttcctttgtggcctcatgcagaatgcttaaagatcctagaaatgttgctgtaggaatggaagcagaagaagccgcaggcttcatggttgattgcttttctgattggtgccataaaaaaaatgcattagcgagagaatgtttgatttaaagagcgcctagatgccgacaccacctctgtttgttttccttcctttagcagaaaccttgtaaaatttttatgaagtattaatggatctgagattttctccagcaaattttatgaggtgagcttaatcccacacatccgacccaatttagcagtctttagagacatagaacgtaaaaggcactcagaaagtatcctgggtgcctcagtaccaggggagtgatggggcaggggtagggtatttcctccctctcagtgctttggtagactctcaggggttgtgggagaacagagtgaagaggtaccccacccacagagaagaccgcacaggtaagccaaaacttcagatagtaaatcttaattcataacttagcactgacttcaagaacttccctatataactgtagtctttgatgagaaaatcgtgtttagggaaaacaagaaattatttgtattaacagtttctgtgctgtcaacctggaatcactggctttaatctaagaaagagacatgaacaccgtccttcctccaccccaatttgttttctgtatttgaaacaaaagagccttgaagaagataagttacatttttgtgtatgttgatgagtgcagctacgttttgtaatgtgaagtttggcctcccacaaaccaagcaacttgatgagcctcagcacactagtgagcatttagcagttcccatcacttacctgtttatgctgattctgtactactctcgcgagttcttgccctgtaatgtgtgaattccattagatttatggtgacgaaatgaaggaagagaagttttttggaagagaaataggagccttcgccaactaagaaatcactgtggcctattcaagaatggtcaagggtttgggattttaccctactttcaggcaaacaagtccacatgccactgtttcaggggtgctggcggaagaaacgagactccagggtcagagataaaagactttgttactcgtggcacagcaggcagcatgagctccatgttcgtgtcagtgctttttgttccccaggtctcaagagggtgatgtgtatggcccaagtggatgttctgtgctgaggtggtttgcaccacaaccaagtaacccctcatttagcaaactcaaatcttttgtaatgggctgcccgcagatttgcccaatcttttctcagaagagaggtgttctctttattttactggacataaaaatctgccttgtgccatggagggagacaccatttctgtcttaaagttcttcgctgtattaacatccttgaaaagatagtcatggccaggcatagttgctcacacctgtaattccagcattttgggaggccgaggtgggaggatcacttgagcctaggggcttgagaccagcctgggcaacatagagaaaccccatctttacaaaataaaataattaaaaaaaattagccaggtgtagtggtgcatgcctgtggtcccagctactagggaggttgtggtgggaggatcacttgatcccaggagttctgggctgcagtgagttgtggtcacaccactgcactccagcctgagtgacagagtgtctaaaacaatactttaccttgttttcctgcgggtgaatattctcatgagtaaaccacctcatcaaccactctgactgatcaaggttggtagcaaatccattcaatttgtctaatacagcatttaattaaagctactatcaacagggttttgtgcagcaggatgaagctgttctacagtattgacctcaacattgttccccaagatcccagacctaaccagatgaagaaatgccacagacaatcatggtccaggtgagaaacaaaagggaaagttttccttacgtttctatattaactttctcacttgtctgaggcatgaatgcaggtacaacagcatgtactagagattgcacagacctgagtaggcttgcaaagaggcagtggagggtagttgtgttatccataacaatcctggccagtgcattgaagctgatttgaattccttccagggcaagggtgttatctccttaaatacttgaggttctctgtgagcacctctgagcgtaaaagtcacagggtgttcagaaggggcaagttaaggcctacttccacacaagaagtacaagctcgagggtgttcatggtgcccctggatggaaagtcttgtttacagttgttgggaccctcccaggtaagacctccgtccatccagaatcacaacttgacattgcctccagtgtcatctcctacatgatcgttaggacttaggggcttcagttctgctagaataattgagtctaacccctgtttttgagggacttcctgccctgtatatccatgtcaccggctggatgccattcatctggcctgtggaaccatggagcagtcagtgactctaggaagggaatcggggagacaatggcagatgttgacatatgttttgtgatgatgttccaggagctggccccatcccctaatgttcatataaactgctcagttaggttaaggggaatcgtgatcaaattgtgttgagagctgtcaggaggggatgctggacccaagagtcagttaaatgaaggtatttgcagcagattgggagaactgtatcaggtcattttcctcatgaagaggatttatggagtggttctatgacaaaagatccatcctgttcccttccagggtctacagcgttcctctccaagtgcctgaggttttggtccgtactctgcaaaattggtctgttacatccagtagctctaacttcaccttttccaattattttctgctgatacctggaactttcatcctgaagattcaggtgcaggagggtcaatattgctttttgaaattcacagagatgcgtcatgcctcctactttggcctgtttgagcaccgtgaggggatttggacaacagcgtcttcaacctactggccatcacctttttcatccaggagcatgtcaatccaacaagagaattcaggcagcctaaccagatttaagcatgagtcccctagatccttttgtagccaggttgctacccaaagggtgggccaactatgctggcctggggttgctgtcaagggaagaaaataactcatgttcccaggaatggtcaagcagaaatcctgaatttgaaaaaaccttcattgttccctccatttattttgtcctgttgattatgcaggaaatggcaggaaagagatgatccctttcttggatcagccactttcgggggccaaagcaccctattaaggtgtgtggagtgggaggacatgagggaaaaagagacagaaatctttctgattcaatttttcagaggctattccaaagcttggtgataccagatgcctgtggatgatggggagaattaaagcccgtcaagtaatccttgactatcaaatccattatttaatcatttttgtgatgaaaggtgcagcattgctagactgaagatactctggaaagcctagcacatgacacaggttggtctgatgaaaggtgaagcattgctagactgaagatactctggaaggcctagcacatgacacaagttggtctcaaaggccacactagcatggggagcagaatcagattacactggagcagcagcactgtatcctgcaagagtggccggcagtgaggcagcatcaatagccctgagagggggtcaaaagtcagactgagtgagtgagtcttccagaactgggcaggggtaattccccatgccatgcaacctttcccactgagacagagatcaccttttgtcaggagtcaccaagtgtgaaatgcagtggtagtccctgcattcgaaacatagagtcttttactgtgtgcctagtctaggaaggcggacatgttgccacatctaggatgatgatggatccatgcaccaatggtgtccatgtttcaccaaggctccatcagcaacttgattttgcctggtctcatgagggaacaggcgtttgttgtgtcatctctgtgagtggcctaggtggtttgtgggtgcctacacccatcagattcccttcattctgagccccttccctccttatggctccttagcatactttcctgggtgcatatgtcctgcaatacctcttgagggagcaccaagaaataccagcccctctcataatcatctttctctttaaagcagttgaggtcagagtagagggggtaggaaggatcaaggggtgtgaaggtcgagagcagtttcatgccaataagcaaggcacaaccaaacacatttctaatgttatggactgcacaattgtgtccttccaaaattcacctgttgaaaccctaaccctcaatgggatagttttgggagatggggactttgaaggtgattggatcatgaggttggagccctcataatggaattagtgcctttatacgaagagacacaagagagctccctctctgctgtcctccctgtgagaacacaacaagaaggcagccatcaggaaaccaggaggcgggcccttgccctccagatctgctggcatctggatcttggacttcccagcctcaaaaaccctgaggaacaaatgtttgaaccactctgtctatggtaatttgttacagatgatctaactggccaagacactaatgtttgcaatccacacaaagttccgtgtcctcattgcttatgccatttaccctgactgtggacccttgggctcagcagctgcagccttcttgtcagctggggctcaggttgccaccccattttcatgaaaacatccctccctccttccaccccaagtagtgtgagcaatgaccacactgtccttcagcagctcgttttattcctacttctcactgcaacctccaaacgttcattaataggtcggatagtgaagatccttactcactgcatcccccacccatcagtgtgaaatagcgtttgctacagggtgtcaaggagtcatttcatatccctgacacagcctgggacgcccacttccttacttttccagaaagctacatctttgtcagcatcccattctcatcactgaaatctgtcaggaactgtgatggatctgagattttacccaacaaaagacacgagactcctgggtcctaggcaaaagactttattactgtggcacagccagtggtatgagcttcaagttcacaccagctcgccatgctccccaagcaccccaaatccacaggtgtgacccagagcagcgcaaatggaggctagacacttgggttgtgtttgcatgacagctggataactctgagtttggggaacctggatcttttataatggactgcaagtaaacctgctcaacttttgcctgggagggaaatattatttttgttatactgggtgttaaagaaaacatgtcctctgctcagaagggagatattatctctgtctttcaggttgttcagtctacaaatatccatgaaaagataggtcctcttcttgcaatatgtgcagaaatgcaagacacccatggagaatatctcctgtgaccttgctaaaaggattctagccagaggcactgagcaggttattgttggagctctactcctatgttgagagcatcccttgattcagccattatgtaggataacatgccaggctctggaataggcacagggtagtgaataaataacacagtaattgtttctgccctgacagagcttatacagacaaaataataatgatgacagctacacttatatagtgctcactatgcactaggccttttctgagtaatttatatgtacctacttatttaatcatcagaatgacactttgaggtagatactgtggctatcattctcatatttatggatcagaaaacagagagagagtgttagagtcagaatccaagcccaggtagtttctgaatgtatgcttctaatctgtcttagtataactaagtacgctagttatacttagtataagtctgtcttacatggcttctagtggaattaccacacaggattataaattcagtgattttataataaaagatgaactggggacatctaggaggagtttctaagccagaccaaagggctgcccagaagaagagatatctaagaacagtccagaagggtgagtggacattaaccaagggagctggagaagacagttctcagcagggaaaccgcgtgtgcagaggcccaggggttggttgggggcttcctgagatgacagtaacatctacttagatgggtcatttgttgtaaggcacacatttatttggaatgagtcagctggtgaaatttcccccagacttctaattcacagctctttgttttccgtgtatttttaactaaaatatgcaacacttctactgttgagatatcacagcagcctctaaagtgtcagcaaaataagccagggcatagccaaagtgacaagtgaaacccagcattatttgaatttattttgatttttgtagaattcaagtgtctaattattaatattaagcaagtagagaaattaaggcaagatacacatgggattatgggacacaagaaaaaaataaatattcaaagcttcaaagactttttggatatgaatagcttctttgatggtctctcttcattatggaatcctgttaggcatcattgtccctgtgatcaatggctagatctggccatcatcgtcagcctcccagtagcctgggtgaggctccctgggttgtgagtgaagactggttatcctggtctttcccatgctcattccacattttaatgcagtatcaccagcttgagagtgccatgtgatctgacagctttgaataattgatgcccctcatactaaaggagagtttaggttttgtggttcagcaggatgctttactcttgttgaccttaaccttcagaggcactcgggcattaccaagagatcaataaaacttaccctggctggtctgtgaggacaggagcctgacagagagtgatgatcaagaggagaggatgggaggattacgctggaacctggggaagaaaagggaggatgtgtggggtagagtggggaaaggggtggaaatagaataggggagcatcgcagaatgagggagacaggagctccgaaaacgatgaagtgcatgacaaagcaatggaaaacaagggttgaacagaggagaaagagtatcaggaggaacatatacagaagccaagaggatgaatgagggacgcacaggccaggaaaggagctctgatctgtaaccctcctccagtctgtggttgcaaagctgtacagtggagggaggtcaccagggactcaacgtctcctggaaagcagacaaggaaataacttatagagtgaggcagaataaaataagggttgtaagaaaggaatgcagtcactgctgggcattggaggcacataaaagggactttaatgcttgaatgccaactacatgctaaaagggcatcggcacattattttaattaattattattaattgtattattaaatattgtaattattacataatatttagactaattgtcaaatgaaagtctcaggtaggaattattgtcctcatgctaatgatgaagaatagaagcttaacgaggttgagtgctttgagtaagctcgctgatcagtggtggagctggaggaggcttgtgactctgaagcatctttcaactcttgtcactgtctcaggctgccgcccagaaaggcaaacattggagtgatttattcttacaaaggcactggagaaaacttcagtggactatcagctaattgaaggtgaggactgtgtctgagttttcaaatctgccatggctagcatagtaaacactgcataagaatactaaatagtacatggaaaaaggaagggttggagcttgggtaggtaggtagagagcaaaggagggagggagggaagggggaaggaaaggagggagggagggagggaagggggaaggaaaggaaacatgagagggaagggaggaatggtatttgtgctgaatccagaaaaacaaattgcatttttctgggggtgatggtaggatgaagaacactcgagggtgagttaatagcataatcaatatagagtttgcatttgtgtgataaaaaaatgacaaaaattcactctagccagagtctagttggaagaaaatagtgggagatgagtttgctgaaacagaatggatcctgattcattcattcattcaacaaatatttaccgaggcagaataaactaagagttgcagtaaaggcacagctatgaataggcactgctaaaggagcctaggatacatcagtgaacaaaaccaacaaatacactttccctcacagagcttacattctagtgaaaagagacagacaataaacataatacatgaataaagtctacagtatgcaaaaggtgacacatgctattgggtaggggaaaaaagcagaatagttgaacaagagatacagggacaagtccaaatagtatatttaggttaaccattatggaggcgatgtttagcaatatcttgaaagaggtgaaggaatgattaacgcattttcctaggaaataaattccaggcagaagggacaggctatgtaaaaacctgaagacagaagtggacctggagtgtccatgggcaggggtggctgggatgcagagtgtggtgtcaggtaagtagttggagaggtgacagcagtctcgatcaggtcaggtctcagggaccctctcaccatgacagaaacaggacccagtggatggctttgagcagggtaggggtagaatggaatgtgttctaaaatgggacgctggcctctgtgtgaggacagacatggtggcaagtggtcagataggaagctgctgctgttgtcactcacagatggtggtgaggaaggtgcccagggtcagattgtgaatacctttagaaggaagagccagtaagacttgctgatgggttacatgtgggatgtgagggaaagagaggtgtcaagagcaattccagggcttctggccaagttgccactatctaagatgggctatgatgtgggcaaagcaagtttgctggaaaagatcaggagttatgttgtccacattaagatgaaatgagtgttagacataaaagcggacatgccaagtggacaggtgaatataaaagaggctggcacggaagagtgatgtcttgtaggagatttacactggagtggggtcatcagcacacacatggtatttaagactgtgagatagaagagatcatcagatggagaatagaagaggtccaggcatcgtgggtggtctcaaatgccatacccacagttcgaaactttaatttatgatcagtggggggcaactgatatatacttttggaggataggcatatcacggtctcagctgggcttgtttcattgatgcttttttttgtttgcctgttttgtgcagagaccacgctgaggtcatgtgtaggttggccctgggaaggccaaacaggaggctggtgcaccgagccacatgaaggtgggatgaggaccaagccaggaccattttaatgggccagggaggagcaaggagcaggcagagataaagggaagaagggaaaagacaaccaacttccctttcactcagttcaaaacagcaatcaccagatcaatagagaagaaaacataatttaagcctgaaacgaaggtttttgtgttttcttctctctcttttttgctgcttgaggcatggcaatgcttgataatgctttgcttcctgggggcatagctgacaacagtggggaaggaaatagagacaaggttttcagtattttagaaatctggtttctatctgaactgtggagggtgaggagcctgcttttctcattaactggtcagcatgttcagaatctgagagggaatttttgagacaaacagatctgaatgccttcagatagaaagatggaaatgtttctcctccccaaagtcccttgaccttttaaataattgccattataccaaccgtatataggaatcggctagaaataacataaataaatgcgaaaccatgtgcctacacgtgctagctagtgttttaccaacaagaatgggtacaatttaaaatcacctttatacaattatcacaatgcactctcacaatgatcttgtaaagtgaataaggatctcctcccctacatattttactgggaaataaaaaacaaaaaactaagacgtaagcaggctgtgacttgctcatgtcagagagaaacagaaccaagaatcaaaccaatttgtgagcggaggtctgcttctccacggtgtttgctctctggagacagagggaccatgccactgaatacactggaccctggtatccagtgcatcctcaggcccataatttgccattgaacagttcatgatcctctaaacttggcgtcctccccagcacctgtttcttaaacatattaaggttaaagagtggcaggtggcggcccttcttccaatcgtacccagcaaaagtaggctcaggggctcacatctggagatacaaagggatgcccatttctgtgtctcttgcctgatcttgaaattacccatcttgcctgatcagcgtttctgtcttcctgactccatgtgctttccttctgagtctttctggactgccctcatgtgctgtagtaaaagtgtagcagcgtttcaagctatggggttattgctgggatattttatatctaacaggcatgggggtgataattcctttttcacttttataattcacacatatcctcccccgaaatgcatttcgtatagagcttttaggcaactgaacacaaagagccttccacccccttaattctcctgatccttatttcaactattttcccactggctttttctcttactgcactttgggccaactgaaagccagtggtgtttaagaactcccttatggattatttgtcagtaggcaaggggatgctacctctatacctgaaacttccataatcaagcacagtttattacagagcaaatacaggacagtagcagggcttttaaaaatcaattagtgtgcaattcaagattaaaaacagaagagggctaattctatttttcatttggatggtaggctgcttaaggaataatagtacaaagactgaagtcattacaggaataatcagaagtttacccaggtgtctttctgagcccctttcctcctcaaggctcagtagcttactttcctgggttcatgtgtcctgcagttcctcttgagtgagcaccaagaaatactagcctctgtgaatgacaggtgggggcttcatgagagctggaggtgatcgaagacaggtcacattctcctaaaacctctgatggtgttttctcttcctatgctagaatctactccattcttttagctgtactctgtatgaatcatatgtacttgttcatgtttttctgcaattactcaaaactgtgtcttcttgacatatgctgtttgtccatcagctccagagagcaggctcctttaatctgttggctttggagactgagcaaggggaggcagggtgagtcctccatgcctttcactatggattagccacataatagatgttggggtttcatagtttggggttttgtggcatatgatgtgaatagaagcactttagactctcggcagatctatctctttgaagttctcttattatgtctaattttgagtactgcacagaatagctataaattttgacaatgataacctgctctctaaccccaggcaacctgctcctcttcccttttcaatgttttcattttagtataaagaaagagcgatgataaatttttttatttttattttttgagacagggtcttgctctgtcaccgaggctggagtgcagtggcaccatcgtggctcactacagccttgacgtcctgactcaagagatcctcccacctcaggctgcagagtagcagggaccacaagtgcgcagcaccatgcctggctactttctttttatggacatgacgtctcactgtgttgccatgctggtctcgaactcctgggcccaagtaattctcctaccttgacctcagaatgtgctgagattacagatttgagccactgcacccagctaataattcttatataaaggcaatgaaagcaatgcaattagaaacttcacctgcaccctgtcacaaccaaatcataattgtcctcatgcatccaggtcaagaataatggtgttaaaagccagttatcatggctccaatttttctatgttgacctgaactcagcttgtgctagtcttgggatttgattgtatgttttctgtttggcttccatgttctacctgccagtgggcttggggacctcttgccactctgcaccaggtaaactggaactccacatggaccttccgatttggtactgagctgtcattcatttgtcaggcctaatgttgctaatcctcttctggaaactttatccttcccgaattgggccacctgattcctagctgaatgttcacatctgctccccattccttcctaggacctgcagacagaggcagcaggtacagttaaactgtggtcctagcctctgggattcagcaacacttccgcctcgctgcttatctgaccatttttattcccaggcttatgccagttatgatatacattccaatcttatacctgggctctcccctcattcttcattcctgatcccactcattattcttcattatttttaccacagatgcagggtggctgagggttgagttaatcacattcctcagttcatagcacatcatcatccctgacaaggggatcattgatccccaaaagtgttatcttatttttcccctcatctctgattctatgccttgtccctttctgctacagcttcccacaccaaagcgtttcataaatttcattaaatgtgcatgtgtctttataaaatgtgatggtgcattgtatgcatatgtcactgatttatccatttatttgatttatcagggctgtctttccaattcccctctaacccaaacaagcctatgacaaacaaccctttacaaaccaatgagaaatttccctagtttcatagccagcggtgattttgctgggtcatgggactccacaggcttaattgtctaaatagctgccatattgcttttcaatatggatttacaagtgtacactcgccagtagagtgcaagagtgcccatctgcatgcatctccaacaaaacttagttttctctaatctctgattcccatttttaaaaccatgttcacgggtgtaaaatgacacctcactgttattttcatttgcatttctctggtcactggtgtgagctctttaatttgtgtgctttctcggctttttcttatgtgtattaccgattctttggcctattttttgattgaaccacctatctttttcttgtagattttcaggaaaaaatgcttggtatattcaagatgttaattacttctcagttgcagatattgaagatatgtgtcagtagatattgaagatatgtatcattttgctttgtcgtctcttaccatttgtcagtggggctcttcatttgcggtatagtgattaagagcatatatgctggaaccaacctgcctgggtccaaatcttaactctgcctctgagctatgtgacctcagtgatggtccttaatcttctatctatatgtaaaactgatatattaaaatgaccatctcagcttgagcaacattctgagaccccacctctacaaaaaaaagaaaaaaaaaaattagctgggcgcagtggctcacgcctgtaatcccagtactttgaaggccgaggcaggtggatcacaaggtcaggagatcaagaccatcctcgctaacatggtgaaaccccgtctctactaaaaatacaaaaaaaattagccgagtgtggtggtgggcgcctgtagtcccagcttgggaggctgaggcaggagaatggcctgaaccctggatgcggagcttgcagtgggctgagattgcgccactgcactccagcctgggcgacagagtgagactccgtctcaaaaaaaaaaaaaaaaaaaaattagccaggtgtggtggcacacaactgtagtcctagctacttgggaggctgaggcaagaggatcccttgagcctaggagtttgaggttgcaatgagctgtgattgcaccactgcacttcagcctgggcaacagagtaagactctgactcaaataaatacataaatacatacatacatacataaaaataaagttaccttcttcatagggatttactaaaactgaatgagttaaattgtgtaaataacttacaatagtgtctggccaaacacatacatacacatacatgtatatatataaattatatatgtattttcaaagaaaacaaataataatttcttttttagctttataattttgccttttccatttaggtaattaagatgaagtctatcttacataataaaaaataatcttaatgtaacaaaaggtagggctatagctttgtttcctcccacgttgtgagccagttttccagtatcatctactaaactgtctgtcattcccattgctttgagggactactgttttcatatgttgggttcctgtatttacatgcttctttttctgtgtttctgctttggcctccacattgcttttctgttcatctgtgctgatggaacccccgcataatgtggctctcttggtttccataaggctctcaataaccaccctggaacagaggcagtgtcagggtattaacataaacatgtttttaaagataaaaaagagtgccacttacaatctcatgtataattttaaatgaaagaaagcctgtgattttgggccactgttgagtgaattgtgtgtcagcattctcattttgaacgtgtctcattcagcgatgtctaaatcactttgtgccatcttactaagtagaaacaattcaacaataaccaggcagataaacaaataatcaagcagaccaacaaaaacaaaataaacaacatgtacttaacagtttacttaagtaaagaaaagattcgttctttaggatctgtgaagaactctaaatgtattagaatgactccactttccctaaagagtgttctcccaatcagggctgcctttttcctctgttcccatctatagtcatgtcaccagggatgactgcgcacaagtgaagtggaaaaaacacagtcagatgtcatatcacctctaatcctttttgtgcatccagttcttccaataggatacagagggggaagttgagcacaagattctgcagcggtaactcaggacttttgggaatttcaaagcctagaattctaaatgtgaggcctctcacttagctcttactttacagcatgtggaatagttcagcccctcaccatccaaggcaagactggtgaacctttattagtgcttctcatgtgaagcatccatgcttgttcctccactccacagtgaatccctaagggcaggaggggagtgctttgttcttctcatcttgtttttagaagactaactggcacaggccaggcgctgtggctcatgccgataatcccagcaccttgggccacagtgggcagatcacctgaggtcaggagttcgagaccagcttggccaacatggggaaaccccgtctctactaaaaatacaaaaattagccagatgtggtggtgagcgcccgtaatcccagctgctcgggaggccaaggcaggagaatcgcttgaacccgggaggcagaggttgcagtgagccgagattgcaccactgcactctaccctgggcgacagagtgagactcagtctgagaaaaacaacaacgaaaaaagaagagtaactggcacagcataggcattcaatatgcacaacatgggcttggactgtgtggttcactcatatgcagattttcttctgcctgtgccacccctgaggctggaagaccaactcctcagcctactccagctggagatggtgaggacgaagacctttcagatgattcacttccacttcatgagtagtacatatattttttctttcttgttattttcttaataacattttcttttctctagcttactttattttaataatacagtatgtaatacatgtaacatacaaaatatgtgttaattgactgtgttatcagtaaggcatctgttcaacagcaggctgttagtcattaattttgtggggtgtcaaaagttatatccagattttcaactatatgggggcttggaaccctaactcctgagttgttcaaggaacatctgtgttcaaatgaatgaatgaatgaatgaattgtgttaaaattgtgtctgtgataacttattccttacccaaaatgcatttaggctagctttttttaagataggagtccttttgcattttccttagcacctcagaatatttgtcctatagacaatttgaacagtgatgagcatttgcatatttataatctacatgtgaacttatacctctttgctctcatgttaatgagttcaacacatagtgagttagcatcttctgtgagcatagcataacgtctgagaggtgcacaaaagatacgtgtaatgtgaaaagagattagaagatgtaagcatgggctcttggatctgactgcctgggttcaaattttgaccctggcatttataaaaaacatgaccttgggtaagtcactaaaatgctctttgccttagtcttttcacttgaaaaatatttttttttctcatagagttattgtgaaaatttagtgagataacatatgtgcaaggcttggcacatacttagcactgcataattattaggtcctagtgtttttacagtctgacctacaaaactttcaaatttagagggggaaataagacagagactggaatagtctaaacttttgaaaaggctaaaacatatcacaaatgtcctaaattatgcctatatcgtgtccttctgcgagcctccactccatttattaatagtttgcaaaaaccttcagtagatctccctgcattgacaagtgagttttcttttcttagtggagttcttcagacaatgcaatctgacctatcttgtgccttaaaaaatattcaggtacagtaatataactgcctagtttccttgtttttctttcttcttattttttgccttttcaggtaacaagtgggaccaaaataagaatcttgccttctttttttttgagacagagtcttgctctgtcaccagtctggagtgcagttgagcaatctcagctcacttcaacctctgcctcccgggttcaagcaattcttctgcctcagcctcccaagtaacaggactacaggtgcacgccaccatgcccagctaatttttgtatttttagtagagatagggtttcaccatgttggccaggctggtctctatctcttcacctcatgatccacctgccttggcctcccaaagtgctgggattacaggcgtgagccactgcgcctggccgaatcttgccttcaatggaaagcctagtcttctagatttataagccttaaaatgttaggggaggggggaaaaaaaacctccaaacaaaaccccaataaaagcttaaataagggcctacgtgaatgaatttgtcatcagatgtgtttgggttgcttgccaccctatttaacggtgtgtttgttttgtgccttttctgcctgagttggtgtaaatgtcttttctccacggtttccttcctgtgatgacatagatgggttggattcgagagtcctcagcttaccgctcttccacttgaaaggaagagggtcatgagaggagaggatttctggagtggaatttcaatctctggtcatcaggaaagggaaaacattctgcccaggatttcctgtcatttattctggagagctttgtgttgtgctctgtgcaggatccgagatatgattaactcaactctggagtctgttggcagaaccaagcagctctggcatcagaagagagatgtccttaggcctaacctgccctccctggggtcttgttacctgctcaaaaagaacccagtggcctttgaatgcattttaaatctgtgattggtgcagtttgatggtccttccttccctccttccctccctccctccctcattccttccttccttccttccttccttccttccttccttcctttcttccttccttcctttcttcctttcttcttcagtttaactcagctttcaataagcttaatgggatgaagtccaagcgatgaaaagagaggtgataagagcacaaaggggaagcttatacccgagcatgggtgagtacaggagatgggttgttctgattattcttgctcctgttttgccttggccaccagttggccaggtcggggacagtatggtttatggactgctgtcacttgactcttccttctcagttgccttttaccttggatgaattttcaacgttctcttcccactttcaatcataaggagttgttgaatagattcatgttttctttcattcttccttccttttgtcttttttaactataggagatgggcacactgttcaacacacagataatttagaagaatgtttcagtgtcagttcttcctctccaccctctttcaccccagttcagtcataactgaaatcacaaatgaatggatccaattaatagtaaaaataaaatgtccaggatgctctctggagttctgagatccataggtcacggacagactcaagaatacaaagtcttcttcaggcctctgtttctaatttgcagaagaaaacaagagggtgagtagtattttgctttgaaaagcatctcagcgaaagtgctacatgataacacagccctcatttccataattctgctccctccggagcacaggtacatttaatttctcacaactgttccctaaatgaagagcagcatgaggaatacacagagaatgaaaaatatcggtgtgtgtgggtagtacatgaccactaatctttcctgacatttactttcactcatgagcacaggggtgaccagccccaccagtcctagatgctgaagataaatgtcagcaccatccattggaagctttctatgcatacatgcatattggaaatcaaatatatttggcttatcacacactgaggaacccatcccttcagaaatgcatggattgatctctgctaccccactcaccagtgccatttggtaaagttggggaatggtaagatagttcgctgcatttttaatggaaggaaaacaaaaagcgactacgcgtaacagtttttacattatatgccttcagtgctgtgtgctgtcaccccacgtgttgtactgccaaatttcccaagagcgtctgctcttcctattgtgaaaacaatgagctggtgtatgtcatgcaaggctattctgcccatgccaaatagctctgtatgttttaactgtcttcacactgggctccaccaatcactcaggcgcatacctcttcctcagccctaggcaatagaagttacagcattcatgagcaattgctttcctcacataaaggaaaaaaaggattttggtcttaaggtcttgccagctcattgactaatttactcctaatcctgaatgtataaagccacttgaacatttcatttgtgtgacatggttaaaggcttacgtaaatatagctggtaagggctaggattgtagattaaagtcagaaagaggtgattttgttctttttgactagatactgtaaattctgatgtccaattaagatctgaaggagaaacctttgtaacccaatgcaatgtgagtttctcgaagaaaaggaaaaaaaagggaaacaagtctccattctcagggacccattaacagctcagtacaatgactctttatgtggcctttgatatgcaaaaacagcccaaaataatttatggagaaaatcaattatgagctgaagagaaaaagaaagttgcccagattaattaccaagtcaggaaggatggcagtgcaagcacctggagttatgtccaagggggacgcccttctgcaaaaattcttcatggtcagaagaaggctctgtggtcaggagagaagggagccacatgaagtcagatgagctgagctgtaccttctggaatgctgagaatgagagcgcatatcatctattcagtgagataaaaaggctgcttcaaaactaaaggtatatttcataccctcgagtgtgaagtgcaaattgacaatggatggaacaatagcattggctagaaagcctggaataaaaccatcacaaattgaatttagagaacttatgaaagctaattttatgcatgttttattttattacatatttttctttaaaacagtaatagactcagggatgttggcaatggaggggattttagaacacctagtctggtggatttcaaattattcgggtcagagcacctattcttttgaacaaatcttactcattattaagaaattaaagcaaacaaagtcagaagaaaaaaaacagtagacctgctctggctaaggggctgatgaggttggagtctcttccctatttcctatgactgttcccgaggctcctgcagcagtaacctaaggctctagagtctcttccctattgcctatgactgttcccgaggctcccgcagcagtaacctaaggctctatggaacactatcagaactcagtgattcctaatattagttcccacactagaaccatgcatcctctaccaaaatacgtttccttagtttaataagtttgttaaatattgcttgcacaacccagagtttggagaattacattagcacattgaaggctgtgagagtaaaacttcagatttgaaatgcattaacctatgtttaacctggtttttcacctgcatacttgaatgtacctgaccgggaaacccttttatcagaaacacgtattaacattctgtggcagataagtcccctaggatgcagtttagaaaacaaaactcttgtctgggttccagtctaactcccttgttttttaagtgagggtacagagcctccgagagcatgtaaatcgctcgctcttgggtacatacttggaagcaaagttaggaaccagacataggattcttgaatccatgaagctaaggggattttcaaacatattttctttaatatttccacatgtctgtgggcagggagcagtcatgttctattcttttgatgctatacactgaaacacagaaagtcaaggttacccagtcaaactctagtataatccttccttcagtgccctggtcggcttgcttggtgctaaaagaaaaaaatcaatccatctccctgctgagtggaagaggataaagctgtccaatttttagatcttagatatttaaactaaagaagtgtgtgatagcattattaacaattggcgtagtaatttcttgaggtttagataaactagtttacattcgcaacatttagtgatgatttaagatgctttgctatgttggcattcaaaaattgggcaaacctctggccaaagtgaagtacagcccatgtgagctatggaaatgcaattaaaaggagtcacagagccttctcaactgcctgggcttaattaagatatgatctgccagtctcttagtggccattaattcattgtctggtaatccaataaggggttattgtttgaagctgtttgagagccacttgcctcactattaactcaaaattgcccaaaaggcggtactacaatgtcattctccctgccccaaagaggacatgacattgaaagacatttgacatccacatttgacaacacttgaaatggcaacattatggcttaagcattcacaagtctatggatatgataatggaactagtgacatctaattactaactggcaattaatgataatagccctttgtgaatatgtagggccattctctatagggagctccttgctctttgcacatattaattaatatagataggcaggtaggtgatagaaaggtggctttataacattattgctgctgagtaaactgagtcaggttccaactgcaccttgtagatgcacaacgattccttgctgttttgaaactaaatggattacaattttaagagtaattaaagaggaatgagaactgtagggaagtgaagggaatggatgtcaaaggaaaattcaaggtatcactaactatttgaattcttgatttacttccacccatgtttctggaataggaattggtcatttttcccggattggtagccagatatgaaacattaagtcggctttcagcaaaatgatgtctggtatattcagaataaggccgatttattttctccccacagagccccattgatgctgaatttttattgcccaatagaattcaacctggttgtgattatcccattggtcctgctagataaaacccatgtgtatttgccaaacacccacttggaaatggaaaatttaattaaagacaggaaactgaatttaatgatctctactgatctcttaaattccccaaattatttcattatggcttacttattgaattttcttaaggaattctaaaataaatgaacaattacctgaattttgcagtgttgtacatagaaatagagtgagttttcaccacactttcaaaaacaagtgagagtctaccccactaattcatatattctttcattcataagcatttattgagcacatacagtgtgccaatgctgtgctgagctctgggtgtactgatagaaaaagctttgatgtggcccttaagatgctcagtgtggtgatagaaaggaagttaaacaaataagtacaatccggagtgaccaattctacaacagaaagatgagcaagttatggggagtaatgagggcaaagaggaatgagagttaactttgtgagtagcccctgcctggctgtgcgataggggttcaaatccgactctatgtttatgggaagtactttgttccatctgcctatccacctgtcattacttcaagttgatttaatagttctgcagttgggacctgtggggtgtgtgtatgtgtgtttataataagtttaaatgaggtaatccttttataacctcactactccctattgggatttgtttgttttgatggaagggagggagatgagatttggcacatagcaggtatccagcaaatgcaactgcagcctgaagagtcaacgtggacaaatcccaaacaatgtgagccctttgggaatgctccgctttgtgtttcctctgaattgcatgaggctaccagatgaggacaggaggagaaagaattaaagtgtcctgacaccgtgttccaggttgtgtagcttttaagtgggcacccatttttccacctaagagctccaatgtgcctctgtttgaccacatggctttccggttagctgtgtgacagctggatgtcccagcatttctttctctccctttccaatcacgagctggagcagtcttgatgaatctctgcaggcacgtcgtcctcaactgagggatgattcattggcatgaagctgttaagtgattaaaataaagcacttttatggaaacgttctgcttactctgtgttcccagacacctctgtagtgtgtctgtggcaagagaggactgtaggggacacacatcgtcttatcattttctctcttgttacaatatccaatatttctgtgctagggcagaatttgaaaattgtagttcaattcagataaccttgcatgtgctcttgggcccttgaaaggagagaaaacaggcctggtgcggtggcttatgcctgtaatcccagcacattgggaggctgaggcaggtggagcacctgaggtcaggagttcaagaccagcgtggtcaacatggcgaaaccccatctctactaaaaaatacaaacattagctgggcgtggtgtcaggtgcctgtaatcccagctacttgggacgctgaggcaggataattgcttgaacctgggaggcggaagttgcagtgagccaagattgcaccactgcactccagcctgggtgacagagcgggactccatctcaaaaataaaaaagaaaaggagagaaaacaagcaaacaaaaaaacccacagaaaacaacacaacaaaaaacactaaaaggaaaaaaaaagaaaccgtgcagtttgaaattatctcctaggttgcccatctgcccaaggggaaaagtctatgagaaacatactggggtggagggaggggggacttggaggcagcaacacactgttctcatgggaagggaggctcctttttgtttgttttgtgcacaggaacttgccctgattggagtagagtttgcaaccctccccagtgtggggtttctttgttacgaagatcaagagaaggcatagggaatgcaagaatgtaaagagaaagaaggggcaagaacaaggatgaaaggagctggagaagggaaagggacagcgatggcaggaatggagagacacgagaggtgggatgaggaaacaaggagggtcatggaacagacacagctgctcctgaaagttcaggagcagctgggagaggggcttctggcttcttccagccagggtgctcccctatggaaagcagagtttctgggtctgtcccgtgtatgtgccctttaaagcaagtgtcactggagacacataaaatgaaagggggggcagggtggaataaagggaaaaattattgtaattcttaaacagacaactttaaaaagcagtgatttaggttgttttattcattacacgtcataaaggactcaggctgtggtgcccactggctttaaaatctaggaccctattaaaacctttccttgttagtaactcagagctttggaaatttgataagaaaaaaagccaatttaatcaaggcaagatttaacacaaagaaaggacctggtcttgcctttctgcagaaaaactttcaggatcaaatggcttatgattttcatttacctaaagaatcccagtggaatcagcagttggggagaggaggggtcatttcattagcttgcagggcatgcccagattcagtttcttcacacactactggctgcttccttagctactcaaaggaaaatgatttttttttttttttagtcatactacatggaagaacacccattgtctaaagaagaggcaaaagcaaatctgcctaatatctgaaagtaggaaaagattggttggtttatcttgacctcagtagatcccattttcaataacctgtattgtaccttcaatcctcaaatgataatgtggcatttgtggcatcacaaaaagagatgctggagttggggagacacagggttgagtccaacctctctaaattgtgtaaattattaaaaataaaaacataacaaacctcatttttcacctctctaaaatggagagtataaaattgtatctttttttttttttttttttgagatggagtctcgctctgtctcctaggccagagtgcagtggtgtgatcttggctcactgcaacctctgcctcccgggttcaagcgattctcctacatcagcctcccaagtagctgggattccaggcatctgctaccacacccagctaatttttttatttttattagagatggggtttcaccacgttggctgggctagtcttgaactcctgacctcaggtaatctgcctgcctcggcctcccaaagtgctggtattacaggcatgagccaccacgactggctataatattgtatcttctattatataaataaaattctctgagttgactcaatataaatttatgacttgctcactcaacaatctacaatgaatgtttctgattgttgttgaggagagaggctctgctccatgtagtcactcagggatccaggctaaccaaggctctgccatcttgaacacatgacgtccaaagttccctgagcattagcttccagccaaaggaagaggacagaatatagaagaatacataagggagattgttaaatgtcatatggtatatatcactttttcacattcttttggctagaatgaaattacttgatctacctgcctgtagagccaaagaaaaggaatgtaacctaattaatgccaagaaaaaatagacacagattttggtgtacaggtagcaatcatagctacagtaggcatttaagtaaatatccatttgtacccttcttcacatactcagaatacacagccccaaggtagactactcaaaatccaattcaattactgcattcagctcaaagtccgagttcacctggtggtatttactcctttttcttcatgatcagccatggctgtttatggatcactgacgtataactgaaaagattgccaccccttattccaaagtccttttaaatggggtagcaagatgggattatcacagtaaaacaccttatttggaaaatggaagcattgaagatacacagcagttactggttcatgggtgatatttttgccccggcagtggagaagcttcttatctatactctgattctgttctccaggaggagatttcttacctattgttagtggtggctccctggcgtcacacactggatagttcttctttgttcagcatcctccatggccacatctgaagtggtcattgtggagtacgccctacttgggggctgaatgaattatctagcccatttgctgtgagtgcatgttggggtgtttggcagttggtttacagttccaggctcttttaaaggaaaatcatagtttttcagctacacaaaaactgtcaaaagtatcataagcttcttccctatttattttcaggcagatccatttgccacatgaaaaaaaataaaaaatataaatagatataactcatagacctacattattgctttctttttgtgttactgtgccctttttcttctcttaatgtggatacattgggatactctgaaagaaagggcgtggaaaggaaggtaaaaaccttgatttgataattgccacgaaggtgaggcctttcgtcaaatcgttaagtaatattgagcctttgctgcttagaaccattttttttaatcttcttcctgacatttgagatccagactgagttggtgttctcaaacatttctgaaatcagtctctcattccctcccccttcatttgcttgaaaataggagcatctcttctgagctcatctcttgtgatcatcggtgtaaacaaagaggagtaatcaatcccagaaacgctttggctctttctatccatttcttctagagccgcaggttcagtaggcacttggtttgtcatagaagttatcacaagggacagttttaccaaacattttgctatttcacaacaagggtctacagacttctatctcattctgttttcttgacacccattgcccaagtgcaatctgtgaacacatttttgatttaatcatgccagaatcctactcttggtaccactttcaaaattaactaggggcacattagttgttataacaaataaacctgcaagtctctgtggagtaacaacagctctccatcctttgcccatgcaacagtgcaacaccgtgctactggcaaccacgggtgtcaggcttggcctcaggcggcatccgggaatggtgcatcaggaggggttgcctaccctcagtttgtgacttccaagatcaccacgagtcttgacatcttcctggggtaaggggagagcacgcggcgtcataggaaaaagttacgaagggcccgggattaggcagttgtgcatgttactcctacgctcattccactgggtagaattcagtcacagtgtcacgtaattgtaagaggtgggaaaatggcatcgagtagggtgcccaagaagaagagaaaacaagttttggtgagcagcaaccaatctctcttacaatatccaccacatataactgttgtgaggactgaattaggcctgtaaagagtctgtcatcaggacacagcacatagtgagtgttccacgagtgtttgctctgttcacctccctccgccctctaggcagccccgaagtacccaataagcacttaataaacacagaataaatgaatcagtattcatagttatttcccctctgaattggagagctttgaaatctgaccctgttttggattgaactatgctggatctctttggatctgatttttctttgaattagaaacatctcttaggaaacctagactatctttcaaagaaccccatctggcctattggaaacagtttcaaagttgaaacatcaaccatgacaggtcctttggccgctaaagatgcagcccctagggatatgtctctgctggctgttcacatgaaatagcatagcagagattggatgagagtcatctgctgttctggattttgcatcctctttaaacacatctgcctttaaacatcctttgcacaaaagcttaattttcccttccctaggttttaaatcactttgcagactacagaaaaagattacagaaggcctgtttttgttccattccttttctatacttgactatcacgtttgcttcttctacctgacattcattttattgtttcagttaattaaacatgtatcatgtcatgaaatatgtgggtcacatttatacacaactcaccagagttaaacttgctgtaaccatcctatctaaaattgcagccccttctgtccagaactttctatcttatactcctattttaacattttccttaacactttagctgctggcatgtgacttatttatttggtttgtatttgccttccttattaggaatataacctccatgagggccagagatttttacagttttcatttagggctctattgccactgcctagaagagtgcctgactataaagggggttcaataagtattcattgaatgaaaaaaatgatccttattccttagtcttaaataacttaattcttatgggggaaatctgacacattccaacataattataattccaacacaactccaacataattattaggcaaagaagattatattggttaatttatgatgtgtcagtgttaaccaagagatgaaaggggaaagaagggagaaatggttgttgttgaggatcttttattccaagcaaattttgcttacattatttcatttattttaaccagtgtggtagttctaaaaacaggtggtaaatgtcccatattactaatgaggaaactgatgcactaaaaggcagttatttgtctaaagttgtataactagcaagtggtggaaacagtattcatcaggtctgtctggctttagtacctgtgccaattatttgcaaagttgttcatactaatccttagaaataagcatattttaactggaacacactccagacaagtacacacatgcacactcccacacagactggaattatttaagatttagctatttgcaaaacatgttattctgtcctattcctcctattctattctattctattctattctattctattctattctattctattctattttcattccagcccatcccatcacttttatctttcaaaatttgacccattaagctgtttctgcagtaaacaaatgtattgcaatacagacttcgaagatctttgcttttaggcacattacctggtgaggaaaagaactgaagatttagaccacaaagtgaggactagagaatactttattgtggagacagtatttgaggtaggccttgcaaaatggattgagtataaagaaaatcttaataaaactttcatcatttcaagcaatattacttcacttaggcttctatcaaataatccaaatgctctgtattttatgatgaggctgaaaaaaagtccaaacactcaaatgtgtggctttcttcatttgaacagtcagccactcagtcaaagattagcaatcatttgcttaggaagtaaatattgagcatgtgctatatgccagccagtgggctaaatgctggaaacgcagagatgactcatgcacactgtctacctgtaaggaacatatgtttgttgccttagtccaatctggttgctgtaacaaaataccaggctgggtggctgataaacaacaaacatttattcctcacagtctggaggctgggaagtccaatatcaaggcaccatccgatttggtgtctgttgagagtccatttcctcagatggtgccttcttgctgtgtcctcacatagtggaaggggcaagcaagcttgctaggagctcttttataaggacactaattccacttatgggggttccacactcattacttaataattccccaaaagccctgcttccagataccagtaccttggtcattaagtttcaacatagaacttttgggagacaaaaaccattcagactgtagcattgaaggttattgtctgattaaatattaacctttccctgagttgatttgttaaggaacatttgcacaacggatatccaactccattccactgtcagaggaattggtggtctgatctggcatcctggggacactgcattgctctctctcctttcttccatcatgatataggatttgtaagttacaatggagctatcctttgtggcctggtgacatagtgactggcagtggtggatattccatgtgaatgatggctgtagacgtggtgaggtaggttgatgggttttgtcatcacttcttttacctgagatcaggttttttctccaagctgggaaaatgaacattgccacatccatttaaatcagagattcgctagagaaattgatatgtgtggttccataggcagtgccttcattttgacagttttctgggtctgatgaattgatggccagcagaggcagttaggtaggcagctgagcttacacaaaaagacctctgtctagaaggcttctaacaagagcctccattaaataggctttatgtgatgaaaacgtagtaccaaaaacactgttatatttctttattttaagcctatagtagtgagctcatattattttggaatggaaaaacagagaaagtaaaatatataaaaactgaataaaatagatatatcatcttcctgattctttgaatccagctatagtgggtccataaccttctgcaccagtttttgtttgttttattttgatttgttttaattgatacaatagaatttattggtactatgtttgatcactgagatacatcgttaaatatgctactgctgattcctttttaaaatacactggactgaaagtcctttgaggatagttctttgttattatgtctcatgttatcccctgcatgatgtcttccaaaaagtagctgctcaaaaacatactaattaacaaattagtatcaactgatatttcaaaacagcaatttttaatttataaaacactttcatatacatttcatcatttaaaaaatcaacagtaatttatttagtggtttgttcttattggtgtgtttaatcatgtttgacttactcattgcagaattaaattacgatgtgatattgcggtaatagttatacatggcataaaagaaacgaactcataggaattattcacttaactcgcgggatcagaaaaatgccaatgtactaaatgttagcctaataactatgggcttttggtatgttgtttagaggaaatgacatcagttaatctggcaggatatcgaagtgaaaagtagttaaggggttctaatgtgtatcagtcagattggctaaattatactgcaataacaaatgctcccaatatttcagtagcttacaacaaaggtgagttatatacacatgcatatttagatacatgcacacacacacacacacacacacacatgaacacatacacatacacttacttactggaccaaagcatataggaataggttctatttaggtcatgcagtcttgcttcagagggaaaagaatggtacaaccatgtgaatgctcttaaagcttttgttttgtagtaatacgtgagatttctattcctttttcattggctcaagcaaatcaaatggccaaaactgatgtcagtggggatagtaatgtaattctttcatgcaagaagttgtaaatatttggaacaataaagacatccatctattactgttattatatgtagctggaattttgagactggggtagaggaatcagtcttattgattttgatccccaaaagcaacctgtacatttggcagaataaattttattcactacattttatggagaagaaaacctaaggctggaattatttttaaacgttttcaactctcatagctgataaatggaaaattctagatttgaactgaaatctaaatctgactttcttcctaacctcaatcgaaatccagtactcttcataatgtggccatgctgcatatgtaagtgtgtggatgatgccagtaactaaaatgaaaaatgaaaatgttcagtagaggatgctagagaatttgtttttaaattttcgcttaaatatttcatattcttttaggtgaccaatattgaacgttcaaggtagttctcactgtacatgggtataatcatgattttcagcattaagattctcattttagcatttgtgtgggtctgtgtgtgtttgcatgtgtgtgtgtgtgtctataatgtgtgtgtgtctataaatccaggttccttcagtcttacacaaaaccttaacaaaatgttcctatagatcctgctagaactgctgactttcaaatcaggaattagttctgattctgttgatgtaaacctgaagagagaagaaaaacataattcaccttcctgcattattaagatttcagatacacagtttttataaaagcttgcaagtgcaaaatttgctatcaagcctaatgtagcatggaggattttgtctgagctagcaaaggatcacattttcatctcctgtgagtcagggactgagctctataaactattttccacatatatgttctattaaaaatagtatctcattttgactcttagtctgtttttatagtgagcgggctctgaaccgagttacctgataaattactttctgtatgtgtgatatacatactgtctaacctgaacaagaacactgacttcaggtacaaggaaaaccagtactgcacaataaatgggctcaacgactcattcagttcgattaatgtttactatacattaagcactgtagtatgtaccatggagcagatgcaatgccattctaactactgaggagcttttattgaagagatgagttatctaatctttgatagatagccttgaaataggacttaaaagaggtgtttttttgttgttttttgtttgttttgttttgtttgttttttaccttctttcttgtccctgccataaccatgcatctcttgcattgcatagttgagaacagcagttccacaataagagagtcttgtttgggagtcagagattgagttactgtagtccacttttctatccttttctccctttgacatcttcttctgattaattagtaattaataggtgattgattaaatgattactttagtctttcatttaataaacattattgaggacattctatgtgtccaacactgtgccaaataatagagagccaaggacataagcatagcccatatccttcattttaagtcaaatgagagaaacagacaagacaagtgtcagtgttgatgccacatgaccaaagccatgtcaagtataaacattttatgtaaaatgtagctattttaggacacagggaaagagtgacttttccgcacttaaagggcctggtaaggatttctaaatgaagtggttcttgaaataagtcttcatggatgataaggctaattacccagataaagaaagggggaatgcattctggacatgtacctgccattgcattcacaaaggcaggcaagaaacagcaggtccaggcatgcaggacaagtagttaagcttggtggaaatatgggaaatttgggaggaggagaaaggttgatgatagtggacaggtaaagacagaagtcatattttcatgaagtgcttatagtccgtgtttattaatctgcatcattctggatgtatatatggaaacctactcaatctaacttgggaaagaaaggaaaacctgatgaaaaatacacagttgattcttgaacagtatgggttttaactgcatggatccacttatacacagattttcttccacctctgtcaccctgagacagcaagaccagttcctcctcttcctccaccccctcaaactactcgatgtgacgactatgaagatgaagagttttatgatgattaactttcacttactgaattgatagtaaatctacttttttctatgattttcttaacattttctcgtttattactttattatacaaatatgatcaataatgcaatacatataacatgcaaaatatgtactgattgactatgttactggtaaggcttctggtcaacaattggctgtaataatttagttttgggggagtcagagtcctacctggattttcaactgcatgggggtccacactcctcacccccacattgttcgaagttcagctgtagaatgagctctcggtgtatgaacataagactacaactttgcttcaaaaacaggcaccaaggacaggaatcgcatcagggacctcaattctgctgttttctcatggcttttttattctcctctttatgcagaactgcttactctacttctctaatctacatgatggaacacagaagtaagagcatctaagattaaatcttacacacacaattgcctgaaaagattgaatacttttctatgttcctcttacaaattcactttgaaaggaagtctgtttggttagcttgggtctggtgcctacacttgcactggtgtaactatggccagggtgtgagttgtgtcataagagcatttttcctgtgaccatgagactggagaggaatggttgcattggaaatacccagagaaagacactggaaattttacaaaagatacccattatataaatggtcccaaatgccaatccacagagagggtgcctcatactaacttctgggagtttgggaaacatactcagtacttctgggggtttacccactaagtattctgatttgctagatctagggcagggtctgagaacctgattataaaagttcagtaagttattctaatgcctagatagattgggaaacattgtaagaaatttagaagagaggaaaccttaacaagaaaacaaaatcctcatgggatcaatttgcgtcatagtacacccactggcaaatagtttgggagagagaggctgcaggtgaagcaacttcttgggagtgcattgcagtcatccaggaggggagaaaggtcttacctaaaggaggagccatgcaaacagagaggagggctatcgggaaggtggagtaggcagttcgttgtcatcagttgtatctgaaggacaaggaatgcatctagaacaagtcccatgtttttggcttgggtaatgaggtaattaagtgatggagggggagaaatgggacttgtagtagaggatgacaagctgggttttgacatcttgtgtttgaaatgcctacagggcctccaattgtgcaagtccaggaagcagttgtatatatagggattctgagctaaagataatgcttttgtaatcattgtttgcaaatgatagatgaagacagtgtgtgcagatttcctagggtggatataattaagaacaaagaaaataagtctatgaatttcagagacatacaaaaattaaaggggattgagaagaatggaatagagcaaccataaaggagagacaggctgagcggtggctcatgcctgtaatctcagcactttgggaggctgtggagggtggatcacctgaggttaggagtttgagaccagcctggccaagatggtagaaaccccatctctactaaaaatacaaaaaattagctgggtgcggtggtgtgtgcctgtaatcccagctactcaggaggctgaggcaggagaattgcttgaacctggaaggcagaggttgcagtgagctgagatcatgccattgtactccaatctgggccacaagattgaaactccatctccaaaaaaaaaaaaaaagaagaagaagaagaagaacaaagacataaacagcagcataatagaaatcaagggagctcgtgtctctaaaggtggagaaagacattaaagaagacagtattagccaatggtatgaaacacttgttgcaaacatgctcattggatttggctagtgacaagtcagtgattaccttgagaagaacagttgtattctttattgttatttacatacatatctgtcttccctacctaatggtaaacttcttttgcagtcaatgagtaaacattctgaggggtgggaagggagttctgaaatatgtaatttctgactcaaagagctcacaatttaatggaaagacaagtaaaaagatgataggagaaagtgagagttgctgatggaagtctaaacaatattaggggagccctcaggagggatatctaacctctcaaccaagtaagcactcaataaaagtttattagcacaaaatacatgctgggacaaaaacaagtggtatcattagaaggtgcacagaaacaggagcatctaatgtgagcgggtgtgttggtgagattttgttgagggaagcaacttcttgtctgtttttttatatgctcgtatttttcagggtttcatcataagcacactagcctcctgtggctctacacagacacctaggactatttcatcccacttcagtaattttagcttttgggccactaactccccagtttatgtttctggccttccctggacaccagatctatttctccagctgctgtttggatatttcccccatatatctcacacatacctcatattaacaaggcccaaactggactctgtatccaacttcatattctgaatttctactcctaaactcattatgcacctattcactagatacctaaaagctgtcctagattcctccccctctcttattcctcattgtttgcagtttatttgtaatgtcttttatctgccatgtgcatttatgctgccactgtggtagttcagactgttgttccctcttatttgcattattgaaatgagccagactgcctgccttagatccccctgtcctctagtgcaccctgcacagcatgcccaatctcacctttctatctcctttaagcccaagtcctgcttcagtcatggatgatccatggtaaggatgggttatgatctaagcacttagcaggtcatgaaacatcttctttacctgttttcaatctaggcctattcagcaatatttaacagaatctaaatttttcattctttgtgccacacagtggtccaggtgctaggatgcaagcacccttgctctgatgggactgccattctactgcagactacaacaacggaatggaaggttgaggatctagtgagtgtctgaaagaaggacctggagggatggaactgtgtaactgtgcatctggtttggtctgggtgctgtggtggtatcattgaggcttctcaaaggaagctgtgctgaggctgaggcatcaagaatgaggagtcagccaggcaaagttgtaggggagcagggcatgtgccaagatcccaagtggaagagagtgtgagatggggaagcggggccaaggctgagagaggagactggtgctcagcaggggccagatcatgttggcttgggcatgttactgaaatgccaggggtttggtctaggtcctgttgcttgctacacagaaagccaaccaccaagacaacgaatgaagccaacaaagacggctttattcaggtgtcatcagcccaggagacagatcagtcttaaattcatctttccccaatcaactaaaattgggggtttctacagtggaaaatgaatgtagctacatgcaggaaaataggaattaaggcaggtaagggagcagtcctgctgaatgaggggtctggcatctcattgtctgcatgtggtgacctggtgagtttcagttcctcgacattatctgggaggcctgagggtcagtttcctgagaaaggaactcagataaaacaaatgtcagtttcaagctttaagactgggagcattaatttccatgttaattaaaaaatacataaacataaattctatagggaaattgggccagtttcagggggactgccctaaagaatttggactttctcttatgggttgcatcacacatctgaagagttttcagtagggacatgatcaatctgtgttttaagtacaggatgctaagggttgtgagaggaatggattggatgagtccaaaagttaaggaaagaaaagcagtcaccctgctgttcccctgaccccctcccctgcacctgccatacccagcacagcgcctgacacacatgtagagtaaattaatatgtacatatccactacaagagatggacgcgctaggcataacagatgtctgtatctgaaatgtgggttgttcttttatatcgcctgccactgtgcagttccctctacctgaaatttcagctcttctctgtaggtgctggaaaactcccgtccattcattaagatgctactcaaatcccacctacacaccttatcttctctaatccttagagcagccatatgaggcaaatgttttatctccactttacagttgaggaagtggctcagaaagattaaggacttgcccagtgacacatagtggtgtcttgggatttacagctgggtcttgtcgtcttcatacttgctttacccgccactcttcaaggttcctggaagcatgagtgattaaggaggaatcattgccagttcggtgtcattgctgccagccccctctgaggcacacctggctccctgggagtgtgtttatgctctgccaggactctccccagcctgcattctgaagcatctccttccttgctctgccacatccccgcccctctagatggagggaaacactcctgtaaatgggaattcacccaatagttcatccaaacatatcactggcttcctacctttctctccttcccagcctggacaacccatagcctccatgatcaatcactttatgaacatggtcagcttcaccatggcctctcctgggctggctgctaggctggcctaacagctgcagctggactctaccctgggcattttaaaacactgttacctctgtttctttgatattctctgaggtctaaagtcagcatacatcacttctcctgcttgtttgggttctgtatgtaggggcttgacagccagagtggctttgcagaaactcatgcccctggcccacccagcctctcgccctgcctggagggcagattacccctcagtgtgcttctgctaggaatggccatactgcatcattcctgttcctctgtctatgacttctgcaggatgactctggctttttctgggtacgtgcggaacactgggccaggctaataagtttagaagaagatttaagactccagatcaaggcacaggatcacattgtctcagtaatcgtgacttgaaaggaccctcgatgggcctcagctaagagctggcatggtggtggtgagcatgcgggcagtgggtttgcaggcatagcacaggctgtggctggataaaaaggtgttcacaccatcattgacaaattttctgaaccatgtggaacacttgtaatgatctgaactgtgtttctctccattttcttttcctttttatcttttcgctctctttcttttttcttcctggaatgcagctgtcacaataattggaagatgcccttgaaaaagtgctctcgagcctgtgattccctggcagcttcatttttcatctttccaatgaaggtggcatttgcccagaccctgttagctatgaggctgcctgtagaaccttcaactaccattgtgtgtggtgaatagtactggggttttggcatttcagtgctttgaactgctgaagaaccctaaagccaggctcatatgcacctctcctccctctctcccacctccccttgcttcctttccgcccctcccctcactccctggttcttccaccccaggacccacctttgctcaaggcaacccctcccaccccatggtgttcccctcctctttcctggaggccttgtaaatgtacagaccatttagactttaagacagtggggccacttttcatctcaggccaggctgctgcctggttttacggggtcataaaagtcctgacaggagtcataaaagcctccaattgcactgcagaaacccttggagtatattttaagggcccctgagttttcattttgctgcttttatggggactcgtaaaagctgcgtggagtgagcccactgattggctgctcagcacggaggtagttaaaattacagctttagacaaattgttccagtcccaataaatcagtatccggcatgtggcagggggaaggcttctagctctgctgcatcctgggccccccttgtcctaccacacaggcaaggctctgcttggggccaccctggccagccctccaccatttcctgaagccattctttgcaaaggggatagtacttaaccagctgtttttatgcattttaccacgtagctggttgacttttttttaaatttccaaaaacctgatctttaaaaccagattgacttatttttcaattcaattgttagagagacacaatctcatactccgtcggtcaccctggccacaggtactacagactacagcctgctttctccccattggtccccacatcccatctccctatacatggccttcttgccttaccttctttctactgttgccttggtatatctgttatacccctacagtgggccagtgcagggcaagaatgatcggtggggatgccattctcaggacccatcctaatttcccactggttatgcctggcagagaaccataccagcgtgggtattatgggagactgctgtgttttgtgccatttcaactttttaggagcttgtggctcaaatatatcaccagtctggcggatttccaagacactgattggagaagcagacattgttttctcttcccttctttccagatccagaatcactcagccccagctgaactgccatgctgacaacctgaggatcaagcatactcttcatttgtgatgtggaagtttaaccattaccatcgtgtgtgctcttccttcgcaggtggagaaagctttcaggagaggctctgagggtgcagaagcaaggaggggtccctgcaatgtgctactcctgtttgtgtgtccgcctctgttcccatggcaaccacctctttcccttgctatttctaaaaagcacgtgtgcttgtgggagtaccattctgaaaaaaatgatgcttactcctccctttctggatcttagccaagtcaataattcaagcagcacgaggtatcttagtacttgagcaatgcccgactgatgtcaactgttaggagagccaactgaagtagggagaacagtttggggtaagaaaggaagaaaagaaggtactgtcaagctgtgggttaggagaaggcattagcctgagaaataagaccaagatacatgtgaggaagactccaccaccattagttcactttcagagtcatggctggtagatgctcccttccttccagagcagggaggaaaagggacgcagtctttgctgcaaatttcctgcataagttagtggagaaaacaggttctcttctgacatatgcctctgttttgaagagccttgttcttttcttaaataaatgaaccaatcacaaaggttacaggctatgtgagagaaaaacacatcttatttctgtcttgctctagttttatataattattatatcaactgtggctgatcaaagcattcattaaagagaaactatctctcccatgcttttgttacagtttggagagatttgacaggctttatacatctctggctatatttccctttctctttttcacggttgatttcgctcttcttcctctcctcctccccttcctgcgtactagtgatttctaacatgactttttttcttttctttttcttttttccccttccacctagcctaatcaaatctctcataagacatcaagggaaccctgaaccaaagcaactcttggagttatatcggtacattcaggtgagcacaggctgacttcctgcctcagagcagccctcagcccacctggaagccaggcaaggcttctactgcacacactcccagacagtccctgcctttcccattgtctttctcaagggctctgatttctaggctgagcttactgccctgttccaatagcctcctcccaaagataggcacatatctgacactcctttgtcaatccttgggggagttctgtggccagcaaaagatttccatatcatcaactccttgtctctttgcaaacgctcatctttcaatgtggtttttgctactccttctttcattatcctcatgctattcttcctgaggaggttgtttcagtttatttaccataagcatgttcccaaggggatttcagccatgcaaatgaattacggaggatatgacttcaatgtgcaaagcatttggggtgaatgtgtacaagtacatttttcatattatgtgcccctctatcccattgtgtggcatgattttatctcactctgttctggactaatgacagactccttcagacatttataaaagtctgctttgatcgttcctctatatttcatcttgcatttatttgttcactccctcaacacacaaagcatagactatgtgctgagtaccatgctggtaccaggggacatggagataaataagaaatagtctctgtcatcttggaattcataaacaaatagaacaggaaaaaatgtaatcaattacttactaaacactgtggaatatgcaatgatatatcaggaggaagtaagggtaagaaatgactttttactggcgtttatcttacctggatttttctcaggaggaaagaataaggaaagggcattccaggtagataaagcgaagtaggaaattcccagaaacatagaacagcgtggtatgtgtgtagcattcatagtcatctgccaaagaagaataggtgggaaaggtcttgagcagaaaagagtctgaagaggaatccaggaagcatattgtgaggagcgtttgttttgcaggttgcaaaacatgagtttgaggttgctaaagaaaaaaagcggcattgtatgattccatatcaaagtagggcattgtggtccctttaagtttagcaaatactgaatgcctgctgtgtacaagagtatactgggtgtagaagaaatacaaagatgatgcaaagatggtatcttagtaccactttttaaggataagaaattttcttgtatacatagggcataaacatatataaaggctgatttatagtaagctgttgtgtgaggccattctggcattactataaagatatacctgaaattggataatgtataaagaaaagaggtttaattggctcctgtttcttcaggctgtacaggaagcaaagcatggcaccggcatctgcttggcttctggggaggcctcaggaagctttcaaccatggcaaaaggtaaaggggaagcaagtatctccacatggtgagagaggaagcaggagagagagggtggggaggaggtaccataccccaacaacagatctcatgaggacagcccgaagctctgagggatctccccccattacccaaacatctcccaccaggccctatgccaaacactggggattgtaattcagcataagatttggcagggacatgtattcaaactatatcatgcatatacacacagacaggcacacacacacacacacacacacatacacacaatcggtcaacagtgtaaaatgagatgacaaaaccatacttgagcaattgccaaatgatattaaggacaaacaatgatggatgtagaggagagtgtaattagacaggtatggatggccaaggaaagctgcagagaggaggcgaatgagtggataaggagaatgggtaagatatggagaggtgaagcctcatgtgtagaaaaacttgaataaaagcaatggcagggacagccaaagaggaatcagaatcagttaatgaattaggctcacaggggtggagagttgatgctgtccatggcaaccggggctggaaattatgctgcctgaagagggtggaggctcttcaaatgtccgattaaaggtattggacttttctccattggcaacagagagtcactgaaggttttgaatagggaagtgacttggtatttggctggacttgtcttgtgagctatttgtggcagctttactgtacaaaagcgatgaaatttaataattatttagttatttggaacattaatatgctggtgtatcatatattttaataagaattcagaaatgggagttttctaataagcaactgagttgggaaggtaacagaaggggaaattttggttgaataggataagaatgagaattttgagtgtcagtgatcaacaattaaccctacgtctcaattcatcataagcaaatacaattactactctgcaaatactatgtagaagaatgaaatgatgtgttggtgtctgtcccccaaattggaggcttctggccattgcttgaataactttctgcctctagtatccccaaacttatgttttgttttttctttttctcttagtatccatgcttctcctgaatcattcctctcgttaggaatgtcagtctactaaattttgtggcaatacaatgcctgggtttgaattcaagttctgccacttccttactctgtctctttatcaataaactcattgggaaaagtggaggaaatcatagtaacgatttattaaagttgaagattgagttttatacatttaaagtcctagaacaaagcctgcacatagcaagctcttagccaatgttagcagccattattactgtttactgttaataacagaaattactattaaaaaagaggaaacaggaaaaacctttgtcttcaagaagcttttactgtccgcctgtcaaagttcctgagcagcagctgatttctggcttagaagttagggttaggaaagtaactagtgagcgcactaaacagtaagatgcgctgccacagttgtgtgtgtaattgacttttatagtcaattctgcttatatttcctccttcaccctaatgctagcccggttctgagccagagttatttcgctctgccagtggtgcacttcagaaacacctggaggcttgttgaatccggattcctccacccacacccttagagtttttttttcttttttttttttgacaggttatttgttgcccaggttggagtgcagtgacgcaatcacagcttactgcagcctcaacctcctgggctcaaatgatcctcacacctcagcctccctagtagctgggaccacaggtgtgcaccactatgtctggctaatttttaaattttatgtagagacagactgtccttatatttcccaggctgctcttgagttcctgggctcaagcgatccttctggctcagacctccaatgtgctgggattataagcattagccactgcgcctggcccatgatttgcatttttaacaagttcctgggtaaaactgatccttgtggtctggggaccacactttgagaatgtgctttcagctcagctctgttgttcactcaagaagaaaaggcttttcctggtaggtctgtctgtagctcaatcacatgtcccacatggagcccactctttcccatggtacaaaaccctccttaattgcctccttggaatctacacagagaaatccctgagctttactttttctggacctgccacttacagaaccagcttcattgagatgttgtttaaaattgatttctcacctagccacacagattatctaaaaggtcaagattctcatgtagacttctttttgaacattctttagccactcgatggcccagagccccatcctcattgttcaggtttcatcgtctccttaatcaaccattagcataatgtattagcatatctatagcacaattatattttgattgctgtggtcccagtcagactaaaggctgccttcaacctagatataaataatttagaatgtttataccaaagggaattataggggagggaagggaagaaaggaaagagaatatttgtgtgtgtcaggggaatgaggggggcattgggagagtaaagatggtggcaaaaggtaacttaggttgccactttttaccacaacacttttctaggctattctcaataagaaaatgtgaattatatatattcaaaatacagataccattttgaattgctttaaatccactcctgcctttaatctcattacatctgtcaaaatatgtctcatttactaagtaaaaagtagaagctggtttccagcacctctttctttattatagcctgatccctgtgcaaatgcattttcctgtggttcatctttgaaagatctctcttctcttgtctggttaacttcctcaatgaccattgatatctttgtgctactttattgtccacttggaaacctgatttccctttattagtgtcctctgtaataggttagcagaaatcttatatggttccaaagaagtttctctctctttctctctttctctctctctctctctctctctctctctcacacacacacacacacacaacacacacacacacacatagacacatacacaggtgcattgtatcagctggaacatcagcatatgtgtggtaggatcacaatcattcagagcttctgatgttcatggtacctaggggattgattcagctttcaaggagctgtggacagtaagattaaaagaactgctctccttggggacttttaagtaatgacattattggtagtcctttgagcagcatggagagatgtttgaaatatgaaattgctgacagttttaatagttgcatttagaatggatgatatttgcaaaaattgctacttctttaccttaccacgcagaatgacaacgggatgctaggactaagccaacttcagtattcttctgcaagtgatgtgaaaacgttatagttgatggctcaggatcagtgcagggatggtaaaggggcagaggatggcactatgaaatcatagtattgacacagctggtcattagattaagcctagtaagggagtctaaaaaaatatcactctccaggtcccatgcatggagattgtcattctgcacctctggggatggaatcccatcagctgagtgtgatagctggccagaattgagtagtttgggtttagatggtgtcagaaagactggagaataaatcttctcttgggtgatgaatatctacaaaaccttaggtaagacacattttctgagtctcagtttccttattctgtggacattgtctttactggatggtagacgacttgaaggcaggagctctgttttctctttgtcatcagctacttgcattgtggcagacagatagatagtaggaccctagttaaatggtttggaataaatgattgaatgagtgaaagatgaatgaatgaatgttggaaggaagggatatatgaatgatatctcatcaatttgttgtgtgtattaaatgaggtaattttatgtattactcctgacagatagtggggattctaagaagtttccatctcccttttccattttcatatcctaccatccaacatgctaattgtgtggtgttgttttcatatttctatctcttccttttctctttttgagagaggaaagaggtgctcagtccttattcctcccattttctgtttcacctgcatctgcccacagcagtttccttagcatacattattagctcacctagacttaacaaactacctttctaactcaaatccctcctgtttccctaaagaaaatgcttcttttttgttagaaaattttaaaacaacaataacctaggttttgaagaaataaaaggtaaagattttaaccacatttgcgtgtttcaattattagtgttttccctgtggcccattcatgtggataagagacatctctgcattattatcttgtcagaaatacagcccctttcccttcccctcatctgattaggcatgcttctctttggaagcctcatcccatttggctaatgcatcttgacaactcctttaataagagtgcttggtgttcgcattcaaggatgtgtaggagttgacagaaatctaccttgtaatctttccatggcttgaaaataaaacccagggagacctagcacccgcatctctcaactcaaaaatggcgagaaagcttgaggggagagggatggccattgatttaacagaaacagttttatttgtttgtggtttttttcccttccttctgtgtgaaaaagctagcagagggagggaaaatttgggaagcagaaaatgtttcaatctacataaaaaagaggaaaataataacccaacaatgagaagagccaagagaatatgagaaggcagcctctttttgaaatagattaaaggctttattgcaagaacatcgtaggacaaaggtgtctctgcaggactgggaacttcagcaaagcacataaaacctcattctcagacttaaagacagccctggaagaggcagtccacaaagcagtgtgtgcctaggcacctattctaaattcaggagagctctgcagtcatttcctttgggggtgaggcttatgaggctggtgtaatcagggatataactaggaatctcctccaaagaatgagtgtagaccaggtcaaacagaactattgtgatgcatttgtcctccacagtatcaggatctcaagccccttgtcctctgtggttatagaatagcctggggcaccactgtgggcctatggtgatcatgggtgccacttcctgagcacttcctgtggtaggattgtacttcctcctttgtggagaagaacattgactagtgctggccaatgagaggcagctacaaatgacgtgtgtcaccctgtgggtgggctaaacattttacttccagtgcgagaccctcctgggcactctctttcctctgtcatgacatccagtgactttcaagactgtgactgccccactgggggttcctgagtgaatggatgaaaaaagctcctccctgtcacacctgtgatggatgtctactgtgaatgagaaatagtcactgagactttcatgttgttgacgatttcggcataacctacttatcctgactgttacagagtctgatcttaatgcaaaacctagccaggaattgaaggcttttattcagtggccctttatttttgaaggtgaacattctacagggtagtttggataagtggcaataagggaatggtgctcattcatcccaggatcacttaagagcacaaataagaccgccagctgatgccaggctgcacagcaggacactaggtcactaggagagtcaggagggcataactcctgctgagcgttacgaagcacagcaacttgtgatttggggcctgtcaacagctatggactcagtaaacagccctgaaatgtgaggtttccaggcagatatttctgatgctctcttttgttgcagcctgctttgctttatttatgcaaagagtgtatccctgggggaaaaatcaagtcatatcataagtgcatcagagaagcttactatttaaagaaatctatggtgaatccttttgtgaaggaataatcatccacctgatttgcatttgctttgtgaattgtgtttgtgtatcaggttttatgagtttggggcacatcataattcagagcatcaaacatagagtccaacagagctggattttcatctcaggtcagctaaaacacaaagcttgcctttgtcctgggggacaaagtgaggggccaactgaggatgaattttttgcctagaaatctctgcaacttgagaatggaggtaaaaggtagatggtgagaataaccctggatggagttagagttgatataagggaggtcaaagaagggaagggctatgaggagtagaaaggaaaatgttaggtgggcgttgcttcgattttagaataagccttatactgtaacaaggaatttggggaaatacacctagtcctctgttcaggccccaaatgaagcaaggcaagagggggcacagtgtgactaagcagggaattggggttagctcttgactccactgtatggggatcatgacgtggtggactgttgtctaagacagatgagagaacaaacgctcactttacccctcgccacttatgggatgcatctctttggacaaggtttgcatttgtaaaattctattgtcctgactttaatctttctgagtcttggttttccatccatatgcttaaggtctttgtccctcctggcaggacttgtgtgaggatcaagagaccatgaatgtcaagtgcctaatatagctgacctcagataggactcaggaaattaaaactatcaatattgctgactatgtatttacttttttctaagattctgaatgttaaagcgttagtatagtgtggagtctatgacaggtttttatagatatttgtggaaagaatgaaccatctagtagcctaagaagtgtggggaatgaacaccagatgtgagtgctgaggggtttggagcctctgtctgtgaatcttatacctttcctccctggcattacaaatgctccccatttccccctgaaaacatgtctgtttcacagaatccacattgctcacaaagattaaaatcattttcaatgactccatggtttttgttttttttgtcctttctgtcttgccacatcaggttatctgaccgtttgatttcagcaactcaaagagctcttcatttttttcctttctttccttttttcttttccttttctttctttccttgttttcttttttttttttcctgttgtcagagccctaggagtttcttttccctttttaattaagagcgaatgaaggtaacaaaatgttttataactggagagaattcaccagcaggacaccaaggcagaaatccacatcctgaaagaaaggcaggcagacaccagatcagcgctgtggggaatgtgtcctgcacacactctgcttcccgctgactgatggtccagccctccctctgccatcagcctggaagctttacctctggcagaagtctccctgtcttttgttaggaaaagctacaattggaaacctgcttttctaaagcatttttaaacacacagtgtgctcccctgaaatacgcctgtgcctgcaagagtcctgtaagttaattcctgccacccagggaagtgtcctaattttccctgacttttactgacctactcctcattgtgtacctggctgtctttaagctgggggacagtttgagattggaacagcaaatttcatgggagagcctgtcagatgggtatgtatgtgccgatgtaaagccagattgagcctaagagaaagagtgtgagcagaagaaagggaataaaatcctactgcagacagtgatgtggaaagggatgtcgtttctggcactgacactgtgcctggtccagtgccctggctgtgccatcccggcagctctgaggctttctgacagtcctgagaatggagcacaagcccccagggacgtctttggagccctaattccggtgcactgctttcgtgcactctgttttgcacgccacacttggaagatggcattataagactgcttccaaggaaagcgtgcttttattaaactcctagaccaaattgcctccctgttgacctctttctttgtcatgagacgtgatgggttattacatttgtgattaaaaacatccgtcatcggtgtgttttgccttttcaattttgtaggaaggtgatcatgatgctggttctcagaggaacagaaggatggagaagagagaccatattttgtggtttaaggaacttgcccctcagagaaggttaccctttttttctgagttcactgctgaatgtgtggctcaaatggccgtggaaggtcactgagctgaccgaatacacgttatatcaattctgcacagcatgagtgaagaaaatggacagacaatttcttaagtcactagattgtagagatcaatacagataattttggaatttttagaaaatccaaacacttatcctcaccacggctgttcatgtaatacctcagcagcttcttgcttcatattagctttgatcttactctctatttggaactaagtgtttcagaaatgatttctccctcctataaaacatactgaacacagaactgagttcttcaaactcaacttatgtatgacaaagctatagccccagcttttagctcaccttggtaactccgatggtggagaagacaaggataaggatttcttttctctgaggctagactggtgaagttataggatgacagatacagtctaaaggtcagtccctggctgctcttcccagagaccctctgcctcataccttcccagcctctagtctccagtctgctcggacctctgctatacttctttgtgctagaagagtgatttggtcatgtctctcctctccttgagcaaaccttaatgaattttccctccaatggccagtcctgtcttatcttggcatttgaagctctttattaagtgaccatttctactgtctttttttttttcctccattctcttctgctaggctctaatatgaactctttacggcaactgatgctatcacagaaggacctcttgtacttgctccagtctggggacttggtcaggtgtctttctgtctccctgtaaagcgtttccactctgcatttttgcctatcacaattgtacagtttcctgaaggcacagctgtgtgctatctctcttaagaattccctgatggaagtatcatttattggtgccaagtgactgaggttatattcgcagctcttggacagggctcctagactccccttagtctcagttacttatctgtgtataaccactaagcacccttcatcttactcccataaaatgaaagtgacctgatatttacatgtcgatctcgtatgggcattatcacaatgtatgctctgtggcattgagttgttttcatacatgttaattataagcaccagcaagcatggaaccatttcttatatgattaatatcccttataacaattaggtctacaatttgtaaaatttgttccattaaatatgtgattgaagaactgaataaagtcacctctagtgaaaattctacttgatattgatactatgatttgaaaaataataaactgagaggggaactccttgacaacagtttactgcactgtttctaacatttaacttgaagtataaataaatggattttagcaaatcaacctctctttgaagttaactgaatgctaactgtgttctggaatgaaagggttcatgcatctctgttaagaaatggaaaacagataatggcagcggagtcaataaagtcagtgcctcatcttgaactgggtgagcggtccctaaacatttgttacgtagtttcttcagcagactgtttatgtctaatgtgttctttttttcttaaaagaaaaggatatttgcatttttgatttacaattttattacttactgtgtacctgacctttacaagcattatccaaattaattcttataacaattctatgacttagagttataatgcacattttaaagttgagaaaactaagggtgtaagtaagttggcctaggtcacacagctaagtgagctgtagagcaattattccaacccaagcccatctgattccaaaatttaggttctctctagtacctcaagtggtttctacatgtgctctacattttcctgcttcttggaatctgtgcatgctcattcctaagcttgtaataccttttccctattctgtatctcagaaggtgtccttctttattcccaatccctgttctctctcagtttggaagtaattgttcttttattgcaaattctcacagcacttagatttttatctcaaactctttaatgtaattaattgttttcatccatataatatagtcatgtgtacctttatgtaccacatcttcctttccacataggaagctccttgagggcagaagcgatgctctttgattcattttgtattcttcaagatggactagaacagcgtagtcaccttgtaaacctatgtggtggatagggtcggggaagaaaggaaaaagagggaaaaggaagagaggaagaaatcaaagaacgatagaagacagtatataattcagtgttaaattgtgtggttcagactaattataaattcctttaaaagaaatgcaattttattactttcaagaacataaagttaattaatggctaacaaaatgttatcaagtagctgtcttgtcattcccactgtaattaatcaatgcttttggaatgaaaaagtggacttaagcctagcccatctccagattattgagaattttaaattagcacagtctgaaataatgaggttatcgccaccccttggttaaacagacgtctgaagatgaaagcatatgatgataaagaagacgtataagaaatttctaaacatgttttttctctttagtggtactaataagggattccttaattgttaaagcgcatacaggaccttatttgccaaaaattgtagcacatttgcttagaattttgagttatttcttaattcctcttctcttgattaatttaatggctcattaattcattttttaaaaaagagaatctaaaaaggttatttagaacaagctaaatccatacacagtagtgaaggtgctgtagcccatcacagagtgggtgggaagaaggggctagaagaaggatctagaagtggtaggagaggatgcaggagccattcagaatacgcatcaggaagaggaagcactgctgagtagcctcaggtttctttcttaggtgacttttcggagaagattagggaatgtagagggatagagagatttgtgaggaagaatatggagttaattttggacttactgtgtttgggatgcttatgagatatctaattggaattgttcatggagcagttcacatacagatctgatgctcagaagtgagggttacttgaagataaccaattttcgaatcactgacatgtagtaaaggaagattttcacaaggggcagctgtgtgaagtcaacagagactagaacaaggaagggtaccatgaagattgaaggtaaggttcagaagaagttgaagaaattgttttgagaagtgatatccaaagaagtcagagaaccacttgaagagtggtgtcaagaaacctaaaagaaaagatttttaagaggggacctattaaataagaactgaaaagaagccgttaaatgttgtgcttagagagtcactgatgctggcagcttatcatcctagtggaaaggaagcctgactggagttggttgtgaaggaagaagtgagaaagtagcgatgtctgtcatagaccattctttaaagaaacatagcagttaaaagaggtagctagtggaggacttgggagaaacaaggagatttgggagtaaacagaatctagaaaagtggtggtaagatcagtcttgaacagggacagcaccaactcccctgctgagagaagagtggcatagtcctgaatgtttatgacttcaagatagatctgatgaagagttcagctcactatttcatttgtattagctttgtttaggcatattttatggaccataaaatttatccactttaagtgtacaattcaataatttttgtgttttttgttgatacatagtatttgttcatgtttatgtgatacatatgatattttgttacgtgtatagaatgtgtagtgatcaagttggggggtttaggatagccgtcacttgggtatttatcatttctgtgtgttgagaacatttcgagtggtatcttctagccatttcgaaatgtacagtacattgttgttaactatatttaccatacactgctattgaatattagaacttattcctatatcgtatgtccttattttttattcctatatccattagccaacctttcttcatacccttcctctccaccccttcacagccctcacatccttcggtaataatcattctactctctacctccgtgagatttttggctcccacatatgtgtgagaacctgtgatatttgtctttctgtgcctgacttatttcactgaacataatgacctccatgtcaaatgaaagacatgatttcatttgtttttatagctgaataatattctatctattctattttgtgtagatgccacattttctttatctattcatcagtcgatggacagttaggttggttccacatctttgctattgtgaacagtgctgcggtaaatgcgggtgcacagctatccctttgataaactggctttttctcctttgaataaatacccagtagtgggattgctggatcatatgatagttctatttttatttttctgataaatctttgtattgtttccatagtggtcgtactaatttacattcccaccagcagtatgtaagagttgccttttctctgctttctgcattattttttgtctttttgataataaccattctaacctgggtaagatgatatcttgttgtggttttgatttgcatttctcagatgatgagtgatgttgaccatttttttcatatacctgttaatcatttggatgtgttcttttgagaaatgtctattcagatcatttacccgctttttaagagaattacttgttttttttttttttttttttgctgttgagttaagttccttgtgtattctagattatttccttattggataaatagtttgcaaatactttctcccattccacaggtgtctcttcactctgttgattgtttctttggtagtgcagaagctttttggcttaatatggtcccatttgtctatttttgtttttgttgtctgtgcttttgagatcttagccatataattcttgtctagaccactgtcctggagtgtttcccccatgttttcttctagtagttttatagttttagttcttacatttaagtctttaatccattttgagatggttttttgatatgatgagtgatggggtctagtttcattcttctgcataggaatatccagtttttttcagcaccaattattgaacagtgtggtctttctccaatgtatgtttgtggcaactttgtcaaaaatcagttggccataaatgggtggatttatttctgagttctgtataatgctccattgaattatgtgtctgattttatgccaataccatgctgtttttgttactatagccttttaatatattttgagtccagtagcgtaatgcctctgctttgttctttttgctcaggattgccttggctattcaatatcttttttaaagttccatacaaattttaggatttttttttctatttctgtgaaaaatgccattggtgttttcgcagggattgcattgaatctgtagattgctttgggtagtatggtggttttaacagttttaattcatccaattcataggcatgggatacttttccatttgtttctgacatctttaacttttttttgtcagtgttttgtagttttccttgtagacgtcttttacctctgaagtaaaatttattcttagatattttattttattttattttattttattttattttatgcagctaatgtaagtgtgattgttttcttgatttcattttcagctagtgcattcctggtgtatagaaatgctactgatttttgtatgttgattttgtattatgcaactttactgaatttttaaatcagatctaataggttttttggtggcatctttaggtttttctaaatacaagatcatatcgtttgcaaagagggacagtttgacttcctccattccaatttagatgccttttatttctttctcttgcttgattgctctggctaggacttgcagcactatgttgaataggagtagtgaaagtgggtatcctagtcttgttccagttctgagaggaaaggctgtcagcttttctcattcagtatgatgttagatgtaggtttgtcatatatggtcttcgctgtgtttcttctctgcctgttgttgagagtttttttttttcacgcaagggtgttgaattttatcaaatgctttttctgcattattgaaatgatcatatggtttttgttctttgttttgttgatgtgatatattgcatttgttgatatcgtatgttgaacaatcaatgattttttaaagtgaatgtatagagttgtgtaagcatcaccacaacccagcttaggaacatttccatcaccccagaaagttcccttgtggctacccacagttaacctccatttctaaccccagccttaggcaaccactgatatgatttctgtatctataatccttttctggacacttatataaatagaatcatgcaatatgttgttttttgcatctgacttcttttcatgtttttcattttccttcttattgtgtaataatattctattataaaagtataacacattttgtttattaattcactagttgctagacatttaaatagcttccagatctgagttattatgaataatgctgctatgaacattcacctacatgtctttatgtgaacgtatgttttcatttacattgtggagatccctaggagtggaattgctaggtcatatattaagtttattttaactttgatagaaactgccaaccttttttccaaagtggttgtaacattttacatttccaccaacaatttatgagttttctgttttctctaaatccttaccaacacttgttactgtctttattttttattataaccattctagtggatatacaatgttatcttctagtggttttaatttgcattctgttaatgatgaatgactttgagaatcttttcacatgcttattactactcatgtatcttcttgtgtgaggtgtctattcaaatattttgattatttcttaattgagttgtttatcttcttatgttgtaagaatttttatatattctggacacaaatcctttattagctgtatgatttgcaaatatattttcccagtctctgagggcttttcttttcattttttaaatggtgggttttttttgaatcacaaaattttaattttgatgaaagtcagtttatcacttttttcttttacagatattttttactttgatatctaataattttacaatccaaagttatgaagatttttcttctacattttctcctagaaatatcacaatgttagttcatacatgtcgatctgctgtgtattttgggttttgtgtttgacatgaggaaagggtctacgctcattttattcacatggatgttcagtgtttctagattcatgtgttaaaaacagtctttttcctcactgagttgtcttaacacttttgacaaaattcagttgaccgtaaatgggattcatgactcttgatttgctcctgtgaatgggattaattttggaatctcaattttatgttattgatctaaatttctaactttgcatcaatatcacacattcttgattactgtaattttatagtaagtttgaaattggatagtgtaagtcctacaactttggttttcttttgttttagttttttctatatcttttgcatatctatatatagtttagaaacagactgtcaatttgtatcagcctgctgagattttaatagggattgcatttagtttatagatcaatttggagagaattgccatcatgatatattgagtctttaaatccatgaacatggaatgccttttcttttatttagatctgttttaatttcactacacagtattatgtagttttcagtgtaggcatttattgctgtttaatttttctcgatgccattgtgaatggaattatcttcatttcatgttcggcttgtttattgtcagtgtacagaaatacaatagacttttgtatgccaatgctctttcctgaaaccttgctaaattgtttactagttctaatagttttttgtgcactctttagaattttccatatccagagtgtatcacctgagaataaggacaattttatttctttattcaatccttttccttctttgtccctctctccctctgtctctctgtctctcttttcctccctctctcgtttcctgtctccctcccttccttcctgtcctttctccctccctcattcactgcctccttctctctttcttccttttgtcccatattgcatgggtagaacctctaatacagtgttgaaaagaagtgtcaaaattagacattcatgcctctttcttgatcatgggggaaaacatttagtctttcatcattgttgtatgatgttacttgtggatttttctaaggtaccttttgtaggattgaacctaatcctcttggttgagaaatttttattgttcattttaaatcatgaatgtgtgctaaatttttaaaaatgtttttctttgtcttttgagatgatcatgtggctttaaaaaatttattatatactatatttcattaattgatttttagatactaagtcaagctatcatttttgcaataagtcccacttagcatgggtgtatgatctgctttaaatattgttggattcagcttactaatgttttattaaagagttttgcatctatgtttatgagatatagtaatctgtatttttattccttatgtttttgggctttaatattggatgaccctagactcatgaaataagttgagaaattgtttgactttttctatattttggaagagtttgtgaagtattgacatgttttgtttttaaatatttggtagaattcacttccgaagtcacagaagcctggcttttctttgccgaagatttttcattgctaatttaaatgcttgatttagttttattcagattttctacttcttctggagtcatttttggaaatgtgtgtctttctaggaattttcacatttcatataaattatctaatttgtcggcataaggttgttaatagtatggtcttctaatctgttcatagtctgaaaacgtagagtctttactatttttcttctctctttttcctggttaatccaacaaaaaatgtgtcagttttatcaaggagcttacttcttgttttattgactttccctaatttttttgttttttttcattctcttatcattattatatcacttgttctgtttgatttgaatttagttttctattccagttttttagatgtaagcttaggttattggttgagatcttttgcctttttttaacatagacgtttacaggtataatgtcccttaagcaccgatttaactgcattccataaattttgaatatgtcaagttggttgatagtgttgctcaagacttgtggttctgttgtttcttgacagtggggtattgaaatctccaactttaaatggtgactagtctattttttctttcaattttgtcaggtttgcttgctgtattttgagattgtgcttttaggtatgcatacctatataagtattacatcctcctgatatatgaactcttttatcatactgaaatatcccagcttgtctttgaaatagttctagtcttaaagtttatttttttctggtattaaaaaaatttcctttccaatttacatgccttctttcttatggttactgtttgcatggtatatatattcatcctgttacttttaacctctttttagctttgaatctaacatgtagaaacctgagattattaaatattttagatttttagatagcttataagaaattggatcttactttttttatccaatctgacaatctttgcctttattttattttatttttgtttctatttatttggtttttttttcagggggtacatgtgcaggtttgttacaaagggatcttgcctgacgctgaggtttggaatatgattgaatctctcacctgcatagtgtgtatagtacctgacaggtagttattcaatcctgtactcctcccctccttatattcccccatgtctattattcccatctttatgtccatatttacccagtgtttaactcctgattataagtgagaataggcaatatttgattttcagtttttgtgttagttcacttagggcaatggcttccaactgcatctatgttgctgcaaaggatatgattgccttccttttttatggctgcgtagtattccatggtttatatgtaccacattttctttatccaatctaccactgatgggcacctgggctgattctgtgtctttaccattgtgaataacactaatatctgccttttcattgtgatatttatattattcatatttactggtacttatttttatgactggatttacatttgacattttgctatttgatttctgtgtgatttctctttttaagttcctctatttcttttacattgtcttattttgtattaaataaatatagataaatattatagtgtaccatttaattattgtattaatattttgtctatttgagttaatgtttagtggtaactctaatgagtatgctacacattttagcttatcacaatctactttagattgatagtaactaaattctggtaaaatgtggaaaatgtctgaatttatccctcatatttgaaaaaaaaggtttttctgaaaactaaatttccggttaatagtattttattttccttttggtacttgaatatatgttatcccattgccttggccttcattatttcagatgtgaggtcacagccatcttaaacttctcagtgttcccctataatttttttggatggctatcaattaatttttcttatatggttgttttatttttttctttggttccaaaagttggatgattatatgtcaaggtgtggctctttttgtagttatcctaccttggatttgtagagttttttagatatctagattagtgtttttaatcaaatttgggaagttttcactattattcattgagtgtattttttgcttcctctttgctctccttatgggattcccattattatatatgctggcactctgaggctttgtttatttttcttctgtcttttttcccctctttttccaactgggtaatttatatggatttatttctacattcatggattctttcttctgtcatctcgaatctgctgttgggtcctccagtgagattttaattttctcattgtactttttgtttccataatttgcatttggttctctttatacttttgtttcctttgttagactctctacatatggatttttttgttgtcatatattcctttaatttcaaaaacatggttttctttagttttttaaacatatttataagaatggcttgaaatttcagctggtaaattcaacatctggggacaatcagagagtttctattgcctactttgttttgtatgggtcacagtttcctctttccttgcatatctcatactttttttaagtgcacgttttagaaaatatattttagcaaatattcctagcctcacttttcccgcaaaggttgtattttgctgtttttttctgtttatgtctttccttgtttagcaaactggctaatctgtggactctgtcttctttgctatgcatgaacagtcactaatgtcttagggattttttgatgtttttaaattttctttaattttatatcctgttttaattttcaagtctctcttcccataggttgccccccaggactgagttgacatccaaggcttaaacagaagttgtgctcaaccatcttgagccagttagtccccttctgatagatttgtgtatgggtagtgaagcaccttcaaagtgcggaccatttccaatgtctcctgatatttgcttcctactgagtcctgtcatgtcctttctgctcaggtttccagcttcagtgtcaactaagaatataggcctgacttgagccctctccaggctatggtgtgtttgcatgcagatttgtacttgcctagccctgagcagaacctggggtagtcattggccctcccctctagcctttgagagaatgacttctaccaacagtgccactggctgtggtgtcactcaccattcaaagtaagtgagcctctgaaccagggcagagatgccactggtcctcaggtattaccctaccctggaggaacctccatgactgagctggggctggagtcagaataccacagagccccacagttcttaaccgaagttcagaagtttcacaagaacatatgcttctcagattgttaagatttcgttcaattaccactccactggaatggttgattttgtcaattttgctcgactttatgctctgttttcttggacagaatatttgacagtcttctttctttgccataacagaagtcactggtctttatttagcactgttctcagacatttatatttgtagctttgggtgatgtttcttcagagtccgcatgatattcgttatcacagctctctaaatttgtaagtacactcttagtcccacgtggccctgcaaaggacactacccactctttgcgagttcccttgtgctcaactaagagccctctaacacttaggtccctagatcctacctctgactgtgaagtaaattacaagttcatgtttgttgaatataataatgtcaaaagacagtccctaatccatgcttctcttgaattccctggttaaactcaggggaaacattccacagacagctttatccctgaagttgtcatgtggactagatacctgtaactgcatggaatcaagtacagcaggaggaatctaagaaaatgtgcactgtggtcctttaagatttgaaagatgcaattcaaaggctgttaagaccttcagctggtgataattggatttgtaagtcagtgcaacatgtgataaaaatgctcctgctggatgggatcccggttttcttctatccttcctattaatgtgataaatgttactgtctcagctgatagggccacgttggctaatcagattggaatcaagtttgagttcctcaggctggctccatgtgaagctcatgggaagatgttaaaaaaatactatagagaatacaaggaggacctgggtttgcagaggggaaaattttactttgattaggaggctttgcagcgtggggaagacacatttaccatagaccctagtcacgtgctgccgcctgggcatgttatatctcatgggggactgtgggacattatctccattgttactgggcacatgccatcgtggagcctggggagaaaacaacagcagctctccatgtgggttttggggcagagaggagccaaaataatgttggaaaattaaacctctcttaattaaagctgatggcaaacaaacacaagtaataatgcactacagctgggaagcacaagttcaatatgaagctgaacagctgtgaaattgagccttctggtcacagctgggcctgtgagaaggccagaaaccctggcaaaggtgttgaccctggctgcagggctggcggggctagggtgggcagccagagtggcttgctctcctggttgttttggagtttgcgcccgctccagtgtctagctctctttgcatttccagactccttctcaccaagagcacccctctgtccgataggattattcagggttcttctcgaagtgaacagcgttattgcaagcactagaattgaggggatagagggaagatatgctttgttgttgttgttggttttgttgttgttgttggttttgttgttggtggtggttttgttgttggtggtggttttgttgttgttggtggttttgttgttggtggtggtggttttgttgttgttgttgttgttgttgttgagatggagtctcactctgtcgcccaggctggagtgcagtggcgcgatctcggctcactgcaacctccacctcctgggttcaagcaattctcctgcctcagcctcccgagtagctgggactacaggtgtgtgccaccatgcccagctaatttttttgtatttttagtagagatggggtttcaccatgttagccaggaggtctcgatctcctgacctcgtgatccgcccacctcgggctccccaagtgctgggattacaggtgtgagctactgcacccagcattttttttttaatgtaataaatttcccacagagagggaaggaggatagggtatgtttgttttgtgtttttaaaattgtttgctctctgcatttccccaaagacatccaggctgtgcctttaccgtcagcttgtttctttggtcagtgtctgccactgtgttcctgacctacagacttgaaaggcttgtgcagttgtcctggccttcagtatctgaggggcactggttccaggatttccctccaatattaaaatctgcagatgctcaaaccccttacctaaaatcggaaattatttgtagaaaatctatgcatatccttctgtatacttttagtcaactatagattacttataatggctaatacaatgcaaatgctatataaatttttactgtattgttttggatttttttgttggttttgtttttgaatagtttcgatccccagttggttgaatctatgcatttggaacccgtggataaggagggccagtcatatagggcaaatgtgggactggcttctctctaaagagagggataaagtacacctcagatgcgcagatacagtctggctgcagttacactgggataggtatattccggactttccctgaagttgtcaacttctgactcagtcacattcttgacctctgagcatgtagctatcactttcacttgcatattagccttagtcctcttactcatttgtctgtcagatttagttgttctctgtggaggttaggaacacacaccgactacaggcactgagtgtcaggattgtcaggatggactagactatgctgtggaaacaaatacaccctgagatcctagtggcttcatgcgataaagtgaattactagtctccttattgcctggagtaggttgcacagacccacagaatgtctctccactgactggagactcctgtgtctgaattccttccctcgtgtggcaccagcaccttggagtcatgggattcagctacagaggggagagagagaggctagaaggctgagcagtggggtagcaggaaagattgagcaagatgtttcatgtccaggcctaggactggcctttctcttcatcttccattgtcatgtagtcattcacatgccgttgggctcacggtaagggaaattggagaaagaggtctgccatcctgtgtgcccagaatttggtgggcaggtggtcagtctgttctacattttagcagtctacccaattattgaagtcttagtgcctgggcttgaagggatctttggaagcaattttgtaattcttttatctgcacctaaaaccttagactagtgcttctcaaaatgtggtcctgggacttggcagtgagcatcacttgggaactagttagaaatgcacatactcgggccccatttctgacccattgtacgagaaattcttggggttgagtcaagggatccacttcaagcagccctctgatgctccctaaactttgagagccactgtcctagaccggcagttctcactccactgtgactacccactgggattgcctggggagctttggaatgttctgatagctgggtccatagccacagattcagaccgaattggccgggggtgtggcctgagctgaagatgagaagcattgccctagaatgattattgaggaatagcttttatcctgaagttctctgtgaaaatagatttcatatggctccattggcacttactaatcactcaaaggccatgggagcaattgattttcatgtcctaagcccttcccttccctttcaattggaagcaacctcccagctttgcataaagtacagacaaaatagagatttgggaacttagacatggaatcctgattctgtcactgactcatcacgtggccctgagtaagccaattaatttctctgtgtcgtgtgtctgtaaaacgggagtagtaacacttgcccacagatgttgccagcattatctaattaatgagcacagagtgtttgggaaatacaaagtactgtacaaatgctaatcattatgatgaatgcggtgcattttgcagatataaaagtgctgtgtatatgctcataattattataattattgctaataccgataatattcctactgctaatgtatttccctggcagtaagagcttagtgtattctttgggttaacatcttgccccgcatgatcaggaagtcttgctaagcagctgttaaatgcccctggctttccacctttcagaaaagtatcattcatcaggagtacaaatagtcacgtatgtaaaccatcctggggtccacttatatgagacatccctggctgtcaggtcactgccagatcatgttcaagaagctctttttaggttccagaggtacccagaatgtagagtcatctgctttttcttgtattttcatcagaggtattttttttccttctactggttttttatctacaatagctttgtcatctgctttcatatggtgctaaatgtgctgaagaaaattctagtgtgtgttggtgagtgttactaggttccaatgctgacaattcacagatattatctgcagcaattggtgttgagaacaagacaattatttttgctgtggttttgtttgttcagttttaacttgggttttgattggaggagaagtgttggggaaaggcaattgtttctctcttctcactttgcaagaagggaacggtattgaggattgtgggactggtttgaacaaagcaggcaggctagaaataaagagagcaaatagatgactttaggatgcagtcagcagttacaagaccattgtttctatcctcatgttccttctgtccttccgacacccatttcctggttattagatgtggacctctgtattttgtagaccttgtctacgctactgcttcctgaattattcatagcaaattgggcatgaaacttacaaaagaaactcatcctgagaattatcccaatttagtacaaggcttgaaaaacaaacaaaaagcagagtttactgactgtccataccatagatccctgatggtccaactcttgtctccatttcaaaagccctgatgatccttttccttttccccttttgtggccccacatgatatatgaaatttcaagtttctttgccttgggctggaactacaacaactgatgaatttgtgctgattgtcttatgctgatctgaatctctgattgatagaggaatccctgataaataaaaatggggaaataacgatcaatttatgtagatcagaatttcttaacgatatcattttcattttctctgaagaacatattttaacatttattgcaaggcaagtatcctggcaacaaattccctcaacttttgattgtctgagaaagtcttaatttctctttcacctttgacgaataattttgctggatacagaattctagattggtggttctttagttttaatactttaaatatttcactcgacgctcctcttcctgtatgcatggtttctgaagagaagtccaatgtaattcttatccttgcttctctattggtaagccctcttccccgaccctcagtttctcaagtttgcctgtctttgattttctgcagtttgaataagatatgcctaggtgtagttttttggtattttgattagtgttctctgagcatcctgaaactgttgtttggtttctgtcataaatttttggaaattctcagtcattattgcttcaaacattttttctgcttctttctcccatctacgtctagtaatcccattgcatgtatattacacttccttttgtagttggatattctgttccatttttttcagtttttctcttcaaatttcaggtttggaagattctattgatattcttcaggttcactggtttttccttggccatatccagtctattgatccatggcattcttcatttctgttgatttttttttttatttctaccatcttcttttgaattcttttttacagttttcattttctgcttacattccccatttgtccttgcaagttgtctgctttttccattagaactcttagcatattattcatagttactttaaatcctcaatctgataattccaacatctctgcgatatctgagcctgttctgatgcttactctgtttcttccagctggttttttttttttttttcgtcttatagtatgctggtggtacttttatctttaaagccagacatgatatactggggtaaaagaaactggagtaaatagatttttagtttaaagttttatgtttctggctagggatcaagctgtaattattgcttgttgtaactgtgtcagaggttaaagtttcctctggtgttcttgtttttgatttccctgttgtccctagaaatttattttcaaataccatctgagatacagaattctttcatttccattcccctcttgttatgatgagctactcctatggatgtgaccatgggtgtggggggagggaaatcttctatagagccatgagtaggcctcagtattttactaagcctgtgcccctgcgccgtgagcttcacaagtgtgtctcagggttgcttttcttcccccgctcaggtgagacaggaagtgtagaaggggctgcagttgggtattttcccttccctgcatcattaggctctggtaatataatttctattgagggcaggccttcataagaacaggatgcatgtgtcatatttcaaaatggctgcctttgctctccccctgctggatgcatgaggggatttttctttgatccttactgtgagaacctcctagggctcttgaacctcctagggctcctattgaagtgtggagtctcccaaagtctggagctctcatgttttgacccctaagacttgtgcacactgaacctccagcaactcatcagttccattttagtttttctatcctgatactggctcccgtagagggttgtatggttggttggtgtgggtttttttttttgttttgttttgtttttttgctactgggcttctgctcttataagttgtgattctctgtatccacctgtcttttccaatttaggggcagtgttttgctctgtgacatctctgaggatctcttttttttatttttattctttaagttttagggtacatgtgcacaatgtgcaggttagttacatatgtatacatgtgccatgttggtgtgctgcacccagtaactcgtcatttaacattagttatatctcctaaagctatccctcccccctccccccaccccacaacaggccccggtgtgtgatgttccccttcctgtgtccatgtgttctcattgttcagttcccacctatgagtgagaacatgcggtgtttggttttttgtccttgcgatagtttgctgagaatgatggtttccagcttcatccaagagttgttgactttcggtttggtcagctttttccttttcatgtgaaaagcatgatgatgatgactccagcctgtttaggtgctttaatggaagctggaaggtgtttgctccaataattatcacttaacaaattcagtccacatagtccatcagtcaaaaaataatcatatgggcctttagttgtgaaaaagtgggaaatagagtgaacatcggcttatagttactactatttgttcttattaatggacttttttgaaggaaaaataagaaaagcatataagggagggagtggaggaggtagtcagagacgaggagtgggtataaagtcatttctgcctgttattcatgaggaaagaattatcaggaccttcattaccagtcctcgtgtttacatagggcaggcttatttaggaggcatcagcagtgttccacatgaatgaatttgtcatataactaagctatcatcctttaaatggaacttaaaacattgcaatcctttttgatagagttctttttctaaaatatattattgttttgtcttattgagcaaaacatggagattatcatttgtcttattttgttactcaggtcattattgaaaacatcagtcacagagtgactctgttgtaatgtggagtaggtaactgaggccatctacacctaaacacactccctgtctggcttcataatgcctagcttagttacccctctcctcaaacactcctaaaacccctaccccacctactccacctaaaataaaattaaatttattaattactattttatttgtgtctaagctagtccaattatctcctaaaatcatctcgtatatcactttgtgatatacatacaacaattaggaaacccaaaccaaaacactgtgctgtaggatagggagaatggagcctattatttaattactcaccagactttatgcatgaaaatcgttttctggcctataggctaaaaagtaaatacatgcataatatgtcatttgtactgtggtgtactatggagaaaaataaaccatggccaggggcttaaatgggactagagatagaggtggtcttggaagccctctttgttaagataatatttaagtagagatctgaaggaagtgaagagggaagccatttggatattgtggagttggaagagggaacctcatatgccaaagccctgtggcaggagtatgctttggatcaggaaacttaagaagaagatatgattctgagaaagggaacaaaagcaggagtgagagtgagaaagggagaagaagcaggagatgagagcagagagatagtgggaagctagatcactgaattagtcagctagtgccacaatagtgctgcataaaactcatgggcttacaaaatagcattttttctcactttggacttgtaggttcgctgggaggactatagactgaaaattgggctcaggcttcttccacatatgttcattctggggcccagactgaggagccagcagctactcacccagacctggttgatggaacaccagggcgcaaaatgacaagctagccactcatgcacattgcaagcctcaatcctgtctacaaacatcgtgcaggccaaagcaaggcacagagccaagctccaaacacagtggtgggaaagtataccctgccaacagtaggaggggaaaagatatgtgaccagttattcaatctaccacacaaaccagaaagagtgtggtttttgacttttactcttagtgtgaacatctttaacttttactctttttgtaaagggaagtcattaagtcatattgatctgacaagtgacttgttcttttattttcaaagagtaactctgggaccatgagaatagactccaagggtcaagttggaggcaagaagaccagtaaggagactgttgccgtattccagatgagaggggatagtggctttgaccatggtgtaggagtggggatggtatgaaatagtcatcttctggatttgtttttcaggtagagtttcgagaattggttggtagattgggtgttggtatgagataaagagatgggtcaaggaggtcttcaaggtttttgggtggaatgatgagtagggaagactggatgaagttcaagtttgaaggttgagggcagggaatctggagttctactttcatcattaaggcttgagatacctcttaggctttgcgtacagataccaagtagtcagttgtatacatgaatctagtgctcaggacagaggtgcaggctggagacagggttgaatgaaaattgataatagacttagacatgtcttggatgttgaaaataatattttactcagtgagagagcatgatttatataatctcttatgtgtgaaagtctttaaatcttcttgttctcatctagtttttccctccaaaatgacatgctcaaaggccctcccactcattaatctttctccttctctatctctgtgtttcatttttaattggcatttttgaagactagtctttctttatttttattaatttattgatcaactgaagtctgtattatgactgctgaggttattaaaactgttctgaccaaagttctcacactctgcacacatcccaagtggactctatgctgctgactccaccactccatccctccgccactgaccatgcatccactactgtgttcaagccattccaccgcctgtctcttctgaagccctctcccactttggcttctgcaactctgctctcctggtcttgttttcttcctgctgttctgtgatgctctggctttgtctccttgtgcatgctttctctcctgtgctaaccccttatatgttggttctgtccttgacttgaagctcttagcccactctgtgggaagtctcatccattccttggattttcactgctgtttgggtataggagctgcacacttcattgtctctgaccctggcccctcccttgaatgtagtgaaagtatttccaactacatgtaggatatatccaagtcaatgttcagtgatacctcaatttcaacatatccaaaatgaaacatcctctggtgattggggaggtaagagccatcgctcttcctctgtgtcttagtgactaggaccttcttgtaggtgtcatactcaccaatccctactccaacatctgttcagctctgaattgtcttataatgctctagagtgggaagtcctccaagtcaccccttcaagttttcatttactcatactttaagatatctgattcaatcggtatctcctctaagaaggctcctctgggtttgtaactaggatacagcattcttccttggtattctgccaacattttattcacatctcatcatattatgttgatgttatgtgtatatatttttccctaacatcctaagttaaacttctccagggaagaatgctgtatttatcatctcaagtacctagatcagtgtctaacatttagtaggattttagtaaacatttttgagcttgacagaaaggattaatttggattaatgaacccaaccaaaggtaagtaaaggctcagatacagccatatatgcctggtcttctaaacctcatagctttacctctgggattcatagtaatgttgatccatgcaaaagctttttctttgtgcccactatacacagataatgagagcacgctcatggctgcgggcaagtagcactgcatgattgacatgagttctgacaactcctccgaaagagaaagtagcccaatcatccccagctagatgatgagtgtgtctcatgttattttcaggcaatgtaaggttttatttttgtcatgcaccaaatggacttggtgtcaggccgtcaaatgtctggcaatctgcctagctgaagagataacatgagtggtgaatagaacattattgtgtgataatgatttccagcagctattgaagataaattccaatgcaaagtagaaagctttatttccaggggaggagatattgatcctgtggccactgtaaatagaatgagaattgcaggtgtagacagaagtccagtcttgtcacaaacattgagatctgactagcagaaggaactgcctcctgaaggcaaatgaaagcccacctgtttaggaattgctcgttgctccccctaatgctgtcactttcctgtaggaatgtaccatgtgaaccagatgcagcgtgagaagcatattaccaacacaattcttaaatgaaaaatcaaagacctctgcagatcagccataattggctgtggtatggtccctgggatctcgcttggttctttaagaaaaatgtttttatgagtcagagataaatccggagactggattacgggatttgttttatagacttaatggttgattgaaaaagaatctcatattctttatatacaatttgagattgatgatgtggttagtcttcattaggttttgacaaactggtcattacaacctgtctacttcatagaatattcagttttagaaagaccttaaagatcatctcatctaattcttttatttttcatgaaggagacagtgaccttaagatggtcttatagttaacttggacacttttttgaggcattatcaaaatacatgactttcttaaaccttactaggattgtgcattaatgcaaagctgttttctttgggatagcacttatttcagaatgagaaaaatcttcccagagaccttgcaaatgcttcaaggtctgggaattctaactctctcttgtttcacaggctagtgcacatagtttatattccttctgtggataaatgtagactatctggtgctctcatctctttcctgcctgcccagagatcacctgctagtaggcactacccgtcctggattgcctcaccacgatttgcttcacccgtctcaggggtgtcctgaacttcagtgtgacaaacttcaggatgtatgttaagtgcatctgtgcacctcttagtgaaggacatttgcaggatgttggagatctgtggctggaagattagcaggtcagaagctagctcaagtgggcaactggatagtggcagatgggtttacattcaatccagatgaaatcccagagggcatttgggttaaccctcagcaatggctggatggtaactctgtcgtgtttctccacctttgacacctagttttgccatcagatggttgtgagtttagggacaaaggaacctggagagaggagtagactttctttttctctcctcagagtctcagagaaatgacctccctgctcctgcaatggactatgccccactttaactgtgccgaggctggatgctttgccaaaggctttccttgtttgttccattgatgaccacagttctccagatcttgacctagttgctaaatccctgtgctgatcaaaaatgttcccactactgagggcagatgatatacattcatgatacaagcacataaactccagagggatagtgccaataggagcatatttctggtctcctagcatcttgattattcagttttaaacttgtttatgctcatatttctgatgtttttcttcccatggttttcattaacaaaaaataatctgttttgctgttgtttgctttgagtaactgagaggactgtggactgagagaaatttaaaatgttcctttctaaaaaaccgtacatgaacttgatattcaggctctcctagatgttcattttaatctataagaagctgtgtttatgattctgtcataccagagtgagtcccctcttttctctacttccatagctcttgttgtctgtaccagtcattggcaattaattatatactgccttgtggcatgataatttcagtttgtgtgtctttatatcattgatgtaagtggactcggatccttgagggagagaattgagtgtcatgcttctttgtttcctctctaacaccgagcagaatgctatatgcatagtcggctgtcaaacaatatttgctgaatgatccaccacacagaatttcttaatgcctctgcataatggtcccagagataatgttgcataaaaagagacaatattcttcccagtattaaaatattcggtgaaatgccacaatagtgatgtttcaaaggtctgcagattaaatgtttcagggaatgtaaattggctattgggctattggcatgtgtgtgtgtggcagtgggaggggtgtgtgtgtgtgtatgtgtgtgtgcccatgtacatgtgtaatgttcctgtgtgcgtgagccccattgctttcatcttgaattttggagccctctgtcagtccctctgattgaggaaggaggatgctggctgggtaatggatgtcttgctctagctggcaaggcagtaatgcttcaactggaaaatcattaaatcccagatttcagcctgtctctctgccacctctcatcagcagcaaatctgctttaacagctaagaattcccttatctctccgtgagtgtggaccatgtgctgctgctctctgtagatgggagatagagctgcatcattacgcgggggtgacaaggatgtaatttacaggctcaatcagttctagttaccatgtaattacagagttattacatggtcatttgttcctgatggacaccagtgatctcttatcctgttctactgtggtctgtttcttgtcttatgctactaaggatatttagtttcttctgcatggcgtgttaaatggtgtactagggaggaaggacagaaacgagttgggataagatgttgattatgctgtgatgctatttgttctcctcaattggcctggtgataataacagcatgctgtggctttcctcccctaggctccaagttcacattttcttcataagagagactggagacaatattgtacttggcagcatgggggaaattgggtgtaaggaatattctgacccattccactcagcgaggagatgacaatatcaaccccaagattatgtcactgcctcttgtaatttgaagctcatgttaatgcagtggctgttggagaaaaattcctttttataatgaaaaaggagagggaaccatttaagtgtgtaattcagtatcagggagaaatgatgagaaggttcagtaacctgcccaatgtcaccaagcgaatggtgtatctgggacacaaatgacagagcttggccccctccactctaactcatttcagtgaattcctgtcattaggaggcaacacacttttaatagcacaagtactggaaaccatgtggagaaatctgaatattccctcatatttgcttgaatgacctgggataagctcctttcttaactccttgtttttattaattaagaattgatgtgtgtgataccatgacacattctgaagatgtctaacataggtggattcctaatccttgggaaatggactgaagggccatgtgtcttgctattagaaagtgtggcatccatatggtgctgtgggtggtatcctggggtcagcactgaatgcacgtcaggagacctgagtcctgtctcagtgtttccactgagttgtgtgattcacagtctgctactctgcctgcttaggagtcagtttccttctccagatgctatagtttggatgtttgatctctgcaaacctctgctgaagtttgatccctgatgttggaggtagggcctaatagaaggtgtttggaccaccgggatggatccctcatgaatagattaatgcttcctcttggggggtgagtgagctcttgctctgttagttgctatgagatctgcttgtggaaaagagcctggtaagagagagggggagcccttctctctcttgcttcctctctcccctgtgatttctgcacatgccggctcccttcacctcagccatgaggggaagcagcctgaggccctcactgccacgcttcttgtgctgcctgcagtaccatgagccaaataaaccttttttcattataatccatcttgggtattcttttatagcaacactaaatggactgagacactggacaatagtcaaataggccagacaattgctgaagtcctctccagctgaccatcgtctgtgactccatgatttaagttgacctgcgagaagagtcagaaagcactgtggtatcattaaggctgaaaaacagaggtcatgggatgaggatattcagtgttgttatcagagaagcttcttcccactgggagccagaaaggtgcttgcatgccctctctgcatttcagttgatggaatgctgtgagtcattaacacgctctcctacttccctccaatgaaaacaccttgctgatttaattaaaatacatttttttcttcttttggatgtctttgaaaatggcactaattataacatagctgctatgtaactaatatgtgcaggtaatattgtgattatatatagacagccatatgctactatgcagccagtctcattgctgttaaactgctgaagcagataactccatgtccgtgcacacaaagtaattgcaccaaactaatttgtgtttgcaaacagatcctaaattaactatgtaaataggcagatctgcaaacaaaatattagaccgtgcatgtgtgcacacacatggggcagagaggaagtggtttttcacctgcttgaaagatgtcacaggactggggcttgcctgtggcatgtgttgccttgtgggcctcttggtcccacctagctcctgtcttgcattagtaagtctgagttattctgttccgacacaggtgactgaaggcaacctgaatttgttttctctaggggtaaagggttatcttgatcaatccacctttcttgatggtgctcgctgccctcatgcattctttgaccaaagatatttccaagacagctggccccggctgtgtgttgtatgtggagtggagatgttcttaatgcagagaagttcacgggtgtgattgaggacagtttggttcctcggcttgcaattgttagtgcccggaggagtgtgtgatcctttgagtctagcagggctgtttgaaatctggttccaccttgggcaagtcacatatcctttctaaggctcagtttccctgactgtaaagagggggtgagattggagtttcctcctggggctgtttagaggattaagtgagcaagtgtgcgtgtgtagcgtttagcacattggatccgtgttcagtcaacccttgctgctgttgctgcacttactgatgttgtcacccctggcagaccagcacgcttccctgtgggccctggcaacagtgtgctgactgcttgcatggatattccaggtgaggaggtcagcctcaaagaagaaagcccactttaatcaggcaagttgggccccaaaggacgtctcgcctgtctgccttcctcacgtccctgtgtccctccgtccctcctgcactcagcgtctccctctccttcagcgtggagcctgtggtctccacctccacaatgctctacttagacctctgctcttccatttcccaacatgcttcttgtgttgtaaaccttactctccccaggcttattctctcaagtcttgctccgtgtctgagtggttatttgagtgagggcaccagtcgggtacagcagccacactggtgtccatggggtgtttgtgccaggtaatccctctgtccagaacactctgcccagggagatgggtgaggcccggccctttgggctttgaggtctgtgctccaaccttgccttctccagcagcactgcctcccacccaattggaccgcagttggccccactcccactctccattcttcttaccctgtcctatttttcctttgtttcatagccaacctcaccttctaatattttgtgcgcttgacttatgtattgcttactgcctgttactccctgcttgcttgtaagttccttgaaagcagggccttttgttcattaatgtttgtcaaagatctcagcctgagtctgtgctaggaaggcccctcataattttttttttttttttttttttagaaagacagggtcttacaatgatgctcaggctggccttaaactcttaggctcaagcgattgctgtaattgtgaatctgtttcctgtctggattcttttgctttcactctcagaagccaacagacttcaatgggaaggacctgagggccaggaagaggagtggagaaaccttcgcagaggtggtcagaggacaagcaattcagggaccagatgaggctgggaacttaatgggcagagaggcccaaagggggcctgaactggaggaaacagaggcaggcaccaaggcaggtgtgtgggaataagacagcagcaggaatgtgcgagtcaactccatgctcatattgcagatgtaaccaagtgacttactttctctctctgcggcgcagtttccgcaccagtaaatcaccatgaaatctaccatattcacctcatcgagaatttgtgagcgtcaactaagataaccacctgaaagtcattcccaaagcagatattacttttttttttggagacagagtctcgctctgtcacccaggctggagtgcagtggcgtgatcttggctcactgcagcctctgcctcccaggttcaagcaattatcctgcctcagcctccctctggagtagctgggactacagatgcatgctaccacgtccagctaattttttgtgtttttattagagacgagatgggggtttcaccatgttgccccggctggtctcgaactctgagctcaggcagagttctgcctcccaaagtagtaggattccacccgcctctgcctcccaaagtagtaggattacagacgtgagccactttaaatattatagttgcttattattatttctgtttgtatctcagtttactagtctgggaaatgggccctagcaagaatggccattaactagaatggaggtaaagtgggaagtatgatggatatttctgaaggattctaagacaccattgaaagctgcatgcaccaagaaatggggcagtttgggtgacacatttcaggagaagagctttcactttcctcagcacacctgaaggcatttcttatttcattaacctaagattaggaacagccccatgacaaaaaatgttggcaatattgatatgaacaaataattaatcccaggtgctacctgctttctcccaggtccccctgtgatccttctccttatgctaaggggtcttgttcccactcccatccccaggcttagggagttgtggacaggacagtctattataacacttatagccattaaaatgtgagaacaaagcccgctctgctctcctgttttttaacctctttgctgaagcataacttctgtcaataggtgacctaattaacctgttcaagtcttgaggatttttatctgtgcatgttctttgatttcagattaggattctcaacatcagttcaccactagctagctatgtgaccatgaacaagttgcctgacactcaatgtccttattggtttaaaaaagggggtcatagctagctccacggtgttatgaagattaaattagttaatatttgcagaagtacctaagacaattcctggcatccagtagatgtccagtaaattttagttttgtcctttgttcctaaaataagcatgctggagtcttcaataccccacatttaaaaagaactgttgcagttacatttttctggattggaagctttctttgtgtgaaatacacgtatcacctgtacctttttgttatttttgctctgcctttttgtttgtgtgtgggtgtgtgtgtgtgagagagagagagagatagatagagagagagagagagagagagagagaaagtgagaagtggtttgttttggggatatcatttttgttcctttttgttgttgttttttaaatttgtaagcaaggtgatggaaaaaaccagaggagaagccaagtgtatctgaagacaagaatgtggaagtgaagaatgtttatgagactcactctaacatgctgatagcaaaggacttttgttcatcagattccctcacatgtattcagaattaaccttaagcacatttagtcagtcatacattttatttttgtctctgggcattaatgtgctgacttgtgggattattaaactataattccccaagatatatttctgtctctcagtgggtatgaacgtgcaatcattagcaaatccaatatttaggagtctttcttctctctccacggtaaatgggagcagaggaaggatcatggctgatgacagcatctgggtcagacagcccccagtactgctgagttgctgggcagtcctgaatgatagtggaatgactgtggcctttggaagcataagacatgaggcttgcttctggctctcacgtttactagcagtgtgactttcagcaagtcactgacccacactgaggcttagtttcctcataggtaaaatggggagaatacctgtcatattgagaaggtcaaataagtgtcatgtattagtatattaatgagctgtgaaacaatgactattgttatatgttgttagtggtgttgagttatcacttagatttccaacctgaggattgagtaccaggattgtaagctaattatcctgaaggcctggcattctattgaacttgttaaatttatgactgtgtattgttttaaatgagtaagcagtaggttgccacaatgtaatctcccttttatacttcaaattgcaggtgcatgtctacacgttttcctctagacccaaaatgaggaatgcatttgggtcagaatctagaggaggtgttttgctttgatcatagatgccaaatagcagcccctcgttcctgttctgtgagagctgtgccccatgtatcagtagaagaatggccccatttctagagcagctatggctactgggactggaaatgcccaagggatgtttatacttcctgctggtcaatcagatctttgtatgggctccagatgtgttgctgaagaggaaaaatttgaccaaacaaaaacaaaacaaaaagctgatgtgagcccaaccttttcaatgtcccagatgctgggattttccacagcatcactcttttcaatgagtgcctttaatgctatgctgaaatctccctggacacctccagtgaaaaggctctcgctgttgggcactgccattgtctgcctccaagaagacaaagagcctttgagcttagagctgggaacacaaaattgggtatgagatgggtcctgccatcagaagctcgcagacatcatggtcagaaatacctgttcacaatgttctgtcacagtcaagtattgtacagaccatataaggcagggtagaatagataggatacacaaagctagattacttttttaattaaacaattatttatgcaacatctgctatgacattgtatataatgtctgccatccccattacatcaaatctccataaagacagtatctcttgttcatcttatatccctggtttgtaggactctatctggtatatagttggtgcacaaaataaatattttagagccatatttcattttctgagcttattactgttgatttatgcctctgttacataagtggaagtatgaagaggccttgattaaagtggaatacattgtagaggcaggggcagttcttatgatgctgtagcataaaattgcaattgaggaatcctattccatcattctaatggccaagggatgggtagaagacattgctttttggtcgtagctgaggaatcctaggtttagtctcacattcttgctactgcttagctttggttagtctttctgcaagctcctacatggtcactaaggacctgagcttggttttaagatttgacctaattcttcatccttcaagcaatatgtgttctggttaatgagtttgtcagaagcaaaatgaacaattctaaccacctgtcccttaacaaaggccactttaacaaatgtgagccatgtgcatttcagctaagatgagggagggtgctttcagccaactgtcaagagctcatcaagccccttcctgcatcctctgtcactgtacaattattgaagtccagggagtagcaaagcaagagacctgggtgcacgttggccccacatggagccacagactctgactcagccagtttttacagattgttgatttgggttcagttatagtttctgcaagattggaaagtggtcacccgttatggctcttggccactgcttctgggtcatctcaagcacattattcaagtattctcttcagaatgagctggcagacgcaaacaagccacagcatcaggcttcatgggaagtctggggacttaccattgtcgagtagtatcaggtggtgtctggaggggagaggagagaggtaagattgaaaattcaaagaatacagagttttggtggtatgaaatatatcatctggaaaatgtcactttgtcctgagaaccattctcctggttaaagaaggcccaatcttgggataaatggcattactgccatctcagcattttaagaagacagacaccaactatgtgtgtgtgtgtgtgtgtgtgtgtgtgtgtgtgtatgggtatgtgtatgtgtgtgtatatatgtgtgtatgtgtgtatatgtgtatgggtatgtgtgtatgtgtgtgtatgtgtatgtgtttgtgtgtatgtgtgtatgtatatgtgtgtatgtgtatgtgtgtgtatatatgtgtgtgtgtatgtgcgtgtgtgtgtgtgtgtgcttatgtgcatgtgtatgtgtgtgtgttatcatttaaatgggtcttatgcactacctaccacaaggtcattctataacttgtggcacttcagtctcaataacctctgccaataacagggctcaagtgataataagtttgcctgtgtgactctttctttcatgcaaatataaggcatttgtatgttacggcttaccttttccctgcaatacctggaaatcagagtcagtgagacactgtgtgttttagagttgggaaatctgaggccaaaaagaaaaataaattgtagaattcagtagatgtgtctgttcaagaggaggacccctcttctgaatttcctcatccagtagcacctctttgtggatcttctcatgagtccatatattttcttatttccatgttcctgaggtggccgacaactgagggaagcaacaagctgccccattgctatcatgggtgtgataggaacgagcctccacattgggaccttcgccagtgcatgtcctctagtgacattttatccctgagctcccagtgcttttcccgagcacaactccatgggacactgcctagtggaagagaccacagcgggatgaaggaagaactagaaaatctagacgaaatggataaattcctggacacaggcaccctcccgagactgaaccaggaagaaattgaatccttgaatagaccaataacgagttctgaaattgagacagaaataaatagcctaccgaccaaaaaaagcctagcaccagacagattcacagctgatttccagaggtacaaagaagagatagtaccattcctattgaaaatattccaaaaaattgaaaagaaggggacttctccctaactcattatatgaggccagcattagcctgataccaaaatctggtagagatacaacaaaaaaagaaaatgtcaggccaatatccttgatgaacatcaatgcaaaaatcctcagtaacagcgttagtgtttcatatcaggctgtctgttgcgttctgtttattattgggatacagtgcttttgtgataagcagttacacatctctttgtacttgttaaagggttaagtgctggcagttctgggaggcaactgccatttaaaggaagtagaataaaagatgatgttgagaaggaagtgaaatggagaaggaagaggtcagaggaatgagggggagaagctgggagtaaaggagcctgcccttacaaatgtattggtaattaggctgtgctctttaaaaattaataacatttttcccattgattattctacatgtagagatatctgaagttattatttttgtgtattcccttatattcggcttcttttacaaacatactagtatggtcttccatgcaagtatttatttttcagacacaatatgaatggcaatttaatattctagttcatgattcatccaccattttcttaggtttaatccaaccagaaaggtacgggatatacttagctcccaaatatgagtacagctagatcagagacagggtttcctcaaagcacgtttctcagcatcagtcaatagcagcggggttgaggttttcctttctggactcttcctttttcccacggcacagcacgtgggacatggcagccatatatgtcggtgttcctggctgactttcttagagaccctggaactggtgacccttttctctgagctctttctgagcttcttccatctctggaaatctgtccgaggatctggagcagtgttgttttggatgggaaagtaaacaatgagtgaatactgctattctcgttctgcataggttgtgtgtaaaaatagagttgcttatataaagactccaaaatggaattttatctgtgcatttctgtgtcatcccttccccttttagactataaccatccaaactgtatgacctcgagtgagttactcaacatattcaagcctcaatttctgcaaaatggggataataatagtgcttacttcctaggatggtaatgaggattaaataagataagtaaagtaatatgcgtgaagtgctcagcacagactggaccagtgtgtgcacagctaatgctgacagttcatgctattttgtcattattgctatcatcctgagctcttccacaagacaaaccatattgtatttattttttgttgaaggcattcaatagatatttgttaaattgaactaactgttttaagtaaaaataaataagaaaaaggaaaagaaaaaaaaaaacccacccctttacataacaacacagcaattctactggccaatggggaaatcatacatctttactgctgtgagttattatactctctgaataaacataagcctttcatatgacctaatgattaatggcttatgcaaagaaattttaatgccattaataaaaaattaagcagcaagcttcccccacttttttgacagtgtcaggctttcacctgttctcctggggacaacaggtttccgggaacatgctgagtacagataatagatcattcccaggcgacactcccctgtgtgcctcatgtcttcctgggcagcatgtaggatggatacaaggcactctttagagaaaggcaaggggtctttgtggtgaggaacagagatcacagctgagcactggctttatctatctatctgtctgtctatctatctaactatctatctactgtttatctatctaccatatatctatcatctatttataaatcatcaatctatctgttatctatctatcacctggttattctctcatattgagtatttattctgtgtcaggaattacattaagatcttattcagtcctcatagcagccctaggaatttcaaagttaatctccgttttacccatggaaccctgggctcagagatcatttcctgttcatggtcatatggtgactgaaacacagatctgggattggaatgtaggtctgtctatttcccaagtgtttccttatccttctttgcctccatccagtcttctgtgcccccatgggctgggatctgacataggtatcattcattctaagaagaatgagcaggattctgacactgaatgctccagaagggaagtttatccttttaactaaatactctttcagtgttgaggtcaaatttcacacaaagtctccaggccagcctgatgctgaattctgaatatcccttatgaatattttgtcctattaactaaatagtctttcagtgttgaggtcaaatttcaagcaaaggctccaggccagcctgatgctgactcctgagtatctctcttgaatacattgtctctaagcctttggtcagctgtgcttccaattcaaatgccagttttcttcaaaggattgatctcagcacctcttatttattttgaagcaaaagctccacattttcaaaactgggattcctggtctgcgaggcaggggagtcagctagagcctggtcatcactggcattctgagcagatagcagcctcctagccatagctctgttcttgacccggtggccaggcagggcagtttgcaagctcagctacagacacatgccctccacaggcctccttcctcttaggccccactgtttttccacataacttttctgagtctgagagaagaaaactggttttctctaaatcaagagtagggtcctcatttaggaaagccagaattttctgtcttacgtatcatattacatccttgacctgtgtgagacctcctgttgaggtcaaagttgggtggacgacccgcttgacatctcagtgtggagctggattgcccttcaatccctaatgccctcactttctacccaacttagcatttcacttgtaattagttcctattaacttttttttttttatatagctgagtatgtctgcgtgtgtacatgggctcatgcttgcatgcctgctctgcttagctatgtttaaactgttagaaagaagagaccattccttttttatgtgtcttttggatgagctcaaaatctaggggtatatagaagaacttcagatcacactgctgcctgaccaatccctggggatcctctctgctgccaaatgtgaaggaacgcattgttagacagcaataccccccatgccgccacctcctccctcccttcagcggcaaagcagagcccaagagcctcctgcaaagagagaaaacagattatattttgtagtttgtaaagatctctgggtccacacgatcaatacatttctggtccctgtgtggggaattgttaagtcattctttagcaccaagaatagaggggccagtacttcctggggactaacaggacaaccatgacagccactgaagcttttcttgtgttcacctctggaaacaggaaaagaacagattcttctcacccttcagagtgcaaagggttctgcatttcttgtcataattccggagtctatctgaagccttgtgtgagaaagtagtgtgaacacggttgatgtttgtgtcaagatacaaccacagtggctcagggacccagaagttgagaatcccagcacaggtcagcctggtctcagcattctcattctgacatcctcaaaacagacagacacccccaaccaaaacccagcaatatcgacaacaagaacacaaaactaacaaaaacaccagaactacagagctgtttttcttttcttttttctttttttttttttttttttatagcagctattacatgaaaaccgtgtactctttccttctgcacctatttgtgcacggtgctggatcggggcttctgaagagtcggcccttaccctgtaggagattcaaggctgactgacctgagagagaaggacttctgcattgctgctcaggatttttgtttttatttttctgttaattatgagcccagaaaaagggaatttcgatttttcagatatgaccaggtcataggaaatgcaattgaagggaaatataattggagggagatgtagcctcctgactttgaggccacacacctcacatacctgaggacaagaaacaaaagaggaaatcagacacatctgacaaaagtgagacggatagagcataaagtatgtctgaaaacagcaacaacaagaacacttcctccaagtgacccctggaggaagacacccccaggcggcccaggcatggagactgtgagactcacatctacagggcacacttcctaggagaaaggcaagggcacattcccccttcatgctatggggctggccgcacctgaggagggagccacaccctttcatccatgccagtctcctccctggaagagaggctaggctggggcaggggtgcggttgtgaggctgaagagcagccaggaggaaacccttctagtgagcagaggatcagctcctccaacacacactggctctggggtctcttgcaggggttgtcagtgagaggtgagcgcccttggctgtgagctgggagttatcagcatggctggagatgagatacacattgctccatcaccctcacctgggaccaggttttgcctatctcaatggcagcgtgactggtgggatgtgacacctctggggaagaggaccaatgctgtgttcagccatgggtgcagggtgggaaaacctgatgggggaaaagacaaagcaaggagggacatttcagtctagctcagtcatgaggatggccaccaaggtttttgccggtcagacatgtctctgatttgatggaggaggagccactttctagggaaaactgatgtctcatttttgagagtctcctttgctgggtggggggcccttccaacagtttttgatacacaaagatctgcagcctcctgagcaggtgattctgaaagatgcagtgtctctctcccagctttcccactgacctttactgaatttcagacttaggctatcccaaaaggcagtcggaaatttgctcagtggcatttacctaactgaggccactggcagcatgacacagttgggtgactttagggtttagagagaaaatgctggcaggggactggggaagggagaagggtgaggtaggagggatgagcttctctttctcgtattgctatgcgttgctgaaaggcaagctaatagttacccagccagggtcaagcagctggagagggaagttagagaaattcacagccagggccctgagagcagcctgggagcacagctctgtcctgcagcagcagaaccttccatggctggtcctcagagccctgtgaaccagcccacccctacgaggattttcttgctctggaaattcctgaaattgattcctaacaaagttggggggaaaggggctgggcaaatgatttttttgtatagcaggcactgtgttcactgtggggaaagagagaaactgcccctgccttcacagatcttaccatgaagtggggagacaggcgaaaacatgcaattacacaaataatggcttccaattgagatctgtacttccaaggagaggtgcgtgctctgagagggtttatggcggcaaagcctagattggggcatctggaagctccatgaggatgaaaaggaggcagctagggaagggcaagatagagaactgcctgtgagcaaaaggtgcccaggccaccagatgtggggcacacagacacctgcagggccagtgtgtcgagagcagaggcagaggcggagcttgcagggctggctggtgtctcttctcttttggccttatttgcctgcttctggcagttttcttttcatacttacatgtcttgcctccagccttgtctggttcttcttctgcataactatgcctgccttgtaataggaacttgataaagaggacttgatgaaatctgagccctgcagcaagtcgggggtggtggaaaggatgtcttggtgccagtgggttggctgaccttggtaaagacagatgccttgctccttggttaaggattttccctgtggagtcagatacatgtcagtttgaattgtaaccctgtgactttggtcgagtaacttaatctctcaaagtctcagtcacactggtggaaaaatacagatagtgcctacctttatttatttgtaacatatgacgatgatttttttttatgccagacaccgttctgactgcttcacagatattagctcatttaatccttagagtaaccctgtgaagcaggtaccattattatcctgattttataaatgagaaaactgaggccctgagagattatgacatgactactctgtgttaaagtcagggttcagaatgatggaatctggatcttgaatccgcagtctcaactgcttatatttttcttatattttcactccgtgtgggttctggaattgctgggataccaagtgtctacagtgaccaggagggaaggaagtaagatttttggccacagggagccttatccttcttggcatatcacttaatattttcctgtgtctccagtcccccaggctccgactgcctggaccagcagcccctaatgatggtcaggctgacaagctgctggcaggactggcacaggatgccaagagccccctcctccccaggaggaccccttagacagcagtgtcagtagaatgctggctaagccctggccactcctcactgctcatctaactactccgtctacagttctgatccggaatgtgaggaacaaagccatatgtgagctttatcaagtgctgagtctatttcagaaaagactgtggagaatgcatcaaagctggttgcttattgcaccatgatccctgaagattggatccagttctgtggaagctggcagaataatgggcccagactgaccagtgagctcactgagggatgttactagttggtccattgctcatctgccaggtcagagacaggtgggaggcaagagaactaattaaattggcagtggacattttacctctaaaatgtagggcaaaaaaaattgcaaacaggccttttatatagaagctaattattaaaggaaagtaaaaatattggggtgttaaagaaatatgtgactggtttagaaaatcctcaacagatatttatcccaaggagggagatttacaaagccaaatttgctcttaatccttaatccacaaagctgtgatcccacaatttcaccaggaataactgacatgaatgctaattggaactctccctttttcccttcctcctttttatgttcttggacaccagcattccggcattctctctaagtttgggagtcctggtctatttccccccttagacagtgatgtttgagtaccactacccaccactcttttggcattcatagtgtaaatggcactttatcagttgaaaatgtgaatcctgtcaacagcccccagctctgccatgcttatcagggcaaggaagagggagagtgagattcagagagatgtactccaccctgttcattccagaagagtgatagataataacattttccggcaagaaacagcaggaaatctaacagacaggaattaaggcaccaaatgggaaagtcaattgcttattcgctccaagttttgtatttgaagggaatgttatttgatttggggattccctcattctccctttcttttttctagggggcaagtggaatagtagaatcaattatctcttcacaaacgtattttccaggctcactgtgtgtgtgtgtgtgtgtgtgtgtgtgtgtaaatgctcatttaaccttttagtaatgtttcacaaacatatatttctcaattatgtcaaagctccccataagtaaaagaaggaatccctggatttttttttctcatggtgtctcttgtcactctaaaatggacctaaactaagaggtagaataacaataatgaaacaacaacaacaaaatactgcttttgtagtgctacccatcttgtttgtacagtgtttgatagctttccactgcattttccttgcatttcatcaacctcactagttgctgtggtataccgatcacaacaaaaatgatgagcatctcagccctgggcatgcatgattcagcataatgcttgcaatggccttatcagggggtagctgtcattgtcctcctttaccaatgaagacacaggcttagagagattgagtaatgtgtccaaggtcacccacctgacaagtgatggagatgagatttgatccgaggcttacccgatgccagggcctgaccaggtaaaatggtcattctttcggtgacagaattgaggcagaggacttgtgaggtcacccatagatgaagaacggatccaggcacagaactctggtcttgttaattctcacagctgctcttcttacctcaccaaggctaggagaaaagagcatctagtcaccaaacaaactcatgctacagagactctctagtctctttcataatgcaaaggaaaagaattctgaaattctataccaagctgttaggtgttttccttggattggggaatgtagagggattaatgaggacaggaggcagaccttatcagggtgaaataacatgaaaaaatgaggatgaactactctttcttcatctactacccaacctctcaaataaatttcttgcaaaattaagtgaattcttgcttcaaatactcaaatagaggatttatcttgtttgttccatcttgtgtgatgaatccaggtgttttctaaagcagaaggcacttaatgtaggttctttatttttttgtgctgattaccctaattggtgggtttccttccaggatcagcagccaattctccactagagtagtatcactggaccttagggtctatttacagtagcagatgtagtggtcacccaataaaaaagtcgctgggtgcggtggctgacaactgtaatcccggcactttgggaggccagggtgggcggatctcttgagcccaggagttcaagaccagcctgatcaacgtggtgaaatctcatctatactaaaaatacaaaatttgccagatgtggtgacacacgtctatagtcccagctactccagaggctgaggcaggagaatcacttgagcctgagaggtagaggttgcagtgagtcaagattatgccacggtactccagcctgggcaaaagagtgagactgtctcaaagaaaaacaaacaaaataaatcaaaatattgtttccacagtgcagttttagcctgctgtctcaaaagggcctgagatttgctatatagccaagctgtgtggactccacaggagactcaggattagcaccttagagtcttgactgggttttcttctttaaacgaagctgtagatttagctataatgccatttgtctgcgcttactactggatgggcacagtggattctgattcgtagtcctattcagtgaaaatagccaaatcattgtgaatacactttaatgtgaaatccttcttctgaagagcccagagcaaattcccatgttagggagaggcagatggatggaggcagagttagctctcaatgagttaaaggaatgtcagcatcttcttgactatactggtagctggtagaatagagtgtattccatattgtaaatatagaatacagtcaatctagacccaaagaaagagaaaggaggggcagcaggggatatactaacttatgaacttgagatttataagcattatcaatcttgaattgaaaaagtgaatctcttgagggagtactggtggcattccaaaagctaacccaagtatccatctagtttatagcaaatctaggcacataattcccttagatgatggaattgagatggaggacatggaaaatgatcagacacccttcctgcctggagtgtagctcagaatgaattatctgtggttaagggaggggtcaagggaggaaacggtggtactggtgaggcattccaagggcttggtgtgaggttgcagtaggaagtggattccagcttttgaaaaccactgttacatctacattgccagcagaaagctgaatgcctacatggcattggaatggagtgaggcagattgcaaaggatggggctggccttgaggttggatcatatgtggctgtttctttgactgtcaatcttcattcttaaatcttctcacttgaacaccttttattggcactaaatttgttttaggataatgaacgcagctgttccaattatggtgctcaccccactcacctccatgtttcacctctcaaagacactgcctctcccttgggactagccctgagcatggtgaggccggcatgcccagggctgaggctggcacttggagagccctagcgtcagaggggttaacacattatctgggcatactcaaatagtatgagcccatcaaataaacaaacacaccaacttgcaaatgaatagaaacatgtttattagagtagaggaaaaacagctttttggcacattaaccctgtggcatcaggagtggcagctgcagcctgggacgacaggcagggaggaggagacagtaaacgtgcattttgaaagtgcttaacatcaggagagggtatttccaagcaaagaggtgtgtgtgcgtgtgcatgtgtgtgtgagagagagagagagcgagagtgagagagagagacagagagagagagagagaaccatcaaagcagtacaaaggccaggaggcagtggtagtgtgcacataagacctaggaggatgtgggtttgaatcccgtctctttcaggaattgggtggccttgggccctgtgcctctctgagcttctgtctccacacagttctcttataatctgtccttggcaggcttgtaagtgaagatcatatgagatgacctgttttaagcatctagcacagaactcggcactcagaagctgctggataaatgccactcctcactgtagttctacgttagaatattccaagttttccatggttcctgaggaggaaggcagctgtgtgttcaggtagaaaagtatgaggtgtgggacagtgggaaattctcatgagcaggtttcaattgaggaataattcatttttgcagtaggcagattaattggaaatgataaactcctcccattgtaaaattaagaattaaaagtgtttatttttattcagtaaataccaaaccatgactgtagtatacttgtattccaaactttgatgatttaaaaagggaagagagaaggagggtgaagggaggagagagagagaatggctatgagaaagagagcaagactacattctgagttcctacacgtcatcccctatccccaaaatagcagctccacttgtatacattgataaattttcaatgtagcagttcattggcagagagatgtccaatacctaaaaatagcttgatagctcctagcatagatcatctgccatatcacctgatatttcatcttccccactaaaatgtaagctccctgaaggcagagattaataatgcatataggaggtaatctttgatatttaggatgaggcaatgaatacatgaatgaatacgtcaatgaatgaattaatcaatgaatggagagacaaggagaatcagactctcttggactcagggaatcttatatctttgaacactaaaattatgcttctgtcttttcttgctcttctcaacccaccttgcctgacagtttgttacattgtcaaactctgtcatttcttcatttagcctgcccctatttcactgttagccaaattcttacacccacagagatgatcctcaacctttgtatgttcaactcttgcacagtccacaaatcccccagtgcactccacggaaaccactttgcaaatgccaagcctagccttgtgtgtcgccttgatgaatgagtcaccaccagctgtgctgcccaccagacagcttcttggttccaggggcgccgcctgctttgtcgtatagcagtgttagtacgattgtttgaatacttcactgcattcttcccccacagaaaaatgaaagtgctgataccagtgataaaaaacataggtttcataaacttaacacaattgaggcaaagatggaaatcatttggcgtgcaaaaaagagcaaatgtttagcctcaatcgggtgcttatcatacttgagctatctgattgtgtgctcagctgtaaaggaaaagaaaaaagaaaagaaagagaacagacacaatgcagtaaatattgtcagagattaagtctaaaatatacggtgtattttggattttttttttttaggtttctagaaatgcagatataaatctagttcgttttcactctcaggcatgttttagcaatgtgatgtggtagtgcaaaaacttcttccctgattttcttgtcctactttgtcaaacagattcagctgtgtgtttatattttcaagaattgtagtaatgtcctttcagttgcctagtttttaagaaaacatctttgaaaataaatacttgcaatttttcctactcctcccaacatgagtgtccaccacgagtcccctttcgccaaacacttcatgttcctctgagctgtgctgccccttcctttcctctgtacttctgcatccttagtgttttctcttgaatcctgtcttctccttcatggtctctggaggggacactgcagatgcttaatttgtgaggggaatcacacaaacatagtagaccctaaagaaacatcttagttggattttgaagtgggcctagactccgcgtgtttttttctcaacatctttctttcccttactcaaaatatcctgcagctggggacttctctcactggcgctgttggttgttttttggtttgtttgtgcctcatcagcttcctctacctcattttgtgatcattttgacctaagaccattgcccagtggcttctcatttccaagatctctacttgggtcctttttcacaagtctgtgcttgtctcataactcctagccttgttcatgactgaaatatttttttatctctctgtggacatgaaacctacatatacagtcctattctcctttccctgttagctctgatccctctgatttgagttgttctgtctgttgagcctcttttattttgtttctttatttgatgttcatggtggcgttctttgtgaaatgtttggtgattctggattgaacccatctctgtaacgctgaatgaccatttgtctgcttgttgcctgtccttgcattctgatggaggaagtgggcgggaggtgctgctgctggaatgtgtgctggtttcggtaaaaatggggaaggcgtggaatgtgctatggggcagtgctctggtcctggctgtggtgagtccttgatcctcccaatgtcacctgccttgagaactctgccctgcgaagcggattaagtctccttcctagccttaagccatgcactccatgtctttctgtttggtgtagagatttagcctttctgacttctcccactgcaatgagatgactaatgctgtgttgcttccaaccatctcgagactttcatccccctcttgacatgggcacttgccatggttggttctctctgcttgctatctttcagggattattcaagttcctattcttagtatgtttctcttcccttattttgtgtgggtttggctggggcagggagttcagaaaggaagagaagattttatttagcaagccacctaaaacaggaagttgccttcttcgctgagtctgagacatactgacttccagaacatcacgaaaccaataggatcacagcccagggcctgaatcctcttgtttgaaccttgttgtagatgcacaacctgtgcatttcaaacgtaggaagcagggtgcacagtgggtacttgctctatattgaatgaaattaagccaatgtttcccacaatgtgtgtgatagatattgtgaaaatgtgaagtagaggaggagtgagagggaattcagtgtgctggtggtatcaagcgtgcaaactctgtttaagaactcctttcacaaaagttttaagattatcctttctagcttaaaaaaccaatatagacagaaaagaaaccccactctggtgctttctcccttcttccattcctgccttgaccatcccttcttcctcatagcctagaagcagcctctgggcctccaccttcccttttggttgtcccctcaccctagtctaacacttgcctctttgtagagaggagcttgtcggacacatgggattcacgggccaggtggttcagcagcccaacaacctggatcctcctcaccctcctctcctcatggccagcccagctcagggccgcctctgagagtctggcctccacaaaggaagatgaaatgtagagacgcatttgctgcctccaagtaacagtgcttcaggtgtttacctttcctcaagtcatagaactagagagcagggcgaggccttagggactgtctgttgaccgattgacacattctttgtattttgaaatgaagaaactgaccctaaacccgtcaagtgactttcccagtaagtgtgtggtaccggctgaactcaagttcagatcctaggttagcagtcctataaattgagaaacagaacctcactactcaagccaagctgatgtctaccccaaaccaaacatccaagtatgcactggggtaggtgctttgtgaccagttcccatggactccacttgagagcccttcgaatcctcccccgccccacaccaccccccatcaccccctgccacgagctctgcatcagcctcagagcctggtttgtttcttcagggtatttatgtcaaggattcccaaatttgttattcagttctttccccactgattcccagctccattcctcagccacacaccaagctacacagtgcctcatggactcccctcctgcaatgggttctctggagtccctcctgcagccttttgagggaggtgcctatttcttccagattagagaccctcctgtcctctagatacctgtagctctccaggatcccccagcttcctctagacaagctcatatctcaagcagtgtgcatccaggaggggattcttccctccacatgagacataggccccaggttgagtggcagaactgcctcttcaggccaaaacccaggcgtgctgcctcaacacgaagaccacactttggcattatacgtcttcccaaagttacaatacatccaccccctgggcttcgttctagattctttcaacacttaagtgtcttattacaagtctctttcctgtttagggaacgggcaatgaaattgtgtaggcaaggggtgctccgtttacctggtgcattcgaggctgaagacaaggagacattatcctccaaaatacttttttttaaagcaagtctgccctagagtaaagtcttcctaaattttgattgttactgcgctatgaacagaggttgtatccacatttaatggaacatagcagtgagagaaactggaatattggaactgctgtcctccgctgatgaaaggaggttgtaaataacattttgctgttggtaaacacgcacaataaatacagaaatatggagccatgcaaaaaactttcgactctgtcacatgttattggtggaaaccactcatagaaaatcaaacacagactttgacttgcagtcacagaaatagtatactacctggagtttctttaggatttgcaatctctgtgcggttgcaggctctgcttgtgttatcttttcatgagggtctagacctgagtttgcagaatgattcagaaatcagtgtatttcctgcttcatatagtgtgattaatcttttttgattttacatgtctacaaatggtgttagtggtcataactgcaaatgattgtgatttttattggtctagaatgtgaatgtttgtgttagagcatctgcaaaagcaaacacttttgctatgttgaaaaaataatgaagatctaagtgattttaagatggcattttgtgaatgcatgctaaaatgctgctagatttttatttgttttactgttaatgctgcattgaagatatagtagtgctgcagcacaatttttttctatttcttcttttcctttgtccttcaaaaaatacccattctagttgcaatttttgttcaaaaatcaagatagtcacacactaagataagttcactatctaagaagtaaagaaatgtaaaagtaaagcatctcatagcagttatcagctgttttgtgtcatacataaataacattttgcttagcattggcatattttttgtgtacgttctaatagaatggccaataaatcaaagtcatctaaatgtctttatcaacaccttaggtattacactcactgatgtttagcatctttcatattgcaattataaaggtccctcaaaccctggctgataaattattttaggtttcttgtgaagaagggttgtgtttaactattaattttcataccagcttatacctaatagagtgtgtggctaatgaatgtgttaaattaaattgagttagattgaatcaaattgaattgaacagaaataaattgaattgtattgaatgataaaccggagagggataatgcatggtgatctaatagcatctgataataacagaacactgaatttacacgcctaacttaggagatatttgataactcatgagtgggaaaattgcccttctcctatgttcctgggcatccttgccaagtggagatgaatgtcacaggagacctcaggcagttatacagttcaagcatcttctgtatttgtgtggcaggaaattgtgccagaagggtcacaaacctgctttattattctgtatgtcaccaagcaggagctccattttttaaagatttttttaaaaattttcttttgttcagcagcagctggctgtgtgtgggcacttaggaacaagtgatgtgagtgcgtgtgtgtgtgtggatcagatagggggtatcatttgctagttttaattggtagattcaacatcttccactaaccatgcagaagccactggctgaggagttaccatggtaaatcaaactccgctgtgtgattggtagacttctgaagcaggtacagtcactctaatcaactccaggaaagttgaggccatctggttttgcctcacttggaagtaatttaccaccccaggtgcaaaaaatttaccctgaggtcagtaacagtaaacctgcctcaaagatgttccagctgagtatggaagaggagtggtgtgacatagtaatttctgtttgtttttatattttcaagcttgggaaagtgagggggctaatcatgcaagccagagccaagaatagatttggcaggtgctgacccagctagtttcagacagcaaagtgaaaactcctgaagctcattctacagcacttctttaatggtccagttcagaatgtctaactaattgagattttataaaaggaactttgactaagcatcaagttgctgaagaatatgatggaagagataggcttttttttttttatttgagtagtaaggagtgaaattgggaatatttgcaaggaagggaatctttcaacaagacttcactctaaaaaaaataaaagtatgttgggccacaaacattatgcatagctatttaggattgtagatattcttgtaatcagacaggatgtagccagccctaaccaaaatatacacagtgagaagacttcagaatcattagctctttggaatagttagaggaatgtgttcggctcatatgacattgatttgttttggctgcacttgaaatgtgtggtctttgcaagtcaatagaaatgaagtcctttattgaatagtagaaactccatggagtaaattatacaaagaaatggaaggccagggttctcagtctcttgtttatttgtgggagtggataccaggcaggatgggtggggctttcgaaaggaaagctcaggggcttgggagaaaggtcagtgttttagactttttgggctcctagagcaaaataccatagactgggtaggttaaaacaacagacatctctttttcacagctctggaagctatgaagttcaagatcaatgtctcatcaggttctgtgtctggtgagggccctcctcttggtttgcagatggctgtcttctcctgtgtcctcatgtggtagaaggggcaaggggactctcctctcccttttgggagcctctgggaagtctctactctccttacctaattacctccgaaatgctcctcctccaaatacccttgcattggagattaaatttcaatgcatgaatttggggacacaaacatttagcctatggcagtaggaatagcaaagtcagattaacggacagccatggagaaggtcattttggaagctggattcttccagaagtgtgataatcccacaaagctggaaatgggaaggccctgaaaaatcagctggtgtgacttctccgtctattaatgagagggtggaaggccagagggcaatatagataaggaataatcaaaatagtggtggattccaattttacagtaccctgttcagagatgcactgagccagcagagcctgaaaagctactggaatcgtgtgtctccccaccctccggtgccctaattgtgcagttatttcagacttagacttcaatcattttacaagtttaatactgatgtggaaggactgaggtggaattgctctttgtccagattctctttgttctttggctcaagagcagtaaggaatggacagacgtgtccttctttcccctgcctggagagggaacacaattaggaatcctggtatgtgagtctgtctccacttcatctcctctacaaaaagaggcagacatagcacttgtgataagccagctcctctcaccatcttcaccctctctaagcttttagtcaactctccagagagtcagaatctgttaaaacacacttaacatgacccacaaagcaacacaaagttaaggagcagggtgctgtgtactttagcacgtgggcaccacaccattccctctaaaagctaactcaacaagggaaagtgaggagggacatcatgttggaaaagcagtgtgaggaagagaggaggaggcagaaaagcacaagaaggggagatgagagagaaagaaaggaggagagaaaggaagaaaggtaagagtgagtcttttgtgggttgcacactctctttaagaatctgataaaaattctttctttctctggaaaacaaaatgcataggatcacatattgcaaataatttggggttcagaagcccatatatagacttgggtaaggagatctaatctatctatctacctatctatctatcctaacaactgcaatttagcaaagttacatatatatatgtgtatttgtgtgtcagtgtgtatataattgtgaaattgccattaagttaggtacatgttacatgcattgaaatatggaatatatgtcaaacccaatctctcattatccaaaaggtacaagagtgaataatgggaaagaattgagcaaagacacattcaaggtgactgtcagcaatgaagagttaatagtgaggcctcctacaatgtagtgacttctttaagggaagggatttgaagccatgggatttcggatgatttaaaatgagcctcactaaagccctggatcacacagtgcaggaaacaaacctgaaaatagccagagtagcaggcagagaagactaactgatctctactctttgaaccccatggttccagtccatttaattgttcttcaggctaacaacttcactttccataggggaggcagtgtaagtgaccatggcctggggttatgggtcagaacatcatacctcattattttaaatgaataaacatttcaaacaaccactgcatttcattggttttccagaacatgattcattttacccgtgtttcctcatttctgtttaaaaatccagcgcaatattatggatttattgtcacactgacaaggatgtgtgtgtatgttaagattcaaagatcacatttgcctctgctctcacaggaagaggttaggggaatggcacattccactggtttgtctgtgcacaggagtgcagggcatgtgactcttggggaaactcctacagctggctgtccggatcaccaggaatcatgaaagcaggctttgtaaacattgcatgcattcccagacattgaacattgtgacatttcatgaccagctctctcagaagagatgccaagtgtagatgtcctttctggaacatccgtgcataattaggctgcccccaactcctcaccacatacatgcaacattttcctgctgttgagtaatcatttgtgcttggctagttttctgtctcctcaaacatcatctcagggcaaaaaggcacagcgtgtagaatatgcttcttatagcagagttaaccagggcttcctcatctcattactagaatctcctgcaccagattccacactgtctctcttctcacttcatatcttgttcatatgattgttcatatctttctaccactagataatgatgtttagaagacagatctaggttacagtatctcgtattttataattattctatgaattaaaactcataaagttagaaacccttgacatgccattcaagaatttaaattctgattggaacctaacttttctagcctggtagtggaaaaatgaaagatgataaatcatgggttctaatcctgacttttcctacttgcttactttctgttactgggtacttggttaagtttaaagaactgtgtaggcatgtgacatacattagttcatcgtaacaattgggtgaagcaggtgctcttatctttattgcttacattaaactcagaaaggtacagaaacttatctgtgagcacgtggacttgcttcatttgaattcacatccgtctgatgccaatagccatgctatacagcctttctttgtgtatgcctgtgcatccttggtaagtctttattttttttccaatgtaaattggggttgtggggagtgtagactagaccagttgtattcaatatttttagttctccatgtctcccatgaagcacaatttgaaaatcactagaatacctctaacatgatgcctactctaacattctaattttatctctttgtcattatcatcccccttccaacccttttcagcaccatgaatttcatgttcctccatttgaacagtgtcttcttctcagaatgtgctggtcatttctgtgcctctacttcttccaaatgctctgctctctgtgaatctttctcagtctcctccacctgaggaactgttccaaggcttttgcattttgcttacgtctttattgttgtcagccatccctgtattagagctagctggatattcatctggacccttctataggttgattcataaatttttatgatggagactgatgactttctcattttagttttctgtaggatctgtgttagtttcccatgcttgctgtaacaaattaccacaaactgggtgacttaaaacaaccagaagtgtattctctcacagttctggagcccagaagtccaaactcaacttcactggccccacatcaagacattggcagagccgcaggagcgtaggggataatctatttctcatctcttctttcttccagtggcttccggtattctttggattgatacattatctcattcttcaaggccaacattttcaaatttctctctgatgcatattcacattgctttctcttctatatatgttcaaatttgcttctttcttgctctgttatgaattaattgcattgcatttaggacccactcagatactccagaataatcttcccatctatggatccttaacttaattgcatctgtaaattacccccaccccaacctcctccaccaaacacacaccatataagctcatgtccacagattccagggattaggatgtgcatggcttttgtgaaacattttttttttcttttgagacagggtcttgctctgtctcccaggcaggagtgcagtggcacagtaacagctcactgcagccttgacctcctaggctcaagagatcctcctacctcggcctcttaagtagctggaaccataggcatgtgccaccacactcagctaatttggctaatttttgtattttatagggtttcaccatgttgctcatgctggtcttaagctcctgagctcaagcagtctgcctgttcccaaagtgctgggatgaccaggcatgagccactgtacccaaccagcttttgtggaatattttttagcctctcacagtgtgcccaacctttggcttccaaagattcttgtctgtcccacatgcaaaatacattttccccataccaacatactgccaaatttcagcctgttacagcatcaactcacatccaaaatcttacctaagtgtcatcagccccaaaagtcccaaactcagcatctagatcaggtatgggtggtactatggatatgatccaccccaaggtaaagtttctgttcacttgttgacctgtgaaactagaagacgggttatctgcttctaaaatttaatggcagaataagcatagaataacagttgtaggcactcctattccaaaggggagaaaatggaaggaagaaaaggttacccagacccaggcaccttccaaatccagtagggcaaattccattacatgcaaggcctgggaataatcccctgaggctaatttcactgccctctgggcccatagctctgccttctggccttgcaattctgggctctggttccaaagctcagccctcacagtcatctttccttttttcatgaagggtagcacatgtttgcaactttgtagttttatgagcttattttctttctatggaattttgggagtctagcaaccttctttcatttagtcatgtccttgatcctttcagtctaagctggacatgtttctactgatgtaatattctcaaaaacctggtgattctcctgtatgtgtcatagggattcatattattagacaaaagggtcctccacagaatttcttagataatctcatctttctttctgacctatgctgatatccattcatatccaagggtcacatacccattcccttcagttctagcaacagggtgttcagtcatatacttggcgttctctccagaggacattttgttaacagtggatcttctaattttagcatattttgcaatttaaacaagctgttaatttctaaatcaagggtctttttttgcgtaacacttctttcctcaattaatctatttttgctcacattttactataagcagaaagaagaaaccaggctgcaccttgagtactttgcttggaagtctcatcagctaaatgtccacattaatggcttaaaagttttgctttacactaactgtaaaacaattcagctaagtttctgcttctgtataacaaaaattgcctttcttctagtttccaacaacatgcttctaatttttttctgagacctcaccagaagggcttctatggattcgctggtaaagacaatctgggctttttctatcatgcacttacaagttctttgagcctctactcattgtccaattccaaagccagctgcacatttttaaagtgtatttcttctagcaataactcacttccttgtagcaaaatctgcatcagtcagggttaaaccagagacacagaactagtaagagacatcaaaaggggtgcattgcagggagttggctcacatgatgatgggtgctggctaggcaagtctgaaatctgtaaagcaggccatcaggaatggcagctggagctttctggcacaggctgaagctgctgtccacaagtgggatttctttccagaaacctcagttctgcctgtagggcctttcagctgattgggtgagacccacccagattatccaggatcatctcttttatttaaaaccaattttatttttgaatgttaatctcatctacaaaaatggcttcacagcaatgacgagattagtatttgattgactaactgggcattgcagcctagccaagttaacatgtcaaactgaccatcacaggttagtaaacacgtcacacagccaagttaacacaacaaactgacgatcacaggttagtttacacgtcacacagccaaaacacgtcaaactgaccatcacaggttagttaacacgtcacacagccaagttaacacgtcaaactgaccatcacaggttagttaacacgtcactcagccaagttaacacgtcacactgaccatcacagattagttaacacgtcactcagccaagttaacacgtcacactgaccatcacaggttagttaacacgtcacacagccaagttaacacgtcacactgaccatcacaggttagttaacacgtcactcagccaagttaacacgtcaaactgactgtcaccggttagttaacacgtcacacagccaagttaacacgtcaaactgaccgtcacaggttagttaacatgtcacacagccaagttaacacgtcacactgaccgtcacaggttagttaacacgtcacccagccaagttaacacgtcaaactgaccgtcacaggttagttaacacgtcacacagacaagttaacacatcacactgaccgtcacaggttagttaacaggtcacccagccaagttaacacgtcacactgaccatcacaggttagttaacacgtcacacagccaggttaacacgtcacactgaccatcacaggttagttaacacgtcacacagccaagttaacacgtcaaactgacgatcacaggttagttaacacgtcacacagccaaaacacatcaaactgaccatcacaggttagctaacacgtcacacagccaagttaacacgtcacactgaccgtcacaggttagtttacacgtcacacagccaaaacacgtcaaactgaccatcacaggttagttaacatgtcacacagccaagttaacacgtcaaactgacgatcacaggttagttaacacgtcacacagccaagtaagttaacacgtcaaactgaccgtcacaggttagttaacacgtcacacagccaagttaacacgtcacacagccaagttaacacgtcaaactgaccgtcacaggttagttaacacgtcacacagccaagttaacacgtcaaactgaccgtcacaggttagttaacacgtcacacagccaagttaacacgtcaaactgaccatcacaggttagttaacacgtcacacagccaaaacacgtcaaactgaccatcacaggttagttaacgtgtcacacagccaagttaacacgtcaaactgacgatcacaggttagtttacacgtcacacagccaaaacacgtcaaactgaccatcacaggttagttaacacgtcacacagccaagtaagttaacacgtcaaactgaccgtcacaggttagttaacacgtcacacagccaagttaacacatcacacagccaagttaacacgtcaaactgaccgtcacaggttagttaacacgtcacacagccaagttaacacgtcaaactgaccgtcacagtttagttaacacgtcacacagccaagttaacacgtcaaactgaccatcacaggttagttaacacatcacacagccaaaacacgtcaaactgaccaccacaggttagttaacacgtcacacagccaagttaacacgtcaaactgaccatcacaggttagttaacacgtcacacagccaagttaacacgtcaaactgaccgtcacaggttagttaacacgtcactcacccaggttaacacgtcacactgaccgtcacaggttagttaacacgtcacacagccaagttaacacgtcacactgaccatcacaggttagttaacacgtcactcagccaagttaacacgtcacactgaccgtcacaggttagttaacacgtcacacagccaagttaacacgtcaaactgaccgtcacaggttagttaacacgtcacacagccaagttaacacgtcacactgaccatcacaggttggttaacacgtcactcagccaagttaacacgtcacactgaccgtcacaggttagttaacacgtcacacagccaggttagcacgtcacactgagaatcacaggttagttaacacgtcacacagtcaagttaacacgtcaaactgaccatcacaggttagttaacacgtcacacagccaagttaacacgtcacactgaccatcacaggttagttaacacgtcactcagccaagttaacacgtcacactgaccatcacaggttagttaacacgtcacacagccaagttaacacgtcacactgaccatcacaggttagttaacacgtcactcagccaagttaacacgtcacactgaccatcacaggttagttaacacgtcacacagccaagttaacacgtcacactgaccaccaccgtgcttgcctgtattaagcccttgatgcctgtgtatctgttaaaatgaaagactgtgatagtagaatgttcccttcctatcagtgaggagatcatttgattcaaatgtgggaaaaattaaagatcatgaaaatacattagccatgattataatgggagtgtggggaagggcatggtaaatatttagaataagctaaacttctaatgaaatgagatctcctcagctggggctggtggacccagatgagcttcagtgggtcatgaacctcccagaattatatggggtgtgcgtttttgtgtgaaagagagaaagaacattttttttttctggaattagagttcatagcttttatcagattcacacaaaaaagtgcgttgtattataaatgtaactacctcatatatatggtaaccaggtcatccatcagtagcaataggcctgtattaggagtccttgacggtggatctaataaaatcttctgtgctcgtaactcacacctacctggatattctagaatcagctcttggagaactcagaggtaatacagatagtggttcttatagggattggctagggcaaaattaggagatgcttgttgtaccaaagtctactggtatgtttcctactaataaatcatgcctgatgcccccaagtcaatgactcgatagaggaagtgagtgatgaggcaggcagcataactctgtgaatgagccaaccccagcccttcccctgacttaaaaaggggttaatgaacacagatggctgcaaaccccccaagcagccagcatactgtaaaacaatattaacatcattgccttttgaataccatgtcttgtaaaccccaggatatgacaagcctctttagaatcttctttgattgtgttactcagactcccgtagggaagtagggaggggtaggggtagataccagaggaaatgtgtaattaggagtctcttagaacaataagggttctcaaacacatatgtgtgcaactgatttgttgcttttggtatttctgttggtgagtaattaactaaccatgttttgggggcagtctgtgcaagcttgggcaatctgatagttgtgaaccatggggaaagaatagttgcctttagctatattttcagaaaaatactaagtggagatgtgaatggaaaggaaagaacagactttctggagagatgccattatggtaatgtcagaacttcctttcagtctcagataaatctttcttgttatcacccttatttttagttttactcaagacaggaggcccagttcagttggagagtgccgtgtacacagatatccctgccacctccccgggagagaggcacaggggcctctgcgggactctggccccttattttacggttgtgattcctcctcactgtggtgcctgtgtgtggggtttcagggagaggggccttttgatttgactgctgagaggaataggggttttctcctgggaactcttctgagagaataagcttttgacaaacactctttgaaagttactctatggccagatgcgtgcagatccaaagatggtgtcatttgtgaaaaatgaggctggcttatgagctgggtccatttgcacacagcctgcagccacggagtccctcagcttggagatgtgctagctccttctgtcctgtgggctgctggggctttgtgtcactggcatcagaaaacagaatttggcagttctctaggctaagggtttccaaactaagtgtcctctgtattaacaacgaggagccaaaatggggacttttctatttgtgaaggggatccagtgaaaataaactgttttattttggtgactttgagtataggaattgtcttctctggacctcagtttatccaactagaaaaatgggagcagaggtgcctagttatctttaggaatgttctgtgacttaatgaagcaatatttatgtaatgatttggtggtgtaaatgtccccagcagtgcatgatgttagttgtatgtttgcaaagtacctagctcccctggtaaaggtaacctttgtaaatggcaagctatgagtattgttaaaaggacatatggctccaccttctttccaaaaaagatcactgaggaatatagggccagttaaatagcatagaaagaggttcagagtgtcttgacctggagcagtttttaaaacctcaggccaaaactccactaggaaactcaccaaactaaccattatggtcaatttcattttgaaataaagcaccctaattcatctgtccaggagtccaggttcctgtgtggcccaaggttgcattcggaggtcagagtaaatcctgtcgctaaagagccactccttctagaaatagctttttttaatgtctgcaatttctcaattcagttctttgactctttagttctatcccatttctggccacaaacctgtttggggtttgctccaccataagtcaacacatgcacatgctttcccatcagttcccagaatgcagaggacactgtaggtctgctaaggggcttctttcagaacttctggggttaacgtggttggaatgtgtgctaacaggctgctctcacagtggcagttctaattggctgaggatgagtcttgaaatgtcacagaaagatttatctctcagcacagattctccctcaactaatttttcagtaggccaccagataatgggttgtttggaaaacaatatgcagttctcagatgcctttctgtgttggaatgaacttggtaggctatttgaagcaaaatggctgatggcaaggaaactcttgactgacttacaggccattggacactgggaacaccaggccttgcttgtgagggatttggctgagtcagtttctcagggtccatcaccattcttgtggggactcagcacacaggtgggtggggaaacctgcctcagaagtttggcttataaagaaatatggggattgatatctggatccttttatatcagcagcaaggattaattttagagaagatatttcataaaaaaatggattcttccctactctcagtttctcaggaaaaatatatttgcttgatttgaaggtaccattgacagttagctgcttgttgatttaataacagctttttttttttaggattaagagaaatagaaaaatgggcaccatgttcaacatacatacagattagaagataaatttctatttcagaaacattgcaacactgttcgcaacaaccaagatatggaaacactaaatgtccactgctggataaatggataaagaaaatgtggaatttacatacagtggagaaatttgttaaagaatagaaacttacagctacacagtatggataagttctggtgttgtataccactgtaggatgactataaaaataatacagtatgtagtttcagatagttagaaggaggatattgaatgttcctaatgcaaagaaatgataaatgcttgagatgatagatatatgaattaccctaatctgatcaccataagttgtatgtattgaaaaatcactatgttccctataaacatgtacaattattaagtgtcaattttttaagagtatataaagatgcatacagggaatgctgcaatatgtgacatcatggatggaccttgaggacattatgctgaatgaaataaaccagtcagaaaggacaagtactccatgattccactgatgtgagatatctaaaataagcaaattcatagaatcaaagagtggaatgatggtcaccaggggctggaatgagaggggaatgagcatggagtttcagttacgcaagatgtgtaagttctggaagtctcctgtacaacattgtacctctggttaccgtattatacactgaaaatttggttaagagggtagagctcatggtaagtgttcttgctgctataaaataaaattttaatcaatacatattaaaatgtgaaaacatattttgtaaaactaaggtgcaacaatatttttggtgactcaccattaaaagtcctacatacatttgctctagaatcctattccaagatgggattccaagttgattttgcatttctaaggttagcaaacattttgtcttttattggttgttttatacatatgtatacctatgtagcaagaaaatttctgatgatctcaggttcatacacagctcttgtcatttccaaacagctctggatttttcgagctattattagcctggagagtatagataattgcagtctacacagaaatctaaaaataaactgtttattcatttttctaaagaattcttttagcacatagcctcttcccagaaaggtttacaagtgcttagattaaaggataattcttttctctccctaccattccactctaaatttctgaagaaaatgtgaaacagcctaaaggcagaaaaggaagtacagtaaaggtcttaatctgtctctcagaattattgaaaattggctgaaaatctaattcttcttatgcaataggtaacctttttattggtggcatttacctgaactaaggtaaatgtcgacagcattggtgggtatgtaatcaatagcatactttcatcatttattttttttaaacaacagatacaatagtattgattactccatacatttcatgctaaatagctgtattaatctgacttaatgagtatgtgttgttgaaatagctgtcttccaactgtaacctgtttttagcaagaatcctgcttgccaaatacttctttttttaatctatagcttctacttgattcttgtgaaccaggggtcagcaaactttttctgtcaagggacaattagtaaatattgtagactctgtggactacactattactgctgcaacaactcaactcagccatgcaatagaataagcatggcatcccaataaaaattcacttaccagatctgcaggtggttgggacttggaccatgggctgcattagctgatccccattgtgttccaaggttggagaaagaaagcaaaatcaacatcatgatttgttgaggccaactatggagaaggcatggtttaacagtgtagtggacaagctgggcaagtttcctgcttttctggagctaacattctcttggagagtggggaaatttgaaaatcaaatctaataagtcagcaaaataatttcagttgacaataagttctatgggaagaaaagatgatttggtaaagaacgacttaagacttaagaggacataatttgtagggggtaatatgggagtttgaacatgcatccatgtttttgagtcccacaccaacatttttctaaggaatctctcaacctcattttttctatttataaaataattaatatcaatacttattgcatagggctacattgaagatcagataagctttatgaagggtcttctgtaaaacagcaaagccaattacaaatttattatatcttatcaatattggtcttgtcatcatttttattacccatctctttattgtgtctcatgttttctttgaagtctttttttccaaaacataacagaatctttaaacgggattgtgtgaactgcaattctttcccttcatattccctagaagaggatttctctaagtcactgacaagttgaaactgctttcttcacattaagctgacttgagaaatcagtgtttaatattcacactttaccttaccctactagaatatcagtcattgccgccagccaaccctatggacttgttggtgacacatgcgaaggcacagggtgagctggtccacaccttcagatgaagagtgtgaaaagacttacaatttggtcttgcatattggaagccttagaaagacatctgttgataacagtgatgagtgacaaacttagataattaaaccttcttgtcttcaagtctttacttgatttaaaatgatgactgaaatgtctactactgtgtttccacttactggaggaagatctcaataaaagtttgggccttgtaagaaattcatgcctacagaatggaaagggcaagagggaaaataccagcagctgtcttttgctgagcccttagaagccaggaactgggaagtgtgttggattcaacttttcttcaacccccactatctaacccccatcacaaccttcaaaggagtaaaattctccttttccacaagaggaagtggagactcagagagactaagtgtcttctcaaagctgtctgactgataaggggcagaggcaaaattcaagcccagacctgcctgatccatagccaatggtgtgtttaccagacagtggtctcaaaatgtttttgattgcttatagccaacaatagaagaacaaagcatgaaaaatcaaacaagcaacaagaacaaactttattttttggtagagaaaggatctccctttgttgcccatgctggtctcaaactccttgcctcaagcaatcctcttgcctcagcctctggaagggctgggattacagttttgaactcccacacctatccaacaaaaaacttttgagtatcactcataatatacgtatatttattggcaagttaaatccttataccattatactaatgtgtattgaacaaataatcaaacacttgaaaaatagaaatgtataaaaggatgcactacaaataaatatacatggaaaaactcatattttcttgccccacacgaggggatcatcacttgcttctcagtgtctactttgaacaccatgacactaaaccaaatggacacatcaggtctaacaatgtttgttctccccagtaaagtcagtttaatctctgtttagccttgcctacataggcttagtttctcaaggattccaaatgaggactgcttggcctggtgaggctagtgcaagctgctggaactgacacactcacggatgtgcggcttcgaacctcagcaaattggtagcacagggttagcatattgcctagagtcgggcttagtttccctcggtgtggctcaggctgctacagcacacttagcactggggtacctgggtgagtgccaccggtgacgctagcagtaggctctggccatttcagaaaatgaactgcttcttccagcacacaaatatcttgctaattagcaattagccgttaagggagaagaaatggaggggaactgggagtctgaaataatctcctaagagacatgaaagaaagcagcacttaaagtaagccagatagaaactgggagctgcttcatttgggcaagatgtctctagacatttttctaaacgttttacattcagcagaggaccccagtgcattctgccaagtgcttttccctttaatttttagatgcattcaaatttcaaggggaatttaatccgtatgtttctggttcttttacacttaactcatcaaaatgttgttctttaagagccgttggatctgtaaggcttatgagcctttgttataagccttttcaaaacctctttcccctttttgaatcagcaaatggaattttgccaattctgaatgggatttcaataaggagaagtccaactttaggattaaatgcagaacctcaagagcatccgacctgattttgcagagatgcacacttgacccttgcatcctaggaggaccgacagcatcatggggtcgacccagtggctggagcaatgcttggtgagcgcgagcccacggaagacaagcaatgtggttcagggcctgtgcttctgttacagaaccagcaaaccttagacttagacattctctagcccatcctcccacccaatgagatttgtgacacataataatgaaaataatgatactaatcagtagccgacactcatggaggccacctatatttccagctgcttttctacactctttgtatgcaacatccatctctcataatccttatcagaatggtgtgaggtagatgtggagttagtaaaacttagtggacacaagtttaagatttagaatcaggcaacctgggtttgaatcctagcatcaacacctataaactctagcgcccgaagaaagttctttaatgcttgccaaagggtgctttcatttccagttgctcctgttaccatcgttgttaaggatgatgttgatgctatccttgttccagtgatggaaaaagtccctatctcctggtgcagccatttttattggtaacttggagttttccatattttctctttatgtgtcaaaatctcctgttttacaaagtatgcccattttttctaaaatagagttaggctaactcctcttttgcatggcagaccttcacattcttgatgacaattgtgaacgtaacctggttgcatgttcctgacactaaaagtgtacacaatgttctggatggggtctgtccagtatgaagtaggaccttgctctcttttgttttgtattttatactattaatatgattgcataatccattaacttttgggaagccacatcacacctttttgttcatctggagttaatatcacctaatataagttttcctttgcttgaactgttcatagggcagtgttccatctcttgtaattctgtagttgattttttaaatttcgaaatatgacattttctcatgggctctaatttaataaaaaacaaatatggatttggtggagaaaaatatacatggtacagggttttgatgttaagtgtgggtatgataaatgtgaagagtttctgcattccagttcctatattaaattcatagcccccaaattttaaactttcagagcctcatcctgaagagtcattatgaaactcaggtaagttttatcatgaaagaatgctgaaaaaaaaaatcaatgccccctggccctcccattgagtaagcaactgaaagtgagcttacagcctgtgtaggacatcttttaatttgccaagtgactaaatgtgcagtcactgcagcaggcatccaccagctgtgcccacatggcccactcagctgggctgcttttcaaagagcagacagggcttatcttagtaccaaaactccatgccaaaaagatcatcactgggtttgagcatttgcacaaaatccccagcagccacgggtagacagctttgcttgacaaaggcagcttcattctccagactaatgggcaactttggctactactgggcaccatgataaaatggctgggcatagagactgtcagccctactggtgattctagccatttggccatttaccttttacctacatttcatctctgtattcccttgggctctgggaagccctttaagcttcaatgacctgttctgtatgagtgctggacagtccctgcaggttcttacttaacctgagagcttgttaaatgcatctccatggaatatcttctattgttaatagttgctggtttggattttaatctaaaaaaaactgtgaaatgtgcttgtttcatatgatgcttttctgagaggttgcatggagatctaatagttgggtagctgatggcaagtgggaatgaaggtaattgattaagcagcagcacctgtgttcctgatatgtacccagtccagtgctagatacagtaaaaatgtaaaagtttagggcaaggtcccatcctctacccagttttgaggactacataacatagttgaagggagaagtttcatgtaaaggaagtaagataagtatataaaagaataagcacatagatgctaagggatttggcacaggctgtaaatgctgtagtccctcaaatgaggaagagttcactgtcactgagaatatcctggaaggtaagacttcatctgggccttggagctgcataggaattagactggtgcaggaaatggtgagacttggaaatgagaatggataattagaaatttgtcatgtggaaatcaaacacacatgcatacctatgtatacatattacactacagaaacaataacccaatactacttcattttcctttaattccctaataactaaacagtacctgattgtgggttccagtagtgatgtacattgacatcttgtagtaagaccttttttcctatcctaagaggatggacaatacatcttcaaaagccagagtggttggccaggcacggtggctcgcgcctgtaatcccagcactttgggaggctgaggtgggtggatcacaaggtcaggagatcgagaccatcctggctaacacggtgaaaccccgtctctactaaaaatacaaaaaattagccggacgtggtggcgggcacctgtagtcccagctacttgggaggccgaggcaggagaatggcgtgaacccgggaggtggagcttgcagtgagccgagattgcactccagcctgggcgatagagcgagactccatctaaaaaaaaaaaaaaaagatagaagccagactggctctttaaatctactaacacttgtatgaagtaatagctttcaaagtagtatgtgaaccagctacttggagggttgtggcaggaggatcacttgagcctaggagttcaaatctagcctgggcaatatagcaagactaaatatatatatacatatattcacgccacacacacacacatattcatatatatatatttatatatatatatatagtgattaaaataatgcaattgctggcacagagaatatgaaaagcaactatattatgagaggacttcaaaaattcatggaaaaatggaattaaaagataaaaaaaaaaacccttcatttctcaaaaaaagcttcatcaaggttaaaacacttttgtaggtggtgatcctagccatttagtccatccctaaagaattgatggtcctgggaatgatgcagaattttcccccctttgttcagctaaatccagttcttgtttcatgaccaggaaaaattaggcacacggacacattgaaaggtgaggagggtggaatttattaagtgaaaggaaagctctcaacaaaaagagagatcctgcattcaggtttccccctcacaaattgaataccaagccaccattcatgagttgaagaggcaaggctcctcccagcataaggcatgaattcctggtggctccactccattcccccggtatgcatgcaggtccttagtcttctaaaaaatcaatgcgtactccatattgatttattttccttactgggcatgtgttaagggacagaattttccatcatgggcatgattaggcaagccccctctgcacaatgacttgggcaggtcagaggttctctggagactcctccctatttgcctaggcatttggctgtctcctccctctatgattcccccatgtaaagaagtacatataactgctgttagaataaggacaaggatgaagactgatcttaactgatcctgctgacagggggcactgtttggggaaaatggcagtcagaggcctaagggtccctggtaaaatggggccattgttcaaggctctggttgcatgaccgtttggagtttgatagcctgaagccaagaaaggacaaaccgggttattagaagacatgtaccaaaatgaaacaaaagcgagggtaaggacggctcaaaaattctgaggctgctggcaggctcagataaccggtggctatagttatttctgctaagatttgggtgcatggcccttggtttgtggttagctcccttggtcttgattttcccaaaaaagaaacctccaggttatgggcactctattactcccatcacctggcaggatttgcaggataattgcccagaactggaatattgattcagatttttatattacccatccctttttgtttcttctgagttgcagccagacatcactgtttacttcagaggaatgagcaggattagtttaaaatgtagatgaaaaacttaatgaatgagtctagaatttaatgacaaatctatgattagctttgaaacagaatttctctctccagtccttatttttgttaaaaacaaatagtgataggactgagttgtttgcaaaataaactttagttttatacttggcctgattatttgcataaagtgcagcaagaataattatttttacataggcttttaaaattggctttgagggaagtttgttccacaaggaatctcagataggactttttaaagctgagcctagccatgggtttctatcctcaaatatacctatgagttgggtgaattcctctcttcttgaagtcacaagaatatggagttcctgggcctgtgagaaagtgacattctttactcaccacaggtgaggaaccctgtaaggggactgtgtagacaaggtatgaggccaatatccccagggggcttttattggctctgcaagttgagcttgattccttaaatggaagcatacccttacagtcaaacccttagcaaaagaaccagtgtctccaattgcatcctcttgcaaaagaaaatggattcttattgcactgatgcaaataaccatattgccataagataagaatactcacagatagttttcaaactctagaggatccaggcagagagaaacaaatgtgctccaaattttttcacaggagtctaccttactcaattattaaagactttaaatagttcaaaataaaagtgcccttgactcagaaaaaaaaaattagcaatattttaagcaaaagttaaaaaaaaagattacttcagttttctattacttcagtctattcagataactcttgttctgcttgatattcgtgaaattttcagctcttcataagtcctgtatgtttttcctttattccgatgtcacaattttcaaaattatcagaaaactgcatttgacagcacctgtcaaattcatgtagctgattataaaccatcttttgaaggggataaaaacaagacaacaattgtctatgaataagaatatgtacagggtcgctacaatcaaaaacatgattgacaaagaaatttggttatctttgtggtttataatacttaacacccttaattatgattgatagcatatactcagacattaggattttagaaatctcatacaattttgtgacatatactaatattatttactaaaatataacctgaagaagattaaacacattttgttaattctatgtacctaaacatgtcagataatcctgttcatctctcatctggatgcctcagggaccctccatggcatccaaaagagagagttcaagaaagacaaccttgaagctgaaatttgattttgggaagcctgttaaatatggtagaggtttaaaacacttgatgttgtgaactagaatttcagattaccataagttatttattttgccaaagtgataacttgaaaattattttagaaagacaaaaacctttactcattaagaggaaatacttagctttccaaaaaatgtctcctgtctttctttcttttccttggtagtctatgcatgaggcaaacaaaaatatttcattatcttttactattacatgaaaatcttgtaccagggagagaaagccaaattttacccttgcattagtttactattgatgtcaaccccaatttattaaatgaaaccttatagaaaattctatgcaatcttaaccagcttgaccatgagctgagattcttgtaaatcttttataaccctttacaaattttgctaatgagtggattagtgccttaagaaaacctttgtgcttttatttcaatgctcaatttacagagtttagtcaatgttcacacacagaattttgtttgcaagattaatttttagaaaccttctataacttgtttaaacctttgtctttatcttatctaatttaaagcaatattttatcccaaggcaaaaatgtacattttcatgccttcttataatcttttactaaagacacattttactgttcttatacaccttgcatgtaaatgtattttcagtggtctcaattacatgttataatggtacttcttagcaatttttaactttaacataaaatctggtagattgttttaattatgcagtaggtgccaataaagttttactccttcttgcatggtgaagggtgtggttaattccatatatccccaggccttaacaattgtgaagcaggcaagtggagcagttctcaacagctaaagaagcagtttataaccttaaaacatttagcaaacctagtatctgacccgtataatttagaccacctatttacattttaacaacatttgcattttaccagtaatctttaagactgtttttatttctcaaagattaaagtcacatgaactaaaaggcgttaaagcttttatttttccttcaaaagtatttcagttaagcacttatttttctttagaccaattaattagagctcttttttatagatatcatgcacatcacatatataactacacagacagaagaagattcagttgttacaagatatttcatttgcaaatctcctaattggattattggtctctgggtggtgccctttaagagcagggttaggaaagcatgctgtttgtaggccctgataaacagacacagctggaagacaaaacatattttgagagggatttatctgcctctattttctgggggttccaagaggaaagcagaggtctctttcaaaatggaatccacggtgccttttctgtttttcccaaggagtctcagagcatcagaagttatcttagggcctttcatacatgcattaagagtggcaagacaaggcagggcacggtggctcacgcctgtaatcccagcactttgggaggccgaggtgggtggatcacgaggtcaggagatcaagaccatcctggctaatatggtgaaaacccgtctctactaaaaatacaaaaaattagctgggcatggtggtgggcgcctgtagtcccagccacttgggaggctgaggcaggaaaatgacatgaacccaggaggcggagcttgcagtgagccgagatcatgccactgcactccagcttggatgacagagcaagactccatgtcaaaaaaaaaaaaaaaaaatagtggcaagacaaggtggagaaaggtaattcagtcgattgaggaaaaaaaaacttttctccagcaaaacaagatccaagaagagaaaaacataaaggccttttaaatatacctataacttggatacccccttttaattaagctgagtgctgtttaagaaagtccttttaagtcccttattacccgatgttagccacaccatgtgtccaatgtttctggcttttgaactttaccaaacgtgacctcacaggtgaaaccaacaagcctcaattaagacgctaaaagcacaccagattagctacagcttaagcccagtctcgtatattctttttcattaatcaaaactttacagtaaatataaacagtgatccttatcattccttttactggtttgcacagggagagaggggccaaaagtccaacaggtaaaaaatattttacccttttgtcagtgtgtcaggcttctgggttctcttcccctgagctcaattctaagccaaccagtgtcaggttttggaaattaacttttctcagtctggaggatgcatctgaggggagtgtcctatagtacagggacacagttacccatctgtaaagaggggacagaggagtaaaaaagaaggctttcttcttccaaaggagcctcagaggttcaggatgcattcaaaaggaaagcagactgaagatgaatggctgctcacctagaaagaggggagccctgcatccctggttcctttctcttcctagggaatacccaggatatgtgagggagaaaagaaaaaaacgtcctttttccttcttctgtccttatattcccaagtcccagtgaccttgatagggtgccacccatggttgtcagtgtggctttcacccatgctaaggggaggcctagagggtaggattatccacttttgcccacgtactgcctttccctctgctgtcagtagcctttgagtttcctagacctcatttatgccatggatactagcatgacctttatccatgaaacaggaggcttggcttaatcagcaagaattagtcatgctcacctacattgtgccttttaactactgttgtcatctccctctggatccctcatatccagttttctttcctaggggttgaacccaaggcttggaattgagtttgggacaaaggaactgcctcaaggaggtgcctggtctcatcaatcccccagtgacccacaccagactggctgctacctccttatcataagcccagtgctaaggtataactgtggaatagggtccttctcaaacaaggaaggggaaaagggtgtcctgtgaattgtggtcctggtctaataagatgcttttcaagaaagaaaaacctctcacataaaagttaactcccgacagggtggagcaaagggaaaaaaaaaagcttaagtgctgggccaagaagacctgggggaagaaccttttgttcctttgcaaatgggtttctccaacagggagagaaacttttgattgctgtcagatcaagttggattaattgaccaggggaagagaagactctgtggatgtggatgcatagtgggaaatgctggccagccggctgcacagggcccaggtccctgaggcccccttgggtccccggcattggctgtggctcattcccatcctgcatggccattggatgccacatagacatgcagtggacacagccatgcaccccagccaagagggaagtggggcagggagccaccactcacccgtatatcccacatgcacacctgtggccattgggatggtggtggaacacccccaatattgtaaaagaaaagataaatgctgttacagtaccaataaaaggaaggaaaataccatagaaaatacagggttggattgaggccaacattcccgacccctgagagtgagtggggtgggggacgtggggcagcttcccctgctctcagaaaaagtctgaggatgagaaagctcagaaatgaaagggaaagatatttttgggttcacattttacttacccttcctcatgtccccatactggccaccaaaatgatgcaggattttttctccttagttcagctgaatcccggttcttatctcacaaccaggaaaaattaggtacatggacacactgaaaggtgaggagggcagaatttttattaagtgaaaagaaagctgtcaacaaaaaaaggggtcctgcatgcaggtttccccctcacacactgaataccaggccaccacatacgagtggaagaagccacgttcttccccagcataaggcacacattcctggtggctctacccaattcctccagtgcgcatgtgggcccttggtctgagccagtccacattgatttatttcctttacagggcatgtgctaagggatagaatttttcaccatgggcatgtttaggcaagccccctatgcacaatgacttgtgtgggtcagaggttctctgaggacacttccctatttgcctaggcatttggctgtctcctgcctctatcaggaatttaactctgtcaatgcagtcttttttgcattattaactgaagaaaaatgggtcccctttaaagattttttttttttaagatttggaaacaaaaagaagccagaaacagccaaatcaagactgtaagaggaatgcctaatgatttcccattgaaactcttacaaaattgcccttgtttgatgagaggaatgagcaggagtgttgtagcagtagagaaagactttctggtgaagctttcccaggtgcttttctgctaaagttttgactttctcaaaacactctcatagtaagcagatgaaatcattgttttgtcctccagaaattcaacaagcagggtgctctgaggatcccaagaaactgttaccatgagccttgctcttgactggtgcactttggctttcactggagcacctccactttgtcttggtagccattgctttgattgtgccttgtttttggaatcatactggcaaagccttgtttcaattcttcaaaaaaatgcttcaggatcttgctcccacttgttcaaaacttccattgaaagctctgcttttgtctgtagcttatgtgggtgctagaggtttggcacccattgaggggaaagcttgctcaatattaatgttttaagtcagaatttggtaagctgaactaattgagaagactatggcatttgctattgtttctgctgttaatcatcagtctcttcaattaggacacaaaaaagatgaattttttcataacaaattgatgtgaatatcctgccctgggcttcgtcttcaacattgtctcctcttttcttaaattcagttattcatttgtaaactactgatttctttagggcattgttctcataaactttttgtaaagcgtcagtgatttcaccattttccacccaagcttcaacataaatttgatgtttgttcttgcttctattttaccagaatttgtgttgctctgttaaaggcttttttcaaaatgtcttattgttcttagtgcctcaaactagatcctgttcagaagttttataaccagttagtatgagtttattttgatgcaaaaaaattaaaattcaaggttttttttataataagtattttctatgatcattttaaatacttcttgtatttacacttcatggagcccttagtgtatgctaatcactcttccagatgctttgtatatattgtttcatgtcatcctcacaatatccttggagggtaggtattattatccccattcacagacaagaaaatgacttacagaaagattgagtaacttgcctaaggaaagacagttaaaaagtgacggaatgagactataaaccaggtattctgactctagcagaaggtgagcacttaaaccatgggctatatgtaggaaaataatctaaatctgcctggcaattaagcacttgcaagtcaccttcttataccttgtctccttggcccttcacaccttccctatggcagagagcgtgttaggcccacgaaaaagctgggacacagagaaagtttctcttaggttttataatctccctttctgctcagacctcctgtacccagggtatgagtcttccagtgccccaccctctcagtgttaccttcccatgcccagtaacttcatctgccctccgttttagggtgccatctatggttaccctctgaactttgtgatcgtgcccgctgtctctagctcttcagtcactgaatcagaaaatttagtgaaattcagtcactaaatccttcccagcttgagttatttctcttctttgacctcactggaacctaaagctccttgaatgccctacttttcctcaatcccttagctacaccctttcttcactttcttccccttcttccccatccagcctagatgtggcaatgcatggcttcatctatcactgtcagactcttcaacctccttaccccactgtcctcctatcacattctcctggaaaaactccactccagaaaaaattcacatcttaagagtttacacttgctgctgttggggaaaatcatatatttctatacagtggtgctttcacaaattcatgatctctcacctcacccagacctaccaaaaaaagtgacagtcctctgtccctgtttttctattcctcccattctctatagcggctatttccaattttctccattccacacaagcctttactgtgtctttcttactcaagaggattattggcatttttcctttggcaaactctttctaggtttcagctcaaaaattattttctcttctggacatggtgagaaaccctagcttataatcctagcactttcggaggttgaagtaggaagattgcttgagcctaggagctcgaaaccagcctgatcaacatggcaaaaccctgtccctactaaaaatacatacacacatacaaaaaaacaaattagctgggcatagtggcacatgactgtaatcccagctacttgggaggcttaggcaggagaatcatttgaaccagggaggtggaggttgcagtgagccaagatcgtgccaccacactccagactgggtgacagtgggactctgtctcaaaaaaaaataataaattaataaaataataaattatcttttcatagttgactatatttctcaattttaacacataccacatatttattttattgagacaaggtctcactctgtcacccaggctggagtgcagtgtggtgatcatggctcactgcagcctcgacctccctgcctcaagcaatcctcccacctcagcctcccgagtagctggggcaacagacctacaccacacacctgactattttttaaatttgcttgtatacttggtggtctgcttacattacccaggctgatcttgaactcctgggctcaagcagtcctcctgcctcagcctctcaaagttctgggattacagccgtgagccaccatgcccagtcccacgtgtttttattacctgtttaactttaccattatcagtaagtttcctgaggtcagacaacatgtattgtacctccagcaactacacattttagtagatgcccaataaatatttgttgagaaaacagatgaataaataaattaatgaatgaagaaaacataagtataccatcatacgagagctctcataactttttgccaccaaagctgtgagtcccgcttcccttccaccttcaatcctcttaaagaaaagctattccacccaaagctagatcttctagcaatgctatggactttgttcacacctatcttctcagtaacgccatttgataatttttcttgtctttcctatgccttcagtctctcactttctatttcccttcagcaatggaacgtgatcaaatctatttcatatttaaaatcattgatttcttgtccaaattctgttctgtctcttccctgtgatagccacaaagaattcctaggcattatttatacttgttgtcgcttctttttcattctgcatttagtccttcctcagagtgcctggcctctgtcctgccactccactgaaaatgggagatctcaccaagatgaccactggctctgctcttgttctttccaagggggaactttgcacttgacccacctgacctcctcaagtcactcagcacctatctccttgcttctgcaaaccttagttcccggattctctgggcctatctccctgtctttcatggtgttctttgggattctacttcctctgacagtaacagcagtattggtgtcccccaggcgttgcttgttgagtccatcatgctccaaggttccagtgccagctatatgctgatgactccctcatcgatggctccagcttagtctctcccaaccctcagtcattgttttcttgatgtttccatgtaaagatctacagacctctcaaattcagtgggcctaaactgacagtatgatcttttcctcaagctcagtttccatatagtagtggtcccttgccaagaggataaaaccagagaccttggtatcaccccaagtcctccattttgacttcccaaatctgtctgaaaactaaacatttctttccatccccatcactccttggataactcaagctgcctgatctctcattgggattattatggcaacccctaactggccttcccacctcaggctggccctgatccaattcattctccatgctgcagctagaaagagcctttgaaatggaaatatgattctatccttacactttttagaagtttccattggcattctcattatatttgggataaaatctcacctttatagcttggttttgggtgccctaagccttccatcatctgatgtcttacatgtttcatttctaccctcgaatcttcacctattcactctgtacctctccacatactcctgataacccacattcaactctggcaatacagactctttcctgtttctctccatgttctctcttgcatctagacctttgcacatgctgtttcctctgcctggtctgtattagacatgcatgctttctgagcccacaagggcatgaaacactagaaagagcacaagatttggaaccagagactcagcttagcagcttatttttcatctctctgtcattcattgttccatccaacagatattggactgagcagtcttctcttcctcccttcctccaaaacacactttgcctggtatctcctgcccatcttcatgctgcactttagacatcaaccacccagaatagctttctttaacacacacacatacacatttataaatctgtcttttttgatattgcattgtaccctgaaattctctatcagagcaatttctttcagtcagcaaatatgtgttggatgcctttctttgtagaaggcattgtgttgggcactgtttacttgtctatgtcaccaacagggtggcatgcttcctgagggctgtgacagtgactatttcacaatttcatatgccagtaactagtactactcttgggttagggtagattctcaaaaatattgtagattctcaaaatatatgtatttatgttgttaaaagaaaaactttagctgaattaaatttcagagtttaattgagcaaagagccaattaaatccggtagtttcctgagccagagtaggctccaagactccagcgcagctacgtggtgaagacttatgggcagaaaaaggaaagtgatgaacagaaaacggaagtgagatacagaaaccgccggtttggttacagctcagcgtttgccttatgtaaacatggtttaaacagttggccacctttgattggccaaaaacccagtgattggcacaagagtaggctacagtctctttacagttttatctaggttatagttcacaatgcacagagaaatctttaggctgaacttaaaatatataaggaggcagctttaggctaaacttgattatttaacaatgtattgatttgctggctggatggatagaaaggtggaaagataagttggcaagctggatttctggttccatgtcttgtgctcttcctagggcaccttgctcttgtgggctcagaaactatgtgttcctatgacagaccttcagatacccctcagggagcacttgctgtcctccatgggtgcagcacttcctgtctgtggctactcgggtgtctctctctcatttttccctgccagactctcaacccttaaagattttagtccttctctttaggaagaccaaaaatgaatgagagtggcatggatttgaaggatgagatgactgaaaggaagagctgactgatttgtttagattgagtagtgcattgaggacactggtccccaggtgttggtaaatagaagccccttaagcagaggagcagcaggcttttcctcctctttcattatggtgatgattattatttttgtggttcccatggaaacaaccagagagagagaacaaaaatgtcagggaggttagaatgatgagatggcccccatatgcttaagaagactatgtgagtccatgtgtgcatcagtgtgtatgtgtgtgtgtgtgtgcactgcctgcacgttctgctccagcacactgctgggtcaggagaagttgtgatgcttattcatggcatttgttacagtcagtctcagcaaggagacaactctcagcttttagtggttagggagtctctgtagtgacagctccatcattgcagggagaggacaaacagagatggagacattcctcatgtgagccagaggagtgtcaaagaagaagacagctcaaaactggagttgccggcctgctcggcgctcccctctttttgtctgagagggctcactctgggcacctactttgtggctgcagtgggtacattgaaggcagctgtctgcagatctgaggatccttgagctcttcatctgctgctcacacttttacttctccccgcctttctgattctttgcctaatttgggagtgggaagaaaatccagcctagggctcttctcagaatggtcagccagagcattaacatcttgagcaccgagagagttgcaggagcccctccacaggaaccctttcatccactgtctccgccaaggctctgcagggactggcggctacctcttccgcatcatttgtggccaggatgttcaggaagcacaaggctgtaagtggtgtcttaaccacagaaggcatagagagaaacagacttgaaagccctgaactgagagggaattcattctgattgagaggagaacacagaagaccagaactaaagaagacattgggacaaaggcagctgctgtccatttcaggctgagttttctcttcagtagtcggcatgcatgtccaaaaagctcaggactccatcccccagccatccttgtgtctaggcgtggttgtcacccacatggttatgtgtgctacttccagactttccaccagctgtgtatcatcatgcagcgtgatcctagaagacacgtattagaaagggaggaaactccattaacctggggtgcttcaaaactgcccagagcagatttggctctggccgtagccctgcctaatgaccaggaacacccacactgtactctacctgggccaaaaagactcttctcgtgtgtcagctgcggacactttggagttgattagttccagtactgactactgccctaactgctgcagcatcccgctgtgggaggaagcaggatgtcatttctatcccaacccctctgcccccaggccccatgatctgccacagctcctctctgacagagtgcagtcaagcctcagtgacagattctgtctcctaggccactcttcttttccttcaacaccattccattgactttctctccccatactttttagtcttttttccccccttgaatgattttcttctttatctttctgaccagcgacctttgattgcaaggagcaactcagtttcacattactagagtaacagagtgtgttgtaattggccgggcattggtcttgaaatgtcagggaaagatttatttcctagtgcaacctctctgggtgctaattttgctataggctgcaggataatggttcccgctcacaatgggcgagagttcctaatcagaatacagggctgtaattgggttgaagggattttaaatcattaaagttgcatttagaatggggaatagaaatagaaccccaagattgaatgactcacttagtatttaatgagggagccatggagtattacttataatattcgcctaatgatcttacaagcaatgtaactccccccgccctctagggcctattcacaaggcacaattctgcagtctcagacccaccactctggagcaattaattactgacccatcaaggagcaatcaggctccgctcggccagcagaagcgctgatttcttcccccagtgtctcctcactcttcatcttcctgcctgccttggtctagggcctgcggggaggggagtcgacatttacaagccataaatcatcatgcagtttttggaaaacccagctcactatgagaggaacagggtgaccaagggtacctgtggagagtctgagaggagaaggcatcagaaggaggctatgctggccctgggagtgtacagtctacaggtttcagaggatgttctctggtgctgcagacactaagtgtctagcacatagtaggcactaaataaattgcagcttcccatgatatgactatgaccaagggttactaacccagctgaatagatttgtttcaggtggcgtgaagctccagcagttattttggacttaatctctaggtagatctgtaagaccaatgttcctgtaaatggaattcctgagaatttaggttacagagaggctgcttaagacatatgtaccccttccttctgcaggttcagaaacagctcagctctctagagagagcacgcaagtgttgtgtgtgtggtggtcgtgtcattgctaatggtccttcctaaagggaacacacatttgggagtgtgattgacctggtcgagtggcactggaaccacagcaggtcactgatcctgagttagcctcacttggctgttggtgccacgtcggccaggatgctggggacactcagtctgtgttgcactggaggccaggatgctcctgggtgctgatggctcactgttctaaatctcatcagggaatgtcacttgtccgtcctgtgtcaggcctcagaaagacgacttccatctcttctagtatttcaagtaaaacaaagtctatgggtttctttggtgatacctcagttgtaacttctattgtgttgacataacaactgagatatcataatgagtaaataacactgatatgacctcctaggtcaggctggcctgggaaaaagctttctatttgagaatgtcttgaacatagagcctggaaggtagtagagacttcgtgaacactcgtgaacttctgatgaaagggcttctcctcaaatacttggatctgatagcttcatgcaggtcattgtgatgaggaccttttccataaaggagccagagggaaaagggttccggcattggttgagttcctcccacttgggcagatggtaggctgctcatcacactaaagtggactcatccgtgatgcccgttttgcaattgaggcaaactttacccttgggaataaactaaaatattctaccagttctgcttttgcccaattaaggcaaagaaagattcgtggcaagtattttgctgtaacaggtattgttatgaatatccattgatcctgctagaaataaatctgtcatgatgtggaaagttaaaacagctaggatattctttaattatgaggtgttgactgatttaaatttagtaactgttaaaatatcagtagttatatcattagtttaccaaaaattaaaagtgataatgcctgcttcatacaaatcagagccaaacagtgtaactttgtgcatgaaagaacatgctgtgcttgatgtaattagtatattcccccaaaattgtgactcatgataaatctaataatatcttaaatgcaaaaaaggtagtccaatattttaaagaatcccatagagaatcttttgtgtgaagagcctttggcgttgcggccatctccattaattcatctattctgaaacttctggggtctgtgcttttcctataaagaaggccacctctgtgcatgcttcatgggtggcagctgtctcctacccacgtgcttgaatgacgagactaatgctctagaccacgcacctcagttgcctgcagatagtgtccctgtcccgatctaatgccaatgtcttagctttgccttttcagtcttctatttcaactccaggcaagtctggctactagcccataaagtgccttttaagaagtgggagacttgcccccgtaggcaaatatagccccacaagtacaaggcgtggtgaacttgtagcatctctatgtgaattccgtcaggagatgtagccccaacctggggttgatagcttaacaagcaaatagtacctggacttcagcctcacatgcttccttggccaggcacccttgtgcagtgaacaacctgcacaacctgtatacagcagccctgcagcttggactgttttgatcacaaccagagcaatgtccaaataatctgccaaatatttgtgcaaacattatgttcatgtttaatcgggagcgatagttttgtcttctttataaaaggagcaaatccccagaagctggtcaggagcaccagctgtttactgcctgcagaagccgctgcttatctccttgtaaccacctgcctcttagagatcatgtcttaattaactcagtgttatcaaaactgaaattgtagcaacacctgtaacatcaaattgtaaatgagagataaagggggaaaaactctgctgaccaagaaagggagcttggaaactctctcttgagctgtaggtagttggctccaggttgattggtggcagtctgctgagaattagaatcagagactcatacattattccatttggaaagtgtcttggaggtcttctaatccagtggtggtcaaatattttttatctcatgacacacaacttattcttctgatgttcaatatatgctgatattttctattttatcttatttatttcattttaaaaactcacggataaaaatcattccattgatttcatgacccactacagattcacaacacaaaaaaactggaaaacagtgatgtagtctaatttctaaaatctaaaggactgagggacaaagaggtgaagtgacttgccccgggtaggttatcagtgggtattgttcttaaacccaggtctatagactccctcccagtggttctgttccctgaaatctactaaattctgccactgcaggacagctccgagaagaaaagcaagtcttaacttaagaaacaggtcttcttgggaccctgctactttccggataacaagcctgagtacctacataatacaaaatgtaccctttgaggagaaggtcaggtgctttctcacataaaaagcattgtaacaactggtggtttgaacgcctcactgcattcccatgctgaaacagtaggggcgccatgcctcctagtcttggtgagcctccttaaaaccttaacaccctgtgctctaccccatccttttcttcctctttcatttccttcccccactttgcaccattgagatccctttctactcaccaccccctaaacttctcctttgagacactggactaaaatcgtgaacaaaataggcattctcacagaaacagtaattccaaattaaaacaaaaacaaaagcagtaacttattacactatgagagacctttttacatttctctgcctatatttgcatgtttttaacatattgaaagaagttttccaaatgaaagctgtctgattggtaaccacacccatgtgtcccatggcagtcactcgtgggagcaatcttgggatctaaacagagtttgtttagtatctttgtgtggtattgatcagcatcattgataaagtatgcactggatgttgttttcccagatcagggattgatttggaagatggttagccagcaccactatgatctgactgtgggcaggcggatcatcacactggggggacacataggcccaaagaggatccagcagattgaatttgcattatgcaagccccctttgagtttcacccactagcacatgcttctgtgacagttgaattaccagctatagaactggggtggcaggaagcaggccatctccattagcttcttttgaatccatttcttcatttcctttggccctgggcatgtgggcacaaacttactcgaatggccatattcacagaagcacaactttctacagcaaggtattatcagctgttgctgtcttcggaaaggctttattgtctcctagctaagggaatccctcctttccttccagggttcactaccagcgccccacccccacgcatacatatacagacactgagctgtgttttgatatgtgaggtgggctatcagctgtgatttaatgacgagtatcactgtcagactttacaaaatggaatttcatcagatggtgagggaagacttctgcatagaaactacagagggaaatttgacagctttttccattcagttatcaaagcatttgcagttcaaagcaggtgaaacaataatgtaatcttagcactgaatgctcatttgtatctgagtgtttcaataaataaaatggtcagggaaatgaaagcagacctgttgtctccaatccactaaatttaatatccagggtattgactgacagctttttatcaccataattagtatggattgttcctgaggccattgatcaatctttcctacctctatggacttgagtggctgttttcttcctctcctgccctccccaccctttattttaatattgatcgtgccagttgtgttccaccgcagagaggctgctcacttaggcaaaagaaaactcaggatgaagagagatggctgagcagcagccatttctaggtggcatccacctgtgacatcactctacctcatctatgttgaccttgtaacttgacctcttggtaccagtgaccttcagctcctcaatacgataaccaggcacaccgtcttccccactgggtggaagttacacaaagactagctacagaagccgtggtcaggaaatatctgttgaattcatgaataccccttctgtaatgttgtcaagctaaataagggagtttggatagaccaaggaacacaaccttgtgtgtgtgtgtgtgtgtgtgtgtgtgtatgtttgaatgtatgtgaatatctatgatgtaacctgttccatataatgcaggccagaaacctaagaccttcttatttctcaccgagctcttccaatttgatgttgtcctcttctcagtctgtctatcactaggcgtatacggtgtgtaggtatacacctcactatctcttgccttaactgttgccataattcactatctcatttccctgcctcctgtcctgcctcacctaactccaaccttgcatcttcaaatcttccacacagaggacaggcaggtttttgtaaaatataaactattatagtccttgactgtttcacatctaagatccttgtcatggcacaaaaagctttctgtaacctgatctctcctccctacttctcagccccatttcccaccattcctacaggtcacactgctggaaggtagaattgcaatggatccgttcagtcattgcctgcttcacgcctctaagtcttggcttatgttctgtattttgcctgcagtagccttcacattctttttctccttggccactctttctcattcttcaggaattcattcagatggtatccctttcaggaaacattactttagctcccaaagtatccgaactatgactttttctgtcttctgagattttaatagaatatatacatatacttttttatgcatctctatcctatactagagaataaacctgaaggggacaggggctacgtggtttttcgttctgtctccaatgcaaggcacaactcctggctcctaggatgtgtttcttgcactggaaagaagtattcctaagaagagagtcagtgtgcctgaagagctggggcatacattatgtcaaactggatctgtcttgggacacacaacgtgctgtgccatataactgcaccacgaacaaaagcgaggtggatctcacttattctcagggtggtgagaagagatgggaaaatatcccttcttcttataagcaggtagcaaggtatctttctgaccttaaagaattcaggtgttgtcaactggttattttccacagtgtggaagagttttgctatctatacactggagtagttttctcattggtcttcctaatggaatttccctctgccccactttgtagtacagatcacccatttgcataacttttcggaaggatgcttcctgaggggagagatgccatgcatttctgggagtgccccatgagcccacactgaccttagacagcccccttgctcccaatctgcaagctgtgtggagcctgtcttccctgttcctggcacagcagcctgccccaacagttacaggtgctcgcacacatcaaatgcctcttgttgaggcattaaaccaagtgcaacttttccgaactgagcacaacagagccaaattggactggaaaggccacaggttcctcagggcctcagggagcctgtggcatctacattgcaaattggccccatagaaaagcaactgatgccagggccggccttcatttcatccctaccatgcctattgtggaaccgcaggggcagatgtttctggaggtgaccgcctgggcgcacacaggcgcaggcagcacctcctcctcaccggcctctctccaggcttatgtaagacagattggacagactgataccaattggcacatcgtccctgccagattggaatcaggcccttctaccatctttggggtccacggtggctccaaataaaatgtacagaaggaatgtgattcttagctacagccaattttccctttgctattgcgctggcatttctaatctcgggcattttgttgctgtggagcacaccactacaaatacagtctccagcttaggaacgttgagatttgcaatcatgtgaaaatgccttttcgtattcctacagtttgtctggataatttatttattttaatgtattatttagtgcaaaactattaagtgagcttcaggttatattgttacgttgttgctaattcagttacatatggctggggcaggtgacaacaaggagggaagatacctatggcacctgctctttcctttcctgagatttctgcagcttctgcatgtagatacttaaccctaaaagggaaggtagtgtgcatattttgcctcctggattcgtgtctcaactgtaccactgagtggctgtgaatttagtcaagacacttaattcttccgagacttaatttccttacctctaaaggtcttcccaggctggagggttaaatgacgtggtgcagatgaaaatgcagagcaaggagcctgacacacaacagagggtgggcaaatgcctgtcctctcccttgctgtcccttcaagtggccttcatcagcagacctaggcatagcacctctgaacttcaaatagtctattagtagcaggaccacatttgaagttatgcgtatggtatacaccaacttgtatgtgtgttgtttaggaaggtcattctacagagtatatctgatgcagaccgggactgtgtttttcgttgttgttgttctattcccagttgtgcaaggcacaactcctggcacctaggatgtgtttgttgcactagaaagaagtaatcctaagaagagaatctgtgtgccttaagagctggggcatctttatgtcaaagtggatctgttatggtgcatgcaacaggctgtgccgcatgaggctatgtaccaaaatatttacagtagaaatttttgagtgatgagattataggataatttccctccttccttccttcctccccttcctccctccattttcccccgtcccatcttctttccttgcatccttcctgttcatgtatttttttcgtaaagtttatatcttataaagtagtaaaagatacaaaaataccctagctctttaaaaattgatttcagccaggtgcagtgactcacatctctaattccagcactttgggaggccaaggcaggaggattgcttgagcccaggattccgagaccagcctgggaaacatagtgggacccccccccaccaaaaataataataactaatagtaataatcataataataataatgggtgtggtagtgcatgcttttagtcccagctactcaggaggacaaagagggaggattgtatgagaccggcctgggcaacatagtgggaccccatttctacaaaaagaaaagaaaaaaaataaattatctgagcatggtggtacatgcctgtagttccagctacctaggaggctgaggcaggaagatcacttgagcctgagaggtcaaggctgcagtgagctgtgattgtggcactgtaattactgtaattactccagcctgagtaacacagggagatcctctctctctctccatatatacatatgtatatatatatatatatatatatatatatatatatatatatatatatatatatatttcatgggaagccaaatgaggagggcaacatttgagtcaaacaaggaagcccatctctgatgagctttcacaatgtcctccttctttcaccgtgaggagacctcaggttcactgtgtcagctcaccctatctgacccacatccccatcactttcctcccagtgggtggaaggattcacccaaagctccaacacgcacagctgaaggagcacgagttgagacctgaagtctgaacatggcttaagatggaacgccgtttcctgaaaccatgccccgtatctccagatgaataaacttggaacatagaaaattcccaagggtgtggaacactggtaggttcagaataaataaatatgtctgcttattaatatagtagtactgttagctcagaaaactgtagaaaagagagctattaaaattcaatgattgggagagaaacatgagaagagaaatcaaaagaaagggaagaggagcatagtaaagaggcccattaggaagtggagaaagaaagaagaggtgggagaaaggaaccagaggaagaccacggtaagcaggaggaatggagaaaacagtgggaagagacaaaaccccagcaggcagcagagaagcgttgatcctgtttccagggtcagtatgagacttaggcactgcagcagccagaccacgtgactaattgtccttaattgtcatgagttgactctccaggctgggggtcccaggcacttttctcagattggttggctgacactgcaggcttctgtcatcatgcagccttgctgtctgcttcatgctggcagacattggcttgaggtccaccttcactctaaccatcttctccgttttaacctaaagattgtttccatatcgagaaagaggggatgttctagatggcacctgtgcatgtgtgggagggaggcagagatagagaaccttgtaactccctccaccagcctgccaagtccctgctgtaatcccaggcccagctcagcaagggaagcttaaacctaagtcaatttgagggtggcctgggatcatgggctccgtggcaaccagggtggatattggtctgtaataagtcagtgaaatagtgaggttcaattacttacatgttccctgaagctgaaacaattgccattatcccacataatattgcttgacctacatttttacttgaaagccttcagctaacaattagtttgaatgttgagttataaatgaacacattcatattccagaaatgaaaagggaaaggggagtgataccaacacggctccctctcttcccgccctctctttcctttgccttttgtatgatatttcaacttagcttttccaagatggaagtcattggagagtttgtctaaagggggaccattcagaggtaatgagacaactgggctttatctgggaaaggggcagcttggtcggtgccaaggagatttgagccatctggattaaaatggtcaaactctccgcaggaagcaattaagcagctccatgtggagaagccacgtgaccacgccaaaggagctgccaagaacaggagattagtaaacaaagtacccagcaggaggtgtccaggttggtcactgctctggccacttggcatttgcacagcttcctctgtctttggcatcccatctgtctgtacccacagcctacctataagctatctgcagagtttaaacaaactcaggcagaactgagtttatttaaaatgttaaaagtccagggctcgggtgatcgtgatgatacatcttagactcacacagcatcccttcccaggtgttctggcaatgcctcggatgtctttgatgactcttcgctgcctgtgaaaagcccagaggtgtactgccattgagctgcgatgtttaattccctgagcgtgatcatttagccatagatagtcacaactgggttaggaagcatgtacctagattattttagtgattattttagtgccggtctttgtgaaagcttgagaaaaagctgagttctcctttcactctaagaatctttttgtttaaaaaaaaatccataaaaggcatgtaaaactcccagacatatgccttttttcattcagtgtacatttattagccaggcactgtattagcccttgtggttagaatagagacccgttctcatggatgttacccctggccaaaagaaagacgcagaggcattgggactgtcagctactccctacatagagtcctcttctgatttccagtcaagtcagtttcacacaacacaaaactaacttttctcaaggatttgtaacatcttgaagttttcatgtgacctgcaatgggctaatgtagaatggtagttcaagtaaaagatttatcctttttttttttttttttttttttttttttgagacagggtttcagtctgttgcctaggctggagtacagtggtatggtcagaacccactgcagcctcaactccccaagctcaagagatcctccctcctcagcctcctgagtagctagaagtagaggtgcaccactatgcctggctaatctttttttttcctttatttaaaaaaattttttttgtaaagacagtgtttcactttgttacccaggctggtctcaaactcctagggtcaagtgatccccctgccttggtctccaaaagtgctcagattactgacatgagccactgtgcctgacttttactttttttgaatgagttaacggcagcttactgtgcagcaatgtatcatgggaacaatctatgatatgttctcattgttcctaatgttcttgacttccatgacacataactccctagttttctttgtccagcttttctaagctctgcatggtgcactacaccatcttgaatgttgtcatgctaaagacttcatcctatgtcttctgtaccctgtctgcatgtacacacctggaatctctttcataaattgatatctttgctccaacatctccactgagttcctgacttataggtatagtgatctgatagaaagtcccacacaaacatataatgatcattttgttttactcaaaccttgttaatgatgcctactccttctcaataaaggacaccaccttccacgttgttgctcacaccaaaatgccgcatacaaactttatccctcctttatctttcctccccatctcgtaatatccattgtttctaatcgattcacacattttgttgagtgaacttccaaaatatatccccacttcatacctttacctctatttcaacaggctttagtttaatccgctgtcatcaaaacgacaatagctgcatgagcctcctagctgacctctttgttatcttgactttcccttgatactctgttctccaaaagaaaggcaaaaacatatttttaaggaatgaaatagtgccatttgtagcaacctggatggaattggaggccattattttaagtgaagtaactcaggagcggaaaaacagacatcatatgttctcactcataagtgggagctaaactctgaggacgcaaaggcataagaatgatacaatggactctggggacttgggaggaagggtggcggggcgaggaacaaaagactacacattgcatgcagtgtacactgttcgggtgattggtgcaccaaaatctcagaaatcaccactaaagaacgtatccatgaaaccgaatgtcacctgtccccgaaaaacctattgaaataaaaaatttaaaaaaaattcaaatatttttattattattatactttaagttctggggtacatatgcaggatgtgcaggttttttacataggtatacatgtgccattgtggtttgctgcacccatcaactcatcatctacgttagatatttctcctaatgccatccttacccccactcaccagcccctgacaggccccagtgtgtgatgttcccctccttgtgtccatgtgttctcattgttcaactcccacttatgagtgagaacatgcagtgtttggttttctgttcttctgttagtttgctgagaatgatggtttccagcttcatccatatttctccaaaggacatgaactcatccttttttatggctgcatagtgttccatggtgaatatgtgccacattttctttatccagtctatcattgatgggtatttgggttagttccaagtctttgctattgtgaacagtgctgcaataaacatacgtgtgcatgtgtctttatagtagaatgatttatcttttagttatatacccagtaatgggattgctgggtcaaatggtatttctagttctagatccttgaggaattgccacactgtcttccacaatcaatgaactaatttacactcccaccaacagtgtaaaagcattcccatttctctacatcctctccctcaccccttccaccatgtgaggacacagcgagaatgtgccatccataaaccgggcagtggggcccaaccagaccctgaatctgccagcaccttaatcttggatgtcctagcctccaggacaatgataaataaatttctgttgtttataaggaaaaaaattaaatatttttaaaacatgaatcttctattatattgctcccctgcttagaacctttcatacttaaaatccagtctacttatcaaggtgtcaagacctacacgagttagcccctactttcccctcacctccatgtccactgtgtcccactgggcctcttggccagccatgctgctctcctctcggctccgggacgccacattttctcctctctcagcacactgagtgtgcacagcattgtgtactgtacccaatgtgtagtcttttatccctcacctccctcccactctttcttccaaatcccaaagtccattgtatcattcttgtgcctttggcatcctcatagcttagttcccacttatgagtgaggacataagatgtttgggtttccattcctgacttacaatttgcctggttctcccctcttctgtcccccagtcctccacctgacaggctcctgcttaccatttgggtttcaggacaaatgttacctcctcaaaatggacttccttaaagacataacaacctttcacttgggctcaactctagcccaatgccctgtgtgttgtcttcggagaacttactgctctctgcaataaacttgcatcttttttcttcctgtttctcttctgagtagtgcataggctccaggaggggagggcctatgccctgtcttttgtgtgctataccccagtggctagaactttgcttggtgcagatttgatgctcaaaaagtatttgctgaacaaatgaatgaatgattacataagtgaataatgcactcttctttccataattttggttttcctggcaccaaaacacttaggaaataatatggtcttcaaagtttctgcatgtcttatctctgccaaggacagttgcctctccggagaactgaattgtcgacatatggctgaagtgtgatccagtggactggaggtatgcactgagtatattcctaatatcacgttgccctgtggcatggggcttaatgcctttccatttttggctgaagggcttcactgcaaatgctttcaatcatatccatgtttggttgaaattttatggcaaaagataacttagagacaaggatttttatttgaaaattacattaaaatatactgttatttctaaatatatgttcaaaatttcaatgaatcaacacagagtttttattgaacttctctattcacatagcatatgaattctcactttctgtcacaagagaagtaaaacttaggccaagcatggtggctgatgcctgtaattccaacactttgtgaggctgaggtgggaggatcacttgagctcagatgttcgagaccagcctgggcaacatagagagacctcatctctactaaaaataaaatttaaaaaattttaaaaaatatttttataataaaaataaaaggcatggtgatgtgtgcacctgcagtcccagctactttagagtctaaggcaagaggattgaaaccaggaggtcagagctacaatgagccatgattgtgccactgcacacaagcctgggtgacacagcaaggccctatctcaaaaaaaaaaaaaaaaaaaaaaaaaaaaaaaaaaaaaaaaaaaaaaagagacagagagaaagaaaactatggtccaaagtttaatccctgtttaaaacagaacgggctagtctccttggtagcaatgcatgtggcaggaagtccccagaaatttatgtgcatgcctatgtgtgtgtacgtttgtgttgtgtgtgtatttatatatgtgcacatatataaatatatgtattttttatatatacatatatattttttcttgattccttgactttttaatctcctttctctctatgtttaaaagttttagaaaacaaaaacaaaacaagccttccagtcaaaaaattttcagcacaagataagtgaacagaagggatctatcatcctgaactgtttttcataagccttcatacagctttaatgcaacacagaggtttggacacaagggtaagcatcaggcatcgaggagctcaaattccaattcgtgatgctgcagtcctctgcagtcctaagcaagccagtatggctgctcagtgtcacagtatgccctgtgtaagatagggattgttttaggaagatcagtgaaagtttaagaactgacctcctgaaaacagttgtagattcctcagacatcaaagtcagctaaagaaaaataagtgctaggcttcagattcatcgcaccaaatgacttcctatctaaattctacaataggtaaaatagaatacgtttcttctaaccaatcaacaccacttggaagctggatctgtctccataatcctggttagtaataaagatgcttcaccactagtttgaattttctggcgaggttgtcagtgattcgtgcttgaggcagaaggaaaccagtttgattctcgcataggcgtttggcaaaggaagagagaaactttgcttttctcaacagaggctagaaatgactcagactacaaatagctgctctgccatacaacaaaaggtcatccctccctctcatttttcctttcccatttgtcctgaatgaaggccaagctatatttccccatctctctcttctcatctcaaaatgcatagccttctttatgtggtgcattctagttcggattggtgtgtgacccaggctaagacagtgttatgcagattggagcatcttaaacagaccacaattgaatcagtcttgccaccatttgtcctgtccactataaggcattgaatggtaaatgaaagaaactagtgtcttttattcagcctagttctcttcttgcacacatgtttcacagaagggtacagctcaactcttaggggaaaaatttctaaggaagaaagaaaaaaatgaagaaagacattttcagaaaccattcccttagtaaataatgagaagtcttagagaatctcttgtgtttctctgatttgatagagaatgatgtttcagctttggtatgggaatgactggtggagtcaacagcaagaaaacgagactcccagtgggagggtgtgtactgccaagtactatgtaggcaacactgaatgcagccaagaggcggccttccactagagaaggcatcccgctctctaatcatgacgtccccccgggctctcagagggcaaaacttggaccgaatgctgttttggtctaacacacattttctgggactgcacacttacacacacacacacacacacacacacacacacacacacacattacatggcaagtcttctggattagcaggagaggctgctgatcaaatgcacccctgggcttctattcagattagctttgaatgaaaacaacaccaactctgttttcttattttaaagatcacagagataatcttccttggtcacagttggggaaacagccagagggggtcttgttacctccagaaaagccgtggaagatatctgaattcctgctgggcctattggaccatcttttatgtttttagacagaaagaatctaccccagtgagattctgaaagcagctcctcccagtcatcctctcctaggtattgtttatagctgggcccgtccctcaaagtgtttatttttccgtacatgcatacatcatgcacactacctgattgctttgatcaggttaaggatgggagcaggctctacttgcgagtcttgtggcacttccatgcagcccgtgcccagtctcagcgaggcacttctcctgggtggttggtaagatattcaactagagacttgcttcttaaataatgttggaatcatatccacggttgtaatgaacgcctctgtgatttgcatttaaatagtattttcatccagagatcacaaagaggaaagctatcttaacatcctgactctaattctctgtatctgaaagccagtctgtgtgcaccacgtacacattttccctctaggtctctttcagatctgtgtaccctactgatcaaaacaagcgtttgcttgcattaggatggaagaccccgacagctctggcatgcactggattctctcgccgcacccgcttcatcaacctggatccccatgagctctgattgaaatgcctccaccactggctgggatgtgagaggcactcccagatggtgtgctcagtgccaggcagttaacacaatcatttcttgggttgtcaatgaagccaattggatctggaaatgattgagaggcagtaaatatagacccccaaagtcaccttagcagtctctttccagagtacagttgtgcttcgaaggactccatgcaatcctaaggctcactttccaagccctgggaggactagagagacaaagggctggctgggctcagagacaggaaagggcacagaagtcaacatcaggccctagctttcagccccactgatggctgctccatgctgattcctcagtttacccatgctgcggctctttccacctgactccaggctttttgtttcttttcatgtcattcttcatcatcttgtggaaggatgttttttcatattgtacagttgaacttatttcatcatcaacaaatttttctctttcccatggattctttaaaaggcgtcttttgaagatttatttctattcggatgcaagcttttgtttaaaaaaataaaagagatgtaaatatggaatgttattgaaaagatcttatcttgcttttgacatgacatctaaaaatgtgtttaaaataaagagcaagtgttgttcaaggcatgtatcaaggcagttggcttcctgcagtgagagctgggtagtacttcgaacacttttctgcccctatgaaagcctctcacaggttaggcccctgcgacccagtgtcctcctccttaaatgtccctttctgatcagccacgagagggcaatgcagggcacttggttggctgccttggttggattgcagttggcaagttactttcagtgagggaagctactcagactatgacagtaattatatcagtctcataaaaaccctgctctccccaacttgctgctgccctttttcctttgctgcctgccttccttcctttcccatacccctggccattggctttgtatttgcagataactcactcatgatcctataaggcagagaagagtatgtgaaattaatgtttgcattttaaactccgaactagaataataggttgtttctagggggaaggatcttggagatcatcaagtttagcctctttaagatgaggaaacctaaattgggaaaggtggcctgactggttccaggtcacacagtatcacgggtaggctccaggggcatagacattctacaaatgcctacattttctttatccagtcatctgttgttggacagttaggttgcttccatatcttagctattgtgactaatgctgcagtgaacatgggagtgaggacaatcctttgggatagtgatttcattttctttggatatatacccacaagtgggattgctagatcccatggtaacattttcggcaacatggatgaatggggagggcttcaggctaagtgaaataagtcagacgtagaaagacaaacactgcatgatctcacttatatgttgatctagaaaaatccaactcataaaagcagagtagactagtggttgcctagggtgggtggagtgggagagaatggggagatgctggtgaacgggtacaaagtttcagttacgtagggtaattctggagatctaacgaacagcttggtgactgcagttaacagtactggatagtatacttgaagtatattgagagtggatcttaagtatcctcaccacaaaggaaagaaaagaaaaagaaaatggtgaggaggcgaggtgatagacatgttaattagcctggttgcagtgatcatttcacaatgtatatgaatgggaaaacatgagattgcacaacttaaatatatacaagttttatttgtcaattattccccaagaaagctgaagaaaagaaatacaataagattagggccgaaaacaaaggaaaggtagacataggtaacattttcctgtcaggaacacacaaacttccagaggaatttgggaaagaggagatgactctgtgggaggaggctcagccgtagtctggatggtgatgctctgttctacgcacagtagcctcggtattcagccagggacccaggagctattgaataagccatgactcagtgtttctgtgaccacttgcccttgtctttctaatgtttgcttaatttacaaaatgatgatgttgcgttcctctcccttcattgattatcactcaaaccttgtaggagcctttacctgcaaatcattcacacactatgtggcaagggctggtgagccctgctctttcatcagctctcaacctgggaagatcctttctctattggggcaaataagcaaaacaacctaaaaatgcctttacacaggctcatcctcctccttgtaatgctctttgccccattcatccattggttgactgctatagcttcttctaaactcagctcaggtgtggccttctctgcgtctctctgagcatttctcctttctcccagttccctggattaggcaccgtatcagtcagaaaccactctaggtataacagtagttggacttggttgcacatgtgatgcaagggctgagaagcctaccaggagagggtgaggcaaccaagggagtaaacaatggtggacttgactaccctattcccacttccacacactccatagggctggagggacacagggtgagaaactgcttttaagtaggggccaggccaatccagcaagtgctaggaccatggaggtaggggctggagccactgggagacactgcccatagatagtacccaaacagaagtggggggtgatactttctcctactcttccattgaccaagacagtgctgaagccagagggagaggaagcctgggaattatagggaatgcagtttctggatacagagcaaggcagagaatgttgggaaatgaaggggacagatacatgagtgcccgcacctcttctctggactcttactgcatcttgtacttaaccaccctcatagtagtaactatagggtgtccttaacatcattcagagcaggagtgttccttctacctcaaggacctagcatagtgcccagcaccaggagatatggaaggaaggcatgcataggtttgggaaattgtgatatgccatggaaatgcaagtcatgattattaagatccagccaaaagcgtgagctctgctgaggatgacagttatagacctttcttcaccacatctaacagatggctcagcccctttccgtgatgctatcctcatttgcagacttgaaaactagtgtagttaattaaaataatatgagtgaatgaaatataggtgtagggaagaaagaacaattctgcaaggagcccaggtcgaagaaaagtaagggggaaactatccatcgaggacaacacagagcttcttatgctaatattttctcaagaggtgagactatttcctggcatcatttgatcaaggcagactctcatcagcccccaaagtcatagaagtccaaagttccagaatgactcacattcatttctaattctgcattggaaaatttctattagaaatcgtgagtgttcatttaaaatgattgtttttttgtattgcaactgctttctaccagtctagttaaccctctagcaatgcaaatgttgttcattcttgctacacgaagacaaagagagtgtttgccaatgtctccataagggaagggagcattgctttttgtttcttctctagttgattgagtttgaaaaggttagaaaagtgtgtcagtcttcagactggaaactctgagcatgggcccctctccctagtctgtgccccaccttgcttggcttcctggccatgtgatggacaataccaagctaagcttctgctgatggaaggagtgacaagtctttgctctcagaagtgaagggctgtgatttgacaaagggctttgaaatattcttatatataaagcattaatttcattaatgtaatcaatgctaaagaagcagaccaaccgggccctttgattcttcccaggctaaaatctgttgggctgatgtgatataccaaaaataaaatagtacccctctccatacttcctgttgtccacacaggaatttattggtctgcattggatttactctctgatgtatttgtttatttggggttttgtttgtgtaagttccatgagaacaggggcttagcacttaaaaaatactttactgctctgtttctgaatctaagaacaagcacacagtgggcgctgaataaatgagcattgtacagaataaaaagtaccccagacacctgtcctacttcagggcaacactgagctgttagttataggtatctgtccagttccttgtctgtgctcataccctcaagtacctaattcaaaactgaagaagaacttgggctgccttgggaccaatgactccgcgctaacttgaattaaatcaatcttgtcactcccatctgcctgcctccatgtcatagtagattaattgcaacataatataaaacacatttatattgcatcttcacaatagtttcagggtcctttacagtcttacaatctaattaagcggtagcttcaaacatgaatttctttagtattttaaaagcgtaagttgagcagataagcttttttttttaacttccctattctaaaactgaaagaccagctgattccaaagtccctgagtattattaattaccagtggctgcaatcaatgcacaaggcttgtctagaaagctatttcctccttaggtgaatggttgggaatacaatatatggtaatcaacaatttgagagggctgagcatggattgaggctgagaaaaagctgggacttggcattgcatctctcctgtgcagatggcagagaataaatcttgactttgcaaggaagataaagcaaggtggaggtgttttcatcgcaatcgcacagcacataaatggcagagagaagaaagaaacctcggaacacgggcttcctctccaaggacagctactgctgttttggagaaagcttatctgctcttatttcaccatgagagaacttctgtcctcaagagccacggaaagggtaccagaaatagatgagagcccaccaacaaaaggaatgatgaagtggccctttaaatataaatctctggcacccccaaactctctggatgttcccttacgtattcaaatgagatcgcagcgtcagattggtatgcattaggctggtttcaatgaaaattaacatgtaattgcttcaaatgaagtaagtgaggaggtaatctgttcttaaattggattcccgggattttgtggtaccataatgcagctgtgaaatgaaatatattttaaggatgatgtcctcaagggggtgaaggggctgggagggggaggagtagagatagatagtgtatagtagaagcgcctctccccccagcctgccacattctttctctgtctcattctccagtttccagcggatgaaaagatgttctctcatccatgggtggcccccatgctctgggccctgggacctgggcagacagtgccccacattggcatcagccggtctcctctacttcttactgtgtctggagcttattcccagaggctgtagctccccagggctgtagctctgtggtcaccctggacactggatttgtaaggagaaggtgctcgtcctgcaagtggtgtctactgagatcatcaatggctgaagggtgcactgctacagttgggcaaattttccaaagcacactgtgcagtaagaaaaaccatcactccttgtactcctggaatggggacatgtgcgcttgacatcatgactgacccttctgatatcaaagagtggagctggggtcgcagcagcaggaacagccaattccattaccaccaccggcctccacagcctgggttcagccagaccaggcacccctgccagcagtgatgatatggtctgtgaagtctgaagatgagcctgggaataattaaccttcttaccgttcaatcaggacgggaagcagctgggtgaggagtcagtgcaggttaatgcattaaattgtttgcctttgccatcctaggctgaaatgggattttcagtcacaatggaaataagctggcagtcttctggtcccgtggcatcacgcctctctgccaaagagccatatctgatgggctttggggaccttctgcaccaaggctacagaagggcagagctgttaaatgaaatgcaatcacctggcaatgcacaggcagtgctgggttagggttcacacagcagagcagtgccactggtctagaccgagtccccatcaagggctagcatgagaatggcatggctgccttgcatcagctcctggggagatgcagatttataacacgctatataaagagtatatgttctggtgtaaaaagcccccatcagagctagagagaagggaaattgacaaatctcagaagaatgcgattctgggcattctctattgcacgcgaatcaggacccccgtctgagccccccgcttgccttccctcccagtcacagcttggttctacagctcggctgatgattttttttttttagttcttgtctttgtttcctcctgtttatgttgctattttctttctgcacatgttgagcagctctggctttaaaactgatcagagctcatggctccttcaaatgtagacgttgtattgctacagtctctcaatatatgggaccaagatttttgagagaatgccagaatgtttctgctcttcccaggagttggtagacttagaaatttgaagaagagaaaagggaaaagaatgagagtgaggggtgacaaaactcagtttacccgactgagtttaggtctccctaaaaacagtggcctgagacactttagacccagctaatggcttttatttcctcctctaaggttgcaagagacagtgtctttgctgtgggcaaaagagggaccagactatgaccaatgattaaattttgaatcactccatataaagaataggacctcttttgaagaccaaatctgtaaaccacattggataaatcatctatgttgctggctcctttctttcttcatctggtagtaggcatagaatagtatttgcctccctgcttagggttctgcaaggattagtaggcgttaatatccacaggagtccccagagagagatatgccaatagcaagaaaagagagcttagcgtccttttctagattctccgtggatgtggaatctactgtacagtttatttgtcgtctgaaccccaaggtgcctcttggtagagtatgcataggctgctgcaagcttagctctgctggaagaggtgggatggaatgtattttgtggggagtgcgtgtgtgtgtatgtttgagagagagagagcacgtacactcgtgatttttccatgatctaatatcttgaattaatcattgtaatgcctttttctgctatcaaaatatgtccagtggtcaccttgatatgctcatctggtttaactctcctcaaagtttgcagtgttcacaggagaaaagtagaaggggccagcggtttcattcccattttagagatggggagggtttcaccgcaggagcctgaggatatgcaattcatcttaatcactaaagttgtctcaggcaatgacctctataagcccttcttccctggacctcatttgctttgaatatgaaatcagggtcagggtgttaatgtcctactcttaaaatgcaaactaacgtcaaggtctaagtataaaaagtaaaatataaaacaaaatgcataaagttgtaccgactgtagataccacagtataacagaaaatactgaaaaaaaatatgaatctcgtataagactcctggggtcaacagaggcgtgatgaaatgcaggagatgagggacaaatggaaaatgccccagctccatttatttaagtaaaaagactatgaagtacagaaaatatgagtgaaaagctggttcattataggatcctgttcccagctctattcttgccaatctccctttgacctaagaaatcctctcctgtttctctcttaaattctacctcagaacctttaattctcattttattttcctttcccatgagtcatttgtgtcctcacacagctctgtgtccctcgattccaatgggcagacccacccctctgttcctcccccctctctcgaaccagcctagactattttgccaatagttttcatgcataataacttaagtgcatcacttttctacaaacatgttatcattagagttcaattcttctgctcctagcctttgtgcctggtaaatatacttctttgacgagtgttttggaagatggctccattttatgcatgtgcattagtgccaattgcacaaagcagaaacacaaattacctgtattctgcagacagatctaatcacctagacaccatgggctggcattcattgcagcctccacctctatgcatgaaactgaaaggggagcacctaaactgcctattaatttgaaatgtaggcaaagtgctataggcgctgaattgcgtgtttaggaaagctgtagcaagccattgtgctaggagccgtgcactcggtgtgggcctttgctccgaatagacagggcttctctttgggaagatgtagggctggggcgctgggaccctgccaaagtgatctctgcctgagactggaagagaaatgagataaataaacaagggaggccaaagtggggtgtgccccctggataggacacttggaggggtagacgtggattttccccactatggtgttctgtaagattcttttccaactggttttatttcaacaactctgtagtcagcaaatcggcctcccctggggctgttaaagtcaaatccaggaggttttcataggaatgaatacttgtaacctaaactggggctgcgcctactgtcagagttcgtgagttttttaaggatgcctgaagatgtgcctcaactacctggcggggaggaaaagaagtcccctctgtaaatgagctgacacttgtctgataaaagtggtgcctttggtctgatcatctgaggacaaataagcagcagtgccacctcataaagggaaggggtacctcagagccccaggggtgtcctgagcaaagggagcactttccacaccagctgtatttgggaaatctctcagccagggactcacccctttctcccaaatctcctgagctccttagttggcgtttctttaaagatacttaagtttgccctgttcagaatttttctgggtttgtagcttgtcacagtggtgcccagaattagattcctgttgccttgtctcacacacactcacacacactcacacacacagactcactcattcatctaattggaaacaaaaagagcaagggagatggaaaacatggactctagttgttctccttcctcgccacgttgaatgtatttcctcatgctccccctggctggcctcctcctggcacacttttcctatcttctcttctgtgcatctccccgtcagccttgcttctctgcatctcactccccctttgcttctctctcttttctctcatctgcaatgaggctgctcaactgccagagggtcagaactgtgagggatcagcatgagggccacattgacaaggaaagctgtcatcaaattttacagcttcatgtaaaatgcactgtccatggcaaggacagagaagggactggaaaggcacagggggcagtgtggggagaaggggtagttagaagagaggctctctcgtaggtgaagggggaggtaaacctacgtgctttctacagaaaggtattcatggaggcaaatctgccatcttttctaaacacaaccatgtctctggaagcctcactaggagaccaacaattaataacagtgtcagttatggcatgtctgtgtggtccattgcatagaacgacagaggaagctgatccaagctttgagtaccaggaagccaagggtagcaatgtggatgggcctatggccgttctgttttcggcgagagctagggaaatcccctgccactggtccttcccatacacaatgctatatgcgcatttgatgagccagccaacaggtgcctgagtacctgccgtgagaccagctggcaatagctcctctgaggcacagcagaatggaccgtgtgctaaaggcatcaacagcctgggcaggcaaacaggaccagcccaggagagtccattagagaaccacgcatgtgccggttactgaccaagagttaggttcctacgtgtgcacagccttcccccagattccattccttaggactctgcacccatcccatcccactttctcaggacagaaaccacgaggcagagttgtaccttgccttagagtgtccgtctcctggagaccgtcagtaggatccagtgcctgctttgtaatttagtagctttgtgacccgaggcaatttattaagtttcagttcccttgcaggtaaagtggagatatttttgtttactaccacacagagtggccgtgtggctcacataacatgatctgagtaaagtgctttgcatagtgcctggcacactccagtgatcaataaacgttagtcagggtcattattgtgctatgccccttcctttctgctattgcccctcccatccccggatcttcgatcgggccatgggttctacttcccggtgtctcctgtctccatcccttcctgtccagcccctggggccctgccctccctgagatctcagcagccgtggctgggctggcttttggtggttttgtgagtgctctcagtctgcagggagagacaggctccaaaacacaggtcccagcacagtgccgccctgttggaagctcttggcacctgcgccttagattccttaacataacttaaaatgcccttcacgaaagtacttctcttcacctgtccaggtttgttgcccatctgcctccccatttctacccaaatcctactcagcagctgctcacaataatgattctcagttttgcacatcagaaaaagttgtggaaattgttctgaatattttttgtgtacgtgtgtgtgtgtgcgcgcgcacgcgcagggcggggttgcttgggtaatttataaagtacaggcatttatataaagctccacaatggctgagtgtggtgtctcatgcatgtaattccagcattttgggaggccaagtgaggaggattgcctgagtccaggagattgaaattgtcagcctcagcaacataacaagaccctgtctctacaaaaacaaaaaaacaacaacataaagaaaaatagctgctcctggtggtcctagcttctgtactcctaggtactgtagctagcgccagttgtctaagctactctggaggctggttggaggctgcaggggtgatgattgtgccactgcacttcagcctgggtgccagcatgacatccatctccaaatgaataagtaaagcaagttctacaggtgggcctgatttgcatcttgagttctagagcacaaccttcccagacacaccctgccttcctcacactgcccgcatatctgtctacactcagtcccagcaaacgcaaacggatgggctcacagtggggatgcaaacaaagatgaggcgactgagtgagtgaatcaggaaaggatgttttcattttattgagtgaattagactaagtcaaaccctcccttagagtgtaaagtagaagataaataatgtactggtgtgtgtttgtgtgtgtgtgtgtgtgtggtgtggtatgtggtatatgtggtgtgtggtgtggtatgtgattgtgtagtgtgtagtgtatgatgtgtgtgtggtggtgtatgtggtatgtggtatgtagtgtgtgctatgtgatgtatgtggtgtgtggtgaggtatgagtgtgtatgtggtgtgtagtgtgtggtgtgtgatgtgtctgtgatgcgtgtgtggtgtggtggtgtatgtggtgtgtgtggtgtgtagtgtgtgctatgtgatgtatgtggtgtgtggtggggtatgaatgtgtatgtggtgtgtagtgtgtggtgtgtgatgtgtgtggtgtttggtggtgtatgtggtatgtgtgtcatgtggtatgtggtgtgtgtgtcatgtgtagtgcgtagtggggtatgtggtgtgagtgtggtgtgtagtgtgtggtgtgtgatgtgtgtgtggtatgtggtgcgtgtattttgtgtgttgtggtatatggtgcatgtgtgttgtgtgttgtgtatctgtgtgtgctgtgtggtatgtgtggtgtgtggtgtgtgtgtggctgggtgtatgctgtggtatgtggtgtgtgctgtggtatgtggtgtgtgtgcgtgcatgtgtttgtatgtgtgtgtgtgtatattgtgtgtgtgtaagagagatcaacaggggtcccaggcaagggggatgagtgggctgttggcagaggaagaagcgcagcccagcaaaggtggagcctcgctttccataagcagcttgggtccccaggcgcccctgcgcgatgtgggagtgggagagactgagtgggcgcaagggtctcgccacctgggtgtgtgaacgagtgcagaaatacaaacagctccgagccagaggatccttagtccatcaattctttgcagaagaaaagtctgatggattgaaattgtcacacaagaacgctgtgaacaatagcagggagatactgtttctctccagcccagctgtggtgagttacttcttaatggcaaggtagggagacacacaccacggacaatgctgagggtgacaggagatgcctgtgccagttatttattatgggagaggaaggtgttccttctactttttttccttccatcacccccttcttttctgtgataagtgggggctgagctgtttgtgttatgcagaggctgacaaaatgaggcgatcagattggaaatcaaagctctcaccatggctggcagtgtgcggggacttcgcagccacctcccatggcgggggcaggaggagggggaggaagcagctgctgtcatttctcccctagcagttgtttttggttttacttttatttctcccaagaggagaggagctggagagggcagccaaactagcacaagaaagaaaaggagaaagagggcaagaatggaaatgcggaaggagaaagagccctaccaggaggcaaagggagagggaagcgagaaggagggaagaagcctccagaacgtgcctttttccgatttgtgctggctgcgaccttgcagcctgtttctctgccagctgcccctcctttgctgtgagaggtgttttctgtgacccgcaaagcgtggtttaatttacagggtgagttggaaatgattcaagcatctgctcctttcaaatgttgggaaactgaggcacagcacattaagaactatttaacttgcttctttcgggccttattgtcagtcttttttcttgagagttccagaaactatttccatctccagctttcaggatgaataacttattcaggcctttgcttttctggtgcgttctcccaaaactcctcctatttcaaactgccccccaaagtccctgagcctgagtcttatgggttgactctgccctctggtggatcgaaaggtggtgaatgaggcagaaaagggagctcgttccagaaaaacataccttggcaggcttcccaggaaagtctttggttaaagcaacccgaacccaaaatgaatacagctcaatatgctgtgatgtattaatatcctgataagcgagtcagaatgtgtttccaaatagacctattacataagtggcaataaatactaacccatctctcaccttgctgcggtgagcgcatagagagggatctgcagtgtgggattccaggcagtcttggcgatgctgaccttctgacggatggggaggcctgagccctctataacacaggtcccctgtgacatccacatcacacaatcgtgccctttgcccacctttttaatgactttctattttgttttacaaccagcaatctgctgcatgtgctggtcaacagtatctatcttttctgctgtggcttgctgcctcggatgcttttatgggcattgattccctccactgcttccccaaagaggttcttttccttgagccagagcggcattccggcggattacagtgtctgccactctgctctccgatttattgccatcctgggctttagtctccctacattcacagccaagcctcattcattttgttttctggggcgagcaaattgaagaagttgctattaataggagaaagagtgtcatgccggcagacttagtagtgtctaacgttatagcctgcaagtcccagagccaagctcttgtcttagatccacccttccccatccaagggactgaaccaggtgggatgctggcctgggcattggctctctgaaagatttacacttttctggcttttgtcgacaaaggatattctcatatttgggcactctcatccatatgtcctctccttttccctgtgaccatcagtttacatttggcagaaggctgtctggggttgtagatgaagtctgagggcagatggctggggacaggacgctggagaggagaagcacatggcagtggtataggatggtttgcttctcagctttcccagacactaaagtatatgaatccaattaaagttgttctgtgagtgtgtttttttttttacattgataaacatgtttgctaatcatttatcacaaattaaatagtagagcaatttctaaacaatgtcctacagataatgaatgtcttttgaatatgcatacacaatgttacatctcaactgttgctagtcctgtttactctctcagctgtagaatttagaggctgcctggggactgtagagagcaggacatcagatgttgcctctccagggaccatcctcagatctttgtggactggccccaggctgtccagatgtatatctccttcatgcagaaacaggagcctcaaagaatcttccagtgggttatagttgtgggtgtaggagttcacccaaccaacttaacttgccaggtgatcacacaggtacaagaggctgataaggggctgggcatggtggctcacacctgtaatcccagcactttgggaggctgaggcaggtggatcacgaggtcaggagatcaagaccatcctggctaacacggtgaaaccccgtctctactaaaaaaaaaataataaaaaataaaaaaataaaataaaattagccgagtgcggtggcgggcacctgtagtccccgctactcaggaggctgaggcaggagaatggcatgaatccgggaggcagagtttgcagtgagctgagattgcaccacttcactccagcctgggcgatagagcgagacaccatctcaaaaaaaaaaaaaaaaaaaaaaaaaaaaaagaggctggtaaggtcagaaatcactatcgacagtgtagaaatttttctttgggatgggttggtgtcacaagtcccagcaggttattgagtgaacaattctctttagaaagtgccgctggaaaagtgtagtttgcaaaagatgtgtgtttgtgtgtgtgtgttggtagggtggatagggtggggtctattggtcatatattctagaagaggaatttggaggtggctgtatagggacttggtatccaaaactgtttgcatttctggaagagcaatgttgtatagtgcatacagctgtgtacgtattgttactattgatgctctaagtgatagtttagaaccaacttaggggatagttttcctgtgtctcacacatatattgattcagagtctctggcactatcctcagtaaggtaacaaagggaagcaaacagatcccaggagccctgagttgaggtcttgctgttcccaatcagccgatgtatcagaactctgggtaacttgacccagtagcttaggccctgcattcccattctggctttgaagacaggagaaatgtattttaagacagaattcctaaagacagacctcaggtgggtttttcatgcctacctagaagtaaggttagcttcagttaatctacagcttcctgtgggctctacctcaaagtcatggaagggaagacttcttaggaaataaaaactgatttttgtcattatttttcttcagtgcacacacagaatatctgtcctccaacaccagtcatttcaaaatggggctcctaggactgtattagaaagaccaagaagagcatacagtacaggaggtaccaaatggatacagcctcaacattctgagctttgccagaaatgtctgtctgtcttctcccactgtttcctcaattctcttcccctttttcatcttcacctacctccattttcttgagttttcttgtgcagttttggtcaggctttttattgagaacaacctcaactcctgccaatgactttacagccttcctctttctctctggatgttcttaacaggtttggatgaagctgaaatgtaaatgtatctgattcttaattagaagaattcaattccagagtctgttaggactttgggagtaggagatttgttttcacagtaaatattctcagaaggagaagggaacctagtctgatattcccagaggtgaccagtaataggaaatcatcttgacagatgaaaccactcgtatctagaaatcagatgagtagcgggatgagggaaagacagtgaagcctcggaagtgggagttggttcagctttgttagggagatgcaaggagataccacaccagtcagagaaagtcataagatcaagaggtatggaatgtggctctcaagtggaaaaaaaaaggaaggtaccgcattttccattctctgccttgtttttttaattcccgtgataattacaatgagaggagcaatcatgttgctaattttacttcatgcgtttaagttctaattaatactatctggttcttctgcgttctgctgaggtgaaatacagcatgctcctttgcacttacacctttctttctctcaagaatttgcataggaagtgaaggcatgtttgcatgtatcgtattttagtaattggcatccctgccttcacagttctacaccactttctagtctaatctcctggacctttcctctctccattcaccttggcaaaagtggaacagctaggggtttcaaacagccctgcccctcagagaatagggaagtctgatggagttgccggcagcagacctaagccgccagcaggctcttcatggatccccacagagcaagatgggagatttctcacggtgagaactgcacggctgaggccgcatagacattaccattgtcctgtacagaaaaggaaaccgaggcccagggtgatgaagtgacttgcccacgatcacacatttcatagcctcagatctgggatttgagatgtgtctctgcctccaactttcttatgatgatgctgtgagatatgaattatatgagaaagggctttgcatgctgtcatgtgcaaggaaagtttgagctattatttttctggttaattaacaaaaacattgtcatgaaatgtctgctgcattctccgttctcattttgaaagcttttgtggagcacaaaatgttgctttgtgacttctagtggcatagctcacatgtgctatagatgcacgcgtgttatgcttctggcagcccggtgtgagtaaccatggaaaacagttggagaggtgccagtgttggggctgagtgtggggccagctattgtctcagagacacctggtttaggacagatgcctgctgcagtgtgccttcacttcaagcaactgatatttactgactgcctgtgataatgaactaggtaccatggaaggcacaataggttgcaagaggattatggaaagaaagataaagaaaatacacaggccctgccttcagaattgccatatgggctggcaaaggttatgatggaaccctacgaaagtgcagccttgttgggtcagagggagccttgtgaaggaaggggtgtgtgggcgagtaagtagggaggggtgctgtagacagaggggcagtgtgggaaatgggttggggcatgggagagcatgccacactaaggaagctgcaggatcccagacctcaaggtcctggcatgttcttctgaactctttgagcttcatcctgaaggcagtgggaaccactgaaggctcttgaacaagtgattctcaaacagatttgttagaaaggtccctgcggcaaaaagagtgactggactgaagagggttgcgtgtgggaccaaaagagcaggtggaagaggccccccgctcccactgcctggtgttcagaagatggtccattgaagcttaggaaatgatttgagcttgtggttggaggttcaaaattagagagaatgcatgcagggaaataactagctcttctacagcctggctagagtcccttcctacagagaccagttaatagagagcatcatcaaaggcaccaagagtttccgtaaaggacttagataattatttgcccagtgttggttgaaggaaattactttggaatgaaccagctgatgcagttcaagtgcccgaggatacattcctctgcctgacgttttatacctgtgcgaccactgccccgcccccatctgctcccccaatccccgtcaggatcctgcctgctccttccaccagggtgggaactacagcagagtgaaggaaaacagccctctcctaacggcttcctttgtttggttcagacttggtcattgtactttgagagttaaaattgggtctatttctttctgtatccgtccggtgtttgtcattcaattgcctgtgcaggttctctgctttatttcatttaagtagctgttatcttctttgtatcataagctcctaaaatatagagtaaggaatatgttttgttctggagagtgaacactgcatcttcacaggcatatgagctcaataaataaatgtgtaatgttgaacatagtgatgtagccatgtatttggttacttggaaaataatagggaagggagggaacgatagcatccgcactcagaaggtttgtaaacattaacacctccatgctcctgcggagtccttgatactcttcccctcaatacttacatggaccctcattacaataagaacagggtggggtagagaccatttttccccattgacatatatgaaaactgagtcacagaaagactacggactcaggcttgtcgcaacacaatggaaaaagagagaagcaccccactggactccatggaaatcaagctactaggcatggttgctgcctctctcaaatatgaacaagcaagctgaggtgatcgcaggtaaaatatatgaatgcatggcggcttccagatggcagaaatcttgttaaaatctgagtaacacccagtgcattgtcaagctttcaaaatgttcattgcaaaatcttacaatccactcaccccagaaaagactattactaattttgggtcaaagaatcaggagatgctcgctgtcatccaaaatctttcttgaagtaagtagctaagtagccttaggcttatgaaagaaagagctgcacagacttaacctctgtaggttccttattgataaattatctcccatgtctctcccagcaccatatttatactcatttgtaaagttctcagcagaaacttcacttctacaagcccttccctgacccattagactaggctgggttcctccacacacgtctactttctgcacaacacccataatttcctatcataagaaacagcacacttctgcattataatcctgtctttctgtgcctctctgcatgagtctgtcttgtttgcctctgcattgaattccttaagagcttaacacaatacatggcacataggaggtgctcaatgaacatttggcaaataaatgggcatataatcccatcctaatgcacttcagttcatccacatctttggagataactgcctgaagtgaagtttaaggggtaagttagaagcacaggtcgggggatggctgtgagttgaaaggttccccgggggacctaaagaatgggccacagagacccctgacacacagccctccctgccagccctgtttaggtggattccagcaccttaagagcatgtctgtttatatgtctgatggtgagaacgaggcctaacgtatttgggaaaggcaactcccaggaagaggacgtttccatgcttctgtttctggcagtgatggacttccctgcccccattatctcttcaccctggcttacttctttattgcttccaaatatgatttttctcctgccattcggctctgcttatctgctttgctgctgatgggagcatacttcccagcctggcatttgagggcagctacagctgactctagtctttcttcctcggtgttctctctctgctctcatcagaccaaacctttaaacatctgccccagagccacacccaaatctttattctttgtttgtttaattaattaattaattttaaacagtctcactctgtagctgggactataggcacatgccaccctgcccagccattttttttctttttttgtaaacagggtctcaccatgttgccctggcttgtcttgaactcctaggctccagccatcctcccaccttagcttctcaaaatgctgggattacaggcgtgagccaccgtgcctgccccatacccgtatctttggatacctttttcttcctagggggaacaccttctcacctcttttctgtttattcagctgatcttttgtttgtttggttggcttttatttatttatttttttatttcagtaggttagtggggaacagatggcatttggttacgtgaataagttcttcagtggtaatttctgagcttttggtgcaccttcactcgagcagtgtacagtgtacccaaggtgttgtcttttatccgttgccacccctgacctttttccctgaggccccaaaaaacaatgtatcattcttatgcctttgagtcctcatggcttggctcctatatatgagtcatataggaatatatatgactcatatgacatttggtttttcattcccgagttacttcacttagaataatagtctccagttccatccagtttgctgcaattgccattattttgttcctttttatggccgagtagtattccatggtatatatatatatatatatatatatatatatatatatatatatatatatatatatctcacattttctttatctattcattgattgacaggcatttgggctggttccatatttttgtaattacagattgtgctgctatatacatgcgtgtgcaagtatctttttcgtattatataatgacttcttttcctcctggtagatacctagtagtgagtagatctacttttagttctttaaggaatctccacactgttttccatagtggttgtatttttattattttattatatcctttattagtttactgtccacatgctcctgccacccactgaactccccaaatcctcctcccctccccacagaatgtccctcgttagtacctaagcctggctggattgtgtcccctcacccctgtgtcagtgtcccaggagacagaaatgttcttggcactccaaggtctcttaggccagggccagaagggcccccactcccggcttctggctgcaggctctaccttgccccgtgtcctctctcccaggggcagggctcacctgtggttgcctgctcccagtgcctgactacagaccaccctccatctttctagcaccttcctttccttgcagcctcccaaatatctcacactccctctccagaagagttccttctgatcacaaagcatttgtgagatttacacataagattgcctttgttccagttctctagaggcagattctgggatacggatttgtgtggtcatgacttattagggaagtgggcctaggagaacaggcagaaggtgtaagggaagccaggcaggacagggcaagaagccaagtggaggctcgattttaggcaaagacccaccagggtgaccaggcccttttacaactcccacacaggccacacaggctactgctaggggccaccctgggggacgcaaaccctaggcacttgtggctgtctgtggaggtgggggtgcaaacagagtctcaggctgggctgtcagaagcagaagcacccagaacccagggagcacacagaaatgatggaaggggccgaggggcctgggctgaaggctgacttcctgctttgtcctgcacagggagagagagacagggcagtggctgtgcaaatgatgaggcccccatcgaggtgagggagggctctggaatgacaacaggccccagcaaaggtagtgtcctcccactgggagctttcctctttctggggatgcatcttgttccccaaggtgccacgtcacctaggttaactatctggagagatccagttaccttttctgcacttaattactcacattttcttgttttagtgagtgttgtctttccagaccctggggaccccttcctctcagcctcctcacagtccactagagagaggagaggcttctgtgggctctacaggatagggacagagaaggatgagcctccagcccctgcagtgtgtattgcatgttggtcctgctctcctgtcccacctgtgtctcacctccgtagatggtagaaatggagctcagaagccagcagcctctctccttggaggatgccagtccactcacctactgtgcctcactctcacctaggccccaggcagtcatgtgggcactgtgttaccaccaaaggtgagaggatgtgttgccaaggtcacttagtgagagaacagacaaggcccacctcgaacccaggtgtcccctttgtccctctggagttctagttgtatttgacctttcttcctgtgaactgtggggtttggatacagcagagactgtctctttggttgtgaaccagattccttctttccagccactccctcccaccacacatggccacacatgtacatcatatgtgtacatggtccctggggcaaagatcaggtggacaggcagtctgcctgctgcccagttcgcacacatgggtgccaggcttcacacacactaactggaagggaaatggcagctgcatgtggtctggggtatgattttggtctcctaagctgtgatatttttttttcctcttcaagtcatgttcaagttctaagtatggatggtgctttagggtgataggagtgtgctagaggcaggatccaggtcggattctggggtttgctggttaaagtgtgtcttgacaaagaattggaggtggaactagccccagagatgaagccaggagtgacacacatgctggcttccccagaggccagtgcatctccttcatagtcgcactaggccttgggcatgggaggagcaaggtaattccagccccttttctagtgtgactccatgtggctaatctatactgttcttcctagtttgcctgaatacatcctggtttaatcagtgtaatcgcaaaaagtgtctgatttgaacaataatcagtgtaacaatcagtttaatcagtgtaattgcaaaaaaaagtgtcgatttggacaactgccaggctggcctaacttgtccagggactgaatgaagccccatttcttcatccagtgtgtcccatagtatggggtgacacacactggccagtgagggcaggactggagacaaagcaaagatggaggagagcctgcagatggatttgtttcagggactcctgtttcttcttcgcagctccttccctgccaaggagggctgtcccctggagaagaaagagacaagctcaagtgtgctaccatctataaccatcagtgattctttgagctggcctttgcagagttcttcattttggttccctgcctgctctttgtcttcaggataaaatgcagactctttctttcacgagggcttattgcacaacgaacctgtaatagtcagggatcctacagggaaaagatggcatcctcaaactgggtaatttgagcagagtttaataaagtggatatttatgaaggtgcagccaaggtgtaggaaaactgtaagggacagtcaggaccctggggccacgaacaggaaggcactgttaacacttttaggcctgaagggataaggggaagaggtcatggctgccaccagactttgatggagggatatagacagctggtggatggaccctgcttcctccccaaccccgactcctgccactgcttcccagtggcagaacaacaggaggccagagggcagggagcctgtccacgcgatccgtgctggtcggcctgcactgggtggtggacttgcggacacacagagagcaacgtgctagcttgctggctttgtccctgctaaattttctcttctacccatgccttctattccataagctccccgtttccatccttccacaaactcgccagtattttccccagctcctttgtgctttgctcatgctcctcctactgctggacatgctgcaccttactcctccttgctgtttaccaagctctttccaaccttggcagccgcctcaacacttaccaagatccaaattgccctgaaagcaagcacgagtcatgtgtgagggttcttggagtagagaaaaaaattgtatctacttcctgccttcccagagttccacatatgacaaaaagataaagcatggacatcctgcttccagtacacaccaagataaagtatgtctggaaaacactcatgggggaacagcaaaattttgcagagaaaagcttgccggtatatgaattaatatttaagcttgaccttggtgtggcataggaatttgtctaacaaacaataaggaagggcattccaaataaagcaggaagtcacagaattcccaatgtgaacagaatgtacaggaaacagtgaaaagtggtccggtgcacctaatgaatgtcatgttcgaagcagtgtggggtgggagtgtgtattagtctgggttttccttttcaacagaatctatctatctatctatctatctatctatctatctatctatctatctatctatctattctaatctatcgagagacttataagaattggctcatgtctgtagtgtaagtttcagtctcagtccaaaggcctgagacaaaggagctgatgcccaaggacaggagaggaatgtcccagctcaagctggaagagtgaagtgcccttcctccactctttcattctgtccagaccctcagtgtattagatggtgccctcccacattggggagggtgggtcttatttatgaagcctgctgatcatctcttctagaaacacctcacagatacacccagaaataacgtgctaccagctgtctggcatcccatagttcagtcaaattgacacagagaattaatcatcaccgaaaatgaggtggaactttgtagggatcactcactgaagtccaagctccaatggcagatggagtccagcgtgaattcccactgaactttcggcacttctgggctctttcctttatgaatggttggtctccatgacaggattccagagaccactcttctgtgtttggactgttttgaacatgctagggaaagaaaaggaaagaaaaacatccaggttacctagctttggtcacctaggggaaaaaggctccactgtctgtggctctatgagatgatgaagatgccccaccttgcccaggttaccttttgctagagtttagaatttagagttcttggctacatgtgtgtaacagagttattgaatcaaaaaaatggcttgtgggagccgtgacttacaaacaagatatgacctattgagcaagcccattcttgcttcagcatttaaattagtgttgggcttttgttgtaggtacaaatcaaagtgttgtgccattcatttcagaaaagtcacggcccaccaaactcaacagagtttgttttgagaggatactactgtatttgacagggacaggaaggacaggtggtaggtgtgcttatggagaattttctggaggtgcacagagcaaaggcttcttgatttatccctaggacattacagaagtggagggggactgcctccttgcacgattctcacacacagtgaccaggtgttgggggagatgtgtgcatttgtatttgtgagtgcaggttggtggggacatgcagagtaattatactcacacactgggcctttattggatgcaggcctcatggtcttttatctctcgggagtttgtgaaagatgggagattttaatcaaataattaatcagtggacagatatttattgtgtgcctacgttgtactctacacaatgttctgtagagacacaagtgaaaataagacatgatccttgcttttcaagaacttaaaatcaatcaagtcagcaatgttacatccctaagatgagaaagcagtacatgttatagactgtacaataggtttatttgttgaatttttacaataaacaaaagaatgtatttacatgcatgtttccatttaatcttctcattaaccccatgcaagaagagaggttatttctactgcaggtgatttaaatgaaacccagtggagtgagataacctctctgaggcctgaggggcatcaggaacagagctgggacattccttgtagcagtcagacttcagaccctattctctttgctctcccggagcctctctctgactacaactacctcctagcggtgtgggactcacagtgcagtgtgtgtgctgctgcttttggttttgtttgtttcctttttcctccccctaatcctttcacctgtatcataagtgtgctgtctgcttctacctaggcatgatgagccctcttactttcatagctaggaaagattccatggcctacctccgttttcttatgtcatgcaaaaatggtaatagttgggagacgtaagaacagtgtgcaatgtgagtctaagtctagtatttttgtctctctatgacccagatcaattttgtaaacttccacacaagtttagagtctaaaagaaatccagtagggtcaaaattagcagcctcagtagtgacgctttctcttacaataaaggagtaaggtgctagctgatatctgaatgttcagtgtcttcgtggggaagtatcctgttttgttaatttcttagtttcccccagagaacactttctcacaagcgcagatgtggaagatgtacacgccaaccccatggcagcgtgtgtgggtatttctgagccatttgcgtcgtgatgttcccctatgatgcttgaggggaggggcagggcacaagccgaatgctcagaggcaccaaacttaggggcagctggagcatttctgtgtgataagaggcaattgtgaccaggtgctgcgaagggcgaaagcacttattttgctgtggcttcaagcattgcttgagatgcgctgcctttcagacacagttaaagggccatttgatagaaggaacggttggaccgcacactgtctgcatccattattgccctcagatcttcaggcaggtgtgtttaagaaaggccaagcctggatgtttctctcttttttcaataatctatctccttattgcaacactctctttgcccatctttagaagattccaagcagacacttttgcttctttttttcttccaattcccaggttctctctctctttctctctctctttctgtctctctctctctccctctctctcccccctacccctctctctctatctctctttctcttttctcatcctaaatccaaaagtagcttcaggacctgagtccatactttcatggttctatttctgcggtgcacatcttgggcttgcttaatcatttgtttttgcttttcctctatgtgtaaatgcagcatgtgtaataaaacaactattcatcagagagatattcaggacacagagggttgcatttttagagcattggaacaataggtgcagctgcagaaaattacaggtatggcagtgttctttctctaccatactcgagctcccatgcatgagtgagcatgtgcacatgtggctggatcctcttttggccaaatacaccctgaatattgacacaggtggggcaccctcaataatccctgctcaaacagtataggcctattctctaaaagaagacacttatccaaaaaaggaacatggtgcagacagacacacacagactaagaaggggactgtggctcggtactgaaatggaaaacacatgccttttccaggctttatttctttttgtctggattcttccaggatgctgagtatgctaggccatgggctgtccacgggggccacacacaggaggggaaggccgcaggagggatgctgatgggaaaaccattcacagagacacagaaggctaatggccactgccagagggctgcagtgcggggcaactggagggcaacattgaagctggaggacagaagggagctggagttgcagggcccagtccagaatcctcaagggaacctctgtccctctattcttcatatatgtggcaggatgggcagagaggatgccagcggtgggagggcggtatatctggaggttgtggacgaaaggggagaggctttgcaggtctgatctgggaacatcctgcccttttgatcgcccatctcccacctcttgttggcctatgttacattgacttgtgactattcctccatatctgatgagcggccatctccagttcagctcacctggatgagtcagggacagtggagtttgaagccttactcactctgacttaatcaccagttaaccaccatcctgagagaggtgagataccgtaccgtgtttcaggagcagttttgtagaaggactatgtcaagggctgtctctgcaaagagaggactcgttgtctgaatgtcccacctccagagccttctctgtggctgagagagcaattatgctcattttcacttttctttttttaaccgaggagcgatgtgtcctctgcattgttgaggagactggatcaatgagacagatagatgggggcaggtgtgaggaggtgacagagttggctgccgaggtacctttgtgatccatctctgcagaagccggcattcattccgtggggattcagcaagactgatacccagcagtgacagtttggacatctaaacatgaccttggatgtgttcagaaccgcagctggaactgtgccaactcctcagagtagtacatcacaggagccgcagaaccatgctggaaattggctgcgttctgagtgctagtgcatctgcagacgaacctctctggccctgtagtgcggtgcagtgttgggggacggcttccgtttctgtcaattttcaataattagatgctcacaaggaagcccaggacagtcctctcgtgttcatcgggaggttgtgagatgccctcgttgtgggcatcaaaaataattattcaagcagtttagtgtttgtcagtcagcgtttcctgcaccatggccactcacctggtacttgtcagatttcagctgctggggaagaaaataaaggactctgcttctggtttccctgaacatatgggttacaggaaagttctctcctgtaacgtatcagaaaactgtttcataccagggtcctttcctagtgcctattcactctgcaactctcatttttgccaggaaacacacgtctaggttagaggttctcagggagctctccagaccagcatcagcagcatttggaattttgtcagaaatgcagcctcccaggccctgcctgggcctactgaatcagaaacccatggagtaaggtcccaggaatctcttttttatcaggtctttcaggtgattctgatgcacagtgaatttgagaagaactgatttagatgttcttttgggagcacctataagaacactaaatttggaaaacaaaacaaaaactggcatgaatcctgcttctacagtttaatatcagcatggtttcagtcaatatggctaatgttttttagcctcagctaattttgtctgtaaattggcaataagtgaacccaaccaagtttgtgagatgataaaatagtacacatagtgggctcatgtagtcaattaacattgaccatgaatgtgaattcatccagtccctgcttggacccaagtgaaggtcagagcagtggccacccttcagattattaatataagctatcctagatacattactagcaaagcaagctgcaaagtgtgtttttgttcttgagagatttcaaacttatgtcgttccaaattcatgtttcagacaaggcagtaccagatggcagtcatggggtctgcaaggagcataagggaaggtacacccttaggtgtagtaagagaggtgcaccctctatcgactgtagttttctccttcttgctcaccctcagagtccattctggatattgtcatcaaagccacaagaaaggcttggatcagttcaaacttcatgtgcattcaggttacctggacatcttattaaaatgcagattcaaatttcttatctctgagaggagacctgagtttctgcatttctgatgagctcccacccaagtgatgctgatgttggtggtttgccagccacacttttgtgtagtgtggtgctagctcagtgcttcttaaaccctaatgtgcacaaaactcatgtctagatatgaacttctagatgtgactcaaggaatgaccaggggccatcagctttggcattacctgggagcttgctaaaaatgcagaatccaaggccctacctcagacctactgaatcagcatctgtacttcagcgaaatccccagggggctcatgtgcaccgtaaagcttgagaaacatgtggagctggcttcacaactttgtttatttccatagaaatctgtggttggtttaaggctgtgttctcaccaccttgaaatccttattcatgcttgagcaaaatattctgtgttcttattttgcactgggccccataaatgatataagttgtcctagacacactgctccatattagtggttttgaaacattagtgtgtgtatgacccaactgagatgttgttataaattcccaaatattctgaatcagtagactgggggtgagactaagaatctgtaataaacctctcctgtgattctaatataagtagtccatgagcactttgaaaggtagtccccagatcttctccaagctaggccttcactcatttccatgctgtatcaggatggtgccagagagagcccacctctcatctgcattgccagaaaatgcaatgagctgcaaaaaacttgttggacacctgtgccaaggtgtttctttttgggcagtatttcccacaagaactctcagcaaactatccctgtgcacctaagtgatccttacataatgttgagacatttacataagcaaagcagaaaggatgcacagtacaggatgtctcatggggacagggggtctcctgaagaagcaggtgtgtatagtagcacttgttagaatttttatggtcacaaaccattttgagaatccaatagaagccatcacccatcctcaatgaaaaattcacctttgcacattatgagtctcacatagtaccaggaattagaagacttgactgagaggtctgacttctatacttctagctctcattccttggacaagtcatcaggctattcagaaccctagtgtcctgatctttaaagcagagaatgggtaagagtgtcaacctcataaatttgttgcaaaacatcaaaggagacattgagctgtaaaagtgctttgtacactgcaaaataatgtatacatttgagacatcattatacatcctatgctacattgttatttccagcattatagtcaggatcaggacactgcttgtaaatttagcctaaggccatggaacagacttgctgtagtaagagagggaaatgaatacagacagaaagacatgatgaggacttggcgagagttgctgggaaatttaaaagtgtagaaaagagaagggagattccacaattcaaggactccagatgcaaaaataaaagaaagaaaatctatttttatatgtgcagacagttttgagattttggaaagtggctttagtctagcagttaaccgaacatttctgcccctgggtataatgaagatgaatagcaatagtggtggtctgtatttagttttgactgcagaagccttctgtgggaatttgctattctgagatgagaggaatgatgtttagtagttaaaagctgggtctctgatctaacacataattattgtgtgacttggagaactagtttagtttagtttctctgctcttctaggctttttccaataaaagattcttcatagggttattataagtattgaatgacttagtgcaccctaaacagctagacataactatgaaggattatcatcacccaaatccttgagcaaagggagaactggtagtattcgaagtatccagccatcctgggcatgcaaggtacctctaggttataactgagatcgtatttgaagtggttctgtgctcaagtggtttgagaagctccgagcaacattctgaggctgtaatcccataagacctttgctgtgttccagaaaagtccacccctgacaaatcaaaggaaatgtatgtgttgggggaagggagaaagacaagatattctagccttgccatgaggacctccctctgatggctgctgtcgtctctcagtcccttgacgtacctgtctggtcttcccttcaggtgcactattgacaaccgggtcacccgggtggcctggctaaaccgcagcaccatcctctatgctgggaatgacaagtggtgcctggatcctcgcgtggtccttctgagcaacacccaaacgcagtacagcatcgagatccagaacgtggatgtgtatgacgagggcccttacacctgctcggtgcagacagacaaccacccaaagacctctagggtccacctcattgtgcaaggtaggtgggcggggcttggcggggagatctggctggccagcctggaaagccttcaggtaaaggtttgttctctgatcctcaacagagatgagttatccttattctacgcatctggggtccagggcacatttctggttgtcattttgcagttagaagctaaattttccagtcattttcattgagtggaactaggaattgtttttttcatttttgttccaataatatattttctcaggaaattatcttgtaattattgctcttcttggcttttttctcccctaagttttagttatttttgtttgtttgttttttgttttgttttgttttgttttttagatttcatccaattccaagactgtgttatgtttaaaaccagacttttaatgcacttttggaagtacaggtatgccatgtccccctccagccttgaacgaaagcagagccaaccaggatgcactgggcactgccctcagctgcatccttcacaagcacctgcttgtttccagctcacttgcgcctcctctcctctcccagccaggggttttggatgccatttctcccatataatactggtgtctgattctccctgttttgattccatcccaactctcctggccttcttctcctcccctgactcctagttcatgaggccttgtatgtttgtgtgtgtgtgtgtgtgtgtgtgtgtgtgtgtgtgtgtgagagagagagagagagagagagagaatatgtgtgttggttatgctctcttagaccctgggaatggagctcacctcttcccacaaggcagaaccagtcctggggcattcagacaacacttaacccggttgaaggattcctagttagtgagcaagagctggcatcacacttggccactttctggctgtgagaccttaatcaagttattaccgtgtctcagggttctctttctgtaaagggggtcaacgtgaggattgaactgtaaacgtactgacatagaaaacacgtagaagagggcgtggcacatacaagtgctatttcagtgttagctatggagctttcttttctcttttttaggacttttgtaatttttaaaatttttgagcatcttttacagtgggtcaaatatcttattttgtgatgtcagcagtatagcccctgagcagcggcatgccagatccagtgctggagccctttcccaggctgatcccgaggccctttcaaccagggacgtgtagctccagggtgacaaactcctctcctaggggctccttccaccagtccccttgtcggtgtgttcaagaaaagggtaaagaactatgggatgattggttagagacagaataggaaggaaggcagcttgagaaggaagaactgaagtgagccggaagaaggaaggggaggcctgctgtttgacagtaggggaaggcggaacttgggtcgtgatcagcactgttgagtgaggcagggtgagcaggactgagaggaggacacatgagaacaaggtgatgctggacctggctgtgggcagaacgtatgccaggggacatgggaatccttgatgctgtggcccaagtttggtcatgccaagtttttattatattttgcttactctttcttccccaaaggaaattacaatggctgtttaaaaaatgattctataaatgaatactttttgaactgatgcatgcaaacagcaattttaaagaaaatagaattgcatagaaggtatcagagtgtattacaaagagtggagtaggtattgccatgtgagatttttgtttcagtttgtgtacattttttaatgtaaaatacattttttattatggatagggaggccaaaaatgcttgagaatctccactctgtgggcagggctggtgaatgccctggtgccaccatctgcatactctaccaggtggtggtttggaagctattgctcagcccccctcctgtcctgccccaacccctgcacacttagtgttgagaaaagaatgcctagcattgacaatgagagactgggaactaggaactattagagatatttgctttaggaagcagggcctcatggaactggaaagtggaaggaattgtgaaaagtgctaatgtctccttgaaaactggatcatatttttgtcattttctttcttcagccacccccactcacacacacccccacacccctgccctgaacacctcgcagaatgcctgatacaaagtgaacatttaataaatgcttattgaagcaaatggctagaattagagccaggtgatcttatatgggctccaagagagacggctgggtgtttttgggggtgagatgatgggagggggtgagaggatggagtctacatcaatcttcactcacatccaagctaatggaaaatgtctaatcccttgctaggtgtttacatctgtgacttagctaggtgccctctcgcatgacacaccacctcaagtattggaatctcatcttgggctaattttcgaatgctgatgggtgtattgatctggaaacaagctgggttaaaaaaggcattggtcttttacacagactcagcccaagctaatccgctgtcgatatgcctggactgagtattatcgacactttaatgaatagaggaccatagttttttcagagccaaactgaccccctcttcaaagcgatcagacaaactaaatagagccagattcttgtgtttctgtattggaaagaggatgcaccaccatcctggattacaaaaaaaaaaaaaaagggaaagaaatatatttatcttgggatcgtttattataccaaacataaaccctaattcccctagcagaagctgactctctggatttgaagttgctattcagccctgagcttctggaataaaagttgggcatattaggttttcaaaatggtattatgatcctttaaaaaaagaaataaaaacagcaacaacaaaaaggaactaaattgatattctgcccatgagtatgtgtatttatgtatatgtagtcaccttcatatctaaataaatccacacagaaggaaggtagtggcatctcacagcattgcacaagctgcttcaggtctggggtatgtctttccccttactgtcaaatatcccatctaccccctagttctctgtactggattttcttcccctgtggttctgatccaatatggttatttcttgcagacagccgtgaggccaaggcgaccacatggagcaagtctctggggcaagctaggagcaaagggcatcctgggggaggagggtgaccctggagccagtgtgggagggagatggagggggaaggcggcagaaaggaggagacaagagaactgagccaagtagctacttgccagggtggctattttaaattaaatttaaattagctacaaccaaacaacatttaaaatttacttcttcagtcacactagccacactgcagtgcttccatagtcatgcaagactactgttcccttgtgttcattttgcattactataaaggaatgcctgaggctggtaattcacacacataaaaaagaggtttatttggctcatggttctgcagcctgtacaagcacagcaccaacatttgcatctggagagggcctcagaatgcttctattcgtggcatggcgtgaaggggacccagtatatgcagaattgcatggtgagagaaaaagccagagacagcagggacggtgccaggctcttttttaccaccagctttcgagaaagctaatagagcaagaactcacttgccccaccccctgcatttatctatttatgctccatccccatggccagacatctcccattaggcccccacctccaattttggaatcaactttccacataagatctacgggaacaaatacccaaactactgcactcctgtgttggacagtgcagagagagaacatttgtgtgaacttccattgtaaaaagctttattggatagtgctataaggggttaccattatggatcagcaggtgttaaagctagaatggctttccatggcttgaagggctaggtatattgtggaaaggagagtggaattttggaaagagaatggaaattttaaatagatggtgctcttttaaaaacaagagagaattgttgaaaaagatggagtaatggatttcctaggttagcttcaattgtttaaaaagatggagtaatggagttcctaggttagcttagacagagaagagtctggagtccaaggatgtacctgcaggagagtaggcagagttcgagggttggttaagtgtgagcatgggggtgatgactccaccaggacactgagatttctacctgtgagctcaggggacatgaatactaacatgtctaaagatcacatggcaaaactgattcatcagcagaggggaatgagttcagatacctggatttcttgactttgagatgccttgaatacttccttcaaatgtgaaatgtaagaaataccacccgtggatttgcatgtcctgaacataatctttttgtccagaataggggagattcatctaaaatttattaacatttaggtctaatgatttccatctctttgaccttagggttttttgcctaataaacataattaataagtggttctctctggagtctagcagaatattttattcctttcaccctcttaatcctgctaccaaaccgagcatattgtacatctgaaaaagccatactactgtctccattgttcctttggacaaggttacatcttggaaaacagagtggataaaacattcagtgggaatgaattgtttggcaagttaaggacagcttgagaagacgtctaaaaggccccgtctgtgtttctaagaacccatgaatggtggtagagcaaaagtgtgccatggttgtgtgcagagtgttaagaaaggtcctccttatccaagtatggaaaactgacttctccattttgactggtgtacctgcaggaattcactctcacttagagacacatttgtatgacagagaacagtagaatacagtgcttataaaaacagggatattagtgtaataaaaaatgttaaaaaagcttttagcctctttgtcagttttccaggccctagctaggtttctcttttgtcactggagtatctaatcatcccctcccttttgtttggtaaaatgagttttcctatttcttgctgggcagaattaatctgaaaatccctgctattgtttgatagttaattacctgcctttggagtcaaacagctccgaagctcaggtaaagaagggaaacacaaatgtctatggaatagggcaggaatgagggaaagaagccaggacattctgttcacttcgtgtgttaaagtaattccagagagaaagggactagactagggagacacccagcccaggcagtgacttgcaaataatggaagtatggccacatcagcccctaatttacctttgattgtctccctatttctgactctctctcttacccacttgatatatacaaccgtgtttctttccaatcctgaataattagttgaccttgtcaagcaaaagctcattattatgattcagagaacaggaacaataacttttaatttctaggtagctacaccctagagacccctccccactctgaatctgaactgaaggtaatttgaaacacaaaatatcaaaggaaataatgtgacctaatccttactttgaaagcaaagctttctgcctctccagacatgtcacccagaaagcaccatgcccttctggcaggacaaggctcccggagagctctgcagatctttgcaccaacacttcccattcaagcgagtcaatggtagaggaaaacatcatgatccaattcgaaatagactgaagtcaccttctgagaacatctgtgttctctagatgtcagtagccctgtgtgacagatagtgggggcatactgatcatcccaaactgctttccaatgacctctctttttcctgtcccattcaagaaatagatgaaaatgtatatttggtctggtcataagactgtgtgtctaaatttgatagaactttgaaaaagtcaggaaattaaattccactataaaattggagctctcctcaaagcaccccggagaatgacaaggaagtagggcattttacctgcaattgatgtacactatctagacagcatgcagatgaggcaactctgttctacctggtgagttttaaaatttcttgaagcagttgctgacaacggagggacaaaaattgacagaaaggctagagcacatttcagtaaactcacctgaggtatcgtctgtctgctaagccaagtagggcaaaatgtaaagactaaagtaatctcagaaaaatgccagaggaaaagttatattcattgaataatggcattttcttttccttttggtatggctgggaaggggtcctcatgttctctacagagtttggaaaacttggcgtcttttgcagaagagtggataaaaatagggtcccctgttctagcctttcacacccactcatagagaatggagcagaaagtttagatgacccttatggctttacagcaagcacttacagaagtcaggcaacatctctccaggtaagcagttagggctcccatgggaaagtctgtaagcagccactgagttcttaccccttaggtgcttttccacagggagtcttggctgcttctgagcggcctcagagtctaacaccataggattgagaaacatggctctgattccttctggatcttgattctttctgcagcttccaagtgagaaatgtcatttattttggggaaaggacaaacaccagatcctgaataatcagctttttcaagatgtatgcctttagactcccattcccatatgagagtgctgatttattcaagctgcacttgaagaaaatcttcttaattaagggttggatgaggtctctttatggtctcatgacccaacactacagatctgtctaatcctataatatatccaaaattttcctcattaccgtattcctaatggtttcagaaggtcacccatacagagtgtgtgatacagcaatatcaagagcagctgacttggatgccatcactgttaggagaagattcttagacactcaaaagacccaaagattctggttgttcctctcttcttaataaaattaaaatgcgtagcttcttaggacatagggagtagttgatgagaaaggtttccgtccatctgttgtcagatcgaagacactctactgaccctgttgaattccatttaacagtattttgaagccaggtcctggggacacaaagattcagacagagctcctgccctgtccagcagaggagaccactatactaacaaatatctgtcttataaggtaacagggattaggatgtttgagggtataaatgctatgaatacattgaaatggagtaattgaatttacctgcaagattagacaaaactacaaagttatatttcatgagggtcttcaatgggcagtagagttttttaggggatctgagaggaaatggcatcccaaacaggatcaatcatgtgtgcaaagcttggaaggctgaacgtgtatgttgtgttggacgaagagtgaggacgctaatatggtcacagggcagagttcctggggtgaaatcactcaatatatggctagaaaggtaggctgcatctcagtttcaggtggaaccagataggcttccaataggcttatttttttctggttgtcctgctagaatgctactttctttcacaaggaagtgcacattagattgttttgacaatggacaaatactcaaaagattatcagtggaaaagaacatgacaaacacctaagtcaataaatcttgggtagaaaggagatatattggaaggaaagaatacatccaatcccaactggttctatgcttcttgcatggttaagacacaaaggggaaagattgccaaagacttttctaccaatacgtcaattttcaaaatctctccaatgtatgtcttacatttgaatttgtaataatgattcttcttccatagtatagtaaggtgcatctctttgtgtcttagcaaatagagggtgtggtactgggttttgtgctgtcatggtgatgatcatggcagagagggtgaggatgctgccgaggatgaatgacagctgcaagaagcagtccccagccctcaggtcctcagcagcctcctacctgagagtcctcatacaaatgagaagacttcctgtttctgatatctccaggctaatttaggctttgaggtgtcaccacttggagtgtatgttaagacatgttcctgttgaatgtcgcctgcagtaaataattgtctaacattggtatgaaatctaattggcttccgctagagcttggctcagcagaggaattcactcctggagtttttggagcaccacactttcttcatttcatgttatttgagaaagaatttattgatgcaaaatcagggcagtttaatttggtggcatgttttctttatgtctcaattatatattcatgtctttgtggtaaactcagctggtggggggattaagaattcaaaatagaggattttcacttggcaagtagtgctttctactgtgattaattgggagtctgcacaatgaacccggtgttggctccgttggggatttaatagcttagtagaaagaagtaaatttcaggatttaagagttttgggttacagtctgaattttgataattacctggaaaaatgatctccttgttttagttattccagattagatattcccaattagataccttttatagaagtgtttttgtgtcccataattcgatttggagaagggtgtcaagtaggtgcagggaagcagaagagcacccctcattgttgtgatcatccaacagccctaaagacttccaggtgcttacatccatttgtctttttctgtcttctttctatggatgcaatcctctagatggggaatgcacacatgtcctgccgctgatgtgggtccctgttcccagaaaccggtctgggtcgcatcccgtttctccagcctcagccgcctccgcggagctctattgctcctggctttctggccttctgacctggtgctcttcctcagctctcttgccaccatctcctgtgttctcacagttttgtttgggcatgttttatggtgttcttatcgtcctaaaacctggatttcacagaggggacctgtgtgctaacactgttcctcattctgagggctaggctggccaagccatttcttcctactctgagaaagaaagatgagaaattttgattattttccctttcacacataaaccatcatgtgtcaagtcctgaaattgaggttggaatggatacaaagatggatgagatgggtccctacaatggggatgtgcaaaggagtggggtgcaggtagggtgtgtaagggcagcagctctcacagccactggagagtccctgggctgagagcgatggctgcaagcttgggagccaggctttgctgttgcagaaggccaagaaaataataaagtcttttgaaattgagtaatgtggcgtttcagctcccgactgttagaatgaaaatagcgattctgccacacccactttgcacccctcacccctcatttctgcacttgtagcctgagtgatcttttcaaaccaaatctggaggttcctcaaagacttctctttagcccaagagagccaattccttatgaaggagttgatagtcctggaggccaggctccaggggacctctgctcctggttcatgccatgtcctgcctcactattttcattctagtgtattttttcttgttatttctggtcataggccctttgaacgttcccttccctcttcctggaattctcttttgcttttcacccagtcggtcctatttatccttcagactttgactcaaatgccatttccatagagaactttcccagacctgctaaccactgccactcccacctctgccaggagctagagccttgcccttcttcctgctttttgccacagttaaaatgtggcatttgtctgtgtgattggttgattatgtcattttttctgaggtcagggggcccgtatgcttgtgcattctatccccagtgcctggaatttaatagagctcagggactatttgttggataatctatctgtaaagtttcttttttattgtattataattattaaacaaaatgattcatttttttttcattactagttgtagtaggctgaataatgtccaaacaaagatcagattctaatccctggaacccaaaaatatactttgcatggtagagtctttacagatgagattagtttaaagatttgagatagggaaattgtcctgggccctaaatgcaatcacataaatctttacaaaagggaggcagaggaagatttgataggaacacacacagaggagaaggcagtgtaaagacgggagcagagggatatgaagatgctgaccctcagggttacagtgatgtggccacaagccaaagaatgcccatagccagcggaagctgggagcaccaaagaccagatatcttttgagagcctctggaggaatcacagccttcctgataccctgatttcagcctagtgagagtcatttttggacgtctcacctccagaatcatcaaagaatcaatttctcttgtttgttaagccactaaatatatggaaatgtgttatagaaaaaggaaacaaatacactgaccttcaatgttttgaatccttaatggatggaaataggaaaaacaaaaattgatatttgaaatctgccccaaatttagtctttgtcactgtgagagatgaagtaacactcatctttttcattatttctttttaaaaaaaatctctttggagatgcacccttgtcatgtaaatgcaatgaggcatcagctttttgtccttggggtatctacaggagcagatggagtcatccacatttcaaaactaagatgatactttttgatgttgaaaatttctgtcccaggggccctagggtatggaagcagggagggaaagacacctctgccaaatatggttttaatgagaggaaaccattgatgtcgcctagcattaagctgtgagatttggtttgtgaatgtgggaccagagttgaagattaaaatcgctaaacattctcttgttaactgggagagggacctcgtatttgtgttttttctccactatgtgtctcataggcatctcaaactgaaaatgtaaaacatagatctcttgaattctagccttctttcctgaccatcctctgactccaaccctaaacctgctcctcctggagtcttgccatctggtaaatggcaattgcattcttctagtggctcatgtgaaagctgcagtccgtcttcactgttttccttttcccgtcctcttcctcaatcctgagcacgtcctgctagattttctgaattcggaggtttatccagtcctgcctcttctgccctctcccaagctgctgttacctttgtctggagtgttccacagctttctacctaactggcctgctttttttgttcttattccctatcgtctgttctccatgctcagcgaaagcatttctgtgcaggcttcgttgttcctgatttagtcgcttcctggctcacctaaggtctttaacatccctactgtggcctaaaaggtcttccttggtccggccaccagtgtctccctggcttcacctccacacacactcccttttccttaccctgtctccactacttcctgatatgcctgtgatacaccaaggtggcctcctggcttccaggccttaaagctccctctgctggtgcccatgccaggtgtccttggggctctcttcttagatctctgttcaaggtcaccttaaggcagaggccttcttcaccacctgcataaaatagagcttccaaccccacatcatcacaccctagcacctttcttgccttgtttgttctttataaagtaactcacctattggcataatggatatttccgtgttggagagtggtagcctgtttcaacccctctagaacatgtgtgccatgatggtggggcttgatctggcatgttcattgttgtttcccaagtgcctagaacagggtctggtgcatagtaggcactctgtaagcatttgtcaaataaatgaatgaatgaaaacaaaggcctaccgttaagtggacttgatcatattttctcagtgtttgctctctctttggtcaggcgtgagagcatgaacttctctgttacttctatcaaaatgttttggtccctctagtctcagaccaggtgacattcagctgagttttgcagtgtgcattttcttagcaaggtaaagaattgaaccagattgaaggaacaaatcacacagcaggaaggactctgagagaccaaagatgagtcactccaggtcactgcctggaaagaaaacaggaatgatagaggcgcaccacagcctggatagcaggagagggccagatctctgccacccccagggtgtgggtttcactgtggaggggatggggaattataggaagggttgaacagggaaattaaattagttgtatttcagaaagatctctggcatcagaatgaagggtggattggaggggagttttgcagcagggagactgagagagaatgaaaacaaggctgagattgtattatcctgtgttcctgaccaggagacccccctctctccttgaggggctggacaaacagggctttagagcagccgatccatggccagagggcacatatacaggaagagtggaaggggtcccgtggccacatggttccagttttcctggatgatcctattcctaagagacgcgtttattctccatgtgtggttgctaagggagtaagtcaatggaatttaaagttgacacctttgtaaaagtttcaagtttatatatttacaaataagggaaaaaatgtgccagactttgtttctgtttggaattctgggaatatcgcctttggattatggacctgaaatcatgtcaccaacaggagatgcagtttgtgtgaacaaagggtaaagcttgaaataagataggataagacaggataaagaaccaggagagctttttaaataggagaagctatttgaaagcagaaaggagaacaggttcagaggataccaaaaccggagttatcacagaatgtttgtctgaccactcattcctgctgcctgccttggaatctctggaggaacttcccagaaaaaaaagaagagtggagaccactccacagacccaccgaacctgaagagcctaggtgcaggcgtgggtgtgggggtagaactgggaatcacaggctggagcccagcgagctaaggcccgaggcagctgaaggtcaaattgggaacatttcttacatcaaatcctaaatgaggttcatgctgattagtaggaactgtgtcaaataggtgagcaggcctgttctgggtttctaattacggtgtggctttcatctccctgagcttgttgctgcactgttgttcaaatgaaaaatgggaaacagacatgaaaaagagctgctcccctaagtgggtcagtgcaggcttcttccaccttctcccaccttgtttttctaaagagttacctggctttgttccctcactgatactcactgaggcatggcagccattcctttgccctctttggacagggcagcatgctgcccatttgggactggcagtagaatagtcaagaaattctttttacctttttctggcattcatatggcaaatgaatttttcgtgcaaaaaagcttcctgtgattgagtcggtctggtagcacaggtgacagctaatgcaccaggaagtgccctcaagggtcagccttggccacagcactgcatgaagctcacggtctggtggggaaggggagctgaagcaggcccttcacccctctcctaccaacacatgaaatgcctgcctcatctttcagcccaggacctggttgaagaaagatgcatatatagcaatcatcttttcttccttccttcacccatcaaatattccatgaacatctactatgagccaggcatcacgctacactcacggtagagcacgaatgccctagttacccccaaagaaataatatgtgggcgggtgactggagaagtcagtaactccttttaacatagggagagagctgggctgaataccaggggctatgccagcagccaggggaggcccctgaagaagcccagggactttggacatgaagttttgcccagctgagagctgaggaggattagctgggtagcatcaggaaggtgaaaccttctggacaaaaaatgacaagtgcaggatggggcaccgctgagggcagggtccctgtagagaaggaaaaagcatcccccgcaggcagtgagagaaggaggagggtgagaggagagacccgagaggggagccacggcagatggcccagggcctggaaagccctgccggtgacttcgggatatttcttaagggcagaaggagccaagttaggggagagcagacccaattcaggagaattcctcacttggtttcagttttgacaagagggtatctgggagcaatgcagagaccaaaggacctccatggttcacagctttgtgggatccccccttccttcttgcctggccagggctcctcagcggaggtgaggaggagttgagctcctggtttcatactatttgtgctcctccagtgaggcttcatttgtccatggattctcccccactggagtgagtgcagcaccctgtttagaagatcggcagaatcagcagatggacacccttcttcctttccatagacagttctcttctttgctattttccacctagctcttggaggctgtttctcatttggtctttcgagcagctttttttttttttttttttttttttccccacaaaatgttctttttgtcatcttctgcctgtcaccgtttttcatcctttttttcctgttctttttcatggtgtcctatttcactctcttaggcacgctctatctgatactcccgttctctcacgcatcgccaaccccgtttttcatgttgaccttcgattccgggcactgtgcacccgggctcatgcgtcctccaatttcacatttcccacagtcttcctccccccaactttctttgcttcctctcctcttcccctggcgcccccttgccagttgccatccctctgtttcacccagtgtccgctttcttccccgtgcgcagccctgtgcacccagactgcgattccctcctcccgcagctgcgccatccccggacccttcctgctgggctgcttctccacggaaggtccccatgggtttcgcctccaacactcagagcccacatggccgttgtagagaggataagataatcagatgcacctttttaattatttatttttcatttcacttaataagcacatcttgaaattgagctgcagtttcactcgtaatagatcatttcccttagggaacccacatccaaccccggttgaaattctctccgtgcgcagtgcagggaaggaagacactaggtttcaggtgtctttcttgagatccaaacatgttacgtcctaatgtaaagtgcgtgggtctgggagtgtgtgtttgtgagaggagtgtgtaagtgtgcatactttgtcccttctgtaatgtgcttgggtatagtagggtatttgtgttttggggggagtgtgtatgtgggggaagatgtgtatgtgtttgtgtgtttatggggagtgtgtatgtgagtgtgtttatgtttgtgtagggagtgtgtatgtaagtgcttgtgtatgtgtgaagagcgtgtatgtgggtggagtgttgatgtgattgtgtgtgtgtttgtggggcatgtgggggggactgcgtgagtgtgtgtatgtgtttgtgggtcatgtgtgtatttgtgggacatgtgttaatgtatgtttttgtgtagagcatgtgtgtgagtgcttgtgtatgtttgtgtgggaagtgtggatggggggagtgtggatgtgtgagtgtgtgtgtttgtggggggagtgtggatgtgagtgcttctgtgcgtgaggagtgtggatgtgatcgtgtgtgtgtgtgtgtttgtggggcatgtgtgggggacatgtgtgagtgtgtgtatgtgtgtggggcatgtgtgtgtttgtggggcttgtgtgagtgtgtgtgtgtttgtgtagggaatgtgtatgtgatcttgtgtgtgtgtgtttgtggagcatgtgtgagtgtgtgtatgtgtttgtgtgggacatgtgtgtgtttgtgggacctgtgtgtgtgtgtgtgtttgtatagggagtgtgtatgtgatcttgtgtgtgtgtttgtggagcatgtgtgagtgcttggtgggggaggaggtttctatctgtctatgagtgataggcgtgatggacatgtaacacttagcccaagtgaatgtgaagaccacagagggaaaagggaagagcagctactcaaaggggctgatgatttacctaactctcccctggtccaccccaagagaaggatcggttgtgaaagttccaattactagaagtgtgatggccactccaccagccacctggagcccagtggaaggagcgtctgcagagaggccctgcctgccatttgttctggcccagccacgggcaagcatctcaggaaaaagggatttcctggaacagtgcagcagcaacaggactgaattgtgggttgagtcccgaggatctcctctggctcctctaggcccagaggcctcttctgctccaggctggggtcctttcctagggcacaatgactcgggtgcccctagctagtctagtcatggaagattgtaaatatagcttctcatgtcgtcgaacttttagaggcaactgtaggaaaacagtagcaggcaggtttcatcatgcaatgataatgctatttttatgtatagcttattgaaacctgattatgtggcagccaagaactagatgaagctcattatgcacactgtgtcatttaatgttcaaacagccctgtgcgatagatgctgtcatttcccttcctttagaaatgaggagaccaactaacccaaggaaggttgcacattggtaagtggcagagccagagtttgaattcagaaagtctgactcttcacagcctccctcaaacactaagcttccccttatgagcaaaggatcaggttaacctgactcaaaggactgtatcccaattgccagcacaggcatgggctcaagttgttgtagagacagaagcctccttggaggccacctagccagtgattctcagctctgctgcgcattgagatacttggggtattgttaggcaataccaacgttgaggtcctcctcagaaattctgactcagtttactgggggtaagcccatggtgtctttgtttttttttttatttttactcctggatgtttctgttgtttacccatgttgagaaccactgtcctaatttacagatgggaaaacatgaaactgaagaggttagctggcttatccaaggtcatgccgctggttaagcacagtagcaaggactaacccagatctcccatctctcttccagggcgctttctcttgccccttgatgaaagacaaatctttccttatgtgtgtgagggaacaaaatacaatatggtgggtaagagtttggactgagacaccaaatgggttggaaaaatcgctgtgtaatcttgggttttatgtgttctctggctttgtttgttgttgttgttgttgttgttttccatctgtaaaatgaggaaataataaatcctgtctggcgggattcttgttaggtgataacatgagatgataccattaaaaagtgccataatctagctcagcatatggtcattgtttttgctgtgtggaaaggaccatccattagacatcagcctcactgggcattctcatgagctcagatggcaatagtcagtaacatcaactttgcgttttcaaaagtagcacacaattaaagaatacatttctttatttgactatgaactcattaaggatgatgtgtgctatgtaaatgcactctgcacaagttgacgtcacctgtggaacctcggtgacgatggctgatggaatgtctggccattggtttggctgaggtagaaccagcatctaaatctactgttgccatgttgtccttctaacttgttgtcacaaatggggacacttgctgttcttccacaagttcttctcaatctcatcactaagacagatgtgaagacattcataatgctgatcacgggtacatctctgaccctgtgaactcccgaggcctgttttccatgggatgatttacatcaggagacacgattgtctccatcactggtttcaataccatccaacaaagatgccatggagattggagcttactccctaaggacattgtctctcagctcatgcaaacgctactcttcctgagtttccccttgcctccctggactctgtctagacggctgttttattctcagctccccctcccctgttggcctacacatagtcttctgttcttctcacttaggctacatgctgtccagtgacccacccaggcctggggctttacctgcagtgctttcacccatgatagtgatatctttatatccaacaccggcaaagctatgtttgtgggaacctaatggaatctcctctcaaaagtggcacaatgtattcaaaattaaacaaatcatcttgccccacctcccttaccaccccaaattcctcttgcttctgtatcagcagtcttggagtggtaaaacccaattctcaagatagatagaggactagagatcgtccttgatttatttctttctgtagcactcctcattcagtcatctgttcctatagatgcccgtcactcacgattccccatctttgctgtcatggccttgcttcagccatttatcccatttacctaacttattgccttcctacagcctgtgtcctccactgtgcatcctgtgtcacatggtcacagtaaaataagagcaaacatttattgggtcctttccatgtgacaggtactaggcttaacttacagaatctcatttaaatctcccaacaatcttaggtagtagatatgagtgtgatatgaacaattttaggtgaggaaactgaggctcagggggggtttagtcttgctgaagatcatccaaataaaagatggggcttgaacccttatctactattggaagaagcccgactgtggggctgttccatccctaagaggctgagctctctctgctttctcaaaagcatccctctgctaagtgctgcttcttgcagaggtcttcttcttttatttctttttgggctctcctgtttccttggaaatgttgatttcattgcattttcctaatatttcatgctttaatttaatttatttgatactactgtacagtgccttgagcacctcagaggaagtgagagttttataaataaaataattattacagcttgctctgatggcagcccctgagctatttagtagatatatcaattactctcagtgttgaaaattttcacctaaagctctttatggcccaagttttccttggcttttaatgctctatcctgcttgttgtagttttgacacaatcatgtagcacttttctttactatccccatcagaagtgaacagacagcagctcagcaaaagtgccatataatgtattctagagaacatgacctagttttcttaacctttttgaatcacttagttccaggtgtcatttactagacctataatgtcagttttgcaatgagtcaacccgccttgcccacctcatggtctctattagtgagacctcattatctattagtctgttgcagaaacctcacccacgataatctagagatgggtatgaattaaccacaacactgtttggcacccaggatttcaggattctaaactacaaggcttatgcagacaaaatgtttgtcaaaatcttgaaaggaagtgaagccccaacacatggaggagggtgagtggattagagagtgcagtgtagagaactctctaatgaaattcagttttcctgcagctcagaatgctatgcaatccacatagtaattagagagaactgaggtaattttgcattcctggacccagtattctcaagatgcattaatcagtcagtggcaatttgcattcctactaagtgcaagccactgttcaatatgctgcttttgctaaattagcacattcctccacagttcctcctttcacgatgagtgagtctggcacatgtcataagattccacctctcaggaatacacctgaatgtggcactgaccatcattcctagcattatggctactttctggatcctgcctgcctcacaatctcatagcacttcactagcaagagatgtgagaggaccgttgtcatctgtttagtgttttagaggcatgttgaagaattcagaggataaaccaatggtcaagctaagatttctccctggacatctcccactcatgcagttagacctgactttcctcctctcacttccatcatggcatatttttttattctacttaaaaaagatacactttattctatcctattttactctgttctatcttattcattcattcaataaaaatgagcttagcgcttgctgtatgccagttatatgactggcatgtacaatgatgagcaaaattgacattgttctttattttttggagtttgagttcttctcttccttttgtttttaaacattttttatttgttttgtagagatgggatcttgttaggttgcccaggctggtcttcaactcctcaagtgattctcctgtctcagcttcctgaggtgctgggattacaggtgtgagccaccatgccaagtcttctcttcctctcatcttgacttgcctccctctcaaaattctactctttgtaatctgtagttgtattaaggatttctaaagaagtttcctcattaaccagaaacaatacactgtgctgtctccattttgtgttttttagcaaacaaatgggagtagccaatctgtccattataaatgagttcattcccattcaagcaatggctgtcatgtatcttgcctgaggcttcttatgttatgagcaacatattggcttcagttgtctgtactttttcctagctgcacagagatccttagatgaagggaaggcacaataactcaaaataatgtattgtattatacatagtagtcattcatagttccaatgacaggaaacacaatgagcttgttcaaggtggatatgtgtaaccctctcaccaggccaggtagaggttgttagatgtctaacaactattcttccccctagccaaatacgaatctgaaacaaactatgacccagatatccagaccagaaagaaacagataggatgaagcctgttttgcccacaacgggaagaatcacttccgatgaaaaacgactaactggaaatacttcaaattgctgtagagagtgcagtgtggagaactatctaatgaaattccgttttcctgcagctcaaaaatgttttgcgatccacataggaatcagaggacccaggtaattttgcattcctggacccagtattcacaagatacattaatcagttggtggcaattggcattcctactaagtgcaagccactgttcaagatactgcttgtactaaatatgtctattgcactgcacttcatctgatgatgggtgaggcccaagcaactcatcagatactacctctcagaaatacatctaaagagggcaaatcctaggcccattcttttcctctcatttctccaaatagcttgtgagcccagttgaccttgcctggatcaggacaatcctgggttgctggttaaaggttgacttggtccatttgcctctactctatgaggtatctcatatcactttcattgtaattctgtggtagccctttaataaaaatggccagcaagcccacaagataacagaataggaatcaatgagacctgcaattgtctgcatgccagattctcctgtcagcctggcctccaatccatcctgccaactcaacctcctctgggactgagacgtttgaaaacagtgcagcagcctcatctcctgggcagtgtttttctccatcatttgctttattaaatattgattttctgttgcattattaaaccttaagtccagagcataaattctgggctgatactttaatctgactcttctcatttttttggcttttagaactgattttcaggccagctctcctggggaatctttaagtcaacttagggccagagacaaacctgcctgtaggaaagggaggagcccggagttgagaaggagcttgccttgccagtgcactataaataaggctgtggctctgtcaagcagatcttcactttacacatgtcttagacacagaggcttatgctccctgggattcaggttgtagtgcaaggaaggacttttagattcccaccaccaaaactatcgagtaggcaaatggtatgcagaactgattttagagctctctagatattatcaaactcattatccatccaccccctccttcttttggtttctaatattcctaggatttgagtcaaaggttataatcacacaggcatttggatttccactcactttgggcctctggttcattcttgttttctcttactgtctcttctctctaagggccaatggttgagtaatcagctgtagccatccattataggatggagccatcacacactttatgaaagtctttctgagagaggcaggcattctcaaccagtcatattagccagagtgatatctaggtttaatttttttacttttttttttttttttttttttttttttttttggagatggagtctcactctgtcacccaggctggagtgcagtggcgggatctcagctcactgcaacttctgcctcctgggttcaatcaattctcctgcctcagcctcctgtgtagctgggactacaggtgcccacctccacgcctggctaagtttttgtgtttttagtagagatggagtttcactgtgttagccaggatggtcttgatccctgagctcatgatctgccctccttggcctcccaaagtgctgggattacaggcgtgaaccactgtgccgggccaattttttacttcttgaatacttcttagactggcagtatcattgactgaggctagggttggtgattttaaagataagaagcagaatactgacagacaagcatgagaaaagaaatgcaagtcaacatgtatggagcttctctggcaggactggggtatgttgctgtctacatggatgtttgcagagagctgtgcctatctccctgtctgacttctgttcatcccatctttctattcagttcaccccatctttctcctcagttatcccacctttgtcttttaggtcctgcatctccagaaatctagtgttaggaagttattccaggacctagcagagcctctgtttaggaaaagagtgaatttgattcgctcttcactctgggatggagagggaacacaggtagctcatggggctacagaaaccagcaactacaaaccttcagatgctgtgagccaagtgctgactgagccgggatagccacatcaggtgctgttgaaaatgattcttggggaatatttgatagaaacaatgtgaagatcagggtggaagaaactgtgtccttcattttcaccaatactcttcatgtcaccaataaccataggcctctaaagaataatacatgttctctttaaggtcatggggattccagatcatagatcttcctccaattccatttccaaagcctgaattccctctacaataggtatacagctagggagtatctaccatttatttgaacactgtcagtgatgagcaactaactacctattcatctaggtcttacttcctttagaaaagctctattagatccacatatacacctctctccctctaatatctacctcttggttacttctttataaccacataggataagctgaatcttttgtaatgataaaaaaagtccttggcatttaattaagagctatgaattttgaatcttactgtctatgtaaatgtctacaagttataggtcaaaatggctgaatattggcagttgcatatgtttcaatctaatatttaatttctcagagctccagctttctcatttataaagaacttgaatataaccactcatcagtttattgtgagggggaattgaaattaggtgggatacctagcattggaaagcattcaatttaaaaaaaataaataaatttaacaactatttactaaacgcttattctgtgtcaggcaccgtggcaagtgttgggaataggaaaatgagtgataaatggtccttgacctcatgatggggattgcggtatttgaggatgcctattgtagtccttaagtcttcccttcttctgctaactaaatagagcaagtatcacctgcatttgtctttgtactcagctcattaaattgtagttatctcttcacccaaaagttatacattttggggtgcaagaatcgttcactaaatgtcacatgtttttctccataaattctggttgttggacctgtttgtagttcttcatctttccttgtctgaaagattctggtgtcttcacttatctcttcagatgttagctgacttttccccagggcagcacaagctcaccgaggtcaaacaagcatgagcatgctgacttccattcagtcacctctgcacgtcctgccgctgatcctttatctcctgtcttaatctgcccaagctgctatgacaaagtaccatagactgggttgcttattaagaacagaaatttatttcttacaattcaggaagctaacaagtccgagatcaaggttctggcagatttggtgtctggcgtgggctcacttcctggctcattgatgacgacacctttttgttgtgttctcacatggtgagagtggtgaggggtctctttctagccttttttataacgacactaatccgattcatcaaagctttgccctcataacttaatcacctcgcaaggctccaccctcaaaaaccatcatcttagagtttaggatgtcgatatatgacttttggagagacattaacattcattccattgctttgtcctttcacacacttggaatgcctctattttctctttgattcttcactatttctgcatattcaatttttgtaatgattaaaaactcatctgaattgcaggaattcattggaatagttcaagaagatttattggatagatagatcagaatttatggaaacaaatgcaggaaaaacagatgagccctgtctgcaggggatacctctgactgctactctctgcccctctcttgttgggactgtgtagtctccttattcatgcttctttctgcaaatctcctatggtggtctcttcaatctcttacttggggtttctctaatccccactaacttcatttcccatgtggccttggcctatattggtgctcattcagacagcttgatagaccacagtcaactgactccacattggtgccttaaattccacatagcagaacaacaagtcagactgccttcatttgagttaagtgaccaaaatgagttaagtgagttaagtttggaccactcttggtccaaacagctattgttgagatgaacatagagatcatatgatacatgatgcgatttatgtctattcagtgttctgctaattcagaaacttggtaaaaatacattattaccaattgacagatctcatacagagatgtttgataatgtccacatagtcaaaaccaacgatggtctgcttgaaccttctctgcctcctgtctagttcttctcatctacctcactcattttctggacatatccattgccaaggagatgtctctgcccaagaaatggtctgaaaatgtgttcagaacctacaagccttctctttaaaggacaggatgtgggggaaatgcattcagtggctggaaatcaccctcacttgaaatgctttggcctgtgaaagaaggagactattacaatctactgaaatgtcaataattaaaagccaaaaaagttattggaaaggctcgccatgattcatgccaactcccattctccccagcatgtagcctcacaagatatataattttccatttgtgtatagtggagagttccaggtcacataggaatattgaaaatgggtgtaggacccagggtcttcaggctatttctgtctcaagttattttgattttcccttttgatgctgtcagaaactctggacatgatcatttgtgctggaaaaagcacaacttctgccctttgtttcgatcgcttttgccatgtgtgattggtgaatttgattgctggccacagaaaattgcatttgtgtcgggagcattctgaacagatcaatgtaggaggaaaccaggcaggatcaattgtaataccaaaggaccagtataaaaagtcatgcaactcacatgtcatcctatagctctcaatgtctaaacatcacatggatttttggccacaattcattaattaaacctcacaatatgcagtgaggtcaagtaatgtttgatgctagacatctagaagagtgggaaataacaccatgtcaatccaactgtctttatgcagagaatctgcaaaaagtgagacaacatgtaataatacaaataattattatagtcactccatatattttccaggggctggctatgtcctctatacacatttctaattttaacttcaagagaagttaaatctatcatttctattttatgactaataaatcaaacccagaagggttaaataatctgtgattgtccatgagtgtgcagcgaagtggggtctccggaattctgttctgactggctctgaacgtcatgcttttaaccgtctctatttattgtctttgtgtttttaaaccacagtgctatataccattaggaataagcattatcattgctgccactattcttgttagtttactaatactgccagatgtgtagtaaactaagtatttcctcttctccacaaagggatgctagggttctagggaggcagttattcatgtgattacatctgtaatatttgtatgcatccagcttgatcaagcagtttccctgtctattatgaaaaccagcttgtggaggaagtagggcaagtatcattcattccatgttccaagtgaagagagtgaggctcacagattgtgacttgtgcccaggaatggagagtggagctaggacgagaagtcaggcctcccagctgcagagatactgttgcttccactctcttgttcttctgtaacaggtagcagttgtttttgaagatatcacagcctaaatggaattaactttcttcttaaaagttggactgtctccagcctcccactttcttaaaaatgtgaaaaacaaacaaaaaccagttcagaacactttagccaaagagtgtgtcctaaatgagtgtgtcctactctctttaggcttggaccatgtcttatacacctgtttggtcctatctggtccctgataggctgccttcaacggagggaagcagtggaaaaagagcttaactgactgctagaagacaaaatttatgtcttaatgatacttaatgatttagtttcaacactgtttattagcaaaaaatgtttagtgatggcatcctacattctaggccctcactgggcactgagtagctgggcaaacttatacaggacacttaagttttctgggcctcaattctgtcatctgcaaaatagacttatgaatgcctttttccctactgcaaagagttattgtaagaataaaattaaatcatggaagtgaactgcttctataaactaatgacccctgtacttatgtgatgcattattttaggctctaaaaaaatcgtaaatgtatcagcaagttaagaatgtaccttgctacatgccccagggtaacagaatcgatgctagtgcagtgacttcatggactcagtatgctgggtgaggagcggactatgatgggcattgctgtgtcgcctctttctccctcttatggagggggctgccttcagcagggtggagctgctgctctttgtgcagccattctcttggaactgctttctctgagtggtgtgatttttgtagcattttcttcctttcctttctctttctggcaatggctctttgaaatattatttttgcttcctcgacggctgggctgtataattgatggcctctcggggttgctggagtcgtgcatttaaaccacgatcgccttggattcaacgcctcagagttcattactttttgaaatgcttcacgtctgtttgtgttcagattattgttgctctggagagagaggttattgtcaggcaggaagaggagtgtggagcagaattcatcataatcacatgctcttctcttctggacgaatatttctgggtaacaagacttcatatttatctggcatggctgttctgaaccagggaacccaggaccttcactttccccctgcagcctgctggagggagtttagcagcattcggtcttggaatgtgggaggctgctgctttgcaaataaagtgggtaataaaagtgcccagcgctcatactagagaatgatttagtgcagaatgtgtacatgtaggatttttaattaaaggtttggggtgcacttggttctcagcaatggtgttggtggagggagcatgctctctccacttgagctatgatcttctctcagttctgcagtggtcgtcccatccttcccagctcttgtctctctgtcacctcatggtccacccacaccattatcactcatgtatgtccacaccctggctcctgctctccacgctgcaccagctccataagcattagcaccccaaatttggtaaacccaaacaagtttgtgtaaatttggaatatactagaacctagtctatatggcaaatgaagaataactcctctaggtttccagaaatggagattcagagttgttggggaggctataactgagaacttttaattcagattctgccattctgtgcatttttattctcagactaaaaaaatcctacccaccccccttttttttttcagacagagtctcgctcagtcgcccaggctggagtgcagtggtgcagtctcggctcactgcaagctccacctcctgggttcacttcattctcctgcctcagcctcccgagtagctgggactacaggtgcccgccaccatgcctgggtattaaatcccacctcattctttaagactgaaattatccaacttcttgagcagccacccttagaagttccctacccccacctcattctatctcaggaaaattctcgggttccccattgaacttccagagctccttatttgtatcatggctgcaacattctttacattttttttgtaattctccatcttatgtctgttctcttttctctcactgtatctcttgaagacaggagctagattttttgtttgtttgttttatttctgaatgaccaccatctagtgtggttccaatatatgcttgacactaaagaaaggttcattgaattaatccatgaaagaattctgtttgatcaagtcacatttcgattttcctgttagttaagtgtaactgtatgtggaagagaagcagtgttgtgtgcgagggacacgctgattcatctgtcctttggaaatacacacagctcctcattccagagggacaggtagtcagatacagtttgttgggtggggctacttatacaagaccaggtggtaaaaagtaggcatttctaaaagatgggtttggtcaagtttggtcaattatggatatagaagcaactttccaggaaaaaaaaaaagaaaaaaaaaacctgtttgagaaaggtttttcatctcaatagcagatgaagtacttataagttgaaggcagtttcttttctttttgcaacatagcaattagaagatattgtcacatcttgtcatttgaaaattctaaattaggttatgcatgtaacaaaaatatatgctggtgtttaacaaaaaataaatatttgagggactattttctgtacatttctcaataggacaccaagtatagatatcctctcagattatgcttgacatgtgttattatattcatatatttcttagtattctgggggtgaggaaggattttagcctctgtgaatcctagttgagtatacatgcctaaagttttttttttttttttttttttttagacagagtctcactcttgtcacccagtctggagtgcagtggcacaatctcggctcactgcaacctctgcctcctcagttcaagtgattatcttgcctcagcctcccaagtagccgggattacaggggcccaccaccacatctggctaatttttgtatttttaatagagatggggtttcaccatgttggccaggctggtctcgaactcctaacctcaggtgatccacctgccttggcctcccaaagtgccaaagtgctggggttacaggtgtgagccgtgccgcctgacatgcctaaagtttttattgttactttgttactcaaacttctccttgacacattacaggagaatgctggattgcatggattataacagtctaaagctcagcaaagtgaaggtgattatcagcattttaaatgctgtgacattttgctgccaaaaagtaattgatttattaaagacattacaatacatgcatgattcaacataagaagttcctttgaatttgttcagtaccaaatcctgtgggagactatttgctttcagcaccacggacagaaactctttttcattcagattcagttggccttacacaagtaaatattatagctcagcagtggcactccaatccactggccacagtatgatccaatagctttaacattccaactgatgggtactggaatgttaatacattgttttccacttattttgccacaaagtggaataggggacacaagtggatgactttataatgcattattattaccttcactttgctaaaaatgaaggtactaatccataacaaatcagatgaaatacataacattttagaagatgactgattttttcctaacaagcaacttcttggcaatgctagatttcaaaacactaaataagaagccataactgagttcagtgattccacacctgatcactgaaccaaagagactaatgaaatgcctaaagctaataaaaaatcttgttgttgaaggcaatgaagccccaatggggcatggggtaaaatactgaaggatcaggatcttcatctgtcgtatgactatgactaatgcactcatcctgactgggtaaacctctagttaattcccaattgcttcaggcaatggatcaaaacttttaaaatacagggacacagtcttaatccagagtactgtttgcttccttattcactgttgattataaatgttccaacgcaattttatttctcctcactcacatgacaaaagaaatggaaaattttgatggagtaattcaggagttttgctgaatcgctcacatgaaattggattataaaatatatagccacattgatgcccaaattaaaaatatttatagaacacaagctgatagacgtcttagataacgtgaagtccaacctgtctccttacagatagggaggctggctccgcaggatctcatctcttgccttaggtcacagagataaacacatggttgggaggggcttattgcttgatgaaacaacaaagaagagaaggaaagataaactttaataatatgtaagttattttgtttccatttttattcagaaaagctacaaggcttcctttttactcaacaaaatgccatataagtaaacataattcccactttgcctttctgtcaggaggcttaaaaagaaatttccagcctaacctaaaaatttatattgacatttatggtttccataagaggtattctctttttccttggattttattttatgtgtttacccttttgttttgtgttttcattataagattcctcaaatttattggggaaatggtgaaatataaataattatgaaaagtttgatagacagccttttcaaatgtaaagtaatcatatataaaatatgacctggacaattgacgccttgtgtattttttgggatcaacttggctgtgaatcatttgctcgtcttaaaaattggggatgggggaagaatgttcatcatttatctcccaagaatgcatgatgaaggtaattaaaaatgaagtgaaaaagaataagaattttattagtgtagatataggttatgtaagagaggaagtatttttattcagaacaaaaatgtttgtaaaatattaaatgaaaatgtaggttaatagaatttagcatttaacttgtcaattgtattaatgaattcaaagcaaagaaaaacttgggcgtttcagttattcagttcaaacaattacattaattaagtaagcgggatttacttttttattcctggtcttatttatttttccgttcatttattgagtacctgctatggtttcaggcactctatactgtctgggtattcagagataaaagagaattgctcttctcaaagagttttcaggaaactccaccctctgctaaaatataacacaatgaactgctgcaagatgctggggaaacaaaaaagaggatcaaaaccaaaccggatcaaggtggagtggagcttgaggaaggctcctaggaatgagtctagatttaaagggctaagataaatttgttatgtaaagattgagagtctgccaatccaaagtaccctaatggatgcacaagagaaaatcctagggagagaggggcaggacacagatcttaatctagtttacagtgaataatggttgaaagatggaagtgggtaggcaaaggctctggtgtacgtgtgtgtggagagagagacagagacagagagaaagtttgggtgcattatggtaaaagataagataggagagctataaaatggggcagtccggaagggccttgccttacacctccagttaaggagtttacatcctgtgaaatgaaagagagtacttcaaaatgttataagcagatgagatttgcatttccacaaagatccttccaagtcattttggaagacggtttgaagagggacgaagctgacccactctattatagtaattcaggggaacagtgtggatggcctaaatgtagataattagccttgatgatgcaggagataccaagtggaatgtatctttaccagcagggactcatggggcttggcgactggtatgggaagaggaaaacttgaagaagaatgaggaatttccttgactggggggtagcatagcatagcagtttagcatgtggacactgggagcagactgcctcttctaaaacctcgctgtttgatcctggtatgcttcttaacatctcagtgcctccatttcgttattagaaaatagtgtaacactaacaatagtaatgttatttttcatacattttcagaaaattattggaaaatcatcaccgtttcttaaatctctttaaaggcctatgggaaccccgtttgaaagcttttgaaatatacaaaagggattgattgtctatggagagaaagtgattcattcaatatgggacttcacattcactttgtattgtgtattcacagtctaataaattattacataatttgtgaaaagatgaaagagaaaaagaacatcttcagagaggatgaaataatccaatagagagatgttggagatgattagtgaagacattcagaaggtagagagaaactgacagtcatgttaagtctaacatgactttcaaagaagctactaaacagtgatggattattattaaaggcagagattagccaagaagtaaagcaagcaacttcaaaggaacaagcaaaatgggaaaaaaaggcacttcaatccttaaaagaaaaggacaaatgatagaaatttttatacaactgaatggcttcccataagcaagtagctctggtcttccctcaagtctagaactgcaaactcacaggttttcaagtctagaaaagtaaaaacaaaaaacaaaaccaaccaaccaaccgaacaaaaaaacaaaaaacccacaaaccctctcaagctctcagacttttctataacttgtgtcctgggcagctgggtttaaattccatcaatctaaggacctgagtttccaaacactataagtctaatatgattaccaccagagttggtggttcagctcaccacctccactccacccagccttagagaatgaagaactaaaacccggtgaggctctcccatcagattttctttccattgtattcgctactaccagccccaggccaacataggccccttcctggaagaagcttcaggaaaaaaaaatggggagaagataaaagaagaaagaagtgatcaatttagttcatcatcatgtatgtaaagtcaataaatttaggctatgtatttaacttaaggatctcagaataagttatacaagtaagacaagtgattgtgctcaggacacaagcaattgcctattgccaaatctcatggcattttttcagtactctttctgtcataattgatgcagttgctaccactgtccttactgatgatactttctttaccaacttttcatgaaactactccctcttgactttcacccaactctcaccactccatctcagtttcttttctttatccaccttaatccttctcatgagtcatacctgttggctttcctctgggttccacatttgaatcttccttttatgtttttcctaggtgatgctactccatcatggcatcagcatgaagattatgatttaggcagtcatcctgctgtgttctgcctcatttcttttctaaattcccaaaggattacaagttgtctattgagattcttagcttttatgtcctgcagacaacttgagctcagtgtattccaaactgtttttattatccttggtacctaaccaggtttttggtttcaatcaatggggattgattcaggttgacttaacagaaacaaggagttgactaaaaatatgttgtataactcatggaattgacagaggtttgattcaaaaatgggaagggggtcaatacatagaaaaattacaatgcaggaagtcctgccagggcattgcatccactacagcttaatagtggcactgatgttggcactattgaaacactggcatttgatgcctcttctgttccttctgatacctctgaatgctggacatcccaacaggagtgaattctaactgtctctgtatctttgcatttttaactatgtatgcaaattccttgaccagagcatccagtagacagagaccaggtgacattcctatgctgcacctattagagtactataaggcaagtctgaaatcttatcagatttcaaaatggagtcacactatctagtttattattattattattattattattattattattattttaatctaggaagggtgttccgattctgggtagtagcttaaaggaatggcaaaaacccactccatatttcatgaggaaaccttatcttcaaccgttatttcccatgttaactaatgccaccaacatatatcagtcaagctagaaacctccatcatttgctagtttttctttcacttctttttaacacacctgttttgttagtagtgtttatttaagttcctaaccttacaattctatctaccaaatattcctttcccttgttttctattctgctctttccactcttatagaagccctaggtcatgactggagaggactttcatatttttaaacagtgatgtactagctaaggttgcatgctccagtgtctgatcacctgcatttgtatcaaactgcagatcatgctcactcattgtgcaaccctgggcatattatttaatctctctacgtgtcatgtataaaatcaggggaataataataatacctgccacacagggtctctgcaagaacaaattgaggctgtaggtgtaaagcattgtgtatgcccacaagcaatgtgcacacaatgatggtaaggtgacactaaaactggaaagtaataatgaggggtgaggtggtgaaaacagtaatgatggcagtagtaatctggtagctatctctaatacgtactctcttgaggatgcagtctgcattgctgccagcattatctttccaagcaaatctgcttcgaatccttggatggtcctcatttcctatggaataaaatccaaagtctttaacaaagcatataaacttctctaaaatggggccccaagttatccttttaccatcaaattctaccactgaccttatagtacaggaacacagaccacctcattttccaacattttaaagattttacttacaggtttcacatatgctttctgcttcctagaacactctcctttgctgccttggaattcacattttctgtaaggcccaaacacatggtgcctttctttgcattttcctccctgataccctccctgtgttcctgtcacactctatatttgcatctcacacggtgctgtacagtcctcattgcatatattgtcaacttctacacctgctggcacacccttgaacttaatgttcctatcttacccactcccatctctgttacataagaccagcacatagtagttgctcagggaatggttattctatgactgtaataatcaacacatttgtaatgactcttcaaggacccagaaacctggagaggcatgcccaccaacttgtcccagattagttaaccataccccactggccacatttggcagtgaccaaacaggctcagcatttgagggcctggactcttgatctctgctttcatcgtttccactttgtgcttggcaccaggcaccatggagaaactttagcatgataccgggaagacacagtcggtcatttttttctgaaggaattttcatgccaccataaactctaaattagcaggcatcatagttatgagactctggagccaaatttgcaatcaccattaagacaaagaggcaaaggactgtgcatgtcccagcaaggtattctaaaacagaaatcgctactccctttgacaacacaagtgtcatctgaaaaatctccatgttctttgaaagcaccagacaagtatatcttctctaggtctacctggtcatagaaactttagactcaccaactccaaaaagtaaagtgtggaacttggtgtaaagtgcttccattcctgtttctggaacttaatattcaatacaaatttaggccatcactagatttttcaaatgacacctgtgttgttaaaggcagtagcgatttctgttttagaataccttgctgggacatgcacagtcctttggctctttgtcttaatggtgattgcaaatttggctccagagtctcataactatgatgcctgctaatctagagtttctggtggcatgaaaaaatccttcagaaaaaaggaccgaccgtgtcttcccagtatagtgttaaagcttctctatggtgcctggtgccaagcacaaactggaaacgatgaaagtggagctgaagattttgtatttcaaacattttactaccgtttttgagagcctcttttgaaagcagtgagtttacgggggtgtccgtagatcttcctgttccatatgctgtgtttacccacagaagagggaactttccctgacacttctgcctcctcaccaaggcagagaaaagaggtcctctctttgctcctttgctctgttctcccgggctgaggctggggatccagttgatccagacagttactggctgcctcccaagcaagttcctctctcagctcatcctctttgtgcttccttggcacagctgtggggggcagtgcactgccccagttcctacatctcacacccatgtgagtgctgctgtttcttttaagacttttctactgactactgtataaatggatcagattggcttaaggtggagagctgcttcttttttcttgaggcaggacacaggaaattctttcctgcagacccccacactccagtcgtccggtcctggtagttaaaggtggtgaaaccctctcattcacctgaagcctggctcttccctcaatggttcagacctggaaggaaagaccagagaaagactaggatttgggccacaaagcttcaaaactgcattttttcttttaaatgtaaatttagattatttgtaattacacaagatgaatttgatgaacaatgagctacacaaattttttgggaaaaataatattcatttctaggcagttgaccttcagtcagatccacacagcgtcatgaacgtaccatgtcattgtgaacctatgctacggcttcatggcgtcagaggtgccaattcagaaacggtgtggctgggccttctgctttcagcttacctttttttgttgttctaatttttcttgatttggattaatactgtactctgccacagcacgctggattattttgctgcgattgtttataaggagtggcatccttatgagggtatttgatctgttattatcccactttctcttgaaattgtcgtatctaggctcagtgctatagaaatagaactttaaaagtgaaaaacaaaacaaaaaatctcactgctggaagacatttcacactgaaacatctctttctgtgtcttgctttctatcactgtcactctcactccccccatatgtgtgcacatgtacatacatgtgaatgtgtatgtctgtgtgtgtacacacaagcgaatatccaaacagacatttatgcacacattttcttgagatatcaaggcttttatgttccccataatgtgtgcctcttctctcacttttctttcttaagggaggaaattttcttccatcagaatatcactctgagataagccctgcatttataatgcacacaaagactttttccagtacttgtctaatgagaagcgatgcccaaaattagagcttgatgccttccaattatcctattgcacatgattttgttataccacaaatagttattttcttccttccccaacagctacataaatgggtcgtggtaatccactccaaaacaaatggctcagtattgctaactttgctgcatataacgcaaatctctccattaataaagaaaaagagtgtctggtcatttcataataattttaatataattatttttaaaagatatgttggtttaaaagatatggaggagggttggaagttagttctcaagagcatagctttcatgaaaactgggagagagcccaggatggagtaggaagggggctgcagggctgggtggcatccattactttcactttatttttgggctcggattctttaacgttgaccctgctttgtgctcaggcaaataatgggtcaaggcacttcaaagcagacagctgctctggacttgattcatcctaatcagaaataactgccgcccttgcctattcatcgctttcccaccctagaaatgggggattacgggaagaatgaagtcaaatctaaagagttctgccttagatagttaagaggatgattgaaatcaataaatcccaggctttcgggaagcccacttgattccaagtttgctaaagacggaaagaaagaactccaacaggagcctctggtgaccagaactccaccactgagccactgcggtggctctctcatcactgggacttcccagcaggagcctaagtattactcgattccacctcattatggtactctccccatgaggagtgtaagtcacaatgacaggacaacaaaatggttgggagacacagccaccaagggaagcaggcagtggatggccagcccctatgaatacactagcttgcctctttccagcagcccaaatctccttggagggaatcccagccagtcttggatctctaacgcagccttctctttttagtttgactggtatcccagctccccgaggaacctgcaggccacttgaaattcatgatgacagcagcagataaagactccatcttatcatccacgtggccactgctttagacagcctgctttttaaatttttattttttaatgttttgttttgttttgaaatgttcgggctttcaggtcatggcattgcagccattcctcctattttttttctttaacgatatgtaaatactttcatggaggttgtcttatttggttctcagaaggacactataagacaaggcagttataataatttcagttttataaatggagcaaatgaaccctaagacatcaaaccactggccctcaaatgcaccagggataggactcttgcaggtttgcccttcttccagttctcatcccattaccgcttccgagccccctgtggggatccggatgatttcctcaaacgctaggtggcgccctgtggagtgcccccatgctcacactttcagagggggtttgtggcagccatagctctatgaatatgtccattcccttgactccgtgtctaggagaacattgtctacatctgagtgccaggatccacatctgttcaattgaatagactccactgaatacatcagagaagcagggccagactggctacccatgccctttctaatctcactgttcaattccttggggaaatatgctactttgaggatgtcttcagtgccttgcttctcttttcttcattttcactggaaaggaggttgctcagatggcgtgtgtgtgtgtgtgtgtgtgtgtgtgtgtgtgcgtgtgcgtgttttaaggattgaatgccctgaaaaaacaagatgagacctagaagtatgttcagcaacaccatatctggcttctctatactccccttcatatttttcttagctgttctgttttagttagcaccaatatagtgctccccacccacgtatccctttagggtgaaacgcctgctcagtgtgcttgggaaaggcagtatattttaggcagcctgataaaaggctctaatagccccagattaatgcattcattcctagccaactgaaggattcattacagtgctcaggctgaggctcctctgacaaatttgccctgggtaatgagccattcagcagctaactaccctgtgctgctggtgacctccagaaggggcagtgagatggagctgagcagacacaggtggagtacaaaagaagggagagatttgaggcatctctgggctttggggagcagttgtaagagcaagaaggtgcttctgagaccacatctgcctctggagctatgacaggagcgtgatagggtatgtggcgcctctgtactttctgagcctaacaagtgaggttcagagcaaggcaatgtaaatctctgctttgaaagtgaacatggattgggtaactaaaaagagagtgatacgtaggagaaacttccaaagaattgcaatctgtccctctgactaacatgtctacgtggagacttccaaaatggaaaatgagacatagcataacagaaagcaagaaagcctcctaaagataagctagcccagcagctctgcagagtatgactttaccctccagggaacatttggcaatgacttgagacatcctagtttgtcacaactctgtgcgtgcgtgtgtgtgtgtgtttgtgtgtcagggaagaaattagcatgaagatgctactggcatctagtgggtatagaccagagattctgcaaaacatcctgcaatgcacaggacagccccacacaacaaagagtcatccagccccaaatgtcagtagtgctgaggttgaggaacccggactaacccaaacgcctccttttataggagacaaagctgaagacttgagaaaagtgcctggctgaggggccagaaacctgtgtcttgtctccctccaggccatgcaaggcttgcttttgaatgctgtcctggacagtactttcagaaatgaagaggttccttctcctcccagactccagggcacccttcccagctcacatcttcagaaaggaaaattccactgcctgccttaatgaacttacgccggtctctaaacactttagtctaggaatatctcttctgggggttagcttattatctttattatgcattttagaggtggatgttactgcagataaaaataggaattcccagaggaaccagcaccagcatcatgatatgctgtatgtgcaatgttgttgcaaacagttccccatgagggtgagatggagacccctgcatatacacataactgtatctcacaattattaaatattgattcatctcagcaggggcctgtgtctgatttaaaataaaggcaagtgcattaactgatgctaatctaatctagacctatagcactgcaccctgggctgtctccactgaccctggttctctgattgacagtgtgcatgggagccatttcctctgccaaccattttgactctagaaatgcgcacacatgagtttatatctggagttataggatatgtgggatgtgagcataagagcttaataagaaagaaaggaggcctacatgatgatgaatagcaattacagggaattagattagtatcagcatctggagtaattgtaaacattttctggtgctgatgtttgatagtgttgggaaggggggcaggtggtggatgatagaaaggaagagaggccaaagataagaacaaatatgcaagtctatagtgtgtgcttaatggaactgagatttgtttctctgtgtgtctttttaagcctctagatagatcatgaaaaatacagccagctgggaaagaaatagcccaaatgtaatttaaaggacagctttttaaccaatacttcaacttggagacacctgtcctatgttccttaaagatgctcagctcaggggaggagtattaaagttgctgatttatcttcaggagcacagacctatttttaatttattgcccagtgacaggtttcttgtttagcttttctgtgttactcaacacaaccttctcagtaaagaagagctgcctgcaggacattgttttatttcatgttccagagccttagaagaaggaaccgaacttggacttctccaaagcatgttgacactctctctagcttcatggcaagcagcaaattgtgcaccaggaaatatagttgccttgcccactgattcacggcagatacacacacacacacacacacacacacagacacacacgatacttgagtgccttttggagtgtgtgtgacagcaatggtttaatcactcctgtgtcaatagttatgtcatagaaacctttgccagaaatatgtcttttagtactgtagagccacaagaaagaaaatgtgtgtgattcggtttatgcatacaaatgaacaatcgtttgtggtgctcctactattcgcaagaaacactgttccatgctgggggccataaaggcgaagcacacaaaagagataaaaacattataggtcctgccttctagaatctcatattcttgtgggaatgataggtacatatacgaatagttgctaagacaaactgtgatatactcgatcagagtggtttgaacaaagggcaaagaaggaataaattaattctggccaggggagttcctctgttcaacaaaatgatttgagcccttgttgtgtgctgggaattgttggtggaagggacagagtgtgcacaatacaaggtttggttctcatagctgttacattccaatgagaagagagagacatcagacactaaacaaatgagaatttcagagagtgtcatgagccatactaataaccaaagcatggtaatgagataggccaggaagctatgtgaggtagcatagcaaggaagggcactgagaaggggaaatttgaaatgagaactaaatgataaacaactaaatatgtgacactctggataaagagcatttcaggagaggaaagaaactataaaggcctgaaggttcttaaccttagcatctttaagagatagaaagggccgggtgtggtggctcacacctgtaatcccagcactttgggaggccgaggcaggtggattgtgaggtcaggagttcaagaccagcctggccaagatgatgaaaccccgtctctactaaaacctacaaaaattagctggccgcggtggcaggctcctataatcccagctactcaggaggctgaggcaggagaatcacttgaacccaggtggcccaggttgcatttagccaagatcatgccactttactccagcctgggtgacagagtgagaatccatcttaaaaaaaaaaaaaaaaaagagacagatagcagatcagggaactgagtgaattctgggcaaaatagtccaaggtaaagtcagagacttccttcaggggttagctctgtagcatcttagagacacagggacacaggtatggattgtgaatttaattctaagttcagtcaaatgccattggaggtttataagcaggggatgatattatttgtttttttttgtcattttgctttgttttaattactctagtcatgatgtacagagtggaatgtccgtgcaaacagtaaaaacaggaagaccacagatgtagtaagagtagaatagacttggatagtatttaccagaggggaaaaaacaggtcagtgtccacaaaactaaaaagcattgttgcagccccctacccctgcacactgcccctctggaatgcttatgcttgcggccaccacccaacgaagtgctgttgctggtggtctgggagcagcttagccacccaaccccaccaccatgctagagtgctttcaaacctcagctccctctacaaagtgctggtgccagtgatctgggagcacctcgctcccaccttccagtgcagccagtgctcaacctcaaggagacagaggacaaagccacagaccaagttccagcccaacagggttagagcacactgcccaggagtgatcagctgagccttggccctctgaacacctctggaaatgaagccatttgactatacccagcttgcatcgcagtcaagccctcaagggctgtaaagaacataaaaacaaaaagccctatccaaagacagtaacttcaaaggatagaggaacatcagccttcacatgagaaagaataagcacaagaattctgacaactttgaaacccaaagtgtcttcttacctccaaatgatcacactagctacccagcaatggttcttaagcagatggaaatggctgaaatgtcagaaataaaatttcggatctgagtggcctggaagatcaacaagatacaaaagaatgttgaaacccaatccaaggaaaagagtaaaatgatacaagagttgaaagatgacatgaccattttagaaagaaccaaactgaactgctggaaattaaaaatttactataagaattttataatacaattggaagcattaacaacagaatagatcaagctgaggaaagaatatcagagcttgaagatcactcctttgaataaatgcaggcaaaaaaatttttttaaagaatttttaaaaatgaacaaaaccttcaataatatgggattctgtaaagagaccaaacctacaactcattggcattcctgaaagaggagagaaaacaagcaacttggaaaacgtatttgaggatatagtccaaaaaattttcccagtgtggctagagaggtcaacatgcaaattcaagaaattgagagaacccctgtgagatactatacaagatgaccatctgcaagacacatagtcatcagactctccaaggtcaaagtgaaagaaaaaatattaaaggaagctagagagaaggggcagatcacttacaaatagaacctcatcaggcaaacagtgaaactttcagcagaaaacaaacaagccaaaagaaattgggaacctattctgagcatcctaaaagaaaaaaattccaacccagaattttgtaacttgtgaaactaagcttcataagcaaaggagaaatacaatctttttcagacaagcaaacactaagggaatttgttaccaccaggcctacttcacaagagttcctaaagggagtggcaaacatggaaaagaaagaatagtacctgccatgcttaagtatgtagcccactgacactataaagcaactatgcaatcaagtatatgtaacaatcagctaacaacataatgacaggatacaatcctcacatatcaatattgacattgaatataaatgagataatccccccacttaaaaggcatagtgtgtaagttgtattaagaagcaagacccaacagtctgctgccgttgagagatatatctcatgagtaacaacacccataggctcaaaataaagggatagagaaagatgtatcagtcaaacagaaaatgaaaaagagtaggggtcgccattcttatatcagataaaacagattttaaaccaaagttggtcaaaaaggacaaagagaatcattgcttaattataaagggctcaattcaacaagaaaacttaactatcttaaatatgtacaaacccaaaatcagaacatccagattcataaaacaacttcttagagatctacaaagatatttagataaacatgcaataatagtgggagactgcaacaccccactgacagcattagacagatcattgaggcagatatctaacaaagatacactgacaaacatgacacttgaccggttgaatttaattgacatctacagaacactccacaacaacagaatgacaacagaatatactttcttcttatctgtatatggcacatactctaagatcaaccacacactaaaccataaagcaagtcgcaataaattcaaaaaagtcaaaatccaccaaccatactctcagaccacagtgcaataaaaaaagaaattattaacaagaagatctctgaaaaccataaaattgcatggaagttaaacaacctgctcctggatgactttggggaaaagaatgacattaaagtaaaaataaaaaaataaaaacaattttcgaaactaacaaaaatggaaaaaaaaatagatcagaatatttgggacatagttaaacagtgttaaaaggaaagtttatagtgctaaaaacttacatcaagaaattagaaagatctcaaattaacaaccaaatgtcatacctagaagaactagtaaaacaagagcaaaccaaacgccaaagataacagaagaaaagaaataaccaaaatcaaaacttaactgaacaaaattgagatgcgaaaatccatacaaaagatcaacaaaactaaaagttaagattattaaataagagagaagatgcaaacaccatcagaaatgacaaaggtgacattacaaccaaccccatagaaatacaaaaactactcagagactattaaaaacacttctatgcacacaaactaaaaaacctagaagaaatggataaatttctggaaacctacagcctcccaagattgaaccaggaagaaattaaaatcctgaacagaccaataatgagttccaaaatttaatccataataaaaagcctactgaccaaacaaagaccaggaccagatggattcacagtcaaattttaccagatgtacaaagagctaataccagtcatactgaaattattccaaaaaataaaggaggagggactcctctctaactcattctatgaagccagcattataaagacacaatgaaacaaacaaacaacaacaacaacaacaacaaatcttcaggttattatccatgatgaacataggtacaaaaatcctcagcaaaatactagcaaacctaatccagcaacacatcaaaaagttaatttaccatgatgaagtaggctttattcctgggatgcaagggtggttcaacatgtacaaatcaacaaatgtgtttcactaaatagaattaaaaaaaacaaaataacatgatcgtctcaataaatgctgaaaaggctctcaataaaattcaacattccttcatgttaaaaacccctcaacaaattaggcatcaaaggaacatgcctcaaaatgataagagacatatatgacaaacctacagtcaacataatactgaacggacaaaagctggaaccattccccttgagaaattcaacaaggcaattattaccactctcaccagacctatgtaacataatactgaaagtccttgccagagaagttgggcaagagaaagaaataaaaggcatccaaataggaaggtaggaagtcaaactatctctcttcacagatgatgttattctacacctagaaaaccctgtaggctctgccaaaagcctcctagaactgataaacgaccacagtagagtttcaggatacaaaatcaatgtacacaaatcagtagcatttcttccttttttttttttttttttttttttctgagacagggtctcactctgtcacccaggctgcagtgcagtggtgtaatctcagctcactgcaacctccacctcccagtttcaagtgattcttgtacctcaacctcttgagtagctgggattacaggcctgtgccaccacgcctggctagtttttgttcttttagtagagatggggtttcaccatgttggccaggttggtctcgaactcctaacctcaagtgatctgtctgcctcggcctcctaaagtactgggattacaagtgtgagccactgcacctgactgaaatcaatagcatttctctacaccaataacttccaagctgagaggcaaatcaaaaacacaatctcaattacgatagccacaaaaagagtaagatacctaggaatacgtctaaccaagaaggtaaaaaatctatacaatgagaattacaaaacactgctgaaagaaatcagaaaagtcaaaaacaaatcgaaaaacatttcatgctcatggataagaagaatcaatattgttaaaatggccatacttcccaaaccaatttacagattcaatgtaattcctatcaaactactaacatcatttttcacaaaattagaaaataaaaactgtactaaaatctatatagaaccaaaaaaaaaaaagaccccatatagccaaagcaatcctaagtggaaagaacaaagccagaggcattatattacttgacttcaaactatactacaaggctacagtaaccaaaacagcatggtgatgttacaaaaacagacacgtagaccaacagaacaggatagaggcctcagaaataaagtttcatacctacaatcatctaactgttaataaagttgacaataacaagcaatgggaaaaggactccctattcaatagatggtgcaagataactggctagccttatgcagaagattgaaactggcccctttcttttaccatatacaaaatttaactcaagatggattatatgcttaaatgtaagacctaaaactataaaaacccttgaaaacaaaccaagaaaatatcctcctggacattggccttggcaaataatttaggactgagtccccaaaagcaatagcaacagagccccaaattgacaagtgagacctaattaaacttctgcacagcaaaataaactgtcaacagagtaaaccgacaacctatggaatggaagaaaatattcatcaactatgcatccatcaaaggtctaatgtccagaatctataacgaacttaattcaacaagcaaaaaacaaataaccccattaaaaaataggcgaaggacatgagcagatatttctcaaaacaagacatacatgtggctaagaaatatatgggaaaaaaaagctcatgatcgctaattgttagagaaatgcaaatcaaaccacaatgagataccatctcacaccagtcagaatgctattattaaaaagtcgaaaagcaacagatgttggcaaaattgtagagaaaagggaacaggtttactctgtttgttggaatgtaaattagttcagccactgtggaaagcagtgtggagatttttcaaaggacttagaactacctttcaatgcagcactcttgttactgggtatataccacaaggaaaagaaattgtcccactaaaaaaaaaatacactcatatgtttattgcggcactattcacaatagcaaagacatggaatcagcctatatgcccatcagtggtggactggatagagaaaatgtggtacatatacaccatggaatactacacatccgtaaaacaaatcaaatcatgttctttccagtagcatgggtggagctgcaggccattatcctaagtgaacaccaaatacggcatgttcccacttataagtgggagctacacattgaatacacatagacacaaagaaggaaacaatagactgtagtgactacttgagagggggaggatgggagaaagatatggggtgaaaaactacctattggttgctatggtcactacctgggtgactggatcattaatacaccaaatttacccatgtaaactcacaatttacccaagtaacaaacctgcacatgtactccctgaagctgacataaaagccaagagaaaaaaagaaaataaaaagcatcgaatccagtttttggcctgtgagagtgaagctcaaagggaggttaaggctgatggcatgaatttggaaaccatgggtatctgatagcagttaagccacagatgggatggaagggagttttagttaaagaacagggctgatggtcatgaaatagaccatgtcagcatttagagtttgacattaaggaggagtagccagtaaggtaagtagagaataaggacagtgtgatagcatcaagccaaagatggaagggtagatctgctcaagtactgctgaaagattaaattatattgaggacagggaattgggcattagatttggtaagatgtacctcctgggatttggttacacagagattggggaaaatgattctattaatagttggattggtgagtgcatatttgtgtgtgtaattctatttttgatcttttaacatgtcctgagtactatgtaaataatctaaattaccatttgtcataaccaccctattaggtattgttttttttttaattttgaaagagagatgtttattgatttttaatttttttattatttaagttctagggtacatgtgcacaacgtgcaggtttgttatatatgtatacatgtgccatgttggtgtgctgcacccattaactcgtcattgacattaggtatatctcctaatgctatccctcccccctccccccaccccacaacaggccctggtgtgtgatgttccccttcctgtgtgcaagtgttctcattgttcaattcccacctacgagtgagaacatgcggtgtttgcttttttgtccttgtgatagtttgctgagaatgatggtttccagcttcatccatgtccctacaaaggacatgaactcatcattttttatggctgcatagtattccatggtgtatatgtgccacattttcttcatccagtctatcattgttggacatttggattggttccaagtctttgctattgtgagtagtgccacagtaaacatacgtgtgcatgtgtctttatagcagcaagatttatattcttttgggtatatacccagtaacgggatggctgggtcaaatgatatttctagttctagatccctgaggaatcgccaccctgacttccacaatggttgaactagtttacgatcccaccaacagtgtaaaagtattgttattatttgcattttgaaaacaggacactgagaaattaaataactttctgaaacatatgtctgtttatacatttattacttatttatttgagagacaaggtctttccatgatgcccttgctggggtgcagtggtgcagtcttggctcactgcagcctcaacttcctgagctaaagtgatccagcctcctgagtagctggatctacaggatcatgccagcataaacagctaagttttaaaaatttttttggaaagatggtggtgttgctatgttacccagggtgatctcaaattcctaagctcaagccatcctcccacctcagcctcccaatgtgctgagattacaggtgtgagacactgcacctgcgcttataaatgtattgaatacgactaaactgtatacttaaaagtggccaaaatgataaatgatagatacattttaccacagtaaaagctttgaaaaactatggctagtagatagtagattcaggattggagcctgagtctacttggctcccgagtctgagttcttggctatggtcatattctgcagatttgcatagagcccttactgaatattaatccattcagatagagagcaatgtgtgatatttatcaagcataattagagagaagactagaagataagtggggaaggaggagtgcctaatgtctcaggacatgtactttaaaatttattctgtgggtggacagagttggcaaattttgaacttttgaattcattcactcatttagtatcagccatccagccaatatctaataaggccctaatggaagacaaggtgtgtttagctaggactaaatgatcagcaatgtttcagacatgtagacctgaaaagcaagcatcttgtaagacaagataaacattatcaaccaaggcaggaagtacggaaagtggcagtgaattctttggtagaacagtcacagtctagggtggctagagtgctaaatgggagagggccttgaatgacaaagcatgggtttttaaatcatgttatgtggacagctatgattaatgaaacataaaagatcatgaaacatcagcaggagaaatctaagaaaggcgtgacaccacaggtagggatgtttggtgactgcaaagcatggtacatagagtgtagttcacctaattcatatggaggaggtttattacatggttaaagatacaaagggtcttaggttctgaatttttgttagttttgaggcacaacgtttgcttctatatgcttttctgtaattggacatattttggattgggtggtcaggctctttgatgtgcagagataaatgaacgctgttcagtggcgtacatcttttacagttctcaatagcaagagaagatgctggcataaaacccacacaattgcatttctcatagtaagtggtcaggtgacctcttcccctctgtatccatagataggggagaaattccttcctgagtgataccggggagtagatggccttgtgtcaagattcactgacatcctgatgggcctgctttctcctgctgggaactggtgagcgagaaagaagagttattgtcaaattcccaacttgccctttttgatataaagttcacttgtaattttttttttacttgtgttgctaatgcattttgttctcccaagtgtgagagacctagcttcctctgtagcctttaattagtttctgaatgatgacatgtctactgagaagcaactggttgcgtccctccaatctcggggggagataaaggaatctaataaagacattcggtatttctaggtgatgtgtttgacaagctttgtattaacaagaagtcatgttgaaacttctctctttccccaactgcactgcctcactcgctccagcactgtgacatttcacagggggattaacagagctgccactctcgctgagaacttgtagtttaaaacagacagacctgtgtctctacccctcatgctaaaggggaaggagcttcgccttgatctattcaccagccataacctttatgagggatttagtggcaataaggtcttggaacacaaaatcaacggataagtttcctttgacagcagtgggaccacctcccaggattcaagattcaaggtcggataatgagatgtgtcttcctcgcagctgcctagttattccctaagacggtggtcacaaggagtgtgggaacaactcaagttttaattctggcatgagcaatattgggactgtagcactagagagaggctgaaactcttctcagggctaatgaccctcctttgctgaactcaactgtgcagttatttggagaacaagagaaaaatctctggaattatttgcactttactgcagtcatggggtgaggtgtggtggggacttcaccacagccttcttactgcagtcagcataattccctgctgcatacagttttatagcttgtgtttgagtgcataactaccagtgcttttaggcaattaagaattaaagtgccgatgacgccatgaaggcagctgagaatgtaagtgagcttggcgctgttggcagccagcagattgacagctcagaaatgcaggtttctgcagagctgagagccgagagcggcgaccacctggggacaggggcttagtctctatctggttgacctccatttgacctgagtgaggcagcctaggagagaggaatgattattacctgagtatctcttaagggcaagaggagaacattagcagaatcatggctcagagtctaagaggttaccatgacctatacatacatacttacatatttgtttacctgtatgatatcaagatgtagaaatacaaacttcatcccagggtagagtaatggcacagactattatagcaaaatgttttttctctctgtgaagtgggtttctgaacagaagcaagggcatccaaggggcagagttagctaacatcttcctgattttgcagacaaatgacccctattgaaaaggtagtgggattacagaggttgaagtccttagaactagaacagaagtgtgtgtacctagagtgtccctctaattgaggctggagctgccagtggcaccctctacccatgagttttctaagcctaatggaatggggtcttgttccatttctatgaagatcttttggagattgtggaaaaagtctgtctaggggagagaagcaactaatggagtctggtatatgatagaagtggcagtcaccattgcacagcttacagtatctggtcacttgagtttcatgaacatcagctgcattcttgctttgggaaaggaaagtcacagtaaggtgccagatgccaaaagagcgaaagacacagcttaacgaggccttgcggttgagcctcaaaggatatggcaaggctatggcggttgggaactacaggaatagacaattcctggtgagaagaaattagaaacagtgatgtcagaaatctcttgccagcccctggctctgaggagaggatggatgtgaagaaaccttgcatgtcaggagatgttgctgagcactataaataaatcctggtcagcacatcagggttggtttttacagcaaacaattatgctgtttaccactaattcattgaactctgaattatctcaatcacaatagcattcatttgcagagtgattagtaattcactaagtgctttcaattatacctacatattttattggatcccaaatccctgtaggaagagcttgggtctgagaacagccactttctagctcagtggcttcgagcacatcattagcagggtaaaacctcagattcctggatgaaaagggagagtatatgggaagcccttattaggtcttcaacaaatattagttttctcccatgaggaataatattaaaaagtcatatttcctctgtttttacttctgttctcttcctcacgaaattatgtaatgaattagattaattgattcctttctcattgtgacgttatttcacgttttgaggatcttttgcttgtatacattttggctgtcagttttcagggacaccttattagagaatctgcagtgtgtctgacattctccatgatggttttgggttacttgtgtaacctctccaagcttcagtttctcgactacacggtggggaatcatgccttaggagttacggtgaggatttacaagggagcagcaaatgtggaacacctggcaaagtgctcggaatagaaggtgtttggtgtttcttttcttcccaccccatctatcctcccttcgtgaactggtccctaaagagagaggcctggtggtgaagggcaataaagccagtcatatagccccaacccaaagcatgcactgccatacatggaaaacacgcacagctgggaaacagatggccctgtctggatggcaggtccacatcatgatcactgatacaccccttatgtttccatgttaaaaaattgatgaagagacacttcttagtaatttcttagatgtgacccacataatagggcacttatgattacaggtagttgctgtgaaattcaatttttaccattatgccccgaagccaagaggcatggaataaggaaagaatggtatggactgcactctcttatgtctccatcaggaatgactaaaactcggtcaagaggcagagctcataaagacttccttccacatttcagttgatcctgaaaggaacaagttccaatcttcagaagcactggtttatgactaatcctgaaaaaatcactaggtttttttcctagagcttcagggttttctagccaacatgaatggttttactatggagggcgagagaaggaatgagatgtaacaaatgacaaaagggttctggtgaagagaataataatccactgaggttatgccattaaggagctttctacattttcaagctctcatttggaattctgattgactgtaatctgacccttccgttcttgaaaatgatggcagcaagcgcattgctgacaaaagaatggggtcctgttgcacagcgcaccctggcctggggcctgagtcctcatttaaagatgctgtttatcctcaaaccttgagcacatcagcagggcgtgtggtgcatcccaatgtccaaaccaaaacagccccctactgcactaaaaatctctatttctcttcgtattggtctctacaggtacacatttttagtaacactaagaaaggacatttgattaatgctttatgtataaaaagtgatttcttaacattttaatctgatccacagaacatctattttgaggagaaaagataggtgttgatatataatgaatacaatcagagactctaatgattgccatgcacttatacagctagtaactgtggggtgtgggcttaaaacctcggcttctgatatgaagcttagggttctttttttatcaaaagagaccttagggatcttcatgtatattcccatgattccatgtgcgtttgttatttttctaacccatattatttccatttgaaaaaacactgcgcggtggcacatgcctgtaatcccagcactttgggaggctgaggcgggcagatcacgaggtcaggagatcgagaccatcctggctaacacggtgaaaccctgtctctactaaaaataacacacacacaaaaattagctgggcttggtttcaggtgcctgtagtcccagctactcgggaggctgaggcaggagaatggcatgaacctgggaggtggagcttgcagtgagcctagatcgcaccactgcactccagcctgagcaatagaatgagactccatctcaaaaaacaaaaaacagcaacaacaacaaaaaaaaaacactgcaattttcagctgtatgtccttgaacaagttccttgactcctctgagtatcggtatcctcatctgtaaagtgtgggaactaattaggatgaccaatgcatccccatttgcctgaaatgcttttggtttcagcagtgaaagttttatgtctcaagaaactctccaattccaggtagacctgggcagttggttgccttagagagaatatctatttgtggggttcatacagtgaaaaataaaataaaggtaatatagccaaacacctgttatacagcaggtatttaataaatggtaattatcaacatcattatgttcacttacagtccttgggggcaatttaaagatcttgaggaaattcagtcatttcaatttgtttgcatttgcatacagccttgagagaatacagtaattcattcactcagaaaaattgttgaacacaaacgatgccaggcattatgatatgtgatgaccattttcaatgaacgagacaccagtggagcttacattgtacttaggagaggcagacagttgtgtagcaagccaggcaggctgggggttctcttgtagaaagggggtttgaggaagccttctgtgaggagctgaaattgaaataattagacagaaccaatgtgagtagcaggagaaaggcaagtgtgaaggatggagtcaaaggtgggcttgaggcatttgaagaggacaggtggccagcagggtgaggaagggagaatgctgtgggaagagcatggagagggaggcggcatccagagtgtgcaaggcctttgagaccaaagaaggagtttgccttcatgctccatgacagattcatctctccgttcagtgtggatgagagaagggaggtcctaaccaagcacatttgccacagcctgaatcccacctgaaccactcaactgtgcctaggcttcgcttgggtacacagtggcccttgggaaaagatggatttttctcaaaaccaacacctgcttggttgcatctttccaagctttccaatctgggttggacattcatgcaccaggctgttctcataggccttagtgtctctgcacgtggtctggaagccagaaaggttaagagcactccagatttgtcccattaattctgtaaagacaaaggtccctaaagaggccttagcagtgaagcagcccttgctgtgagaactgcccggaggagatgcgggcatctccagtcttcaagatagaggagaggcaggaggggaacccccactgccagccaaggaagccatctgggatctgtagatctgcatgcgccgtgcagttacctggtccaagtggcttatgtgcattctcagccccacaggactgcacagtgcttcataaagcatcctgatttggatttaataggatatccactgtgtgctaaaaacagcaaattgctatttattaatgacataattattaaaactcaacacctgggcagtggaagctaaaccaagagtagggaagttcctcagaatactgttttaataattatcttatttaattatttacacatttgaattaaaattcaataagagccggattaaacattaacctaatgtattaaacatggaactgtatccaaacagcatggctcccttggcttctgtctttcttcctaaacataccctaaccactccttggtctttcggtttctataattggtatattttctagattcagctctcagaagccaggaggcaccacatacatgcctgtgggtaaaagccaatgaccttttcaaaggactcttccactcatagcaggtctaatttactattggcacgtcagttcttacccctctgctctttacctttcatgtggattctcaaactgggatcttgcccagacctccgatcctctgattccaactgctaacataatagtaatattcttcctggatgtccctcatcatctcaccatcagcaagtctaagatagaattaatcacactaatgttctccccaaaagtagttccccctagaaggtctaggggtctccctgtgcagccgtccagatgctacttaacagaacggcattcctgctcgaccccatctccctggttgtcctcctagcaaccatttgtgcatttttcctgggcatggctctccaatccatcccttgcttttcatcttttcagagccaacagtttaatccaggctttgaacatcactgtcgattgatttctgtgactccagtttctgtctattttactccatctgacacaatgttaacagattctttttcttaaaataaatttttaaaaaattacgacatttcttttaaaaaacttcaaatgcttgtcactgcctgtaggatagagctaaaacctaggcactaggcattcacgcccttccatcatctggctgtcattcacttcatgatcttgtatcccatttttcattgattctgtcaaaatttatggactgtccattctgtgttgacactgcatatatgtgtttgccaagcacatacaatattaaaactcactcattgagcacttcacattgccagaaactgttctcaatgcatttcataacttactcctatgtctttgaaacagtctttatgaggttcagacagttattagctccattttataaatgtggagagcaagacacaggcaggtgaagtaacttggccaaggttgcccagttagaacatagtagagccggatctcagcccctgctctgcgttgcctcttgtagtcaatagacattgtatttcttcagtttgtggatttctgccttcccatctgtgcccatgcaattctgtcccatttgaaacagcttcactttttctgcctagatacctgtttctcatttgttgagacctaaaataaactccaatttgaggtgaagccatctctggaactctctctagctgttatcctccctcctagtaactcatagcacttaaagtttgtactgttcattcacattcaatcatacacaattttccaacatattttgccttgttattcaactctctggaatgtttacatgccctgtttcctcaaacagattgtaagttcatagagggccaggcaaattggtatatgtctgcatgtctttcatatacctagcacaccattgtgtaacagtaggtgttcacaaaatgttcattggatgacttttggcccagcttctaaagcaagggtctccaaacctcaggccacataccgatactgctctgtggcctgttaggaaccaggccacacagcaggaggtgagcagctggtgggtgagtgagtgaagcttcttttgtatttacagccactccccattgctggcaataccgcctgagctctgcctcctgtcagatcagtggcagcattaggtaggagcacgaacccttattgtgaactgcccatgcgagggatctaggtcgtgcactccttgtgaaaatctaatgcctgatgatctgtcactatctcccatcacccccagatgggaccccctagttgcaggaaaacaagttcagggtttccactgatcctacattatggtgagttgtataattatttcattatatgttacaacattacaatgtaataataatataaatacaatgcataataaatgtaatgtgcttgaatcatcctgaaaccattccttcccgcatccccagttcatggaaaaaattatcttccatgaaacctgtccctggtgccaacaaggttggggactactcctctaaagtagacttcttccattaacagttgtgcctggccacaaaatgtcttactgatagtgcttgccttatgttgtctcctttgcctaggatatctttcctccttttctctccagatatgattaatttttacttactcctagggcttaacttaggcatcacatatctaagaagcctcttgtggcatccatgtcaaggttggcttagatgtatatcctctgtgtctccataacacgtgattcaccattctgtgtcaccatacattagaatattaggcttctgcatctattttgatatcttgaggctgtgaactccttgaggaaaaggatggtatcttatttagtttatgtctctaatgcttggcacaatgctggcatatggaaagtgatcaatgaatattgaagaaggagtgaatgaatgaaaataagcaaaacaatcctagtatgtttctaacagtctgagtgatgagaagtcagatatagaatgtatccatggaaacaatataaaaatataagtagccctatctcacacttggtcagaagcttccttatgaggatggcttagctaaaaccacagtgcaccctaatcaattcaagtagtcttgaatactgacaatgtactagaagttgccacctagaaaatcatattttgactcccttagcatcttaggcatatgccaatttgtttctgataattgggattgctcccctagtcaaaccacctcatctctatgccatgaatgatctgtctttctcactcacccaagggcaatttgcctccttcaaactgtattcttaggcagaatttaaaggacagcaagcacttctcaacttctacctcatgagttggatattttccaattattagtggggggagacaattctagatgattcttccaagcatgaggtgcgattgtctcatttaatatacttactgcactgacagctctggcccaaaccaccttctgtcctgcttggggactgtccattgttctctagtgtatgattagcagattacctatcatgcaggaagccaggaaaatgaactcacagtaagcccttccaaagcaagagtaattcattacccggcctgatttccacttaaaatgtactttaagcacacttccaactacaaaccctaaatcaccctgtgttcacaaagtccatcattttttattttattgcatggcattggcgtgacataatcccttgcagagcatctcggagtgctttacagatcaataaattacttacctgcacagttgaagcaacgtctgcaaggccagcacagacattctgcaggcagcctgtcctccaggaagcaagcaaggctgtgtgggtgctaagagtgagcagggacagggaccagcaaacgtatgggttggtgttggggggtgggggaaggaggtggctggtgcatgagatgggaatgctctagttaaaactctgaataaaacacatcaaagtgtctatttttgcaatgatcaatttaaatgattccagaactaagagaatttagaagcttgtacccttcaggcagtcagcaaatcaaatgctcagtcattaactcatcagttacctttctgtcctggaaggctccatgtagcttttaaaatgatataaccataaatggcattgttacatcttaaaagtcccagattatagagctagcattctctctcctccaacccttgtccatgtccactctccattatttctgtcccaccaaatgcttatgggagtgcaattgagtgtgtatgtgtatgtgtgtgtgtgtgcatgcatatgcagagacacacacgctgcctatctgaagctcaatgaggatggaaatctaaaaatgattaactgttgcttactctgtgtaacataccctatttaggacagcaaaaaactaaaaagttaaatgaggatcttttcaaatatcttatattaatgtaatttatagtataaaaggaaaggtgggaacatgttacataaaagtttactttaaatgccgtataggagacactacagtgctgtggaatccccaggaaggagaggtcacatcctcttcaggttcatctggacagccttattaaaggggtggtaattctctcaggccttgaacaattttaatagatgtggataggcacagagaagagtgtaagcactgaagtcagcaacaagggcatggggataaggagatagctcagtgcagcacagataagtacagcacacgcttattaatgatgagcatttcaattgggtggatgcaggacatacatggaaggtaacactggagaaggagagaaggggaagaaggctaagatatctttataaactcccttttcatgaaggaaaagatccaacacaactaggaatgagtgagtaatggttcaagtagaggcaagaccagcattaaaatttgcaaacccatctgattttagtgtgagggccccactctgacctcgcaacaagcaataaagtcatcgtgcagcttccctgggctctccggcaggcccgatcacattgtaagccaggtggatggtgtgctttagaattgcacagcatggtggctctgaggaatagttattcaaggaaagaatataacatgaagaaacagaagagtgctggatggaggggacacttaacttgccaagaactaagaagtcaaaaccagcatcaggagggttgaaagaatatctgccaatgacccaactctgaggttggtatggacacgttgcacacaggttgggaaggtggttcccttgaataaccattatcactcaattctgtaaatatttgttgagctcttagcgtggatacagatataagtaacacattgttcaggtcatcagaaagctcatggcctagtgggtgatgctaagcacataaccatagcatagtgaaataactgtctagaattggagtgtgggagctcagtaaatgacatctttactccatccacttgaatgttaaaacacataagacagataagtagacacatggaaccaaatatcacatgtttactagtggtaaagctgagactggagaattaggctcagatgtgcagcaacaatgaggttctacgactggaccccggaaagaaacgcacacacatgcaatggctggatgttccacaggccctatccagtccttgtgggtgctgcttctgaaaataagcacatggaggagcacaacataatataagcttcagaaggttccaaaatagaagaccaaaggaagtagacatcctgtctccaactttacctattagaatgaaccccttctctccctagggggagtcatttagtggagaaagaaggtgggggagagagagagagagatgttatggctaactgaggcttaatttgattccccaccaggtgtgtagaatgtgctctgggcacatggatgaagaagcagcagtcaatttgagatgtccaaaagggcagagaagtatagagggtagggaaagtttcaacaaagaaagtggcatttgctttgggccttaaggatggctgcgcgtgcactttgataggctgaggctggtgaattgcttgagctcaggagtttgagaccagtctgggcacatggcaaaaccttgtctctacaagaataaacataaacattaacaaggaatggcggcacatgcctgcagtcccagctacttggactgaggtgggattgtttgagcatgggaggtcaaggcttcagtgagccatatttgcaccactgcactccagcctgggtgacaaagtgaaaccctgtctcaaaataaaaatgaaaacgagaatggctgggagttgcccaggaaggataaaaggaacaatatgaacccaaatactttatgcccagacagggcatgatggagaacaagggagtcagcagaggtgggatcactggggatggccatggaaaggtgggctgatgcttgattctgcatggcctcatgcctagaaggagtcaggctatgaccaggtggccatggggagccactggagctgtttagacagagatgtgatatgatcagaattgcattctttcaagacatcgctgaatgcagtgtggaggatggctcgtggatatgtgttggaggtgggtgggggtgagtggatacaggaagagggtggaggctaggagaacagctattccagtgttgcagtagaatttattcccattcggactccctgactttgtgtttaaataggaggaaatcaaagctaaattaaaggtaagacttttttatgtttaaggtaattcctctaatttcttatcgttaacttactgtagtccatatattttactctctggactgttctgccaactaccatgttaagacaactaagaaatgtttcaggaggatttttattttcattctgtcttgtttccacagtatctcccaaaattgtagagatttcttcagatatctccattaatgaagggaacaatattagcctcacctgcatagcaactggtagaccagagcctacggttacttggagacacatctctcccaaaggtaagagaacagtttgttgcattgcatcatgaggataaatgggggaattttgggcctttggtaggaggttatgggtgctgatacctactccagaggagtctacgtttttggtggcttgatggtaatctactcatggctctgcagagaacgttgatgttctctgcaaaacagccataccctctaagatttcagaattcatacctcagtatctctccagtcccttggaaattaatctctgttgtctctgggtgaaatggtggtaaggtgttctgggtgaactttacatgttgtttgatgatggaacaaagctttagtggcaattgttcagctggttgttttaaaatagagaaaacacataatgatgggtgagagctttaaatggccatattcctaaaaggagattctccaagtctgtgcctctgcagccttgccaaaaatctggtcacgagctgtttttgtggttttgttgttgttttactccgattgatcctagagaacaaatataacttaatatgtgactaaattgcaaaaatttactttatctgaatgctcagatgttacgtagaccaaagtgttgttttgtgctttcatggattgtacattaaaacctttagaatttgagacaagatgtcatttattattaagctagcttttatttgggaacaagaaagataaaaatatttcattcttaaatatttattgagtgcttgtaatagtccagcctctcttctaggcactgggggttacagcaataagccaaagcggtgaagttttcacactcatgaactcacattctcatgagacagatgacaaaaaaaaaaagagtatgcaatataacaggtggtattaagggtgagaaaatagaacaggatgtgttgacagaatgacaagagctttcttcagagaagggctctgaaaagaagatatttgtgcagagacatgaacagtggtccttaattgtgttgcttattgctgattaatgtgaaatgtgtgtatgtgattatgtatgtatatatgtgccggtgtgcacagatggatgaaggtgtgtgattggcatgaaagacgcatattagggggtgcttttggtctcaactcccatggaagggaaaagtgggaaacagaattgggcaggttagaagctggcttgtgcagtaggacatctcggctgagcctacggggagctctgaagctaggattgcccttcagaaggttcccttattgaggtgatggagctggtcctctacatcggcacagcagtccaaatgtaggctgatccccaaacaggtgtgactgtgggccaggcatctctcttcacatgagacacagggggctgaccaccgagggctatccaccagcagccggtccttctgtgaggcataagtcctctgctcctgaaggtgactgtgcatgacagtgtccactatacttcaacattttaataaatcagagtaagactatgaaggggccccaagtaccaaattctagacagtgacagttggccctaatggatgttctcagagaaggcgtgacattttcagttgtgtgtggcctgaattcctgggagctgtcctgggccaccattcttttttttttttttttttttttgagacggagtctcgctctgtcgcccaggctggagtgcagtggcgggatctcggctcactgcaagctccgcctcccgggttcacgccattctcccgcctcagcctcccaagtagctgggactacaggcgcccgccactacgcccggctaattttttgtatttttagtagagacggggtttcaccgttttagctgggatggtctcgatctcctgacctcgtgatccgcccgcctcggcctcccaaagtgctgggattacaggcgtgagccaccgcgcccggcgggccaccattcttgacactgtaactgtgaacaaggggtctttgaaagctattcatgtgtctgccagtctctccatttgaaatgacctcacatgtggactggcccaaaatcagggaggaagcttcagctgtgcatgagatcattagtgatggaaaatggccctgggcccttctgaaggaggggccattcagacaggtgcatgctaagtccgcggtgtgcaccattcatcacagcctgatgtgagtccccagtgctggcggatgccagcccagtctgtgcctttggagtctgcagaacatttatcatcagggtaagcttcctgtgcctgatgtcaagaggctctgtcttctgtttgatgtctcttctcattccctcatctggccagttctttgtccttttctgggtgtttcttcccccacttctcctgcatgcgtctcctttttgtcctgccattttatgcctataacttcccgataagttatttttgttgttgttctatgctttggctttctcttgcagcgtctgaaatgtttctgctttaatttcattattttccacattctctcttccctccttgcaattgtttgttgtcttcccctctgacatttgagcctcttgggtttgcctggctgatgttcacaaggctgtgtgttagagtcttttgtttccccttttgtgaccatcgaacagattcatttcccaagggaacttttgcctgagcctgggccaggtgtcccattttactgaggttttagctgctatggaaacagaagatggagcaaggaaagaggagcaggacaatcagaatgtacctgtggattaatttacatgaacagtgttttccagatctcaggtccagtttagttatcccggattcaaaatgatgagacatgccaagcaataactaatcacctcagaactcaccagagtgccatttcccagtgactgattatttggagatcagagatgtcacttggctgctgcccaatatgaactgaagctggagaccctcaacagtcaggccttcatctttccccagtagtatttcctaaaggaggcttattctaaataaaccaggatgggcttggtgttccttggagaagaagatctgcaccttagcggaggctccaaagaaagagcgctgttgtcatcttttgtgtcattcttcgagggtagatcacagttccatcaagatctttcttacatgcgaacctgccaaatccctggatgaacagctgatcagggctaagctctttcagcaaccctgatgacttcattgcattttttctctccagactgatctgtttgttctgtacatttcttaaaagtccttgtttccttcattatcacttatgtggtgctgcttgcgataaacttatataaacctctttaaattgtgcatttctagtcttgactaccttgtgtggaaaggagtacagaaatgttaaggactattttagacgtggctcatacactttgatataggggcagcttaggagtgaccatcaggtggaaacggagatggagggccctgtgtagcactttatatcagatagagaaaatgtcagttgtgcatgtccagtacagagagggaggtaggacctccaaggccacctcttggcacttccattgattgtttgaataatttccgtatattattatgggcattatgcctttgtagttcccttcaggaatttatcagaattcaaagagaaagtgagctagctttttaaagattcctgccctgactctgcacaactggtttgagatgggccgatgttgtttgcatctgcagagaccttggtcttttcaggaggaagagcccccatctcactcctctcactagcaggagccatctccatccacatgaaggcttattgaccccaagccggagtccttctaagtgctagcatagggtactaggtgcacaggcaccgttggtggaaccctaaccttctgtaggtagaaaaaaggaacagggcagccaactgcccactgtgcctggtgtcatgactctgtgctttgccctttgtctacatctagaccttcaagaatgtgttttttagcacatcccttaaactctcagctttctgtctccaatagaaaaacgttcatgctgtctggttctcctgagtcttcactatgtaaatagaagcatgatctctttcaatatactccaaaagatgctgtgttggacctcactcttcatagaaaagcattctgaaagccttattgttatgttaccagtttcagttggattgtaagagctttaaagacaagtctaggattcctacattgccacattcctgagagcccaaaatgaaactcaggtgagggagtgagtctcatcacttatctgtgggtgtcactatccatttgcagccagggatcactgagtgtcctaatggagctcccatcttgggtgcacttaccttcacctttctgtcatcaaacaagacactgacaataaaaacctcatctaggctacctagataacacgttgtactgagatattggtagggatattcagcaaagccctgcaaggtgttcacagaaatgtcctcctttccagtttattttcaatgtccctgtcccatgagttctttgagatcagagtttgcatctcacttctctttgattctctccttctagcacaatgcctagcacctaggaagtgtttaataaatattggtcagttcagtgaacaagcactgatatttgccaatgccccaaagaggcatgcctgttctcccagttcaaagactatcttgatccttcagaagttgtccttcactttgatgttggcatggagacctggagtgtttctggctggcgagtctccaggacattttctctggtcttcacaagatctccaagcctttcctgaagtccccttgaggggaccttgctgtggcaggactcaacttgtccttgaagaagaaactccttttcaagtttccttttgcaagaagagaggaggctcacaggtgacttggacagtgggtcatccatgagcttccttctgctgtcatggctgcctcattgcaactgctcttcatctggccattctagtgggcatctggcccttttggtgccttgctgtaccaagtactcctgtgtctaaaccccggatgactcccaaccactatttcctaaggcaatcccgatatcacctgggggattatttcaactgtatatgaaaatttgccattccttataggttaactaaagaaaaaggaaaagaaagaaatcaatcggtagaaaaaagaaaagtactttaaattcagttccactcttgtgcctctttctctctctctctctctttctgtgtgtgtgtgtgtgtgtgtgtgtgtgtgtgtatgtgtatgtgtatgtgtggggtgtgtgtgtgtgtttctcaggttctctctttctctctttttccttctttctctctgcctcctgatatatgaattgaggtgggttagagatcaaaagagatcttccctagggtgatataaagaccctgggggcagaattagagcagagccttctgtctgttggattccaagccaagcccttgttctgcaagcctttctctttacctaacgtgaagtgggtacatctgcgtggcctactctccataccaacagggctcagtaaccttcctcagctgccagatctcttccttcccacctcagttctccttttctacttgaagaggtccagtggacatttgactgccctgtttcttttttctggagttttaaaaggcaccaaattgatggaggcaaagtgacacccggataagagttctcctggccaatgccctgagccctgtgctccccctccccttccccaatatcctcaccccaccatacatccacctattttcctatttgtaagcactgacaaggccttctcctagccaagcaggacactaaagcactaattggcactagaggtatcacagcttgagttcaaccagagctggcaggttccatgactccagtgacagctctgtgaaaaagtgtcaggagcagagctctggcgtgccatcggctgactgcagcaccctggaactaatgagcagcctgtcagcaccagcatccggggccccgtgtggcgctgagatcattagaatggcagaggagaaagacttcctcagcaaagaggagctggggaggggagaagagggcaaaatggaactaaagatatcaccttacccacagagggcaaccacccaacaccaaaggactgagaagaaaaagggagaaagagagaaagcaaaagtttttctaaatccatctatgccaattctagacaactcttggaatctccttttggttgggttgccctgtcagtaatcaatatgggctgtaaatccttgcaataatccaagaaggggcctcagtgattaaattaactctttagtcttggctgtgctctgaaacctggaagtcgcccaagtctctaggaaagagggacctagggcgtaaggcaagacttgagatcttagtctttttgctatttgtcagggcaggctctctacctagggtatctcctgcactgccagctgcctgcctatcttctgctagagtatcagaatccaggagagacaattaatagaaggagttttcgctctgttattccttcccagagggaggtagggggactagtcagtgtgtccactctgtatctgcttcctgaggccaagtatgaattatccatcttgttcgttcttctgcttcaggaccagaactgggccttcaggtctgagcattaagcaatgcctggctcttctctgaggcttctgctactaacaatgactgcatttccatgagcaaaggcagcaatgtgtctgaaagagataggctttgaaggcaggtccaaggggatttgtattcccttgcactactcactggctgggtcatgctggagtagtgataaacctctctgaagatgtgcttctttattaatttcattcttgcttcttggcgtgaaccctggcgttttcatgatttggttctagaccccattttctccacacaccacagtcacactaacaacttggcattctccacacactagatgtctttgactttgcacaccccatctgttctccttccatcccccctacttcttttggtttgagttctgcccttgtttcaagaccatactcaagtgctaccagtttgaaagcctctggtgactttcttcaggcagagtgattcacccatttctttgagatcccacagcactttgcgtgcatttccaactatggcacctcttacaggtactcaagggcctctgactactcctgtcatgccagggatcatggcagccaggaaccaccctaatgctgttttgtctttagtgtctgataaagcaccagatgttttggggtcttgtaaatgattgttgaatgaggaagtatctgatactgtagatgtagttttcagtccctttctaaaattaagtctctcttaatttaatatgtataatattatattattaaaggtaatataatataataatgtatctctttgcatcagtttggactgtggatcatctcatatttcccaaaccaatcaaaggaattcataagaaaaggccctccccccccactgtcttcctcatgtgtactcaagtctgagctttagactctgtgaaatagagataataataccttcccacatggatatgacaaggattaaacacgtgcaccaatggaaagctcctggccccataacaacacatagtatgtgtccaataatgttagcttgcagaccttcagccagccccctcctcttcactcccacccgtgagaaaagaacggaagggaaggaaactcaagttattttttttctgaaaagattgaatctttataaaagctcaactcagtccattgccaaaatggatagatattcaaaggtgcttaatcagcaccactatcatctccaccattttctaattaacataggtgcttgattaaaattcccagtaccccaagaagctatcccaggagggccaagtaattgccattgcaaaagatattacagtagtcattgatggtgggagaacaaaaaaataattgcatcataatggaaagtggccagcttcctgttcagagtacctgtgaaacatagagcattaggttcaatatatacagaaaaaaagggattaattgtgacaaagataaaccagtggtacaacctcaaattggggaaaagtgtccaggaactccttacataagtggcttaaacacagacaggcagaccaaggtgggagagaaaaaagcagaggaagacatttatagatcactctttaactctgtcattctctttaactgtaaaattactgctagatagatgcagttagggtaaaatttgccagtgtcaataggggtttttgtaaatttaatatttatgatctggtttaaagcattattatagctgtgtaacttcctacttcaaagaagagagaaataataaaaagactagtggggaaattaatgagttcaatgtgctgaattgagaacatatgaaatcaagcctcattctagaaaccaagggcaggagtgcataccacagacactgtttgtggttttacccaattattttaaaacccttggaaaatattgtagaatcagatgtctgctgaattcagacattgctaacagcatcctcccccacactctccagagtcttaagctatttatgcctgtacttggtgaccgttaccatgcagaactgtcttgatggaacaaataaaggaaacataatagcaagaagattgtatcatcctccccacagaagccaaccagccatagctcagtaagatgcaaagtctcattaaaatggtagcccctacagggcaggagaccccatctctcaaccagcacccataagagtcagcaccgcctgggagtatgagaaggtccttagtgggatgtcccaccgcccatcacaaccagggtacctcctcgagtcacaccgctgtagaccagctaaaggcttggggagtttcttgtgtaggaccctccgagcactgccaaccaagctgggagaaactttcggatgaaaacgtccatatcactaggtcctcaggtgtatttttctgactttgtgcctactttcagatcctgagtcttgttttgacccatgacgactgcctttctcctggagtctaaataacaccagaggcagtatcattcaatcataacaatagctaacagttggtggatgtgcaagaatgtcgggggctctcttctaaaaacatttatgcatagtaatatctattcttcacaactaggcgagacaggtcttcttattagcccaccttatcaatgagaaaacttaatatgtttttccatttgaatgaggcttagggagatcaggctaatgggcccaggctaatgggctaatgtggcacagtgccacattgcagacgtgggttccaagccaggtagtcggtctgtccccagagtgcaggggcttcattgctgtgctgggtagtgtagttctcaaagggcagtctctggaccattgcatcaaccagcatcacctagttcatgccccagccttactgaacgacagctgtaagggtggggtccagcagcctgattttgacatttcctccaggtgattgtgatgcaagctcaagtttgagaactgctgctgtgtaaatgtgctctgtgcccagcaatcttcttcatcagcattatgttacttaattctcatggaggtcctaataagtaggcattatttttattttagagacgaaggcatgaaaatcagggggcaggagaaggaatttgcccacaaatactaaacggcaaaggtgaaattcaaatccaagactttttgactccaaaatccatattgttaatgcatattgatttcctgcttgatgtctagcccactgcttcatcttgctctctgggacatgtctattctctggtttcatcccacctaccagcttggggcacccggtctttgggttatgcacattctcacagcattcttacaaatttacccgcacctgtgtcatcgcgctggactccaggctctgctgtgtgccaggtctctgcattccaccctccccagcaacctcaggcttcttccagtaggtctggagatgagcacctcagtggcaaaggacagagcccttgtgtggaggttggacttcttcctcactggcagctgagctcttccaactgagtcaacctttctctttcctctcttccacctggatggccgtggcgcacaggacggacacagcctccctctgacctgacttttgttttcctcatgttaaatgctatcactcactcaaataatgctgtgtcttgtgcattgattattattagaagattgttttataccttaacagctttagacatgaaaagaaattgccagactccagggtatgtgtgtcctttcttatctgagtctgttcagtttccccacctgtctttgtgggagttggcattcttcatcttcctagctgtgtaaaatgcttttctctccagaaccaggacagttgaaagggattgagcagagcatcatttcagttcctcaaggccccagtctgccacctggctctccaaataccatggcacagccgcagcctgccttttgcactagaacccggagtcctgaagatgtggccccttccctgggaggctcatcttgccccttattctacccaacagtggtgggttcttctctgcttactgccctcaccccccacgcaccccaccctgaaaaacaaacctcttttcctcctcctaatccagagttaaacaaaatgactttggactttacagttcttccataatagattcaggactccccctgtttaactgatttgcagcccgggaggcgtttcctcccctaattcctttcatcactgccttgccctttatggagtgctttgctgagttgactgtggttgaagatatctggccagttatctgcaagatagaaaaagacaaatggctttctccctcattgatttatttatttcgacacacaccagtccagaaaaggatttaagcagagaaaatggtatggattttgtccccaggaaaaccttttggtaaagcaattttgattaacttatttgttcagtaattgtttattgagcacctactgtgtgtggggcaactctctgaggtactagagacctatgagtgaacaaagcagaccaaagccctggcctctcagaacttgtatgctagtgggagggagagaaaatcaacacatggctgaggaagccctgtaatatgttatatggtaattgctttagggtaagaggcaaagagatgatcaggtgtgtgtttgagggattgtagacttaaatagagtggtagaatggattcattaagaagatacctcataaaaggcggactgacatttgcatagctcggcaggagtactcctggcagggttcacagtgactgcaaaggcatgatatcaggacccagccggcacgctcacagaacatcaacatagccacatggtgacagaacctatttaaaaccttccctgtctgcactagactctaagcttcatgagggcaggaagcatgcctatccttgctcactgctatgtgcaccaatgtttagcaccaatttgcctctcaaatcatacacattcaatacatatttgtttaaaaaataagtgaataaaataaacatgagtttatagtttgagtacttgagcaagcatgctggaaagacatgagtttcgagtcagaaatggcagtcccttaattagtgatttcaaagaatgacaagttcaggccaatggcgggggtagcttatggctaagacagaggggaaggcccatgagaagatgaggccaggtaggtgacagcgcaggtgtctgaggactcatcacaaggagcgttgcagtcaccccagataatggctgaggctagtgacaagttgggctgtgagccaagtgtcaaagccctcgatgaatcttgagggactcaggatatcagtcattggcagaaaagaagagagggcggagcaacattgccaggtggcaggagcttcagaccagcaggagcagggctattcaataaaagtgtgaaagagaaaaggtctccacttgaggaggatcctccactacgaggaggatcatagacccaacctctgcatgccaaaacagacaactcaacattttcttgagaaagctaccgaggaggcactcccctcaggaaacagctgggtttcaataaatgaaggcagttcagggagcactctgcctgaaggctgatggtctcggggagcatcttgcctatgttgtgggtgttccagagagcccagtggatgggtgtggaaggtgggggagagtgaaagattggccagaagggggaaattcttttctctaggggaatgaatgggctggagagcctgatgatgttaggggagcaggagcagatgcacatgcctgtatgcaccctggcaataagagatgaggtgtgttggtgttaatcccacatgttcccagtggaaggtggtgaaacctcacctcacagatttcagcttcaacctgtgtctgtggcagggcagaaaccccttttcttcctgcccctgaaggtacagcagtggcagtaagtgggtagctctccataggccaagtcttcctgtggtccagagtaagaagaccaatcttcaggaaggcagtaaaaggtcaagggcagaggtcatgagatagtgggagtggagaagagagggtagggcttagagatatgttgggggccaaactgccagaacctgatgcttggtccaatgtaggatgggagtgagggtggaggacaggctgggaaagacgaccaggtttctggtttggcctcccttattgcctattcgggagaactaggggttctctgtccagcttttctcctgtgtggcaataggtagggtattatggacttgctgatgtctgatttatttctgcctgctgatccatgtgggttagctctcttttctacaaaaatgatcataacaactccagactcattttttaagagaagagggatttatcagattgaacagaaatgatagaatacagcagatatatgataaataggcagaatgaatcatcttttattcaatagatatttattgagtagctaaagcacaacagtgtatacttaggtgctgcagattgcatggtgaattcagcctttgcctcatcgggctgcagtatgggagtgtaggcaatattcaataaataaatatgcaacccaatgccagggagaggtagtgccatggagaaaaattaaaaaaaaaaagacatgggtgaagaaagccaggaggagctgcttttgttagagagtgactttagtgctgcaagaaagccagctcagcacagagcctagagacccaagcgagatgagacagcaagggcttgtatgaagagagggtgttccaggcagaggtaactgcaaatccaaggccatgagtggggaatgcatttggtgcgtatgaagaacagcaagaattctggtgctcagggaagtgatgtaggatgctgtgatgagagcccctatagtcagttcatgcatgaacctgaaaaccatgtgcaaaactgtgggacttgttctaataaaaatacaccagcacattttaagcaggagagcaaaataatttaataaatgtttccttttttaccttttttatttaaatttattttttattgtactttaagttctgggatacgtgtgcagaaagtgcaggtttgttacataggtatacatgtgccatggtggtttgctgaacccatcaacccatcatgtacattaggtatttcttataatggtatccctcctctagccccccaaccccctgacaggccctggtgtgtgatgttcccctccctatgtccatgtgttctcattgttcagctcccacttatgagtgagaacatgtggcgtttggttttctgttcttgtgtttgtttgctgagaatgatggtttccagcttcatccatgtccctacaaaggacatgaactcatcctttttatggctgcatagtattccatggtatatatgtaccacattttctttatccagtctatcattgatggacatttgggttggttccaagtctttgctattgtgaacagttccgtaataaacatacaagtgcatgtgtctttatagtagaatgatttataatcctttgagcatatacccagtaatgggattgctgggtcaaatggtatttctggttctagatcctttaggaattgccacactgtcttgcacaatggttgaactaatttacactcccaccaacagtgtaaatgttcctatttctccacatcctctctagcatctgttgtttcctgactttttaatgattgccattctgactggtgtgaggtggtatctcattgtggttttgatttgcatttctgtaatgaccagtgatgatgaggtttttttcatatgtttattggctgtataaatgtcttcttttgagaagtgtctgttcatatccttcgcccactttttgatggggttgtttttttcttgtaaattggtttaagttctttgtagattctggatattagtccttaaagaattactttaaccatgaagagaaagatggaggggagggggcgtaaagatagccagtaaaggcataaaggtatgccagttagaatactgttgatttcgtccatcaagaattgatgacgtcatggactgcagtggtaggatttgcaatctaagagtatgttaatctggaatatattctgaaactaagctagaaagttcattgattgattagatgaagtttgtgagaaagagctcagtattaagactgactataagatttgtggcctgggctgctggtgtataccatgctggtaatatactattcttgtccatcaaaaactccaagaaaagcatgcttgtggtaggaaagactttggtcctttagatatacaaatgaaaatgttgagtagatagttgactatgccagggagctagaaaaatgcatatgggaatcctaaccatacaggtggtgtttagagccagaggctggctatcccacatgcagcgtgaaggcagacaacagctttgtaggccaggaacagtggcactccaatagtccagtgtcaggaaaaggatgatccagcaaagacaattgggagatgagaaggaaatctcaaaaccagttcaaggagaatgtttcataaagagcaggtgtgattacagcacaagtgttgcttagaagtccagggagatgaggattaagatttggcaaaatgcacttatacacatgagacattggaaagaagggttctgatgaagacggtagataaaagattaattagaaagagggagaatgggttaaagaagttgagatagtaattaattttgctgagaagtttcactacaaagggaagcagaatatggagggtcagtggttggaggagagtgtgagttcaggattttttcctctaaagtccaatctgcagcctaatatcccttggtcctttactggctattattgcggtgtaattacttgtctcggtgttctctgttgttcctcctcctcaaataaaataggggaaagagttagccaagattggcctctgctttttgagcaatctatacattttgatcttcagccaaatgacctcaaaatttttatgtgtggcttttgggtgctctgggaatttggaacaaaagtcactatgttgctaaagcaattgactgtggctgacactaggtgctttgtctggaagtgagactatctgctgccagccctaatgaggattccactggggattgatagttgtggcacttacgggaaaaattgcttggagtgggaaccagcttataagaaggggcaggggacacagaacgatttctgctcatccccagtccctccccaaggaccaaggcagaagttctcaaagtcctcaatatttaaccctgcatgaccagatgctcacctgaagcaggggcgtatgaatgtatcttttttcaaaaaagatgccacagcaggaatcaagttaggcttttgaagccacccctctggcccacacacaagaagtcccctccttgtccaggagaagctctgaagggagtggaagtgcaggggcaacccaacgccacagaaatgtggacaaacactgcccaagtcgtatcctcaggggagtagggctctggggaaaatacctctgctctacgtaggtccatgccctgggaattctgtgaacatccctgctgcctcagtgctgtgaattctacatcaagggggcagaggaagcaggcagcctcagtgtttaggtttcaataatgttagggatgagggagagctcaccaacctggaaaacgtacctgccgccataccttgcccatctaatcttggcttccaggtgacttcctgggtattcatccaaaatgctcctcttcagagtcctaacaaacctattctcattgccaccattgccctagaggcactcctttcttggagagggaaagccagttgattgatagaacattgtataagatggggaataggagagaatagcttccatccctctctgtacccaccttctccccagaactcatggctcttgagaaattagagcaaattagtgagtgaccacagtgttttcctccacatcattctgctgtctttagttttgcttccagctgcccacactgaccagcccctgtgctgcttctgagcggtcacgttcctccgtgtgctgacatgtcttctctctgcatcaccagtttcctagacctcttggtttgggtcactcaggtgttgtcatggcaatgacatcctcagtagagtagcactgctcatgttgtcatggttatcaggacctcttgatgggagccccactgcactgttgtcatgcggagagcaggaaggaaccctaggaccttctggtaagcctggattcttaggctaggcatgagtcatctgtgcctgaaaatgaaggtggttatgattagggaaatagcagctgcctaaaatggtgagattctaactacttgagaaacgaataactgaaagagggatcatcatcctcatcaccgtgatcacctccttcccacctcctcttcatcctctgcatagtgtctgatatttttacggtagcttggctatgttccaggcactcttctaagtgttttccatttgagaactcctcatttttcttgacggccttatgatgtaggtgttcttgctgttcttttgcagatgagggaactgaggcgcagagcacgcacttagaccgcttgctcacaggtgctccctaacgtgcaatatggccaagacttaaccaggcaacctggttccagaggtttcactccgaactcattacctattctgtttcaatactaacaagaaaattcaagatgaatcaatctagttactgaaggcgttactaaattatatcaccttctttttggctagaatccatatagtttatattttttactacttttaagttttaaaatattttcatatgttcatttgattccaacaactgtctgcagttagtatgtctattaacggtattttacagaaaagaagatcaaagttttgagagttcataattccccaaggaaagttgacgtctaaactgtgttggacgaggtctgaattcatgacaatctgtagattcagaagctagtgttttgtcttgttctactgcatatcatgtcatgttatatggcccagagcctggctctggggaggaaagtggttcaaccatctaagataaatgggtagcagcagtcacctctatggatagaaggaccacatggcaagtcttggcatgttcactcaaggagccattcaccctcttttgccctcattattctatgcctaaaaattccactgtacagtagctactttatctattgccatataggcaagagagcagcaaccttccttccatggcaactgccgtcatagaatctgggctgccttgagcaagtcatttaacctgtacatgagaatcccaacagaaggttaattggctctgtctctaatataaatgacaattaaacacaaataagttacttagtagctggcctgtgagaaagtacagcttttaagagagaggaagctgagccctgagagtcgatgtatcttctcatttgagtacaaagggattgattggagggggacatgctgagtggggaacagcaaagctaataaagacgattataaacagtagcagcaaagacttctcattttttaaagtatctgacagaactttacctatatcagcatgtttatctttagagcagcactgtgaagtaggtaataatgtcatattattatctatattcaaaaaatagggaaagtgaggtgcagaaatgttagttaacttgctggaggtcaagtcagaggtggagatgggacctgcacccagcctcctggatgtgtctggcggcatcagcagctgtcttttctgcatttgaactgggtttcaggacctgggcctggagcttaatcaggggcataacgatgaacctcaacgctccctttctgctcaccactctccaagcagccgcgccttgcgcactttgcccaccctctctgagccttcgccatctcctctgtcaagttaagaccgtgataggatgtatattcctagcttgttgtaaggattatatgaggtaactcatgtaaatgcatgccggggcctgatataaaacaaatgctcaggattggtgtggtggcgcacacctgtaatcccagcacaataggagactgagggaggaggctcacaagcccaggagttcgagaccagcctaggcaacataatgagacccccatctctacaaaaaaattttttaatcagctgggtgtggtgatgcgcacctgcagtcgcagctgaggcagaaggatcacttgaggccagggggtcgaggctgcagtgagctatgaacacactactgcactccagcctgtgtgatagagtgacaccttgtctctcataataattgtaataataatgctcaataagtgtcagagtggtgacatcacaggtggtacacagagtgagcattagaattggtagttattcctgtcctcagcaaatgtgtcttcttaatcttaaagatgaacatactgtttatagcacagagtaaagtgccggatgtggcaagctaagatgcaaatgtccatcttcaagaccttttcacaatactccattttctctaatgcagagtttggcctatactattctcagatgacctgttggtacaagggctaccattttcttttggcagtgtttccaagtctccatgtcccctcaagtgaaatccataatgtcttctaagtttccagtggatttcaaagcctcataattaacgtccatttaatagcgatagcgaatgactgcttgttgctttcttaacatcctttcttttacaggtaaaagggtaaatttacaattagcagcctccaatttgcatagacacagaagttttattaagggagcaaaaagtgattgaaatttaactgaaagtaatactatgatctaggttttaataaaccaaaacaaatggatacattcttatttctattctaaaagggcattttattcaaaatgtgatggtccagtcttgaactgtgatatgtttttcgtcattgctgggtaagcaacttcctagccacattacacaaagtgaatttagctatgagctgtgagctatgagctggataccagtctgcccagtgacgagcctccttcattcctacttccataagaaagtaacttgggaatagtcagtgctgtccacaggccttgataatatcaagatgctgctggcctcatttgatattaaacatcagctctgacgctgttttcatgcacttttcaaatgaaagttctccccctgcctagctaatggatagggcagtgcagtgggaggagacccgtctgctgtcctccctaggcgatgtagctgccaagtgggtggaaggcagagcaagagagccaggaggttcacagcagtgtctctttccagatccaagggagacacaaaagggaattaaaaacttcacgttgcgttgttgtcactctacctgcgtctcgcctgggagagctctgcagctggagagtgctgagaagtcagcccttcagagcaattacaattcatattgactataaacttcccactgtgcgaggaaaggaaaggaggtgcttgccaagcgctcagaggggcgagtgtaaattatttcaccatctgatgatatataccacgttggcaaacattaggggaaaagaggaggagagaaagcaaagagtgtggggaagctgacaactgatctcccgcattcatgaaaggaactgggacccgggcacactgctgggacaggacgagtcgcccacctgtcgctgctgcagctggcttgtctatggtctacacttgggtgaggaaagcttttaacctgatgtcccagctcacacataactagaggagagggcagggaatacggggaagtgaagagcactttggtcagaacacttggtttgcctctttgctctgccagttactaagtgggtgactcttaacaaaccaattaacttctctgaacctttgttacctcatctgtaaaataggatcagaatatgaagattagcaacagtacattggaggtgctttgtaaacatgaacacattacgcacattatcctttattaaaagttttgtattaattatgcatattcttttgggcagtgccaagaaaataaaaaaggcagacaggagaggtgtaaacccaccacagagcaatcttctaagataaaggtgtttttacatttttgcaacacaaactcaaaaagcaaaaaacgtaagcggcgtttatgaccgttgttataacaacagcaattatcatttgttctcattatcgtttgctaactcctgcatttatttacacagcacaattaatctgaaagttcacctaaccatttcacaaatgctgtggtggaagggagtctaaggaaatgaagagagttgaacgttaggacacagctgggcagtgcaggaatcaaaaggtaaatcactgggcaaaaggaacaacgggattgataccagttttagaatggggccagacaggcacggggactcacgcctgtaatcccagcactttgggaggccaaggcaggcagatcacttgaggtcaggagttcaagaccacctggccaacatggtgaaaccctgtctctactaaaaatgcaaaataaaattagccaggtatggtggtacacacctgtaattctagctacttgggaggctgagggaggagaatcagttgaacctgggaggcagaggttgtggtgagccaagaccgcgccactgcactacagccaggatgaaaaatatctcaaagccagtgttgactcttattgtctcatttcatgtcactagggatcagcagattaaggcaggtaggtttacgaatagcttgtgggctcacaatgaatttcatatttttaagtggttgaaaaaattaaagaagaatcatatttcatgacttgtgcaaattatttgaaattaaagtgtcattgtctctaaataaagttttatcagaacacagccatgcccatttgtttatgcctgcttttgtcttacgatgtcagagtggagtagttgcaactagattgtaggtataggttggcaaagcctgagatatttattatctggtcctttagagaagtctgccaatccctgcactgcatgaacatggactcctgaaggttctgaacactgttattaaaattcttatttttctccatactccctttttgttgcctttcctcagcactctgtgaagttgcaatgaggatagttctcacatccattccaaatgatgcccacttctctgtcttccaagagtggcccctgccaccctccaggggtcctccctggcttgtagatgttgtgctccagtcgacagctatggctcaccttattttcaacctcagctacaacaagacactttcttgcctcgtccctgactagtcatctctgcctccatcttcattatgcaaacaattctatatcctgcccactttggcttttttggagtcattcttaactggggttaacaaaaatctgattcttgccctggatctttggttatgctcactggtctgcagttggttctggttctatctatggggaagtttgtttttggatagtggcactggttgctttgtttctgtagcatacagcattctgtggcagcatctgagtcggtcttcgctagtactgccttagagagggccatcatcttcccaggaggagcacatttgcctcaatcagcaccttcaaccaaaacatatcattgcatactccttatctctgctggtttcaaacccatattttaccatcaccaactcttcttcctgcctcttcaccctctctccctgttttctgtctggaatctctctgtagcaaaagtttatttgtgaagcagaggtggcatgccttaagttgaccagaagaccatggtcaaatgagccctactcaatttactacatttcttttgaattccttaggtatctcctcaggacctctcagaatcccgtaattacgatttcataatttcaaaaacactttacacgttataataataatgatttcaacaagaagagaaagggaccactttgtcatagagatttcttttctattgagatggactttgaaatcttgtcactttcaaaagtgaatctcaatttttacatcaaaaaattactagttattgttaactgtttgaagtatgtgtcatttatattcttctacataactttgttacttttgaaaatgtgtaatatgtgtttgtgtcaatcttgtagtcataaactgagcctttagaaatagattttcaacgttagattccagtaagatatgtttagctgaaacagatattgaattaaatcaggacgggcctttggtgaaccagcaggcaacatgcctgcctgtattaatgtggttctcccctttgctgtgatgcagagcgctccatatgatctgaagactctgttgtagcagcagtctgactcatgacattccctagttgtcaatgggatgaattctggaatgaagcccagattctaaagtcaacccacatgggttttctaatgcagggggagtcatctctgcttccatcttcattaaataccattagaatcatcttccgacccctcaaggagatgagaaatgttggagcctccaatgatgcatcaataggaagcaaggtgggttatcaaacccccatcaggctttaagtgttcactgtgtgtgggtgtgggtgtgtgtgcatgtgtgtgagcgtgtatgcatgtgtgtgtccagtcatcacgcatctccagcctccagaacgttcttcctcttgtgttgtaaactggattgaaaggtggtcacatttcagaattagcagatgcctagaatgtagtacttttggtagcactgaaataggagaaacaaaactataaaaaggaagttctatttctttcctacttttctttttcttcctctccctatgtagcactaactcatttgccctgcaaaagtcccttgggctttttatcaattagctgaggtaatgcaggctgagccacatggggctcagagaccaccctgccataagcatcgacatctgacagggtggattttccaagataattccacacaattctatatgggcctgtttattatcccattattagtgtttttaaaagtgaaccccctgggaaaattttcaactgattaatattcacctctggcatatgcagtctatttgaacaatgtggtgtttttgacaattatcagaactacttagtatacccccaggaagtagtcagtgatctgccattgctgtgaccctttttggaatacatgtcatcaaaatgccttcgatttggtttaaaaagtcagccctcaattttttgacaggcacacacacagacacacacacacacacacacacacacacaacaaaattgtataactcgcttaattcatgatagtttgagccaaatggctgtttgcaaaataaagcctatgcttgaaaatgatttcgttgtcattgaaggcatgacaaagtatcattagccaacttttctggagcatttattctttaccaagcctgagtgaagtgctctacatctgtgatcacatttaatcttcataatgaggtaagtaccattgtaatcttcattttacagataagaacattgaagctcagagaggtttggtgatttttccaaagttatatagtaataacttttgtggcaattttttagtagctcatatcgtatctatagaaactaattttacttagaaggaaaacagcactggggaaagataatagacttggaatcaaacagacctgtgtttccatctgcttcacatttgtcagccgcttctccaattgtaacttgggaggaatatacacctctaaaagtgggacggcataactattccacatccactgtaggcataatggagcactcatccacagcagccatgattactagtgttattaggatgagaagatggggagagccttacctatacttgaatcgacagggatggacagagcaatgaaaaggttttgaatcaaaatcagaggcagggaaaccatagcactgctgtagaaaggcagagcaagccagactgaagcagtgggctgtgctagtgctcagaagtgtccgagaattctttgcgccactctcacccgtggcagtctaatctcccggcatggagaatggctggccttactgactccctccgaaagaatggagtgaggtggaaggaaggctgtgtgatgtcgaaggccaggttaccgaaggccacacagcttctgctggtttttcctggggacaccacatggcgagaccttcaagagaggggagaccaggggcccagatccccgggcccagctgtcagagtctggaagtgcagcagccctagagaggaccccagtcctccacgatctggccagaaacctcatggaagaccctgatgagatctgctggttgagctcattccaccccggattcatgagcagaaaactaagatggccattgctggtgtaagcccctgttttggagccatttgctcctcagcagtaaacgtccggaacatgggtccatcatcctgaagaaatgccagatgctaacttagatgtcctgttgtcctttgctcctcacgtcaccttctctgtccctctgcacttgcttcctttggtcaagacaaggtggacttacgctctcggctccacgagggcctttccagtgccctcagtttgcgatctgacctcagggtttttctttgggatctcggtacgtcacagtgatcccagagtttctgtcagattcaggtagctctagaatcacagagtcctgaaattttgtcttgataattagctctttactctctcagcctttgggccactgaccccatccaaatggcggaaagtgaaagaagccggtcccgtgaagaggtctacgttttcagcccgtttgtggacattctcactgcctgacaaagccgcactcagtctcagcatctcaggctgagggctacactgtggagacggaggtggggtgcgtcccaatgctagtccctctctctggaacccacaggcagaggcctcaagccaactgtcctcccctgtaaatcagaagcagggcaagtaaaagcttggatgtcttcgtctctccgtagccagaggaaatctgggcgcgcagagagatttggagtttcatcctccccgctcagccagtcccaggcctcggctccgaggaaattcgctgaaccctttcaataggcttgaattctgtcggcagcccaaccatccccttgtttactgttgaaataattactactttgccataatattagctctgagccgtgactccattaccattatcaccggaatattacccatttattatctcccagcaaccctggaagatgaatactgggcttcagagaccaattgttttacagcagacaggatcttggtgtgcattgtttaatgaggtaaactacattacagccagcattaatttggctgcagtgcactccactaaatcactcttaacctggaaatctgccactctttttgatatacccttaatcggcgaggatgggagacatcctttgagaagaggctggagctgaggggagaggagaggaaaggttacaggtgagcgagccccgcccagagatgtgtgcataagatgggggaggattgtggagtgagggaccaagggaggcaggagaaggaagcaggcagagggcacgcatcctctgttctgctggtcccaaacgcctgggaagaggcaaaggtgatatgatggctgaaaataatccacatgcctcccctctctaagctcaggagttatgaatccacagaatccattttctgaccacatttggcttttctcttctgtttggcatcttcagaatcaccacagcaacccacaatagacagaagacagaactagacaatgagattgtcttttggcatgaggttgtctttcggtatgagaggcagggcagcctcccagagctctggccatttgctgagctcatagcagcctgcgtgtggactcgcggagctcattgccttaggtgaaacgcagctggagacacaccaagaaacagaggagcagatgaaagaagtttctgcataaagcctcccttgtcacttacattcttgctgtaagctgcataaagtcacctgaggactttgttaaagtgcagattctaattcagcaggtctggggtagggctgaaaagtcttcatctctaagtggctcccaggggatgctgatgttgcaggtccacagcaaaaggagccttgtttctctaagaaatgtctgcactgccttgttcaagatcatgctccatgcagtctaataaaacagcagcatagctaccatttttgaggtgggcaaacagaaatgaattccttttgctccatcaaatgctgacaacatctatacaggtcctggggtgaatgaagcacaaaaacttctcagaaagaatatcccagatacaatagacaccagagacactgccgtaagtcggtgacttcagatttttagggcagagaacattgtagtcctaaaatgtcgtaagaaattacttttatattaccaattgagaaagaatcgaaagggcttgaacttcggactcttggaatccaatctaatgtttttctgtaaagagaaataaatacattttctgctatgccactggtgagtttcccaaaattatctgttttcctgatgttgaaaaccttttctctgcacagcctaaatgaatttaaaacttaagcaatcatcccataaacctagcccaggtaatagtggttgaaattttaaaaatggtttattagaaaattccagggtttcttctttaaaaactaaggtggggctgttatgtttctcaaagcctctctcagtttaccatgttcatctgcccaagcaccaccatcattgcattttactgagagagacagaaaaaaagtctttgtgatttaatatgtaatctcaagaatagcagaacttggccaacggtataaattgggaatgtcttttactgtacatcttccctcccaaacctttttattgtacccatcttgaaaacttataatgaatagtttttatctccggccatacatatgaagtgtgaggggtgtgtgtgcatgtctgtatgtgtgatgtgtttcatcctctataagagtagcataacaataataattcttcttttcaaattttatcacaattaaaggaaaaggacatcactaatttattttcatattgtctaccaaactgttccactagtgtttggattacatttatctggtttgggagcattatgcctctcctagttcatttatccatccattcatccatccaaccacccatccatccatccatccatcatccatccatccattcatccatccaaccacccatccatccattcatccatcatccgtccatccctccatccctccatccgtccatccatccatccatccatccatccacaaacatttgcttagcatctgctaggttctggtaaagctggaaaaacaagtaaaaattagaaaagtaaaaacaaatgagacatgatttctgtctttggggatttcataatttatcatgagagacaaatataaataactttttgtgataccatttggtggtgcattttagtccttctcttttttcctcaactctgtaagcagttttctttgtagagataatgtctaattctttttattgaaccatagataaaagacagagtggaatctagcagaaagctcagagtataaactgggtctaattttgaaatggtgattctaacagtcttcttgggtgagtctccaatacaactacaactccagttctttcttgtagcgtctccaattttaaaactgggcattactaacttgactcttccatctcaagaatgtttttacatattccaatgagggattgtcctgttccaaacatgggtggaaccctcagcttagctctagagagcagctgttcgctggagactacgcatttgccagaaaaatgccatcctgttgaagatactttgccactggctttttcaagcacccaaaaatggaagactgcactgaaggaaatttgttcgaaagaacttgagagattagggggtgaaattagatagagaaaaaaattctaaacacgttgagatatgtcgtcagtaaaatgcgctttggcataacaaagttgtgaattgaaacagttacagaaatattgtggctggggaaatcccaagtgtttctacagttgaacatccctgattagaaaatccaaaatcagaaatgttccaaaatccaaaactttttaagcactgacatgatatcacaaatggaaaattccacacctgacttcatgtgagaggtcacagtcaaaacgcagccaaaactttgtttcacacaaaaaatatttaaaatactgtctaaaattacctttaggctatgtgtataaagtatatatgaaacataagtgaattttatgtttagacttgggacccgtccccaagatatcccattatgtatacacagatattccagtatttcaaaaaatccaaaatctgaaacacttctggtccaaagcatttcacataagggatactcaacctgtattagaaaaattaagaaatttgccttctgtaaactttaatatatgtatttcatatataacaaatttatatataatgttttttccttttggcatataaagcctattttatttggttgataatcatgtgattggtgctctgaggccaatttaaccgtttttactgaatagttaccatgtgttggatgaaatgctatacaattaactgtaatattatttagtcctcatcccccccagcaatacaattcagtgacgtctagttacatgagccaaatcaactaatgggatattttcactgttgagcagggacatacaatcagagtaattcaaagtcgtaaacacaaacagcacccttttggtaactggctctgtccaggcatgctcacctcttgccatgacctcttgcatgtgtctctgtaaaatgaagctgataatgaattgttccgtactcctaatactaaaaatatctgtgatatagatgtaaaacttctggggtctttcttaaaagctatcgtgaaagtgcacaattattttgcatgtttgtatacaagcctcatatccacaagtgcacttggatgcaccctccagtcctgctccctgatttatagtacattcatcaagcccaattgcccatacacagtacaattctctgttaagaagcagcatttgggaggaaaatgtaaactagcctttgttgtgatggtcgcagtatgtgtgtgctgtgttttctctccctctgaggcaaattactgtgagtaaaacctatattatgctatcagatgcaatcccagcctttgctcaattgtactttgcaatggcacaatagattgtggttgtttgatgccatctcattcggttatttttctcacgtttgtttgtctctcagctaatcggaagaattcaagagccttcagtaggcctctcagtccttagcctcagatcaactagtggagccttccccatcctgggtaaccctctggaagtcaagctgtcttgatttgcattatcatctttctttatccgctctccagagagtccccatcttaacaattaaagtacacacaagaaaatgactgaggatttccttttggctttcctggaaatggaggatcaagctgagtaaattctccaagcttctcaatttgtgaagaaaaaatgttacatttaggggaaaaaaggggggctcctgcttagttaaaaaaatggtgggtggggacagagtgcaagagggagaaagaaagaatagcaaagaaagaagaggtgtcatttgggcgtctcgctagtttttcttctatcctggttatcaaaagagcaaagaaattctacttccctttcccctccctcaggtgcccttaggcctgcgcagcctgggctgggtttgcaccgctttcacacggcccgagtagccaccctgtttgaaagtaaagcaagagcagccacaaagtgtctgagattcatgagatcactccacaaattaaaaccttttatcagcctctaagagctgtgcaaactaattagactttggccgaactttgccaatgactccctcgaggtattattataaaattttgagcttggaaacgcgtccccattctgtcaacatcaggttgtttcagctacagaaatcgagctccagctcattttagcttccatgatgtgctttgcataatctgtggcattttgcactggtgtggcagggaggagagtagcacagctgtatttgaaaacacataaggatgtttcccagcaataagacttcagacacagggactgaatttcaagaaaaacccatttttgcccctcaattttaagaagacgctgcagagttcttagcttaagctataaaggtgagtactcaacatccaggtctaacagcttctaatttagggaggacatatcacttcccttctcaatgtttttggctcttcatatgcaaatgaagagctcttactaacaaattactgctcaaatctttgatcatgttttgaagcaaagtctgagagaggaggctttctggaagagcttggtaagaagtcagtaaactttgatttgtctcagagaatttaggttcataaatagcaagggtgcaaactccatgtgactcaacaaatatttgaatttgtcattcaaaaaatatcaaacatatataggctatttcgcattattgggggtacgtcgaggcattgacagtgccatgtatgccagtggagccgttcctactcttgctctgaataattctctgtggggctggcctgggagtgcagaatccctctgcagcagatgtggccttctgcacgctcagagccccaggacacagtggacattgaaggggaacagagaagtagagggtttccctcatccttagcccatgcctggagcagggggccaggaaatgagaggtggtatttgtttcctttgctgaaaatggagtgaggtgaccttccgatgtacccaagcaccttatgacagtgtgtttttaccacttcccagaactgaccatctgcccaacttttggaccaatcctgggccactggtggagccaggaagcctggagggtcatggaaggggagactcttgcccagtagtccacaagagggctatgcagctggcatattggcccacagaacccccagccctgcagcatggccctgagccctcacaggcccagagcagaggcaggagtggaggctgccagggtttagaccctccttcactaaagggtccccaggttcatttttgtctccgccgtctgccatcccgtctcatgggctctcatgatgggctcatcaggttcttgaattctttccagttgtcactaattacactgcagatccgtaaatcattccaggctggggctgacagggagagacgggccctctgccatcctgagctcggggcttcctgccacacctgcagccagtgaccctaaggcagccgctgatcagtgctcagtgtagaagggagggatggccagtccctcagtcacccatccccaggctctagccctggctgtggccacatatgtgtgctcatcctggaactaggtctcaggtaatgcaacccctggaagaatgcagctactgtctctgcctatgggtttttattgctgtttgaatattaaagacagctgcgaggaaaggtgagcttatttcatctggagtttgataaagttgagacagcactcctcaaacttagtttaataacgcaacagactgattcatcaattctgggattgggtctaccaatcttcattttaaatgtgtaccccaggtgattcttgggtggtgattcagtaccccactttaagaactactgtacactaacttacactttatctctctctggctctaggctatcattgaccctcttgtttctggatcaggtgagaaccttctcttttcaaccttgctattctaatagggacacacatgtcttctgatcaaaaccacactagcttctctgtacataggagctattcacaacgcaggtgcacaggcccctatgcctgtcactgagagaaagcctgtgacctctgggtgttctgcagccagtgtggtgggccgagagggagcccccagttcccccagcccaccggctcactgcacagattgctggctaatggggcggagctagctgaagtgccttctattaatggagcagaatataaacagaataaagccttcatttcccaggctgtggtttcattattaatatacttcacaggttgtacgtttgcgcccgtgttttctcagctggtgtaatctgcggctctgagtgagaacagtcataaaattttcatttccagttgaatgtgcgtccaattcgccgtgaaatgttctatctgtcgtgaatattaagtgcactgaagcaatggctgctggattaggcagagaggttccccggcccctgccaggcctggcagaggacagaggtttgccggggcatgggtggaactttaacagggaagctgcaccgtgtgaagtctgttttcttgtggccgcctcctggagctttggtggaagagaaggaacctactgtccaggcgggggagaggtcagaaataatggagactgtgcacctcagggccaataaaaagcattcagacgggaggtgaaagggcacaggaagttcaagtgcagagtagagaagtggagggccaggtaatgccaggacagaggtgaggagggaggggattgcagaggagagagcaggcctgaggggagcgtgcaccggggaggctggttgtcaggcataatattagaaagagcaagcggagcattttatgcacggtgcctttttagatacatcaattaagcgctgaggagagagcacgatggaggaggtgcagggaaaggctgggagtgacagcaattaggagagcctttctgtacgacggcctgcagtcctggtgcggggcagagcgtcacggggactctgtcctaagaacaaatgtttcccactgccagctggcctgcagtggatgttatttgcctcccagcactgacttagtatcccttcccctcatgccactactcggctcagccatgccagctggctcttccctccaaacccttcctctcctctttcttaggagttgcagcattgtgccagtttcagggttgaaactcctcggttgctcccacagtgtgcagagagactcggggagccaaggccagtaggagtagaaagcccgcaggatttgatcttctctactcatcccagctgccgcgtcaggatcttttctccccgggcggccacgtgcccctgtcctataggggtttgatgagagagctgccccgggctagaggagaatgagaggcaaataggaagactgagtagagaaagtggagtctccttgccttgggcccacagcctccttagcagcactgagcggaactggctgtgccctgcaggagaatcccaggaagacacccgctttgttttcccagaactaaagtgctgattcaggcaaaggggcctttgccgcacctcccgcacaggtgggactcctccaagcctgcccggtggcccacggagggtgtgaatgcctgtgcgcgtgcgtgtgtgtctccaccgacacaatcgcacagtgaaagtcaaacagttcgttctatatctcttggctttttacagttaaagctcccaacagcccagtgaaacagcaatggtgattttcctcctttacaggtaaggagcaccgcacggccacagattaagtgattctgccgaggtcacagagctgaactcccagtggaggcagaacaaaacccttttattccaatctggagccatgtgcactctccccctcctccaattattgatagttgactccctctctggtttccaattgttttgctttggataatattcaaataattttgtgtttctgaaacgcacacctgcggtgaggagtgagttgagaggaagaagctgaaaaatgagctgagctgagatattaaagtggtagaagaagaataacttaccaagtgacatcctaaacacatgtagttatagctcgggaaggcatcgtctgtttcgtatgtcggccgtcctttcacacgccagtcacataccgactcaccttcattgtgagcagaagccttgagaacaaagctcagcatccagcatgatgcctacagcaggcaagagcccggccaccctctctagccccaggctcattccctgcccttgctccccactgtcctgcgtcttcccagggtggactccagacatttaagctttgcagatactgttccctctgctgagaaaaccactccatcctcctcccctccccaaacctggtgcccaccctcacatccttccagaggcagcagacaggctgcctctttgggaaaccttcctgggcaccagttttcacccccaagtgtggcccctcctcctgggctccccatgaacttgacatgcacacatctcaggctcatcattgatcgccctgtggtttgccatctgcgtgtatgtccagctcacagaagagacagggaggttgtcagagaccctagaacatccatccttggacacatactcagggcctgggcattggaattatacaaatttgggttttaagcccaatgttgccgcttagttgctatgaggctcctgatgaatcacaaaaccggcttaggcctctgtttttacatcgcaaaaatggggatcataacttcctcagaggcaggttgtaagcaagcaatcagtgaggaaatatatacgtgctatagaaaacttagatacttttgcttcccttctctttaatagatgtctcttctttccaataaatgtttactgggtgaataaatgaataagaaaaaaacatataatgaagtgcaaaattgtttggttcagactcaaactatactggagattcagaaggaaaatatcatcaaaaggaagtatggccagggtcttcaagcaggaggtgggccatggagggatcctggattcggggataagaaccctttaaagttggatctaggagaccaccctctgcacattctcataccttcctcctttcctttccttttggatttcccttcttttctctgtctctttctctatccctgtctcttttctactctctgatttctttcacttgttggacctgaacacttagtagacacttgctacctcattttaccccctgtgtatctctaatcttaaatctgaactagttaacccctgagaaaggtcatttccagctcttaaatccttggattttccaagagcctcaccttctctccacaggccctagagagagcacctgaaatgccattaaatggtcacagcccacagcatccaaacatgggagaaaatggagaaattaggagaaagtgctcccaaaatgttcttgtctgatgaatctttaattctaccccttgtgactcagaactcctgcccttaaactgcattcagaatgcatttcgccagtgtcccattctcagggagggagagacaggggaaaaaactgctcatccttctcctggcttgtcactgtagagttgagataataatagtctttttctgatcccctgaactttcccatctgcttcataaaacaatggcaatttttttcccttgctctgtcttcctctctctcttttatttttatcctcctacactataatttaaaactgtggcagtgctatagcccttgaggttttttttttctctttcttctccccttgctttaatacatgactgttatttaaaatggcctttcatctgagcaccaggaggctgcctgagcaagctgcctcctgcttttagagagggagggtagggccagtgtggtccctggtctcacctagcacctagttctcttcagtactgccatgcaaatcagaagtgttgtttgttctttctgaaagaagacatcggaagccaaggtctggaagtgcccctccctcagaaatggacgtcatatcaagctggtggctgtcagtggtccaccacgcatcaggtctaaataaagcaatttcagctgaaggcagtaaattcagtgtgcccattgatgccaggagggaaacatgtatcagccactcagcatggagactcagccgttgctatgcaggcttttgctcagctgcactgccaatcaccattcagatgcatctctcctcagctggatgggcactgcataggaaagggtggtggtcagggacttctttcccgggggaaatgtcatctgttttggggatcagaaaggaaggtgtcggacactggtgtttcccataccaactctgcagccttccctgccatggatgctcgttcagctgctgctttggagcactggctggaacatgctccacacacttcctgtctctgtgacagttcagttccatgactgcacctgtacctctgaaagtgattttggccttgtcttttctctccaagctctctccagagccccctctgaactggcatcagcaaagcaatcatattctaaatgagcttcatgaagaatatgccattgcagtaaaacaccagagacaggataaggctgaaggctagaaaataaatcgtgtgtgtgtgatgagagggtgtgtgtgtatgtgtgtgtgagggtaaggtgtgttccagccctcatgaacgtggtgatcacttccttcttgaattaagcagccctcctgtcagctggagaaagaactccctggagaaggcagggaccgcctatccccagctgatctgctgaggaggccacccacctgcaggagatggacaacattttaatcctggctacgtgggttgtttccttgtgtgatgcccagaaggactggcggcaggaggaaattcctggagaaattgtctcttgagtcaggttgttggatttcaaatcctaggtgtcattgcttcagtccctccttctccttagaatcctcctttcctttaaacactggaaatgattcttaaaaccatgtacaactattaaggtgagaaaggctgagaagtcaggatccaggattttctcctgaatgtgatctctcaccctgatgtggtgaaggtcatggcctccagccaggcactttctctcggttttctcttcaactcattaaaggaccattttaatcaatgtttttaccttccccccgataatccaaggatgtccaaataattttaattttctctctcttggcccaacttcattgccattgctggtatatagcttaattaacaatctattttaagatattgttttaaatgattttcacttatcaccaatttatcaccttctttctgtttatttcttcctgcatcttagaccttacatctgggattattttccttctgccttaatcctctttcgaatttcctctgggagagctctgctgctagtggcatattttctcagtttttgtttagtgaaaatgtcttattttgtcctgattcctgaacggtacttattctgatacagaatgttaagttggaagtcattttctttcagtttcctaaggaacatttggctctcagttctgctgttgagaagtcagctgtcaatcttatttttatttccatgaacgttttctgcctttctgcccaacctccaacaacccctgttgcttttaagattttttctttggatttggctttttgcaagttcacgatgctgtgttagctatagatttctttctttaacttttcttcagatttgttagtattctggaatctatggattaatttttttattacttctggaaaattctcagccattgtctcttcaaatattgcctcttgtccccttttccctttcttctctccttttgggactcctcactaaatgtagacaagacccctccctctgtcaatgcccttatgcattgtttggcattcttcatctctttgtctcttcacactattcacttttttttttttcgttacttaacttacagttaattgattctctctttagctgtgtctcatattcttttacacctttacaccagtatttttaatttttcttttctagaagtcctatttttactttttttcctcaaatatgctagttacctttaataggtttattttccaatattattagtcaagtttgtcatgcatttctttatataaagatatttgttttacagtcaatgtttcatgattccattatctgatatatttgtatatgtttctgttttctattttatgctgttctcactcttagtatcatgttttcttgtgtgcctggttacttttggctctgtgaggctcattgtatttttttacaaaaagctgaaaaattttgagccctaaaatgaaagcaccttccctaaagaatgatttatatttacttctgcaagatgaccgaggtctatgtaaactccattaagggtgtctaatttctgagctagcccaggtaattcaaaccgtaacacaatttcttggagagaatgtttgtcttttggttcactcccaccttggggatgcagctttttgcagtctccacttattgtacagagcttttcctgttagactccatcacttcaaaagggtgttgggctttgattcctgttcccctgtcctttcagattgtcaaacaaaggcttcaatttacctgactcagcaaatgccctcaggtcaggaaccagctgtctcttggttcatgttttatctttaatttagggtctggtaattctgtaccaggaaggaagcttttgatacttttaagaaagatgtaaactgtctcatccagttcctttggtagttttcaaagggagggtagcctgaataacctaatctgcagtacctgtttaaaccacatcgcacatctgctctccatccacagcttgaaacttccttatgcgatgatgagcctacctatgaggaaagggcaaggcatgtggaagccactccactgctcaccagctgtttcactttgtacaaagatcaaagtttatatctttctgtgtctcaatatccttggatgcgaaatggcgggaccaatagcctgaagtgcctgtgcctaccccacagggttattccaaagctcaaaatgatcctcggtgtgtattttgctggactcagtggtacgtatgaatgtgccgtttggaatttcaagcctactacttatgtgtgggacttggaattttctggcttgtcaaagaggggagggccaaagggcaaatgtagggccaggaagaggcgcaggcttccacccatgagaagaaaatctttaggctaacagtgacaaagcacagcagcagtaaagcacaggtgctccaaacctgaggcttgcctcaccctgcctttccgcccagacagagagtgatgactgggaggcaaggccgtggccttctgtttggaatgtcttgaaagcaggtttgtccttggagcactccctgccataagcccctcagcctccctcctacctctccttttccctcccctcttagccagggctggccgctcagcgtcagttctacttggcaggccttcttttcctcatctttatcttagcatttgtttcccatcttatgaaaaattgcttatctacctacaatcaacctttcagctcagctccctatcagctcctttatcagctctaccatcctaacttctcatttgtttctgacaggcatcctgtaacaaattcttaatttgatgagcttgatatagcccactggctaaacagtgagctgaagccagggctggctgcaggaatatcccatactgttcagccacccattttcttgagagcagagagtccccaaaaaagggtggaaatgggagaggagcaattctgtggggcatatggcagcaggaaaagaaagcctggaacaacagttttccatggggaagcctggaagacagtgttggacagaggcacctgaggccagagatgtagatgggtagatgaataagaagttggttaataaaagagagagaaaaacaacttgcagctttgagatacttcttggtaattatagatgggaaacacaggctcggatacatgaatacctgggtctttttgtcctgatatatggctgggtaatcagagcagccgtccatgtgcaccatgatttctgaaaccattgttcagagtgacattgactgtctctgaaaggttaatgggtatttacgtagggaggaaaaatgtaccttggttaaataagtttaagcaactgtgtgtgctccatttcccatttggagatccataggatataagaacttaaagattctaaaaatcctgcccttgatctaacgaacccagtttccccagacttgtgtgacaaagatgtcctctttgcagaatactaattacagtaccgtcttgcaggatacttagaagaaaatgttgattctaaagccatagtaggctctgttttacctctgctgctattaagggattctctgtccaacaacaatgtttctagaatggtaactgtgagcaaaatgtcctttctggaacacatgccatgtcctggagcttaggatctggtaatcttctatctcactatctgatgatgataatgaccccccatttattgagggcctgttaatctcctaggtgctttttctatgcatgacttctaatcctcactatgatcccacaggagagatagcattaccccatttcttctatgagaaaattgagagtcgggcttattaaataatgtgcccaaggtaagcggctaagccaggatttcatccaaggtctggctaactctaacataatgtttgttttcatcacactatacccattatgaaaatggggcagatttcaaaaaacagagaagaatgatttaaaaagcaaataaatttagcagcctgtctagttacatacaaggaccacttattgattgaatgctagctctaggaaaacaaaaatctgaaaattatctagtcctattgtttatttttccccttgtaaataaagaaactgagatctgtagaaagtaaaatgacttgctcaggctcacgtggccagctggtttcagagtcaacatgatcactaccaattaccctgacttccagtccagagttacttatacccatagtgactttttccccctcctctcagagactgtttttcaggctaagacttgccaaaatgctcaatttgcagtgtgaagatgataaagacctcctcaggcctgccctcagctcggcccctctatgaggaggcatcaggaacaaaggctgtcctttccatctgcatatactgaggacctcgtgcagaggacataggagctcagcttgccatcgtgctgcactctcctgagttctccctggatatggagtctggagaaatgaggcagtctctgcaggtttagctgggaactcaagccaagcaggggctggaaggcagctctctggactctgccaaagcctcctctcacctggtgttgtttgctatccagactcttcctgtccaccaactcttctagatttgagctgccaagtaaagccggcagccaggcacttagcccttagacgcactgacagggcctgtgtgttctactgagcacccggctagagacagaccttatctcctgcctgcccctccctggggagtgtctccccgcaacccgtcttcatccccagcattcttcaatctccttctcgcccacttgtctcctggttgcttctcctattatttctgtgattcctctcttccttttgtctttatctagaactgttgctttgtttccccctcaccttttcccatgtttcacagaaggccagtctccttttccccacgtctctgtacacacccactgtgaatgcactttgttttcacctctcctcagctgctcagtcctcctaagtgtctctctgtgctccgccgtggcattgttctcaagtcccatctaccgctggccttcctttggccactcttccctcattcctttaattttctttgacctctttgtatatttttcttctccaatgtgatcccttctctctctcccacttctataaaagactcggtttctgcatcactggaagaccgcaccaccattctgtggtgatggtgatggctgctgggttaaaggaaatcagtgtctcctcttctggatgggtttggatggtttccagtgaggtcagaatcctgttgcccctgctgggattctccagcctggggttctcattcttggcgccattgatatttaggctggcgaatttcttcttgtgggggctgttctgtgtatgatgggataccgggcaacaccccttatctctacccactagatagcagtaacaagcacatcccaattgtgataaacaaaaatgtccccagacatttccagatttcccctgggaggcaacatcttccccatttgggaagcacagccctagcccacagcctgcagccttgcttctagaaccacatgcggagttgaggtttctatgcctgttggataagcagaaaaagatgtggaagtggtggatgctgtcagtggagacacaagaagtgtgtttgccaagataaatttgagcctgaacattttttttatctctttggtttgagtctgatctctttctactcctttcttttagctctttagctctcttttggctctcttttagctgtcttttagctctttcttttagtcttctttcactgtaatccaaacttctttctctcctgacaatatgacgttcttgagttgcagactgctaaaaacggctctgattaagccctttaagtgattcctgcagaagtggctctgacggtgttccatctgtaccctcagaaaggtcaaggtgtcactcggctgctcgagggaactctgcttctgggctcccaggtggttaatgcctgtttgattagctgtaaaacaaaatccagaaaatgccaagaggcaaatctcaattcacctttcagaatgaagctcactgcccagtcagagaagggggtgcggagtgggtggtgagatccacagctgttaaattcgcaacaggtaagccagcaaatagactcagtcctaatgcggctgccctcatctgctgaaccacctgagtcaccttcacctttctgctgctgactcttggctggaatgtggttcagtcctatttgctctgctttccatgcagctctgccttccacttgggtgcccacttccattccagtcagcctcccccttccctgctccactgccgtcctgttgctttccttccaagctcacctctacacccaggaagctggtctcggttgcacatcttcacctcgctcctctcacaaatgcatctcactcccaaatctgctgcaaaacatcagaaccaaagaataataataataataaaaatagacatacccagtgaacgtcctcctccattgagctcctcccaccttctcttctctatccctgcaccacatctgtgcatactccttcctagaaggcaaatgtggaatattctgtctaggctatgcagagggtgggctcctaggaagcatctcctcattcacttctctcttgcacataccacacacaatggttctaacaccatggttgtcttgctttccaacatccttttcatattattttccaaatcccagtgtggtcctcccacgtgcagcccttcattgaggaagacagcattactgaccagaccacagtcatgaccatagcatctgaaatgagcaacgcccatcacccagtgcttccctcacccctccagtgtccatcactggggcagcatgccaggaatgttgaccaggatttagagtgcgggccaacctaatcacttgcactgttcggcctctgcaatggatacactttcctctctcacagagccaatcagccaccttccacctttgagttccatcactttgccggctttttctcattctctgtgctcttcctctcattcctggctctccaggtcctttttccaccatgacattcctaaagagaggtgcttgctggatgcgagctggctctcgctctgttggttgattttttttttttttttcccctgggcttgtgtggactggcagggcctgttctcagatggaaggtgtgaaagtggcataaacggcacatgagtgcatctgtttgttcccagtgacttcaggagaggcagaggtgggccaatcagccccactctcacatatggccccagcgattccagccgcaggagagtgggcctgccgcccacggacccgtgttatcgtcgggacccctagctcccacagacaggatgtgtgtgtttgtctggctgcatttctgcaggagcatctgtcactctccaatatttcctttatcattgcagcaaattatttaaacactacccactgaaccccatctgtcaccgcgccccatcactgtcagggccctgcctccccaggtctgcaaagcaactcgctggcaaaggctctgtgccaaacaacagggcaaattaaatcaaagcgcgctctggcacccagggggaaaatgcacatcagttttgacttattgcatgaagcacgcttacaagagagaaagcagcggcttttgtcactgcaaggggccatgagaaatgaattagggcctctgctgagagggcatggaggagaatctttcattctgagatgttgtcctttctcaccttgcaagaaggaaataataaaaggagaacttgtggtgggtctaagtgtctccaagctttgacactatcctgaagcacttctgggtgtagaaaggaagtgaccagttggagacaaaaggactttgagaggcttggaaatagcctgagttacatggtgccaccagagggtgagaacttgagcaggtgcaggtaagagctaacggcatctgtccatcccgggaagctggagcggggagggacagagggaaatgcaggcctcatcctcactctgccctgcagtgtggcctgggaactcctgaagaagccagcatgacaagggagcaaaaccaatgtcaccaaaccctcactacacaccacttgctgggataactcttcttcacacttgatctctttcaatccccagattctcatgagataggaattatttttgcccatcttacagatgagaaacctcaaaaagtttaaagcgattgcttgcgatcatccaatttatgtgtggcagggccaggattcaaaactacatccatctgatttcgaagcccattgcctctctttataaaagaatttctcctctgtctccctgctccccgtgagacacagctcatttgttttcctataatgagggaggggccttcgatttcctaatagattgctcacctgccgtcctagtggagctggcatttactgtggcatttactgtgtagctgcagagccttccccaccagacacatttgtactttgtgacagcaagaacacatggacagctgctggggcatttctaacacagcccttctcaggcagagatcttggctggggacagcatgactccatcctccaggagaggacaagccatgcggcatctctaattagaacccaggctggaacattcagcttaatgagctgggagttggaaacgctcagctggaaacgagttggtctggcagaaaggacataggactgagggacacattttctaaactctgtcctcatctcagttgttaatcatcttctgcttctgtctatccatcagttggttattagactgtgttattgtgcatttgcctcaagttcagagtgaacatgcgttaaatatattggacgatggcttaaatggatgatttttcctatagtcttctaggaggtcgctcgatgttgccaaatacttgggcagttcttggactgctgacatattttaaataggatgtgccaccctaagtagtgtctttgctttttgcactctctcaaaactagggaagtccaggtcaattaccatagtgttgtgctttgccatagtgattttctcacctaggcttctctctatgtatttcttgagagtttggacccatataactttagccgtcttttgaagattgttggccacaaaagagaaagcggacaactctagacctagggccacagtgtcaagggaccactgatctaaaatgagccttttgtgtggcccactatttccgttcaacacaagtaagcagggacaccacgtggaaaagagaatgatgcttatgactttgtcaaaaattcataagcacattattgtagtgattgagtattcacctgtaagatagtgacagacatccttcgtgtgtgtgacagtcaaactgaatgttcagttcaattcagtcaaaatagtccaattcagcaaacacccaatagttctgtttggaagcatcttctgtgtttaattccataagtttcctatttgtgtcctgcccctgatttaactgctagaaatattactcatctctttgtgattttaaaggaagcattgaccacctcccctgccttggtttctctgtgagtcactgctagatacggctgtgggagcaggctgatgataggtaagaatcatgtatctagaatctctctccccacaaatatatgactttctagtaaaatcatgctttcaaaatagttgccattttaaatatgaatgtaagttttgatatgattaatattggaaagagccttaaattccaatgcataaatttaaaagaaaaaaaaagaccttgaggcagggtgaggaacctctgaagaagctcaaatgaaaaaaagaaatgtagaaactgcacattgcagactgatggcactgcagggtcagctgtaaaatagttttttaggccaggcttggtggctcgtgcctgtaatcccagcacttcgggaggccaaggagggtggatcacaaggtcaggagtttgagaccagcccgaccaacatggtgaaacaccatctctactaaaaatacaaaaattagcctggcgtggtggtgcacacctgtaatcccagctactcgggaggctgaggcaggagaatcgtttgaacccgggaggcagaggtttcagtgagctgagattgcgccactgcactccagcctgggcgacagagtgagactccatctcaaaaaacaagaagttttttagttgatcaccaataaatcaactaggacagttttttgtttttgtttgtttgtttgtttgtttgtttgttgagacggagtctctctctgtcgcccaggctgtagtgcaatggtgtgagcttggctcactgcaaactccgcctcccagatcaagcaattctcctgcctcagcctgccaagaagctgggattacaggagtgcaccaccatgcctagctaatttttgtattttttgtagagacggggtttcaccatgttgatcaggctggtctcgaacacctgcaactaggacagttttgagtagaatcagttgatgaaggcatttgcctgggtggcgggagcaggagagatgtaccttaggaaaacatggaaacttttgtgaatgggaaacaagggaggaggaggactagcatttaagttattttgtgactttctaattagcaaagaactcagcctggcaccaaactcaaagctaaaacctggctgaaacaggcagtctttctttagttaccacggaagcccatggatgaatcaatgttaaatctaaaaaatcacccagcctttttttttttaaagataagagaacataagttcagagaaattaagtgaatttctcaaagtcacacagctaattagtagcaaaagtaaggtttccagacagtgtaactatttttgtaacagtctttccacagcatcatgctgtctctgaattaccatgggaatgtttatttttgcttttgcttgttctatttgtttttaagaaagttctaaactttgctttggacagaggtgcttcaaaatgtggatgatgtaattagaagtaagagaaaccaaaaaatgaattaaaaagtccacaaaaaaattattaatatggcactcagtgttaagctgaaattctggtacaagcttgtgtcctcgggttttgacttgtctgtggtttgtacaactagactataaaatatttcaaaaaatgattttattcacaatctggccaaactggcttgttctggctgaagagctacatcaaaagagggtcaccagatgggaaagccttcgtctccggggcatggcctaaaacacagctgaattatccggtgttggcagtagaacaccacggaaccttctgttcaaatgtgccctgaacccattaagtcatgagcctcaggctggtttagagagtggcttctaggcatctcgccttgttttctcctgagcaccacttgtagacctactttctttaggaaagggagacagagccgttggcagctcagatgtgaaatggggtcatggaaagagagcatgcttaggagtcgaaggatttgggcactgttgctggttctcgttttagctgcacggtcatgcacatgtctgttagcctgatgtgaaggtgacgcaggtcactcattccatttaggggtggctgggtgcactaacccagtgtcttcttccttatctgtagaaaaggtgggctttttatggagataagaactctttggccaagagagtagaggtggctccacctccctgccagaacttccaaacaagctctcaagggccttaacatgtcacctcatttctctgagcctccatttcctcatgcttaaaatcaggttgtcttgaagcccaccccacggtggatggaaagtactgcatgggaatcgctggggcatgtattggaatgccagttatgagtgcacctggggggcacagacgcacggctcacagcactgcagcttcctcctcccttttgccgtggttataatactttgaagagcagggcataccagtagggcatgcactgggaagaggaaagatcctggtcttcttctttgtttagtcagaattggttaaatgcagaactggtagttcagactgcccatgttccagacctagttagatggaggcatttctgacatgccttttaagattgaaggcagaagcacagaaggccgtgccagcacaatggaagatagaatgcttgtatctcattgtctggagaatagataggttgcaggtttcagtagaataggagctgccagtcaaacctttttaatagaatgggagcagatagatttcaataaaagaaatgagtataaatattgtgagtggaggaagggagaaagcagacagatcatgtttgactagtcacagtggggaaactttgcacgaagtttaaactgaaaacccataaagccaaggtgggtgactgggttgaatccatcgacagctgcagatccagggcttgccccatgggcatccattaaggaggctccagctggataaagagcactccaagtctgtggtctttcctcaactctaagcccatcccagccaagtgcaatgagcattcagctatctgttttactggcatcctccacccccaccctatacagaatccacggaaccctgctggcattgtgcctgtagctggtgccttattagccagggggactctgaaataattcccccaggagtctctccagggcagtagccccttccaccatagtcccagagaattatttgttagcagctgcctgatttgtccccaaattagcaaaccaaccacctaccaaggccttttggctccttctccccactgcctcaggttcccaggatttctgtgtattttacccaagggtgggacttttggccattttgtttgccactggccacggttgactaaggctgctataacaaaataccatagatggagtggcttaaacaacagacatttacttctcacagttttgcaggttggaagttccagtcaaggcactgacagattcagtgtctggtgggggctctcttcttgacttgtaagttgttgccttcttgctgcttcctcacatggcagggggagagagagaaggatcatctctttttttatctattcttacgaggactttaattccattcacgaggactccaccctcgtaagctaatcacctcccaaatgcctcatctcctaataccatcacaatgaggattaggtcttcaacataggaattttggaggaacacaaacatctactccatagcattctgaccctgtcattcctcccaaatgtatgtccttcttacatgtgcaacacacttattccatcccaacagcctcaaaagtcttaactcgctccagaatgaactctaaagtccaaagtctcatttaaatatcatcttaatcaggtgtgagacaaaatttctttgcagctgtgaacatgggaaaacaagttatgtatttccaaaatacaatagtgggacaggaatggggtaggcattcccattccaagggggagaaattgaaaagaaagaaggggcaacggttcccaggcaagactagactacaaggcaaactccatgagatcttaaggctcaagaatagtcctcttttgctacaggaatatatcttcttttgtttgatgctctgccttccagacccagtggggtggcagtcctgcgcccacagttctgcagggcagggttgcagctccatggccttgggcagctccaaccccaaggctgttcaagggggccatctggcctgttgaaactgaggtggtgctcccctgacctcatatgaaacttaggaggctgccctggtgatctctgaatcacttttttgggtcgttcttcccttgtcttgaagaattgcacacattcatagctgagtagttctaggtaaaatccaagaaatcagacaaccttccttccttctgtttccttcagtttaaaccagaagttctcctgctaggtcagctgattagcttgtggttcacatccacgctgacttccttatcaagcaatgagtctgccacgcccttagtgttctttcttttccaaacatgcttttacattttgtataattcggaccagctgagaattttccagatctttacgttctggttcctttttttttcctgaacaattccatcttcaattcatttccctttctcacatgttattattagcagtcaagaggaatcaaactgctccctcaaacacattgcttagaaagttcctaagctaaatatccagtttcatccctcacaagctctaccttccacacaaaacactggaacgtgaacaatattcagcaaagctctttgcaattttacaacaaggattacctttcctccagtttctaataacatgtcctttatttctgtctgaaatctcgtcagaacggcttttaccattcatatttctaccaatattatgtacacgattattttggcattctctaagaagatggaagctttctctccagttttcctgttttctgttggaatcttcaccagaattgcctttagtagtagacaggattcctacaacggaatggcttggtcatagggcatgtttattttaaatgtttatattgccacccagcttgccctccataaaggctatgtcaattagcaatctcaccaacaaacagaaatgtctattttcccaccctttggcccataacagatactttcaatagtttacgtttctgccagtgtgataggcaggaaattgcacctatttcaattttcatattccagttactagggaagctattgtgcatattttttcatatttcatatatttattggatatttgtatttcttctgtgaattgcttgtccatattcttcatccatttttctattgggttgtttatcattttgaaaattgatctgaaaaagcagtgtatacattatggacgttaacccttttttataaaggttataaagggtgcagatatccctcccagttattttcttgtcttttactttattttatagtatcatttgtcatacaacagttttagatttgcatgtaataaaatctgtcaatctattcctttatggctttatcatctcgtgttttgcttaggcaggcttgcatttatacatacactgtattgtatatttgcataaaccatcttaaatctcttaaaaataaaggcaagatataaagagatgaatgaattaaaataagaagagttcctcccaggcatatcacatgtgaagacagtggtatcttatatttacataccacttttacttcccaagtattttcaactttattatctcattacccaggccttgcaatgtttccgacagacataactgccaaaggcaacctcaagcagctgctcatgtatttacctctgttgccctctcatggaaagggcaagagcatggatgacagctcaagtctcccttctcttcttataaagctgtgcctgtcccaccagcaggccccaccataatgaccttatctaatcctaattgcttcccaaaagctccacctccaatcaacatatgaatttggggatgaaggttccaccacatggaatttgaaggacacattcaaaccatagtagtagctaaggtgagaggattagctgcatgtgtaccagctatggagacttggagcaaataattttcacttttctcgtagtattgtcttttaaatactgtggcattagaatctactcttaatttgtatggtggttctgtgaatgaaatgggattacccatctcaagcattttaaacataaaaatgctcaaagagccagatatatttttattaaaaaataaaaactggaacagcttctggcatggttgaaaggagatggttttgtacgcaaacgtaggctttacttcttgttctgccattttccagccatgagattttgggcaaattacttaaattttctaatacgctaaagttcatttctggtccagaggagacatcaaatcttttctgaattcgttcaccagaaacaacccaaactctcccttgccttctgaacctcaaactggtagcaatgttgtaccagtttggattcttcccttgcataaaaaccagcactgatgttaatgtaatctaaggggaatacattgccgggaatctaggggcttatggaatttatgaaaagctgggtcaaatgcaggaaacatgacagtgaaggtggatgggaagtagggagcactggcatgatcattgtgatggtgatgatgacaccaacccgtggcatgcagtcgttgtgcatcaggcactatttcaagcattttttttatgtattaactcattcatttctaataacaacctgaatgaagtatgtgctattcttctccacgttttatagatgagaaaactgaagcacaggcagagaggagttaagtagaaagcccagggaaacacatccgcaggtggcagagatgggatacactgttgggatttcccacctgtccaggttcagggttcctagaagacagacacttaagccaaaatcatgtctgctacttccttaacacagggtgctgttctaggaggaagaatgaggaaaaacatgaagcaggacagagcaggagggagagcaagtacaggggtgacctttctggagctggttacaggttcacagtaatacacctgcctgcctggtctatgggatggctcaggagagtcacaagaaacaactgcacttcaggacagtcttttgtgggaaggagggacagggattgatcactcctggttgaagcctacagcaaggggcattaactctccgcaagtccagctgtgtcgcccagtctcccaggcagctagagcctccctgaggtgagtccagctaaggcacaggcatagccatctctcttgttgccagtgtggagtggggagccctggatctgtcctagtagtggcatctgaggccgcctcattacaacctcagagcagtgtgagccctgctaagattgctgcagggagggatgaagcagaaactgagacccaacctctatctaaatatgattttacatgaatataactctaggtagagccaaatagaagccacatgtaatgaggagaggcttttaatctcttcctctgagacagtagcatgatctaagttttaaagacagagaactcaagagctagaaggattatgtgatttgaatgaggttttattgctgtttagacatggtggtgagaaagagaatccaagtgccctagatctttctgaagttttgatttttgttgatagcatagatttaatatgctcataacagttttgggtctggtggaaggagtttcagagaggaaaagctgtgaatgtgtgtgtagatggaatttgcctaattgttttagaacaagcacatattgttgaataacttagttgacatttgaaccagagaaggccattaatagattttgaatgtaaatgttttatttgaaaccaaatgatctttatagagactacaagcattagaggttgttagtcctcatcagggaaagttggcgtatcaaatcatgacggaaataaccaacactgcagttcaaatagcagaggaaagacgggaggggccacccaccatttatcaacattttcatgtgctagcaccttgtaataaggacaagcagtatcttatacatgtctgctgtactccctttccctggagtagctagatcaaaggatttttcctctgaaaagctcatttagtctcatagcaaagattcagtagatgaaagactagaagtgcagtccaggagcataaaatcaattaacttaaaaaatacagtgtaatatattatagctggttacttagagatgctgctactaaaacattgcaaacatcatcggaagacatgctatcatttaaatatatacattcctcactctttagttacatgactctctttaaatctactgaaatttacgtatctccctccctcacactttccttacccatagttgatgggtttcaaatccacacgcaagcccttatcttgggttcttggatgatttttttttttttttaattttcattcagatacctttaaaaaaaaaaactcatgggagctgggtgcatggctcacacctgtaatcccaacactttgggaggccgaggtgggtggatcacctgaggtcaggagttcaagaccagcctggctgaaatggcaaaaccctgtctctactaaaaatagaaaaattatccgggcatggtggcaggtgcctctaatcccagctgaggtgggagaattgcttgaactggggaggcagaggttgatgcaggagaatcacttgaactggggaggcagatgttgcagcgagccgagatcgctccattgcactccagtctgggtgacagagcaagactccatctcaaaaaaaaaaaaacaaaaaaaacccagaaacctcattgaaaaatcatatcatatccatgaaactttcttaatggagtgcatatgggtgttttttttgcattcaggaaataaactaatagaaagaaatgatagtcaaacacaaccacaagaacactgcctttcatgttcctgttagggacaggctcttaggagtcaagaactagattgtagaatccaagcccctgggttcatacctataatattaccaaataatgactttaacaaatttttactgaatgcttaaatgtgtaaagattttgccactatggagcaagagttatgtaaaactttctccttacaacatagtagttagaccttagttccaataagacttatattaaaggtagacttctagaatcccatatttttcttaataactacaatttttaagtcatgatgcctcagcctcacatctgtgttgcactctgctagctacgtatacactattattttatttcaatctctatcacaaccatgcaaagtagacatcaccctcctttttcaaatgaggaattcagactccatgaatagttcagtcaaaatttcacaacacacataaaatcatcaaacaccttctgcatcttgttttatttttgttttagaagtttggcatacaatcgtgtttggtgagggaagaagctgcccatatgtttaggtttggctaatggttgtgattactaattcaagtgtgtgtgtctgtgtgtggtgtggatgtgtggagtgtggtctcctctgtgtgtgtgtgtgtgtgtatgtgtgtgtttgtggtgtggggtcctctctctctctctgtgtgtgtgtgtgtgtgtgtgtgtgtgttttagatagtgcgttaaatttaggataattttgcattatttttaaagataggtctgagctaatgctaatattttagttccatagaaggaaaaagtccagtttgctatgagaatagtaacattgtctacgctctctctagcagaaaggaaaggatggtgagtctcagtgggcagcctggggaaggtcagagaatgccagcttgttcctgagtggcctcagtgatgacccagacatggtcagtcatgattcctcagacttgggcataatcgaaggatcatctggatctctgcttctcctaatgcctttatcccctgcattccaaagcaagaggggagaaaagcaaaattgaatctgaaggcagactccatgtgaccactttaattaaatgtaagagtggctgctgtgtgaggcaaaaggaaaaaactcaggagaaagggcatgatattgttttgaagcagggaagccgaggacatacaatagaacaagaaaataaagtatggaagttgttcaactaccgtctgcttcgtatgcattctattgcaggtgtagagatctggagagaaggacagagagggcaatactagtgattttgtttttaaataagttaccaaaggtaattaagtcttccttttgtgcttcaatggaaacagaatgactcaagctccaaccagcaggatgtcatgcttcctgggctagactgcaccgtctatcccactaaaatgggcaaatatttcactaccgtttggtacttctctatgttgccttctgttaataaaatactcatcaataacaatcccatctaatatggcagattattatataggtcttataatgtagttcaatttatgtaaacaagcctgaagaatagatattttacaggccaggatttatatacaaattgcatcacccataaatgctacagccaggattggaatcaaggtttctgacttcaattcagtgttctcttcatgacatgatactgactgagagtgaccactgcactgtggctgttgagggtgagaaagcacagtcattgttgactgggggctcctggcaagccaacaatgtaaaaatgttccagaaaaatcccatcactcaggagtcaactctgaacatacacctgagagatgtgtcatttacttcatcaagtgatttgtgtgtggttttaaaactcaactttactgggctataatttacatacaaagactttcaaacattttaaggttgatgacttttgacaaattgtatacagtcaggtaaccaacttaatcaaaatataaaacctctccatcgagcgagaacattccttcatgtctctttacatttctttagtcattctctctcctcagcgtcctactccaggcaaccactcgtgtggcctctataactacggatagcgttttattcatatgagatcatacgtatatattctttagagtaaggcttcttcacttgacatagtctctgtgagatttgtctttatttttgcatatagtttacattttattaagagaccatatattttattttttattattattttcttttttgagacagaatctctctcgtttgcccaggttggagtgcaatagcacgatatcggctcactgcaacctttgcctcctgggttcaagcgattctctcacctcagcttccggagtagctgggattacaggtgccaccaatgcccagctaatttttgtatttttagtagagacggggtttcaccatgttagccaggctggtcttgaactcctgacctcaagtgatcagccgatcttggcctcccaaattgctaagattacaagcatgagtcactgtgcctggtcagagaaccatatttttaaaaatcagtttatttgtccaaagaaatttaggttatttttagtttaaggttattatgactaaaactgttatgaacatttttgtatatgtctttataaatttatttttatttttttttttacttttttggggggtaatagcaaggattagaatggctgtgtcacaagtgtatgttaagatataaaaaacaattttgaaaaatggttgagccgctttacaccaaaaatatataagccttccacttgttccacatccttgctctttggaattgtgctttgtgtatgtgtgtattacaattaactaattaaaaggtaatacatgaaaatgaataaatgcagttgttagcattgttgagatatgattaacatagcttacaccttattcatttacaaatgtataattttgtgagttttggtatatttaaaagttatacaactacccgtttattgttgtgcaatacaatcaatttagaaaaatgttatcatccccaacagaaacccataccttttgtaagtgaccttcatctcaccccccagcacattaccttccctaaggccaggcaaccactagtgtactttctttttctataaaattgcctgttcggtttatatcttttgtcttttgccactgctttgttgacttagcataatgttcttaaggtccatccatattgtagagtctatcagtagttcatttgtttttatgactaatattacactgtatggatccacattttgtttatccattcatcagtggatggacatttgggttgcttccaccttgggactattgtgagtaatactgttatgaacattcatgtacaagtttttgtgtagacatatattttcttttctcttggttttatacctaggagtggaatagctgggtggtaggttaactacatttcaccctttgaggaactgccagactattttgcaaagttgctgtaccattgtacattctcactttagcatatgactcttccaatatttcaacatctacaccaacacttgttattatccatcttttttattatagccatcctagtggggtggaagtgtgatctcattgtggttatgatttgcattttcctgagggctaatgataggaactgtttttgatgttcttattggccattcatacatctttggagacatgtctgtttagaactttagcccatttttaattgggttgtcttttttttttttttagtgagctgtaagagttctttatattttctatatatgaattcctaatcagatatatgattggcagatattgtctctcattctttgtcatttcactttcttggtattctttgaagcactaaacttaaatttttttgatgttcaacttatacattttttgttgcttgtgcttttgattgtcatataagaaacaaatcatttccataggaaaccattccaaggtcatcaagatttatccctgtgttttcttctaagagttatagaacttatattatgtatcttgagttaaattttgtatttagtatgtagtaagatacaactttattcttttgcatgtggatatctagttttccccagcatcatttgttgaaaagactactccttcccctaggaactgttttgatacccttgccaaaaatcatttgatcataactgtggggtgggagtgttgctcctaaactgtcaattttatcccattgttctatgtatttctccttatgccagtatcacagtctggattactgtagctttatagtgatatttggaatctggaaatgtgggttctttaaatttgttctttgttttcaatattgttttagttcttctaggacccttgaattgccatacaaattttatcatcagcttgtcaatctcagcaaagaagccagctgttattttgatagcaattatattaaatctgtaaaataatttagggaatattgccattttaacattaagccttccaattcatgaacatgggaagttttcccaattatttagatcttctttaatgacattcaataatattttgtagtttgcatagtaaagtttgtcactattttattaaatttattgctaagcattttattctttttgatactacggtaaaaagagttgcttttgtaaattcatttttagattgtttattgaaaatatatagaaatacaattgatttttgcatattgctcttgtatcctgcaatatttctgagctcatttattagtttgaattttttttagtggatttcttagttttcactgtatataagatcctgtcatttgtgaatagatttacttccttcctccagtttgctttttattacattttcttgcctagtagtcctggatacaacatagagtacaatgttgactagaactggttgagaggagatagccttctcttgtttctgatcttaagggaaagcattttgatttttaccactaagtataatgttagctttatgatttttgttttgtttttgtttttgttttttgtagatccacttctacaaaaatgttctggttcggattgaggaagtttcctgctattcctagtttgttgtgtgttttttttatcatgaaggagtgttggattttatcaaatgcttttactgcatctcttgagattattgtgtggttttgtaccttattctgttgaaatggtatattatattaatcaatttctggatgttgaaccaattttgcattcctggtagaaattccattgattcatagtgcgtaatcatttttatttgttgccaggttttgttgactagtgttttttttttttttttttttttttttcctgaggaattccacatatgtattcataaaagatattggtctgtagttttccttccttgtgatatctgcctggtcttggaattagggtaatactagctgcatacaatgggttgagacgtatcctctactatttttaaaaataatttctagataataggtatcagttcttcaaatattttgtgactttaccagtgatccatctatgcctaagctttctttgtgagtaacttttgattactaatttaatatgtttgttaaagtcctattttgatttttaaaatatctccttggctgggcgtggtggctcatgcctgtaattctagcactttgggaggccgaggtgggcatatcacatgaggtcaggagttcaaaaccagcctggccaacatggtgaaaccccgtctctactaaaaatacaaaaaattagccagcgtggtggtgcatgcctgtaatcccagctacttgggaggctgaggtaggagaattgcttgcacctgagagacagaggttgcagtaagctgagatcatgccattgcactccagcctgggcaataagagtgaaactccatctcaaaacaaaacaaaacaacaacaacaaaaaacacaacttcttgagcctatttcagtagtttgtatctatatgaatttgtccatttaatctaagtgatctagcttattagtatacaattattcataacattgctttatgatcctttttgttctgtaagtttggcagtaatgtttcctccttaattttttattttagtaattttacttctatttcttttgtttttttctttgttcagccttagtaaagccttgtcaaataaccaacaattgattttcttgactttttaaatttattttttatttcattaatgtcttcttttaaaataattttcttctttctgcctggtttaggcttagtttatgcctttttgtccagtgtattaaactgaaagtttaggttattgatttaaggtcactctcttttttttaatattatagacatttatggatataaatgttcctctaagtattgctttgctgcatcccaaaagtttttggtttttgttattttttaaagtttcaatatattatgtcttcatttccatttatctcaaagtataatttgaaataaattccagatgacctgctcttatatgtaataaattccaagtttcctttggctcattggttatttagaagtgtattgttaggttcatgtatttctgaatttctcgattatttttctgttacagatttctaatttcaatccattgtggtcagagaacatactttctatgatttcagtctttcaaaatttattggaacttgctttatagcccagtatatggtttatcttggaggataaaccatagcatttaatgtgttccaagtgcacttgagaaggatgtttattgtgctattcaatggagtatactatatgccagtctctttaaattttagccagtccagtgagtgttcagcgctgtttcattgtagggtgaattcatgtttttctgcttagtaatgatgttgaatatcttttcatttttacatgggccacttggatagttctttgcccattttcaaataaaatgcattatgttatttttgagttatatgagtatcatatatttgggatacaagcaccttgccagatatatttggattgcaaacatttcatttcattttttgggttacattttcattttcttaagttatcttttgataaacttatatatagttttatggcaagtctaaagatctttggctaccctaaggtcatgaagatgttctacgttctcttcaagatgttttatagttttagcctttatgtttagatgtacaatccatttcagttattttttatatgatgtaaggaaggcattgagatattttttcatttttctgattcagatatccagtcatcctagaacgtgtattgaagggactatctttttaacactgaattatattggtgacttttcaaaaatcaattgactttatatgtatgggtatttgggaactaactattctcttccatcaatgtatatatcaatccttgtgccaatgccacagtgtgttgattattgtaactttctagtaaggacttaatgagatagtatgaattctccaatttgatttctcttttttttcattttttgaaatgaattttttttcattttttgctcattctgcatacttcgcttttccacatatattgcagagcaagttagtcaattctttttaaagtactgtgttttttactggtgtttgtttctttaattttttattgatttaactgatacattacaattgtgcatatttatgaagtacaacttgatgttttatatatatatgtatatatatatgtatatatatacgtatatatacgtatatatatatgtgtatatatatatatatgttatataatgatcccatcagggtagttagtatagccatcgcctcatgtatttttcatttctttgtggtgagaacattcaaaagcctctcttctagctgttttgtaatatataatattttactgttaaccatagtcaccctgcaatgcactaaaacaccagaatgtatttttcttgtctaattgtgactttatacctattgatcaacttctccccatcctcgcctcctgcttctccttgctagtctctgataacgactgttctactgtttctgtgatattgacttttaattttttttttagattctacatatatgtgagatcatgcagtatttgtcattctgtgtctggcttatttcacttaacctgctgccctccaggttcattcatgtaatgcagtgaagtgacagattttatttttgtgtggctgaatagtattccattgtgtatagataaccacattttctttattcatccatcgttagtcacttaggttggtttcatatcttgtctattgtgaataatgctgtaataaatatgagagtgcagatatctctttgacatgctgatttcatttcctttagatatagtcaataacgggattcttggatcataaaagttagtatagcagacctgagactactgtcatttatagaggattgcttgcaagcttggcttttggggggtgtctcagactcaactggtaaacagtttcctaaatttataaaaaatactccttaactgaggagagtggcttactgtgcatagaatgatcacacaaaaattgtggttcatgctgacacctgctttccttctagaaatctggaattttggtgcaccttaggcaggaggtagctatgtgaccacttccaattaaaacattgtctgctaagtctcaaatgggattccttagacagcaacatcatccacatggtgctgcatttttgttgtgggggaagagtgtgctctgtgtgacccttcttgggagggaaagagcatagagaagcctgtatatgggttcctgcagcctctacctgtgcctttatcccttacgattcagcagtaagtcttactctaccattgttaaaagtcttggccaagagtacaactttatgctgagtcctatgactatccgaggtgtaggggtggtcttagggactcctgacagatagttggcttattctattccactatgttgttgctagtatatagaaatacaactgatttttttatgttgattttgcattttgtgacttcacaacatccacttctatttctagcagtgctttgtaaattccttatgtttctacatgggcaatcatgtgattggtgaataaagataattttacttcttcctttctaatctgtaatcccttttattactgtttcctgtcttattgccctagtaagacttctgttggctgaaagtggcaagagtgtacatttttgccttgtttcttatataaggtggaaaacattcatcttctcattattaatttataattgattttatcgacttacttacaagttaatgactttgccttgactggatgtttttctaagaaaaggttgcttcaaaacaggagataatagcaaggcatatattgtgctggtaccaggtgaccaaggattgtaggagaaggctctattgatgaggataaaaagagatgaaaggtggcattgcaatgtctaaaaacctacttgatacctttgcagattttcctctaatttgcttttcttcttttcccttatatatctctcagttcctagcccaatgtctcacagagttggttctcaaaaaataagaatttgggcgtacttgaattgaaaccaatcagtataagggattatttttaattttgttggatgccataattatatttgataacgtaatatcaaaagcattacttttagaggtatttttgaaatatgtctagggaaaatagtatattatttgggatttgttttcaaatattccaacaaataacaatagtaaccaaaatgagattgttacaatattggtaattgtaaaagcttggtgctatttctatcatgctaaaatatatatatatatttaaaaatccatcctctgtgctactgtttaatgagaaatgggtaaattctggtttgaggactcttactttctgagttccaagaaattgaaagcatatttgccaattacttttatataacagtttattgagaactcgaaaaataattggtattaacgaatcatcaaacagtctttgaaagtctgctttgggccacagtcaccgcttaatcactgtggtattcacatcaacatcggccttctggttgccaagtccaatggacacttcttccttaccttagttcaacactctgcatcctttacagcctacccaatacttattgaggatttctgttcctttgcttggcctctgttgtacttagctagtgctgtgtaagaaaccacccccaagctttgctgtgtaaaccaatcattgtattatgctctcagatactttgggtcagggatttgtgttggacacagagggatcaacctatctctgttccatgatgtctgtgggcctcagttggaaagacctgaaggctagggatgagttggcagcaggggggctggagtcatctagaggcatcttcacccatctctgctaatccgtcagccagaacacctacacgtggcctctccaagtagtctttgtgcatagccttgcttgggcttcctcctagcaaggtggctgggtttctagaacacaggcagaaactacattgcagccccacccagacacaagagacacaagtggaatgcaagggtgcagggtcatattctccacctctcagtgggaggactgtcaaagtcagtgtggtatggagacaccatccagagatctttggaaaacacattctgtcttagcttcgtaatgctgctttacagttctcctcctttggaatgtctttcttaaccttcatttgggcttctctctctctctctctctctctctctctctctctctctctttactgcttaaatgtcagtaatctccagggtggctctgatacagatcctttctttgttcactctacgctcctctccttgtatttcattcaaccccgcagctataacttacaccaatatgtagctgcaataaacatgtaacaagcagatctgtacagctcagtcttcactcctgagagccaaatccaaatatccacaagacgtccccttttgaatatcttacagtcacattaaacttagatcatccaaatggaatgcaacatggtgtttcttctgtctgcccctgatagtcttcctgttctgcttatcacagagaataccacagctatctgctggccccaaacagagacttgtaagttattttagatgccttctttttattccagctatcttttcaattaatatccaagtcccatcaattaattcttctaaatttccttttaatatattacattctgtccatttccacagccactgcctacctgaggcacatattatctcttactggaatcattgtgctatttctctcatgaatccatttgtctttagacttggcctctgcttcctcctccattctgctgctagagggcactgtttatcacagagatctgttcatgtgactctcgctccaatcttgcagatgatcatccaagattctcaggagtatcctacagtccttttgcttgtcatgtttagatgccagcccacatgttcgcacttaatgctcaccagaacttccactactgcacgttaaatcccaggctcaaacaattatgtataaatacttaaaaccatatgtcttcatgcctctgattttttgcacaggctattccacctgcctggaatcctttccgccattgatcttccaggcctttgtttatatttagcctttaaaaatctcagcttaagtgctacctcttctattaatatttccctaataactcaccttctccacccacacacatgcccatacccaccaaaattaacacacacaagatctctgtagatttgtggacttaacactctgcatttcctttgcataccttccatataaagattcacatcgtgttataataattgtatcacagaactctctgtgggctgtccatctcttaatggtgaggactgcctcagtaatcatccatttattaattcattcaacaaataatgaccaataactcctactatatgccggttactgttgttgaaacagaccgccatggtaaacaggacttcattgatagtctgtctccagctcatggtacatgttcagaacatcagcgttgaatttttaagtcatctctggactatcattggtgctcagtaattgttgttaaacagttgatgagagaaaattccccttgatggatctcaaccgaggtcatcagagaaatccttctgtacatatagggcagggattgtgatttactagtttgcctaatgccagaaaataaatttgaggtttgctagcaaagttccttggatttatcttgaaggctgtgttgacatcagtatcccccacccgaaatagtaatgtaacatggtgaaagtacaggacactccagcagaaacatgcagtttgctcgcctagggtgcaccagctctttagttttcgggtgaacttagtctcagcaccctccgagtctactggagacatctcctggcctcaccacactgtcctgatactctcttcttttttttttttttttttttttttttttgagatggagtcacgccctggcacccaggctggagtgcagtggcatgttcttggctcactgcaacctccacctcccaggttcaagcgattctcctgtctcagcctcccaagtaactgggattacaggtgcatgccaccacacccagctgatttttgtatttttagtagagacagggtttcaccatgttggccaggctggtctggaatggctgacctcaggtgatctgcccacctcggcctcccaaagcgctgggattacaggcctgagtcaccacccctggcctctgatagtcttcttattgtgaattgtagggatagctttcatttgtttgtggttctgtaaaccccaccccagatttcaaagccacctatagctagctgttcctcagattcaacagtcattgcccacagggcagtcattggctaagaaacctctggaggaaaatcacacttgaggcaaataacattctctcactattagcagctttgatcttttttaaaacctcattttctttttccagcccccattgcattgtagacatttttataatgagcataaatgttcatttaattttatttggcatatgctgctttgaaagtgccacatcaacatggagcatcactccttcagtaactaaattcttctaacagctttaaaggaatgaccttgggtgtgaccagtgggtcttcagagcatggctgcgttttgattagctaaattttctgttagcccagtgagtccacacaccaattagtggagcataatcacaagcctgaaggtttcaggagttttctcacagggaagtaacattgatacttttcttaatatattattatttttaagtaaatatctgacagtgtctaggtaatcaattctgtgcccacaaaagctcagtgtgcctccgaaagagttcaatatatacaagtatatgcatatacgtatatgtttttcacaattcagatgcaaatacacagaaacatttgttcatcttcaaatcattttaatagatgattgggttccttgtccacccactgcccaatgactgtgggagaaccttctttcatttacagaaccccagtctgtaagaatagatatctaaaaatacagaagtctgatgcccagaaattgtccttgaagcttgattccaaagcacaatatgtgcagcccaaagcatgaccagacagtaagctttcacatcatacatgggtcaagcacagacatattcttcttttagatttggaataagggttaattgcatcatctaggaagcgttcaggaatatagccttgtgaattctcacagttatgagtactatcaaaaattgacttcacacatgataaaaagaacaagaaatcttggaatgctttcaatctcaaaaaaagtattgtgatattaataacatagataaaatttatttttattaatttctgcttccaaactttcaacctgtgagctttaagcccacatcttatcatattgttatgtttcattgccaaaagcaactacgtattgatatttcagaaatgctgccaggcctttatgtaactagttgctattttacctcaaaaaataaataatgcttcctgtttttacttttacttatctggaataagtagctattgacatctgctgaagtcagtataaagatttatttacctgagtgtagatattgaccaatagggagcctggctcaatgtttacattgaaggacaataaattgccgtattgactgggctgagacatcaatatttgcattgttgtaaacatttttaaaaatcttcatgaaatattcctcagaaattctcttgtcaccagagcagctgagctagagctctttagggaatagcttgtgtctggaagccagtgggtaacttgaaatagctataaattgttctggtttccaagtttacacaaagacacattttttattgtgatgtataatgctgatcattaggagctttcagatgacagtcccagccccctcctcaaatagcagatttttgtctacaacaactctgaacagaaatacgctccccgagtagcttgtgtcttgaaaagctcatgttttccaaaaaatatctcattgcccaaacagtgaaacatcattaattccaaccagattaattaattaaaaatgtgggatgtttcaactcagttggaataagtttttcctttgtgtcaagagtagaaagaggaagatgatttagaaaacattaggacaggtaaagtgataaattgaatatttagcctgtttaagagagaaacataatctacacaaaatcttcttacaatctatgaatgcctattaataggcattaacttaacttcttaactccaagtgatatgtgtgtttatataatatatgccattttaattaagctttgtaatagatacaggttaaacaactttatcaacatgtgttcatataatttaatgtacttggaagaaatgaaacgggaaattcctttattcctttttttttttttttttttttttttatttgagacagagtctcgctctgtctccatgccaaagtgcagtggcatgattttggctcactgcaaccttcgcctcctgggttcaagcgattctcctgcctcagcctcctgagtagctgggactacaggcacgtgccaccatgcccacctaatttttgtatttttagtagagatagggtttcaccatgttggccaggatggtctcaatctcttaacatcgtgatccacctgcctcagcctcctaaagtgctgggattataggcatgagccaccgctccgggtcaacaggggcaatttctgtcatatggtgtaaaagctaaacatctggcaaattcttaattttttccaagttggtaaaatcataacctactttagccagcccaatagttctaagggagtggctcaagataattagcaccacctcttggagaagcacagattcattgttctagtgcagggtttggtgcctcatcgtctttgtcaagtaagacaattaggacagcgatcagagatcaaggagctcgggatgatgtgcaaaatgtgatgcctatttatgcttgaataacaatttggatgaaaaaattggcatcttaaaaaaatatttgcatcatggttatattcctaaatgatgaatgaaagaaaagaagcatccagttctctctgcagttgcttccacctctaggcggtacttcatagcaccctgttctaagttaggctcagggactgagaatgcttttagcgaagagggataggaggggaggctaagatgggcaagtctgaaatgtgccctcctgttcaatggggggctttagagggaaagtggaaatgtcctaccagtaaccgtgtctgcagaggagacactaagctcttgcccaggccccatgggagtgcctgtgctgtcatcaccccaggggctctatctcagtgattccctccatcccgcccttttcctggcctcctctcctcctcttgggcttctccctctcccttccttcctccctctgaggcaatgcccagtgcttgtagaaagccccaccacttccaaaggactgtcccagcccctggggcctcagccccaggatccctagaggatgattttgtggggattaaaatgaaatgaggtatgggaaagagctggcgcacagcaaaccctccaaggtgagccccctccctattctgggctttcccctggacacccactctactggttgctagcgctgaggtaacaaagtaccacagcctggagggcttcaacaacagcaatgcattgtcttacaaatttggaggccagaagtctgagctaaaacagtcggcctggttgatttctgggagggcctctctccttggcatgtagaaggtcgccttctccctgtgttttcacatgtcttccctctgcatctctgtgtcctgatctcttctcctaaggacaccagtcccattagattgggtctcccccagtgacctcagtttaactgcatgacctacttagggaccctgcttccaaatgccctcacactgcgatactgggaccctgcttccaaatgcccccacactgtgatactgggaccctgcttccaaatgccctcacactgtgatactgggaccctgcttccaaatgccctcacactgtgatactggcggttgggacttcaacttacggatttggggtgggagcataaatcagcccataacaactggtcagtccctctcctctgcctcctccaactgtcacattgtaaaccccacctgactcttccccgacagtggccttggggagaaggcggggccggccagggtttctactcctgcctcatggagacccgcctcagatgcccagcactgcgactgctgcacagccacgaggctgagccgctgcggatgcatgcgtgacttaggaatgtgtgctggtgtgtttgccacagcaacaggatgaggaaagcacagctccaagagaggtgggagctcatccacctggggaagcatgagcaggagcaggaagggtcactctgggactgtgctcatgggaccctgagatgcagcagaaagagcagtgtgaggagcaaagtgacgctgcctgcaggtgctgtccactcagaccttcccagcctaggcttccctgctacccacgtcttcccacctggactccccctctctcaaggggcatcctcagtagtgctctctcagcccatctgcccctcagaggcctggacccctgccttgccctctgtggcttcacattaacattgactgggagccatcctacctggttctcatgcccaccagccttcctctccaccctgtggtcacaggactatgggcagcctctgctctgagctccctttgtacctctctcttctcacctttttgttgttgttaattgtcatgcacatcttgaagaaggaggaatgaaatgctcccagctctgaccaactctgtttttctaagtgtcctccttcgtggacctgactgagatggcactgctactctcactgtcacagccacccctcgacagcctgaggcacactccctgctgttcaggagcacccagattggggcatcggtgcacctggacttgctatgtctcgggcaccacccattacacttatcactttttctccatgagttatattcacagcggttccccaggcatcaaattggcaatatgagtttagctcttaggaccaaaggacacacaagagatcatttattctttgcatcactccccttttctcaggtaggacatcaatcttccccgactctgctctggccatatttactgccagtcgctgtcccttagactgtctgcctctcctagccttgacagatgagtctcactccaccaggatctttacaattcaaggcacagtccagcctcttgtagatgggaatcttgctaatgtagccactctagcttatcctggctgcatcatgagaaaaatggagttcagctcaggactggcttcctcggtttgcagagtcagtgggcacctgcaaactaagagcttccatctgcaaggaagacctatcaccccaagcacttggcttggctgctggctgacatttgatcatcagtacctttagtttgagtctctggtttctgtgaaataataacttctaatatccacacagtggagtacaatttacagaatgcatccatatatttaaaatatttaaactgatctataaacttcacagtcgatattatatccccctcattttatcaggaacataaaataagagactcattcaagctaaaacataaacgagtctggcctatggcagtgcaggctatttctgtctgttacagcaggctgccactctgcacttcatctcaggagaacagtttaaaaatagtagttcttttcaaatgggattgtgtttctggccctttcttggaagaggacctgaatgaaggattgaaagattcaaaggaaggagatttaggagtaacacagaagcaccatttaggtaaatgctagagaagaacacgatattacacatactttgcctgtccgccccccccacccaaacacacacagcctcaatgcgcaactttggcccacttatttttgcctcaccactctgttgttgctactagaatttttgatacttctgatactcaatggttttcaactgggcaccatctctgggggatattcgaatatgcatgagcccaccagaatgaccgcatggctctactggccccctgtggggaggggccaggaatgctgaacatcactgtggctagagcagggcacagtgttgaatccacctgaccaccatgacaatggtgtatccaatgagaaaacaaactagggagatgcatcagacttaggaagctccgccatctgttcgcaggatccctgagaaccctggctattctacctttcctgcacttctgcctattgatccttctttgaagatgcttttcttctttggtgcctatgtccttctcactcttgaaatgactcaactacagaaaatcctttccctggtacatgaacaagggctttctcctttaaattcctccttagtgtgtatttattcttcaaaatattttctagaccatttgagacccctcaggctgtcgatggcagagaatgtgctgtctgatgctcatccatcatcctcccttgtcagatctgtctaaccagtccttaggccctttaggcaaggccagtttcagtcctggtgggtgtaaagctgagtaattttctcaggcacacataatggtgaaataatgatgatcatagtcagaattatgattttggtaagtggagtatgctgtgttttccaaacgcttatttttcattatgtatagaatgaataatggaagacacattgagctcaggacccggatgttctgtctgcgtacgtttccttctaataacttgagagaagcattcttttatccagctcatgtcatgcatgtcaggctgggtgtgcatgtgactgagcagaggaccctagagctgcatatgtgtcatgccacctgaggtttaagttatataaattcttgggggaaaagatctggtttatatttaaaaaatgcttaaaaggctggagaaaaggatcagagagactgaacagcctctaaaaaatacaatttcagggagtcaagtacaaatgaatcagggacttttgactctgcatgtttcccaatataaaacatctgaaaaatggatttaaactagaaataaatgaccagatctaaggattctgatagagaaagaaaaaatgtgctaacatgcatgtgtgagcatgcatgtgaatgtgtctctaataagcttacattgcatgagcttacaattttgggtcggtatgcatgtccaaatgcaggatatgggtacacatgaaaagcaggaaaaacatagtgtgctgaggatttgtttggtgtatatgtgtctattttgaagaatatggaagaataattgaggctactcatttaataaacatttatgtggttcaagggtatgatatacattgtccctagagacaaaaattagtaaaatttcagtttctttatatgctttgtgaaaaataatctccttttacaaaactctttagtattgtgtgcagcgcacagagcctagtgtcagtgtttctctggggattgaagcagacagttctgccaaccagcatggatgggggaatagcctgggcaggatgcaagccacatcgtgcagaatatgattcttagtggaatagaaagccaagtgccatggaagccaagacacgtgcaggcttaccaagatgccccaagccattggagagaatatggagtttctcagtgcacagaagattcagaagatttacttaaacttaaagggcaagtagaccttaagaagctgtaaaacttgaggacatccaagattctgacatatgaaatataatttctttggcacctatggtataccatacactcttagctactaaacttagctactttttgaatgcatgtttctgtgcctgtatgttttaatgcatacatcaattcatgtatagaacaccacttgaactgaacggaatacacaatagtttcaccccaaaatatttcttttgttgccttcccatcttttaacctctattgtttagattggatactttttttctttctttctttttctttttttttgggacagagtttcgcttttgttgcccaggctggagtgcaatggcacgatcttggcccactgcaacctccagctcccgggttcaagcgattgtcctgcctcagcctcctgagtagctgggattacaggcgcccaccaccacgcccagctaattttttgtatttttagtagagacggggtttcaccatgttggccaggctggtcttgaactcctggcctcaggtgatccacccgcctcagcctcccaaagtgctgggattataggagtgagccaccatgcctggtgcgataatttctatttatctttaagtttactgactttttactctatcatctctattttgctattaaactgatccaattagtacctaaaactcagtcctagtttttcttacttgcttcttgtgtatggcttctagttctgtcttgagaatgtccaccatcatatttgttttaaaagtgttcacctttactttgcagggcatagttttagcagctgctttaagatctggcaatttgcaacaattctcagggatggtgtttgttaattgtcttttcccttgggaattatttagcttccccttgctctttgtaggatgagtaatttttgattatatagtgcacatttttatcttactagactctagattctgttaagatcctttgagaatatacaggcagagttcaccaactaagactctgggtggtggtttacacaagagttcagttctcaaagcctttggtgtactgtcctgggtgagttccacacaagttcagagtgaacctgggactttatacattgctatacctgattcctttcttgagctccttctctccgtgatttccccctgctctccagctcccatgagccccctttctttgccatctgcctagaaagcaggagtattagcaccatactccatcccctcaccccctgccataaccttaatgttacaaatttcttgtgactgagtccaactccagggaaaagtggtgagaagaaagagaagaaaaaatgtaataggtattcctctacacttttcagaccacagaggctcctgtactcagttccgctggtcatgaagtatttttttagagttttagatgtctttgtggccactgctgctactatcaccactgctgcaagactgcagcgtcagcactgaggtttacctcagggcagggtcgagggaaggaaagaaagtggacttccccggactctccgtcttacaagccttatctttccacatcctcagaccaaaaagagtttatccaagagtttttgtttgttttgttctgttttgttgttgttgtttctgttggcatttgctatacagttttaggattctggctgttctaagtttaagccaggaaaggaaggaggaaaataaacaacaggacatttgccgctatattgttctttcttcaagttttcatttccctccacaagcttcctgctattgtttaaccttcagagctctcatatatttcatttatgtatttttgtcagttataatgaatgggagagaaaggataagatgtagttaccccataataacttggactgcaagtcttatagagaattaaaaataatagcagtaagactgactaaaagatagtctgatttttttttttttattatcactgtacacatgtaattttaaacaccatcagtgagcagacatctcccactgccctgcccttggtaaatcactgatatggggaaattgggagccgggagtaataggaaatagggctaaagagtcagctatgtttgtcatgggttattaaagaacttaataaggacggtgtccttcattctggagttctaaatatgcattggatactgagcgtattgttttaatagaccctgtgcataaaagcatagatgaagaattaacattgacctagtaaattataaatttattgagagtgaggaacatatcagctttatttttgtgcatttattcattcaacaactatatattgtgtataactatatgctacagatacagaaatactatctctctttaatggacctttactctgaagggagagagagataaataacccatccattttaatataatgtaataagtgttaccatttttaaaaagcaccaagtagttaagatgtacagtgaattggggatgggggtgctatcccaggggatgtgcagaggttacagaaggattcttatacgagctgaacttaagctgtaacctgaaagaaagaaggcgacaacctgaaaaatagagtgtttccaggtggtagtatgacaaaagataagatgacgttcttctagaattatgagttgtttccgttagatctgaaccacatgtgggaaaatgtgaggaagaaatgataaggaaatagaggcattagatcacaatgggccgtataggaatttatgctgtgtttgggatgatggtatcgtatggcctggtatgtgagtatggatcagatgttgacgcctacctaatattattattgaataaaaattaaaatagataatatttgtaaataagttttataaatgtgaaagtccagcagacccctccagttgtccctaaagtatcaggtgatagaagtgtcagtgaacagaagaggatggattcaagatatactttagaggtagaattaataagacttggtgatggatttgatattggattcaggaagcgttaagtactgagtatgacttctacatttttttttgagaaatgtgactggtaaaggtgccatttatgaataagagaaaaactgaaggagaagaaaatttgaaggaagataaatctagaagaatttcatgtcggacatgtcaaatgtgggatgcctatgagacttccatgtgaccatggaattgcctatggaagtgtagggttcatggaagagaaatagggtgaagatataaatgtgtgagttattgccataaacctgaatgttcaaagccacagaataaatgatattgcctgggaaatcattgtacagtgagacaagaatacctagaacctagccctgaggagaagccaggaaaggagattttgaaggactatccagagaggtggttgggcagttaggagattatgacattatagaagccaagaaaagctcatttaaaggagtgagttgtcagctatgtatattgctgctgagaagtcttttaagaaaatgctaagatgtgtgccatgaatttggacacatggaagtcattcagtgactttggaatgggtaggttcggtggagaggtgtgaacagaagctggattggactggttgaagtgtgaatatgaggggaagaatctgagacagcacatttggacaactgttctgagaagcttgactgtgaaaagaggctgtggagcctggggtcagtggaaaacagtggtgttaaggcagacattagaaggtgtgaaaacaaccatgaaaatgatccagtacagcaaaagcaggtgaagattgaggagaaagtccaggtagctgatgaagggaattccttgaaaaagtgagaaagaaacaaatgcatagaacaaaaggaggaattggttttttgatagcgggaagggaagacatttgttagacagttactgtaaagtatgaatagaagtgaaggggttgaggatatttccccatgagagttgcagtgatgggtcatgaaatctaagttttctaaaatgtaggagataatgagatggcaagcacaaatgttggtctgtacatttgatcatgagaaaatgagtctgtctgacggcttctctattctccctcctccggcccctcccccacctcagtggagcaggagacaggatcctcagcagaggacagcgtggatggagggagagggtggtgaggcactgagaagttggaagagcatgaagaaggggaaaaatgaaccttgagagtgctcaagtgtccatggcagttatgagtgcctgcttgagacaggcacgtatgagtgtacggagaagccagtttgtttttttgatgttcctacagcagacacagaggagacagacatttagattcatctaggatggggttttgccaggctagtggaacaagggagggaggcgaaggagttgagagtattttccagggagagagaacaatgatgcgttataaaatataaattttatcaaaagggatgtaaaagtaaaaaaaaaaaaaaaaaaaaaaaaaactaaaaaatgttggatcgggggatttaaatccctagtgaagaaaaataattgttccctcaagcgactgaacaaagattttaaaaaggtaggaagttatggacagagtgagatgcttaaattaatgccttcagaggtggttcagtttctgacaagttttaggtgtgaatgtggagtaggtcacagaagacagcagagcaaaaagtcatggaggtaagatcaagaatatgaggggccggtttttgacggattgtacttctggacgaggaggtcacagagaatagtggtaggagtgaggatgcagatggagactctaagaagcaaaggtttttattgaatagaaaaaaataataaccaggaagtcagtagagaacagaaatgtgatggaagaggaagaggcaggggtgtaattatttagataatatgagccttaaagatgtaaggtttgaaaaagatggagcaagctcagaagtttaactggaaaacaaagacaccaaccaacaaaaaaatatgtgcggtatttaaaaattgggtagcccccacttgacaggacacgtctccaggagagcccatgtccccgcctgagtatgagagtgaggtggaggcatctctccaagaattggatgctgtcagggagcgttgatgatgcaggagaggttcctgagtgcagaatggaaggactgcaaaagggtggggaggatgtggagtgcagtccgatgaagggttatatgaaacagcgggtgtgagactacaggaaatcatagatgactggagatttacgcgtctacaggagaggtcagcaaactacagcctatgggccagattcagcctgcagcctcttttctgaatggcctgaaatgtaaggttttttttttttctttttacatttttaaataattgagtatcaatcaaaaggagaatactatgttgtaacacattaggattgtatgaaaccacaatttcattgtccaaaagtaaagtttttttggagtgaagccacactcactgatttatgtattgtctatgactgcttttgtgctacagtggcaagtttaacagttgctctagaggccgctcagcctgcaaagcctaaaacatgtattatactagttggtcttttatagaaaacgttggctgaccctattttacagaattggttatggaagtctcctggagacgagtggtaactggagctgataccagggtcttcaaagcaccatgggatgctacagtggtgtgcaggctagctgtccccacaggcatcataggaaagcatggttaaggctaacacctcccgaaggtgtcactatgacttcgagctttaatgagaacacggtagtcacaggagcaagcttctgatttacctaagcaactgaataattaccttcagcaatcatgtgtgttctggttactttctctgtttgacgtgcaattttatcatctgcttgtgctctctggctctctcacactcccctcgccttcccctcccctcattccttcatcccagttttttatcagctgctaactccattggttaatgcatgagctcctgtctgctcttgtactgtaccatggaaggtgccattcaagtcttagagtggaaattcgtcttctgaagttgagatttagaactgaaataaaaaataacttaaaactcatcagttaaggttgctagttttttcacgccaagatccagtaaaatgttcctttattttcccttggaattatcgggaaggaggagttactggggttgaagaagtctagaggaatgggaattaatgcaacttacatcgagcagttgaggacaggaggaggcaggaaggacagcactgtcaatggcaggcaaagcccttagtcctgagaccaagcaggtgcaggaaagtcacaggagcatgttgaggctcattttgtagtgatggcagcagttttttccttgcctgtcccaggaaggtagagagtttaatctcactccttgcaatcattccactactaattacagacagacagagctgaatggccaggctgattccactaagaaaaaattcaacctaattgatgatgacataagaaagctctctgagaccatttttattagggcacactgcatgccaaggaagcagggacattggctataagagcttttaactaagaatatttgtgaaggtggccaaacctggctcttctcttattaattccaggcctagcttgatgaaggctcttttagttccccttaagaaatatggaataaaattatttagccttaggagattttaagacatctcttcatgaatccagccctctctctctctctctgtctctctcacacacacaaacacacacacacacagacacacacgagaaagaaaaaccttaaaaaatatacccactgttttcttaaaggtcatcaaagggtgttctgaatcattgatatgattaacaattgatatgatataacgatatcataatgaattatgataggctagaacagccatcaaaagtctagtcagctagtttattcattcaacctttgcccacatgatcatgtggccccttctacgtgctaaacctgctatagatattggagatgtagaggtgcataacagagtcactgctctcttggaaattagagtccagtggggtaaacatatataaataaataacaataccgtgtgattagcaatgctagagaaacaaataaacaataataaactaggtggggaggaggcccggaagtttgaatgtgacgaaagggttcccagagcagtgattgctgggatagttttgaaggctgcatagacatttgaaggtggacaaaagagaagacaaacaggcacagatcaatacaatgcctcgtgttttaggaacttcactggtgtgtccagtgggtgtagggggaagtgagatggcaataaagaacccagagatgtaggcaagagccagctcatgggaaccttcacattccatgccacggagcaatgtggagcagtggtaggatttaagcagaggtgggactgactcttatttttggcaattattttggcaataaagaaaagaataaatgggaggcgtggagactcataaagaggatattgtaataatccagagtagataatgagggcctgaattaagacagtaacaatgatgaggaaaagaagagaatggatttggaagctgtaaagtgagtggaaacagcagggtttgttgattgaaggtgaggaataagggaaagagagcaagcaatgtaactcacttttatcttacgagaatggggattcgacaatgctgccaagagagatcagatgcaggagttaagagcagatgtaagggcaaggtggtgaattcagcctgcggtgtctgggaagcatacagagtaggcatttcacaggcagttatgggcctggagctcagcaggtcctccaggacggccatgcagatgtggagatcatgagcacagctggccatctacagtgctgagatggcatttaaaagaataggtttacctggggagggggtagaagtagtagaggagtgggccttatgtgatgctgttatttagggattgaatgtcccaaacttttcctatagtttgttccttctaacatttttaaaattatttcccacgtgttaatcattcttccatatgtttgcacaacttctctcatataattttcagacccaatatatgagtatttgagtcataaataaacagccacattttactaaggagggaactgaggcccagttatttcctcaaggctaccagttcctaagagacgtcgccatactgaggattcaggagttctgtgtttgtctgcttgttttaatacattgcattctacccaagacccaggtgtgtgtgtgcctatatttagattttatgtgaagtgaagtagaaaggcacagtagtagtgtgcccagtgaaagagtaaatcggctattcttttccttcccatacaccgtctttttatagatttcatgtaggtgaaaattccacctggcagtggaatgctaagaacagaggggcaaggcattcaaaagtaagtgggcagagcccatgcacgtgtttccagcaggatgatttggcctacctgctggaaagtagctatggtgcagaatagattttgagaaatgtttataaagactcatttttttccagtcaaaggctttaattaaatgttacaaatacaagggctttcagtcatgtctccctttctcctgaggcccaaacaatcctactccaataggcttcctgctcttctgtagaattgtgctgtggtttcccaagttattcccttctgcacatgggctggtgtctgccctctccatgccaattgaaaatacacagatggcacttccatcttgagtattcctggcaccttgtagttttctcccagaatctgatctgaatttattcattagattgtcttaactatagatttgaccccaccccaggttttctgctccctctgtcccccaagtggtccccttgtcattgaggttttgcttgataccatcactaataaatgggattcttcaggaaagcctgcgttttgctctgcatctgaggatgctgcttgcaaagggaaagcctggcttccctcctccttctatgtgcaagaagcctctagttcatcagccagtgggcatgggcctctgcaggaatgggcagagccctgcatcctccgtgcatttcaacttagctttggtgggaaaagactttcccccatttagtgaaaaaagaactccccagatcgatatatctattcttcaaaaggattatttataagttatttcacttcccatcctccacaaaatatttaatgaaacatacgtaaggctctgcttccccgtggagtgatgttcttttgcctatcatcatctacatttttgcgggctttttcttggcagacatgtgagttgacatggatttggttctgcaccatcactaggggatgatccagaggatcatagcaagggggtaccaagccgtgtgtgtcctgggctccttttacatccttttcagagagctgtagaatctcttcttaaggaaaacacacaccaatgcacgtatgcataatattatttcctggtattcaaaacccctgaggttaacagttccacaattctcagattaagaacccctgccctacaaaatgtattgatggctaaatcataggctgccctgcttcccaaggctgttgggatccaggtagtgaaggtgacttcttatctgatcctgagcacaatggtgtcaggagaaccttaaccctttaggagcctcttaagtcaatagaattcccttaaattaatctgggtgaggaattgaaagcaattaactccttcaaagttatcagcactcagtactggcttatatctccagtgatttagaaaaagggaaagcaaacagccaagatactgaggcaatatgacattgcggagtgctatatttatcccctatcaatgtctttcagatcaaattggctgagtttacaaatcaaaagctgatttatttttttatttttatttttttagcagccatcagctgcactactgcaaatacacagttcccagacatcaagctgcaaactctaaacacccagctgtgtgctttctgactttgatatcatcacgcgtaatagagggtctgcatgcagatttgagctgacaggcctcctgagaaggctcacagcagaagagcacccaactccagggccagcccagcttctgaagccacatctgcaaagaaaacccacgtcatgttgttatgggaagggatgggcctcagaaatgcacagggcctggctctgtggagtacaaagggttcactttcttataattacactttaagttgaagcttctctttaatatgaagctaattattattcccagatttccctatcaaaaaaaaattaagggaatttgtttctacgtatctataaaatgttatagttgatatatgcgtagctatgcatattcaaccatatacacatattcagttccaactatcaaatgagttcttaatatgtgtcaggatctatgataaatgttttgttgatattgatagacacatatatgtgtgtatacacacacacacacacacgaaatttatagttggcaccagtttgtataatatttttattgaatctatatttattgctttatgaaaaaatctggttaataaattaatttaagaactattcatggccaggtgcggtggctcacgcctgtaatcccagaactttgggaggccaagaagggtggatcatgaggtcaggaggtcgagaccatcctggctaacacaatgaaaccccgtctctactgaaaataaaaaaaattagctgggcgtggtggcaggcgcctgtagtcccagctactcaggaggctgaggcaggagaatattgtgaatccaggaggcagaacttgcagtgagctgagattgcgccactgcactccagcctgggtgacagagcgagactctgtctcaaaaaaacaaaacaaaacaaaacaaaaaatactattcatttgcatttctagcttatgcaaagggtatagtgaacatggaagttgtttgaggaagggaacatggtgcaaaagaaggtatggcaaggtggaggagcccaggaagaagcagtttctgtgtatccaacagaaagggtatcctgagagaaaggaggagataagtttcccaggtataaaagaagttcaggtgaagtaaataggaatctgagctgacaaagaggcaatgtcgtggggttgttgccatatgcatactctacgacttacgcacagctcacaagcggccagcatgggcctatttaagaatgctttctcttatatgatgggaaccacctatttagaacaattcagctgtcccatttcccagagttgggctctatgtttgttatcaactgtgtgaggtctgtcctgcagtgttacaacaggcaaacgtaggtttgagcccttcagaacttttcctatgaaacatcttttaaatttgcccatttttggcaagatcatcagattctcttttccgccagccatgctacctgtatccaaaggaaatgtcaaggaactatgtgtaatatatatgtacgtatattacatatatatatagatataaaatatatttatatccttttatttttagttctgaaaccagagacattttttaagctctcagcagttcttacctgggctatgcagctatacctgcttttttaaaataaatgatcatgagaaattatatttattatcaatcacatcctgttttaagtcaagagagtagagttttctagttaaaggatatgtggtgaatcctttgtaagatttattattattaagttcctactggcaaagcagaggtctgattattatttcatttctgagttgagatgttcttgtatcaaggatcatgtgtattaaaaatgtgataaagcctaattagggttgcagtaaaaataaagatcatgatagctacgatttcctgagagcttcctatatgctaagtactttactcatatttagtcatttaatgctcacaataatactataaggtaatcttatgttctccattttacagaagaggaatctgaagtgcacagaactgaactgtcagataatactgtctatagggctcgagtgcagaaatactagagctcatcactgcccccacagtgcagccgggggaagtggtgcttacagctgctatcaactcttcaaccattgctccagcctagtatcaggcctacagaagctatcctatgcagatcattcgacatgaatgtcacattgtggaaacactttttaacactgatggtttcaccctgttgcagcggatattgctgtgtgggttatgtgggtagctcccatgtccccagccttgtctagcttagcggcacagatttgcattaattccatattactgtgcctctcagcacccatctgcctgcctgggaccctccgtttacctcagaactggctctggtatttcttggagtccctgttacgtgcttaaatacaagtcttcttgtgccaccccctttgacagtctctcacatggcctctgctgccacttggagtggggctgtttttgagccttattgttctatgctttccagctcccaggactgcactgattcctcaagggggacctggtgtgaagaaggccttccccagttcatcagcaggccttgacaccagaactcacagtggcaccatacacctctgtattagtctgttctcacactgctataaggacatacccaagactggataatttataaagaaaagaggtttaatcgactcacagttcctcagggctggggaggcctcaggaacttacaatcagggcagaaggggaaataaacacgtccttcttcacaaggcagcaggaagaagagtgagtgcccagcgaagtgggaagctccttataaaaccatcagatcttgtgagaactaactcactatcatgagaacgggatgggggaaaccactcccatgattcaattatctccacctggtccctcccatgacatgtggggattatgggaactacaatgcaagatgagatttgggtagggacacagccaaacctctaaagtctttcatgaaaacagcttctttcctttctggccaagcccactttcttcatgagacctcaaaatcagttcctggggcttgcacatgttggtattgaggaagaggagtctcacctctgtctgtcttatctcccagcatctgagcaaaaccatgccttcatccagtcaaaacagaaaaccttgaatgttcatcagccatcataatggcactgggggaatacaactgtccttgaggtcagcctgggtttaacaggaacacctgatgcaacctgagatggtggagagagcagaggctgcagagctggtgcaggactggaatgtcactgctagtcatgggatatgggctaaattttaaaaatgattccttccaactctccaattctgggattctatgttctgtatctttttcaatttctgacgtccaaagattgtatctcagctggtatatatgccataaaaatattaagcaaggaggcagctgtgtcctctcctctccagtagctacagctgtactcctgacaagcttattcttgggtatgataaaaatgatcactgtgggtattattattttcagttataaagatttttaatgcccaatctatgaagtcagaaatgtgggattttcttttccaaagggatgttatgcacacaagacagtctctgtcattcgattagttgtaaatgctaagctcagcactttggacaacaccaaaacccctgtggggatttgggggcaggtgtgatcacatatccagcttgcttcatttccctgcttcggttgtcgtattccacttaatgaaatagctgtatttccaaaaagttggctgtaaaacaaatttctgttagataaatcatacttcttcattgatctacacttttaaattaaggatgccttctcctgaggaaataattggccccaaaactaaatataaattatactacacactcgataaaccttttaaaatcacatatttaaagaaaatcttttctgttagaacactaatagtgatgatatttcctaaagtcaggaaatacaatgatcatgctaagaactacgactgtacatggtgttcttttgggattggggccacaggagggttaggtgagcaacaaggggtctctgactttttttcattgaattcaacgtgttgttctgggtctgtcagccagaagttagtcaataagaagttggcaaattttaaaattatgtaaactggtttcctagctgtcttgagagccagagatgtccaagaacctggtttctgctgtcaaaggccttcaatcgcattggaaaaagaagccccctgtgtgcagcacaagacagctactcaaaaacttgattacagttgcaggagcagtggattggacatcaggaggcctggtgtgctccatcactgaccagatgtgtgcccacagactcctctaagcttcagtttcccacaagaaaaatacgaggcttgagcgaaatcactagttcccaaacttgcctatttgtgagaatttcctaggaagattatgcaagcacctcatcccaggagattctggtttagtgggtatgagtgggacctagaattctatattttaagcaactactctagtgaattctactgcagacagactatgtactagcagagcaactatggaattatataaccattcatgtccccttaagctctttaattctgttatgattttaaagactagatgaactgaatgtgcaacaatagtgcagaacagccagaggcaccaagagttaggagacaaaagggaatgtattagtgtcccaggactactgtgacaaggcacaaaaaactgggtgctttacaacaagaaaactgtacagtgctggaggctagaagtcaaaatcaagtgattggttggaccatgctctctctgacagtgacaggggagaaccctccctcgcctctcctggcttctggtatgcaccagcaattcctggcgttccttggctcctagaagcatcactcctatcacatggtcatcttcaccctgtgtgtcttcacactaccctttctctgtgcatgtctgcccgaatccctttttataaggacaccagtcagattagattagggtctaccataatacctcattttaacttaattacctttgtaaagacctttttccaaatatagtcactctctgaggtactgatggttaggatctcaacataccttttttgggaggacacaattgaacccataatagggtgtttgcaaggaagagttaaaatttgaaagaaaggtggtatttgcttagatagatagggcacagctttctaggtgacaaaaaaaaaaaaaaaaaaacaatctgtgaagaacaaatcatcatgttggtccaggatgagaactagcatggcctggcaggagagctgcagcagtggcagtggtggcgtggtataccagttgtttagactaagttctacagagggcttctcctgggcccctcagtgtccccactgcactccacgtgttgtctttcacagcaaccctagaagtaggtaacgttattctgattgtgcagatgaagatatggtggtacaggggagttaggtgacctaccccatcatgaaactagagggtagagaattggtttcttctgatcccaaacttttgcctcttaggacgatgatctgttgccttcttcatagcacttgtgcaaaataaacttgggtgaatagatcagggctactttgtggagggctttgataataagggagtagagtttgtgtttgatgtgacagaaaaataaggagccatttctagtgtctgaagaagtggaccatgatgaaggggtatttcaggaagatgagtgtgttatttccacctgaggatgcattttctttacagaaagaaaaagcagacttataatgagaagctgttgaccgtgaagtttcttttcatagggttatatcaagtggtttgcctcttccccactgatgtctcttaaccaagaatatccttcagcactttaaagactatgcttgctttttttttttttacccaatatgctttgtaagttcctcacactagtgataaagcactgatcacttcatagccacagcacaaatgcttttaaacgaaacttttcgttgatttattaactctagaaagtcagattgcagtttagtgttttggggggcttgtttgaggcatctcctttaggaacctgattttgggtggttcaaagtttattttgttatgtgtaaactgaccaactttctctctggttttgccatatatgcctctagtagagaaaaaggtgggtgaggagaaaagtgagcataatgacaatgaaagcttaaatttattaagcatattactatgtacaagtcactttttacatgccttacccaacttaatcaaaaagtgtacatgtaataactggtgagcaatgaagtcattgtgatttctctgggattgcacatttggtccagggaacataggaaagtaggattaagcctcactgttcctgcaggatgacttgaggaaaaatctcctttctctggaattagaaatttggatcagtagagaccatacgccttccccaaaacttgagccacccaacgtcctttcctacacaagatcacctgacataaatatacaaaactacacataaattaatgtggcacccatgtccccacagaaaactgatgagttctcgattttgactgccttaatatttgtgtaactgcatttcagtccaggactgtcatgcctccaacaggcctttccatttggatgtccatgacaagttggcccctgcaaatctcgctgtggccacaaaagagcatatttgaattatggaattgaaacagatgcatgaactttagctggagagcacaagagatccagagaacctctgtctttttgtttgtttccccgctttggtgatgtaatacacagcttcacaggagacctgaggtcctatcagtccctgctccgaccctggagctcaatccagaaacagctgtccagagctaatttatttcctaatgctgcggcactgttaatttataaattacactggtaattcgagctattattaatttcagatggtgtagggcaagcctaattaaaatatgacaccaattgccacacatatgtaccaaggactaccatttaaaattaatgggaatattaagtgtgacactggtctccgagatgcttggcacagtaattatagcattctggcaggggaagatctgacaaatgtaagcccgtggttggtagcaaataaacaaggacaacacaagaggaattacagattcttcatttaaagctcttctcaattcttccacccatcctcaaatcaaggttagtacctttcccctaaagatgcttatcaaacaatattcataaaggctactgagaccattagaagtgtcttactggtaggaactatgagtctatttgggttaatgttgtttgtcctcttcacatcctggtctttttggctgtgttttctacttatgaagaggttccttctttgtcttgtgaatttagtatctctttcttgtttgttgtaatggacataggctgttcttttcctcttctgtatgtaacagaggcaagaaaccgtctgtacatacatagtgtagtttgcatatggcatgaagatgtatgagatgaggccccggttgggcctactgctgggcagtggcacagacttatcatggccaaagagtgctgatcgaatggaacaaggcagtggcccttgttcacaagaccatggtcttgttgttgttgctgttgttattgttattgtggttatcttgacaaaacagtgacttcaacactgttatggaacacatacaatcatcccttacataccgcacacatcatcccttgttgtatcggttttttacagctactgttttcgtgctctgggccagcagaaacacgtggcattatggaagggttttctcacctggagagaaatgtccctttgttccctttcttgggccactcatgttaatacagtgctgcaccccctgaagctgtgcctccaaccagattataggagtaataactaaatcaacaggtgggcagcacacgagagttttggagtgctttcgtgcatgtgtgtgtgtgagtgtgtacatatatatgtaggcatgtttgtgtgttagtctaaatagccccgtgaccctgtgaggtattaggattgtatgtatattatgtttgggaaaatgcttctcaattgctagggacagccttatgcctgttgtctgctaataatcattaattactagcacctcatttccttttaaaggtatccaggtttaggatgctgtctttctaattaccctcatttaagagagaagggaggatagcttgggatgtaagccctaacttttgtttttcattgtcttttggcaaggaagcgaaggctcaggtgcctctgggagagaactttgaaatctcctctagccttaaatatcttggtctttcaataactgagtgctcatggccagacgtcaggcacagagtctggtatgtgaagcgttgttattattactcataatttttcactgaagacaatgagtcccgcaatgattaggggactgagtggattcgcagccacgtcgcctgatgaatctctgacatgcttacaactaggcatcgagtgcggagtcccattgctggtctgtctttaggatcttgtacctaggagctctagcagatcgaagtttagcacgttgatttctgcctatccaattaattgtctgagtcaaaaaacagaaaattaaattttttatgttagtgtttctgctacctttgtgatgcacgtgtgtgtgtgtatgtgtatgtagctgctggtgtggcattttcaattaatttatgctcaagtgtgcagtcataaattttatattcaaggctcagtctaagtgataccttgagatcagaaagagttaaggtgcctgactcagatcccagagcacgacggcttggtaagatacaggcagtgtaaatgtcaaaattattaatcacttattgggaccagtaattctctaggcactgtgctttgttcagttaggaacacaaacatttcagctgttccactggggagccaaggaaaagttggtggtgcggaggtgtagaagagacggaggagggataacccacacagttcctcagaatctgaacttacaactggcaaattatctgcagacataaccattttatactttgttttctaagtgaacatgtttggtcttttttttccttgtatttcaccacacgttaccggttttcccgcagcggttggctttgtgagtgaagacgaatacttggaaattcagggcatcaccagggagcagtcaggggactacgagtgcagtgcctccaatgacgtggccgcgcccgtggtacggagagtaaaggtcaccgtgaactgtaagtgttctcaccaccacgcgccctgcacgtgcatcaggctggcctgttgtcacagccaccacccagagcccattggcacagccagctactgacttagggtgggaagaatgcagcaccactttccacactctgctttcaggagcaaacatttcaaactcgagtttttgacacttcaaggtgtcacagtgtcacgctgaaagaaaaagtagctaaagtaactgaaaataatgccaaacttgacttgcatggctggcagatcattaaatggcattcagctcataattttttaaacacgtcttcaaatccaaaattttcccataatttactcacacaatacagttgtgctggagcctctcactgtctagaccagacatctccataatgggacaagaaaccatgtgctagagtgtatgaaggaagtttcaaacttccatttatggtatgtctattatatctcattattttacaattatagatgtgcatggtatacatacaaatagttacgatatagatcttagaggatgtaacaataaatttgcttgttactaatagagatacagaatccaaaaagtttggaaggtgctgtgtggacccctcattctcctttctcagccttccagattgtctctgacatcaatcctacttgaatttgctacctcctttcactcttttccctctgggtccctcattatgtaccttgccttagctccctacaacattctggaggttttctctgctgtgcacattccaggaagacttacgaagcaatagaactcaataactaaatcggcaaacgagatgacttcccttcaaaacttgggtggcgtggagttaggagaaggatactgtatctaggagaatatccagtctttcagatttaggtttgtgttacaatgtgaacccagtcaatatgaagcggtttaagaagcaaggcaataggtataaaaatgctgtcattttaaaaatcatatcacaagtttttacaaagggacttaagaggatttacagtttataaagatgaacttaaaacataaagaaacagaagcaaagaaaaaatacgcttaggaaaatgagtgaaagctaggaaaacctcagcacatgaaatattaccacaagactgctaggtgcaggtgcagaatttggctcagccttgctaaagcaaagagggaaacatcacctgctttaagatttatgttgtccataagataaaagcaaattagttgcttgggagaaacactgcttttcgtggtactgagaccctagagaaaattctcttcagggtctccacaaatagagcactttgggagagagtcagcaacatcatgtacaatatttctgcattaaatagaatagccagtttattgtggctgtttttcataataccctttaatataaactggtagaatgtgaagagtagtttggtaaagacgtcaaatgaatgcaaaccaagtgcgtaggcctagcttggtcacttgctctggtttgattcagggatctgttttagaataccaagaatgactgatctgtatatccttcaggcaattctccttgaatattatttcttgcaactgagcttttgatgggaattgaatagttcgaggttatatacttttggcaagaacctggtgtgcagaaattctagaaggctgattaaaggtgctgactgtcaacccgtggagtgtagggttgatgggctggcatcatcctatgaaagttaaaaagtttaaacagaaaaaatgcttgagtacatggtcatttcaactctgtacagaggagaacaaaagcagtacatgaaaggaagacccagctttttcttagagcggcatcaaaaaggtttttattctctggtacaatttatgtagcagttttaccttctaagtaagcagagccagggcagagactgagaaacaaaatcaacaaatgaagcagccttcttcattttaaaatgctgtagatcaggtgcagtgccctgtaatcccagcccttttggaggctgaggcgagcagatcacctgaggtcaggagttggagaccagcctggccaacatggtgaaaccccgtcgctgctaaaaatacaaaaattaggcaggcatggtgccgtgcacctgtaatcccaattacttgggaagctgatgcaggagaattgcttgaacccgggaggcagaacgtgcagtgagccaagatcatgccactgcattccagcctgagccacaagagcaagactccatctcaaaaaaaaaaaaaaaaaaggtgggggggcggctatgagacatcttctttttgcagatccaccatacatttcagaagccaagggtacaggtgtccccgtgggacaaaaggggacactgcagtgtgaagcctcagcagtcccctcagcagaattccagtggtacaaggatgacaaaaggtaaagcttccttctttcctatcccacccctacccccatctccaggagaaacttttccagggtcctgattccacattgttgcaaacgagttctataaaatcctcttctgaacttatctctatagggggcaaatgtgcaaagaagtcttttcttaacattaatggatttcagctacgtttttaatgtcaccatgtagaattatcactggccaaccaacagatctgaaaggtaactttttttaggaaggcaaaatcacaaaggaaaggccaccaggagcattgtaaggcctgtgaattttttataggccaagaacataatgtgttctgcctgaagctatttttaccacattctcaggcttgcgtaaaggagttaggaaggctctcagggccctgggagtggctaataagttagctgcagctagtaggtctcccctcctgttccagacactatcagtagcggtgtataagagtccatgacccaatttagccctccctttgtgcccaagttgttcttttactgtaggagaaaagagaagggactattcccttccttcccattgtcacagcatcctcgggatatttgttgtgagtcactgaagatgatcatttccaggctttatcaaatgacatatcagtgcagggatcagtagctcagtacagccaggcaccatggcaattgctgttatcaaagagccatttttaagggggatgaacaacgggaaatgggcaagagctgcctgtgttcagaacattttcattgaaaaagaggtggtggtataggggatgctagagagtcctgaggtgtatgtggggtggagtaagagcaaggagtgggggaggccaggaggctgagaaggaaaaacaatgaagagggcattctgagaaggagagcagcatgagaaactgcaggccaggagcaagtgaatggccgcccacgctgtgtgcacgtcttcagccagccttggctttgtttccttatgaggtcagtcagaaacctaaagctctttctagtctctagatcgaaaattgaattttgtttagaaccacgtcaatcagttttaagattcactgggttttatcataatcctcccaaatgaaaagcagtgttttgtttttttaaaaaaaaatttttaaggacacattctggcagcttctagtgagatgtattatattcatgtagcccattttacagatgaaagaactaagacacaaaggggaaaaacaaactcatgaagaaatagagctggctttccccttcttccaagaaagaagaatcaagcagactggagcgtgtttttctgataaatatggtttccttacttagaaattctgtttcacttatgcgtttcctcttcgaccttcttattgtactaagaagtaaactgaggcataaaaattaattattgaaccaaaccaaacaaaaaacctattgagctatggggtcagttcccaaatcttcaattgtctaggtcttaatgaaaagtcatcagctgcgtcctattattccaattctttattggagaaaaatagaaaaaatacatataagggaaagcaaaatcttagaggaaaataaagcaaaagtggccaatggcgagtaaaaggatgagagagctctcctctgtgcagcatctctggtcacaatagggacagctgtccctgccaccattcacccaggaggagagagcaggctggcagggccagggacagtcttcagaggcccctggctcaggcagctttgtttctgtctttctttcagttcttctgatggcctctccttttctcccctttccatttagtggtttagtcagttttcccttccctgcacatgtatttatttatttccagtgtgctggcatgagacaggggctgtctttcctcctggcacccagctcagctgcagcatccctgcctctgaggtcctggtcacagcaagttgggtctgccaggtaggtctcccaaggcatattgtgtctgccctggggggaaggccagctctagcccatctcccattttcagtgagatgagcagactaccaaggcagattaaaggaaactgtgtggtgaggacaggcagttttctcaagagttagttaggtgagaagtcttttggccacatgccagaatgactcaactgcacgctattgtatgtgttatccaacaaaggaagaggaatggaatgctatacctacggaaggccacccatccaacaggggcattgaccaatgaaaagtccacagctttggtaagaaactgaggcctggaagcagtgcgggatggaggggatgtgtgcccgcacagagaaggggaaagcgtgtcctcccaggagctgcaaagcctgcaaagtgctgctggccccctgtgctgtttttagctaaagacatttcagagctgtcaagcaggagcctactttcagttaagtctctccccactgcagagctgaaatctcattcacagtttggttatgatgggaaagcttcctccccatggtggacgaatggtgtcaaaacggccagtgggatcaatcagcctgacttgctcgcagaatcctcccggtgagtggtatggacagcaccccctagaggatcaatgtatacatagcaagctggaaatgtaaaagtggcctgtggctgcacagccggatgcctcattccatttggacagtgctagcattttaatgaagccgtggactcaggccagttcattgcccctagcgtttggagaggaaggctcccagaggaacatctacataatgaaaagcaaggcaagtctgtccaacctatcttctgacttccctggaggcagatgttgggtgagaactccggccagaacctgcctctcttttctgatcaaggttactgtaagttgcaggagtggagaaattattctgtaatcccacagagacaggtcttcagataatgacaaagcagctgcactctatgccaaaaaacactgtgacccagggatgggcaagagtcatctatgtctaactccatagaaatacattatactgatgccattgtgcggtccgcaaagcatttcctcatcattgtcaaacagccttgagtactgtttgtttttctcaatagcatccatttgccccaaagcatgtcccctgaatctgttccagtgtgctcccgccatgttattatctgcttgctacaagctgtgctccagccaggccctaaacaggaaacttagctttgtgtccatattccctgagatccttcatcaagaaggggttttttgccccaagagtattcatctttcccatagcatagaatcagcttcagggcaaggattacagattgtttgtttcagggaaaaagtaaaaggttggcttaaagctcattctaagaaatggacatttcggaatcttgcaaaggaaagtaggtggtatccatgatcgccataggaattgctgttaacaacttcctgagaaggaggacatgtgcctactgactccaatagcagctttctccttacccttttatctgcctggtaatagaatccatggttctaataagcatacctcacttcccccaactaactaactccctgtggcatttctgtagtggcccccagaccaatgcaagtccttgtggcttactgggctgccattgtggagctcagggagactgtcctggctctaaagggacatattcttgggaacctctaatccttccagactaatcctctataacagtctgggcagatcactcctcccaagcccttcagagtcccctgatgagaaaaatgagaaaatgatgatttttctcctcttcatagccaaaaaattaagtattatctatacaatgcaatgcttctggtgcttcaggagaaattagattaccaggtgctcgaaaaacatttttctttcaaattcctcaggtggctcttctctcagaagtttgagtttttcatttgcatggttgtcatcatcaccatcaccatcatcatcatcaggcccacacatttgaaccacctactgtgtgaatcgtattgctctgaatgccacacagctggcaggggttatttgttgtggtgttgctgtcagactacaaagcaaggatgagaggctagggagatcagatgttctggtaggagtgcccctgggcacatgtgtgaaaatcaagaaacaacgtgtcactcactgtctgtgaactactactacattatggtgtggttgagtggatcaaataatggttataatgatgtcagaaaggggggcaaggagaagaccaggaatccctgggcctatcttcttcctatgaggacacataaccatcttgttttcttcttttttgtcttttgtttctctcagactgattgaaggaaagaaaggggtgaaagtggaaaacagacctttcctctcaaaactcatcttcttcaatgtctctgaacatgactatgggaactacacttgcgtggcctccaacaagctgggccacaccaatgccagcatcatgctatttggtgagactgtgctctgagctgggcaagaagaggggagagggtgcagaacgggagagctgggtgggagggcccctcaaggccagggtcagaggttagcagggtatcagtggacatggagagggaggaaaaaaaagagagagacacagaaagaaatggagagagagggacagagagacagggaggaggcagacagaaagagaaagaacaagagatacagtttacatgtatacaaagtagtatatgtatagtacatgtataaaagtagatctcagaagtgggaaaaggaaaatgaaaaagaatgttcatgtttcattctataatggaaaagatcccgagataggagaaaaatactttggaatgccaa

SEQ ID NO: 1267 - DNA, 426005 bp, Homo sapiens; identical to SEQ ID NO: 1265

SEQ ID NO: 1268 - DNA, 263829 bp, Homo sapiens
accagcaccccgcccagagcagtgccgctgcccaaatcctcgcaggcagctcatcaacgcaattgcaactccggctggagccccggacctgcaagcctgggtgtccgtgggtccgtctgcccagccatctgctggtggcacctctccctcctgccgcctccctcggtgaaccccaccttgcagaagtgcagctcgcccggagcagcccaggagctcagcatgcgtcccccaggcttcaggaacttcttgctgctggcgtcctcccttctctttgctgggttgtcagctgttcctcaaagcttctcgccatctctgaggtaagtttggtttgttattcttcagtacagacctgccctgcttatgtggcagggctcaagcttgcaggatggctgccctaagccaagagctgttattaaattggacaagggataaactgttttcaacctgttccttttcctctccttatatctacagcgtgtattgcctcatgtctgtccttttgcttttcctttggaaaaatgcaatcattgaataaaaatataattttcttttctgcaaatacatatcaggaggaattcctgctgtgagttaaaatgctatgtgtaccagtatcttctcacaacatgtaaagcagaatgatctgtttcccaagggcagcaacaggaggtctgtgttacattttgtatcatcctgaaagagactgagtgaggcacactgcaatagtgaaactaaactttttaaaagtagagttcctaaagactgcttaatgcaaattatgcccgatgctatcatagcatgtctaactctttctatagattcacgttttctcttctgtaatataagtgcccattggccatcagatagcagtgggacgttttttaaaggagaactgaaaagtcagctgagtgccgtaccttggattactttgtatttaatctaaatgtgcatataagatttagtgataaactaccaaagagcagggcagttcacctctgtccacctggaggaaggacctgtgtccgggggcaggtcacccattacacattttgggccctggtcatttctctggtgggtgatacctgtttgcttgggaaaatacagcccttccaggcagcgcttggaccccagagagatgtgggcctcaggcgtcctgttcttggggttgtacgtctgcacctggaggggacactggggaggaaacgtgggttcggagcagggggcggcgtccgcgtctgacccggcctgccggttgcttgtcgcccgcgcaggagctggccgggcgccgcctgcaggctgtcccgggccgagtcggagcgacgctgccgcgcacctgggcagcccccgggggccgcgctgtgccacggccggggccgctgcgactgcggcgtctgcatctgccacgtgactgagccgggcatgttcttcgggcccctgtgtgagtgccatgagtgggtgtgcgagacctacgacgggagcacctgtgcaggtaagagggcggcgctgtctcctccctcgggaggtcgaaactcctcttctgggatttctgccactccctagaagagtgaagggtggggacacgcctcccttcacataagcaccaattaagttactgcgattgtcacactttggctagttaattctggcatcatttatcacaacacttttatcccccaggctctgaacttgaatggaagtaaagttttaaaaattcattcacttaattatatattttattgtaattatgattttttaaagttgggatcttgctatgttgccctggctggtccccccccccccccccaactcctggaatcaagctatcctccctcctgagcttcccaaagtgttgggattacaggcgtgagccactgcacctggccgtcatttgcttaattctaaaatctcacttgcctctaaagttcctcattatagactaaattccccaatgtcctcacaaatggagttattttactgggttctcctatccctatcaagaatgttaatgataatatttgtagatcttaggcctgtattttattttacataggaaacagtgggagggggaatgtattattttcctccattctagggaggcaggttttgtctttgaagcctgatttgccctctcattattagaatatagttcacaggcaggagtgcatatcagaaaactgtaacaaggaaaaaagtaaacgggcacatatttacttagaatgactgttcttgcattgttctagctgcttgaatttttgagttgcaatgaaacttggtattttctgagggtggagtgaaaatacattcatttcccttgcacatttttaaggagtgattcaggttctgatattggaaagggtcaaaaaattccttcccagagaacacccttaacctctttacctgtgtcgttttacttaaggccaagagcctcaattagtgccttgtgagtgacacagaactccattagtgaaagcacaacacaatgcattccagccagggtttggcaaatttgtaggaaaaaccagccacttattttaccctcaatgtagctaagaataataagacagccaacactaacatagaaagatcaagaatgagtttatagcaaaatatttttttctcggaacctgggcccagtagtgtataagttacttaatatgcaggctgcttggcaatgcaaaaaatagtcatagaagaaatttggaggggcgcaggtgcatctacttgatttgttttccctgtgaaggctgtggatcaactctttaaaaatactgaatgctgggtggggtggctcacacctgtaatcccagcactttgggaggccgaggcaggtgaatcacttgaggtcaggagttcaagaccagcctcgccaacttgctgaaacccagtctctactaaaaatacaaaaattagctgggcgtcgtggcatgtgcctgtaatcccagctacttgggaggccgaggcagaattgcttgaacctgggaggcagaggttgcagagagccaagatcatgccactgcactccagcctgggcaacagagcgagacttcatctcaataaataaattaataaataaaattaaaatattggatgccacaacttgttatttaacttcgcagtcctacaaaccgcagtataattaagggtagccctttggaatgaaagctaagttaccgcctaatatttcattccaaatttgactgttacttggcttctctgacctatggcctctggcaagccctcttcaatatcatgaattttgaacaaattttccagggctttttctcttgttttattagagaagtaagaggtaagatgcagcctttaactggtgaaagttgtgagtgtcgtcagattcactttccctgttgaagaacctaggctggtgcttttctccgagaaactatgcagaaggaatgctgtggtagacagcattcctttttccctcccatagaaaatgatatgttgtttactcatagcatcttagtcactgcattccttccttcttgatacgaaatgcaggactgagtcaagcatggttttgtttggttatgcatgcatttctgtagaagatgaaatgcttctctttattttaatactgaatggaataatgaagttcattttttattctcatcttgctgactgatgcccatcaaaacttactctacagggccttgagcagaatctgtccccgcaaatgccctgaccacgtttgtggggcccatgcggagatccctacaagtagcacctagggctgccttgcgagcccgtcgatgtattccatgcttcaaatttagcttctcagttttatttttaagagatagttccagttgtatcactggaatatggaaatatagcaggtttcctatgtttatgtgcccctgtgctttcacctccatgaaagttcctgtaggtcctttccagaaatagagtaactttcggagacctctccaacttctaagaagaaaacaaaatccttctcttatagtactatatcatggagtgattaaaagtgtgggctctgggctgggtgtggtggttcatgcctataatcctagcactttggaagcctgaagcaggtggattacctgaggtcaggattcaagactagcctggagaacatggtgaaacaccatccctactaaaaaacacaaaaattagctgggcttggtggcatgtgcctgtaatcccagctacttggaaggctgaggcaggagaatcgcttgaacccggcaggcagaggttgcagtgagctgagatgatgccgttgcactctagcctaggaaacaagaatgagacgctgtctcaaaaaaaaagtgtggactctgggagacaatttccaggattcaaatcctagtcctattacttaatagctgtatgaacttgggcagttacttaaacattctgagccttgatttcttcatctgtaaaatgggaataacagtacctaacttatagagctgttgtaaggtttaacatatgtaaaatacttagactagtgtctgacatgaagtaagtgctcagtacatattaaaatgtatatatacataatattattacaatgatgcataacaagtgggctagtatggatggaaggatgggtggatggagatgacagatgggtagatagatagctggcccagtgtttgttgggcatttaatgcagtgagagcaatttacttctcttcatgtagtctgggtctgttactgattcaaggcccaaaaagtcaagtagggataactattttggcccagcctcagggcagctgtattagatacactatgcccttttaaagttaagtccattgggattattatactgtgaatcataagaaccatacttattatagtttgcgctggttgaaagtgattaggttccctccattagaagtctgtttcttccagtgtccacttgttcgtggcacatgcatcttccacagacttttatagcataaagatccagccaagtgagtgttcctatggatgtgatggtctattaaggggtaaaataattttggtagaatggtgaaaccctgtctctactaaatatacaaaaattagctgggtgtgatggtgtgcgccttgtagtcccagctactcgggaggctgaggcaggagaattgcttgaacccaggaggcagaggttgcagtgagccaagattgcgccattgcactccagcctgagtgacagaacgacactccatcacaaaaaaggaaagaaaaaaagaaagaatggcaaaatgtttgattgcatggaaagaaactttcagttgatatttctaaagcattcctggttgaccccatgaccagctacaatgacacttaaataatgtattgttttcttagaaatcttttgaaattgctgttgaaatatgtcacttaaagagtttcagttttagtaatttaggaagagctaattgaattcaatttagcaacacttatgaagcactgcatattttctaggctctgtcctgttgaagggagtgtaaagatgagggatagaaggcagcttaccattgagtagggagacacagagaaataccagatatctataatgtaatgcaaaatatcatctgtacaaatttttatgagggctccattgagccaggggttatatattatggctaaaagttcttgagaaagaggtagcatttgacataagcacttgagtactgggagattttttaatccaaaaagtggactgttggaattctgagtaaggaaaatcttaagcaaaagtgtagaagcagaaaaacatgtggatgtttgggaaatagggctacaagggttggcttggctggatcttagagctgtaaggaaagtaataaaagatatgttgagaattacagttgatcatattgtagagagtttgttcttgattaaacagcatataagagctattaagagtccaaatataggagtgatcattagtgctctgatttatggaaagaaatacagtcattccttgatatctgctgggaattagttctagggagcctcccccaccagtggataccaaggatgttccagtctctcatataaaatggtgtagtatttgcatgtaacctatacacatcctctagtaaactttaaatcatctcttgattacatataatacctcatgcaatgtaaatgctatgtaaatagttgttatactgtatgttagttgtattattttgtactacacttttttattttctgaatagttttaatctgccaatgaggagcccacagatatggaggcccgaccgtatggtgcccaaaagcatggcaagttaaagtagagaaccaatggggaggaactccacgggagaggcaataagaacagaattattatttttttaaaggccatttaaaagtaaaatcaatatgaattagtgtccaaggatgagtaagatgaattaaaactcatgctgggtttttaagtctgcgagatcagaagtgtgatggaactgatggagtcaagaaatcacaggaaagaaccagataaccaaatccatgacttaaagttcttttaaaagaactctcatttttaagtggaattgatataaaatgaaaaattaatgctagcagaaagagattctgatttcattggccaccacgtttggggcaggatgggaatcttgtctgaattgttaacgtgggttaacttgtttatgttgttaaccttgagccaggtttttaatttacctgatatttagtgcctttttctgtaacagtatccttatggatatgaagaaccttctattctgtgtgacattgagcatgattttatgtatgtatgtataaatttatttaatattcatatcctttatatacttctacatttattcagactatacgccatccttagctgggtgtggtggctcacacctgtaatcccagcactttgggaggctgaggtagctgggatggcttgatctcaggagtctgagaccagcctggggaacatggtgaaactctgtctctacaaaagatacaaaaattagctgggcatggtgcacacctgtagtcccagctactagggaggctgagaggggaggatggcttgagcccaggaggcataggttgcagtgagccatgatcatgccaccgcactgcagcctgagcaacagagggaggccctgtttcaaataaataagaaataaatataaaaaataaatataagccattcttataaacattgatttatgtgttcaaatattaacaatataacaattaaaataattagaatacattgaaacatttttaatatgtaaaaattagtaattttttttcttgaagatatttgacttttatactacgaagtaagtagtatgggaattatatgtggttattcatgagaactggacttcctggctcttgaggctgcctgaggactgttcgacttgcctttcccttccaattgcatttttcttagattgttgaacgatctccctccaagcctacttgtggatttactcaggctttttctttactagtctttttctatttttcatcttctctcccttccttcaatcctcatcctgtcttccttgcccactccttcacctccgtctagcccatcttggatttaccgccccctctctttcgcaaaatagcccttccatgtctctgagtcggaggcaccaagcacgtaagaatattatctgccttgaatccccttcaccagtaaataaatgtctgtaacagacagactggctttcacattgcctctttcctgtattttcttcatagtcttcacatcgcttgtagtttttggaaacacattcaggagttccccactagctcacccactgcatgtaagccatttttcgggagctctactttcttacattcatctgtgttcgataaatgcatattgtcttagcccaagtgacgtataaaagttaaatgttttctttctgaaagcaagtgccaaacatgcacagcaattttcctcaattgtactgctttatttggacagggctctgcagctctaccatggtttcttagtctgttttgtgttgctgtaaaagaatacctgagactgggtaggttgtaaaggaaagaggtttatttggcttacagttttgcaggctgtacaagcaaggcaccagcatgtgctaggcttctggtgaggcctcaggaagcctttacttatggaaagtgaggagggactggcatgtcacatggcaagagatagagggaggggtaccacattcttttaagcaaccagctgtcctgtgaacaaatagagaactcactcatgaccttggggagggcaccaagccattcatgagggatccacccccataacccaaacacttcccacttgattccacctacaagattggggatcacatttcaacatgagatttggaggggacacacatccaaactatatcacacagagacagacataccttgccctggactaggtcatccctgcaccttgatgatctagaggaacatatttatagcattgtggtatttagataaaatagtataaatgtgagaaattcaggagttattttctatgtaaagtttccccagaatgagaaaggaaaggaacatatggaaacaaatttatttgtattacaaattttaaatttgcaaaacataaacctccctcataaggttctcagagtcttcaatatattttgaaacacaatgctaaaactgacatcgcatgttcttgatatcataaacccccacaaaagctgctcagctctctgagcctcatatacatattgttacatctgaccttgtgactcaccatgttcatgttcttgaggtaggtgatcaatgccctaggagggactgggtgtagtggctcacatcgcctgtaatcctagcactttgggaagttgaggtgggaggatccttgaagcccagtggtttgagaccggcctgggcagcatagcgagacctgctccctactaaaaattttttaaaaattgccagacccagtggtgggtgactgtagtgccagctatcaggaggctaatacaggaggctcatttgagcatgggagattgaggctgcagtgagctatgatcaggccactgcactccagcctaggtgagagaattagaccctgtctcaaaaaaataaaataaaaaattccctgggagcagagagccccgttatcattctttgggggaattccctgtctgcaaaattatgaagtaagacgagacattttgccaagcttcatatcctgcccttgtattatttttctattgctgctacaacaaattaccacaaaccttgaggcttaaacagctcagatgtcttttctagagttctgtaggtctcaaggtcccctgacatgggacttccagggccaaggtgttgatagcctctgttcttttctgaagactctaggagagaatccgtttcctggttattggtgttgagataatttagttctgtgtggttgtaagactgtggtccccagttccttgctggctgtcagttggggtccctcttgtcttctagaagctactttcgggtccttacaagtaccccactcccaaatctcaaaactggaaacaggttgtgagacctttctcacaccgctgtctcccagagcctcttccatcatcacatcccttcttaccaccgtcggaaaacatactccacttttaaggtgtattttaactagactgaacccagataatccaggataagcttcccatccaagactcataaacttcatcacatcagcaaagtcacttttgccacgtaaggtgacatatttacaggtttcaggagcaagggtatggctatctttgaaggcccatagtcttctcagcatagtcaccctcctataaagtgcagggcactctgtatgtgtgaatggcaagggagaggttccaactccattcatatctggctgttggtatgctccatcgaggatgcaagggctgagtcttttccttcttttccgaggttatctatatgatctaattgctctggcccatcttttccatatcattattttttttgagttggattctcgctgtgttgccgaggctggagtgcagtggagcaatctcagctcgctgcaacctccacctcccggggtcaagtgatactcctgcctcagcctcctgagtagctgggactgtaggcatgcgcccccacacctggctaatttttgtatgtttagtagagacagggcttcaccatgttggccaggctggtctctaacttctgacctcaggtgatccacctgccttggcctcccaaagtgctgcgattacaagcgtgagccatggcacctggccttttccatatcatttctgataaagaacactaagtgtctttctaaagcatgaagagagggacttaagcccaacagttgcctgcattcagttcctgacattgtcacttgcccactgtggagctacagggaggttacccaagaggttacaacctctgtttccttatggttgaaaagagggcaataataagaccaaatagggataatgacagtgccaaacacatatgagtgattaataaatcactggagttattatgcttaaatatgctagacacccctctcctaccctagcgtaattcctggtcctaagatatttattttcaaataagcaattttctttccatgttatatcttcctccattactaaattcatgtcttggaattactctgatagtctttgaactattatatcccaacaagcttgcctactctatagtgccagggctgggtgtgccctcagccctggccagcatgaggaatctgagagcttactgtatcatgccccaactcactgcactgccagccgtctgagtcttgtatatgtctttgtctcagaacctgccttttgtgttcctgtccctgaaatctgtaccctgatttatatgatcataattgatctaatggaatgctccagaaccctaccctcagaactgtataattagtccttgaatttggaattttcatgctttttctctgctggaaacctttagacgtctgcagactcccagggcttactctataagtgcaattctgcttctgactcttccctccactgagatgcctgtacttctagggtgttccttgatctcctctaaattgttgatcccaaataggttgatcccagaaactgcttcttcagttgcaaaactgcagaaagcaacacaataaaaaaacaaaatcaaaataactcacatatttttaaaaatatgtaataaacattactgaatgttgtggagacattgggttgtgtgttatttaatcataagaatgcaaactactgaagattgaataggagtcattctagttctttttttttttttttttttccgagacagattctcgctgtgtcacccagactggagtgcagtggtgtgatctcagctcactgcaacctccaccccccggattcaaacgaatctcctgcctcagcctcctgagtagcagggactacaggcgcccatcatcacacctggctaatttttgtatttttagtagagactgggttggccaggctggtctgaaactcctgacctcaggcgatccacccgcctcagcctcccaaagtgctgggattacaggcatgagccaccacgcctgacccattcttaaaactcccaatgctttgttatgtacttcagcctctcttctttatcctgtttgatcccctccttctcatcacatttctgtttttttatttcactttcaaataatgttcatttttcacaaggagtttagttattatttctgtcatctcattttttgcccatccatggcctctaaaatcttggcttgtaccccaagtgttgatgtactcagatattaaggacacagacatatatgcatgtgtctgtatgtatatatgtagttttttacattctggtttattatgtatatgtatacatagaagacccagagagggtctctctctctctctatatatatatatatgcatatgtttatatatcctcctatatattatttatgcttgtatagccaatcaaaatacatatattttacccatttatatttggtatatgtatatattttgattgcctgtacaaacataatatatatacacatatttatatatgtatacatacatatttgataccctaattttatacacatacgccatacatatgtgaatatgtaagtatgtgcacaaacatacatatatatgtgtgtttgtatatatgtgtgagtctaaatgttatacacagggacatacatgcgtaagcccttttctggtagaccactacctgcagatcgaagtcaagtccactttcaaatttctgtaatgctgacactcttgatataaaggttgcttgggattgatgccacatgtgtaaacctgctagaaatcaatatctcattggggaatacttttgtgtctttatctgtttaatgaatgccatgaaaacaatgacgtatcatttgggtgattcataattggattcttttttcactatggagttaactaaatgcttttaggctattcaagtcacattcgaattacagttaatagttggtaaatggtcctcatattgttatactaaaactgtgcaaagatagaaaagagaaaacagcttcttttcttttttcaaaataaataatagtgacattcttatgactaatatattttaatgctatatacatttttgtggagtatttggaaatgtcaccaaaattaggtttcattggaaatccttgagtctagggttggagacaaaaatcactcaggattctcttatagctgtcctctgaaagacatagtcttaaaaatataaaactatgataaattttctctatctttgaggcaataatagctgcttgtattattttgcttctaataataaattctgatatctattaacagatatgctattctttgctaaattactgtgaattttgtagtcacatctcagaaggaagaaaaaaggaaataaaataatgtgataaatcagctttagatttgtccggttttaagaccctctgccttaagaagcagcttgcatcagtggaaagataactggattaggagacaggagaaacaggccctattatctacttttccacttatctactatgtgatcttggcaaataacagtcacccatttatatttggtatggtacttctgacttttttgaagagaaggtatgaggttgaggatccctgcaatgagtaattggcagtttgtaggggctcagtaaatatatgttcagtgaataaatgagattcagcttatttaaattaccattatggctatggaataaatatttaggtaaaggcatctgaaaagattaataattgaggatagcggtaactgtagagcgtagaggataaagacactcataactttaagagcagaggtagtgatgttactgataaacagttgacaagccaaccaaaatgaagacgtggagtcagaaaggccaagaaaacttggaggggaggggatcctcttagtcatccaactaaactatggccaactttgactcatccttttcatttgctctcatatcctgccaatattgctaatgtttttacttaattttctgctgaatttagttctattgctagtgacttagcttagccttcatttcccttgacaaggaatattagtaatagtaaagttcttatcacacctcatgcttcattcaggctgtcttcccttctgtctatcctgtataccaccacttggtgaatcaccgtaagtgacattttgtcaagtatctgtgcttttcaaattcacttcaaagatcattctaaccatttatactggccacttattctgtacccctgctttgattcacttcatgaacacacattgagggtatatactataggtatcaaatctaaattttggcttctaatctacttggccattaagacattctagaatctgattcctctttaatggcatgctgacccgcttcctctttctcaccttgtatgctcccatctctctagttagatcttaacatcactgtcacttaatacagtctacaccaaacacatttttcatgatttcacgtgttttcttatgtttacaaatatgctgaatattctgaatactagcaccatctcacatatttttctggaaactaaaaacaaaaatatttagcacaaaaaataggtatttagcacagttctgagtaaacagtacagatcgatctttcctggagctctgctttgtatggttttgaattactgtctagtgtccttttatgtcaacccgaaggaaggactcctttagaatttgttgcagggtagatggtttagtccattcaggctgctgtaacaagataccctagactgagtaatttagaaacaggacaaatttaatgctcacagttctggaggctgggaagtctagaatcaaggtgccaacagattcagtgtatggtgagggctcattttcagcttcctggatggcaactgtatcctcacatgttggaaggggtaaacaggctcccccaagcctcttttataagggcactaatcccactaatgagcctggagtgctcatgacctaatcacctcctgcaggcccacccaccttcttaatactgtcacgttggggattaggttccaaaatatgggtcaatatttatatcatagcagccggtctactagctgaccttggcaaagggaaacctcacatcagtgggacggggatattgaagcctttgtcctttgggaaatttagcttccaaacctggtctgagatttaaaggcaagagtcacatctaagaaggtggaaaagtctggtacagctagactgagagtatcaggggaatttaccagggcgtttttgggactctacgtgggtaaattctcaagctattttctaataacttctaaattgataaagatagagagctgcatgggggttgcaaatctcattttctttggaaaaggagtgctttgtctttccaagaatcacatttcctggcaaataagaaactatattttgtaatagaagtcattctcctgtctactctaaatcatcttacttaaggctgggtagaagaatgagggctttataaagagaaaagaaaaataagacttttataagggtgcttactgatttgactttgtacaaccccactcttaggttatacgataaaatcagtccctgtaccaagagccctatcgttgtaattgtttgtacatagtcactagttcaaacaccgaattatttaaagtgaatacctacccactctagtttcctgttctgttattttatctggaaacttcctagggaaaggtaggctaaatttttttttttaaaagaggtcaatgagtttgggcattgcttaaaaacttctcttacggcaaggtattaactgtaaattcatgacttagtcaatggggtagagtaaggagccaaaatcagaaaatgaaaacgtggtaaatgcatttcctaattgttcattactgctttttcaaagctatcattttctgctgagcaaaatagttagacaaaactagttatttttataaacaaagtgacttggccatttaagcagtttcctctccaaaatacaaaagacaagttatagactattttcttttctttcctgggcaacaccattagttatatgagctctaagagctgtcttgacatggaaataattcacttgcttcaagaaagaaagtatttgatttgttaactatgtgctcgagagacttctctcagttgcctgtttggataattttaagccttgaaattaatgctacattagaaatacaaatgagtaagagtagtatctacctatatttgagtatagtatgctggaaaatattttcatacatatgaattcattcactttttataataacttttaagagatagtcaaaacaattatcctccaactattgtgctaagtaagcctgaggagaaattcctcccaccccaaatcaatagaagggttttcttcagcattatagtaaaattatcctaaaagcacatatgtagggataatttcttcatgaattttggagtactgaaagaaaaacataattttcagaaactttatttacatttaaaaatataacttctttttggaaaagtagattttgattcttatttttgtcttagagagtgcatgtaaaagctcaaatggtaagaaagtactgggcaaaagaacccgttatgcatctcatgttaaagaaagtgagatagccgaaatcactgggacaaaattacttgtcgtactgataatgagcattttctcagctgtagttgaagtttttagagagattgcatttaacatcaaccatatccaaataagaaggatcctcctgagtcagcctttgaaggaactcctccataacctaatttttcttgtctataaaagtgaaagaaaaggtaggtaggagagttgaatctacatatttgttatttccttgggcattaccttacattattttgtgtattacatattttggctattacgaataagtcacatcagagattctcttttgttcttataacattacatttcataaagtgagctccaaaaatttaaacacatgcaggttttaatatacgtatagcctttttgagatcaaagctatgcgagccaacaatactgcaaagagagagaagaaaggcatttacagaaagctgaacagttttgaatggatcatcatgtaggttcactttgcatcttggaaatgaatgggtggaccgtgggtcataatatgaaggcttatggggacatcctgcctacctgggattctggatattgtggtctttcaatatttcaaatatccctgttaatacaccagttgttgccaggcgctgtggctcatgcctgtagtcccagcacttagggaggccgaggcaggtggatcacctgaggtcacgagttcgagaccagcctggccaacatgggtgaaaccctgtctctactaaaaatacaaaaattagctgggcatggtggtgggtgcctgtaatcccagctacttgggaggctgagacaggataattgcttgaaaccgggaggtggaggttgcagtgagctgagatcacaccattgtactccagcctgggtgacaagagtgaaactccatctttccatctataaaaaaacaaaaacaaaaaacaccacaaaaacagatgttgtattttaagacctatgagtggcaatgcgctgatcttttattaaaagatagtacagtctttactgaatttaacaatcttttccttgggaaaactaagcaggcaggtttgggtaggatgaaaatgcagaggcagaatgctctggaaaatgcttgggaattggaattaaaaaacaaagctgtttgatctttctccgctattgttgctgcctgtgtgatcttgcacaaatcacgtaacttctctgagcctcagttcagttaaattcaaaaggcacttattaaacatctccagaaggatgtctagagaagaacagggaaatcttatgatcagacctagcctcattagctgtgagatttcagccatcagatggcaacaggagctggatctccagttactgtagatttgataagagggtggaaagaatttgttttcttacagttgactgcaaaacgaaatattctgttaccttagctaaccttggaagctctgctttccttgaggatttaagaactttcatatccataaataattatttaatgcatgtccagtgcttgaaagatagtataatataggcattactattttattccttttttaattaatttattttttttttttgagatggagtctcgctctgtcacccaggctggagtgcagtggcgcgatctcggctcactgcaaactccacctcctgggttccagtgattctcctgcctatgcattactattttataaagtagacgtggtgtttgtctttaattccccaactatatgcacacagtctgttaaagcacaatgaaataatgatatttgtgtgcatctcaacatttaccctctgggtgtatagttatcaaaaaccataatagtctctgctgccctttatatgaaagtcaactaggcaacctagcaagagagccatgactttgaagaacaactaatgaatgaggtgtgtgtgggaggggtggaggggtggtgtttagaagagaatagcaatagtctggaaaaaaattccttttctagtaggacaacattctatggggtgcccttaaaaatctatttaattataatcatcctatatgcttattcttaatttgaaataaggtaatgataatacagctaacatttatttagaattgctacatccttcttgtgtggtgttaaattctcccaataaacaaatatcatcttaccattctaaagataaaagcatgagcctcaaaaagattaaataaaatgtttaagatcacatgttgtctgaaataaaaactgtgcaatcagtcactttgttattaagttacaccatttagtacagtgacactggctaacaaatgccccaagaagtattaaatctcttttctgaattttgaattatcacatgcattattaatctaccataattaaatgtcattttcatatgtgaaagtgtgagagggagaatgctgaggagattgaaggagaaagactatatgggttccaaaactggctcgattttgggaagttagttgatttgcttgtgcctctgtttcctcttatcatagtgttattattgagaaaactcccttgcaggtaataaatcctcaacagcaacttctttttgttatcagtattatcaggccattcccatgtcactatgattaaattatatactcctcaagggcaggaatagtatctgattttctgtaagattttctcttaggtctttgttgttattgcttcaagaatgcttcattacagaccaccacaacatttagtggcttacagaaaggcaacacaaatatatatgtgtgtgtgtgtgtgtatgtatgtgtgtgtgtgtgtgtgtgtgtgtgtgtgtgtgtgtatatatatttctcactcttgggtgtgcaaatgagctacaactcagctaggcaagcctggacttcaggctgaaggctggctgcattctgctgcacgttatttttatgctacccaagctacgttttcggtattgtggatcacaggagcactagaaagtgagacgaaatacttgagatctcttaaatctttgactctgaaccaataacatgcactttatatccaaacatcactgggcaaaaggagccacaggcccaagccagatatctctgctctgcatggtgggagtgagtgaggagctcacagcagtaataccatcagtaggatttagaagggatattcaaatattcagtgaaattaatttattgacatgatcataaacatctgacatttaaatttaatttggaaataaatacattttatttttattttaagtataaccatattaatcaattacatagtaaattatattgacatcataagacattaggtctatgtttagggaattcatttttatgagattgatatgaactctcttatgtattaacttctggatgtatttttacttgtttaaaaattttcatgtcccttcacaaaaatccttaatttcctaaatatagacttaatgtcttatgagttaaagaacactgcactgaaatatatccaatatgccactttatggcaccttccaaatgctcttagtgtaaatgtatgttacaaatcccataaagcacagcaaagataacaaccaaactgttggtacaaatcatgagacagattcagtagttgtctgtttttatatgcacattcagtaagctgcttacctatgttttgttacattactttaattttcgtgcgttttctaccttaaaataatattttatgtaggataatatgcttagatctttgaataagctacttttagaatttcttgagaacttcaagagtattggaagcagtcaacatattattattcagatttctgttttgggggtttttaaaccatataactcaacttacttgagaagaaaggaaaacgtaaatggttttaaatggtgttagctctcacacaggcattgggtggccagtcaactgttttaaattaactgacaatgctattgtgaagtccattaacttaatgcagagggttgtttcattttttttaatgaggaactttaattcctttaggaactaatatttccataaagtttcatcaattttgaaatttaatatacattttgatttgatgtccatatttgtataaatatatttgacaaacatatttatccatatcaaatgaacacaatctttaagaattaaaactctaaaaatggactgctttctcatatatagagtcaaggatttatatattgatatataaattaagagttgtatatatttatgttgtgtgtataattatgttgttcaatcaacagttatttattaaggaactactatttataagatgctatatttgtagctgcagaggttataaagattaaaatgtgattcttgagagggaagtggaacaagatagccaactagaaccctccaatgatcatccaccccacagaaacaccaaactgaacaattatccatgcaggaaagcacctttatgagaaccaaaaaccagatgagtgatcacagtacccggtttcaataccatatcaaagaaagaggcaatgaagaggtaggaaagacagtcttgaatcaccacaccatgcctaccccatccgccggcagcagccatgtagtgtggagagatcatctctgtgctgttgagggagagggaacagtgattgtggaactttggattggaactcagttttgccctgtacagtggaagacaacaaggggcaggattcagctgatgcctacagacagatcattttgatcagccctagccagagcggaatcatccattctagcagttggagcctgagttctggctagcaccaccactgtggactaaagtagtctggtgttttaaataaacttgaaagacaatctagaccataagaactaagatttctgggcaagtcctgctctgtgctgggcttggagccagtggatgtgggatgcatgtgacctggtgagacaccagccagggcagccaagggagtgtgtgcatcacccctcctttgaccctaggcagtgcagctcatagctccaggaggagagggtaaagaggaatttgtcttacaacttgcataccagctcagccacaataaaatagtgtaccagagcccccattcgaggcactagctccttgtgccagaaggaaacccactaccttgaagagaaggacccagtgctggcagaattcatcacctggctaaagagcacctgggttttgaataaatatcagtggtacccaggcagtacttgctgtgggccatgggtgagacccagggccatgctagattcaggtgtgatccaacatatttcaagctgtgttggccatggagagagatttcttttgcttgaagaaaggagaaagaaaagtaaaggggactttgtcttacagcttgggcaacagcttggcccagtgggttagaggatcaagtgaatccctggggtccccagttctacagttctaggccttgactcctggatggcatttctggacccacactgggccagagggaagcccactgccctgaagggagagaccaaggcctggtagcattcaccacaagctgagccttgagtgaacattggtaccaagcctggggtggtaatggccatggatagacactctttctgactgaggaaaggagagggaagggtgggaagaactttgttttgcagcttgggtgccaactcaagtcacagcagaacagtgcactaagtagattattaagtttcctgactccacgcactggctcatggacagcatttctgggccagccttgagccagggagtagcttgctgccctgaagggaggaacacaatcctggctcagtttgcaacctgctgactgaagagcccctgggccttgaacaaaattggcagtagccaggcagtgtggttgctatgagccttgggtgagacctagtaccatgctggctttgggactgacccagagtagtcccagtagtagttgcaacaggggtgcttgtgttacccctcccccagttccaggcagatcagtgtgaaaagagagactacatttgtttggaggaaagtaagggaagagaacatgagtctgcctggtaattcaaggaattctcctggatcttatccaggaccaccaaggagatacctttacaagtctgtaagaatcacggcattactgggcttggggtgccccctaatgcagacacagctgcaatgaccaaagatttagataacaacactcaattccctttgaatgcttggaaatcccttctaagaaggacagatacaaataagcctggacagtgaagacaacaataaatacctaactctttaatgcttagacatcagtgaatatccacaagcatcaaggccatccaggaaaacatgacctcaccaaacaaactgaataaggcaccagggaccaatcctggagtgacagagttatgtgacctgtcaaagataatttaaaatacctgttttggggaagatcagtgaaattcaggataacacagagaaggaattcagaattctatcagataaatttagcaaagagattgaaataattaaaaaaagcagaaattctggagctgaaaaattcagttgacatactgaagaatgcatcagtatctatcaaccacagaattgatcaaacagaagaaagaattagtgagtttgaagacaggctatttgaatagttagaagagacaaaagacaaaaagaatgaagtttgcttacaagacccagaaaatagcctcaaaagggtaaatctaagagctatttgtcttaaggagaagggggagagagagatcagcatagaaaatttattcaaagggatagccgagaaatttccaaacctagagaaatatgtcaatactcaggtacaagaaggttatagaacatcaaatagatttaacccaaataagactacctcaaggaattcaatagtcaaattcccaaaggtccaggataaagaaaagattcttaaattagcaagagaaaagaaacaagtaacattcaaaggaactccaatacattggagcagacttctcagtggaaaccctacaggccaaaagggactggtgcaacatatttaaaatgctgatggggggcaggtggtgggggctggggaggtggggaacaacttttatcctacagtaacatattcagtgaaaatatccttcaaacataaagaagcaacaaaactttcccagataaacaaaagcttaggatttcatcaatatcagatgtgtcctatgggaaatgctagtttttcaatctaaaagaaaaggatgttaacaagcaataagaaattatctgaaggtacaaaactctctggtaatagtaagtaaacagacaaatacagaatattatagcactgtaattgtgtgtaaaatatttatattttgagtagaaagactaaaagatgaacctatcaaaaataataactccaataacttcttaagacataataacataaatagaaacaataaaaagttaaaaagtgggtggatgaagttagtgtagagttttcattagttttctctttgcttgttagttcatttttgcaatcagtgttgtcatcagtttaaaataatgaattataagatattatttgcaagcttcatagtaacctcaattccaaaaactgacagataaaaagtttaaaaatgaaattaaaacataccatcagaaaaaataatcttcacaaaaaggaagacaagaaggaaggcaagaaagaaggaaagatgacaaaacaaccagaaaacaagtaacaaaatggcaagattaagtctttacttattaataataatattgaatataaatggactaaactctctaatcaaaagacatggagtgacttactggattcaaaaactaaacaaaacaaatgagacccaatgaacatttgcccacaactaacacacttcatctgtaagacacaaatagactgaaaataaagggatgaaaaaacatattccatacaaacagaaaccaaagaagagcaggaatagctatacttatgtcagacaatatagatttcaagacaaaaactatataagaggcaagtttattatgtaatgataaaggagtcaactcagcaagaagttatagcaagtgtaaatatatatacacccaaaactggagcacctagacatgtaaagcaaatattattagagctaaagtgagagatagaccccaatacaataagagctaaagactttaacaccccactttcagcattggacagatcatctagacagaaaatcaacaaagaaacatcagacataatctgcactacagaccaattgaacctgataggtatttccaagaacatcgatggctgcaaagtgcacatgcttctcctctgcacatggatcattctcaagggtagactatatgttaggccacaaaacaagtattaaagaattcaaaaatattgaaattatatcacatatcttctcagaccacaatggaataaaactagaaatcaataacaagaggaactttggaaactatgcagacacacagaaattaaacaatatgctcctgaatgaccaatgggtcaatgaagtaattaagaaataaatttaaaaatttcttaaaacaaatggaaagactacatacccaaacctatggaatacaatgaaaacaatactaagaggaaagtttatagtaataaggacctacatcaaaaaagtacaaaaacttcaaataaacaacctagtggtgcatgttaaagaattagaaaagcaagaacaaaccaaaccccaaattactggaagaaaatagtgaagatcatagccgaaataaatgagatcaaattaaaaaaataacaaaagatcaaccaaagggaaagttggtgttttgaaaagataaacaaaattgccaaacctttagccagactaaaaaagaagagccaaataaataaaatcagagatgaaaaaggagacattacagctgatactacagaaattcaaaggatcatttgtgactactatgaacaactatatatatgccaataaattagaaaacctggaagaaatggataaattcctagacacatacaacctatcaagattgaaccaagaagaaattcaaaacctaaatagtccaataacagtaataaaattgaaaccatagtttattgtacattgatgaaaagtttcctggcctagtaaagcccaggactcaatggtttcactgctcaattttacaaaacatttaaagaaataataccgatcctactttaactatttcaaaaaatggaggaggagggaatacttccaaactaattctgtgaggctaatattaccctgataccaaaaccagacaaaaacacatcaaagtaagaaaactataggccaatatccctgataagcattggtgcaaaaatcctcaacaaaatactagcaaaccagatttaacaacacattaaaaagatcattcatcatgactaagtgggatttatccctgggatgcaaggatggttcaacatatgcaaatcaatcaacgtgatacaacatatcagcagaatgaaggacaaagccatatgatcatttcagttgatactgaaaaagcattggataagtcactattacttcatgataaaaaccctcaaaaaactgggtatagaaggaacaaacttcaacacaataaaagccacatatgacagacctatggctagtatcatactgattggggaaaaactgaaaggctttccttgaagatcaagaacacgatacggatgcccacttttaccagtgttattcaacacagtactggaagtcctagtcagacaatcagataagaaaaagaaataatgttcatccacatgggaaaggaagaagtcaaattatccttgtttgcagatgatatgatcttatgcttagaaaaacccacagactccaccaaaaaactattagaactgataaattcagtaaagtttcaggatataaaatcaaaatataaaaatcaatagcacttctaaatgccaacagcaaacaatttgaaaaagaaatcaagaaagtaacctcatttacaacagctacaaataaaatgagttaaccaaagaagagaaagatctctacaatgaaaactataaacattgatgcaaaaaattgaagaggactcaaaaaatggaaagagatttcatgttcatggattagaagactcaatattgttaaagcatccatactacccaaagcaatctacagataaaatgtaatctctatcaaaataccaatgacattcttcacaagaatagaaaaagtaatcttaaaatttattgaactacaaaatacccagaataaccaaagccatcttgagcaaaaagaacaaaactggaggcatcatattacctgacttcaaattataacacagagctatagtaacccaaatagtatagtactagcataaaaacagacatatagactgaaggaatagaatagagaacacataaataaatccatacatctacagtgacctcattttttataaaggtgccaagaacatacattgaggaaaacacaatctcttcaataaatggctctgggaaaactgatatccatatgcagaagaataaaactagacccttatctctcaccacatacaaaaatcaaatcaaaatgtattaaagacttaaatctaagacctcaaactaggaaactactaaaagaaacagttgaggaaactctctaggacatcggtctgggcaaagatttcttgagtaataccccacaagcacaggcaaccaaagcaaaaatggacaaatgggatcacatcaagtgaaaaagcttctgcacagcaaaggcaacaatcaacaaagtgaagagacaacccacagaataggataaaatatttgcaaactattcatttgacaagagattaatatcaagaatatataagaagcccacacaactcaacaggaaaaaaaaaatctaaaaatccaatcaaaatgggccaaagatctgaatggatattttttgaagacatacaaatagcaaacaggcatatgaaaaggtgctcaacatgacagatcatcagagaaatgcaaatcaaagctacaatgagatatcgtttcaccccagttaaagtggctttaatccaaaaggcaggcagtaacattcccaccaacagtgtatgagagttggagaaaaaggaaccctcttacagtgttggtgggaatgaaaattagcatagccactgtgaagaacaatttggaagttcctcaaaaaactaaaaatagagctatcatatgatcaagcaatcccactgctggatacataccgaaaagaaaagaaatcagggtatggaagagatatctgccctgttatgtttattgcagcactattcactatcacaaaagacttggaagcaacctaagtggccataaacagatgaacagttaaagaaaatgtggtatctatacacagtggagtactattcagccataaaaaatgaatgagatcttgtcatttgaaacaacatggatggaactggaggacgttattttaagtgaataagccaggaacaaaaagacagactctgcatgtcctcactaagttgtgggagctaaaaatcaatgcaattgaattcatggatacagagagtagaatgatggttactagaggctgggaagggcagtgagtggcagaggggtggaagtgggaatgagtaaagtgtacaaaaatatagttagatacagtgtataagatctagtatttgatagctcaatgatgctattttttccatttgataacacaaatactagatgaatgtagggtgactacagtcaaaaataatttattgtacatttaaaaataactaaaagaatacaattggaatgtttgtaacacaaataaatgataagtgcttgaggagataaataccccatttaccctgatgtgattattacacattctatgcctgtatccaagtatctcacaccctgtaaatatatacatctaccatgtacccataaaaagtaagaataaaaaaataaattcagagtaaaaaatcatatgattttgtccttgagaaacttagtagtaggtttatagtatagcataatgcagtattagagaagtacaaagtgctttatatgtgaggagttggggttgttttgaaaatgagcatgatgttgactggtgggtatgaaaagaattgcattgtagtcaaacaagcaaaattttaaggtaggatatcatggacattttgcttgcctaggccagcaggttcttttaaagatgctgttggagagaaaccttcagagatcaataggagcagctcatagggagccttttaatgccaaaagatatgtgtgtgtgtgtgtgtgtgtgtgtgtgtgtgtgtactcatatatgtgtaactatatacacacacatacatatatatacacacatatatatacacacacgtgcatgtatatacacatatatatacacatgtgcatatatatatgtatatatatatatatgagagagagcatatatatacatatgagagagagagagagagactgtgaacgcccttggcaggcaatgtgagcagagaattggcttttccagaaaggagtttctgggacatcactcttgggataaataggaaaaagataaaagccttcaaatggaggtaccaaggagaaagctatttagctattttaatagctaatagtgaaattaataatattctaaaattttgtgggtggctataggaagaaaagggaaagaatgatgctaggcacattgtgatattatagaactgacaggaattggagactgggttaagaggtggagatggggctgcaatttggtaaatgtaactagttatggacttctggctctcaaatattgcaagttctacaacccttcctccaccttatcccagagatatctgagtgtctttttggtttgaatttcaagttaaaaccctgaatatctggaggaacacccacgcccatcatgctctgatgttaagtactaataccttttgctcatccttggttaaatctttttaaattcattcattgttctctctatatatactcctcactaacatgcaagattttctttttattttgagttgtatatatttttatttttccccatttaatttttagttgagattaatgttgcacatattcacggtaggcaaagtgatatttcaatatatgtatacaatgtataatgatcaaatcaaggtgattagcgtatccatcaccgcaaatatttatcgtacctgggagagtcaaggggaatgtggtggggccagaaaggggaaatttagaaggcaatatttgggaggcaaaggaatgaggggcagttgttcatgaaatgacagtctgaaggtagaaagtgggggccaaagaagacatcaactcccaaagattaccagtttattacgtaatgagcatgtattagccgagaaggcttgaaaaagttgacttttgaatgcgacacattttctttaaaatattgaatctggatgtttttctagttatttaaatttttatttgtaggtatctgtctagggcactttgaccctttaggtgtgggttagccatttctcattaggactgggaaagatgagtgagaaataaaattatagattgcatgttaaaaagaaaaacactggttgtgacactgagtataggttttttttttttactatatctgaagtaaaatgatacttatctgccttgttaattatatttatttgtaaaaatagtttccatttaaatttgtcaataataaaattcctcatgaaaaatatcagaaacctactctcttttataatgaaaagaaacctaagtattagttttttatgtacctatgacatttgattacaatatggaatgaaatttaattgtagcatagtatgaaatggaaaacaccctaaatataccatgaaatttatgttatgctgtgtaataatttcctcatatactttccatatataggcactaaataaagtgaagtaatttaggttaatttaggaggcagatgtttttcaaatactcataggtgtatcaggtaggatacacctgattgtgacattatttggggtccgtataatagaaaacccaagccaagggtgtgtaaggaaaaaaattgcaatttactggaccacttaactgaagtagttaggactgtgatttccaaagtgtgattcttgaatcagcagcacacgcatcaacgggggacttgttaaaactgtgaattctcagtttcatactcacggcatcagagactctggctgtggagctcaacagcctgtgtattaccaagtcctccagcttccgatgcttccatagtcaagtttaagaaacactggtatagagctggatctatccctgggtgcaaatcaacttacggttcaaaggataccaccaggatctaaaggtggactctgctaggcactgggatagccccacacccaggcttcacatggtggctaatgacaacagtagatacatatcatcacagcaccctgtccagtggacagagaaattatctcacctggaatcctcttgatgttcctgggtagcctgactcagggagtatctctgtccttcagccaatcacaatgctgagtgaatgggatgttccagttgtcttattctagtcatattgtccactgtcaaggttgcaattaatttagtatgggggcattgccacaagaaggacaagaagatgtagaatatcattgacaatgtgtcacaaacagcaaagattcagttgtttcagaagacaacctcaggccaaaatttatttaactgaagttattgatgaaagaaaaattcagagatgctctagaagtcaatcacttgactggagaaggagaaaaatgttcacttgcacagaaaatgcacagtcccattttccaatgtcctattacctagagggcaattttagtttcataaccttgattacactattaatactgggctatttgggctagtgtggaggataggcttgatgtttgtaaaataacatttatttgaatatgtttttctaaaattcaatttttttccttcttaatataaaaattgtccttattttactatcttaccacatatttttgaaatctaatctgattgttatcacatatttctttaagtggaatggcttaaataactcagataattaaaggctaattaaaggctttgtcatcattaagataattaaagtatcaattagctttttaaaaggaagcttagccttaatcagaaatcctctattcacacagcagggcctcagatatggcagatattcctgaaatggaaaaacagtacttcaaagttgaggctctgtggaacttcgtcatgatttttcttcatcaatctctattcttttttgtagacggcatatttggtttttttttcccctgctttttgtctaactagttatatattgcttattgtagatacttttgcaaataccaaaaaaaatgaaactcccagaagcaacattttagctaatttttcccagcatttttctaagttttatttttatttttgtggttaaaagggataggtaaaaacccatcagcataaaaaatttacttctctaataccctaggaaaacaagagaattacaaaatacctagaactgaatgataatgatttctggtttcaaatatttcctgccatgaatttagttttatttatcctatcagtgattatgtatagcttttctacatggtttatttaattcttaaaaattctcagtgatttttctattccaacattgtgaattgacccaagttgagtttctggatatgaaaaccacaatatttgatatgaaaaatactatatgggattaacagcagattcacatcacagaagaaaaaacggtgaatttgaagatggagcattcgaagctatccaaattaaaacagaaaaatatttttatttgtataaattttaggattacaagtgcagttttgctacatgaatatgttgtatagcgggggaagtctgggtttttagtgtaatcatctcctaggactattcagaaaataggttttaaaaatgaatggaacatcagttagctgtgaaacaattttaaatgatctaatagaggtataatttaatttgtgaaggacaggaactggcaaaatatttgaagaaataataatgaaaatatttcaaatttgatgaacattgtatatccacaagcacaagacgctcaataaacttgaactataaacaaagaaatctgaagacactacactgaggcatgtcaaaattaaattgctcaaaaccgttaatagggagacaatcttaaaaagcatctagagaaaaaaccgtatactgtatacagaggaacgaaaataaggatgatagcagatttctcttatttcaaagacagtagaacaacatctttaaaggattgaagaaaaaatgtaaacctagaagtctaaactcagcaaaatacttttcaaaaacaaatgtgaaattaagacttttttcaggcttacaaaagagaatcatcactggtcgatgtcagctagaagaaatgctagaggaagttctgcaggcacaaggaaaatcatgccaagtggaaagatgaatctacactaagtcatgaaaagaactagaaatggtaattacatgggtaaatatatgtggtgcatttttcttttattcacatgtcttttaaagagaagtttgcatcaaaaagtgggtaaaggatatgaatagacagttctcaaaaaaagatatacaaacagctaacaaacatatgaaaaaatgctcaaaatcacgaatcatcagggaaatgcaaactaaaacctcagtgagatactaccttactcctataagaatggccgtaattaggccaggtgcggtggttcacgtcggtaatctcagcactttgggagaccgaggtgggctgatcacgaggtcaggagatcgagaccacagtgaaaccccgtctctactaaaaatacaaaaaattacctgggcgtggtggcaggcgcccgtagtcccagctgcttgggaggctgaggcaggagaatggcgtgaacccgggaggcagagcttgcagtgagccaagatcacgccactgtactccagcctggtcaacagcgcgagactctgtctcagaacaaaacaaaacaaaagaatggccataattaaaacatcaaaaaaacaatagatgttggtagggatgtggtgaaaagggcacacttttacactgctggtgagaatataaattagtgtaatacaaccagtatggaaaacagtgtggagatttcttaaaaaactaaaagtagaactaccatcaatccagcaatcccactcctgggtatctacccaatggaaaagaaatcattagacgaaaaagataaacgcacacatgtgtttacagcagcaccattgcaaagatgtggaaccaacctaagtgtccatcaaccaacgagtggataaaaaaaaaatgtggtatatatacaccagggaatactactcagccttgaaaaggagtgaaataatgtcttctgaagcaacttggatggagctgggggccattattctaagtgaagtaactgaggaatcaaaaaccaaatatatgttctcacttataagtaggagctaagctatgagaatgcaaaggcataagaatgatataatggactttggggacttgggagagggaagggtgtgagatgggtgagggataaaagactacccattgggtacagtgtacactgctcaggtgatgagtgcaccaaaatctcagaaatcaccactaaagaacttcacctgtttcccaaaactattgaaataaaaataaaaattagaaaagatcagagggaaagaatatgggggaaataagacccccatcaaaaaataagtgatgaaagatactggggaaaaacacaggagagcaggttactggggaaataaagactatttgagaaatgggcaaaaatgataaataatgcaaatccacaatgtaagtttcatattttaaaagtctagacctcttgcagctttgaaacttcatgatgctatttaaatgtcatgtttagtattgtaaataatggtaattttaatcattaatgctaattgctattctctgtggctatattactattcatttattcagtcaatgcatgtttgtttagcactagaaggaacataagcacacatccagtagtctgtattttatttggtttaatttcacacacccaaaaatgcctacgtaggtattaaatgtcagctcttatttttaatgctttctagattgcatcagccaaatgggaagaattataaaaaaaatgtaaataactacttaaatacattcataaggtcaataataacaaaattttataatacttcttcataaaccttggatttgttttattgcttctaggttctcatagtgattttgatagcctatcttatcatttgttactatatctttgttaggtataaatgttcaggcttcacctattaccaggcatattaaatttcacaagagaaatgtgtagttacagctccaaggcaggtgttatgatcctgtcaaattgctcaggctaattttaaatcatatcaggtctgttgctgggagatgtttgaggaacacaggaaattatatggagcctgttgataacagcctgtccttatcctgtgacctaaaataataccaaacttgccacattaccaaccctcttgtttaaatgtaaaacccatattggaggtttacaccaatgtcattaaaaaaagaaagttaggattcaaaaatatgattgtaatttttgaaatcctggtagcgaaaatttagctgaaattggcaattatatttgacaaaatatttaatataaatcaatgtgatgtttagttcaattacctcaggaatatatagagttatcactgatggcctaaggccatgcattccaagcttgggtgatcataagcattacctgtggtgtgtttctgcaatacagtttcctaagccccttttccgaagtgcattccgtagatgtgcaggttaaccagtgtcctcggtgaatctcctgctcagatatactggcagcacactggcctaaagtaaggaattcttatgctttttaagaaactggatgcagagagctcttctgcatcaactgaagtatgttcagtcttagcttgtaggttttatttccttacagttcattaaggtcagaaagaagggttaatcttcctaactcaaatgatgctccgaagacaggaattgttaactaggtttgtgttcagtgtgaaactggcacagggggcctgactgcaaacagccatgcagggaggttgaggctgaggaggtggtgatggtaagaatgctgggcttcggaggaggagatcaaatgggcctccctcatgatgagaagggagagaagggatggaggatggcagggattgggacttacagtaaacagatactggtttttcttgaaggatgtttggatttcacagcccatgcttttctaaccaaggagccagccttagcattgacatttgagggagtatacaattccaaatgaggttgaagataaaggagcaattgctttttacattaaaggcacagccttttcagagcaatctgttcatcctctgttatcactttaaagggagtctagtttttagcttgatgtatacatttaactgactctctataatggcagagaagactgcatggcacttccaagttcatttctttacctttaagtggattaaggcatatgcctgcttagctttcccacgttcactgctttgaggggagtaaaactggagtgatttcaggaattgacactggaagagtttcctggtcacaggctttgaacccggaaagacctaagctgactgtcaactttaacttgagagagctgttaaccacctcagtttccttgtctaagcggaagaacagaacatgttaatagaaagtgcagtttactgagcatgtactgtgtgctcaggcattgtactaagtaccctatgtcttattcgtgaaccccccactacaacctttggagatatgtgttatgttctgacaacagcaataattttgcgtcttcctcatggaattttttgtttatgtgtgagtgataatgagattagactcattaaagattaaagaagattaaagccatgccaatattaggttcccagttctcaaaaaaaagggagttatattccttttctttcatttgtgactgttccttttcatcttttggtgttttcaggaagccattttgcctgcagccgctgaagtggcccagctgcagatgttaatggctgtttaccagtaggagccaaaacaccacactaaagaagctaggaggtgtggttattttgccttttctgtaagataaatttcttaatgctaatgcctccaaatgaagacatttgatttatctctaaagtatatttttaagtatagaaactgtaatgagtggctagattactactctgttttaaaatgtgttacaagacagctttcatcatgtcaatctacggatccaacaattaaaagaaaggttaccgaaattgtacacagatagaagtttacttcatatagccctggcattccagtctcttctaagaatgtgaaataaaggattgatagatggataaacacatggtagatggaggtctgattcaggtggtgttaaaaatcaaacaaaaatctttccaaagtagggatcaaattctacttcttttgagatataaactgtttatagctttgaaatgacagttttcacctcagcacacccattaaatttttatggaacccttcctcgtctattaatacatggcatataggaggggctcaatataatttagttccccttaaatgctttggtatgtgatttggagagagcagctgacatagttgaatatatatcagatatatggttagaaaaatatcgcatagcatctgtagcagaaaaattagttttctgaaaagagtgaatgtaaataatgccagggaagtatgcttttgaataacatttggtaagatccattctgaaagaagagagttagggaacttttattttattttatttttcacagtacaggaaaaaagcaaaacaaagcaaccaaatgtcctgcttgggatgaggtcattgatatcagaggatgctgcgatactgatcaaactgataaaatagcattcagtttgtctgactcattggtgaaaaatagaaaccagtgagaggtggactaaaggttagtgtgacggttgctagcttttagaacaagcagaaaacaaaatatttttactttaaactttgtctcatgaacttagttgcagtgatgggagcatttaataaaggtaagtagtatttttcattaaattttattagcattttgttatggactgaatatttgtttacccccaaaattctgtgttgaaattctaacccccagtgtgatggtatttggaggtggggccttttggagataattaggtttagttgagtacatgagggtggggccccataatgggatcagtacctttataagagaaggaaggaacaccaagagctttctttctccaccatgtgagggtacagcaagaaggctgccatctgcaagccaggaagagagccctcaccaagaactgaatcttcccgcactttgttcttgggcttcccagtttccagatctgtgagaaataaatgtcaattgtttaagccacctttttatggtatttttgttgtagtagtgctagctgactaagacacacttgataagtagctactatgcacagagtcctcttaaggaataaagaacagtctaaccctgaagccagtgaagacaagactaattaaaataatactactaacagggctgtgagtaatgtgttgttcacacacagtaagtagccattaattctgcctgggattatcttgtgggtggtgctgtttgagctgagtcttgaagagtaagagggatttgtagccttgagatggtacagcttctgaagacaggaaattggaaatgggcacagagaagaggctaaactacaaataagtgttttgacaaaatatgccaaacctaacacatgtaggcaaagccacatgcagtagttctggctctgtttatcttcctgctcagattttagtctgacagatttatagagagaaggggcagagtttctggttcatttgagaaatcatggctgaataacaggtttttcccttgattagctgggaatccctagggttgcccaagggccacagatacttactgacatttagtaaagaacctctaaaacatcttcagactggtctcattgttaataagtggtgtgacacacattgtgtgtgtaatgtctgtcttggtttttggtggaccacttaaaagtttataaaaatagttttttaaggttctgatgacttttctgcaatataatttgtaagtgcttatatatctccaacctgtaactatgtaaattactgtgaataattttgtccttaatgaaactctgtctgcttctctgtctgtgattaaagattatgaataaaatgcatcggtcttttttgtcctacattctcctctgcaaggtcaggagatagggtttgtcagggcccagttctagcactgtcttaagactccatcctcagaccctccttctccccgttaccatcactgcaaaacttaccctataaagcagatagcttccaaattaacctactttgaacattttttatcattatgagcaacttcatctagcagatataagtagtgaagttttattcagattgttacatttgaagggattttataatttgtcacattacggtagagagccctgtggcctcccaaattgtaacaacttttcctccatcacacattgtcattttcttatgccacacattcttctgatgatttttaagtggatttgtaagatgaaaaattctgaatcacctggatgagcattgctttctttttctttatttttttttaaattatactttaagtgctgggatacatgagcagaatgtgcaggtttgttacataggtatacacatgccatggtggtttgctgcacccattaactcgtcatctgcgttaggtatttctcctaatgctatcctccccttagccctccaccccctgacagggccccggtgtgtgatgttcccctccctgggttcatatgttctcattgttcaactcccacttatgagtgagaacatgcagtgttggtgtttggatttctgttcctgggttagtttgctgagaatggtggtttccaccttcatccatgtccctgcaaaggacatgaactcatccttttttatggctgcatagtattccatagtgtatatgtgccatattttctatatccagtctatcattgatgggcatttgggttcgttccaagtctttgctattgtgaatagtgctgcaataaacatatgtgtgcatgtgtctttaaagtagaatgatttataatcctttgggtatattcccagtaatgagattgctgggtcaaatggtatttctggttcttagttcaaccattgtggaagacagcgtggtgattcctcaaggatatagtgcatcgctttcttacagaggtgtctgaaataaatgcagttccttcttttgaaagttcaaaggcgttaagtcaatatatgactgtatttgtggtcctgctcagcagttattcatttaggaggtgatttgctattttctgagaacagggatatgaaatgaatgtggttgcttttagagtccagaaatccatttggctcaatggagctgacacagtttattgcagtttttaggacctttttgtaatttacagtggatactaatttcctgctcaagttttctttggcagcttctgtacagctggaacagaagctggagctatgccctaagagggtggtctggattcacttctgtgggtctactcctctgcctcttcttctctgttccctctttcctttgcctttcttttcccaaattcctcaaagcttgaaagggtgagattttccttttctttcccttgctgccctccttggaattccattatgcaattcaccagcctcagctgttggtggaataaatggtagctaccagaggaatttagacaatcctttctcttggctctcaagtatattgtctcactgtacaatcctcttttgaattcccaaagccgaatattaactctttctttcttcgcattgcttctgtaataatcctaaacttcctcactccctttccttttccaagttcaaatgcagaagcttcaggctgcctaaggataaaatgcgtttatgaagaattcctttacacagaacttttctgggagtaaatctctgttaagcatgtagtagatgttgtacaaagtttattgtgtagataaatccatgggttaatgggtggaaggggaggtagaaattacagactttgtggaatgagtagatttcaaatcatccttggaattttcaagattttactcaaggagctgatatttagagcttagatacacctctactattttataaataaagggccagctgaaccgtatgagtttcttacttagcagaattggagctcttgcttttttgtctttcatcctctatcccaaagatttgttgaaggatgatgaactgaatgaaggctgggtatctttaagaagataccaacaatgtcacttattgaaaaaaaaaaagctatttcgattacatagttttaataatcctcatgtcatgtactcttattacgattctcaatattgcagtaaattgtgttttgtggggctttgattaaaattacattttgcactcacttttatggtctggagtgattctgatctatggggggagtgataacatcagcatcaagattttctttgtccgggacgtgcttcagctgcatgacaactctcctcctgagtgatatgtgacttgtgccttcatcacctgttcatcctgccaatatattttccacatctgtcctcccattcacctaaagatttattccacatgcctgatgacaaaatgtccttgcacctgggggacctaagcctgtagaacatctatctcattttctttcttttgacacaagtccattagcttcatctgtcttgaggacaatcccggctaagagcctatctgatgtttcttctttggggacctttcagaatttcaaggttataggaaacttggctttgtgcaaagtatgttgccatctgttgctagtttctaatttcagatccatttaagagatttgccaggttagatttatatagacattttaactaattctatttctttgtacttaacccaagatcacatacttaggtttgtcctttcaatatcatttatcagaatactccactattcagccactttgaggagacacattgtttacctgccacttgctgtgataagacattacatgcagcatgtgtttatttggtagttatcaaataataatgcctggtaacagacagccaaaaagcaaacaggggatttagaggttcctgtttatttttgtttgtttgttttgttttaaataagtaaattgaaactcagagcaattatgcggcttacttaaagtctcaaaattagctcatatttcagatgaaatttgccttcaagttctagatcacctgcagcactgaagttttggtgaccatttattcttcagattgtatttatgattccttgattaacaaatctttaaaaagttgtgaaaattattttctggcaaacattggaaaagggctaaaatatgataatactgtagtcagaaaaaaactattcaaagacacacttgtatacaaataaatatatttttattacatatgcttcatacgcactttctcacatacagagctctaacttcagtgacaataagctctttccagagatttatcttaagacaataatccagaagaaggaaaatgctatacatatgatggctataatagccaagtgttataggcaaattgtgtatccaataatataaaataaatgatagcatattaactaatgtggtaatttacagtcattaaaatgatgagtatgaagacaatatatggaaatatgatgaacaatcgagtttaaaaagccagaaccactgtattcgctttcctttcaactatatgaaaagtatacatgcataagacaaaaatgtaaaagtctatgaaatacttagtgttaggttgatgatattataagcgcttttctacttttatatttttctgtaagttaatgttggttctacaacacaccatgattacagtggtatgatatccactgccaaagaataggaatgcgttagaccaagagtgatggggattatttcacacaagtgctatatttctctacttcccatgattgacattcttaattgatgttggaagggttttgaatccttctaagttagttcttcaggttcatgaactgatcagcaagagcatggaagttgccaaccctttttaacttttatgtagtttactctatattccaaattaattgtccagaaagagtattgactttaaatgggctccaaaatatataagtagcaggaatggtggctgagacaaaactcctggtgttcattgcttagaaatgtctgatgtggaagtgatggaaatggtgggatctgagctggccgttgtcgtagctgtgaacgaattcacatttgtttcccaggccccacacaggtaatgctctgtctgtattccacagacagacacacggtcaaccccacaagggtgcttttctgttcccttcctagagtcctctcatgaaaatgtgcttgttctcatctcatcccctcaaggtttggctttctacttcactgactccccggatttaatccatgtatgggtgcagctcctcaacagtgggattgctatttgtgtaggaatcttctgggtccccacactttttttttttgtacaaagaggtaactagcaaaagggattttttttaagtaaatgatttttggtacacttccaatcagtctatatgaagggcctacctcctataaggatgggcatgagtaggggaattagaagaagattaagggggggtctttagttggagctaccagggaggtgtatgagatttcatggtgtctgtctgggacctggtaaggagtaacctttcccatttgtgtaggtgtatttacagttgacataactggtatagctttcctttatctcaagacaggacaaataatactgtaattctaggtaaaagcaattcattgagagagaaactgatatatcttacattgtatatttcataatatagtgaaacattttgaaagcttacttgtcttatattggttttcttaatattctttaattttcccaccagcttcaaattccacaatttatctacatgcagatacccaccatttctcacagatacatatattccagcctatatttctccagagttgctatttcttacagaatatttctacttgaatgatttactaatatgtaacctatttttgttgcaaaacaacagatagtgctcagtgtagaatttcacactccaatccaatgtaatctagaggtagacgctcccgggcaggctagtgttcagcagggacacagccctgggcatatagttgggagacttgggctggggttttctctgccagagcacagatctctgatcctgtaagtcatttaaattcttgtgtttcaaattccctcactgtaaaaggagtggcttgacctagatgatctcaaaagtctctccaagcttgaaaattctggttctatgattttaatatttaacaatacacataattgtgcttgtgcttgcatgataattaggcatgcatgataatggggcacagtgaatgactgtaattagctttactcctacagagaaaaaatctatttttaagtctttccacttctcatcttattggttttttaaaatattgataatcagtatcaatggcctttgactttcccttggaaccttttacccttaccatcctcaacttccttcttgccactgctctctgtcattatagcggtaatcacaaatccacacatatattagagaccattatgttgaatattaattcctgcagagctgaattcttcctgttctgactttcaggtaggacaatcctctcccatgtccttaattttcatccaataaaggtacttttgtggaagcttcctgccatatcctgaataaaggtgtccttaaaaatccagagatgaacatggaggaattaggtaaacaggatctgtttcacaggggcctgtggaaagcctgggatgttgtagtatcaggcatgtagatcatagtaaaggggatgtcaaggagccaggggagcctgggacaagcatggcagagggcaaagcccacagtgtgagaggcctgggggcctgctgacccacctgggagttctgaggccagagggaaaagagagggagagttgtccttacaggatgagagaagctagaattgtggccctttactttagaagtagccttctggctctgtaagtaaatttacctgacaatcatattaattattataactaacattaattctacaaatgtgcaaggaactgtgataagtactgtaaaagaatgatttaactcctcacattattccttttaagtaaatccttttgaatccctcaattgtaggttgatgatctaagtactagagagttctgaaaacttgatcccagtgatatgagtagcaggcgatggagccagctttagacacaaggcgatgacattttcttttcccttctactcaccccacagtccgtatgccatcctcaaaatatgtaattgcaatgtcaatttttcctgtttcgttggaccaggacatgtaaaccatggaggcagagtctgaaaagttctacgtaattgagcaaagtagtgaaaaagtgaagctggaaacgaaagacaagttttgattccacttggtgtgttttaatttaagttggccaccaggagttcctgagcaaaggtgctcactgtctctagtggtacttgtcttcctgagatggaagctctcggtccttactccccaagtgaccatgtcacgctccttaagggcagtctctccagatgatgaccaaatggtttgtagggaagattttaactctgatgtggaggggctcttcaagcaaatattttgtctcttctcagtacagtaattaagctgataattttttttttttttaccttttcgggccactacaacattctctgctcttggattcaaagatgaatgttccttccacacagtttaatacgtctacagttccagccgaggttgggggagattttgtctgatcaggatgtttttccaatagtagtgtctggttctgtgttgggatttcactcagtaaggttttccattcagttttatgatttggtactcctggtatgcacatcttaatatatctgacccttcactttaaatttttgttgcactttttcttttttttaaattttgtaccaaaaaaaaatgttctgtatccgagacctcatatagcttctattgggagttgtctccacttcaaacttacatttcctttgaaatcccagtgagtagccttactttccatatggcctgatgagaatgtatttcccttgcagatgtgaacaagctttttatttttaacttctcaaataagatgtacatccaagactgttaaaataatcttccataatgatttgtcttagagtagaaatatgtggcatatttttaatcataaatacatatacacattataattgttcttctgtatttaagttagtacctgtgatttgtttatccaagacagatggtaaggggtgatacttttgtcagcttacatctagagatctatagtagggttaatttagaattcaagtaatttttgttcaaggctttatgattttatgaagaaaaaataggaagaggttaaatgtcatcaagcattcagtttaaaaaatatacagatgacctaaataatttgttcagttgtatacttatatataggtgtatgatgtattactcagcttaaacctccagtcctttctcctagagcctaatagcatgaacggccgcagatggggattttacctaggtttctgtgttagcctgtttttaggctgctgataaagacgtacctgagtctgggtaatttatacagagaaacagatttcatggactcacagttccatgtggctggggaggcctcgcagtcatggtggaagagaaaaggcacgtcttacatggcagtgggcaaggaaagaaatgagaaccaagccccttataaaaccatcagatctcatgagacttattcactaccactagaacagtatgggggaacctgcccccatgattcaattatctccctctcacaactcatgggaattaggggagctacaactgaatgtgacatttgggtggggacacagccaaaccatatcagtttctgaatgtcctcttcaggcacaattttgccttgtgttatctgtgctctaagttcatgctgcttgtttcctggctatctgcaaaaataataaaataaaatgcagcttcagactcctgcatttgccacatatacttttcttatgctttacaaactttatcctagttatcaaagaccaggtgttgctggatatttctgctttggcttctacttttctttaattctgtcaacccctccctcatgtctttacactgcaattacatagaggtactcagtacaaaatatattgtatcagcagcatagatggctgcagagattgccttacagtagaaggcagtagaagtttttatggttttatatggagaaagaaaattgtttgctagcactcagatattcttctccttaagttcgtttctcccgactttgactttcactataaaatgccctgactcacttttggaactggagcaaagagaacaagagaagtgatctagagttgctacttcttgcttgggcaaataaatgcctcatgcttcccctgtccctttagtgtgagtcacatagaagactttggcaattgatttttctatttataatcagatatccccataggaatctttactggattactctgactttaaaaaaggagagagatttctgtatttaaaatgtttcataaaaataattggggaaaagagaaacaagaaataagagatggctcagggcttagatgcctgtgtcccctaatttgcccctgagatggaggacattcctgccttctgctgcgtcagcctccttccactggctcttcaacctcctggacctcagtgtggctttccaggtgtggccactggctggccttgggcctgtcaccactcctttcatctgatgccttcccccactgaaggccataggtttatcttccaccatcagtttgtcttattaaaactggccactcgacccttgcattttctgtggtctcacaaaataacacctaaggataaagacagtaaatccagaatacactttgtttaattcctcatgttgaggatcatttttgatcattgcctgctccaacaagccagaaaaaaaaagtccaataaaatatattatgcagtatctctttataaattgttttcttgaatagttatgagtggagtccattggattcccatttataacagagtttaatgtagtgaaattcctgctgactgatattggaaatgaaagtttcatttataaggatgcaattaaagcattgccaagttaaaaatgtcatgttgctctttgtcaatgaggttcattatgctatattattatatctgtgtgaatcctttcttctcaggagcgaaatgttctttctgaatattaaccaactgctacaaaattcttcagagattattattctttcaaattacatgaatttaaaaatcatttactaatgaatcctcctgaatttctcagaaaaagaaagaactcgagcagatttacccattggtaaaggaaactgccccttctctgatattgggttggttagtaaccattcagttgcatttttcctgcactttcatgtaagtcagtcatagatgcagaagggcatcctggtgggaagtagcattttacagcctttaagcagactgtttttctaaatataataacaatgaaaactatttggatacacatgtaagtcctttgtgaggcttgagtctagatgaaatatcagagtctactgcaacatccagtctgagggtgcctttgaaccatttcaggacaaaagcaaattaaacttggaatcctatcccaacttcattacctagctgaatgtactcacagttcatctaacctaattgctcttcctgcttcctcctgacagtaaatgaaataataatgacaattattttaaaacagtaaagggatatataacttagtggttgttattctgattactactgtgtgtctcctctgcttcacaatgggtagagtttagtttgatgggtggttcaccttttggctcctgctatttggcttaattgatgattggcaggcaatctggcttaaatctgatgacctttcttcaggaaaggaagggtgaaatgaagagatggtaagaattcctcccatatttcctgatctatctttggtggcccaggcttccagaattccctgaatcacactcctctgcagaatccttgcagtaatggttgaccatagtatggagagtgactgtcctgttatctactgttggtgtggctagacttattctgccagcttatctgctggctcccaggaacccagtggaatgggagtcctggcatgcagtgccctgtgaattcaatttccaggcaaaaccaaggaagagctttcctttcgagaatgcagctgacactgacatcctcaacaacactttaaatacaatgattacagtaaacaaaaatacaatgtcgtaaaaaagaaaaatgactcttagatattacccagcaaggaaaccacagtgttccagagaattgtaatgccccatgatagcccttaaactccctcaccactcctactttttgatagaaagatctgtaagggctacatgaccttaggctctactccccagcaaggtcagttttgttctatggaatatactataatgttgattgttgtgttcccataaggtcagcacatctccaaggtctgtcctaacagataaacttttggatcagtggtgagcagactaggacaggtataacatgtgctccctaaccagcttcctgaagtggctcatggttgaatttttgggaatcctttatcacaaagatggagaaattggggaccagaaggttgaatgtaagccagttccttttccccagaggcttccctctcacctgaaagggcatttttgggtgagcctcatcgttgaaagaaagtgggatacaaacaaaacaaaaaataagaatgtgtattggcccccaagcagacaccctaatttagggattaatggatatcatagatataagtacacacttaaaaaaaacaactaatgctctttgatagcttaaaccttaagtctttaattttatgcacattattattttttattttccaatttaaaacatttgcttcgttaaataaaacacacattaaggaaaccacataggaccatgtgtgatataataagttatcagaaggttgaattcttacatttactactcaggctaagaaattagtctgtggccatgctggagccctgtgtcccatcctaagtttgttctcactctctttcttcaaaagagatcattatcttggtgcctagtccttcatttatttattcacttattcaacaagcattatggtgtgcctggcatatgtcaaatcttttccatctgaaagattcagaatggtctcttaggtatatgagataacattctaaattaattttattctcctggcctgcaaatttattctcaaaaactgctagttatatggttgctctgtttacttggggacaggtaggctggttcatacatttactaattaaattacttttattgctaactctgaatatttaatgccttgtttggcaattatgagagatatgagtaaaccacagtctttgcttctacaatgattatacattatccaaacataatgcaaaggaaatgttaccagtaagaatgccagaggcccttttcccctaaattctcatgtgcctcgttccaggaagaaaaaaagaaagatttaggatgtttctttctacatcagtcattcccttggagacaagagagaatgaggcaagatgtattggattgttccttagtgtttttccattatgcctctccatctacagattgtgccctccaacaatttcctccctctaattcaaacgcagtgctcttgggaacttattttatgtgtacccaataaaatggcattaatctgatagtggtttgttcaaactcacacaaaatttgaagcaagtgctgtgttccaccagccagatgtcatatttggtaaaagaaatatggggtaatcaattttaaagtcctccaagttttcctatactgtgaaatttagggaggtaaaattaagattgaggcaaaaggatctggatctcctgaaaaaatatggttgtgcacttagtgttgtacacatctttcctaaccctctattccttggactgtttgtactcagggtcagggagtggtgaggctctcattggcatgaccatttaaggggttcaggaggtgtgtactccacagaaggcattgctgaacctgtggaagaaatgctaacaagaatttgaagaatcagactccaggaatgggaaacactattctgaaataatggaggaaaagagaccacattcctttcttgggggctgggatcaagaaagggcccccaggtgggccaggaactcacctgggctggatccatgcagagtttgttcatggttattagagattatgcctttagaagtgacactagtgggcacccctgaaatgacctccaacacaccccctaggggagtacaccctgagtttcccgaaaaatgaggaaccactgacaacagaaagaactggttttctttgtgtggaggggttagtccctgggagggaataatcttccttcagtctcaatagctaaaactgtggggaagtgatgaatggtagacttgagactttcctttgctgttaaggatgatggactagatgatggatgctgttaaagatgatgatgttttgggacatcagagcaaccaataactaaacagcagcctgtgataggctggagcaggttgtcactaggaagacagggagtattcaagtctggctttctctaaatcgtgaaatcattattctcactttgatggttttaggctaatttgacttggtaaagcaaagattacataaaaagttcagattgtggctgaaacacaggcatgtccttcaatctgtaaaagataaaggcaattaaaaaatgaactgtaaatgaagacatatttttgctaaatgttggaataattgttaaaaataattattttgctttataaacatatatttccaggagggctgtcaaaggcactgtggttaggatacatacacttattttttaaaaagttaaagatctgtttttcttataaaactgttcatcccttttgtgcttgacacatgctaccagagatacaaagtagatggaaaggaatcatgccctctcagagtcacgatccagcaaagaacctgaaaatgacaatctgacacccaagtccaagctcttaactactattttacactgattctcagaattgcttggaagattaaataagatgataataagagtgcatcataaccttatggccaaatagaataccattcactaataaagcaaatgttctgtacatttccttccatatctatatcaaattattcatcaagaacatcaaaatgctattatccatccacaactaatatttacaaccaacattttagtaagttaattttaggtaaattaattgaaacacggcctgtatatatattttatgtgaaagtattaatagtgaagtcagaaacgttgcatgagtgtctctccttagctttttatacctattctgtggaaagataatttaaagaaggtgaaatagcccttgcaaatgatagctggctggctgactcactgctatgacttgctttggtagctgctgcttctgtcttgcctgtgttttagggggaaaatatacctggcaaattcctctaatgtgcattgcaccatacttggagaaaatgaaatcttcacataatgtcaaagaaaaaaccagcatcacacagcctttttgtacaattagggataattctacctaagtggaagaagggaagggcaaaatagaacattcagcaggtcatctctccaggaagtgtttaatactgaggcgttttgggtgttcgtgttgtgctttaagctgttaccatctctcaagcctccctacttatttattataaacatttaaagctgagacctttacaaaaggccaacattaacagtgagtgcattcacacaatgaaaatgtatttgaatgagatttctctgctgttagatggatcgtcagtggcattgtctcaaaggatatttgtgcttctctccttgtcatttggctttgacaatcagaatgatgaagattcctgtagtagaagtgtgcatgtaaatggaatttttttaacctattttatgaacacttcctgagtccctactgtggactggatgtgcatgttcttgaagaactcataatctagcagaagatgtaaataaatcaatctatagagtagaatgtgatgaaatgttggagagaagggtgtttatttgccctggggaccctaaacaggttgtggctaactccgcctggaggatttaggggagtaataatgaataaaacattcattatcttattcaatctgtattgaaatggataaaacatttattgtcttattcaatctttattgattgcttcagtgtatgccatgcactgtatttggtgctaggaacacatgggtgacaagacagcattgtgaagaactgcaaaagatctgaggtttctaccctccttgccagccaatgagcttaaggctttctctccgtctgagaaaccatcaatagtcgatgttcccttcctcttcctgcttgctaatactccccagagcaattctaccactgtttgaactagccactgaataggaggacactgacaactttgggtggcagctttccagttcttcagaaactattaaactggcaacagagaagaagcggagcttgctgggactaggcctgcaggtttgaaagttgcttcagcagcagagcaccagcatctgagctcccttttttggctgcatgtcggccctgggatgacagtacagtagtgacatgagaaagagatctattagcaagagactcagctgcttctgaagaggtgggctttcctaccaagtgaatattcttttgatggcaagcctactacaatgcgctcactgtggaactaacctaaggacattcaagaatacttcagatgtcctaaaatgtgagaatgtactgctgagccaaataagacattcctgatgtgttggattttggaacttagtttgatttaggacaaaagaccaggaggcatatctctctacatttttctagcatctgtgacattgaagacagaagaaatgttaaatttgtttgattgttaaagacaaaactaacatgtgtcaaagacaatgtcataatttattttgtttattctgggataactttctagagtaatgtgtatcagattagtaatggggtcttgatgggaggcattgttgttcatagcgactctgaaagaccacatgcagcaaggtattgggatgcttagaagatttgccaagtattcagggtgaagtagcaggtgcacaaatgggcaatcagggcacagccaggtcggcagagccagaattgtccctgccctgcttccatacctctaccaaccgtcacctgcaggctgcacacatttccatatgaagagtgattcctgactcttgaggaaacataaaaggtgttgtaactgagataaaatttgcttcagcttaaagaattccttctattatttcctgtgacttgcattttattttttatttcctttgacttgtgtgacatgtaggatccttctctcctgagatctctcttgactgtaaactaattacccattgtgacatgaaaacaaaatatgcttcaaatttccaagaactgtggatcttaaagagagtcattgtttgttcagtggagatgaggggtttgaagatgtaattggaagaggtaagcttttgtgtatgaggaaaggaaatataaagacattggggaagatctgggagaaggagaactgctggggtggaggaagaagaaataagaaaaacctggttgctgaggtgaagaagacatttgggagaaaaaggaatacatgtagagaagattccttctccacgccccagtaaagtcttcccacataatatgtaaagtcaacccttttccttgcaacttcatgaaatcttcaggaagatagtggttcctcattcatctattgagaagtcagagctatttattccctgcttttcctaccagaagttccatgagggcaggaggacagcctgctttgttctctgctttaccccggcaccaaggacagtgcttggtagagtggatatccagaaaatacttcaacaaatagatgacttacttatttacaaataaatgcttttgtttacaaataaatgcttttatttttgtgattgtgttgaacaaaaagatttttcttcacatatcatcctgcttcaaataatacctatttctagaatgattttttacctttcctaatgataaaaaatatataaattatttgatattttaaaaatacacaataatgtgaggcaagaaagcacccacaatatcatcgatgttaggaaacttaattcttttatgtagtctttcttgtcttctttgcatacaccatttttatacagcgtcatttctggctggtgttttaaggcaaaatggatatattgaggtcacagagccattggaacaactgaaggaagagattttaagactggccttttggaaataactttaaggcaaaatagatataatgaggtcacagagccattggaacaactgaaggaagagatttcaagatagcttttggaaataacttcacatttatcctgttctctttccaagttgcattcataaaacttagattgtacatagggcattgctcgcaagggagtatgggaatgtagtttttaaggcaccaaaccttttcttgtgtatttttgtagttttcttttgtctggacctctctttctgcagctggctctacaactaacctattgacatatttcaaatctgagttcaaaagtcaactctgatgagacgagagactttatctgctcactgactcacagcttacctctcccacttactctaccttattacccagtttattttctttgtagcattagtggcaatctgtaattatttatttatgtctcttggctgtctccactactagaatgtaagctccataaaagcaagaactttgtctttcaatactgtatcctcagtacctaacattttgccagggctttatgtattttatacacatttgtaatacgatcaattcaccaaaagttgtacatttagtttctttccagtttactataaacactgcatgatgagcatctttacataaaaatatttgtctacgtttctgatcatttccataagatagactggtaggagttattgaattggtaggtatggaacatcttatctcttatatttgccaaactgctttataagaatatggttctatttactttcctgccagcaaagtgtgagcttccattttatcacatcatcactggaattgaatattttcatatttaaatatttgctaatttttctcactaaagcttagagggtgtgttttctgataaatattaagttttattatattatggatatttatgcttggtcatatttttgaaataaaatttacattgttttattctatgttagaagtcttacatttatatgtagtcaaatcaattgattttttatttgtgatttctgtcattattaagaaagtttttgtccagagctcagatgaatattccatattttgttctttgatgttttcaatatttcaactctttgagaaactttttaaatcaaatttattgtaataaactgtattttaaggttttttaaaaaattctctcctttcccaaacttgaaactggctcccgttagtaaagaacattggctcatattaatagaaaacattgactaaggaaccaaacataaatcacaaacaaaaaagaaaagaaaagtaaagctttcatatctgtcatattagtccattttcatgctgctgataaagacatacccaagaccgggcaatttacaaaagaaagaggtttaatggacttatagttccgcatggctggggaggcctcacaatcatggtggaaggcaaggaggagcaagtcacatcttacgtggatggtggcaggcaaagagagttgttcatggaaactcccattttttaaaccatcagatctcatgagactcattcacgatcatcagaatagcacaggaaagacctgcccccataattcaatcacctctcactaggttcctgccatgacacctgggaattgtgggaattacaattcaagatgagatttgggtggggacacagccaaaccatatagtcttttatatctgtttattcttataccagcattaagcaactctgaaaatcacattcaaacattcatccctcattttaattttatttacaaacataaattaatattctacccaggttctaaattgaataataccattggacccggtttacttagcacatgttgtgattgtttcaatattaaccgatattcaatatcattattattattggatgataaggtttgtacatggacctaatttcagatttgaaactgatcatagtgacttcccaaagcaaaaatgaatggggaaattttggttttagtgatgcacaaagccagtcatcctccgtgtctgattccagagtgaacagaaatgacttcccatagtccctttaaagttttaacctatcaaataaagtcctttagtctaatctccttgaaaaacaccatttttcaagtttcctgttattaacttcatgtcagaattcaaatccccaatgttttaaagaatgtcattggttactataacaattaacttacttaattcaacagagtgccttcctagacatgaattatgcagtgatcttgaaagaacaaaagatagtacaaaaaagaaatccaatttctcttttttttctttaggagtactagctttaattaatttatcttttactttcagcttttattttagatataggtggtacatgtgtaggattgttacatgggtatattggacccaggttgtgaacctagtacctaataggtagtttgtaaaccagtgctcccttcctccatcccctcctctagtagtcctcagcatctattgtatctatgtttatgttcatgtgtattccatgtttagcttccacttgtaagtgagaacatgtggtatttggcttactcttcctgtattaattcacttaggattatggcctccagtttcatccatgttgctgcaaagaacatgatttcattcttttttatggttgtgtagtattctatgctatatatgtaccatattttcttgatccaatccaccattgatgggtatgtaggttgattccgtgtttttgctattgtgaatagaacagcagtgaacatctgaatgcaatataatgatctatattcctttggatatatacctagtaatgggattgctaggtcaaatggtagctctgttttaagttctttgagaaatctccaaactgatttctaaagtagttgaactaatttacattcccacgaacagtgtacgagttctctttttcctgccagccttgccagcatctgttgttttttgactttttaataatagctattttgactggtgtgagatggtatctcattgtggttttgatttgcattttgatgatgattagtgatgagcattttttcatatgtttgttgatcacatatatatcttcttttgagaagtgtctgttcatgtcttttgcccactttttaatggggttatttgttttatgcttgttaatttgtttaagtttcctatagattctcgatatgagacctttgttggacacataatttgtgaatattttctcccattctgtatgttgtctgtttagtctgttgatgatttcttttgctgtgcagaagaagctctttagtttaattagatctcacttgtcaatttttgtttttgttgcaattgcttttagggagttggccataaatcctttaccaagcttgatgtcgatgaggatatttcctagattttcttctaggaactttatagtttgaggtcttacattcaattttcctaatttattgttttctttcttagaataatcattctcttctactccaatttgaaaaaaaagaaaacttcaggagtagaaagagagatgactttaatttgcagaaagtatgggttcacctatttaggccttatcaatgagaactcttaaagaaacagcctttgagtatacagtactgtggcacacacccctaaggaaccttctatgagtcatgaccttgtataattcctttttcttgagtggaacctgagacttgcctttagccactacaatatgacaaaagtgatagaatgtcactccagtgattttgttaacttatacacaaaggtgaaaggatttttgcagaagcattaagtccctagccttttgttttgagctaatcaaaagagaaattttactgggtggggttgacctaatcaggtaagccctttaaaggaaaagccaggccttccctggagttagagcttcaaagcagcagagactctcgccctcctttcctggctttgaagaagcaagtttccatacatcctatagccacaaggaaatgaattccacaaacaacctgtggttgctgggaggtaaagtctaccccgttcaagtctccagatgagaatgcagccagacatgcaccttcatgtcagcctcctgagtggaatacccacctaagttgtgcccagactcctgatctgcagagctgtgagatcatgagtagatgttactttaaacatcttgtttgtggtcatttgttatgctgcactggaaaatgaaaaccagaagtctccttgatggcatcagctaagggaggaagaattccttctctcagacataccaaaatgtgcaatttccttttcagtctgcagattaatttgaatgttgtcattctaatttgaaataatacccctctgacaaatagtagcagttactcctgtggattttgtgtttctttgtaattcgactactcgtcctattttttctatcctcatttaagtcattttacttccaagctcagatggatatccctcttccacttgcctttgtgtttgatgatctgatctcttcttctgcatgttatttctactttgcctttgctgggttatttctgtatttcttcctcacttctcgcttatttctatttttattcccattctgggtccactcgtgcttctcctcaggccactcaccatccaggaaatttctgtctccacgtctcttctaagatttacctgtacttaagaatttccattttctgaatgatgtttcaaatttagaaatgtggatttaggtctatttgctttgtaagatttatgtttcacaaatttatttattttccttgagaattagtgaacaaatggttaggtaaccttgagtggacatgaagcttttcatcggaattggatacagattgtatttaaacacctcatcaaagatttaggactgtgggattgtcattcataggttgtgagtgagcacaaggacccttcccatggggtggttgaccttttgttttgagagccagagtgctgcaaggaaatgtagttattctttgactggaagatgtcttttctgttctgaatgttctgaggtatgtggattcttatctataattaccttcccttaagtcaatctgcatgctaaagcctcccccaggtcctgcatctgtgcctcattctttgaagctgggattcagaatatattataacagaataaattataaagattgcttgggtgtttcctgtaccaggacatagcagtggtttggtgtcctgcccatttgtgtggcaggaaattcttttgtttgtgctggtgaatcgttttgtctggggcttctttctttgctaaaaatcttgcattctttcatttggcaagcattttgtcaacaactttaacttgcaagaactatgggtccacctatttaggcattatcgatgagaacttctaaaggaacagcctttgagtgtacagtactatggcacacacccctaaggaaccctctatgagtaatgggtttgtataattcctttttcttcagtggaacctaggacttgcctgatattccagagagtgtgaagagggatatttaaaaataaaaatgaaaaagtgttgcccccatagtatgtaacaaatgcctctcaggtgtgacagatgtgagttatactgtgaaggtgatattgatgagtctgggtaggtgtgcaactgcttatggcataaggcaggtacacagtaagaccagtaagactaaatgagaattactgggtatggagcttggggatccaataagcctcccaagtgattcctgtgtacactgaaatttaagaaaattattacatggtgccaaaattttgttgttgatcatgatgatcattggaagacaaaataccaaaaattttatccaacgtattatgtctttaagagaatgttataattttaaaagagaaattatatactccttaaaatcattttcattaatcaaaattacttatggctagaattcctctgcctttataatgctcttgcacttctaagtctaaagcctttaaaatggtcagtaattattatacttcaaattaatgaagaaccattgaccccatgaaatcaagttctgaaattgaccaacaagtaatgaattgttaacgaggatgtattattcacatctgcagtaattattttgcaccaatattctagatttaagtgatcttggaaaatatcatacatgtgatactcctgatctcaaagaacaacttagtaatgtataattatttttatttttctgcaataactgagaatgaagtgcatatttaaataaatatttatatagtgtttgtttattcaatgtgaatttcatcatataaagttaatgccctaaatttaatatcttttgcattattgtggcaattgtgatagttaacacatctgtaaacacaaacacatgttctgtgtttccatttgatgacctataaatgaagacacattctaaagtgagacaaaataactatatcctaaatattctatcctaaacgtccccatattcttgcattgtatgaagaagtgtgttggctggtgtatgctaatttaatagttagatataatttggttgcttgatggaagataaagggaaacttgcagtttgaaagcagtcagaatgttaacatctgttaaaaatttgctaagtttcatcactgaaattgccatgacttagtactttagagggaataattatctcccttggaaaaaactaatcactttagaagtgcataaacacttctaagtcacaaaggtgctgtttcatgaatgacatcaaattattattattttttttggttaggaatcagttttaggagctaatttatttcctaaagtctctcatttcttctttaatgtcatttgtgtagtgagagatattaacaagctactctacaaatgatgagaaatataaaaacaaattaattgtatctattaataaccgtatctgttaatattatgaaatttccatatttctccccctagctgttgtcaacatcacatctatttattgtctgaatttcaatttctttgttatccctcatatatgaaagtttaaccttgaacctgaaatgaccactaaatatactgccttaaaaactggaatacacatgggtgtggtatgtgtgtaccctcacttattccaacttagatgccttccattccttctatccacctttgctcctgaggtcccaggctaggggaatttgggttgtactaataagcactttaatattggccaccagagggctcccatattccttccatctaagtatgaaaatacaaagtgcaactaacataaagttcaccatcaaatagaaaatattataggaatttatgatatagttctctctagagtgaaagtgttccaaacccattgtgttcttatataaaatacttacaatgaaccaatttgggatactcaacactttcattaaaataaagttatgaaattatgtttggttttgtctttgttttgggaggttatgataagacttataatacttaattggtgattccacattttaaatattaatgttagtaaatctggatgtaaatccattatttacatatgaatgatgtaaaatacaactgattctagtcataggagtacaattttttatcacaagctagctatataaataatcctctattaaaaccccgggtatttttttttttagcccagcattttgatggtacacaaaactttagacaacaagatggtagggtttctttaagtgtgtgttggtagtaagaaatagttccattggagaaaaacaaagaattgcttcgttggtgagtctttccactagttcttgttgggttgtgttagccgagaaccatttgcagttactgagacatgctgggatacctctcagggttttagaagcagcaaaggtatctgccatttttttttctttttctttcattgatggtaatttgtttggttttgtactgaccaggtgctgaccaaagtatttatgtatgcagacatatttctgctgtgcagtagagggtagggttagccaatagtgaaactgttgtaattgacagcggaacagactttgaagtttctttaggaactctttgaatctaggtgaaacatttcatatgagtcatcagattgatcttctctgcgatgtactttaaaaattacaattcatttatcatcagtaaccgaaaatggcatttaaccattctacctttttcaattgcttttcttctagaacacattacttatatttctgcacttaaatgtgcatcaaagaggatagcaacatggaaggcctgattaactaactcaattatacacccacacctagatgctgtctttttgactgtgagactgcaatgttgtgttgcagaagaaaataaaacaatctgttcccctttttttatccattatgttattctggtctgagaattattgattgtactttttctttagaaaaagagaataaaaatgagctaattttggtgcaccttgtatttattgaaatagttttaaagcagtgttttgaattatgttttgatatgtgtttttaaaacggtttttctgaaagcaggctttctttgtttaaatcctcctctgtcccatcctttgctttcttttcatgagacaattgtgattaaaaagcactctaatctctagggttagattatcatgtctaaatgaaatgcggttataaaactatctttgtatacaatctattttggaaatttgaatagttttattcagaatcacatagtaacaaatccagtccagtttgtcctgatgattcagtgggattttgatctgataatgttcaccaggcatttgcattcaatttctgctcaaggaaatccacaatatcgcaactagtaattgactgcattttaaaaatatgcacaagcaaaagaaaaggtagaaaaaatgcaacaaccaattttgatagtgactggatattatcatagcccaaaagctaactgtattatgttcctcttagaagtctttgaattaacaagcaaggcaaattttcagggttagatagattttattcaggaacatctttgttaattatcatattatttctaagtttatactgtctaggaataaaaaatacctggaaatgttttaattagtatgttcacacacttccatgtaaactgatttgggttcctaagtttcctgaataattgctctaattttgaaattcagcattcttagataccactccaattgtatgtatttaccacttagagagaaagtttattcctatctagcttgtgtgaaatcaaattggcagagaatgaactttggcttaaaagcttctcctgacatttatttgcaaaggtttctatggctaatattcttgcactcaaggtgacattaagcttccttggtcactagggagaaatgtggcttttctcttcactgattctgggtatgagaagaaaagaatgacttgaggatatgccaacctcaccttgcttctgtctgcccctagctatattttatatttgcatttcaggcaagagaccaaaaaactgaattcccaacacagagagacagtggcgagcgagaggacctgcatcacccagctcttaaatcctacatcagtacctatgcctaaagccaccaatgatatccagagaccttcctatctgaagctattgatgtttatttttttcaagactttaagacctctcaaaaaataaaatataaaatttaacttagaatactggtgcttaattgtgactgcacgttacgctcatctaggggtgctctttaattcctaatactcaggttgcatcactgaccaattaatcagaatgactgggattcaaccagacctcagtagttttgtaagctctctctcatgactgtgactacactatgggttgagaagcactcaaagtttgagaaccactgtcttgtaaaccaggaccactaaatgatatcataatcctacatcctgacatatgtaaaggataaggatcttagactgcaaatccagatgttcaagaaatacaggttgattatgagttgtgtggtccaaattctgtaattcagccagtgtggtggagggttaatcttggccaattcagggttcttcctttccatgagaatgcaagtgaattacaatgggttcagagagtgctacattatttgggggtagggctggagaggactctgtcctgggtggctacttacctgtgccagccttgctgaaatgtgcaccaaggcatctgtccacagtggatcagtggtggctcaagtccccacagcactgccccttcaccccaccaataggccattttctttcccccatgccatgttatggcatgacgtgagctggtgtgtacctgccgtgaagtgtccctcaaaattttttcctcttcggtcttctccacacttgagaaaatgactacatgtttgttgtttctcagagatttgacctcagatgaaaatgttaagaaaggaaccaatcattaaactgagactcctggtcagtacaaccgatgtttcctcttctttttaaagcaaaagcttgtaaattccttttttcaattataaggaaccataaaatcatgcatttttgtcctgaaggaacttttttagtatgcaataatttgattaaaaataatcactaaaaagtatattaccatcaatcgttatgttaagatacataatacatgaagtgttcatatacatacattgttatgttgctggataaatctaattcatctctgttttcccaaggtacttttgtcatctgtccaaacagttaagagtcacgtttaaaatggtatcaactgatacctactccagagtatttatcttaatctaatcagtgttattgctcctgtcattcagaatcttcttaattattgatttggattaattacctggtgaacatttaaagccaattcaaggggagaaaaagaacagtatattgattagcaccattactgaggatatcatttcagtttgtcttagacagggatcccccaggtatgtataatattggccttgagaaaatgtaattctgccatacaaagtctaattcaaatataatggcatttatgtttttatcaatgtaacaataatttacattaattacattcttactatgtgttggagaccatattagtacattgtaaacactgtcttgcttaatccaataatctcatggggatatttactattttatctccactttacagttgaggaaactgctcaaatcacttttccaattactcagctagttaccacagttaggacttgcactatgtttttagctattatacttagacatacaagttgaaggcagttcttgatgttttaaagtaattgttgtaaagacagatacatgcacacccacatgcagaaaatactcctttttctaatagatactaaactttaaaaataaagtcagtggtacgcattaaaaatacgtatgttcaaatccgtaatggaatatcaaggggagcctggaaatattttgaaaataaacctttttgggggtgatgtgagagacagtacccgggcctctgcaaaaatgtttttgatatgagaatactgcactaagggcaccatagtctaccccagggctgcctgatacagctatatgcagtgatgaaaatgttcttcatttgcaatgcccagtatggttgtctattgagcacttgaaataagcgtagtgcaaattaaaaactgaatttttaatttttaaaatcttaattaggttaaatctaagtagtcatatgtggctattggctacggtactgccaagtgcaggctaatctgcacttactctgcttctttctctctctccctttactcccaccactccttccttcctgcctgtctgcctgcctgcctgcctgtcttcccttcttcctgctttccaataaagagaataaatataaagtttggatcagacaaataaaattcgctttttaataatctgagtaaatgcatgcgtttttccttcttaaatgcaaacagtaaataacaacacctacttatatcattatttttaggactaatgagacaataacagatcctgattatggtaatttttttgagctaattagataatatatgtaaagcatcaagtagacttcctgctataaatgatgatccattggtgatgataatgattatgatgatggtgatactgacactaatgctgtattcatttagcaaatgggatagaaggaggtccccatttctacatcagtgtctcatgtggtaaaaagattcagatatttactcattgatgtagtaatatatttcctgtcaataaagccatgtgtgtatatagtgatttattagtatggggtaactgctcatgtttgagcatgtcgacatgctttttgagtttagggttgaaatattagccttgtgttactagtaataaaacgaaaatccagtgagagggatttgctgcagatcacatagaatttgtactcaagttcctgtcttcttttccatctacttctctttctgtgttatcatagttcccataaaaaaataatatgaaagactctaagattcaatgaaaaacataaattttgtgggatttcttcataactttttgacacaaaataaataagatgttagaatcagtggttgagtacgatcaaaactccagatgaaattattttttgcatctctttttttaaccaattattagcagtgctttttagagagcagcatttattttgtttaaccttgcaatgagagagtttcaggcccagttttttaaatgagtgtgatagtagccaatgatagagaaaaatccagtattcctagggaataaaaattgaagaagtaatcatctggccttggaagtatgtatcagcatggccaagtcatgtatcagcttccatctttcactgttgccatagttccatggaggtgatggaatccaatcatgttcttttaaaggataaccactgctctgttcagggcaccctgctcactccgtggggaatgctggaaggatgtgggaccctgcaaggctgcctcgctggaaccaagggatttagcaaatgctaggaaagaaaagcaagtttaagctgggaatgcaagtcatttgctgagacggcaaaacaagaagagagaagccagaggattgctggccatcacaaagccaaggggcctaaaggaggtggaaatgcagcatactagaggccagatgtgcttccactcaaacccattggtggcaagggcctgagaaggaagtggtaatgagtcacaagcaggatgatacagtattaacccacatcctttagaaggcttgaacatcgtccttttgtagctgattcctgtcttagatcagaatgccgactgagagacaggattttgacagaaataaaataataaagggttaccaagtgaaagagtgataaaaagtgctggaatggaaaaatatgtagtacatttacaaactctgggtcgattcgaaagaacagaactttgctaatgtaagagctgtgtttggggcatagattctgagataatattggaaagttattcctcatccttttattcactcattatttcacttcttcattcatttccaagcatttttctagaagcaagggacatagcaacagatacaactgacgaaaatctctgcttacatgcatctttcattgtaatatgggaaacagacaataagtgagaaaataagtaaaaaataaagtaggttagatggtgataaatactacagaaaaattacatgggagggaggatcagggatttttgggccgatgagaagcaattttaaattgggttgccagggaaggcctgcaaatccaaaggacctcacttttgtatccagggaacaagacagagaccagtgtgcctggatctggacccaagggaatgagaagggagggtgggaggagatgacgtcagaggagtgatgggtggggacagaagatgccatggagtctcatcgaaccagctcgaagacctggacagaagaggattgcttctccatcctggcagcatggagaaggccttgttccctgtgtgattcccacaggagtgccgaagagcatcctgcccctttcctgatgtatccatttacaatccgcacaagtaaaattgcaacagctgtccctctggactagttcttttcctttctttctttttccttacctttccttttcttgcttttttttttctttttgtcttcagcaacagaaattcattttctcatagtcctggaggctcaggttcaagatcaagatgctgttaggattggctctaggtgaggcatctctccttggctaacagacaccaccttctgctgtgacggcaacatggtctttatgctcacagtgggagagaaagagagagggaggaagagggagagagagaagagagcaaagagaagagaaagagattgagtgctctggtgtcttcctattcttataaaaacaccagctctatgagatcagggccccatccttatgatgtcatttaactttaattatctcctaaaaggccttgtctctacttacagtcacatgggaagtgaagacttcaacatacgaatgttggggggacacaatttggctcataatagtatatgaactaaagatgtagcattaaaaaatgtctatattatactaataaagaccttacagactagttactttgcatccacaaagctacactacaagaaggagaagaagaaagatactcttactattccctccctccattgggccagccctggaggttatgatttctgttattcttaacacatgtcatagagaaatttgagttcagctgtgaagagccatttaagccttttgagaagaaatataccttgatcagaaccgtgatttaggaagataaacatgaactgctttgtgggaggtaggaagattaggagaagggagacttatcaagtagattttagagtactctaagaaaaattcgatgtggctattatgtgggacattgacagaagtttcctcagtcagtacatatttactgagtgtctacaatgtgcctgtatctactgtaacacatttatacagttctaggtgccaggaacaagtcagggctctttgttatttgcctttgataaaaatgatgacaagtcagatttgaggagctttaaacccagacacaagaagacattgttttgatccaggcagacaagtgacaaagagcaagcgcagagagtaggaatggaataaagtcttggagttaggacaatgaagcaatatctacaaaggacaagccgttggttacatcgctgcaggcaaaataatgccaaatggacagacatctcaaaatgcattcctctctcgtccaaagatttcacctcagatcgctcagagatgttttttcttttatgcaagttaaaaatgcagacaaatggaaataatgctgctttatgaaaattcaatctttagctacctttattagcacatatctgttctatgaaacaaatgttatttgtccatcctagctccatttgtccttgaaataaatatttggccctagctcctggatttcttaggaaattcaatttattgctggacatgtttcagtaatctgtgaatgaccccaaattacctgttcataagagaaggccaggcctggatgacaaacacagaaggcttttcatttttcccatgacttccttttttggcaaaccatcctctttgtgagagtccgcctccaagttggattagaagatgtcctggagcgtgcagttcaccacccactatattgtaagctgaaagtgtttttgctaactgaatgtcaaattaatgcggttttgctatctacatggcatgttttgacaaaaatactgtgtacctttattgacagtgaaccttctgctccggagtaatgctaatccaggactgctggtttttcatgttaaaacccataaacttgttattagagcagatgacttccaaaacgtcaaaactaaagatgttgcttattcactagaggagtttatgttgttcacatttaagatgatttatttttattcacttgacaacacttcgaacttcaaatggatgcacacaagccaattcttggaggggttgtgactgcagaaaaaaaattaaatcttgtgctcatgtgttgctccatcatagtaatcctcagttttgtcccagaagtagcatgtgtcacttccagtgattcaggaccagctggtagaaaggacggacatttcatgctgccatgagcaactgctgtgtggtccaggatgacttttccaaaagcttcactcactgctcctcagaccacgtctgtttttgtagaggcaaaatgagatggctgagagaattgtggactctggccaaatgagtagtcattccctggctgtaagtgggtgaaagagaggtgacagaaccatttttactgcagtgcagtgtgattaatctgtgtcttcttaatgagattaaggggaaaaacaaactttttttttaatttttttttttttttaactagctctcctctatactgcaagttaaacaacttattctggcagaaggttgaaagaagggaacaattgctcctttgctagaaattctcttcattaggagcatagcctttcaaaaaacaatgccactcatgatatgcttcagattctatataatcatctcatgttgcacttctcctaatttattttataaaagaagttcttttttggtgagagatagattgtaaaactcaatgtattcttattcttttttttttttgcaattattcctgaatacaaaacttaaaaaatgacaccagggctttatgtctagagtagactgtgaaaaaaatgaatacacatttatttgggaaagatattggtggtcattatgccaattgacatatagttgtcatcactgatgtaattttgcatttgtttgtgtaattatttaattaacatctgtttctcctactgtagtatcaggttcttttttagtgagagatagattgtaaaactcaatgtattcttattctttttttttttttgcaaatattcctgaataccaaaattaaaaaatgacactagggctttatatctagggtagactatgaaaaaaatgaatacacatttatttgggaaagatattggtggtcattacgccaactgacgtatagctgtcatcactgatgtaattttgcatttgtttgtgtaattatttaattaacatctgtttctcctactgtagtatcaggtatatgtagaggtaatcacagatgcatcggctcaacactgcttttggagggctgcacacaaccttggcacatggttggcactccatttgtatgtttgttggtgaaaggatgaatgaatacctataattgaaattttatgcaatttattttttatttttgtagtgcttgtccaagcttttttgagcacctctagctatagagaaaaagttttcttcataagggtgctcaatgtgttttcagaagttttggatattacaaagttttttcttttattgaactgatatatgttcatatatagactttaccatttaaaaataaaataattgtatagaaaaatgactgatattaagggacaaccttctttatgtaatttatgtcctgattaatggacttttcttgtttgggattcattccttttcattcaagcattgttcacaaaactggattagttgttaattacaaatggcctaaactattttaagaaagaattttattatggaaaaataagagtactataaaaaaagttagttggggtcaccttgtctattgcaactaaaatagaattgactcagagctacattttcatcacctccttttcttggcccccttattctggccttagattactctgcagaaacacaggcaccttgtttttttttttatgtggaaaaaattaggtttctttttcttattcttccactattccagatgaattccgtgtctattttctaataaatgctaactattttgaagagaaatgcattactcccatagaaagaacaaatacttgcaatcagtgatgttttacacttactatttctattttaatttgtatttattataaaaataggggatatgtgcacacttgaaaacattctcgttgtgtaacattagagtattacagttaaaactgaagccctctttaagcagtaatacctctattattaagcatttaaatatatatgcatatatacatatatcattgtttttatgggttttgatatgtggtacctcaagactctcttctctctatttttccaaatcaatatcagtgaatcataaattttgcattttcatatatgttcatatatatttctgatatatgttgtttgtttttacttttgaaaaataacaaccctattttgattacttcacatcaagaagtctgtttcactcttacctttagattgttctgccttcaaatacaaacattttacttgaaactgtggcagtaagaactctggagccaaaggctagtttcttcttcttcttcttcttcttttttttttttttaaatactttaagttctgggatacatatgcagaacgtgcaagtttgttacataggtatacacatgtcgtggtggtttgctgcacccatcaacccgtcatctacattaggtatttcttctaatgctatcccttccctagccccccaccccctgacaggccccggtgtgtgatgttctcctccccatgtccatgtattctcattgttcaactcccacttatgtttattgcagcactattcacaatagcaaagacttggagtcaacccaaatgcccatcaatgatagactggataaagaaaatgtggcacagatacaccatagaatagtatgcagccataaaaaaggatgagttcatgtccttttcagggacatggatgaagctggaaaccattattctcagcaaactaacacaggaatagaaagccaaaggctagtttctaggcgctcttttggtttgattttgaaatctgaaaaatcagcattgaagttatatgtgtgtgtgtgtgtgtgtgtgtgtgtatgtaagaaaagttcagtaaacacctttagcacccaaattaaacactagttagcatttttctataatatatttttatgtttattcatctataatgccatcatagatttatgtattatctgcttataattttttctgaattatttgataagttgcaggtatcatggcattctacccccaaatactccagcttgcatttactaaaaataagaacattttcttgtatcaacataatgccataatcacacccaagaaaaataataatttcttatataatatctaatttaaagtaacattttcctattatttccagaatatttttaaagctagataccttctttgattctatgccaacaaaaattcagacaccctagttatgtctctttagtctcttttttaaaaaatcacatctattaagataaaatttgacttcaatgaatcgcacccatttaaagtatacactttagtgcatattgcccatacatgcatgtttgattctaacttcatgatcaagatacaaaacaatatcatcatctccaaaatatttcctcatgtcccttgactattcatctctccttccatcagcccataggcaaccactgagctactttctgttgttaaaagttagtttgcatttcctataatgtaatataaaaggaatgttgtacattgtactcttctgtgtccaacatcttttgctctgcatgcttttgagattcatccatgctgttgcatatagtagtacatgtatggatatatcactatttccttcaccattcaactatggatggtcatttgagttgtttccatttgaggctatcatgaataaaactatgatgtatattcattcctaagttttcatgtaggcatgtgttttgtttctcttgagtaaatgcaataatacatttaattttagaagaaactgcgaaacagttttaataatcctcaacaatgtctgggagttctggttactctgtatctgtcaagacttgtttttttcagagttttaatttagccattctaataatgtgctcaactttcactgatatcaaatttcagttaaattttactagtatcaaatttcactgataagtatgttttgaatattttcatatggttattggccatttatatacattcatttggaaagtgaatgttcaaattttatcgtatttatttaggaatttgtcttctcattactcagaagaacatttatatattcttgataggaatcctttggcaggtatacatattgcaagtaatttttcccattccatagcttgccttttacttttcttattgtatgctttgaaggtaaaatgtttatggttttgctaaaatccaatttgtagattattttttctttaatggctcatatgttttgtttgctatataagcaacctggtgttttcttcttggaaaatgttttattacaaagttattgtttttatataaaaatatatataggtttattaatatttaatggtttattaatatttttcttttttgtcagtttttatatttctgtctttcagtgaatttatccatttaatctaagttttcaatttattggcatagagctatttataatattgtcttattgcctttataatattcaaggaatctctagttgtgctcactctaatttagaatattgtaatttgtttattacttgtgtttttaacataaatgtttgtgtacattgttgtttataaatttcagtgatctttccaagaagtcagcttttggcctcattgatttttctctatagtttgtttttttatttcctttattttagcccttatatttattaatttatttgtgccatgttgtgttcttcttttcctagattcataaggagaactcttagatcattgatttttagcattttattttgttattattttgcttaaaatattttttaaatttatttgtgatttcttattttacctatggtttagaaacaagttgtttgttctccacatactgaatgtatataatgaatgttctgtcaaagtcgttaagtagttcttaaaatgaaattaacagaagagggagctttgtaaaggtaaacaaggatttctgaacttcaaaattatggatcaagtaattttctataaaaataagcatagcaaaatatttaggcccaatcccatagtaagatattgtaagacaaaagagaatgagacaaataacatccctagaggtaataaaaactagtcaaataaaataaataaaaatatcaacttgtatttcaaaactagctaaatgacattaagaatataatgcaaaacatggaataacattataaaacagaattagaaaaactcaaaaattaggcactataccatagggaaaaatagaaatgaaagaaaataataatttcagaaatgaagactaaactagaaatatcaaaagaacaaataaacacatggataatgctttaagaaaaaccgaagttgaaagtagaaaaaaattgagaaagagaaatgcagaaagaaatacatataatttgagagagaaattgaaacgtggaatatgaataaagaacttcttaaatatggttaataggcatctctaaagaaaaaaaaagcaagggaaagaactgatactaaaatctataattcagaaaaagtttctgcagtgagaaaaagatgaaaaagatttcaaactacgtgttgaaacagcataccaaatgccacattgaccagaattaaccaagaccaaaatatgttctaataaaactaccagattctaaagaaaaagaaagaaaaaataacaactgggcatccagaaagaacagtaagtgacactggaaaaagaaaactatgttagcatccctatttttggcaagtatagtttactccagaagaaaatgaggctacatagttcatgtggtttggctctgtgtcaccaccttgaattgtaatccccacgtgttgagggagaaacccagtgggaggtgattggatcacgggggtggtttccctcatgctgttctcatgatagtgagtgagctctcatgatatctgatggtttaaaagtggcacttctgcctttgctcgttttctcctgccgccataaaagacttgctttgcttccccttctgccatgatttaagtttcctgaagtccctgcagccaagtagaactgtgagtcaattaaacctccttcctttgtgaattacctagtctcaggtagttctttttggcagtgtgaaaacgaactaattcagcagttaagataatcaagaaaaaaataacttgtgagcccacaattttctatctaaaaaaatcaccttccagtataaaaggcgtagacaaactgttatctataaggaagaactcagggaatattgagtaatctaataaagaaacagcctaaaacaaccaaaatgcctagagagaagagacaggtggtacacattaaacactggtgggaagcattaaaaacatagttacttttgttgacaagtcttactttagtacgaagactagaacaagtcttagtgtagaactatgactaaatgcaggttaatgggggaaaagtatgaaatgtaattatatatagagagagagagagcgcgaggggagagagagagtagtgatggacaatcaaattacattttcactttaaagaaaataatatactatagtgatgtctactagtatcttataagtaagagtaattataataatattagcaattgccttgctgcttctgtgccaggcataattgggtgccatgtatcagggtgatccttttccccacccagggttttgcttagatggttctcccttaaaaatgcttttgccactgtcttctagtttcccagcccttcccttttggtggaaggcttccaaaaccaagactgaaagtcaagtttgtttatgctgatgtgtactctctggacatttttcttgtaatagaaatcagtgttattttattttacatcctgatattttatatattttatctaaatttgtttgaatatgtttggtaatttacatatgtagcctttagcttacaaaaaaattaacacacacattaaatcttcaattttatctaatctaatacactgatgagattttgattctttaggttggctattgacctaaaaacacatttttgggatatgtcgcatgtaagcagcaacagtttctaatgaaatcttcttggactgactatcaacttcaaattcttgaagggcaaaccacatttacttagtgtctggttgggtctagattcatcttaaaaaatcactaagaaaagtaaaatcatgttcgaaagtccatggaggtttcttgtctttctttctttgaactactagaggagctgtaatataggaagaaatattagaggattttttttattttaaaaactttggaggcatacaggataaactttcaataatggctaagtttatgaaatttaactgaaatgtgtgtactatatatttagttgtaactgttgattttaaaaaaacgtatactagttggttctaatcagaaattgtcaatatttatgtaatgtaagtgactaaaagttatggaatacaaaaaagtaaacaattgtttacatgatatgttttcggggctctgatatttctgctgctgctccactgaattgcagtttaacttagctgtaacttaaagtttcagtttcagtttttgctaatcattaatattcattcacttattcagttcttaaatatttatccaggtcctgctacttttgtgggtgtgatattgtgctgttttaaagcaatactctggaaaggattaaaaagccattaacaatatagagtgaagtcaaggtcagtgagtaggattttgcagaattggaagtaagacatttgcactcgaaaacaggggtagttggtttctggaacacgctacacccgattacttcatagcgtattttttggggggaggggatttactttatttcttaagtagtttaggtattttattagtgattttgatttttcttgaaggttttattttttttattttgttatttatttatttatttatttatttatttatttatttatttatgttttttagacggagtctcgctctgtggctcaggctggggtgcagtggtgcgatcttgactcactgcaagctccgcctcccaaggttcatgccattctcctgcctcagcctcccaagtagctgggacaacaggcgcctgccacaggcctggctaattttttttatttttttggtagagacggggtttcaccgtgttagccaggatggtctcgatttcctgacctcgtgatctgcccacctcggcctcccaaagtgctgggattacaggtgtgagccaccgcgcccggccagttttatactttttaatttactctccaatattcaagacatacaacatgcacatcttaaaataagttgtgtatctgtatttaaagaacgaatttttttcaagttatttcttagaagttatttatttgaagagattatttttaatcatatggttgctgttgaataaatttttaaaacaaaatatgtaaagaagtacacaaaatcattttcagtaattctctccttatccaagaaggcaagttctatcttaagaacctgcacagagtaaatattcagtacattatctatcaagtagtgtgttattcactgcaaattgaaaatcatcaaattcctagttgttctgcttaatagatgcttaactatattttagcagattccaaatatatgttaatatatatttttggaattcagcatgagtatctttagatgctaattgcaagttaatctttcttcctagaatgtaagttccatggattataaacgttattcctattgcagattttctaaatagtgtttctgctggtgaagtcttcttcactctctggtgcttaagattagaaagaaaaaaggaaagtaactgaacaaaagaaattctttgaacatgaaattatcaaatgaaactgtacatatgcaaaggaattttaaaccattgccttgcaaagtctttttttgcataacaacgttttgataaaatgaagagactgaccaaagtaacaactctaaataatagcatttcactgccataaggatgattgtaattatcagtggaagcctagagcattaggtcccaactcctaatattagtttcaacttttatagcctggttgttcaaagacatgcaattaaactaacctagtattattggaatagaaaataaagaactactgttggaaacacaattaacaatacataatagaggggccatatttccaatggctgcatattaaaatcaacattgagctaaactaagcataggccaaagctgaatatcatcatcataggacatacttctaggattacaagagtgtatctgaaagtgactaccactttaatgatattaattttatcattaaaaggttttatggtcaaatttcaaaatcatggcattgtaatgtagggtgaaagttcctcagcactgccatgtgattatttctgcaatgaacctgctgcacatttgccattctaaaaggacactgactttcaacttgtgtctctggaagagccagacccacctctgctagtatagcttactgctaatagtcatgctgcagtaacaacattatcaagcttttctccttctctcaaagaaaatgattcaggtaatgctttgcttcctttgcaacccagggattggacctactgtcttcaaacaaagctctgtgcagtgttggtagaaatggtttctgaatatttttagaagcagacttaaaactgtagcatgatttcttgtattttccacaaatgcacttgatgctttactcattcattgagatacgtaatccttcaagtctggatccttccctatatttgatgttaaataaatgttaaatgtattggttaaaactttttgattagaagttaagtgtaaatccaaacactaagttttgttcatattattcacattctgaaactcatttggtatgatattaaactttataacagagaagactttgcagcaggtaattgagtattatgatttccaatgctgaagtacaataaaagagtttggctaagcatctcttggctaaggcctaacattagtgttttcctaatatgattcataaaacattcttttctaataaaaacaatctatttggctgctactttggacaccttgaaatcaaagaagattaaatattccattaataatgttaaattagtaaagtaggaaatggtccaattgttcaaatctttgcctattttccaagttaaaaaataagccactaaggaaacaaagaagaaataatcagagatagaaaggcattcagaaaatagtgtgtcagggaagacaaagatagtttttcaaagaaaaaataactggccaacagcatcataatcagcacagtctaattaaacaaatatagactaccgttcttgtatccacagcacaaatgtcattgtcaacgttgaaaagaataggttcagggagtaatgacagcaaaagtttggaaggggagaaccattaatgggtggggaggaaggagaaacagcaggcataggctactctttccagaagcttgggttgggaaggaaaggataaaacaagaaataggtacgtaagtcttagaattgagaaaggttgctttcatgtttgcttttgttttttagaagaagaaataggtaggaatggttttaggttgagggcaacacactaaaagataagacaatttaaaagtgtaagagaaagatggatccaaatccaggaggaaatagaagaaggactccaagattcacatacaccagtaaggaatcaacaggcagtttcctgtttcctctaaaaatggaaagaccctggaaagggtcagtgcagaggttggacagtcacaactgacaggaccagtgagaagaaatcttagttcatgatggcctccatcttcctgatgaagcagaaaaaaaggcagcctgttagcactgaaaaggctgaagcttaggaagagggtgttaaatgttcataaaggtcaaaaagttgaaagaaggtgttggagggttttttaaggccgtaaagggcttattaagctgtgttgagtgctcagagaaatctggagaccatgattttcattccataaatctgcacataagtacaatttttttccagcagtaattattaatccaggtggagaggagagattgtgaaattaacccagggtaaaataaaacagtgtaacataagatgttctggtggtgctacagcaaggagagatggagcatttgtcaaagatgattgtgaccaccatgcttatggccttcattctgtagctttgtttgtcatattcctcttgtcttcacagtatcttcgtcagaagcatcattgcttttactccacttgggattggctttccataattgaccccagaaagaggcttttctttctctgctgtcattggcccttagctgcattatgctcaatatatctacgtggtgataatgccctattaaaggtgaatcttcacagatgatattttaggaatcttaagtatgtttttattaactcaaaaaaaagagcaaactttcacctactccagcagaagactaggaaaagtgtactctgatgttacccagacattaccttttgatgaggcttcacccactctttcagagctccaggaggctgtgttcttctgggagtgcttggagttaatgctagaccttatagttagagaatatgatgttagctggcagagacatcctggtcaaattattttagtttaaactttcaacctctctcaaaacatctttgaatccctattaaattcatgaccagacagttttctaaaattcctctgacttgagaatctaggctgactcagagcttgtccttgtgaaaactttatctaaacttaatctaggttcagactctttccttaaggataagttgagagttcatatatcagaactgaaaacatgttgaagctaattgacataatcttcacaaacaacaacaatgacaataacaataacaacttgttcggagatgttcttaagctcttcaaagatgatttgattccaaaaacttttgcgaagagtctgaaaaaaatttttccttgcaaaattttgcaattcgaatctcttcttcataatcattcttaaaagtccaagtgaaaagttctcatatggctgttaggaactataagttgaatattgataattggcttaatttgtgttgaaatagagtttttaaagtatatttctcatggttagttctgtactttagcttttgaaatagattttgtgtttgatcctcaatttattctctttaccttaaatatgaatatctggggaaggttggtggcccttttctatcttttttttttaaattatactttaagttttagggtacatgtgcacattgtgcaggttagttacatatgtatacatgagataccatctcacaccagttagaatggcccttttcttttaaaaggactctgcgtggcaaataatcaaaagactaggctatacttgtttcttctaaaaacagtatttgtaccctatccctccctgaagtcaggcttactaatagaacaaattgtatttttatttttaacttctagacgctttcagtttccagaagaggaaatataaaaaacaacaactattttcaccagagtgactaatacaggaaagattatttagcataatttctaaacatatataattgtaaaataaataaccatgagggcacgcattttcttgaaagcattattgagaagaggcaaaattgagagcaattgttgaagctgagtagtattgtagaaaagagaagaccatggatattaagattgagtataactttatgatttgaggcaagtcagttggtctccctgttctaaatgttggctttctcattctcaactcataagttgtggtcaataattcattgtgctaataaatttgaggacctaggtacaatatgtattcctttcttaccctcaggatttttaatctgcctcataaagacttctgagtaaattgatgcaagacttctattatttccctatggttgtctcactagtaaataatacctttcaatacagaagatgatttctggtcaaattaatttactataatctcatattaataattatttccagaaaatatctggagcagatgtcactggagcatatttaagaaatgaatggcatttaaaggtttaatttaaactgatcacatttaataaacttttaatacatagatattctttgcttatctctactttgagaaggatgcttttgtctgtgatgaaaacttatctacattttaaaataaaccatttcctaaacctgttctagcacccagtgtttctattccccattggataaaacgtatgtaagcatatagaggtgacaaggttaaagtcgtaccttctctaacattcaataatcagtctcctgagacatgtgaaattcatcatattctaatcaacttgtatattatcagccctgaaacacaaatattatatcagctctgactgcctcaaaccacatcttagcagtcagagactggctctccaggctattccatctcatttgagaagaaaaccaagaaccaaaacaaattttggtcaagtaacttaggaaatatttaaaatggaatacatatttccagtaacaaatggatgatattaaaataattttatatgaaacttaatctttagaaaaatataacatttcaaaggaaggctttgaactcagtcatgaagtctgatgatatgtggcaattttgggatgctgttgctcactgtggccttggaaaaggtcaaattaaaatgaaagtgtacattttaaatgacagtttgtttcacttagcatagagcagtatggtaccttcactaaacttcctagattcaaggttgattcaatcatcttaacaaaactaaattattaatttaaaaacacacatttttcatgtaaagcagagggttccctcttatttcccagagaattaaaattgtcatgtggatcacaatgtattaaattgctttgatcaactcccagtcatttttaccttagaatgaactttacaggtagtctatatctttagctttgtttaatggattctaagattgtttgcatgaagatccactgagttttagtcattatgattgacaggtggtcagttgcagcttaatcaacttaaagaattatacaataatttcatgaagaactgttaatcctatgtcaaactttggttacatagattaaaaactatgtttggatcatgctttaaagtctcacactaattaaagcttattaataatgtctatgcacacatacatcataattttatcagtattaggataaataagttatttgtaagagtcatttgaaggataattataatttcatgtatgtaaaacaggtttttgaccgagactcaagttttaaaatttatattggtgtaactaaggaaatgtatagtaggaaaataggatttgtagagacaagaactagatccatattctacttttgctatttatcagtggtgtgcccataagcaaatagttctaaagaagatgaattcttagttctaaagaaggaaacagtttactggggttggggggccgtgtaaagagatgataacagactagaagtaatgaatatgaggaggcatactggggggtctagaaaagtttcctctcccatttgagggttaagaaggctttcaaatagtaaacaaaaaggaagaaacactggcttacagttgttggtagaaatgaaaattgcttataaccattttaaagaactataaggccatatctatgaaacttatgaagattggattttttaaatttacctttagaaattcatttttgaaaaacataacacgaacataataaacaaaactccagaaaaaaaatcagcacctgaaagatctcactatagaactataaattatgaacaatttttattttacaaaattaaaaagaaagtgtttcattctaataagctaatggatatgttaacttcctggaaataagagctcaaaggagaaatgtcaggcatgtaagggaaaattacatgagagcagagataagttcttttttaaaaggatttaagaaatacttacatagtgtttattatgtgacaaacactcttaagcagtttatagtcattattttacatagaaattctgtaatgcaaatactaccattttctcattttacagatgaatattctgtgatatataaagaggttaaataacttgctcaagttcacacagcaaatccatgtagtggagctttaccatcagtggtacggttgcggagtgtgtgactttgagatttatgctgtgctgcttcttttttttttttttttttttttttaagttttagggtacatgtgcacaacgtgcaagttagttacatatgtatacatctgctgtgttggtgtgctgcacccattaactcgtcatttagcattaggtatatctcctgatgctatccctcccccctccccccactccacaacaggccccagtgtgtgatgttccccttcctgtgtccatgtgttctcattgttcaattcccacctgtgagtgagaacatgtggtgtttggttttttatccttgtgatagcttgctgagaatgatggtttccagcttcatccatgtccctacaaaggacatgaactcatcatttttatggctgcatagtattccatggtgtatatgtgccacatttttttaattcagtctataattgttggacatttgggttggttccaagtctttgctattgtcagtagtgccgcagaaaacataggtgtgcatgtgtctttatagcaggatgatttatagtactttgggtatatacccagtaatgggattgctgggtcaaatggtatttctagttttagatccctgaggaatcgccacactgacttccacaatggttgaattagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatgatgagcattttttcatgtgtcttttggctgcataaatgtcttcttttgagaagtgtctgttcatatacttcacccactttttgatggggttgtttgtttttttcttgtaaatttgtttgagttctttgtagtttctggatattagccctttgtcagatgagtagattgcaaaaattttctcccattctgtaggttgcctattcactctgatggtggcttattttgctgtgcagaagctctttactttaattagatcccatttgtcaattttggcttttgttgccattgcttttggtgttttagacatgaagtccttgcccatgcctatgtcctgaatggtattgcctaggttttcttctagggtttttatggttttaggtctaacatttaagtctttaatacatcttgaattaatttttgtataaggtgtaaggaagggatccagtttcagctttctacatatggctagccagttttcccagcaccatttattaaatagggaatcttttccccatttcttctttttgtcaggtatgtcaaagatcagatggttgtagatatgcggcattatttctgagggctctgttctgttccattggtctatatctctgttttggtaccagtaccatgctgttttggttactatagccttgtagtatagtttgaagtcaggtagtgtgatgcctccagttttgctcttttgacttaggattgacttggcaatgtgggctcttttttggttccatatgaactttaaagtagttttttccaattctgtgaagaaaatcattggtagcttgatggggatggcaattgaacctataaattactttgggcagtatggccattttcacgatatcgattcttcctgtccatgagcatggaatgttcttccattcgtttgtatgctcttttatttcattgagcagtggtttgtagttctccttgaagaggtccttcacatcccttgtaagttggattgctaggtattttattctctttgaagcaattgtgaatgggagttcactcatgatttggctctctgtttgtctgttattggtgtataagaatgcttgtgatttttgcacattgattttgtatcctgagactttgctgaagttgcctatcagcttaaggagattttgggttgagacaatggggttttctagatatacaatcacgtcatctgcaaacagggacaatttgacttcctcttttcctaattgaataccctttatttccttctcctgcctgattgccctggccagaacttccaacactatgttgtataggagtggtgagagaggacatccctgtcttgtgccagttttcaaagggaatgcttccatttttgcccattcagtatgatattggctgtgggtttgtcatagatagctcttattattttgagatacgtcccatcaatacctaatttattgagagtttttagcatgaagggttgttgaattttgtcaaaggccttttctgcatctattgagataatagatggtttttgtggttggttctgtttatatgctggattacatttattgatttttgtgtgttgaaccagccttgcatcccagggatgaagcccacttgatcacggtggataagctttttggtgtgctgctggatttggtttgccagtattttattgaggatttctgcgtcaatgttcatcagggatattagtcgaaaattctctttttgttgttgtgtctctgccaggctttggtatcaggatgatgctggcctcataaaataagttagggaggattccctctttttctgttgattggaatagtttcagaaggaatggtaccagctcctccttgtaccactggtagaattcggctgtgaatccatctggtcctggacttttttttggttggtaagctgttaattattgcctcaatttcagagcctattattggtctcttcagagattcaacttcttcctggtttagtcttgggaggatgtatgtgtcgaggaatttatccatttcttctagattttctagtatatttgtgtagaggtgtttatagtattctctgatggtagtttgtgtttctgtgggtttggtggtgatatcccctttatcattttttattgcttctatttgattcttctctcttttcttctttattagtcttgttagcagtctatcaattttgttgatcttttcaagaaaccagctcctggattcattgattttttgaagggttatttgtgtctctgtttccttcagttctgctctgatcttagttatttcttgccttctgctagcttttgaatgtgtttgctcttgcttttctagttcttttaattgtgatgttagggtgtcaatgttagatctttcctgctttctcttgtgggcatttagtgctataaatttccctgtacacactactttgaatgtgtctcagagattctggtaagttgtgtctttgttctcattggtttcaaagaacatctttatttctgccttcatttcgtgatgtacccagtattcattcaggagcaggttgttcagtttccatgtagttgagcggttttgagtgagtttcttaatcctgagttctagtttaattgcactgtggtctgagagacagtttgttgtaatttccgttcttttacatttgctgaggagtgctttacttccaactatatggtcaattttggaataagtgtggtgtggtgctgagaataatgtatattctgttgatttggggtggagagttctgtagatgtctattaggtctgtttgatgcagagctgatttcaattcctggatatccttgttaactttctgtctcgttgatctgtctaatgttgacagtggggtattaaaatctcccattattattgtgtgggagtctaagtttctttgtaggtctctaaggacttgctttatgaatctgggtgctcctgtattgggtgcatatatatttaggatagttagctcttcttgttgaactgatccctttactattgtgtaatggccttctttgtctcttttgatctttgttggtttaaagtctgttttatcagagactaggattgcaacccctgccttttttttgttttccgtttgcttggtagatcttcttccatccttttattttgagcctgtgtgtgtctctacacgtgagatgggtttcctgaatacagcacactgatgggtcttgactctttatccaatttgccagtctgtgtcttttaattggagcatttagcctatttacatttaaggttaatattgttatgtgtgaatttgatcctgtcattatgattttagctggttattttgttcgttagttgatgcagtttcttcctagccttgatggtctttacaatttggcatttttttgtggtggctggtactggtttttcctttccatgtttagtgcttccttcaggagctcttttagggcaggcctggtggtgacaaaatctctcagcatttgcttgtctgtaaaggattttatttctccttcacttataaagcttagtttggctggatatgaaattctgggttgaaaattcttttctttacgaatgttgaatattggcccccaccctcttctggcttgtagagtttctgccgagagatcagctgttagtctgatgggcttccctttgtgggtaaccctacctttctctctggctgcccttaacattttttccctcatttcaactttggtgaatctgacaattatgtgtcttggggttgctcttcttgaggagtatctttgtggcgttctctgtatttcctgagtttgaatgttggcctgcctggctagattggggaagttctgctggataatatcctgcagagtgttttccaacttggttccattctccctgtcactttcaggtacaccaatcagacgcagatttgggcttttcacatagtcccatatttcttggaggatttgttcatttcttttaattcttttttctctaaactgctcttcttgcttcattcatttgatcatccatcactgataccctttcttccagttgatcaaatcggctactgaggcttgtgcatttgtcacgtagttctcgtgccttggttttcagctccatcgggtcctttaaggacttctctgcattggttattctagttagccattcgtctaattttttttcgaggtttttaacttctttgccatgggttcgaacttcctcctttagctcggagtagtttgattgtctgacgccttcttctctcaactcatcaaagtcattctccatctagctttgttctgttgctggtgaggagctgcgttcctttggaggaggagaggtgctctgctttttagagtttccagtttttctgctctgttttttccccatctttgtggttttatctacctttggtctttgatgatggtgacgtacagatggggttttggtgtggatgtcctttctgtttgttagttttccttctaacagtcaggaccctcagctgcaggtctgttggagtttgctggaggtccactccagaccctgtttgcctgggtatcagcagcggcagctgcagaaccgcggatattggtgaacagcaaatgttgctgcctgatcgttcctctggaagttttgtctcagaggagtacctggccgtgtgaggtgtcagtctgcccctactaggggggtgcctcccagctaggctcctcgggggtcagggacccacttgaggaggcagtctgtctgttctcagttgtccagctgcatgctgggagaaccactactcttttcaaagctatcagacagggacatttaagtctgcagaggattctgctgccttttgtttggctatgccccgcccccagaggtggagtctacagagacaggcaggcctccttgagctgcggtgggctccacccagttcaagcttcctggccgctttgtttaccttctcaagcctcggcaatggcgggcacccctccccgagccttgctgctgccttgcagtttgatctcagactgctgtgctagcaatgagcaaggctccatggtcataggaccctccaagtcaggcgcgagatataatctcctggtgtgccgtttgctaagaccattggaaaagcgcagtattaggaaaagtgacccgattttccaggtgctgtcttttatccctttctttgactaggaaagggaattccctgaccccttgtgcttcccgggtgaggcgattcctcaccctgcttcagctcacactcggtgcgctgcacccactgtcctgcacccactttccaacacccctcagtgagatgaacccggtacctcagttggaaatgcaaaaatcgcccatcttctgcgtcgctcacactgggagctgtagactggagctgttcctatttggccatcttggccccacccctatgctgtgctgcttctaaaacagtaagatgagctggcggtgttttggagaaaaatatagaaaaaagtaaaaatactctaagaattaacagtgttagaatgaatgttgtcacaagaagaatagatgcacacaggcccattgggaacaagaaacacaggcttaaaggtattagaattgaatgaaaagtaatcaagtgttacaccaatgagtagagagaaaataatatagaaggaaaaaagggaaatccaacataaacaaaattggtgcacttgctgaagagaacagaaaacatagaataattttcaaagatgtaattcaagattacttgttgaaaatatgtacacttttatctgtagacagggaaaaatatgtcctgggggaaaacaaatattttaaaaaaacgacatataattcagcagtaaaatcttccatggtaaagttagtgcattcaaaagataaggaaaaaatctaatgggagaaccaagctaaatataaacaataaaaaaagtcatcttcttcagggaatttatagtaacagccatcactggggccctctgctgggactcatggaccagcctatgattcaacaactaaagggagaaggcagagcaaagcagcaagcctctgactgttgtatgttcagattggttactcctagttaaacattttgaatattatacctgtttataattacattcctagtatgacaactactgaaggcaatccccaaagtcccacagcagaataaagaataattttttaaaataatcatacaatgaactatatcaaggtgaaaaagaatgaaatacagctacaagtagccaaatagatgaatcttacaatattatagatattacaaacataatattgggtaaaatgttatgataaaaaataatagctttgagtgacagagttcatgtagtatgattcctttatgaacgttagaacatgtgaaattaaactggtcacatgcatatttaattcaataaaactgtaaagaaaagcaaataaatcataaacataaaattcagggtggttggtgcaattgcagtgggctacaagggatactcatgattttggttttcattgtcgaggtggtggttacatggctttaatttcattattgggtgttaaacgataggtagggtttatatgtacactttagtgtgcatgatattgtggaacaaaacaattcacatggcagaaatgaaacaaatgaaaatgaacattttaagggtccaaaatcgaagtaagaaaataacagaataaacctaaaaaagtaaagaaagataatgaaaacaaacaaaaatgatagaaataatttaaaaagtcaaatgttaagtctttgtatagtcttcctgcaaacttaattttaaaaactaacaaactcataacagaacaaacaaaggtgaaaagcaacagacaaacctaacagaaaagcaacaaagaaaaaattggtaaatatattaagaatgaaactgtatacattaactatagaattagcatagaattaagaatatagcaagcaacttttatctagcaagcttataaatttagatgaatctcaatttcccagaaatattttttaatctgactcaaaaagagatagaacatgttaaactatcaggaattaaataaggtggctaataatcacaactgttttcatatcttactgaagatgctaccaagtgaagtcaaagtagcatagcaatgtgaaggaaaaacaattctcaaatattttagtatcagtagatctctataattttagaaagaaaagaataataaaaccagagaaaataaaacacaaaataaaatcctattgattactaaaaatatctcttggaaatcttacaacaaaagtcaaacccagactgcagaccaccaagattacaaaaataatgaaaatcctgaatatcagaaatgtgtttgtgtctatataacctatttatattgtttattgacttagcactttattttccttttagaatttattgctaattttttcttgtttgttttgtgtatgcctatattcctcctttttgaatttattatgaaagctaatgactttgccattttactagctattgaacatattaagctcacttactcatgtgattattttctaatttattaacttctgctatcatctttaattagtccttctccttttctaagaattgatatttaatgactttatttttaattaaaagattaattttattctttcttgtttagtaagaaaaatattttaaaatacagcttttttccttaacacctctttggaagtatacaaaaagagtgttgcaaataaaaaaatctttatgcatgtaaatattaaagcctagatgaaatggatgtctgggaagggtagtggggagggaactgagatggttaatgggtacaaaaatataattacatagaacaaataagatctagtatttgacagctcaacaggatggctacagtcaaaaataatttattgtacatttttaaataactaaaatattggattgttttttaatacggagaaaggataaatgtttgacgtgatagatctgcatttacccggatatgactattatgcgttgtatgcctgtatcaaaatatctcaggcaccctataaatacatacacctattatgcacccacaacaatgaaaaagaaaaattgctttcttacattaaatatgtgtatatatctctgtgtgtgtgtatatatatatatgtgtatatatatacacacatgtatatacacatacacacacacacaaaaagagataaagcaaactctaaaaaggtttattaaccatagttaccattttagatgtttaaaagtcttgttaccaccaagtgcttaaaacaagacaaagtgtttcacagataaacataaaacttttaagaataagtttagttccttcttaaattctgttagaatgtagaaaagaaggtcaatttccaaagtttattcttcaaggctgcaaaacattgactatatccccagataaatatgacaatacaaaacactataccaaactcactggattgctaagcctttgagtaatgtattagcagatagaaataacagcatgtttaaggatactatgctattactaatggtgtcagtacaaaagagggaaggctggcttaatcttagtatcttttaatatcattttccatattgagagatcgatctactttaaaaatcctgtgatcatttctacagagattgaaaagctatttaacaaaatttatcttaatctatgccttaaatgtatgaccacaatttaaaatgggtgaatattttctatatatgaaaagaatgcatatcatagtcttccccaaaaagcagcattaagtttagtgcatttaagtgaagaataagaaacatatatccatgtctgttatcattttaaacattgttttatacatagaagggaaaataacaaaataagtaaaaaattgtcttcactatttaactatcattaacttgataaagatcttattatatagctaaagcaaaagaaaacaaaatatctgaaacaaaaggattattagaattaataagagaatatagtagacaatttattgaaattgacaaactgtttctatattataaattattgtatatctgtgaatttaccttacattaatctttatgtttaatgtgattaactactctctccaagaaattccaagatttatttttggaattaaataagctgagttgaaaaataaaggcttaaaatgaagaatacaaaagggacatcagacctaccaattattttttaaaaatacattattacacttgaacatttaaaagtctggcagtcacacatgaattcacgcataaattgagatcagcagatatcaacataagattatacagagttgagaaaaagataaatattcaggaatgtagtatttaacaaaggtgactttaaataaatgagaaagaaataagttgttaattaatggtccttcaaaaacctgtctagccatatggaaaaaataaatatggacagtaaccatattttatggacatacgataaccatattttatgtccatatttatggacagtaaccatattatcttacagtataaaatttccagatttatgcataaaatcaaactttcaagaagaaagcataagagaatttgatcatatgatttaggagtgtgagaaactttatatatgtcacaaaacttagaattcataaattaaataattttcaagcaataaatattaaaattttatggaaaaatgccatttattaaaagtcaaaagatcaaaaataaactgaaaaatggctgcaacatgatggaagtaaaaggctgaaaacaacatacagaattgaatgcccagaaaaataatgaaaatgttcaagactcagtagaaaataagccaaatatatgaggagaacttctaagaaaattttttaaaagattttttatataacaaaaacgatttataaaccaatgagaagattttgaatcttattcacagttgacacatgtcagtgaaaatatccagtataattttcagtgccaagattgacacaagttatttggtaattttttttttgttatgtgttggtaagtgtattcttacacattgtcggtgaaaataaatttaatataactttgaaaacaaatctggctatatctattaacaatgtattgatatacatagctttcatccgtaaattcaacatataataattgatctcagaggtctagtcacacttctgcacaaagatgctcctgtaaggaagaatatttatgatgatataatttgtagtggtaaatggtcaaaaactagttagttaataaaggactgctagatgattatggctatatactatagtcacaaattatgcatctattcaaaagaataagtctttttctatgagctgggatatagatatgtttagatattgggagaaaattctccatgggcctcttgtgtttgcatatttttgtcaacataggccctgactaattttgttccagactatcttttcatggctgtttgttcagagaacagcctgggaagacagacatggtgcctgcctctggagaaaaagagtatatttatagcataatataataaactactgtctccttctggggcaaaggtcaggaatacttactgcccactgtgaaagagcagggaccccgtatcctgagggttcctctcctggaacacaaccaactgcatgttcaaacaccacttggttctcattgtgttgccttttgggaagtaaaacttgataactatctcaaattgatattccagttactgatcttgccattataaagccccttgacgctgattcaagagtctcatgtcttctgccagaatccgtgaaactgtggcaggctaatttgttagtttgaaagtaaggtgaaatctaatcccagtcccctttcacagttctcaacaaaagttctccaagatatattgtaggtggaaaaataaaccaaggctcagagcagtatgtatggtagagtaataaatttaagaaaactgataagtgtgtgcttgtggaagattaaacttcacattctttatcttgaatgtgcaaaggaaatatttcttttaattcctttctattttctctgatgtttctcatgagctttcttcctatttttcaactgctcactgaatgccaggaaaaaaaatagaacaaagcttaataaaacataacttagttcaagcctacttaaaacttagtgtgattcagtcatgtgaagaatatctttaggtttaattaacattcttcagaatacatgttccagtcttgttcttttatttgcttcatcgcttcttggatgcactggggtgtatggattttgctgaccctctgtcatcatgtaggcatgatggagaggggtgaggatacagaggaggatggggagggtaggagaaagaagagaagttgtcaaaagacaaagaagcaacaaatgaggtaaggatttaacaggcaattgaactaagcagtgaaaagcatattagtttatcttagagaaatgtcagtaggatggtgggaataaaatctgattgtaaataaaaggtgagtcttggaatgaaacctaccttcgcctaatgtagtactgattatattttgtaaagaacaggagacacttgctcagttgtatggtttaaggggaggtatcgaaaatgaagccaaggttgaaatagagaagagagaggaattcgggacccaaagaaccagaaggcaaagaagtcaaggctccttgaaaggaatggacctagacatggccttgggggctggagaaaagggagcaagatggatcaggaaggaagttcaggaagggaggggatttctgtcttgctcctcagctccagggtacctgagctgggtaagtgacttgagaaattggctaaaaatttggaggaatcatgaaaagacattcaccaagaatttccttttctagaagtgaggatgattatgttttctgtttttcatgccattttgcaagtcaaagtgatttttaactcagaagattaacatatgcttatgttattttatgcattataaacttggtaaagctattttccaaagtaaatattggtatgccaatgcaaaaggaagacaagatgtattatctagaatgattaaaaatgagatagtttgtaaatgtaaaactaagtgaagattatctatcatgacagattttcagaatgtggggtgatatagcccatgggtcaagagcagggagggcagccttgatgggggtggtgagttttgaactgatcatattttcatgggaagatattcctttttgtcgaagtgatttccaccactgttttcatgctctttcctcaatctccaagctccttggttttaaatggcttcaaaacagctgtgcatactggccactctagcaacctttccttaactgcatacctgagtacagtttgcagtccctttaccaaaatacatgatttctatgagagttctacttgctgaatgaactgtgtccagtgtttagtcctcaagaaaggagatggggcatcagaacagagagagagtatcatatcctgcaaaatattgcttggcttatggatttattctcaatttaatttttctgtctactgatctaggtgtttttttttaaatagaatcaaaagtgacaattcatttgaaatatttctcccttgtccatgaattgctttgtaaatcttgtgagctacttcacgagttatgaagtttttaagaataaatagcaatgaactcactttagtctccatgccaaatgcagatgtttttgtgatagctgatcttgttttgtaggaaaactcttgccttcaagtccttctattggctttcaagagaataatttccttgttttaagtcagatcaagcaaactgtcaataatgtttattaactacccactttacaacagcttacagtggaggttccctagggagttagagttaatagaaaagtcattgcaattagaggatttacaataaagttaactcaaaatataaatgtttgttaattttgaactgagtgagaaggaaagaaaaataaattattgcaatcttctccttttcagttgggtgaggagaagataacattccaaagaattgagtgatcataacatttgtagatcataaggtgattattggtaatctttgtgttagccatttcacaaatttatttgaaggagcagtaaaaatgttctctctgtctatgaaacatcttctcctcaggcataatttgtcagctttgtgtgggggattctttacacagcccactggaattcagtgatgcaatgttgttagtaggagaggactgacatttttttcagacaaagaaagtggtcttgttttttagacaacaaactttggggaatggaggaatcccaagtagaattagaaagagaagtcatggagagacatttggcctgttacttagtgattgcctcagctgtgtgtttcattatatgggagatttctattgcttttctttcctactgcctttagacacatgttagcaaggagaaatatatacttttgttaagaactttttgccttctgatgtaattttcaggatggccctgggtatgtcaggtacaatattcagatttaattatttctcccaagattcatgtaaatttcaaccctcatttatgaggtcacctcttaagcatatatattaaaatgcattaatatgtcaatgtgtggcagttactttttgaaactgcaaactcagaaacgcaaaatgatataccttcattttcctacaatttttgaagactgtaccttgagtttctgccttggtttgcaagggttactataacagagtgccacaaacgggatggttttgaattacagaaattttttgtcacaatgttttggagaccagaaggctgagatcaaggtgttggcagacttggttcctcctgagggttatgcgagtggctctgttctatactcccttgggagcttctggcggctgatgacccttggcttgtagacacattgccccgatccctgccttcatcttcacaaggcattctcggtgtgcctgccgctgtgtccatatttcccccctttttttgagacagagtttctctcattgcccaggcagaagtccaatggcacgatctcggctcaccgcaacatctgccttccaggttcaagcaattcaactgtctcaacctcccaagtagctgggattacaggcatgcaccaccacactcagctaattttgtatttttagtagagacgggttttctccatgttggtcaggctggtctcgaactcccaacctcaggtgatcctcctgtctcggcctcccaaagttctgggattacaggcatgagcccccgctgtgcccggccgaggtttcccctttttataaggataacagtcatatcagattaagggcccacctaatccagtgtgatctcaactaattctatctacaaccaccctatttccaaataaggttacattctgtggtactggggtctaagttttcaatatatgaattgtaggaggacacaacttagcccataacagctctcagtccactgatgacagaatgttattaaattccatttaggttgctctcaatcaatgtggattttccctggagtcaagacaataatccttgggagtaaactgttcacagttcacagggctttgccactgtcacctggtccctgcttatgtctcatttctctagctgctgtcttacacgatgacatctgtatttgccatgtggtcaatggtgggcagtccttgtgggcccatctacttgttctcaccataggtcctcttcagacagcaaccttcctttgaagcaattatggttgttctcatgagccatgctgcgtctgtggaacatttggtggcctatgtcaggcatgtgtggccttaacagccacaagtgccttattctgttgaaattgttctgagatgattcagagaaaatttgcaactctccagggatatgcagtttggacctgaggctctgtctttccctgtctgtactccacccctcctggggtggggcaggggacagggcccttttgtggagtgccacacaattcatagcttttctatgcatttctcatactggcatcacatttttctgaataatagtgtccttttcatttaaatagtcattaattacattctcttggctcttcacagcccctcaggttgcaaagattagtattactctgtcttcccccaggcagtgacttatgaatgtgtcaggatactatgagttgtaacatctcttgatttcactgaaatcccaaaacaacatcatagttaaacaacatctttaatattactgcttatagaaagactgtttctgacatatgtttttccttttttaaatttttgagtgaaatattatcataaagtataaaaagtgacaatattaatattgtgtgttcatcacccagcttaaaaaatagaatttttcttatagctttgcaaatctaagcttacatcaattcaaaacttttttgattacacatcaaaagtgaaacttacacatacatgcatattcatttataatttatataggcatattttacgtcaatatgttgtgcacataaaatgtacaaaataaccatttttaaagataaaacaaaaataaggatatgtattaattctagtgttttcttcttgtatcccaaatatttttttttgtactccctcaacgagggccctatattttggaaaccaccagtgtgtatcaggacctttgctctgaagatgaaaaacacagaaaaattaatttttgctgttggttatgtttctattgcttttccaaaggcagctgatgtcaaggtataatatggatatgggaaggggtggcgtttaggaatcttaaaataatacacagacaacgcacacaagaaaatatatatgcatgtatttaagtatctacatatatgtatgtgtatatatatgcatgtatttaagtgttttgtgtgtgtgtgtatgttttatatagataaaacattggttagcactttaaagtctttaaattcttatctggctccaattggttttgaattcatctgttagtaggtttgtctgttagttttgtggacattctccaggaaaatttcttatctctgtaacccagatgcactattagtatttgatcagggatttttgtgtgctatatgagagaaggactcagactcagaattttcacttaatgtcctttatttcattctgcaaaagtacttcttcatttaagcttagggttgtgatggtcaagacagttgtgttagggcaacctgctctccaaacactttcagtgtggatagtaatagctatgatttgactgataagcagtgttctaagtgctttgtgcatactgacttattccatacatttaacagctctatgggagaggggctatcattagctcctttttcacaaaggaagacgcagagataatgagaggtgttatgagttgaactggatctccccaaaagatgtgttgaagttctaacacccagtacctcaggatgtgatcttatttggaaattgggccttgcagagataatttattaagttgagatcatactggagtagagtgggtccttaatctgatatggctggtatccttataagaagaagaaaagaagctgggcacggtggctcatgcctgtaatcccagcactttgggaggccgaggcaggcggatcccctgaggtcgggagttcgagaccagcctgaccaacatggagaaaccctgtcactactaaaaatacaaaatagccaggggtggtggcacatgcctgtaatcccagctactcgggaggctgaggcagaattgcttgaactccagaggcggaggttgtggtgagccgagattgtgccattgcactccagcctgggcaacaagagggaaattccgtctcaaaaaaaaaagtagaagaagaaaagagacacagagacatgactggagaaggccatgtaattggagtgattggagaggcaaagatctgagtgatgcaactgtgagctgagaaactccaagaaatgtaggtcactgccagaagccaaaataaggcaatgaaggattctactcagagtctcaagagaccctggtcctgttcgcaccttggttttggacttcgagtctccagaaatatgagacaaaacatttttgttgtctggagttactcaatttgtgggactttgttatggcagttcttaggaaactaatatgatggattaaatagttgcctaaagttacatagtgagcaagtcatacaagcagaatttgagtcaagcagtctgtcattggagcctgcactccacagccctgccttatccctcctcaggggacagacagagcggtgccatgctgatgcacagctcctgctggggcatgaggaataaggctgtgggcagagatttttccttaggcaaccagtggaacttaggatgaagaacgcagcactgtcagatgaagaatattattaatgtttatcaaagatgcacattcaagatttctgaaaaacattttcaacactggaaggcatgttaaatatcatctcattacacagtgcttttactttgagtcgccatttaaaagataaagtttatagccttgctgatctccttggcatatgcttacatacatatgtgaatacatagacacacatatatgcacatataaatgtgcatgtcgttcttcatttaaccagattccttgtgcccctgtattaaaaatggtcaagtttctatttcaaaccatgcaataattataatatcagataaagaattctttcacaatcttttcttagaattctagatgtgacttagtttccttcctctacagtgagggaggaaataagagtgatttgtgaagatgcatattttttttcagtaaaacaggggaggtttcacctatctcgggtctcctattctggatacaacatttcaagagtcttggattcctgtttgattatcaagttcacttccactgaccaataaatattggtagacgttaagttctcaggcttgagaggcttctgtcatttggtgtgtccgatgctaacagacactcttaaataaaatgcctcatgaggggccgggcacggtggctcatgcctgtaatcccagcactttgggaggccgaggtgggcggatcatgaggtcaggagattgagaccatcctggctaaaatggtgaaacgatgtttctactaaaaatacaaaaattagccaggcatggtgatgcactcctgtaatcccagctacttgtgagactaaggcaggagaattgcttgaattcgggaggcggaggttgcagtgagccgagatcgcgccactccagcctgggagacagagcaaaactccgtctcaaaaaaaaaaaaaaaaaaaaaaaaaaaaaaaaagcctaacgagaaggtaaaagagcaaggaggaaactaaagcaaggattacttttattgcaaaagaggtggaggaatctttaaagatttctgatacagcagaaaatcagatattgcatgttctcacttacaagagaatgagctaaacaatgagtacacagggacataaagatagacataagatactgaggactccagaaacggggagggagggagaaggtggaggttggaaggttaccttttggatataatgttcattatttggatgatgggtacactagaagctcagtccccaccattaggcaatatacccatgtaacaaacatgcactgctaccccctgaatctaaattttttaaaaaagatttctgacaaatagagtcttagaactgaaagctagaaggtgacaaagagaacggagaatgtctgtcatcaaatctagtggtcttccctttctctcgttcccttctcaggacacctgagatatgccatactctcttttattatcatggattctctggtagggaaagggtcaccaagtttttgggatttacgtggatgaaacggcagaggaagataattccgataccctcttaaagggacatgccttgcctccctcaagaaattctgatctcatatacatttttaatttaccagacaaaaatattgggaccagaaaaattaaaagattaaccatctggctgaaggccacagagctagcagtgacataatctatactaacacctagaggtttcctgaatcccaaactagtgcttgtgtatttgtatttgtgtgtgtatgtgtgtgtgtgtgtgtttatataactttcatgaatttgatacatgaatatatgtttgactttataaaattttctaagttcagccaaaatactgtgttttgctttactataatttcaatttcatcctttagtcacaggttattagaaaaccccctaattttagtagcattaatgcaaacacaccttaacaataaacatatcatgattatctgcaatactttaatggatactctgaatgacacatagaattttaactggtcatggttgcttttagtagcaaacaagatctgatcacaattaattgatgtctgtcacccccttgttttaatagattgagtgcccaatttgaaaatactactttgttgtgagaaaaagaaaataattgaggatatagtatgggattttgcagatgaagggaatcttggggctattcaatccaatctcttaattttgcatgtgaatacagtgaagtaggtcaagaaaaatttcatgactagatttctgaattatttcatgtagttttagcattattcaattttaaatcgtgaagttcaataatttactgttatagttctttcaccaaggattgtgaataatccaattctaagcatgtgtgtttcaaaggaagcagtaaaaataaaaccagtgctatccaacaaccaatccatagcttttactaacaccactcttcctacagcaaaagagtcctttcaagtccattgctaaattccagaactaaacagataatgttggctgtcatgggaaaaacatagcttttgagcttaccagctatatgaccttgagccaaaccaaactacttaaactctgctcagtcttttcacttgtagaatggaaaaacaaagcccatctcactggctcattatgaaaatcagactaacttgcataaagtacttatcatagtactggaagccaataattattagattccctttcttctcttcttttttattttccttcaagattacatggctagttagtgtccaggcaggacaagagtggagaccttttaatttcgaggcagtggaaccctctatattcttccgttgtccacatgaaaatgctctcaggaatgaaaagcagaaatacctaaggaacattttttttctcagcttgagaagcaagccagggactggtgccctgtcttaaaaatggtgaagtttctatctcaaatcatgaaataattgtactgtcagataaagaattctttcacaatcttttcttagaattctagatgttacattgtttttttgtttcttattactagagaaggcttaggaatctatggtggctcaaaaatgactagagaaaaattgagtttatctgttataaactgagcatatttgaatacactggaaaataggacacaaaacaggtttttggaatttacatatttgaacaaagcaaatgaattttagctggcagagtcaactaagtgttcaaattaaaatacccctatttcaaggttatcatgaggctgtagcagtggtacacctagcttatcagatgcacagagagaataaatttttaatacctatccttctctatgtgataaaattgttgccagtaataatcatgaagagataattaacaatcagatttttaaatttgttttttagtcttaaaacaagtaacagtgtatgtagaataatacatttacttttaaaagatattgcaaaattaagttaaataatttatatatgaacaaaaatttgcacttacctcaaaagttatgcattacatccctctgtatgctgttttaaaatgtaaaacaagtaaacattccaagtggttaagaagacaaatacaagtaactcaaattatcctttttttgtatttacaatctctgagctataattgtttatttccaatatacatgtaaatgcagggctgtgtagcatcacaggttttggggatgggagctatagttattctttacccttgatgaacttatttgcaaagtgtctgtaagattttggtttccacttagggatgtagaaagttacaaagtgtgattcccattcttacactgaagaaaagtgggacgaattaaaaatccccatgtgtttctgaattcatccaagatctgaagtcacaggaaaagcaactggccccaaatctggagatagataggcagatgaagggagagaaatgagctcgggcttagctgggtagacataattaggtgctgagaagggtggtgggaaagttggtagcggccaagtatgccctcgtgaatgagcatgaagccccgggtgctgcagaatttgagagagcccaaaccctcttcagatttgtatctataaatcctactgagctctcacagaaaggactggaagatgcttttgaaaacagatccaggaagtggggaactcaaggaagagaggagcagctcctccaggatggtcatgaaactatccagacatttagtacctgtttcccctataaaacaaaatctttcactgtcggggaaagggtaatacatctccttgctcttagggcacttgtaagtatccatggcagctatgggaaggaaacaggaacataaataaatgaaagctcaacatagataaataacgaagaaaacatatcacacaaaaacaaagaggtggacttatcattttcaaattaccaaacacaaaaacaaacagaaactcttacaggcagttacagaaaaagaaacatatgcagaggaacaaagatactaatgacaggggacttcttgtcagaaaccatgcaagcgtggggaaaatggagagacgtctttgaaagcctgaaagaaataaatgttagcattgaattctatatccagcaaaaagtatattccagaaatgaaaacaattaaggatttttatgaggctattcattacagcagacctaccctaaataaatgtaaaggaagttctttagacaaaaggaatgtgatacttgacaaacttgaatctacacaaagaaatgaagagcaatgaaaatggaataaattaaagtgtaatagcattatagttttatttttagttgctctaaaaataactgactgtctaaaacaaaattaatggcagtagattgtgtgtctataggaaatgtgtgtgtgtttatgcaaaaataaaatggcacaaagaatgggaggaaagagctgggaatttaatgttttaactcttacagttttaactctttcctagaattacatataaagtggtacaatattatttgaatgtaaactctggttggttaaagatatataatgtatacactaggacaaccactaaaaatcaaagtatacaaatagcagaggaaatagaataaaaaataatgctcaataaacaaaacagaaagcagaaaaaagaggcaaaaacaagaactgataaagctaataaaaattgcttagaaagttggtagatttatatccagcaatgtaaaaaatcatgttaaatgtgatctctttaaactcaccagttaaaagatagagattgtcagattgtataaaaactgagacacgactaatctataagaaatgactttaagacattgacaggttaaatataaatgaatgggaaaggtattctatgcaaacacccgtcaaatgaatactggatcaactatactgatgatagacaaagtaggctttaggacaagaaataatatcaaggataaagagagatattacacaatgaaaaagtaattatatcctaagttttaaaatgctaagtatatatacacataaagcatttcaaaatacataaatttaaagaatgacagactgaaaggggaaaaaatccacaattgtagtcaatgtcaatactcctttctcatagtcgacagaacaagtagatagaaaattagtgaggatatagcaaacctgaacaaaactatattaccagcttgaccaaattgacatttatagaacagcagaagatacattattttaaaatgcacaaggaaaattgaacaagatagatcatcttctgggtcataatagaagccttcagaaatttaaaagaaactgtattatcatataataatgtgattaaactagaaattacagaaatagatctgaaaaaaatttgaacaacacacttctacataacccataggttaataggaaatctcaaaggatattaaaaatattttaatgaatgaaaataaaataatttataaataaaaatatttaactgaatgaaaataaaatataacatatcaaaaatttgtggattgcagctaacatagtacttagagaaaaatttacagaattaaatgtttatattagaacagaagaagtgtttaaaattaatttatacttctaccctagaaaatagaaaaaaaagacctaattaaatccaaaaacaggagaaggaagaaaataataaagattagagaaaaaaatagtgaaattgaaaagagaaaaacaataaagaaaatcaataaaaccaaaagctgattatttgaaaataacaataaaattgatttatttttaagcagactgatcaagaaacatacaggacatacaaatattaccagcatcagcatgaaataacatacataatatccaacactatgcatgttaaaaagatagtaagcttatgatataagcaagtctatgcctgttaagttcaggaatttaaatgaaatgggccaagtccttgaaagacacaatctgccaaaaatcaattaaaaagaaatagatgacttgaatagccaatattggtcaagcaaagtgaatcatagttaaacatttgtaaaaatgaatattctaggctccaatgattttactagcaaattctaccaaacccttaaggataaaataatgctgattctatactacctcttccaaaaactaggagattagagaatacatttcaaatcatttcactagggcaaaattttccttatcctaaaagtagacaaagaccttacaacaaacaaaactgcatgccagtatgatttataaacatagaacaccaaatctttaatagaatattagcaaatggaatccaatatataaagaaatatataaaaatataatacttattaccaaccaaatgaggtatatctcaagatgcaaggctggtacaacattaaaaaatcaaccaatgtatttcactgtagtcacagactaaatattgttaagatggcaattctctctacttttatctatagattcaatgcaatccctatcaaaatctgtgcaagcttttttgctgatgtcaacatactgattctagactttatatagaaaatcaaaggaactacaagagctgaaataattttttaaaaagaacaaagttggagttctcagaatacttgatttccatacttactataaattagggtaatcaagactgtggttgtagcagaagaataagcctagagttaggcaaaggtttttcaagtagataccacaaaaaccactattaaagaaaaaacttgataaattggatttaattaagatcaaaaccttttactcttcaaaagatactgttaatagaacaaaaggcaagtcacaaattgggagagaatatttgcaaattacatttgtgacaatgaacttctatccaggagatacgtacatatatatgtatatacaacaatttatatacatatatatccgtacatatatgtatatataacaatatataacaatttatgtacatatatatgtatcctggatatgcatgtatatatgtgtatatgttgatatatatatatgtttttatatatacatatatatgacaatgaacttgtatccaggataaacatacatatacatgtatgtataaattttaaaacatatatatagaaacacaggtatatatgtatgtgtatatgtacatatatgtatatgtaattatatatgttatatagtcatatataaaaaatgactctgcaatttcaatacaaaaatgggcaaaagaagatagatgtccctaaaacttaaagtataataataataaaatttaaaaaaagaagatagatgtattgcaaataagcatatgaaaggatatgcagtatcatcagagcagagttacactgccacaagccaagaaatgcccaagattacctgcaaccaccagcaactgagagagaggcatggaacagtttctccctcaggtcctccagaactaaccaacccgatttcaggttccagtcttcatcactgtgagagaataaatttctgtttttttaagccaccaagtttgtggtgctttgttatggaagattcaggaaactaacacataacaaataaattattttgaaaaatgaggtgttttttgaagccatgttattgacactgtaatggagattaccttgccacaataatatagcaacctaatcccccgaggtctgctaaagctcttactaaccttagaaaaaattgtaaacaatagtctgaatactattttgtaaatatatatttatctttaaacaaggttacacaggctatttgataattcttgacagtcagaaatcaattcctattcaatgagttttcctaaatggaagaaaatgaatcatggaacccttactgggcataaagcttagaaagaatgtaaaggcagatggccctgtctgacattagctgtcatctttgcctccaaacagatgctaaggaagaagctgaaaacacattacagtgtctgacacagtgttagtctaagcatgtgcctaagatgctaatacaggttatgagaaaaggggcctcgtagccaaagttttgcaaattctaagctaaaaaaattaaaaatatttttcatgataggatatatgaggctcattagtgtgctgatatatatcgtgacacattagaacagaagacagcagactcttttccatgtttattttaccctagaatcttctgtgaagagagtttcatgaaactgagcctccatgaacccacttcaggggataagcaacttagaatattgcttctattgatgcgtcattgggtcaatttggaagggatggatctctccctatcctgtatacattttgtttattttccccctttctttctatttttaaccatctcacctttaaaaagatgttcctttgacccacaaattatttcccatctctactgtgtatactttaggatctaagatgtcctatttaatataaaatttaaaaaatcacattgagtagtcttttattcctgattcaccaaattactgctaccataatgctttatcttctaaatcatttctattttctttactgtttattggtgtggaaccataagaaacagctgatattcaacttatgaaagtggcaattccatatggttcaaccaaatacattaatgttattaaagagtcaacacagtttccaagatagttgatttatcaaagagccttaaccactgcaagaatttggcttaatgcttttataaataggctaggtggttgacaggtgagatcacttatgcttaaaaatgataccaagttgggcaagactgacaatattttgtagggccaggcaggaatgcaaaatgatgcagtcaatttgagggagtaatgtgtgctgaatagaatgaattcctaataaaatacttgcaaggttttggttataaaatagaataattaattttataaatgcaacagaaataggaacatttacatggactggtccacataaagagcagttttaaagtcacagccaatcacagattcaggctctgccaaacatgcccaaatgggcagcctccaagccattcatactgaccaaccatctggaccttatcccttggatttcagctaccatgttgaatcagatcaatgacttcatgtggcctatgaattttaggcatttagacatagtagtattgtcttgagtaatatatgtacactcttcctgtaacccattcaaaatctgctcaactttcaagggccagttaacagtcaaggaagtccagaaagtctctgctgttacgtctataggtcatagactttatcgctcagcttaactcaaggtgacaatcacttctggctgacaatcacatcagcttctttgtatattagccttgactttgaagtttgtacattctttgaggacaaggaccaagtactgcacatgttttgcacttctgtcagactaatgtgcaatcaataaaaacattagtaggcttcatcaagcaggacttaataacattactgatcacaacaatgaaaacaacatgcattaaagcaaaatgactattgagaacattaaagattgagaaatttatgtggaggcagatgaatatgaaacaaaatatatacgtattttatgtccatattactgaagttggtatttaatatatccataaatttcattacatgcttaattcgagttaacagtaaggccagtgtttagtttagtagagtttcatgtaagagtctttattcatggtttgtggtttaatgtgttatgtaaaatacagtaaactagaagtattttttcgttggacttttgtctcttaaatactgagatgctggatagaatggtttttcagtgctgaattttctgaccctgtgatttattaggctttttaatgtattatcctaatgtctttataaattaatgtttttataatttatcggttgactattgaaataaaattttcatattccattgcattttatataatagcattacccctcagccactgcgatatacatgagtttcaatttattatagctcagtcccaaatcaatgtcactgttaagagtatgtgttacagtagtggttatctttggaaaacaatttgagtctgactagatgttgttcaatccccaggccatggtaagtgtgactgtggcaagtgcaagtgtgaccagggatggtatggggatgcttgccagtacccaactaactgtgacttgacaaagaagaaaagtaaccaaatgtgcaagaattcacaagacatcatctgctctaatgcaggtaagaagtataccctgtgaaaattgttaagtggaataatcaaattttgtttttaatggaaatatgtgggcgtggagaaatgttgaatctcagagtgagtctgcttttgagtatgttttttagaagtgaaattcagataaatcaatagaaaaaaaatgccatcttgctgagactggcaagtttgatgctttccagctgttccaaatgcctccttctagcaggatattcactggaaacaacaccccaaccacattttatgtaaattgtgagccatgatattgaataccggattacatctgttaaaaaggatttatataaactgacttaattattttctgttacagatcacgggtgctttgaatttttaccttcgcaaaatagaaccaaatactttaaatttgatagaagtttcagatatactggttataaagctctttgaaggatacagtcacagaaagattttttgtttgatcaaaatattttttatttcatagaagttatttgaaaatattttttacaaaattgtagcaatgctgttaaaatttattagcaaaatcatataaaagagttgcagtttaggtttcaatggtatttagcgagtgttaccgtaattaaatattctttttacatttgggcaggtgaagcctcaaaatcagattttctcaaccgtggttgaacatcagcatcccaaggagaaaggaataaactgtcagttctcatgtagtacaccagaggttctgtttcaagtgctttggtgtgtggccttgacgttggtggtttttttaaagctctctgggtgattttaatatagatgagtgtgtgacccattgctctaaatgctaaaggtgaggatttgacttcacgaatgagtacctttcttcctgaagctcacattgttggtagggcccatctctaaccagagctgagaattccccacagtctgattgcaacagattgtgtgttttagactgagctcagttaaaggtgttttgctgataggaatcagaccatatccaaagcgaggtgtgagtggatccgtcaggggtcatgacaaatggtcttagcagttaggtccctttctgtgttcatgatgttctcatcatatttctctagcacttcagtctttctttcttcttagtaggatttctctacgtccaattcataacacccacccctccaaacacacacacacacacacacacacacacacacacacacacacacacttctctacttccaattcataacacccacccctccatacacacacacacacgcgcacgcgcgcgcatgccccatagcgtctttcatcttgaaaaaattattcttttcaaacttgtttcagtaacaagacttgaattctgttttgggtttgaaatctattttgggatttatttatttattgtttgcaaatcaaatttagggtttttttttagagaacattataatcaaatgtggtagtctaggattctaaagatgtttaatattaaggaatctaaacatgtaattcaccacattaacatatcttaaaggagaaaacatacagaagtgtttcagtagatgataaaacatatttgatacaatgtaaacgcatttctaggacatctgtactctctcattttttaagcatggatgcaatacctttgttcataacctgctttagtcaagggacccagtaatgtcctgtatagcgttttcctctccttacaggattcagactattgaaaatgttatgtttatatctctctttagtcttctttaatctgggtcatttccacagactttggctttagagcattgaaacttgtgaagaaagttgtccccattttattaaaagaaaagtgtacttatcttggatttgtctgatgtctcccccgccatgattagattcataatacatattcttaggtaaaacactagagaaatggttttgtgttctcaaaatgtttcatctggaagcacatgatgtccatctgctcatattggtgatgtcagttttgatgagctggtcaaggtgttggctggtgtcttaactgtgttatttctgacttaccctcttcacaaatgtgcattctatgaggaaatactttaaagccatacatgtatcacattcctcactaaaattaccccagatttaacatccgctgatgacaatcacctgacacagtattgacaatgatgactggaaaatgatgatttatgaactgtaacattctctctgaattgactagttggcactcagtattccaccacaaacaggaatcctcctctctcatttatcagttatttgttatttcatttacttagtgacttattatcagtctagaagcacaattcttattatttcattgatttgttattcattttgtacataattattctggtgcacagagttttccagattaggtattaaagcccatcaggctagcttttgtgtttttgtgacatgcctgccttttgtttttgttttttgttttgtttttgcaattctttacttgttggcataataacatattccagggtcatattggacctgcttcactgcacctttggaatcatccacttatccaaacagccctgattccttttagtgaaaatggtatttgaataaaaattgtgggcacagggatacttatttccactggagggtatttgcttcttggccctttctgcaaataggcttgtgtcaaaaaagtagattgaagcataatacaatttttattttatctgagcaaacaatgattcatgaatcaggcagctccaaatcagaagtgattcaggtgcttcattgagggaatgcaagtgggaggcttttatagggtgaacagaaaaagaaagcaaagaaaaatagttggttggctaatgttatatggttgccttatttagtctatcctgttggaaagtccctagttatataattataagtttgttggttgcttctgattggttaaacttaagttctgttcttctttaatgtagacatttataagaaataacttaagctaagtttcacttatttttgcctgtcaggcaaggttaggatcatttatgaggcctaactggcttagtctgctcaggggttctttaggccttgtctccattttaatttatcttgacactagtaaatatatgcctgtgcatatacacacaaatacatatacacatacttgcacacagatatgcatgtacacatacacatacatgcatattttagaaatcatgaatttacaccagtgcatctaattccagtccaacctcacaggattacttcttgttttctccattccatatttgcatgtcccattttcacagggagaaccctggctcccaataccaccaacatatttacttatttgctcaatcctatactacatctctagttacttctagaagtgctgcagacacaccactaaaccaagcaaatgtaccaaaagagattaggatttgcagtccacccctctccacttccccccactcactgtacctcaatcatgcccaagattggggtatgtagtcgaatgacgtgttcataagtcactcagacttattttattttcttctcttttagtgtggttatggtactcatttgaaatacaatttagcttatttatttcagatcactttcaattttaggttttataattccttcccatctgtattaatatattttataatgtatagtacactaacatgcttctaaaagtcataactatgcagaaaagtatactcagagaatcatccctctcttcctcaaaccttgcaccctgcttaccctcaccttatagataaccaactttattgctctcttccttctctgtgcatgtatttctttttgtgtaaagataaatagacatatttgtgtgttattatttctcatttttttcctgtgcaaatggttgtgctttcattccatgtgttcttttgcactctgcttttacgactcaacataatctcctggaattcactccaaatcagttcatagaaatccttctctttattttttcaaaagcacaggactggattctatgtatgcaatgtaatttattcaatcaagctcttatgcttgagcatttagacagtagtcagtattttggattgtaaataatagtgcacagaatgatctagtgcacatatatttttatatttttggaggtgtgtattcaaggcaaattaccagaaatgcaattggccaaaagatacatttatattcagtgttacatttaatcttttctgtctcatttactcttgtagaaatatctaagcctttcatgtttactttggcagtctcattctcacctgtctttcttttaatacccacttccaccctccgagttcaggaccatttcccccaaattgcattagcctatgaagtctctctattaatccttccctttcatatcacagtgtggttttctgaagtagtttggagcagaaggggaagaggagttaaatggattggggaatgagactgaagggcagaatgaggcagagctggggatcaaagtgttccagaggctaactttgtgggaaaagtagaagggaggtccagtgtgcagagcagggtgaggccccggcaccactgtacaggagtgtgggctggtgtacatgtctggtcagtcatcctagagagagtcagttctattgggcactatgaaaaatgagagctaaaaatcatcaagtgtaaggcagaagaccagtcctagaggctgagttaactggcaaccacgagagagaagctgtgtgtgtcatagcatgagcacaggagtctggagcttttgcctgggcgtccatatgccatgtcttggaggctccgttgtgaattctgctttatgggtgagacaggaagtctctgagctgttgtaaacttcccacatcagccgggaatgtttccgatgtgtggatgagagggagctgcctatgggggacttcagtgaggagtcatagaatttggaggcagaggctgttccttcccatctttcctgaaaaaacttcctcatacacagtcctaaccaagtgacttcctgctctcatattatatatgagaggcccatattatatatggttacatgtataatatttgtataggtttatatttgtagttataaaacaagaaaacatatgacacaaaggcttttgcaatagacttgtggcaaatgctatacaaaatgtattaatagggtatctcttcctggtctatgatttacttaattttaagcatctcattattttctatagcacttagttccttgcaaacaacataacagataacaagaaagcttaatggctggatatgtgggtggttgagagacaggatgaataaatgtgaaaatgaaaaagaagggtgataattagagaacaaaaactagatgaagcaatagcataaattatagcattagatttcaaattacttttatgaattgagttagcttttagggaaaaatgcaataaaatgaagtttaatgacaggaaaattcacatgagtatttgcaagatagaaaaataaattctgcaaaatcaccatttatatgtaactgtgagtgaaaaatttatagataatagtgacttgcaagtgatctgggtaacagaatcatgcagaggatatgaaaacaaggatattgtcagcatccataaatatattttctggagaaaatgtttgtaaatatgatgaatatactctatatcttaatgggagaagaggaagaacccaaattttctcaaatcctactatgtactaggtgcagcagtgcttctagaaacatgactgggtacatattcatcacttggtattggcagcagttctatgaagcagagattatttgcagatatggaatctgggaattagaaatgaaagcaatgcctttaaaaatgcatagctcatgaggattaaaactcggaattcagctacagctctaccttactcacaagttcattctctttctaatagatcacatatagatttgctaatatctagtaattcaaaccaaattagcaacagcttccttggttccttcccatccttcaccctttacactcagtcaccaaatgccctctactctttctcctaaaaatatccccagatgtatttgttccattctaaactcatcgcatcatgtgtctagccactgtcttctttcctgcagacaaatataacagccttttaactcatttctttgcatccacttttgcctcatttcagttcattcactcttatgctattgcttcatctagtttttgttacatgacaaccagagtaatctggtaaaaattcatacatgatcacaggactcccttgcttctatgtcttccaattatttttggattaaagctggaaatctttaacatgacctataagacttccatgaactgcacctcaggttgctttattcatttcatgccacttttcatgctgttctcatgtggtgtttttccttcacttccccttttattgcagagcctgtgctattgtctcatgctggaagtaagcctcttcaccatctcacttctcttagctatgctttttctcttggcttttagttctcagctacttcctcagggactctgactttgacctactggtctcagttaaatccccttgctatgtgcttctgcaacactttgcacttctgtatttattttatcacattggtttttgctcatataaaactctgagaggagggttatggctgacttgattcccgttggattttcagagtccagggtggtttcttgtgagagatcaagtctcagttgatacatggtgatggctgtgatgagcattaaaactcaaaatagataaattaacaaggaaatttctcaagtgggcattctacctctcaaaattgtttgagtgcaatattaatgttggtgaaattacatttgggggatgtggtagaatcttcagacttggatgagtatatggctcgtggtagaccagatgactaccatgcctctctaacgtggaggtcccctgagaatctggtgagttaccagcaatccatgcctaaggaaatccactcttgtcccattattgtaaggacatgtgtatcagtataagttaatgctgaggaggagaaattatcaggggcacatatgatttttatttatgcatttgataataaattatttccacaaatatttattatataaatagtatgttcaaacatagtgcaaaacattgaataaatactggtgaggaagataagcaaggttgcttccctcacaaagcttagaatttgctgctttatttcacttcagacccaggtgtaatcagaagacattcatgcattggttggatggctatatgtggagtagctctgcacttggagaggtcaaatttacattcattaaaccattagaggtcaataataatagttgtgtgatctaaaatataattgccatgctaaaataacctcaagaaagagtagcatgtgctttacctcaccatgcccacagaaatatctaattgaaatattaaattgatttggattatctactctcttgagagagatggtataaaaattcattaattataattttatgtgcatgtaacaaacagtcttttttgttttcatggtttaggtacatgtcactgtggcaggtgtaagtgtgataattcagatggaagtggacttgtgtatggtaaattttgtgagtgtgacgatagagaatgcatagacgatgaaacagaagaaatatgtggaggtatgtatattggctctgtagaaattaataaaagtacctgtttttttcacctatttcattgttcttttatctctacataagtttctgctctaggtgtgctaatgtagtttaaacctatgtttatctggaaaacatttcacataaggagagtgagactatggcattaagagtagactagtactttttagatgcaaagccaaattgtccccagaggagagctgtgtcattatggcaacaggccaactgcatagctctgaagtagtcctagtagaataccatctcctctgctcaccttagtcacttttattttcctttctcctactctcttaagtgtacattttcatttctttgtttttccctttctaaaacatgagtctcatgtcctatcagggacaatgaaggtcaatagggttattagcctagagtttacctccccctctctgtccctaaacacttaaataacattttcaatgaccttttctgtgtaccaccattactcaattcatttttctgttgtagcagttcttgcatgtttgctagtgacaaattctgcaataagtgctttacattcattatgttttgtctcacaacatcactctaggctaagaattatgtttatctacatagatagatgtggaacctgggacgtggataaattaggtaacgaacccagggtcagtccaccaataatagtagaatttgggctcgtgtctgtgtgatgccaaagtctatgttcctgatgcctcaccactcacgactgcatcagtgccttagagctcagagctccacaagaggagtctctcctcaccacttgcagttttcatctcttctgctcaacctgcaagcctgtgcccagagttcccatttgcaaccttgactggtgtaggaaaagaaaagtagaaagcagagagaatcatttggtttaggtaaatttttctctgctctgaacttatatttcactcctatctcatgggattccagttgaaggaagactgccctgcgtgcagaaatggtagttttagaagtattgtttttctggaaggactagggcccaatggggccacgtggaaccagagaaccctgagaaactgtggctagcataggacaagcttgttcttttgtttacatttcggtagcttcaattcctgtgagtcatccaaatacacttattttaggcctgattggccctccctccttgatctcctggctgtacaaactacctggataaaacaaacaaacacaaaaaccttattttcatttttccgagccaatgacctaagcaagatgctgctcagacaattctttcttaaagggctcagtccaaaataattagatcaattagacaaatccatccacaaatatatgtgtttgtcctcttgatgtttagtttccaattattatagatggaaaaaaaaaaaaagaagaagacgggaacatgctttggggccagtgtgtgttgataaacaccacaaaagcagagtctatttgcatgtatcaatagaaaaatgtaacttgaaacaacacaacagaaaatgtttaactttcaaactttctagttgttatttccatttgtttgaggcttaagcaatttcatggtgcaaagtctctgaacaaggacaccagcactgcagtaaacaccctctgggggtgacattgcctgggattgtaaatctttccatgtgtcattcacatgaaaccaatctgctgagagatgattccacagttcatcagtgaagtagtacaaatagacattttcttgctctatcagtttgcacaaagcaaagaattatgtttattgtctggaatatgtattgtcctaaagcacacattttaatctcaattattcagatgtgtcttgttcaatatttttatttgagttatgtggatatttgtttaattttccatacctgcatagacgtgtattgttacataatttttgcttccttatttacctctaactcaaaggtttcttagtaaaaccctaattcagtactgaattgtataaatattcaaagaatttggatgtgagaaatatagattttctatcatttattaatatagtaatccttacttatgttgcaccttctgtataaattttctgaaattacagagaaaataaattccgtagtctaaaaaggtgattgggtcgtacaaacctgactcctaagaaaagcaattaatatacactattgcttttttttcagtgtaatccttgagttcttgaggcctgtgatatatcactaggatgtgatttgtgtgtgcaagtagacaccattttaagttcataaataagatatatagatgatatattctgtactgattaaatcacttgacagcctttgcatttgcttaagtaaacaaatttaaaattcaaattcattgtggaaatggtcattgatttttaggttaacaagtgattttctttgaatatcccaattataacttatttagacagagaacatggcattgggtccctgtctctttctctgtgtctcactatagcactctttctgttcatctctctggctctgtctctcagatgtgtatcttcttgatggaagtctcatctgctggacatgaatagcgtaggataccagaatattctgttgtacttcttgcttcttatgtgagttttacaggtcctattaatgttcttgccattggccagaaataccatagtgttagaatgataaatatgcttataagacaatgaaaagtagtctcataatcagttttgcattgtcttttggggagtttggctgtaagagaagagagatggaaagaacaaagactttagccatagactgataaaacacaaactcctataatacagaaagaatagactaaaaacaaaacaagaacaaggacatacatttatacttaggtgatataactacaaagatgagagtataagaagtaaaatttgggataaatgccatctttggggaatttgcagaaggattgctaggtgtggatgaggaaagcaatggtgcgataattcactacagatggcttggaggcaagtgcagatgagcaggtaacaggttacagagaggtgggagctgaaagagggcatctggacacaaaatggtgagtgcccttacctgtcatttgtatccccttgacaagtagaaagggaatttgattgcgtggccaagggcccatggtattttgtttgtctaaatgaggattaaacatggactaggctgaaaacctctctttcacatggtggaacacaacagcttgtggggcacagttgagtgaaaagatgaaatatttattctgctttaaagagttgtttggtcattcataatgtctatctaggtaaatatgcaccattggtttctcaatagttgatttcaaatgaaatattttaataactaattcaagaaacgtccttagagtgaatgctcatatatatttgggtttgatgtgtgcatttgagatggaaaagtaatagactgtcatggtcattcatgtcatttctttaaaaatacttttaatcagttccctgtctaggccaagttaaaggacactttgctctttttgtatgattaagcaggtataggcacaaccatgatgtgtttggagaaagctgtataatttgattattttaggcaaggaatgtggagctgtgacagtatttcagaaggcaaaaatgatcacaaagagatagaaagttaattctgcttatgaaagttgcttttttcctcactgtataaaattcattttgggtaaaggccatgggaagtgttactgtggaaactgctactgcaaggctggttggcatggagataaatgtgaattccagtgcgatatcaccccctgggaaagcaagcgaagatgcacgtctccagatggcaaaatctgcagtaacagaggtgtgtcattcatacatgttactacataatggggaggcaaacaaagcttttaattgttaacacttcttttctttgtatttcctctagtgtgggaggaagttatcttctaaccatttactttgatgtaaatcaacatttactatcccaacaatcttttctgtcttgttttttattgagtagaaaagagaaagataagaaagttgctgtcattctttaagcttcactgaataaacagttaacttagggactgtaatttctttggcagccctccagacatagcacagtgcagctaaaaggcaattcctttagatacttctgttaaatgtctcttgactaacagaaccatctacagcatgagcatctaattatccgtagagaattcagaaaaccctcttgtcttaattatgagtatatggaaggcttggttgaaatgcagatttgatatggactaatttaacttccgtgtgcaataataaaaatttgatattgaatacaatagatatacaaagtatgtatccaatagccataggaaatgtacactgactttacaaaggaagttaacaaatatattaatattgctaaactataatttaaaggtagttaactaacttttgatgtaaaatcaaacagtttaaacatagttttaaaattccttgaaaatacttaattttccctttgctgtagtgataaagagagccatactaaagttttcattgcctatccaatggcattaaaaagtgattatacttctttaaaactaaaaaaatctagatagctggaaaactttttttcatttctatacatgaataatgcattgcaataggtaatgctaatacagaaatcgtagcataccacctgtcagaaattgacatagaggagtaaaatgtgccacatttctttacatagagaaaataaataaaaaggcaggaacttggaacaaaatcatgaagtcttcctttgtggggactaaatcttactatatatcatactaatttaccttatggtttctttttattatttattattattatactttaagttctagggtgcattgcacaacgtgcatgtttgttacatatgtatacatgtgccatgttggtgtgctgcacccattaacttatcatttacattaggtatatctcctaatgcttcccctccccactacccccacatcacaacaggccccagtgtgtgatgttctccttcctgtgtccaatgtgttttctgcataagtccttttatgcagtaggggtcacagtcacctttttaagtatatgaagcttgaactctggtactgtggaaaatgactatttggctgtcaaaaagagagaggtggaaaatggaattggttgggctgtggattaaggtcaggttctgcagcagagttacattggctgtgagagacgatgtccttcagaaacataagctaagccacctgcatcccacttcgctgtgcttggagcattctgacctggagctatggcagaggcagaatgggaagcagcttgcctgagcgaggctcacagcttctgagattcaggggtacttgaagacagggcagaagtgggcgctgagatgagtcatttttttttctcaaaagataatactcctgactaccctgaaagcatttctgcatcattgcatccataggtaatagaaacacactggtccctgcacatacctatcttgtcttcctttttccccatcttcaggggccaaaaaaccaatgttgcagacataagcattaatagaacaaatgtcctctattgcccatctgttttattgagtttcatagtggacccctttacacgtggctgagaagctgcttcttcgtcacatctgcatagctcctagtccctgttcctcctgaccaaactcatttatcctattatgagagcaatgcatattcattttttaaaatctagataataaagtagagtacacagaaaaataagaaagtgacccataaacctaacttccaggtgtaacctccttttacattttggtacatgagctttcagtccgtatttatttattaaaattcatttttatggctgccctatccctgtatttccttcttattaaagaaaaaaaatcaaatcatactgcacgtgctgatttgtaattttacagttttatttcatgatatatgttgtttatctttccatatttatggggcaaaaacctaatttattacttagtgattgctaggtagtccatatgtgtgtaccattactgcgctaattccccattgaacaatatttcggtcactagtaatttttcaaaaacataaatacaactatattttatatttctgaacatacacttgtgtgtactttttctttctgttgggtacattaattaaagtgagctataagtctgaataataacacagatataaaaagtacatattgcaaaatcgctacccagaaagttgtaccatttcgtactccccttcagggcaagaaagtacccattgtcccacacctttaccgagtctggatccaacaatattttccacctctgacgatctgacttctaaaataattgccaatcacgattattttgaagatctgccactgctacccacttagtagtggttgattgagtgataaacatttttcatctttatctgtcattatttctgtatgaaatttccttttgttctttccttttgtctatttcactttgggcatattaatcctttatatattcaattctatgatttatttatatgtttttgaaattgttctttgtcttttacagacatattaactacttgtttcagctttgtcagtcttttttttacagtgttttgtttccaaccaaaattttcaatttttatggaaattttcaatttccttttttagtaattgtgctttggggtcttgaataaaaagagtttagttcatattatacagttttattttgtacgtttaaatctttaatccaactggtacttattttgatgtaagaggtaagaaaaggatttaactttatgtctctatcaaatgattagctggttgccctaaagacagttactgataatccacacagagtaaacatgatgtacagctgggcatttccctctgcaaatctgcaaatgaccaagtttatgtctctcaatctgatctccaacattctctataatctgggctcatctgatctagcaaaccttacttcttagtcttttttattttttaacatgcacctcagggtccctatgcccatccctacccttctttgctcagtctttttttcttgactttctcttagttctacctccaatgtctcctagaacatttcctctaatccctatatatccaatccatccactgctaattactccaacactcattgatcctctttctccaaattcttagagcattcatgtcttagtttacaaaatatttgcacattgtttttagtgtttgttaatttttctttctaattagctttctatttgccaaatagattgcaagcttcttgggggaaaggattatatcttatataaattgttttagtgttatctttgaaggaaactaacataatactaatgacacattccaccaactcacataattatagaatagataataacttttgtttattaaggaatctctattatcaatattagatggtgtttttcctttttagaatatttttgtctgaatatatgtgtttttttcaaacacaaagtaaacagaaaataataagcgatatgtgaaatgctttctttcatggtttttcttgactggattcttataaaattcttcttcccacctagggacttgtgtatgtggtgaatgtacctgtcacgatgttgatccgactggggactggggagatattcatggggacacctgtgaatgtgatgagagggactgtagagctgtctatgaccgatattctgatgacttctgttcaggtaagggctcttccaattcctgtttttctggagggggaggtggggcttgttaatgggtaaaaaaaaaaaaaaagcaattagaaagaataaataagacatactgttggatagcacaatagggtgactatagtcaataacttaattgtacatttttaaataatgtaaagagtataattggattgtttgtaacacaaaggataaatgcttggaggggatggataccccattctccatgatgtacttatttcacattgcatgcccgtatcaaaacatcccatgtaccccataaacatatgcatctactatgtacccacaaaaatttaaaaagtaatgaataaaaaataaaaatgcatatttccctgttttcaagatttctgattctcacataccctgtaaaagaaactgaatgtgtattctaaagcatcttatatttgcagtgctcctactggtaacttggaaaacctccagagaattcccaaagttggcaaagactagagatgagagggcacccactcttttaaagttagtctaattcctcacccaggagaaccattagctctagatagctactcagttcaactctgagactacaaaactagcagagctgttgacaatgaacaggatagttatcattagggcacctatattaatgtattacaaaacaggataatacagtgctcagggttattttgtgcattaactctttgataggctttaatgttattctgcaatgtagtctgtaattaaatatcaattagtagattcaaaaatctttgactgtaaatactgtggggcagatactgtctgttagggactgagtgacatctgggctactggtgtagtaggagccagtaggggacaggagacagccatgaactttgacttcatggagtttgcaatctaaatgcaaataaataaaatatgtaagtccaggatgtctaatagtgcaaagaaaaagaaagcagtcagaagtctatctgaaaaggtatcatttagcaaaaatggagttatagattttcagtccagttctatttgataacccataaggtagacacatacacatatacatcttgctaagcttgactgcctcattggtgcatgcagatggatagaaactcctctggtctcctgaaagtttgccagcaaagggagataaaagaactgtcccatttaattatgagtgtgcaacttcaaaggcttctccagactgactggggaaagcctgctgctaaatcttcccattgcagaagggtttccctcttctgataatctcttgtgctccagaggatttcctaaacattttgtgaacactattctcttgagggtatttttttctattattaattatacatgctcatgttcttcattatcattgctgtcaacacagtggtaataaaagagctcatgactagtgagtggcttctgtgttccaaagagatgatgagaatagtggggaagaggcctgttggagattttaattaggatgatgtggctcttcacagtggtggtgatgtagggctcatgaattgcaggaggctattggatcacagtgcatgtgggttttatcctaaaaaaaataggcttgcaggtaaagaaagatgagaggggcattccaagcagaaggaacagagggatagaatctgtgtataggaccagactcagtttgaaattaccagaatgcagaattaaggaagcatgtggtaaaaggtaaagttggttgagaaacaagaactggggggctttttaccttcctgcagacccaggttttattctaaaggcaatgaggagctaatgatggttttaggcaatagagtgctgtcatcaccagatttctagtctgagtgtctgggaaaatgttggtgccatttactgaaatagggaatatggaaggaagctgtcaagtttgtttctagacatctccagcatagagggcaaagggtaagccaaagtttatattttttcccagcctgttgaatatgtgagtcagggtcagggttaaaccaagagaatttcaagttgtaagcatagagttggtggttaaaactatgctggcattcaggaaatgccatttgacaataccattttcttttttgagatggagtctccctctgttgcccaggctggagtgcagtggcatgatctcagctcactgcgagctccacctcccaggttcacaccattctcctgcctcagcctcccgagcagctggggctacaggtgcccaccaccacgcccggcttatttttttgtatttttagtagagaagggtttcactgtgttagccaggatggtctcaatctcctgaccttgtgatccgccagcctcggcctcccaaagtgctgggattacaggtgtgagccacctcccccggcggcaatgtcattttaagattgcttttgagataaacatgatttgacacaatttaaaataagaaaataagggaggcatataaaaggcagtattttaaaattgtaagtgtgtgacttgctgatatggagcccctttttcctatgggtattcactctcttgtgaaatccataattctgatgttgatcctgattttggactggggttgaaaaattcaaactaactacattatagcgataattcagggtcctgtgagccagtccatctcactgtgagggagtggggtcatggggtaaagatgggtgatcactcctgaactgacacttcaatcctcgtgtaagcttgtgtgcaattcccgcagcgtgtcatttagtcttggagtgcttactctaggctgagcaggtgaagtgtcattaaggaggctgcactggaatctaattttccacctcacctattcccctccaacccctcttccctgttttcctttttctcacattttcctttctttcataccctatgagattccacacagtgggtatggacaggtaggggtaggaagaggtgatggcacaattggctgtagtttgaacaagaaaacatcaatctattattgtgattttatgattcgctggttgaagtgaattgaacatggccagctttccacagcttggctcccacacttagaatgaggaattgaggaaagaggaagaaactcatatttacagagactctactctattggacccttgctgagttcttttataaacctcattccattttatgtacacactaactcagagagggaggcattattgtctatagtttagcagaagagaaaatacattcagagaaattaagtaacttgataaagttcacactgccataaaagtgtcatctgaaaacacatatagcctgactactcatgtaacttaatctccaggtgatgcaaatacaattctccagttttactttatttttctgaggaagaactgtcctctgggtactcagatttttttaaaataaaactaagcttctctgaacatcattacaatctggagcagacatcaacctctgcagtatttcatcattcttacagaatctgtagaattctatatactgtatggtattatgcttattagtctttaaatttttcctaattaacagtctaagttgcagtgtaagaagagtgccatatagttgattattgagtatattaatacctttgtgttatgagacagaagtaacccaatgacatcaatattctctagtctttcatgcaagactagaacataataaggctctgatgaaatgaacttttatttttagctcctattcttgccatcctgagagttttggtcttatttaagtccaagggaagtctctggacggattagtttaagttagctcttttaattgacattctcattttattcattcatttccattctctccatttatctgttcaataatgcatttaaatgtaaatattttatgcctaacacatcatgaatatagggaacacaaatatgttgaaacatggtccctgcacccaccaaataaatcaattttatttacttcttttaatcctgtctgttgttcatcatccacaaaatatgtgtgtttgtgtatgttcatttgcccatacaccaacatgactgttatactacacacatacacgcacccctcaaagacaatacggttgacacaatttgagtgtgactgaaatgatcagggcatgaatgggcatcctgacgtgtcccgactgtcctgtttgttacacccaatttactttctgattctaatataactgctttattcctaatggccgcttaccactcaggtctatttacccaaatcccataattggaaaaatacgctgcaatgtgaccttaaactttatcgttcagctttccctgcctaagaaaattatgaaaatatagggaaagttttggcttagagttacattagtttggaaaatggaatattttgatagaaccatattatgtggtgaaatttgtccctgtggattgtcaaagcattaagaaagaaactaaaggaaatgattaagtatatccagaccacattttcttgaaaggaaaaattaatatattgaatttaaaaaaaatagcaagtactacctagatctaagttattccccaaagcttttctctattgatggtcttcatgttactttgtaaacatgttaacagacgattcaaattcacaggcattttttgatcctttaaaaagaaagaagtatcctctaaagcagagaagtgtttgtctggaatagatgcaactgcacttgtgctgaaacacctgcacctgtttctggagtttggatagcataactccaaagaacacaatagttacaaataaacaagaaaaagtttagttaacaccctttcctataatggcctgagaaccttaataattcctgccttcccagcatggcctttggaccactcaatggctgctcttgctgcaaatcttccttttcgtatgggtattttgggctgcagtcatttttatggtaggtagattataccaacaccaagcactgtattcttccattgtgtgtgtgtgtgtgtgcatgtgtgtgtacatacagagagatctttagagagcatttctcttatttgaattcttctgatgttcgatatcaagacaaacagcaccatgccgaatctttcatctctatttcattgatcttctgcctacacagtttaaaggaatactggttagaagtaatgaaactaaaacctgcaggcttaacatacacataaatttgacaaaccagcatggaagcattgcatttcagatccatgtggcaaattgatctttttttagttctgtcatttgaaagataaagcaatttgagataaggcccagaaaagatagtggcacatcagatgaaggacacaagtctcctgatttcttcttttatgaccttttcactatttgtctattaaaaaaaaaaaaaaacctgatgtaatgttatggcagtctaaagggttttcatgctaaatagataccattatctctaaactcttctatatagcaaaacccaacattttcatcttcttgactttatctctaccaaatgattccttctttggcataacttttaaaattggaattgagaaactggtaaattcacaagaaaagttgcaattttgttttataattttctgtcttatctgaaaagcccaatacctgcctgagaatctggtaccaacacctgatatttctaagtgatttttaaactctaccagttaaatatcacaaaggattttgtaggacatgtacagtttcacttaaagtggtatctctaatattctaaaatatattttgacagcacatgactaacttcttgaaatatgtagtatataatttttattactgaaaaagcaaaagttatgtttctgtttcaactctgtcaattaatctgtaataaacatttaaattaggcaataccattgtcgatactatttttattatggtaggctagaattatagaaagtttatccatgcacttttatgcttgcttcttctatgatatacagtaagatatcttgtttagaaaattctactttccccaaacaataaaaccagttctactctccccagacaataaaaccatcaaacactttctgtgccactattttgtcacttaaactggtgaccatacattcgctgactttcaggaacttcattctttatggatggcttatgtatgtcactcatatttaaatacctcttctttccttagcttgaacttgttcaattaatatcaaatcctggtggtaaagcatagaagacatatcagtggatgatttgaggaggaacattggccatcttgaactaaacaatgttctcccactttgatactttcctgtttagggctaaggtcttttatccttcagccaatcacagcaatgatacaatctcttaaattcatcccaatgtgcaagcaattggctgcaggtgtgttattgagaagattattgaggagtcatcacacacatgccaaagtaaggacacatatatattcttcccagctttgcttatagttggcaatgcctggaggtgaagcacgcatttagaagcatgatcctggagaatgttcatgatgttgcattaagtacacaggaaaagaggtgtgggagcttataggctgtattttccccctcatgtttgtagaagagcatcagaaatagcaatgggatataaaaataaagctgcaataatagaattatgttaggggaaaaaggttgagagaattaaaaactgagaaaaataaaatgataagaaaacagaacgtgcctatgggagaataaaggtgaaagaccgccaaagatttcttcctgcaggtctagagcatctgaacttaaaaaacgaaaaattattaaggcttccacagctaatctggcttttgttactaattggataggattccaactttaaaaatctcttttgaataacttctgcctttaggatttgttttattctgccacatgtttttaaagatgtcaacatgtgaatggatttcagataggaaaaaatggttgcttttaaacatggattccgactatgcaacttaagaacgttctcccttcagtcgtgtgtctccctttgtacctgcctttatccccaaggtttctattttattttccctccccagggagggaatcctcctgtggggcacgtcactgcttgtgaattcaggtgggccttagtggcagatgacattctcttgggcagttagggacttcctgggtcccgcatcggctagatgtattgttctaaccttcacagccattaaactttcaagagtggagaaactttttctccctcttcaatctggttttcaatgttattgttaaagtgtcaacaagcaatgttattgttccagtgtcaacaagtctctcgcaaatgtcagcatgttctgtactttgcccagtttcctcacaacagatctgtcgctgaaataaaaccacttgtctccaagaatttcaaagccattggctcctgtgaaacaacagaattgactgtactttaaatgtgaaatatttatgtgttaaaatcattatttatataggcatttccaatgtagatctgtttgcaatgtttgtccttaaccttacatgagggctggaaataaagaaagataggaacttctttgttttgttttttttgagttggaatttccctgtgtcacacaggctggcgtgcagtggcacagtctcggctcactgcaacctccgcctcctgggttcaagcaattctcctgcctagcctcccaagtagctgaaactacaggcatttgccaccatgcccagctaatttttgtatttttagtagagatggggtttcaccatgttggccaggctggtcttgaactcctgaactcaggttatctacctgccttggccttccaaagtgctgggattatgggcgtgagtcaccacgtccgatgggaacttcttaaactgagatgaatgaatggcaaaagccatagaacccaacaacctatgaaatataattgttaataagcataaaccgttacaaaaattcccatactgtaaagtctaatcatattcatatgtcatgtatgtttattaataataacaattttcttttcctttcaactgaggtctagaacagataattatggcaacaatttgtcaaatagactctgttacatagcagatgatcaacaaatgagcatctgaattgaattgaatttgggattaaatgagagatttaaattcagtgatccctaatgtctcattccactttgatttatgattttgtgattttttttttactaaaaattagttaaatggtgaaaagcttctacatatgtgtattgtccagtttcttcaaattcagaagatggaaccgcaaacctcaaggaatattagtaaaatggtctagtctttactggaggccaattttcatattggatgatatacattaatatcagatgctaaagacagcatgcattttcatccattagcatttctatgtacttttaaaaagtgtaattccacttttaaaattcttcatgcatttttgcagcaattatagaaatctactttgttctatatctgcggtgatgagtagcttcatgtttattaggaattatggaaagctcagttgaaactgtgctttcctctacttgcttataatgtgggaactgatgaatacaaaaaccagtagctcctttttatgtagcttttaaactatttaatgtacttccgaagaaatgtggattgataatatattttcttcctttttaaaatgaagaaactgaaactcagatgtggtcatttgaccagccccactctgtaggaagcagaatcaggatttgaacccattattttattgataatgtaggtcgatttttgctaaaccacaccgtttctcacaattctttgcaaactgtatattcatgtgttgaaaaatttaatatcttttctgacttctttggaatacactaggctaatcttcaaggattgtaaactccatgtaggttactggttttactctaagggtctccaggctaaacatgtagtatttgcttaaaaagtgcatgaaaataaagtgtggagactccataagataacattctgcttcggtgaagtaaccaaaacagaaattaagaaaacaattttatctgcggtcgtgtcaaaaataatatacttaggaataaaattaaccaaggatgtgaaagattattgcaccaaaaactgtaaaacattgatgagagaaattgaagacacaaataaatggaaagatatctcatgatcatggatcagaaaaatgaatattgtcaaaatattcacactacctaaggtgatctacagattcgttgcaattcctatcaaaagtcccatgactgacacccaactgattttcaacaaaagtgctaagaacacacattggaaaaaagataatattttcaataaatggtgctggagaaattggatatccatatgcagaagaatgagattaaatcactacttctcatgatatacaaaaatcaactgaaaatgcattaaagtcttaaatgtaaaacccaaagctacaaaattactagaagaaaacataggatagtactttactgtgggcaagaatttttaaaataagacctcaaaagcaaagcaacaaaaacaaatagataaatggaaggacatcaaactgacaagcttttgatcaacaaaggaagcaactaaaagaatgacaaatagacctacataatgggagaaaatagttgcaaactatatatctgacaaaggattaatattaagaatacatagggaacttaacagcaagaaaacaacccaagtaaaaataggcaaaatacattaataaatattgctcaaaagaagacattcagatgtccaacaggtatatgaagatatgatcaagatcactaattgtcagggaaatgcaaatcaactccacagtgagatacctcttcactccagttagaatcggttttattatagaattataataaaaaaagacaaaagaaaacaaatgttggcaagggaggtagagaagagaacactgacacactgtgggtgaaaatgtaaattagtatagtcactatggaaaactgtatggaggttcctccaaaaattaaaaatagagctgtgatatgcatataattcagtaatttcactactagatatatatccaaaagaagtgaaatcaatatgtcaaagatatatctgtacccctttattgcagcactatttacagtagtcaagatatggaatcaacccaagtggccattaacagatgaatggataaaaaattgtggtatatatacacaatggataattctgccataaaaagaaagaaatcctgtcatttgcaacaatatgaatggaactggaggtcatcatgttaggttaaataaggcacagaaagaccttatttcaaaacctaaaaaattggaatctaaaaataaaattgaaatcatagaagcagagagtttaaaatgtggttaccagagacgggaggaggaagatgggaggatagggaaaggttggtctgtggtccaagttacaatcagatagcaggaataagttcaacttctattatacagtaggttgaggacagttaacagtaagatatggcatattataattagaaaataattagataagcttttgaatgcccttaccacaaatgataaatgcataaggtgatcatcatgtgaaataccctaatttgatcataatgcaacctatatatgtatcaaaacatctgattctaccccataaatatgtacatataataatttttaacctctcctagcatttttaatagtaataacaaaaaaatcttaaaattcacatggaaccacaatataccccaaataactaaagcaatcttcagcaagaacaaagctgaaggcaccatagctcttgatttcaaattatattacaaaactatagtaattaaaacagtatggtactaacacaaaaacagacacatagaccagtggaacagaatagacagcatagaaataaacccatacatttatagccaattgactttaaacaaagatgacaagaacacacaatagggaaaagacagtttattcgataaatggtgttgggacaactggatgtccacatgcagaagaaagaaattagagtcttatctcatactgtatataaaaatcaactcaaaatgaattaaagacttatatgtaaaacctgaaattttaaaactactcgaagaaacgtaggagaaaagctccatgccattggtcttagcaatgatttttttttggatataacaccagaacacagacaacaaaaacaaaaataaatgagtgggactgcattgaactaaaacgtttctacagcagcaaaggaaacaacagaaatgaaaaggcaacttctggaatgagagaaaatatttgcaaaccatatatccaataaggggttaatattcaaaatatatgagttctagtccatttttgcattgctacaaagaaatacctgaggctgggtaatttataaagaaaataaatttattttgggccaggcacatggtggctcatgcctgtaatcccagcactttgggaggccgaggtgggcaaatcagttgaggaaaggagttgtagacaagtttgaccaacatggtaaaaccccgtctctactaaaaatacaaaaattagccgggcgtgttgacgcacacctgtagtcccaactactggggagggtaagacatgagaatcacttgaacctgggagttggagattgcagtgaaccgagattgtgccactgcactccagcctgggcaatagagtgagactgtgtctcaaaaaagtaaataaataactaaaaccaaaaaaccaaaaacaggtctattttgactcacatttctgcagtctgtacaggaagcatgccaccagcttctgttcctggtgaggtctcaggaagcttctgatcatggctgaaagtggaggcagagctagtgcatcacatggcgagagagaggaagacagagggaacaaaagaggttgggaggaggcgccacactcttttaaacaatcagatcttacgtgaactaccagagcaggaactccctcatcagcaaaaggacagcattaagccattcattagggatctgcccccatagtcaaaacacctcccaccaggccccatctctagttttggggattgcatttccacgtgagatttggagaggacaaacgttgaaactatatctaactcatacaactcaatagcaaaaaaaatcaaacaaccagattaaaaaaatgggcaaatgacctgaatagacatttttccaaagaagatatgcaaatggccagtgggtatatgaaaaaagtgcttaacatcactaatagggaaatgcaaatcaaaaccacaatgaaatatgacctcacaactgttaggatggctgttatcaaaaagtcaaaagatagatgttggcagggttgtggagaaaaggaaaacttccatgttgttggtgaggatgtaaattgatacagccattatggacgatactatggagtttccttaaaaaatcaaaaagagaattatatgatctaggaatttctggatttatgtataaaggaaattaaatcactatcttgaagagctgtctgcactcccatggtcactgcagcattactcctaataaccaagatatgaaaacaacacaagtgtctgttgtaagatgaatgggtaaagaaaatgtgagatatatatctatatatgtaacatgatgttttgatatgcatatgcataatatgcatatatttacatatgtgtgtgtgtgtatatatatatatctatatatacacaaatacccagtggaatagtattcgtcctttaagaaggaaatcctttcatttgccacaacatggatgaacctggaggacattctgctaagtaaaataagccagacatagacaaaaaaacactgcacgatctcactcatatgtggaatctaaaaacgttgaactcttagaaatagagtagaagggtggttacccagggccaaggggtaggagaaatggggagactttgcatacaaactttcaaagttataagatgaatacgttctggagatctaatgtacagcatggttactatagtttgtaatactgtctacttgcattgtatgaggagagtacatcttagatattcccactgcacatagacacacacacaaagttaactgtgtgaggtgatggatatgtttattatcttggttgtggtaatcatttcacaatgcatatgcatatctaaacatcatgttacatactttaagaatctacaattttttggtcacttatacctcaataaatcttggggaagaaaagagcgacctcttctgaattctagatttcatgctttttgtcagttcatggcccccagtttgaccgtggttgtgagaccttaataaatagcgatccattaaatggttaatttaaaaaaatcctgctctgaataatattccattctttggatataccacagtttatttatccatagaggaatcttagatgcatattaccaactgaaaaaaaaactgaaaggactacatatactgtatgactccaactatataacattaaggaaaaggcaaaattatggaggacagtgaaaagatcaggttgtcagggattggggaaaggtgtgggagagggacggatgactaggcagatcacagagggttttcagggcagtgaaattactgtgtatgagtagtgaattcatgtcactatatgtttactcacactcatacaatgtacactaagagtggaccctaatgtcaactattcactttgggtaatagtgatgtgtcaatgtacgctcatcagttacagcaagtgtacttctctggtgggaattgttgataatggagaaggctatgcacgtgagggagaaggaggtatatggaatatctccgcatctctctcagttttgctgtgcacctaaaactgctctaaaaagaaaacagtcttaaaagaatatgtactctctctgatattgtttgttagcgtgctctataaatgttaattatgtctactgggctgttaatgtcaacttttctatatccatactgattttaatttcactaattgcattaattactgagaaaggagcgtttatatattaaaaagtagtctaaaaagcaaaaaaaaaaaaaaaaaaaaaatcctgcttcaaaaatacagttagtccttccctgtgactgccctccatgcaaattaattgccaaatccaccaaatactcctttccgttttttctttttttgttgttttttttgtttttttgttttttttgagacggagtctccctctgtcgctcaggctggagtgcagtggcatgaacttggcttgctgcaatgtctgcccccctgggttcaagtgactctcctgcctcagccccctaagtagctgggattacaggtgcacgccaccatgcctggctaattttcatatttttagtagagaccggggtttcaccatgttcgtcaggctggtctcaaactcctgacctcgtgatcttccctcctcgccctcccaaagtgctgggattatagacatgagccacagcgcccggcccaaatactcctttaaggccccagcaaaccaatacaatcacatgcacctggaatttgacagcttgaagtttatagccttactaaactgtttatcttatctgttgcttttctctacccctcaagatcaattcatataagtcagttatttaagaatttgagaaaaatgtgcgtttgccttaatatgttatattatgttcatcaagatcctgactcatttgtgacatttgctgttagaatgaaaactaattccaacttcattatctttatgtacatttttattttttgccactctcactgtgaaggtcatggacagtgtaattgcggaagatgtgactgcaaagcaggctggtatgggaagaagtgtgagcacccacagtcctgcacgctgtcagctgaggagagcatcaggaagtgccagggaagctcggatctgccttgctctgggaggggtaagtgaggtctctcagggcttcccacggcctctccatcacaattcaaatgaattcaatgcacacacatctttttgtttgtttgtttgttttttgttttctgctttttggtttttttgttttttatttttttattttattttttattattatattttaagttttagtgtacatgtgcgcaatgtgcaggtttgttacatatgtatacatgtgccatgatgatgtgctgcatgcattaactggtcatttagcattaggtatatctcctaatgctatccctccccgctgcccccaccacacaacagtccccagtgtgtgatgttccccttcctgtgaccatgtgttctcattgttcaattcccacctatgagtgagaatatgccgtgtttggttttttgtccttgcaatagtttgctgagaatgatggtttccagtttcatccatgtccctacaaaggacatgaactcatccttttttatggctgcacagtattccatgctgtatatgtgccatatttccttaatccagtctatcattgttggacatttgagttggttccaagtctttgctattgtgaatagtgccgcaataaacatacgtgtgcatgtgtctttatagcagcatgatttataatcccctgggtatatgcccagtaatgggatggctgagtcaaatggtatttctagttctagatccctgaggaattgtcacaccgacttccacaaaggttgaactagtttacagtcccaccaacagtgtaaaagtgttcctatttctccatatcatctccagcacctgttgtttcctgactttttaatgattgccattctaactggtgtgagatggtatctcattgtggttttgatttgcatttctctgatggccagtgatgatgagcattttttcatgtgtcttttggctgcataaatgtcttcttttgagaagtgtctgttcatatcctttgcccactttttgatggggttgtttgtttttttcttgtaaatttgtttgagttcattgtagattctggatattagccctttctcagatgagtaggttgcaaaaattttctcccattctgtaggttgcctgttcactctgatggtggtttcttttgctgtgcagaagctctttagtttaattagatcccatttgtcaattttgacttttgttgccattgcttttggtgttttagacatgaagtccttgcccatgcctatgtcctgaatggtattgcctaggttttcttctagggtttttatggttttaggtctgacatgtaagtctttaatccatcttgaattaatttttgtataaggtgtaaggaagggatccagtttcagctttctacatatggctagccagttttcccagcaccatttattaaatagggaatcctttccccatttcttctttttgtcaggtttgtcaaagatcaaatagttgtagatatgcggcattatttctgagggctctgttctgttccattgatctatatctctgttttggtaccagtaccatgctgttttggttactgtagccttgtagtatagtttgaagtcaggttgcgtgatgcctccagctttgttcttttggcttaggattgacttggcaatgtgggctcttttttggttccatatgaactttaaagtagttttttccaattctgtgaagaaagtcattggtagattgatggcgatggcattgaatctgtaaagtaccttgggcagtatggccattttcacgatattgattcttcctatccatgagcatggaatgttctttcatttgtttgtatgctcttttatttcattgagcagtggtttgtagttctccttgaagaggtccttcacatcccttgtaagttggattgctaggtattttattctctttgaagcaattgtgaatgggagttcactcatgatttggctctctgtttgtctgttgttggtgtataagaatgcttgtgatttttgcacattgattttgtatcctgagactttgctgaagttgcctatcagcttaaggagattttgggctgagacaatggggttttctagatatacaatcatgtcatctgcaaacagggacaatttgacttcctcttttcctaattgaatgccgtttattcccttctcctgcctgattgccctggccagaacttccaacactatgttgaataggagtggtgagagagggcatccctgtcttgtgccagttttcaaagggaatgcttccagtttttgtccattcagtatgatattggctgtgggtttgtcatagatagctcttattattttgagatacatcccatcaatacctaatttattgagagtttttagcatgaagggttgttgaattttgtcaaaggccttttctgcatgtattgagataatcatgtgatttttgtctttggttctgtttatatgctggattacagttattgatttgcatatgttgtaccagccttgcatcccagggatgaagcccacttgatcatagtggataagctttttgatgtgttgctggtttcggtttgccagtatttgattgaggatttttgcattgatgttcatcagggatattggtctaaaattctctttttttgttgtgtctctgccaggctttggtatcaggatgatgctgacctcataaaatgagttagggaggattccctctttttctattgattggaatagtttcagaaggaatggtaccagctcctccttgtacctctggtagaattcggctgtgaatccatctagtcgtggactgtgtttggttggtaagctattattgcctcaatttcagagcctgttattggtctattcagagattcaacttcttcctggtttagtcttgggagagtgtatgtgttgaggaaatttatccatttcttctagattttctagtttatttgcgtagaggtgtttatagtattctctgatggtagtttgtatttctgtgggattggtggtgatatcccctttgtcattttttattgagtctatttgattcttctctcttttcttctttattagtcttgctaccggtctatcaattttgttgaacttttcaaaaaaccagctcctggattcattgattttttgaagggttttttgtgtctctatttccttcagttctgctctgatcttagttatttcctgctttctgctagcttttgagtgtgtttgctcttgcttctctagttcttttaattgtgatgttaggttgtcaattttagatctttcctgctttctcttgtgggcatttagtgctataaatttccctctacacactgctttgaatgtgtcccagagattctggtatgttgtgtctttgttctcattggtttcaaagaacatctttatttcttccttcatttcgttatgtacccagtattcattcaggagcaggttgttctgtttccatgtagttgagtggttttgagtgagtttcttaatcctgagttctagtttgattgcactgtggtctgagagacagtttgatataatttctgttcttttacatttgctgaggagtgctttacttccaagtatgtggtcaattttggaataggtgtggtctggaatgcacacacatcttaatttaaaaaacagctgagatccctgaatgaggggctattagtctttttagaactaataataaatccaatttccatgaatgaaagtacatggagaaatatgattctctttctctctttatatatatcttttgcacacagacactctcactcactgtcagcctactttagccttaaggtatgttcaatttcagttcagttcagttcaatgttacattaaaaaacacagtttagacgtttgcttaaagttttctgaatgagaccatctaattgtccactgacatttatgaaacccagtaacattattttgaggacagtgttggcttttgaaaattcattgtataaacaaatagctatgaataagcttttgtcatttgagaaggaaggcatgtagcctcaggtgtgttcttggtatcagatcagtacaaattggagaaggacaaattcatctagaagaacacgtgttccattcctcttgatttatcaaaataagaaatgcaatttcacttcccacatgagaataacaaagttaatatgaaatatgcttttgaagaagtcgtaattgacattattaccaattttgttcaagaaaggaaacaaagactttcttcacttgaacattagatcagaaatttaattttatgttgcgtttttcttttttaaaaaatatatgttaatagagatataattcacataccacaaaattcacataccactcagtattttgatatattaacataattatgcagccatcaccactgtccaattccaaaaaaaaagtttatcatcataaaataccctgttaccctatagcagccactccccattctcttgtcccagaacccctggaaaccaccaatctactttgtctctatggacttgtctattctgagtattccatacaaatggaatcataaaatatgtgatcttctcgcatctggcttttttcacttagcataagtgtttgcaaggtttatcaaagttgtagcatatgtcagtccttcattgctttttatggctgaataatatcctgttgtatggatacaccaccgttatttaacccttcatcagttaatgggcatttggacataggatttctactttttggtcgttatgaataatgctgctacaaacattcctgtgcgactttttgggtggacatgtcttttaatttctttggggtctgtatctgtgagtggaattgctgggtcatagagtgactctgttttaccttttgaggtagcacaggaccgtcttcaaaatgacagtaccattttacattccaccagcagcgtgtggagtttccagtttgtccacatccttgccatttcttggtattgtctgtctttttgattctttagagtattctttataaagaaaactccagaaagtgtctcaggttgtttgcagcacagatattttctcatatccattattttcccctaagggttgtaagtagaagagtggaggagtaggatatgggtataataatctttttaatgtcaaaagtatttttgactagccctgtatttcaccagtaaccccagacaggaaccattgttctatctgcattggaatattgtcattatagtgctgcataagccatcatgcttttaaagtaacaaagattaaaattcatatccctcagactgcttagttaccaacacttgtaatctacagcaaaaaataattttacattattattttacatttacacaaagctttatctgttgggcccagacatgtaaaaaaaatgaccataggaaggctaaccactgtctcttttttaaaaaaaatgtgtgtgtattttcaaaaatgtattataatcctagggacaattccatttcaaattaaaaaccttgggaagtaaagaaaatgacttcatctcaaaaatagatttttgatcttgaggatactttttcagttacatttaagttagagaactttaggtacagtgatttttactgttatcttaaagtggtaaacaaagcaaagggtgatctgatatcttaaaacattatttaaagggtttacatttggtaaaattatttaaactccaaatggttatgttgctagtagaagtaaacagaacagaaaccaatagggatatgcacttatattttaaaacaaagaaatgaacaaaatgtatacttttaacaaatgcttttatattttgaagttaaaaatgtcaaaccatataatagaaagataagaaaagcatacaaaatagctctcaaacagagaaaatcactgtaagtatatacttatagcaatggtttttcatttgtctctaaattttttaatatgtagaacaagtaaaatgaaattattggggacttaatatattgatcttttataaactccactaggtttttcctcaaacatgcatgtttcctgtctttctggagattcactaacttatttagctaccattttttaagcaatagagtatgtttaaactttattttattaaaaaggtgttgagtaaatgtatagaattatgatttttaaaattgtttataattcatttcagcctcttgaagtactttaaaactaaataagcttcatcagtttccttacatgagcaaagtaattttgcagggaatcatgacagtatgtaagatttttgaaaacgaaaaccaagaatttatgacagccagttgagtgcctttggtcaaggtcacggaccctttctttctcatagtgctacatctgcaaacacattggtactggatgttttgaagcaaatgaccagtatgaaaacttgtaaagagttcgttttgcaatttatgaatgaaaactgcagctgtggttacatgagttaggaaagcaattataagacccatcagtttctcaatcctgacagccgccatcacctcaccagctggaaaaaaaaatcctagaagaatatactgaagtttgtcagggaccaggtgaaggcaatatatatatatatatatatatatatatatatatatatatatacacacacacacacatatatatgtgcatatatgtgtgtatatatacgcatgtatatatgtgtacatgtgtatatgtatatatacatatatgcgtacatgtgtatatgtatatatacatatatgcgtatatgtgtatatgtatatatacatatacgcatatatgtgtatatgtgtatatgtgtatatacatatatgcgtatatgtgtatatgtgtatatatgtatatgtgtaaatatacatgtgtatatgtgtatatatacatatgtgtgtgtatatgcgtatatatgcacatatagacataggcatgtgtgtatatgcgtatatatacacatatagacataggcatgtgtgtatatgcgtatatatacacatatagacataggcatgtgtgtatatgcgtatatatacacatatataggcatgtatatatgcatatgcgtatatatatatacacatatctagacatgtatgtgtgcatatgcgtatatatacacatatatgggcatgtatgtgtgtatatgcgtatatatacacatatatagacatgtatatgcgtatatatacacatatatagacatatgtatatgcgtatatatacacatatatagacatgtatatgcgtatacacatatagacatatgtatatgcgtatatatacacgtatttagacatatgtatatgcgtatatatacacgtatttagacacgtacgtgtgtatatgcgtatatatatacacgtatgtagacatgtatgtgtgtatgcgtatgcacgtatgtagacatgtatgtgtttatgcgtatacacgtatgtagacttatgtatgtgcgtatatgcgtgtacacgtatgtagacatatgtatgtgcgtatatgtgtgtacacgtgtgtaggcatatgtatgtgcgtatatgtactcgtgtgtagacatgtatgtgcatatgtgtatatatatgcatatacatatgtatgtgtgtatatgtgtatatatacacatatatagacatgtatgcgtgcatgtgtatatgtacacatatatagacatatgtatgcgtgtatgtgtatatatacacatatacacatatatatgcatatatgtgtatatatatgtgtatatatacacatatatatgtatatatgttatatagcatatatatgatataaggctatccttgtatatatatgtgatatatatatatgctatatatatatatatgctctctctctctctatatatatatatagccttcacgtggtccctgatatacttcagtatattctattaggatttttatatatatatatatatagccttatatcatatatatatgatatatgtatcagaaattaagttaaatttctaatttcttatttctgctggtggtgactaagtgtgatcattatgtcttgaaggtagaataacttagatgatgtcttacattctgtatcctgtgattccttgatttctataccatattggctgtagatatattttcatgtaactagatgtagctcatatagccattataggtataaagacattcgtcctaatttcggttcctgggagtaaaggtgggaaaacactttctctagtctcctagtgttgtgctcaaaaactataatggcttatggtaggctaaacgttagttttacattcttcctgattaaagaatacatcattattattatcgatgttctcctgagcatcagtttgactttggtttaaaaaaatgtgagtaaagttaatttgcatcacatctgagcagaagctataagaagcagtgaaaaatctgccattgtctcaggcaggaggatttgcagtgctggagatcgtctctgacccattagcttggctctctgaatgaggatgggcaggagaaacctctattaatccaccaaggttctatgatgtgaatgagaaagaaacacctgttgttttaaacaagtgagattttggagggaggtgttcttgcaggagaatccctgactgataatcggttccccatataaaatgtagggaatgtggttaagccaagataaacaaacacagcaaaaatcatgtttacataatttatattttgtattatatacataatttataaatgccataatttatattcttgtagcaggattcatgtacaaatctcttagtattgattcttggatatggaatacataggtctaaaaaaaccatgcatatattttataaatgatgtgtttatgctcttctgtcaacagcatttatgtgcactttgtcaacaggtaaaatgataagaacattgaatacatttttaaaaatttcctaaaaacacaatgaggtaggaagacgtataattattattctttttacagaagaagaaattagatatctgaacagtttgccattttacataattgcaatggtgcaagtttaaaaaaaattaatacatgttctctgactccaaggttgttgttttggataacttacaggttcttgttacatgccaatttattggacaatatatattaaacatatttcctgttacaaatataattctgcagaataattgaaatggctgcataatattccattatatagttgtagcaaaataattcaatcaatcctctttttattagatatctatatgttcttttattcaagttctaaatgccataatttatattcttgcagcaggattcatgtacaaatctcttagtattaattcttggatatggaatacataggtttaaatgaaaaaaaataagttaaatattttgaagaaaaaagtccaatttataatctctaaaataaattatacaggtgtgctctcctgccgggggcttaagaaaagtcttcttcccccaccactagtgacaatttaaattatcagttagctcttctcaatgtatattgctgttggtgttacaaacttttgccatttatcaaacttctttcattgacttctataatcatcaaaacgaatgatttatctgcaggcattattattcagaggcttgtgttttcagtatttgccttctttgatcatcgtttgtccttgtgtctaagtcatcctttcatttgatactgcaatcccatgtgcttttcttatctgtcctgtttgccctttggttttcttttatcagacttgttctatgcggtattgcatatgttttagttccttaaacacataaccatacacccccataagggaaggtgtgaaatgggggaagaatgatagatggaggctaattatttaatattgtaacttctagaaaatagaaaccatgtcctcatttttatcaattagcatgctttaattaatgaattaagaattgtttcaattcccttacctaggaacatactttcaaagaatagtagcatgccaaattctcaccatctggatatttttcaatgaagtcacaatttatctttcctttttattgggaaagcccatctttaatttcctgttttatttttcagagaagttttcatgatacatgctttctttcctttttttttttctttttgacctgtgtgttttttactctatgtaattttggacagctgaatcattacctttcttattcatgtttacagagagtttatttatttggaacaaagagaaagtttaaaaatttggaagttctccaaacattttcagttaagcagcataccatatacagtgattatgattatattttaaaatcctttgtggcttaactaaccatcttatcataagtttgctgctgcaggaaatgtgctgagtgtttaggtaacaagggaacccccaatgtgttcttccagtagtactttgagaaagcaagtgggattcagatttaccctattctgtgctttctgctagattgattcattatttctgccagtgctagaggaccctggaatagtcatgaactgagttatgccatttgaaacctagtttttataaactatagccaaagatgataaataaatgaccctgcaaaattaacttatttactatttcttatccaagaggaatggtcctgcttttagtgtgcatcaaatagggagaaatataaatgaattggtgagttttttcagaaggaaaggcctggactttgtcatgttatggacattaaatgacaagaataagcctgcataccaccagggagtcttccatgcacctttgatcatgctttgaactgacaatgcccactattatgggttgtatatgctctattaccatgcaatagcccataatagtaatattatatgtagaaatagaagagcctgtttatcatttgctttctttatactcattatgatatcttaaactgtatatgcatcatacatttcagaacatgtcgggaatgtaattgttatttattatgaggttattaaggatagtactgatatgagaagactgagatggagggagaattaaatagggtgcttctggtatcctttatctatctttatgatgcacttggatttctgtgttgggacattgtgtattctcatagagatagccaaaggtgcaggtgctcagaatagtcatctacttgaaggtcctagttaaatccagtattaaatctctcagtcatatgatgaagcagcatttactaagctaatgacataatctgcatatgtgaaaagaaattattaaagggaatggaaaagagccttgttaaatagaagagacgatctcattcaggttgatttttcagagattcccctttgcagtaggtatttatgttccttatttctcctcttgtgtttgatcttgcctttcatcttgctattgttatattcaacagaacagagagaaaagaagaatccagaagctgaatttaatacttttgtttatttttaagagatggtagaaaataattcagtggaaaataataaacataatatattttaattaactgaggtttttctaactaatagtccagaaaactgtattactaccaagtaagagagagtatttttttcctgttctaaataaacaatctttatctatggcaacagaacagtttgtatcaaagataggaattgatccaaataaatagacaagtttcattacattttgcattatttttatgttgtaagttgaaaaccagtgaaattctttggctaagataacttcctagtaaagactgcaaccagtattgtcaaaatgtatttgaaatgaaaatagaaaattggacttgaatttaattccaatttctccaggcaagcttaaaataaatgtgacagttatgaaaattttgttactatgattatatatttatttctattaaaatactaaaattatagtgcagattgtagtggagagctttagcagttatttacctgatttcattcaatataaacaggcaaaccagatacttttatgggaaacaatttgctctggttatcagccataatcttcatagaatcagcctcaacagatgttctttctaatagaaaaccaatgaggcacagtgttatccctttgtgtagcctgtagagtcacatagctgatcagaacctgcgatgcccctcttaggatacacaaaacttaatagggctggtcattgtgctatagttgcaaaacgaatgcagatactctacactcacagcatacagacaacatgtacatcatattttcataaacgatgttgcttatcataatcaatctaatatttattgatcttaccaccatgtatctctgggctaagctagtggtcagaaaactagggttaggcctacattctctttttgtaaataaagttttattagatcattgccatgctcatttgtttacgtatagctactttcttgctgtaatggcaaagttgagtagtggccacagagagcacagggcccacaaagcctgaaatatttctcatgcagccccttacagaaaaaacctgctacccctgagctaagcatttgtgataattgtgacaaatatgtcgggagaagggattgagtgtcttgagaatcagaggaagatgacatttgctcaatttgtgtgcaaatatggcttcatgaaatgagtgaacctagtgggtatctgcagagatgagtagtagcattaggcagataataatttagaacaaaaataaaaggacatcccaggtaggaggaagagcagggacagaaactctgagttatgatgggaataatgtgtaaagaacaggaagcatactcacttgtgatgatttagaaaaaataagaaaatggtgggagacagcctggggggaaatatgtctctccctcccacctaacttcttcttgtgtgattgacaggtttcagacagaaaaatccacttctttgcagagctctctatgtcataattgtcttatgaggttaattgttagtaaaatgatgtcatagaaatgccaagttaacgttgcttcatgcccatccattgggtcattgctaaaatgccaagttttatttaactgaatttagcgagattcaagtttttccatgaacaagacaaatactttaacatcctttcatgtgcccttctgcacctcgtatcatgtttacttaactactgacagaagatgagaaaacaagcacaaatccaaaattgttttattcgaaggcatttatatcagcaaagtattaaaatgacaactgtcagcagtcagatttgtattttgagaatgagattactattatctagatattgggtatgtatatagatgcctacatgtttaaaatgggaaagggtcacgttgcacagttagttgaacagtaagctactgggatagaggtgggcagaccctgagttagtctgggttcagtcactagccagctgtgtgacccagcaagtcatacactgaactggcagcagaacccttctcggtgaccttgaacttagctccataagcttgcattgcctccctttaacctctctttgcaataagtgaatttgacactgtgttctgactcatccggacccctagattttatatctactcaaatggacaccatgcctgtcatttctgacataccttcatagcagactttgtgtctggttttgcaaagctaactagacagactaagatctgactaactacgtctcatgagaatcatgtgactaacccatcgttctttcagactctgctttctaccaagagtctgcttgggattcaaactaatatattcttcagttatggcattctttcctttggaatataacaatttaagatggatgagattttggttctccataaatatttatttttcatgtgttgcctactatttggataaaggcaaaaaggcaagattctttggcttcctatttaagtttataaataattttggcctctttgatgctcaaaatattcatgccatgtggatgttggtaaataataccaaatggcctggcatggtacagttgtaagctgcttaagatttggatggtctctagggtgaaacagcaaatattttgaggtcatgtataaagtcctttataaagatgtgaactcttttgccaagatttctttgcagagccctgtattgtataatagttaaccaaaggaagttaaaaggaatgtgaaaaacataagaaaatatggagtatgtagtgcctggtaaagtctctcctactgcttcctttaatttgctggaagtctgggtatggttaatgatactgttgaattacagttgcaatggtgagagagaattgtaaaactcaccctcttgagtgtagcttaatgtaattataaaaaaaaaggtggtagcaaaatccaagtgacataatttatgcttgagtctagatatattctggataactctacatagagaggaaaacccagagggattgcagtttttaggttaggcttcttagtaaataagattttggatgtgttaggaggcctggagtcttgtgaccacacaagggtatgacagggtgagcacagggcgacactattcacccctgctcatctattcatcagtgatactctcctcttcactggcaaggtccctggaaacactattaacaggcatcagtttcttgttcgggtagaaagacacacatgctgccaacaccgtgccttccctcagcgtccgtagcttatcaaaacagccaggctccaactgtgagggcgtgtgctctgagggggcagggatggaagagatggccacgtggctgcatgacaccctcatagagctgatgtctcacaccacttattattaatgtgactttgtagagttttgtatttttaaaaaaactttttggacccttaactttgttatctataaaaatggcattagaacaattgctgtttactctgaaatgttgttgtgagagacccttgaaacagtatatatgaaacttctttgttaactttaatatacaattttacgggcttacaaggttttaagtagatggcataaaaatgacctccagggcatacgatttaatagagaaaacaaggtcaacgttcattcattcattcattcattcacccagtcaacatatatttaccagggtcctcctgtgttcccagaaccactctcagtgctgagaaaaaatagacaaggcaacggatgtcatagagtttgggaaaataagttaaaccagaaaacaaataatttcagatactcctatgagaagggaaatcaagagaatataagagagtggccaagatgaagtctgggggctgctgtaagtacggagggcagggaccctctcccaggaagtcatatttggccagattggagtattgaaagtgggccacatgacaactcagggaagatggcagaggaaacaggaaaacaatttcagactcaagggataaagttttctggaaggagatgtaagtcaggtgggcttcatcctttaaaaaaatcatggaggagatgagggcacttggagagcttgcagaagtatttttaaaataccagtgctgagttcccacccgacttgatttgtctgcaatatggcctgggcgtccgggattttaaaagctccctgggtgactctgctgagcagccacatgaagactcaccactctgcagggttgtataacaggcacggtcctgcagcaggaggatggacactttagtttttgccctacttcccactgagcaaacagggctttagggagtgcttaaaagttgcacaaaacttattgctctgtggtgtcctttcccaaagctttgttgaatagggataggagggaaaggaatgagtcagggacaagaggggtgggtgggtcgggtaggggtgtagagagaaatacagagaggagatcttgaacaatgaaccaccttaggcacgtttgaataccggcagcatacaggacaatgattatttgttctatatgaaagataattggctgaatagatagaattgtcaaagagtccagaaaaggggctttgtcagaaatgcattttgggttttcgccatagataatttctgctttgaaaaataatatggaggaatgtatttagccactctttttcctagaatagccatggtgatatttaataataaaatattatttagttctgttaccacaacagtactaattgttttccatgttgtcttttttcccatgcatattttcttatgtgttgaggagaggcattcctcaggattatattttccttgttaatgaaactaagaattttgtggatgagtctgtgtaggtgcagtttgagcacattttccattattaaatcaaagaactgaccagcgaatccatatcagctccctacaatctgttcccagcccagccttcctgcttggtccgctgctaagctggctccttgtctgctttgtccccaggtttttgtttgggctttcgcagctacggtgagaggcgacacttctgagaagtgaggcgcatgctcaggggagcaatgagccaaggcgagtttagcagtaaaaccattgcatgttgtccagagagaggctcctcaggaccaatgctgggagatagcccagagagagttaggctgtcctcagatgctccccagaaacccttcatttgcatagtgcttcttttgaagagcccgattttgaaacaccacttctgtcttagctgcaggtgaccccttgtgatccacattggaggtataccccaaccctgccctcaggttagattcctagggctgcaaaaacaaatgaccacatatttgatggctgaaaacaacagaaatttattcccacagctctggagatcagaaatttgaaattgaaaaatgtcaggatccctcccaaggatctaggagagaatccttccttgctgtttctaacttgtggcttttggcgttccttggcttgtgactgcatcactccctgctctgcctctctcttcacatggctatcttacctgcctctctgtgtgtccaagctcccttctcctttctcccataagcacaatagtcttcggacttagggcccaccctaaatccaggatgattcagctctagtctttaattatatctgcaaagaccctatttccaaatgaggtgacaccctggggtcctaggtggacatgaattttgaggaacactattcaactgattataccctcttaggggaaatcaagcccgcttctaccagagatatttattcagaaaataaatgtcttatccaccatatactactttatttgctgatttgtgcacattactttggcctgaatgtttgtgcccttcttaaaaattacatgttgaaacctagccccaaagttgatgatattagaaggtggggtctttgggaggtgattaggtcatgagggtggagtcctcatgaaagggaatggtgctcttacaaaagagaccccagagtgtggtagtacatgcctgtagtcccagctactcaggaggctaaggtgggaggatttcttgagcccaagagtttgaagctgcagtgagccatgatggcaccactgcaattcagccgggaagacagagaccatgtctctaaaagtaattataataataataaaataataaataaataacaaaagagaccccagaaagctagcttgacaattccaccatgtgaggacacagtgagaaggtgccatctatgtgtaggaagcaggctctcgctagacactgcatcttccggtggcttgatcttggacttcccagactccagagctgcaaagcatagatatctgttgtttatgagctactcatctatggtatattttatagcagctcaaatggactaagacaagtatcaaagttcaattagatacagcgtaaaaaagaaagagaaaaacataaatcattgcagtagaatgtagtaaatgctctgacggagatatttgaggtgctctctaccagcaaaattaagagggtgagggaggtcttgaatggtcagaagtttgctcctggagaaagggggaagaatatgtccaagacaggaaatcccatcacgaagcacagaaagatgaaaggatatgataagttcaggtaattgtttcatccagcttatgtatatccaaggtaggatgggagtctttatttgtaagtagatctccagtgtgaatatgaagtattttggcttaaattctgggggtataaatctgtttcataaaactttccttctgtggtataagttgctcagaactctgagatcggctttctgccttcatagctagttttctttctttttctttttataattgtttattttttttaaatggagtctcactgttgcccaggctggagtgcagtggcgctatctcagctcactccagcctccgcctcccaggttgaagcgattctcctgcctcagtctcctaagtagctaggattacaggcatgcaccaccatgcccggctaatttttgtatttttagtagagatggggtttcaccacattggccaggctgttctcaaactcctgacttcaagcgatctacccacctcgacctcccaaagtgctgggattacaggtgtgagccgctgcaggcagccgatagctagttttctgagaggtactctctgatgtgcttccttggccagaataatctgcattgtaatgagggagttggggaatcccatatccagggactcttagcctggaattcatgcaaccccagaggatggttaggtatcagacaatgagaacaccttaaaatggcacaaatatattgtgtttaccttttaatatttttgtgcagaaggagtccatagcttctttggctagattataaaagggctccataatatcaacaaaggtggcagtgatttagacatctctgcataaaatcaaacaaagacttttagctgtcacaatatattattttgagctacatatgctttaactaggtactgtattgtttactaagtaaattagtaaattattcaaaaggtagtcaaacatagaagtaccttgtgatatccagttttatttatagtttttgattctgcttttaaaaaattggaataaaaaggtagaccaagccccaaattattttactataagtcataagaatttgtcactgaagtttcttttaaggataattggtaacaagcagaagttcaagcagagaaaagaattcctctcctgttttactctcagaagacagtgatctttgttctataattccttaggttttagtgtgtatccatgagaaggatctctattctgattaatgtggaagcactggatgctcatatgagtacaacctggcatcctagaaataataggaatacagaaacaagaagagaaataattttaatttctatgctaatcaagtttcatttgaaagtcttttaagcagactcatctcattatataaaaatacagtcttttattaaaactatagaaatttaataaaaaatataattgatgttttgcatttcctacatgactctaacctaatatttagccagtttatagactggctaaatcaaccttcagccgtattattactgttttaactttggctagtgaatatccatatgaatcttgtgaatgtgtgggatatggctaaattgtcaaagacaatttcagtgtggcagagcacccagaacctgaggagacagtagtgaagaagtattaatggatcatgaagcagtagtaacagtggtttgttgatattgaatgatccagggcctacctcctgggcttagaacaatttttttcactatatattcatgtacttaatcattcactcaatgtgattagttacattggcaatataaggtaactagagaatcttcctagtattcactttagtgaaataatttgggttgctgctatttacctcttacatatgctgcttatagattctggttgaatccacggactttgtttctatgctattaactagctacatggggggaaattatgtttagtgagaatatttgctattatttgttcaacataggcaatagattaggaaagtgttaaagaagacatggttgatgcctactatagatcaaagacttagcaacaaaaagctatggtgttgctggtaccagatcacactttgcagcaatctccagtttgggacatataaagagttgttcttcgttttctatgtcctgaaagaattctagcttcctttattacgttttaaaatcctttgtcattagttatagtgctgagcatataagaaaactatacagcatctattttaattaaaagaccttagatgaaagtggcagaatcccaattcaaacaaccagaaacaaataaatgatttatgtgctcacaaaccaaaaaggacaggggtacagatgacctttgggaagaatggtaaagggacttagacaacctcccacagactctctcactctttcactttctgtatcacacctacacccgtgtacatacgcatgcacatgggttgacgcaacagcctccaacacacacgtttctgcttttatcagccctttaatctgaatcttgtctactgcagatggatttttctccatacaggaggaacatggattttagcatcgtctaaggttatagttttactatgctctgaccaagaaagattaaaggcttttccttagcagtttaagggagaaaaaaaatattcagggggaaaactcagattgactttgcttggatgaaatggtcaggtttgaaccaatcactgatgatagagggatggtagcgttctaaatttgggtcaccactgggggcaggtgggaattggggcaacgagatgtgagactgtaagactttaaggagtccttctgagcagaccacagttttcactagatacaactgcattcaggttgatattgatcttgagtatcattgattacgtgtacagccttcttaatgtaacaaagatgatacatagcttattttcagacttataaccaaatgacagcacaacaggacaaaataattcattgatgattgtggtaggtagaatactgcccccatcaaagacacccctgtaatcccttgaatctgtgaatatgttagattacatggcaaaagggacttatgattgctaatcaaaagattatactagatcatctgggtgtgcccaatacaatcacaagggcccttacaagtggacatgggaaagaaagagtcagaatcaagtgattcaacatgagaaggactcaacctaccactactgcctttgaagatggagaaaggggaccaagagccaaagaatgcagcctgtctctaaaagcttgaaaaggccaggaaagagatcctaaagcctccagaaggaatgtagtcttgacgacaccttgatttgagcccagccaaaccattttagacttctgatctccagaactgtaagacaataaatgtgtattgtttttaggcataaagtttgtggtaatttgttattgtaggaccaggaaatgaatacagtgatctttggacatattctttggcatagtcaacagaatatacatcagaagctgtttctgaattatgtattcccatgtattttgaaaagcttttttacaaaaaatctgaaaaagaattatgtataaaagattatttcctttactgagagtatctcaactataggcataaacatagattagttgagatatgattttcttcttggcttttttcttgctttgtcttaaaatgaaaccagtcctcttataactttttccaaagcacaactttatagcttactcgttgcacctatttgaagtcttacaatttattccatgttgtaatataatcttggtatattgtttttaatgattacacattaacatattttaaccaagcataatatgcattatattccgtcgtttaatcaatttttctatttaaatggcccatgaacataattacaatattttaatattatggcctaaattgttttactatttttacattgtaattctacattgcaatttgggatgcatgtctttgtctaacgtagataagtagattcacattttgcagggtttacattttgggagtcctttttaataaaatgaattcaaaatcaaaagtacaaagttagttaaggtgaatactaacttaggatgaaaaggcaatcagcacaaattacatttttatatcagacagataccataaacctcacaaatctagaatatgatgtaattataattttacacatctgttgtaagtggctctgtatatttcaaaacttgttcattctcaacttcttaaatgtgggctgagcattataggatgcatacaattttattatttgatctctcgtcttaaattgtcatgacccaagagggctacagcagtatttctagaaggcatttctataccctgaaaagccacagaagtgatggtaccccactaatagcaaaatgaatgtgtcctcaacccaccttctctttggctgaatctcagaagtacctggagtctttccagagccactggacatgagaggaaatgtggatgagtcaaagttagaatagaaggagagtcagtcatcttacttcactcaaaatttcttattttggaaaaatttaaaacacgtatgtcatctattgtcatggtccttctcagtgccagagactcccaccagtgaggaaatctaaagaatagttgctgttagttccatggtaaatgtgcctgtctctttgatgattgatactgaacaactgcacctggggctgtacccaaagtggagaacagtgagtttctgtgtcgtgactgtcattgaccttccacctttcctctccaaaagaataagaagcaaatcaattgtgaagatggagcaggtgctgtgattcagcctttctttatatcaccagacaaggtgaagccttcctgggtttatcatggtctcccaaaggactgttgacacctttgtacctacgcagctttctgctgcttgatgctaatatcatacacgttcttctgaaatattaacaggaaaatatctgtttgaataaatagctttgtacaagtgtatgtctccatcccaggcatccttccactccctgggtgtgtatggaattagaaacatgtaccacttcatcagctttcaaacacattttttaaaatctggaagtgtatagcctggggcctcagtgtttctatttctgtttatttgtcatacagagtgttgcttctcacctgaaccccttgcagacattccagcaaaatgaaaacatgaccttgagccttagtttcacagtccatgaaaagctcaacttttattatagaaattcagggttagagcccttcttttttttctcccacttaaaaagggataaagaaactaacccacccagattgctgctaagcctaacatgagctttgcatagccattgaaaaaggttcccacactctagaatttttattccaccttttaaaatgctcttgtccatctcttctgaagactttggagacaggagatttttcagtcttaatgcattgaaatgaagataatacaaaaagaaagctttttcaaaatttttagtctcaaaaagtcttctcttgggaaaaggcagacctttatcttagtcaaaagggaatgagactgttggcaatgacaaattaaagtttgaggggataattgaaataaggaaatggaaaagtatggctgattatccccaaagcctggatcagacaaggaaataagccagaggcagcatagatttgagtgaagatgtgcaccctcaggtcaagagctgaggctggttgggagcaaagaaaaataatagaaagaaagaaatgggaggaaatgttttaatacatttaagatagtggaatataaataagcaggcaggggtttctatttctatttattgtgtttcctttgcctgcacagagtgttgattgacttcacctttctccgtatccagaaatccatctatgtgattaaacttttgttcttaaacaaggcttctaatattagatggaagatttaatgaataatagtagttaacattaagtgagtacttatagagttctaggcactgttctaaatgtttgacttatgtcatttaataatctcatcaacctcatgatgatggtagtatcatgattatccctacacagctagtaataacaccagcgtctctgtctatataaatttaatcattcctatttccatcaataccaattcagtctaggttcttgcttttgcccttctctctgtctagaataaccactgacaccttgtaagcctgaaaaaaatgcaacctcacatgtagctgtgatcacattttcctccatattccagctaaaccggtgcgcacttttagttttgtatttgccgtttactataattatttgttggtgttggtctctctgactccatgagtagtgttgattttctttgtatttctaaaacctagaatctagcaaacatttgactgaataaagaataatgattgactgtgaaacaaatgactacatgagcgcacagatggatccagtgtttttttcttttaaataaatgatcatgtaccagtaattacagaactggttctaaacatggattcttatgtagttagagatccatgaatagaaaatctttatttaatttaatacgaggcctctagcctagtattcagttagttctaggttccccagcactgatctggaagggaaaagaaaattgaatctgaaatgaggctgggatgtgtgtgtggggtatgtatgtgtgtgtgtgtgtgtgtgtgtgtgtgttttcctgtagttgtgacttaatatcaaagacaattgcagataatatgagaacttttcattatttatgcttgttttctctaattgagattagattatattttgcagataaacaatttgaattcgttaataacgtgatttttgaaaatcactgacgcttgttaatgttaactaggataaatattattctctatttaaattgtgtgttttgatctttccctttaaaaataatttactacaaattttaaaatattaaatattaatatgataatgcaatccgaggtttataatttagcttgatcccatgacagagtaagctaatgttaactatataatcaacaacttgtaaaaaatgttcagagattacctcttaaggcccacagtaataaaactatctacacttttctctaaaagtcataaaaatgtttgtgaaataaaatcaagtttcatatctttgtgtactgaaattagtttcttattcctacccaattatctaacatacaattgtcattttgttatgagatacatacacttctcattacacatggagaagcattatgtcattatttttataaaaggctgataaatacagttgttccttcatgtatggctcccatacagattcctggtaagatgattctataaaattatataactcaaatctcctgttgactttcatctgaggacaggcagtgggttcaccgtgagtcactgtagttcaaagatgtaaagaaatctgttgtaatcacacttaaccttcgcagagcacaaatttaaagggagactcatgatttaaaagtggacaattaacaaatgacctttctccttcacattaggtgagatcatcagggcagtgtggtaagtagtctgactgtagaatattttaaaggaatgaaagtttttttgggtataccttctggccttctgggcctgtttttggccttctggccctgttttaaatcccatttttaaaaaccctattgcttaaaacagctaaaagaacaaattttgtaagcattccattagactggctaaacatctccccccacccagtttacaatgtatacaatctcttatattcatgtggcttagtgatttgtacaggatgacctaaagccaccaggattcctggagatatgcttagatgtttactaggttgctttggagagtgagaagaaatctgggcttgttgagctttacctaccctacctactgctttctctgggcaaattcacttacatatgttttatttagcatggatctgttaatactttcatttggaatgaaatgtttctgccggtttctttctgttcttgtgcaaatgtgaaaactattgctttagcgaaagcaaacaccgttacttcctgaatcacagctccctccaaaccactcctctccagataaacatttatgttttatgccccaataactacacttccttttattttccctgctctgagccttgaagtgttcacctgaaagcattttaaaatagtctgtaattccaaaggaaatgaagtaattgtccatggaagggaggtgaggactcaggatacagattgacctggggttgctcatgaattgagaccaaaagaaaaacagaggtagaataaaatgaaagggagaagagctcagtgaacatctgtgctttctctttgccgagtcctgacacagcgctcactacccctctgcattttatccctgtcaccatttggagaatcaggcaggaaggcccagcatcagggatttcctctcccttcaaattctggtccctgcaaccagctggagccacccacagattccctttgttgatgagtgcttccggaaggtgaaggagaacctccccatcagggggctgcaatgttccaaactgcagcatcattcatgacgtggctaacatttaccttcattttcgtagggggtggagaaaggtatttttttatagtaataaaatacaatctgtgaattctgccatataccaaattaaaagaggttttgcggtacagctttccatggagacaaggaacaggtaattattcagagataatgcttctgaaacagaacattgtcagtatataatggttccctgccggtagataaatgcagaggcaaagacagcatatttattttttaaagcaagagacattcagtgatgcaattgcaactcttgaaattacctttcctgttttaccagatgaaaggttgtagatttaatcatcatgcctgatggagcactggtgtcacaaagtgacagaaataagcccagtgacagcagccctgctgtgtacagattgacttagtaaacactcttggcacagactttagccgttgaggaacttcttagttataaatgggtggattctccatatagctgctcaaattctaaattcattatattcctgccagttaagccttcgtatgtctttgctttgccaatgaaaactcagccggccaggaacaaatcatatacagacttaatttgaattcaagggatgatattgcttcttctgtaggttaagggttgcagtggtagctcgatagttgtgtaactacactgcactgcaagggctcatcaggtcccactcagtattttatttctaataatagtaatggctaatttttttttttgagatgaagtttcactcttgttgcccaggctggagtacaattgcacgatctaggctcaccgcaacctctgtctcctgggttcaagcgattctcctgctttagcctcctgagtagctgggaatacaggagcctgccatcatgcccagctaattttttgtatttttagtagagacggggtttcatcacgttggccaggcttgtctttaactcctgacctcaggtgatccacccacctcggcctcccaaagttctgggattacaggcgtgagccaccgcacccggccagtaatggctaattttattgagcatttaatgatgcgttagacactgttctaaagactgcacatgtatttttcatcaaccctataatgtatttttaaaatgcggtagatttctcttttacccagggagaaaggagaacttaagggaatggcttggatctgatcacatggctaataaatggtagaacttcgactcattgagttgatgggcctcttaaccattgtacctttgctattcaaagtgtggtttgtagactaacggtatcagcatcaaattgtatttcagatacaacttcagacccagttaatcagaatttgcattctaaagagatcccaggtgatttgtagtcttcatagacagtgtctacaaacttttctggaatgcttttgctattttaaaatgaagatcactaccacccatggatttttatagcctttctcatcatctttgatctattaagcactttgaaaattacactacaatttaatggcacagaaaagaatgagttttgtggacattttaattttagaaaaatgtcattgtaagtgaataacaattttctccgaaataagcagcttaccttagaagttagcttgggactgattgatgtgagtccccgagagatagcccttttgctgaatcagacagatctttcatctatctctaaaaagtaccatctactccaggaaacctggcagtttctactacctttatctgcattgctttgcttgtgacagtcctttgcatatatgatggcctttttcagtgctttctaaagctatttttaatacaaatgaaggatttgaatttaaattaaaatccagctgcacacattattattaaagataatttcgttgtggagaaaatctaatcagtagatatttttattgatgttaatgtgccaattctcagacaataggagtacatctttttttataaagaaatcattttaaaattgatcctaatttcagaaaccttaaaatatgaaaacaacattttagagttaagggtttagctaattaaatgttttccaaatttaatcttagtgtttcttcaatagggagacactggtatatcttaaaaagagccctggactaggaggcagaagatctgagtgaaatcctgattcagacacttataggctgtatgactttgcgtaggtcatttaaccttttggagactccttcatcttgtctgcaaataaagataaaacacgagaattaaataaggattgaaacttgcggttttctgtttcactcatttctgtaacaggtttcatgttttactttcattttcactgcttctcaaagtgtagtctgagttataagattcctctttcatgtaatttttttttatatttcttacaagtttttttggaattatgaccacagaccatagcttgtagaaaacatgtgatatttcaatgctttttgtaatacactttattttttagtgcacttttaagttcacagtaatactgaacagaaagtacagggagatcccatatactccctgccctcacccatgcatggcctcccctgtcatcatcccccaccccaccacagtaggtctattggttacaagtcaggaacctacatttacacagcactatcccccaaagtaattattataatttaccttaggattaactcttggtattgtattttctatgtgtttggtaaattttataatgacacgtacccaccatgacagtaacatatagagtagtttcactgccctacaaatcccctgtgctccacctgttcacccctctctccctacaacccctggcaagcacggatctttttactgtcaccatagttttgcattttccagagtgtcatacagtgtgtaggcttttcagattggtttctttcacttacgaatatgcacttaagttttttaagtgtgttttgatggcttgagagctcacttctttttattgctgagtaatactgccttgtctgaatgtaccactgtttatttaaccattcacctactgaaggacgtcttggttgcttccaagtttcggcaattataatgtagctgctgtaaacgttggtttgcaggttttcatgtggacattaagttttcagttcctttgggtaaataacaaggagtgtgattgctggatcatatagtatgtttagttcagtaagaaactgctgaactgtcttccaaagaggctgtagcattttgcattcccaccagcaatgaatgaaagtctgtgttttctccacatccttgccagtgttgggtgttttcagtgttctggatttgagccattctaacaagcgtatagtggtatttcatcgttttaatttgcatttgcctgatgacaatatataatatgaaacatctttttatgtacttgtttgccatctgtatgttttctttaataaggcatctgttaagatctttgggccatttttaaattgtttttctcttattgttgagttttaggagttatttgtatattttaagtaacagaactttatcagatatgtcttttgcaaatattttctccttgtctatgacttatctttttgttctcttgatatttcttttcttttctttttctttttctttttttttttttaagacaaagtctcgctctgtcacccaggctggagtgcagtggcatgatctcagctcactgcaacctctgcctcctgggttcaagcaattctcctgcctcagcctcccgagtagctgggactacaggcgtgcaccaccatacccagctaattttttttttttttgtatttttagtagagactgtgtttcaccatgttgtccaggatggtcttgatctcttgacctcgtgatccacccaccttggcctcccaaagtgctgggattacaggcgtgagccaccacacccagccctctcttgatatttcaatgctttttacatgatctagtatatgatggatatctctatttttcataaatgttctgtggatagtttagagaaggttgattagagtaagaggcaaagttgacatattaaataaattatccttattaattattttgttctgagttatataatactgcttagactttctcataatagtaatcaacttctcatctgtttctaacagtttttatgtcatatatattgataatgagtgatattgaccaaaaattcatgacttcacatattccttaacattcaaattatagaaaaagaaaatcatatgacctttttgttttgtttagttgttttgtgttaaattctgctgagtctgaaatttaggctaccatgccgtttttctatatgcttgataaatctttgacaaccctttacattttattcttcttcattcctttgagtcagatttgtcactttggggcagcatacactttgatttatgattttgttaattttttacctaatctacaaatctttgctgtaagagagtagggattaaaatatttgagtttactatcataattgacatatttgattttattcctgccaacttattttatcctttcttcataccatttttaattttgtgtcttctttcaattattttataaaatacactgcatacagtttaatgcccaatcctttgaaaataaatatatatttttatttatcctaatggttaccttatattattttaaaaacattgtcagtattcattttatatcaaggtctcaaatttaatggtgtcatttgttcttcatctatttaaaatgaaagatatagcattttttcaattttcctcccatctttactcactggaaattattagtataaactttgctttttataactaggtaaataaaattttaactattttatagtgcttctgttttaatcattaattttgatatttccattgagttgtataaccgtatttatagtggtccttaaatccgactactataggaattgattaacgtaatatagacagccccattttccaattctcccatattttgagcccatttatttatttattcatttattttttgaaatagagtcttgttctgtcacccaggctggagtgcagtgacacaacctcggctcactgcaacctctgcatccaaggttcaagcaattctcctgcctcagcctcctgagtagctgggattacaggtgcctgccaccacgcccggctcattttttgtatttttagtagagacggggtttcatcatgttggccaggctggtcttgaactcctgaccttgtgatccacccacattggcctcccaaagtgctgggattacaagcttgagccaccgcgcctggccttatttatttttttgttaaaatttcaaagtaaattttgaaagaattttatttggacaatttgttttctaaaaccttgaatacctaagattactttttctattgccctaaccatgaacacagtttacctttgttatttaaaataagtattgtcattcaatatttattttgaaaataaaataaatgacaaatcattcaatattttgaatgacaatattttctttctctctaaatgctccatttttgctgttttaattgtaagaaatctgatcctttgtaggtggtctacatgtatttctcacttgtatatttaaattctttcatgatgtgaatctcttaattgatctacccacagagcatggtaagttgtttctaacttcacattgagacctggttttaggtacaaaatgtatacttcaatggtttcttcaacgtcacatctggtactgttgcacttgatttttcttagagaagacccataactcctagattggatagttctacatctatcatcatcttccagtgattttcccttattcatttcctatgcatttttgaaatacttttcagtttgtattccaaatcattgttagatctcccctggtaagtgctgatctgcattgttttcaatggcaaatttaattttacaagtgtacttttattttctttgttgttatctctttcttacctgctcccttgtaatcttagttgcctctctgtctctgtatggcatttttgttattgtttaattggagctatatcttttactgcaatcagtaaagataaagacttcttttagtgtttctgctaaaataattttgaagcatgtgttctgaattcgacttgtcgctttgctggttctgtagctctatcttatgctccaactgatcagacatatgttgatcactctgtcctcttcttggagatgttcagcacttgttggttagttaaagactctgatatatcctgcagtaagaaaagtctttaactctgtccaaccaatatttcctgaaattaattgatcctggaacttttctccccatgaaacaccttacagagctactgtttcatgaaatcatatttgatcgcaaatggttaaaaatatgtcgtcttatagttagtaaatatcttggggaattctttcactgctatgattatacactaatattcatcttcaccttaaggataatttatttgattttctatttaattgcagtttctttacaaatgaaaagaaattgtgatgcagtttcccagtgatttttttttttgcaatgtaaaaatgatttgtagatgttaagtctatatctcatagttctttaaatgaggaggaaaggcatttaatgagtttgtatagacacattttcagatacccacacagagaaactgcagaagagaagtgcaaacacatttacactgtcctactaccatagatgatgttgaaattttgcaagggattactaaaagatgtcaaatgagctaactataggatgtgaagtcatgtttttgcctacatttgctaattgaagaactgtgtgtgagagaggttattgtaaagtgtcaatgactcattttttgtgtatcatgaaaattttgctccattattttatagctacatagaatatgaaaagatatttacacaaaagtatctgaaaaatgaaagtcaagagggtctccacagctacagctagttgccaaggcaagttaatgagtaaaggaaacattttaaacaaatggtactagaacaataatataaatgtttgaaaaagaatgaatggacctcttccacacagtatatacaaccgaatgtaaaagtctaaactagaatctagaagaaaataggaaacaatttgttttgaccttgggttgatgaagatttatatacggtacacaaaaaaaagcaaaaactataaaaattgattgaatttcttataattaaaacaataaacttggcttatcaaaacacactcttaggagaatgaaaaagaaagtcacacatggataaaatattctctctctctctctctctctatatatatatatatctgacaataagctatacctaaaatatataaaccacttttattactaaataatacaaaggtaaacaacccaactacataggaaaaggactttatcagatgttacaaaagaaggtatatgcttggctagtaatcacttggaaaggtgctcaatatcatcatcagggaaatataaattaaaaccccaatgagttatccctgcacaaccactagaatggagaaaattaaagagcctgaaaagcaccaatatgttggttaggctgtaaagcccagaactctcatacattgctgttgggagtataaaatggaacacctgctttggagaaagtgcacacctactctgtgacctagcaatgtcacataggtgttaacccaagagaaatgtctgcaaacaatatgtattggtaagtgaaccaccacttaccaattattccattcataaaatggaatattactcaataataaagaggaataaattactgataaagacaacaatatggatttatttatatagcttgtattttatctccattcatcaaaaatctctacttaatttgggtgaaagatacacattttctttctttacctgagtttttcttgaaagagactatcaggtttacaagtttagaagtaagaatgttagtcttctaaaacatcacttcagtagaggagaacttttgagtcacagactaagtctagccttcagtttaatttcacctgatgatattgctttgatcagataatgattgtgaatggcaaagcagaggttctcaaaccttaatgtgcatggggatccgctggagtttcagatttagctggactggaatgaagcctgagatttctcatttctcccaagttcccaggtgatgctggcactgctggtccaggatagatgagtgctctggataatgaactttctgttggaattggaagggctgaaaagaatgtattttcacaatttgtatttcaaagagtacatggatatcagagcgtggtgaagcctgccctttcaggcatatcacagttgggaccaccgtctgagttcattttaagccattttaggcacctccataatgaatgtatctacttttgccccaaattgaccgttttcctttctacttgacctgttgacctgaggagaagcaatagtgaaatgatgaactagattaagaagggtatgcatattgttttgtatcttctaattgacctggcgttgacaatttcaaaaagtgtatgagttcttaagccatctcgttgatttactgaaataggttgaatgctgtggtggcttcatgactgtgcccagttcttccatccatgcatgttgccctgtgacttctattgctgtgaaactcatgtgagttgtcagccaaaaaaaccaagtggaatgtgagtctgacagttctgagcagaagctttgagagcctcccgtggcttctcagcctttttgctttttcccttctgcagtaagaatggcacgtcacagatagtgactgatctttcggccaaagtaagaaaaatacgtgaagagttgcagctgacatgtaacctgagcaagaaataaataattgttgtatctcagtgagactttggggttattattgtggcaaaatctagaaaaaatccacaaatagtctatatctcatacctggtgtcaggtattgggataggctgattatgtattttatttgtattagtcatcacaataatggttacataatttttctcaaatcataggggagaaaataaggtttacagagagttgacatcactaattctgggaaaagatttatttcaaatgtactgtggtgtgatgatgcataaaattatgaaatatgactaagattttgtacaaatataatgagaaaagttatcaatagtactagtttaaccttttaattataatattctaatcaatgggcagaattaatgcaattatagacaatagcagaaactccttttcactagaattggctttctcattcaaattcaatcgaatatatttttaagaactgaaagcaaaatgttccagttaaaaatttctactctgcaaaacttggagtacaatttaattagctttcttggagtaaatgaactgagattttgatctttgaaagtggaagatgatagactccaatggggagatgaccttagcctagttaagaaatgtttagtcaagtaagtcaacatgataatgtaacagatcattggtattttggttgctaatgaggcagaaaatgaaagcttcataggagacataataaaggccttgatatccaagttttgtgcttaggaggctggttttaatgacgagattaagtttagggatatgcaaagtaagatacttttccagtgagatgggaaagatttcaataaagatgttatataaagaaagttttgagaatccactgggctagtcatttgggactagctttcttaaacatttcattcatttattccttaattacgtttttacagtggacctactcagctaagagtgccaggtgtgtgtcatatgcactgaataggaaattatcctgttctcacagatgtcttacatttcagtgggggatataaacaagaaacaaaggaattcctttttaaaatcagaagtgcaatgaagaaaatgataaaagaagagtgtggctatttgcaaggggcagggatagtatttgcaagaggaaggggtgaatgaaaagggagctgataaggaaccaatgttttatctaagacccgaatgaactaaagaagcatagatatactttcaatataagcaaaaggtgtgtgtgtgtgtgtgtgtgtgtgtgtgtatttctagttttataggcaattatgctcaatttcaattcgaatttcctttttttttagctttatgtgcatatcttaactgtagcagctatgctgggaacatgttaaattgtatattatatagtcaaaagaaaatgagaatgtacaattatctgggaaggtttcgtatcattcatacagacttttagaaaaaaaaattggttccctaaattatctgtgttgcctcagcaaataagagtctctcaagcttttgtggcacaaaatatcctatggagcaaaagatttagtcactgagttatttccacccctggcctaccttcaaaaaagaatgtcataccgaaggaaataaaacacatgttaaatatctgcataataaacgaaataaaagaaccgaaaataacatctatttcaatagaatgaataagaatataatctctttgaaataaactccaatttagtcataaacaaataactcatgctagtcatagatattattacatgccatgtagttgtgtgaggtttaaaaaatcagtctcaaagcttattaaaggaagtacaattgtattatttgctcgtagagtcaagaaatatatgaaatgtggccatatttcaatgagtgctattgttcaaatacttgctgattcccatggtaaagacagaagatacattcttaatctgtatgcactcaggtactatagattaaatgtgcagctctttgtgtattagaattcactccagtaactaatgtagacccaaaccatataggaggtagtaattatatatgcataaagaagggcagattaagtcatttcaaacactttaaagaatatctgggctaattttctactctcatatggaactgaataaaatccagatcaaaattgcatccaccatttatatttaccataacttaattgtggcataattcaatcagtatctaaagaaaactgagaggaaacaattactgtttacctaaccaagttatgtctgttttaaatgacttaatttccaattaactattaaaaattaaagaacataaaaattatacaaattaattatttactcagtgatgagaacttttttatcccaacaggctgagaccatatttaatacttttccttgtattttattcttccatgcaatacacttttgagttttcagaatatgttcctcttttcagtttgtccctatatgttggtcaacagattcctaatggcaattcagaatagaagagtgtttaactctagaaatttgattttgggtaccaacagcctactgcagacactttcaggaagaaaaactactttctaattggccagtgtcaaggatccaagagtcacctattcctttaatactcaaacatatatccacttagtgggaaagttaccttaatttatcatttaatcataatcattttcaatctgaacaaatcagaaacttatgacatgtttaatcaagggctaacaggaggaattggcactctggatcaatataaaatctccatatttgtttagaagcctattcaaacatgtatagactataggcttgttaatatgttacttatatttcttcagtattttttaatgaacagaactattgaaaaattaattggaaccttcttattgactttcgttggagacaccaagttctactcctaggttagcagaggattaatagcattgaactacttaaaaatagctgcatcttgtgctttgcagaagtgggaaggagaagctaaagaaaataattattcctcacactgtgtaatacactggtcctggtgattttcaatattgaaatacgttctatcatctctaaagtttctaatattgatcctgctgtatcttattctgaatatattatttcatattatttatttggatgccaaagactcagtctactgctttgataaattttgttctagctcatcacatcaaattttttgtgaaggaatttaattaaattaattttacatgttatatcaaaatatcacatccacttaattctgaaagcaactctttactggggctgaagtttaaaattgactacatctagaaaattctatgggtattcattagactatttttatagttataaagtgttcatgtgcgtatcaccaaaaataacaaaatgggaagatacatcaaagttatgtagaacaagtttgctaatgttccatatgtgtaggcactttcaatgacttggaggtgatgatattttcaaataaaataatttaaaagcatacctcaattcaatgtttgttatatacccaaagaaatttgtgtatgtatgtaaccatacttgaaatgtcaagtatggtttgaagttaaatcggtgctggggacaacaaagtcaaaatgattggaacagtattttttttttttttttttttgagacagagtctcactctgtcacccaggctagagtgcagtggtgcgatctgggctcactgcaaccaccgcctcctgggttcaagccattctcctgcctcagcctcccgagtagctgggactacaggcacgtgccaccacacctggctgaatttttgtatttttagtagagatggggtttcattgtgttagtcagaaaggtctcgatctcctgatctcctgattcacccgccttggcctcccaaagtgctgggattacaggcgtgagccaccatgcaccatggaacaataattttaagaacattaattgttgacatcttggctgccatcacaccaacagaaatactaccatcactctaagccaactctctcttttacctttggtttacatgggcataccatatctggctacagagaaattctccaggagtctgcagtacactttcacattgtccagcaatgctaacattcaatcttagaggtcatttagcagctcatgactgagttgattttgtgcagtaaggcatagatctataatgaaaaacaaatcttcatttacttctgttgccccatttaatgattatgaagagtaaactcttataaagtaaagtaatactctacttgaaaggaatattcctgttacactataaaatatattaccagatattaatttgatggtagaacaaaggaaggatctgctataaaatatatcaagtaaggttttacatgtcattatacacaactgcagagttttttgagaggctctaatgaaagggtacttctcatgctttggaagctcaagtcttcctcctcaaagagagtcaatgacattattttacagaggattttgtagaaatgaaaggtaattaatgccatataaaagcaaaaacattacatctgtaattgctacatagcatgtgcatgacaagttgctggtgcccataagggacagcacttgaaggtcaaaggaaagagcatacccttccacctctcagtttgatttgagtattaaatgagctagcacacagcttggcacatgttaggctttcagtatttaccttctttcttaaaaaataaaaaaaaaaaaactatttgtattagcccgttttcatgctgctgataaggatatacctgcaactgggcaatgtacaaaagaaagaggtttaatggagtcacagttccacatggctggagaggcctcacaatcatggtggaaggtgaaaggcacatctcacatggcgggagacaagagagaatgagaatcaagcgaaagggatttccctttataaaaccatcagatctcataagatttattcactaccatgagagcaatatgggggaaaccacccccatgattcaattatctcccactgggtccctcccacaacacatgggaattatgggagctacaattcaagatgagatttgggtgggaacacagccaaaccatatcactattattcagagtaattatgatcaaatgcaacagtgagattgaaaatattatttaatattgcattttgagtacaaataaattttggcttttaatcgtgaacagtcataatgttgaatgttttacttaactgtatttattattaattttttgaaatggtaaaaagtaacaactaacaaactaagaaaaaagagaaaggaaatgaacagtgttataggcaagtagatgctgtggcttacaagcatatggttttctctcagaaacgccccagtcctgtctcctatctcatctctaggagcccacatctacacatcaacctttcctacctgaagtcaagacctaaaatagctgtttacatttggaagatagtattcagagtattcgctttaaatatcttatctagaaattacaaaaaaattcagacttctcatagattttctataccatattttctactcgtggccaatatttccctgagacaaagttttcttttgttctgaaattcatgggataaaataattgcttgaataatcaatttttggaaagactgataatgttgctcaagaattgaagatacacatatctaatcatcatttggaattgggtgagtcatctccaagttatttcatatgaaataaaatcaaatccattatttaaattacagctcacagatatttctgaaattacaattccttcaaatatatataagaagaagttaaatatttacttttaagatttattctaaaacaaaatagtttactacattgaatagactcagatttcaatttgggtctttaggtataagtaggacctgtcttccttacttttaatttattttagcatggctttattattctgcattacacaccgtcttgtgtgtttccaattacaaaccatgtttcattgggttctctcagcattttagttttgtttttgaaatatttggtggttgcttctcctctaaaatgctttaatgcaatttcggttaaacttcagatcatccaattatcagaatagcactatatagacaacacatgaagaagtgagtcattcacccatttcctgtcttttgtttctttactgattgaagggttcaataaattccttcagctcataatgaccatgaaagttaaatactatttttatccattcagctgggttttaaatacagcatgtggacccatcattctgtcatgggcagaagctctggaaattcttgacaacttataatcttccctgcccatattcacaagtgaaaatgattatacttacaagaaagaactttacacactaatttttgaatcaactttcagaaagacaagaagtccatgaaaatcagtgtacactattgcttttgagaaaaaaattatctgagtataaagcattcaggatttaagggttcaacttattacttgtttatcacaagttaaagttcttgtttatcacaagtggaataaaatcaattattcatgataacactttggcttactcaatgtaaattttcttggattaaagttaaattttaaaataaggcagtctgtttgacagaaaatgaaacttttactttaggagaagaatacaatgtcccagaccactcaatttagattacaccaggcactctcttgatttatcccatacccttgtatattctacctgggtacattttttactacctgaaatctcaccgtatatttttttacttctagaagtctattttaccttttaggataaaattacagaagaacgcacacttttcttatttagctttgtggtctttaaatttttttaatttgcatttattttattttaaaaccttcaacttccattttggattcagggggtacatgtgcaggtttgttacatgggtacactgtgtgatgtcaaggtttggggtaggaattatcccatcacccaggcaaagagcatggtacctaataggtagtttttcagcttttgtccccctccctctctccctttctagtagtccccactgtctattgttcccatttttatgcccatgagtacccgatgtttagctcccacttataaatgaaaacctgagagcagtacattagcatgtcaagtactccagtgtcctaataaatagctgatgactaacgttgaaggaatgaaaaatatccatcattacttatttagtattagtgtacattttactaccatggcacttatgactaaaggttttgaaatctgcactgcagaacttcatgggtctttttttatgcctatgttctgagtgtaattattccttagttgtttcatgtgtatatatgagttatttttctcaattaggatgcaaacatgctgatggcaggaacttacaatagcttcatcttttgagttctatcatggctgacatagattagcagcagagtgtcaatgtgtgcagtgagggaatgatgagtcaatgtctgagtgcaacagtaggtgtcaagtaatggttgttaaataaatgcattactttaataatctgccagtcagtttatgaataaggtgaagaaataaacatatatttctttttatttttttgcatattttaaattatttcctcttggtctatatagaaaaggagttaaaatgtgtgctttctaaagtctctctgattttttgattgtctatttatgtcattgtggtttttattctcaattttggggtgtactccttcataacttgtgtttatgtgtctttcttttttattttattttattttatttatttttattttttcttttttttctttttttattatgctttaagttttagggtacatgtgcacaatgtgcaggtttgttacatatgtatacatgtgccatgttggtgtgctgcacccattaactcctcatttaacattcggtatatctcctaatgctatcccttccccctcccccgaccccacagcagtccccagagtgtgatgttccccttcctgtgtccatgtgttctcattgttcaattcccacctatgagtgagaatatgcggtggttggttttttgttcttgcgatagtttactgagaatgatgatttccaatttcatccatgtccctacaaaggacatgaactcatccttttttatggctacatagtattccatggagtatatgtgccacattttcttaatccagtctgtcattgttggacatttgggttggttccaagtctttgctattgtgaagagtgccgcaataaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacttgttgtttcctgactttttaatgattgccattctaactggtgtgagatggtatctcattgtggttttgatttacatttctctgatggccagtgatggtgagcattttttcatgtgctttttggctgcataaatgtcttcttttgagaagtgtctgctcatgtccttcgcccacttgttgatggggttgtttgtttttttcttgtaaatttgtttgagttcattgtagattctggatattagccctttgtcaggtgagtaggttgcaaaaattttctcccattttgtaggttgcctgttcactctgatgttagtgtcttttgctgtgcagaagctctgtagtttaattagatgccatttgtcagttttggcttttgttgccattgcttttggtgttttagacatgaagtccttgcccatgcctatgtcctgaatggtaatgcctaggttttcttccagggtttttatggttttaggtctaacgtttaagtctttaatccatcttgaattaatttttgtataaggtgtaaggaagggatccagtttcagctttctacatatggctggccagttttcccagcaccatttattaaatgtggaatcctttccccattgcttatttttctcaggtttgtcaaagatcagatagttgtagatatgcagcgttatttctgagggctctgttctgttccattgatctatatctctgttttggtaccagtaccatgctgttttggttactgtagccttgtagtatagtttgaagtcaggtagcgtgatgcctccagctttgttcttttggcttaggattgacttggcgatgtgggctcttttttggttccatatgaactttaaagtagttttttccaattctgtgaagaaagtcattggtagcttgatggggatggcattggatctataaattaccttgggcagtatggccattttcatgatattgattcttcctacccatgagcatggaatgttcttccatttgtttgtatcctcttttatttccttgagcagtggtttgtagttctccttgaagaggtccttcacgtcccttgtaagttggattcctaggtattttattctctttgaagcaattgtgaatgggagttcactcatgatttggctctctgtttgtctgttattggtgtataagaatgcttgtgatttttgcacattgattttgtatcctgagactttgctgaagttgcctatcagcttaaggagattttgggctgagacaatggggttttctagatatacagtcatgtcatctgcaaacagggacaaagaggaaggctttatgtgtctttctccattgcattagtatgttggaataaagtccactgtgatcacagaacacagtttgtggaaaataaagtctaggacttcattttctcatatgtaatctttagtcaccagtgagaatgagctgctttcattccctcaaatttctaatacagggtacaggggagcaatttgagaaccagctggatccactgtaggggctgggagagtagcttgatctcttcacttctctatcccctcacctgagttcttataaataagtcttagaaataagttcttataaataagtgacttatttataagttttgtgttcagcagttctggttttgcaatgagaagtgctacaacttctcaatgaataccaagctctttctcttctttctggggttgtaaactggcggtcctccagagtggcccacacaacgttagctccatttcaaacttagagccaacatccagatttctggaaactctttgaaaagtggaagatccggcaactttggcccagatccctggctggccgtgtcacctcggggcatagtagctgctgtctttgaaggatgcatgcttggccctccctgttgctcccttacctgaaccttagtggaagcttccagttaccctcatacttgtcgagtacagtctaatggagaataaaacactgactctgcaccttcaataaaaactactttggtcactagatatgtgagtttgttctttctccaccagaatataaaacagtggagttttatgtataaagtagagggagatggtcaggctcaattttatccttttcattgcatttggaatctgagtgatattcatggaaaggacaacaaggagttcaaatattagaagtggtgtctaatgtccacttcagataatggtgagatcaaatgattgcgatgcctatggacactgatgtcgccttggagatattaagtaggatatcctcagatttataactactctatactcacagtgagattacagcaggaaaatgaagttcatcaaattttcattgaaaaaagtaaacaaaagctgccaaataaagatttaaattcctctttagggattcagcaaatacttgaaaagcaaagtcatccttatatttacatttatattttgttcaaaatgcgctgtaaccattttgaacaaaatgtaactacgcctctgaatttgtctaagaaaaatccagtaactcttttttagatgagtaatatttactcatttatgtgaataagcaattgacaaataaaggaataaattagatattgtggagtacctaatgaaaatattagaatgtataaggcatggatttctaattcatgtaataccttaagaactagattcttggagagaaaatattgtcagtttcagataaaaggattttagatagaagatgaatgtcatcaaaataagcagcaatggaaaatagagaccagataagtaaattggagaattgcattactcaggaataatttttgactcaataacagacacaccccctcccaatcaaatggcagtttaaacaaattttgagggaggtcttattttgaggaagtgtaaaggtaggcaggttagggctggtgtgaccactgtgtaacatgaccaagtctctcatcagagaccaaggcttgctttggcttgtggtctgtaagatggaaccacacttgcactcatgctctaagatatctgcagggaccctagagtcatccctgcgtctcaggaaggaagaaagtaaaatgccaagggaaaacaaaacgacattgcttattctttaagtaaagaacttgacacctttaaagccaccttttcaggagcccactcagtggcttctgtttctttttcatacaattatatttcattgactttgattgcattcgacaggatatagctatgcctatctgtgaatgagcctgggaatagagcttcgtatttgggcacattataaacctgaaaaaaaaaatttgtctctaagaaacaagggggtcattatattgtataggcaactagcattctcattgctttttctctcattcggggaaattaagtataatcaataccttgaggcatagtttgcaggttctatgcaaaagccttctctggggtgagccaggtaagcagccagggagtgagacagggaatctgaatacgggctctaagaagtgaagatgaaaagctcagggatgggcatagcatgaggttcatgccccgcaactgcctcacgcaggagggacacgtgggtaaggagactgagtttaggtaagtgtgttttataaattctcatttctcatattttgtgttctgggataatttattttttgttttttggaaattaagtggggaaaaatcctagtatttagcttttgatatttgaattttttgttttctccaactgaacttctcttgcatctgacttcagaaacagtctccagttttgctggaggagcaatataatgctgttctctgcctaatgaaagcagttaataatgattaatgccaaagagtgagtgctcagagggaggaacagagctgctggacagtatccacctttgattgatgtgtttccattggcttttacccttcattgtttctttgcatctgcaatggcgtgaactgcaagcaccattttgaggacagtatgcttcttgttgtagtctctcacatattccaccactccactgagtttccctaagaataaaactcttttacagtaatgggtgtttccttttgagagccaccaggtgtaattattttaccttgttgtatttcagttaaaaaaaaatcattcttaatgtgaaaaagcctaaaaaatatatgaagattgcaaattacataaacgaatggtcaaagaaccttaagaaataacttacccaaaggttaaaaaaaagtaattaaaatgtatatataaaagttccattaatttggaaatatgaaacttttttacttataaattggaaggatgtttttagtgacattcagggttgataagaattcaccgtggagtaactggccagtgtgaataaagagccttaaacatctatacccctttcccaagtagttttattttacagagtctacctcagtaaatgctacaaaatgcaaaggtttatatatatgtattaatacaatctttgaaatttaatttctaatattggaaaaaagaaagcaacctaaaaatctaataagagaattaaatggttaaatagaatgctgaaccacactaaaacaaaacaaaacaaaaaggaaaaaacttttcaaaggacagtgaaagacatgagatgttactgatgtcatatgtaaaataagtaagattcaaagatgcaagagaggttcagttggagaaagaaattcaaatatcaaaagctaaatcctggagttttataacatatattgtatataatccgttaacaagaaataatagaaattaaatgggccaaaaatctaaaagtaatagaccctgagtggtacaattatgtattactcttgttttcatctctttttttattttcccattttagacagtgaatctatatttgttcagtcattaaaatgtgttaaatatcttagttagcatgatgtttgttattcactgaaatatatgaagtcaatttctaggacagatgagaacaaaaatgccacataatcatgagaataaatttttagacttctgtttaccacaattatagaaattaattaacctcaagcaagtaattcagtagtaatagaaatagttatccaaattaatatttttcattttcaaaaccatctatgatgagaaaatatttgtctataattcatttataatacaagatttttattgaaaaattttattgttaacacattttaaaaattaatatgtggttcagtttctttttatgatgaaatagttttagcagaccaatgctactgacaaagtcaacaagaaaagctgtataaaataccaacaaaaaaaaatatatttgaaggaatgggaatgccgttaaggcagccagtgcttgagaaacccagatctcatagggaaaagaagctgatttgggtgtgcaattcttccctctcaggccatttgctgaattttaccctgtgcagggaaagagggtgagaagttcagcagataacttggatataagaagagaagatgtcagaactttctgggttcttacagggttggaagaaaatatagaaggttgagacttttaaagccaccagcccttttgggtcatgaccttggagacaaaggaggtgcgaaaaagggagccagctattccaccctggtttttttctccaaagcatttgccaattcaagaacagtgaaagattagagaataagaagccaagaagaaagtgactaacaaattgattagaactggtgggagcgctggtgtgcttggaaaacaaatactgaatttcaacatccatgaagaagcatggacctcatgttcttacagaagcgtatggaagtattggtgaatcagagagatcaaacctagcaaagactgccacctccctggcatcagctcagtcgctgattggacttgtgagatctacccctaattttgatgactgccagacaataggataaattatttcaggagaattattacaccgttcagagcttctacagtgtcctacattcaataaaaatatatccaaacaaacaaaacaaataagcagacaacaacaaactaggactgttaggaaatacagatgatagaaagagaaaggtgagacagatattggaattatcaaatatgtgtgatatatgtttaagagaggacaagatatagaattcaaaagatatttagaatcagtaaaagaatgcagtaactaagatcgagaactcaagtagtgcgtttaacacagattgggcataacagaagagagaattagtcaaaacaaataagagatagacatttaatgatgaaatatttaaagctttctcccagtgatcgaggacaaggcaaggatgcctgatagcaccacttgtattcatcattgttttggtgaacttagtccatatataaaggcaagaaaattataaaaagacataacaaatggaagggaagaaataaactgttattgttcaccaatgacataaagtaatttctggaaaaccattaaaattattaaataaagttcatagaaaataagaatataagaaaaaattagttgtacaactatcctagcaacaatgttagacatgaaagagtatattctgcataattccaattacaaaaatttcaaaaattgatctacagtaatagaagctaggttagtggtggagttggtgggggacagaagaggaaatctgggggtgttagtaatattattttctttcacttgagtgttaaattgatctgttcactttatgacaattcattgagtcatgaattcatgatttgtgcatttctctgtatatgcatgataagtgatactaagattgacatactaggaatatgagacatctacataagattttaaagagtgataagagccataattaaaattatgattaacacacttttattcttaataaagaggagtatgcatatgaatcaagaaattggtaattttagttttagagtcttgttggcttttaaacatctgttcacttttgtggttcacagatattcaatttttattgaaatttaaatgtgaaaacacatctgtttctctgattcatatttttatggtcaactctgaaatgagacagttgtgaactgagaaattattcaaaacacaagggatgtgtcttcctattatttgtgaggaggaagtacaataaagtcctgaaatcagcaacttgcattggtggcttgtttacataaggaatatattaaatatttccttttctactgtggatttctgtctttctcaattagactataaggtcaatgtaagaagggttcctaaataaatgattaaagaaattaaagtgtgaatagcagagctacattttgaattagagatttttaaaaatattgtcaaggtaagggacctgcggatgatatttctcatggaaatctatacttgtttagatattttttttccagtccaatgaggtaatgtctgatcgcctagatgcttctgtcacaaccttagcaaggatcatgatttctcaattgtattgctcaagagcctttggctgctcttactgaccagcctattactcatcttgtacactttgatttatgtattcaccacactaccttcaaggtaatctggccaaaattttattttctaatttttcagcttaaagtttattaagactttaggacacgtctagattcctttcctctaccataccctcttagtttcacttcaaacctcagtgaaagtgtgacctttttcaagaagctctcagggctggaaccagatatctgtgatctagttacatttcccacattcttaccaccttgagttataacatgtaggattatttgtctgctctgcccaataaagtgtaagacacctgagaaggatttagagtaagaataaaagcaagagagagagagactgagagagataattagcgtttttttctgaaaatgcattgtcctcttaatgctcatggtactgttgggtctcagctttctcatcagattctaaaatgctcaaaaactttttgattaaagtaaatgtaattgttgccctgcaccgtggtcttatattttctcagatatatactaacagcattagaagctgtactttactttctttcttttaggaagaatattaagttagtttgtgtttaaatgaactaattgttttgcaaatgtgtttataaggagatgatatacatttttttttcttgtaccttatggtaaatacttgaatgtttgtattatatattttcccagtatcttcctttgacagtaatttttatatcatgacccttatttcatgttgaaaagcataaatacattcatggtaattgaaaatattaattacttttctttagcatttgtccaaaataaaaagtaagtatcaccagtgatttaaaatgcaaattttgagaaatacaaaaattggatcaagttctggctccccatctgctggccaggtgacttcttttttttctttttttttttttttagtcaacttttaatttctagggtacatgtgcgggatatgcaggtttgttacataggtaaacatgtgccatggtggtttgctgtacagatccgcccatcacctaggtattaagccaagcacccattagcttttcttcctgatgatattcctcctcccatgtcccccttttgacagaccccagtgtgtgttctgctcccccacagcccactgatatgtccatgtgttctcattgttaagctcctacttataagtgagaacgtgcagtgtttggttttctgttcctgtggtagtttgctgaggattatggattccagctccatccatgtccctgcaaaggacatgatctttttcctttttatggctgcatagtatttcatggtgtatgtgtaccacattttctttagtctatcattgatgggcatttgggttgattgcacgtctttgctattgtgaatagtgctacagtgaacatatccatgcatttatctttatagtagaaggaattatattcctttaggtatatacccagtaatgaaattgctgggtcaaagggtatttatgcttctagatctttgaggaatctccacactgtcttccacaatggttgaactaatttacactcccaccaacagcgtaaaagcattcctttttgtctgcaacctctccagcatctgttgtttcttgactttttaataaaggctattctgactggtacgagatggtatctcattgtagttttgatttacgtttctctaatgatcagtgatgttgacctctaatgatcagtgatgttgaccttttttcgtatatttgttggtcgcatgaatgtcttattttgagaagtttctgttcatgtcctttgcccactttttaatggggttgtttgtttttttcttataaatttgtttaagttccttgtagactctggatattagacctttgtcagatggatagaaggcaaaaattttttcccattctgtaggttgtgtgttcactctgataatagtttcttttgctgtccagatgctctttagtgtaattagatcttattagtcaatttttgcttttgttgcaattgcttttgacgttttcatcatgaaatttttgcccgggtctatgtcctaaatggtattacctagattttcttctagggtttttatagttttgggttttacattgaagtctttaatccatcctgagttaatttttatataagatgtaaggaaggggtccagtttccattttctgcgtatggctagccaattctcccagcaccactcattaagtaaggagttctttccccattgcttgttttcgtcaggtttgttgaagatcagatggttatagatgtgcagtcttatttctgagttctctattctgttgcattggtctatgtgtctgttttgtaccagtaccatgctgttttggttaccatgtgactttttaaaaaaaattatttatttatttatttatttttagagacaggatctcactctgtagttcaggctacactttatcttagccaaaagaccaagaagtcatgtcgcccaggctagagtgcagtggtgcattcatggctcactgcagcctcaaactcatggactcaagagatcctcctgcctcagcctccagaggatctgggcctgcaggtgcatgccaccacacctagttaattttttttacattttttcagcaacagggtggccatgtgaccttatgtaagttacctaaaccctgtaagtctatgtgcctcatctgaaaaactgataaaaacagaaccctctttatagggtcatggtggagaagaatcaaacagtggacaaggaatatttagtataatgccaggaaactagttgactggtcatagtcacacagatgcttcagggcaggcctatttcttgcatacctgtgatttcaggacattttcagaagtcccagacctagaacccataggtggagaatccaaattttttgtctgaggacaatgaaggtgtcagtgaatatctactcccttacaagagctttgttacaattgttcaaacctatcaacttctagatggggaagactggaagaaggttcaagaagtgtttcctcagaaacacccaaaatgcacgagaaggaaatagacgcaccaaagttacctcaatatagtgatcatcacagaataagaaacttgagcggccgggtgtggtggctcgtgcctgtaatcccagcactttgggaggccgaggcgggcagatcactggaggtcgagagtttgagaccagcctgaccaacatggagaaaccctgtctctactaaaaatacaaaattagccaggcatggtggtacatgcctgtaatccagctactcgggaggctgaagcaggagaattgctcgaacccgggaggtggaggttgcagtgagccgagatcacgccaccgcactccagcctgggcaacaagagtgaaactgagaaagaaacaaagaaagaaaaagaaggaaggaaggaaggaaacaagggggagggggaggaggaggaggagaaacaaagaagagaagaagaggaggaggaggaggaggggaggaaaggagaaaggaaggaaggaaggagaaatttgtgccattgactaactgaggccagtatcatggtggaaaagcctgttactagtgttgaggtgaagaagcttgaccatataagagatacttctgaatttattcaggtgaatattgggatatcactgattttatcagattcattatatttaagagtaagaaggaagaaaagtggaattctgggatcatgaagagttcagaataaatgggaaaaggaaatgcagcactaaaaacatgaccaaaatcaatcaacaaaagtcagtcaacaaatatatgttaggtacatatgtgaattacattggtgttcaaaatagaatctttgactttaagtgcatacattttaattagtaagaagagggctccaaaaacatgtaaataggcagcaagacaatacatgcttttggcaagtgctattatgaactatgaccacacagtaagagatgaatatgggtggtagagaaggcttctttttttttgagacagagtctcactctgtcgccaggctggagtgcagtggcacaatctcggctcactgcaacctctgcctcctgggtttaagtgattctcctgcctcagactcccgagtagctgggactacaggtgcgcaccaccatgcccagctactttttttgttttttgtttttttttttttgtatttttagtagagacagggtttcaccatgttggccaggatggtctcgatctcttgacttcgtgatctgcccacctccgcctcctaaagtgctgggattacaggcatgagccactgtgcctggcctgagaaggcttcttagatgacttatgtgttgagaaataaatgacaagacagtgaacaaaatttggggggaattctttacaagcggaagtaacaacaaataaaaaatgccaagtttgccgatttcaggaacgaaaaggatcactgtgttcagatgatcataactgaggccgaggaacagagaaagatgagttcagatcttgttctgaaaacagaccatgcagggccctgaagtccaagtttggattttattccaaattaatgaaggcccttggaagatttttagaaggggaaggtgacatacttttctttcctttgagagatcactgtggctgctatgtggtggatgcctccagggacccgaaggtggggacaaaggccaactaagaaacacaacaggagttcaggtagaagatgatggtggcttagactgggagcggtggaaatggtatcataatttccatttgacatccattttaccaaaggtttgagatttggaatatgagtgaaagggaggaatcaaggtcatttttggtctgagttactgtctgaagagtcatgccattaacagagaaacagaaggcattgaggagctgactcgatggtggcatgggcaaatcagtggttctccttcggtcatgttacatttgaggtgcttatgatataaagtgagaagttcaatacacacgtctgaaagtaaaaagagaagtctgtgttagacatgtagatgtcatgtcttcagaatgcagatcggtgtaaagctctgggcctggatgcaaccacccagggagaaagtctacttatgggaaaggctggggacaaagcaacatttccaggtctgggaggagagacctggaaaccaagaagaaagggtcaaagcagtgctgaggaacaggcagatttcagttagagcaaaaagataaaagcaatgttcagagaagaaggtgtatgggtatagatgaccttggtgatgacagattaaatttcacagacattaggaagggagtgcagaggagaaggggccacgaggaatagatcagaatagtgacgcatttccttttggtggcgtgcaatctggagacagatttctgaagatgactgaggtgaaagtgatgcaaggaatgatgcacttgcttaaaagcaaagtgtgccatgaaggcggggatcttggcaaagaggagaattaattcatcaaagcaccctgcccttgaaatctcaccacactgctagattgaaactagattgatggcacagaatggatgttttgttttatcttatctctctattttcttatgtgggaggagtggacatattgcaaaaagcagttgccagacatgcacatttaaatgtactgaaacgcaaggtgatagacaagaaaaatttagtcaaatttatgcattaattatcttcagaaaatgcaaatccctgttgtagttattttcctatttctacaaatgtaattaaagcattgataacacaggggaaccacagcattggaattgagaacaacctggtgtgaaagaaaagaagtgttgaaaattttaagtttccctctcctatgctttctattatttctgtgtgtaaacccaattttcacttcccctttctatgaagctaatgctagatcttatctcttgacatttaaaacatccactcttcctgccaacattcatttgcttctccattgttaaatcggatagtcacaactctgatgtgctgtgttgtagtacctgagctgatcgtatggaggcagatcttatgacgctggccattgccacaagtgataattggcaatgcccaaagagatgctatgaaagccttaatattgttgacgaaaagagtcaaactctgtgaaatatttgaagagatttattctgagccaaatatgagtcgccatggcccatgacacagcctcaggagaccctgagaacatgtgtcgaaggtacagcttggttttatctattttaggatggcgtgagacatcaatcaaatacatttaagaaatacattgatttggttcagaaaggtggcacaactcaaaacgaggtgggggaggggggcttcctcgctaaaggtaaatttaaacgttttctgattgacaattggttgagtttgtctgaagacctgggatatatagaaaggaaatgttcagattaagataagagactgtggagaccaaggttcttttgaagttttatagtggctgcccttagagacaaaagatgtcaaaggtttcccattcagatctttaaaaggtgctagacttttagttaatctcttcaggattgggagaacctggaagaaaaagatctagctgttagtagagattctttactgatgcagttttccccccacaaaggacagctttgcaggtccatttcaacatatggcagggaaacatgttttgggctaaaatattttgattttcttccttgttttgtaatgttatgcctgagtcagagtggaaagtaagccacaatatatagggttaaataaaatccatctgatgagaatttatggtttgtagggcatgactttctagacaacttaggaacttgggcaagataaaaaaaatcagagcttagtccttaatatccagagaatatgatgcattttcataaaaaagtaaggatcacccacttaacactctaccctttcaaaatccactcatattgtaatttgtttgtaataggtgacaatatttttctttcatttatagataactaatcttcacctttatcaaacatgtctttcaagagtatgtaatacatcgattgcagctccaagtctacatcatctgtttttgcatccttcttatttacttatttttctttttgtcaataaaatacatcttaaatatatagtcaggctcctctttagctcaaatagtgttgttttgtttaattagactgtgttcccagtattgcttctatttttttttctttttttctttttttttttaattatactttaagttttagggtacatgtgcacattgtgcaggttagttacatatgtatacatgtgccatgctggtgcgctgcacccactaactcgtcagtattgcttctatagaaggctagcccaaatgcagagaggaaaatggcttgacttggccttaaatataatgaagcttgtacagtgtgcattgtgttttaagtttgaatatgaatgtaactgctacatgtattgtattaaattaatgaacttttattatgcttagcccagtgtatcctcagtttttaattcaagttgcacaaaaatttattattttgcttcttgataaaatgatttattaatattttattcaacctcattgttttaagcttttctgaaacatattccctctttaatcaatgatgatatgctagctttaggtaaacggtctgatgttaacacatatacagagagtataaaattccacttgactcctcaagtgcccatcaaacattttctttaaaactcctttgatacatcttagtcccattctgcattttatatgggtcccattctttgattttcatttgttttattacatttgagtctctttacaaattagctaaatatgcctaaactctaatggtgttgttgtagattttttaaagttacaaaatattttgagattggttttctacttgttgaaactggacttcatattgcagggtaatattcccccatggggccatcagtattcataaatctatttgatttacatgttgaacactacatgttccgtaaaatacctagaatgctgcacatgtggatgaatattaatgattgtctctacaaataataaagcaaagaacaaatgacctctctttaataatctagtgttacagcagtcctgaaagaagtgggcagagcaagggtccccagccctcacagctcttcttatcctttgggtagcacacaagagaaagaagtgcatttgagagagttcatgagcaattttaaaagacttctgtaggaagatagatgcttttatccaaaaaatggtctacttactgatttaagtgattacatctgcattctctcttcactaggaaagaatggccaattaatcaaacttaaagtaaattcatctacatttgaaattctgtcaggtataattcaaatgtgtactttggctggtaccaaatatgtatgctccttttaagaaacaatgccatattttgggataaagttcaactgcaatttaagtcatgaaaaaggctactgggagaatgaccttaattaaaataaatcattttcaaattgttcctaactaaaatatttgttataattttagatgaaattatattgcattgtttactcatatctggaaaaataggtgtagttaaaatactagaagaaaatcagttgaaacattaacagtatttgttcctaaagctatgtttaataaggaattttctgccttctacttatgtgttttaaaaaaattaaagtgatcgtgtattgctttaatattatgtgtgttgctttgataatactttttaaatcagttaaattataatctaaaataaaaggtgattttagtgcatatacatgcatgtgtatgcatgtatatgcatatgtgtcttatatacttatattaaaattttgaactggcaattagggaagtggttttttaaactgggataatacattttaaaaatatgtagtggatgggaatctcaggtaatggcataaaagtgctaatgacctgcacaagcattgaatgaaagatgcaaatgagcagcttaatggaaaaaatatgaggaacttggtgctaaatcattcacagtcaacctgtttctgggctggggtttcctaagcagcggagcacctccctcactaccgtctattgaaagtcagcttttaaacaataatagtaataaataataaaaaataataaaaatatacatatatcaaacaaactttgacaccatggtgtacattttagataaatcaatatttgttagactacagcactaacaagtttctatcttaaacattatagtgacccctaatcaggccttagagtggtgattgaattttttttttttttttttttttgaggcggaatctcgctctgttgcccaggctggagagctggagtgcagtggggcgatctcagctcctcagctcactgcaacctctgcctcccatgttcaagggattcccctgcctcagcctccagagtctacttaaaacacataaatagaaggcagaaaattccttattaaacatagctttaagaacaaatactgttaatatttcaattgattttcttctagtattttaactacacctatttttccagatatgagtaaacaatgagatataatttcatctataattataacaaatattttagttaggaacaatttgaaaatgatttattttaattaagatcgttctcccagtagcctttctcaagacttaaattgtggttgaacttcatcccaaaatatagtattatttcttaaaaggagcaagtatatttggtaccagccgaagtatacatttgaattattcctgctgacagaatttcaaatgtagattaatttactttaagcttgattaattggccattctttcctgtagctgggactacaggcatgtgccaccgcacctggctaattttttgtattttgagtagaggtggggtttcaccgtgttagccaagatggtcttgatctcctgacctcgtgatccacccacctcagcctcccaaagtgctgggattacaggtgtgagccaccgcacaggtcctggtgaggtaatttttaagtaactatgtatctgttcatatgtaagtatatgtgtgtaggagtgcagatgccagtgtgtttggacctctggggaaggagagggtaagcaagagatatgatgcaactcagcctcagatgagctcaatcactcacagaattaattaaggtaattgaccctcattcacttctgggttcctcaataacagcactactaacattttggaccaaataattatttgctgtggagactgttcttctgtgcattgtagggtgtttaggagcctccttgacctccaccctatagatgccagtagcactgtaaccaccagacaggttcttcctgcccgctgaacaaagttaattcatggagaccataacattgcagtaaagaaatagtttaataaagttgaggccggccacaccacgtgggagacagttgtaactcaaatcaattttcttgaaggctcagaggttaggggttttttcaaagatagtttggtggataggggcccagggagtggggagtgctgattggttgggtcagagatgaaatcatagggagttgaagctgttctcttgctctaagccagttcctgggtgggagccacaggactcaggactggttggcaaatgctggtggggccatccagttttcagaaatgcaaaatcctgaaaagacatctcaaaaggctagtctcaggttctacaatagcaatgatatctgcaggagaaattggagaagttgcaaatcttacgacctctggaataatgggtgttaattatgtaactatgtttgcatcttagcagaattcaggtccctctcatcttcctaacctggtggccttttattagttttacaagggcagtttacttttggggaagggctattatcatttaaactataaactaaatttctccctaagttaaccttgcccatgcccaaaaatgtgcgaagacagccacccttgaggctagaagcaagatggactcaaccatgtcagatttctcttactttcataattttgcaaagacagtttcaagacctctctattgttatatctaaaaatgcctccaaacattgtcaaatgtctggcattttgtgagcaggtggttgggatgggtaggaggttgtctgggattgagaaacacaaaacactgctctaaatttgttaccaaggggtgaatcattttgcggggaatatttcatccagatgctctatagtcttttccatacaactgttgacattcaattaaagaaatatgaaacaggactaaggaaacaacaacagacagtagtagcagatgcataaatgaccagttattaggaattaacggatatacatatttaaataactataacaaacatagtaaaaaaaaaaatggcaaggtgggtaattggacaatatccagtctaaagtacagataactcaaagaatattgtttttcctgactttggttcatggtggtttgcttccttgtgtgtgtattttttggtcttcagtttcgagcttatcctaaactccggaatatcttgaaacctaagttcaggacacgtttttcaataagttttgtccatttttgagatgaatattactgatcttgcacctcttcagtcctcatttcatgacacctactccccggcttactcaggtagtcttgggtctatcttttccacctttatggcctgaagtaccaatgtaggaatttacccacagagctcctttcatgtgagcttatggtttattcctcttgcttcagcttatagctcttgttttcgggtttcctgaaggatattacttcctataagtccagtaataaaacaaacaattgatatttggtataatagattatttggtctttgcattgctggaagctaaagcccatatactgtgtgcttcattgtaatatatctttcatcatgctatttcagaatgtgacaattactaaaagctgacatttgagatcatatcaccacctaatattttttttcaaaagtaaaagtaaagtggaagataaacgagaaacttagaaaagactaggtttagaaagtttattaattatacttctgaaaaagcaattgtcattttctaaacggataaaaatgaactgcaaattaaaattcccagtggaattaatgcagtgactcattacataatacatcatgggcaagtaatccatcctttgtactctcaggcaatcggatgtatttaagccaaagataattcaagacaaaagtaatcagggttcctccaacatcgctttttatgtgacatagagcttatcattgtttaaagcatcgaactgcttaggcattctttgttctcttttattgccttcatttcattgtctgaatagcttttgtagtatgatgttaactatcactgtttggactgattgaatagtttatttattttgataaccatcaggtgaaagcaaaagtcatttcatggcaatttcctgttacttcaatgagacactgctttccaaaaatggcaagaatgttcttgacaattagcatttacacgtgattttaaaattttactttgtttttattcttccatatgagctcttttgattttattgaagctttgaatgagtgagacataagcacagtttaagttgtatgatgggagctaaagtaagtttaatttcaatttcaagcaaatactatttattctacattttctatagtcagggagacatgagggcttgcatgaaggacctgcatgtcaaattcctctattttctgacttttttccattaccaatatagacataatcacatacatttggttgttcttacttttccaacagcctccctccctttctctttactgtaattggaagcatatttccatctcttcctctgtctccatccctcccactttgatattcttattaaagtggaatatttcctcttatctggtagaatgtgaggaaaatagggcaccctaatttatttgatcaccgttcagtttttctcggtaactaagtttgtccctgaaagtttctggtctcacttatggttacattgttaattatcttggaatagtgaaaaagatagtcaatatttttttttcatatgtcttcccacagtgtctgaactatttccatgattttttgactattcgcttttgtctttgtagaaaatattcattaggatataatttacaaatctaattttcatagttctggatcacttattgccccagtaaattccattatttggaactgtacctctatacttaactactagtgaatggcagaaggtgtttctctatcctagcttctttagggaaagaaagattatttgaagggaaccacaagcagctttgtttctatctgtgatggaagataacaattttaatatttaaatagatgttgaataaatgagtatgatttttatatgtacattacatagtaataatagtaaatgtctttgggaaaaaatgcaaataataccatgatagatgctatcagagtctaatagattatataacttgactgcacatatttgaaacatttaagtagaaaacaggactggtagttacaactggtgtagctttatgaatctctaattctattacatctgagacactttagagatcgcttgatctagtctctttgtgcagaaaacaaggaactgaatctttgagaagcaaaagtggcttatccaggctacataattaaaactgtcatcaaaatgggcctcccagctgccatcacagtgcttggcccataccaaccattgattcttactttcctatcaggcctgggcatattccagtctgtccaccatttcttgtgcatatccttacaataaacatgaaatttatattttataatccaaattgaggtaatgttccatttgactgtcatacaaggtttcccaatcaaaagcagatgagatagtggttgaggccaaggcatcctgggtattagttatgtatttaaattctctaattaattgtctccaggaaggaaacaaatgtgtacactttggaatttgtctgtattactactaatgtaaaataaacattgcactaaaacttggatgatgattgaaaaaacaatttaaaaaccatgaaagaacaccacaaaatatttttcttacttgaactacattaatgttcaaggtggcctaagggaaagagagagaggaagtgctgttttaaaatgttctctctctctcttgagaaacagcagatttattgtcataataatctcaaaatgcttttgaggaggtcagcagatataaagtacatgcagattgagtgtaatcattatatgaaaaattaaccacatgaacaatgaaatggtactgtggtagcagccctttgtcaaattaatgttctgaagagtgttatttgtgaaatacaaaggctctgaaaataagtggactggactaacttcgcagttttatgtgctacatttgtaactggattccagaaaaaattattaggagaaggagaatttagagcttaacattctgttcacctaatataaagttacagagtgtcagatcagatagcatcatccaattagtcaatttacattgacataatatatatgggacttccataatgaacaatagtcaaaatgtattattttgggaaatcttgaatcaaattatttacaggtatcctgagagatctctattataataattgtaaaaggcagcaatagctttctgaaaaatatttatatattgtttcttttttaaatattgtttaattatacttattttttatttatgtctataatgtaaggtaagggttaaaaatactgtttaaatgcagttgggatatataattgatccaggatcaatttattgaaaaataaacttttttcactgcactgtaacattagcccaccataaatcaagtgaccttatgtgtatgaacctgtttgtggtgtttctattctgtttcatttgcctatttgtctgatcttgtactagcaatccattcttgtttgtttggttggtttttgtgagatgaaatctcactctgttgcccaggctggagtgcaatggcatcatctcagctcactgcaacctctgctttccaggttaaagtgattctcctgcttcagcctccccagtagctgggattacaggcacccaccaccacactcagctgatttttgtatttttagtagagatgatgtttcgccatattggtcaggctgattttgaactcctgacttcaggtgatctgcctgccttggcctcccaaagtgctgagattacaggcatgagccacctcacccagccaatacattcttaaatactatagctttacagtatgttttaaaatctgatattgacatctgtccaccaattttttttttctcagcaaggctttggctatttgtatgcctttgcatttgtgtataaattttagaataaacttgtgaattttcttaacatgaaaactgttgggattttgatgtggatgcattaaatctataaatcaattgacagaattgacagcattgatgttctaatctatagccttcctttttatttgtatattttttaattcacttaataatttgtagttttctataaagaggtcttgacatatttcatgaatattcctattttctgttttttatatgttattataaatgacataattttaaaaatttatattttaaatgtttgtttctactatataaaaatataactatttttaaaattattaaccacttgtatctagggaccttgctaaattaatttattaattgtatgtagcttcttttatattttctacctatataatcatgtcatatgtgaataatgactgtagcatttcttcctttctgtactgtttgtatttctttttcttgctttggggcaattagctatggcttctgtgtaatgttggttaggtgtagtgatagtgagcattcttgtcgtgctcccaatcttggagaaaatgctttgtgaaagctatcagaatcaaaatggaatcacttttgtcaaacccttacaaaaaaaagtggggaatatgaagggagggttcttatgcacaattgcctaataacaagaactatcataagagactgccaaaaccacagcgttgcacaaagaccaccacagtcttacacacacaaaaatatatatacttatgtgaggatctgcccagcaactgcctgcctaaccttggacggacactggctttgttattgatccttgtagccagggataattatctcaaaataacttatataacctcctcattttaccttcaaaaacccttgtcttttgttttcctcccctgaaggtgtctgtagtttactatgctatgttattccatgctgtactgcccactgccagataaacttattatctttggagaatgtctgtctttctgcccattattaagactgacataatctggtatcaagaaatgggacagaagtaagctcacctggaacagccgggcagcccctggaatcaagtgcagtaccaactgaatgaaccctttgtactctctgcttccaggagtcaccttttctgccctggtgattctcctcttaaattcttggactgcctccttttagtgagttcttttgacttgacttgggaccgcactggtttatccggttgcctcaagtagaagatattgcatccctcttggaactgtgagcctgtcttctctggcaagttctttttaatagaaggacaagtatctttccagagagttcttggatttctgcagaacttacattatttgtgaggcatgttttttttttctcgtgaattcacttttgattttttcttcatgtttgatttaatgttttgtttgatctgtaccactggcttaaaatttttgtgagtacagaattttgttttatttttgtttggttacatgtgtctaatgatttagcaattttatgtttttctccctcttgtttatgaacatcttttgaaagcaaaaataggcattttaaacagtggatgtgggatggcaaattgaaagtcactagagcagtcaccaccatctttgtggcaccttaataataagagcctcagagaaaaagtctcccatgtcaagatcaactgttacggacaggcaaggtcaccttcaggaacccagtcggttccaagaaaaattctatacaatgaaggaaacttggtcacaggtcaaagaattagggcacaagccatctgccaagtatgaaataaaggaatcttgtgccacgtacacttgtgaaagcaaaacgatttgtccaaatccttaaaattccttgacagggcttataggattatctgtcgctctccagagattaataagaaactgaatgacattccaaaattctaagacatgccaaacccttagactgctatacattcaaaatttatggtccattctcatgaacatttttttaaactgatgggaaaattacaccaagaataatgtatggccattatggagattgttttggccttccaagcttgtttttctcagaaatgaattagaaaagtgcaactagagggctaacatatagtcttttaagtttcctatttttctattttatctctgcctatttgaatatactgacgtttttgcttgcattggaagagaaactctctgctgcaattgttcttgaaactaaaataggtcaaagtctgcttggagattatttttctcatggcatttcaatgaaacataaacagcaaggaattaatccttaatctaatttaacactgagaaaaaaaaaaaggaaaagaaagtaaaagggacttattaaaacaaagttgctagagaaactgctttacccaaaatttgatgcacagccttcataatattacccatcaggacaaatgaaaatcttaagtttagccatgtgaacatttcccattgtgtcagaaactgaatttagattcaattgtccttttataaaccattgagtttatattactattttactgtctcatgactaaaatttttaaatgaaagctataagatctttgtgtgtatatgtgtttatgtgtgtttagacacatatgcatgtgttatgttgtatgttgtatatacataatacaatctggcatagttggccagaaatcctttaaggaattcttttcaagttggcttagagataagatatgcaaatgacacttaaaagtgtaaaaaaaaaaaaaccccaaatgccttttagctcatgggattcatatgaatctttgataaataaattggttttaaatttgttggtaaaataaaaatttgtttcagaattgttagcttacattttgttgcctgggtttgctggttagacaggattacattgatctctgttagatgttttacagtcataaaactataaattcagcttaggccaggtgcagttgctcatgcctgtaatcctagcactttgggaggccaaggtgggtggatcacctgaggtcaagagttcgagaccagcctgaccaacatggtgaaaacctgtctctactaaaaatacaaaaattagccaagcatggtggtggcctcctataatcccagctacttgggaggctgtgtcaggagaatcactggaagccagggggcagaggttgcagtgagctgagatcatgccacttcactctagcctgggtgaaagagtgaaactccatctcaaaaaataggtaaaataaaataaaatatattcagcttaatagcaaaatagattttgtttgtgtagctctttaaaaaagatgactaatattgttggtttaagaaaaacagctgtattttctgagttactggcaaaatacccatatatttcaggttcctacttgggtgatgaacacctgatattcacaggcttcaaaaatagttaacagagaatcaacttgaaatgagaactagcttgtctaatatctcagttttcatgaataatctggtataattgtttaaaataaataggtgaatataaatggtataaatgtgtataaatgaacttttcatgtaatttcagatgttaaaattatgttattttgaattaagtaatattcataaactggattatttccaaataagataaaataataaacattaatttctgatcagaggttcatgtttatttaattttggcttcttaaattttacaggaaaacacaatatatttggatctattaaaaattatatcatgtttcacattaaaaatttgttctatgaggaagcacacattcctagaagttgtaagatgtatattcataagctgttgctatatgacaaatagttcaaaatgcttacctcctaggctttaactagaaattaaagctacaaagagttaaaccttttaattaatatatgtaattctatatgtaagttgtacaaggaagtaagatacctttttcgttaaaaaaaaaagtataagcatgggaaatatttaaattttggtaggaaggaagaataattttgtctaagggttatttcaaagtattaaaagaaataacaacaaagcaaaaagaagccaataattaggggagtgagagggatgcaaagaaggttatgaggaagtgtttttaggtaaagaagttaaaagcagaaagtgaataatatgaaaaataatattgtgtggtcagaatgataaagggaaataagaaaaataaatgtttgtgctaaggtagaatttaaaaagaagaaaatataggagaaaactgaaagcttaatcaagtcgtaaaaggtctgaggagaatgcaaaggtttgtaaagtataatcttatgaaaggaatttgtgtgcaatcaagttggcttaagttagaagagaattgtttacaattctttctaaaattgaacattactatactgatacaaaaccagaatctagtcctctgtgtttaaagcaacacagttttcttggattattgatctgctctcagtgaaatttgcagaaagtttttatttttaattgtaaaacttgtttcttttaattttcaatcattttctgaactgcatcttttgcccaatttacagttttcatttattttttcccaattccagattaaaattgctatgttcttcttttaaaataccaatttaatttcacaaattggagtttcctcttgaagcttttcagattcatgtctcagaagttcaacttttcattgcatctcactgcacataatttgcaggtcatacatcattgcctctagctcttcctccttctcttcctgcagaggtacatcttttcatattgttaaagttgtgactctctccattgactttttagtcagctcctactgcctttttttccccctccagttgttactctgccactgtggtctgatgctggaaaatgtcttgaaggcccagaagagcaatgtcttcctccaggataacttgatctgttctcttggcttttcttgatgtgtctgaattgttccatgtaatgaggcaattttgcatgcttttactttttttaagagccacatattaccctgctcaaggtactagttttcttgtttacttctatgatatgaagtgcactcataacctcgggcagacaattccagtgtcttagagaattctggtatcttttcattgggttcaacttccaggttatttaaatggacttccataagcagacaacaatcacactgcaggaggttcgtgtttgtgtgtttcttaaaccttttgatgatgggcctaagaaacaaaaattttgtgttttatcaagataattccctatgctttatgttgtcttactaggtttttcattagtgagggaaactgagctttgaaagagttaaagttttcttacatccttgtaattttctgtatttatttttgacattttctgtcactctagttaagtgaataattattatttcatgatgacatgtgattctgttttaattaaatgttttaaaccttttgacatctttggcaggcttccccagtatcaaagttctaaattaagtctttttgacttcaaattaactttgggaatttctagtcaggaaattctgaaggatgtgtctctcatcttatgaaagagttattaaacgaattaggcttatttaatatgttgggttgtctggtaagcattgtctaataatagagtgatgccaaatctttttcaagttatatttatatgaatatgttattgatgtgaatgttccaaagattatgtaaaatttatagaagtctgatggctctggttggatgctgtcaaccataattctggttgttatcttaaaatgttacatgcgatagaaataaccgaatttcttcatcaattttgtcattattataatgaaccctgcagagttcaaattcatcagatttttaaaccatagttattctaaatctttgtcatctactgttacagttttgtttcttctctaaacacatgtgcattcagatgcctagaaaagactccagtaattactcttgcttacaggtttctgataacactaaactcagtaggccaagcgaaaatttccagaactctgataaagaaactgatacattcatgaaactgctaacaaaaatcaagcagaacaaaaattaattacatgaagtgaaataactaacaaagatgatgttttatgacttttatttgaaacattgttgtttctttacttaaaacgtttcagttgcagatttaaggaaactttccctcttaagctaattataatttacagctatttgacaaaagtatacctttgttttttttttgtttttttttgtttttttttgagacggagtctcgctctgtcgcccgggctggagtgcagtggcgtgatctcggctcactgcaagctccgcctcccgggttcacgccattctcctgcctcagcctcccgagtagctgggactacaggcgcccgccaccacgcccggctaattttttgtatttttagtagaggcggggtttcaccgtgttagccaggatggtctcgatctcctgacctcatgatccgcccacctctgcctcccaaagtgctgggattacaggcgtgagccaccgcgcccggccaaaagtatacctttgtaaactaaagtggaaaaatttactttttatccctatttgatcctatcaaaattcagaaactacatgagtattcttatgttttttaatggcagtatatatgtttgtgtaagttcaataagaatctgctttctttataacagaatagaactggaaatattggctatattacaaaggttttgactgagatgtgatatttaagttatttataggtactacagacaaaacctgaagcctgccttggtttgactttttagtctcaagagatatttaagggtccaatctgagattactatatgtttaatcactattcttgctacatttatgtaaataattcagtcacatttgacaaaattaaacttattttacaaacaaattaatcttattctcattatctttagtaaagattgggatgactgtagagagaaaaattatgtttctaaagaaaaactctaatatacttgttagatgttggccctgtgcatagtttcttagtttttattatctatctgtagactagactggatcttgaattcttctgatataggagttaagaagaaattacttaggcagatagtgagaatatgggagtcctcagtaaggttttccttttaatgaaaagcagcccccaaatcattttcttttcttacgaagagcagcctattgctggcagttgtgccaataggaagaaactacctgggaataggcaggctcaaaatggcagctccatcctctctttgccagccacacgtacagtaaggagcagacaagatggttctggccaagtggaaagtccatttgcataataagattagggtggggcgaccagccttcccacacacaatgtaaatgtcacacctgatccaatcaatctgtgggccctacataaatcagacagtgccttctcaagcttgcctgtagaatccagtgcactctgccaccagcaggtctttccttttcagatacctctctctggcaagagacagacagagacggctgctctcctctcccctttcttctgcttattaaactttccgctccttaacccattccatgtgtgcgtgtccatgttgttaatcttctcagcacaaaatgaccaaccccaggtatttaccccagacaatgatgccacttcacttgtaggttcctccaatccacttttctctcatgaaattagtgagaacaaaaccacccttttctaaacccgcgtagaatgaagctagacaatttgatgtaaatttcaagggacaagacttgtgcctgatgtttgagccacacggcaagttcaccaaactgtcgaatgctgtaaccagagaccttcaaaccacaaaccagggtgagaagttgacaatttcatgctgggaaaaattcttcccaagacattgaaataagattccttatcataatgagactcttgcccctcttaatttttccttgcttgtgcctacctttttcacttggcaggataatggtatagttaaaatttcacaatcaatagcttctgcaggaagctgtaaaaaatgttgcatctgtcatgcccatcctaaatatttacatgccctgacagataagcccttagcctgcccaatgggtaacttcaacagcatctctagtacaactgttgctcattctgtgttttaattcaacccagctataagatacgaaatgatagaattgctctagattctctattggttaaataaggagatatttgtgctattgccaataatacatgctgtacctggataaacccctttgggcaagttgtgatgcaaatactcaagaaaataggccacatagttacaacaggacttacctaattccccatggtcatttggctgattcagtcagttgctttcaagcctaggttcttggctcaatattattacataaactagaattttcctattactattaattttactttgtatttttctttataaactttgtacttattgcttgtcaaatttcagcagaagtacaactcctgagagaataatgctggctcagagttttgagatgataacccttgtctatgaaactgatgaagttggacttaacaacgaacactccccacagaactcctgatgctcaaatgtggctaaagggtttcatactgactcctaatcagcaatcacttccctctgacatgggatcagagttacccagaacaagttcatcctggcactgatggatgatgaaaatctaaccacagaatgattagtcagcaatggttttagagacgtattttgatcaaaaggggcaaatgtgaaagttgtctgaatcaaaatgaagtcacttgtgtcagacactgacataatgaagccaggaaaggccatgaagaaagcgttttcatgcacaattgcctgataataagactttgacaaaactacaatcatatacaaagccattgcaacctaatacacacacacatacacacactcgcgtgcatgcacacgcttctgtgaggatatctgcttgtctaaccttggactaatgtcagacttgtttttgatccttgcaactaagaatagctgtttcaaaataactcatgtaaccctcctcactttacctttaaaaacccttgtcttcttttgccaccctgagtacttccatagtttactatgacatgttctgcattgctgtgcgtgttcctgagtaaacttactatctttggagaacctctctctgttctgttatttaagatgaaacctttcaatattatacttctaaatatgatgtttgatataaatttagtttagattaccttcatcaaaataaggaagttactttctatttctttcttatgaatgattttaaatattgtctaatatagagtatatatgttgagataatttttttttctgtcaaaggtactatttattttgattttaaaatgataaagcaaccctctattccttgactaaatctacttatataaatttttttgtatatttctgggttcaaagttcatgagattgatttgtaacctccttttcctaatgtctttatgttatttctgtatccatgctattctagtatcataatatttacattctagatttagtttaacttcatcttatttttatggaattttttcacttagatttaccctatatttgctttttgtttttctttatttgcttcttgacttcagtgtttctctttctctttttgatcttttatctaatatgtgaagaaattttttctttaacatttcttctgataggctcctctggtcacaacttctgttagtatctgtttgtctggaaaagttctgatttttgccttcaaatgaaaggatatttttgctatgcacagaattctaatttgacaatttttttcagaatttttaaaatgccatttcatcatcatctggtttggccatttgttttggtaattcagttatcagtcttgttgctttttcctttgaaagtaatgcatctttttatcttttactactgtaaaaatttttccctttttctttgtcttgactttgtcatgactgtgttatgtctctgtggatttctttttatttattctctttatgttccatgtctcagatctgtagtttgaattagtttggcatttgtgttagtttgcaaagactgtcaaaaaaattattaaagactgaatggcttaaacgacagaattttaattctcacagtcctggaagctagaaatccaagacaaagatttaagtaaggttgatttcttccaagggcgtctttccttgtcttgtacatagccttccctttgtgtcttcacatgatctcttctctttaatgtgtgtgttcaaatctcctcttctagtaaggtcaccaagattagggtcaccttaatgatctcctttaacattaattaccactttaaagaatctatcttcaaatataatcatactctgaggtactggtaattaggacttcaacatataaatttaggggtgggatatttcatccaataatagccgtgtaaatgtcttatccattatttcttcaaatgtcctttctgcctcattctatcttttctccttctgagaacccaattagatgcatgagatacaatttcaagtccaatgtatctcttatgctcctttccccaattctttttcttccctatctaatctgggtattttctactatcctatcttccagtttgctaatctttccttctgtgtctagtctaccatcgaatatccttattcaatttttaattttactgtatttttaaattcagaatttccactttatttgttttttacagataattgtctagtgagtttctccacacagtaatattttttgaacattttaaaagtaatagatattttagtcaatgactgatgatttaagtttgttacctgcatcattttttaatctctttctattgtctgtttttttctcttttatttttagtgaatctgtcctgtctcttgacatacctgtttttgttttgttttgcatttttgttgttgttgttggttttggtgtgtttaaacattgtttatcaaaatcggtagaattttgtaaatgatatgatcttccttgagggacagtttactttttttctggcagatatatagatatagatataaatatagatatagatatatatccaattaggaattgagataatatctaaagtgaaaatctgtggtgtttatggaatgtttatcaatacctccttcttgaaggttgctgtgttccaattactgtatttgcagcaagatcaaaaagccaaaagttctgcctagtttattcatattttagatattgttttctgcttggcatttcaacctcttgccccaaatagtttcggaagtgacaaatacatcaaagagattatttggatagaaggtagaagtcactttccaatggtcctcttttctctagtatcttggccacttaaatcctggttgcctttgggtttacttaatactgtttattggatttttggtaatctaaaaattatttcttacaacagagacaaaaattccaataggactttaaagtggaaaaggagtcggttgaagaataatgtcagtataagatattcgtataagatattatttaaattaccattaaattaaataagcatagtagcattactggctgggcacactgtctcacacctgtaatcccagcactttgggatgctgaggtgggtggatcagtcgaggccaggagttgggtggcgaaactccatctctgctaaaaatataaaaattagctgggcgtggtggcacatgcctgtaatcctagctacttgggatgctgaggcacgagaattgcttaaacctgggaggtggaggttgcaatgggctgagatcacaccactgcactccagcctgggcgacagagcgagactctctttctaaatatataaatacataaataattagcactacttaatagagaaaccataagttatctgaaacatattgtcggcagagggggaaaaagaagaaagcagaaattcattttagaatgagaaacatattaggtgtgaaaaaactatataccactgtcatatacaaaaatataatatgtgtaggtctatttgtgaaaggcttttactctttaggttatatagttcttgaatttttaaagctgttcagacactgtaccacaacctcatatcacagtggtacccagaaaatccaaatagtagtacttgtgtaaatagatttctatttcagcctctttaaaggcagttatgtagatactcttaattttgaatttttggaaatagggaggatcattatttcctaaaattatagcacttataagtggtagatagggaattctctcgtaggtctcagactccagagcacaaacgaccaacctttatgaaatatgaacttcctggcttcacttccatctgggaggagaaatgtattcccccttatgctaatccattccattcaggacaatgctcatgggtagaatcctatttattatagtatgttaaactctacttctctgtaactcttacttattaatcctgcctatgatgaatgtgctgtaaaatggcaaagtcaaagcaaatttactacatccttaaactttaagcttattatgtttctggcatttggggctatacagttcccaggttctgcatatgtttgacacggcttcatagataaaaatggcttacatcccgaatatgatgctaaaaactgttttccaaaattggatataaaatgtgtgagtaggtgtatacatgattattgatacgaccttatttttgaaaataccatttaactacataaattatatatagttttacttatgtatttttaaattataaactatttttatttgaaataatttcaaacttagaagacttaagaatagtacaaagagcttttttgcataaactatttgaggataagttgctcacatgaatttgcatcatcccaaattcgcatgtacatacattctcacatatgtgtaaactcgtatgtatgcaatattctttctaatgtctgcgacttggggaagtttattttggtagagtcaaaaacaaagactaataaaaagataagctagaagaaactgttgttttatggtgaatttttcttaattttaaaagataagcctatttgtgaaggaaagtatattatgtatttttctattgattttgttgttcaatttgtaaaatatatttgctaattatcccagatttgggaagaaaacagtttaattagcacttctgaaatgtgtattaaggaagtgacagattcactgagactttttttttttttttgagatggagtctcattctgtcacctaggctggagtgcagtggcacgatctcggctcactgcaacctctgcctcctgggttcatgcagttctcctgcctcagcctcctcagtagctgggactacaggtgctcaccaccacacccagctaattttttgtatttttagtagagactgggtttcaccatgttggccaggctagtcttgaactcctgacctcaggtgatccactgctttggcctcccaaagtgctgggattagaggcatgagccactgtgcccggcccactttttaatgttttaaagcgttagtaccaagaagttcaaagtgactagagcctgattctaccctactcctttctcctccccaaataaactcatcttcaagaaacactttttttaatttttttttttatttttttgagttggagtctcactgttgcccaggctagagtgcagtggtgtgatctgcaacctccgactccctggatcaagcgattctcctgcctcagcctcccaagtagctaggattacagacatgtgccaccacgcccaggtaattttttgtatttttagtagacatgcggtttcaccatgttggccaggatggtctccatctcctgacctcgtgatctgccctcctcagcctcccaaagtgctgggattacaggcgtgagccaccgcgcctggccgagaaacactttctatagaaacatttatctgattatatcaacgacaacactttctttcactggtgcatgacgttgattgcctgtgtgtgtccttcagcatttatctcataaagtaattttatggtgaattacagttgagtgtgtttgtttacaatctggaatgaaatcattaaagtcaatgtcaaagatcagccagtatttcataggacttatgtattcagaaatccataactgtgtttcgaaagcagggcactgcctgatgaccaatcaatgggttttgccagctagaaaaaaggagatttttactctaatttacatgggctgcttcatggtggactacactggttaagaacttcagctctacatttcctacctcagtcattcactgactttttaaacttggacctgtcactcagtttcagaattacttttgtatatgagtatgatattactacctaatttatagcgtttttgttagaaaaaggtgaatcttgaatagtttttggtgttgttgtagaagccatctcaaggttcaaataatgagataatctgttagaatcctaaatgacctcctctgtgatgttttgctctatggtttggaaaacctttagagatgagtgtggcctggcgcttctcttcccattttcaattttagacactctaagacagagaagagaaaattatattagtacagaatttgcttaaatgtcttagttcctcacatagtccatgactgattactttaatccttgtgtactaagaaaacacaaatagaagaatcgacatttatctgtattttaaagttatgagcaactttttcttggctaacgattgatctgtaatgtcaacgtggcttgcattatatgaagttttactggctgttttgaaatggaaggtgagggtgcctcttcactttcaaatgtctgaaggaagattactgtattcgcacaaaaatatttgtacttagctgaaatggcacagaatattatagttctcaagtgtttaattccttctcatagaaattgcaagggaacttaggatgcatttggcaggcgctttctctagtgcaatcaggttgctatggcaaacctattattttaggcgaagaaggactatgttagtaaagtgctaatctattttctgttttatgtgagcctctaattactccccaactattgagcacatactgcaagtgtggtttttatcattttaaaaagtgaaaaaaaaaataaggtcatggagagtgtgcctactgttaccacaccagcaggtgcatttgatgatacagtgctctcctgaaatcatctcattctgggtcgggaatacactttttttttttttcatagaaaagtacaatgaaaaaggaagtgaacaaattgtatgtgagtaattgaactccaagcctcccagctgtgttttacttattaaaatatgataataatatctaatatttgttgaacacatactatgtgccaagccctgtactgtgtagtttgtacacattataacattcagcccttacaatcatcctgtgctatgggtattatttttactcccattatgcagccacaataaatgaggtttaacttattcttccaaggaatcacatttagttgtgtatgcaccaagattaaaatccagacctattaaaagttagagcccacatttttaattgtacctgtgccacaaagtgtatttcccttttagacacttaaacaaacacattaagactcaaccccacattatctttgccagaacctttctctaaccctgcaggccctgtgtgcacgtgcattttaccttaatttcccctgctagtaaaagtgttaaaacatccttctttcttttgtatctcaatatctagcatgatacttaccccacagttgatagtcaaaatgtgtctggggaatgatcaaagtaatgcagacatttaagattgtgagccctgctaaacctattcttcagcaagaacatgtgtgttctctatgtggggtagttagaaggaagttagtattcttcagcggaacactttaaatgtgaccatatagggaagaaacgtatgtgtatgtgtgtgcgtgtgcctgtgtgcatatgtgtgtgcgtgttgcatattcagtcatggtttctgaaggtgattacaatttttaacactagcagttcaagtccaggcatctaccctgtggcttctgagtttacagattttcaccctttcacaaatgtgcaaaaatgttactggtggtcatgcagaagagatgtacttggtcctgaataaataatgactttcctgaattagttatctgaggactctcttgattgtcaatccatgaggttagtgggcgactgtgtctgtcttgttcgtcttcttgtctccccatccaagatctagaaacttagtccctgctggtttgaaacctgtgtcatgtggaagtgagaccttaaagcgagaaaatcaaagaaagtgagggaaggagatgtcaaagtctaaggcttgagatattggttgtggttgagattatgaaaaaagaggaatccaagaagaaaagaaaaacctggaagaaagagggaaggagtgaaggtggtgtgtgtctgtgtgtgtgtgggtgtgcgcatgtgcgcatgtgtgtatatgtgtgtgtgtgttgggagagaatagtcagaggggaaagggagggagtagaggatcaagaagaggcagagaaggagagaaaagaagaagaggaatatagcttgaaaaacaaatgtcaaacttcacaatttcacaatctttaccttataccagttttagaaaattaacctctaccagaagttgacaactttccataaggcagtgcttccagatatgagtcatccatgaatgtttaactattaaaaaataagacagacaatagttaaataaaagattgtggaacaagagatgacctttccatttcttctcttaccctctgattatttctactgtaactacactccagcaattaatcaggatgtgaaccaatgaaactactaaagttttaatctatttgtaataatgcaaatgaggcaatctgtattttataaaggtcacaagctactctttttcattttgtcttatactttagatatactgacttaccctataagtaaaagaaaagttcgactttgtctttctagtattaaaataatagtattttgtttatataaatcttgcagtatcttatggataacattccaaaaaaactgtgaatgagagtttcttccaggctatatcaagtaaaatttagtaacaaagatttcagaaatgtcaagtatttcaatgaacacggtaactttcctaaaagtgtaattatttcaagtttgcagttaatttccatcatatttactaaaagacaaaagtaatttcatgttcacaatgatcaatatatattacttctattgtgaataacccatttttgccctcagttcatttttcttttgctcatttattattagttatttttattttaacttatacacatagtaatgttttcttagtgtctatattgtttgtacaaatattttgtccttgtttattgtttatattttagtcttaggttattcattgctctatagaaattgaatattgaatattttatggtcaaatttattaatattgtcctttatatttctgatttggtgtcatatttagaatagttttctcacccaagtgttatgaaaactctcacctatattcttgtctagttttatgacttaaacttttacatttgaatgttgaaacccctggaaacgtatttagttgtaaggagtgaagtaaaggaaatgaatatttttgaaacatggctcaccaattttatcaaacatattttttgaataatccattatgcccagaaaagtatataacataaatttatagcattatgaatcatataaagtaatcacatgcccagattcagaaatagaagaatgccagaatcctaaaagctccattctcacttctctgaaatcagcataccctctccctaaaaagataacctttattctcatgttcatgtaatcacctctatacctgtctttaaagttttccgcctagatatatattcccaaacagtgtgatagttagacgtgacttttttggaattaatccaacagcatgcattgttttatgactgagttctcgcactctacattatgttcttgagactcaggcattacgttgaatgtatttgcgattctttcttttaattgctatagtgtttcatttaagaatatagctgatatgtaagtattccgtaattgatgaacatttggggcatttctcctttgaagttgctaagaataatgttgctatgattattctggaacatttcctggttcacatgtgtatgcttttttctctagggaacttacccaagaattaaattgctgattcttagattatgcatgccaacttcactagataatgccaaacggtccccagaatattctaccaatttatattctcaccctctgcaaaagacttatctgtatttccaaaccattgccaatgcttattagggtcagtttttaaatctttgctaatctgattgggttggggcagaatctttttgtggttttagtctgcatttcccatgtgaataagaggaggagtatcttttcatatatttactggccatacaatcccatttgctgaagtgcccattcagatctcctgcccatgtctttaatggattgtatgtatttgttgttgttgttgttagagttctttaaatagtttggatatgagacagttgtcagatatgtgtgtcactgatatcatctctcattctgtggctcaccttttcactctcttattttctaatgtactagagctcctaattataattcaaatggttaatattttcttttttagttacttactccagcaccatttatgtgaaaagtcatctttcctttgttgcttttcagtgtcaccttgtcctaatccagtatttgtatatgcaaggaattgtttttggattctctattctattctacttggtctccacttccaccaaaatccaacttttatgattactgtgcctttaaaataagccctgatatctatttcaaaaggtatttctacctccttcttgttcataagtattttcgttattggtgctttccatttctgtataaatgtcataattggcttttaagctttaaaaaatcctgataagattttggttgtagttacatcgaatctatagatcaattaggggatatttggtattttaacaatattgaataataagcatacagtatttcttcacatttaaatctcaaagctttcatttgtctatgctgcatatacatatgtgatttatttttgtatatatgtttgctatagggcaactaatatactctcttaataatccatattatttgttagtagtttttgcattgtctacatgcacagttttcggttaagtaatttttgtttccttctttcaattctttatgtcatctttttatccttaccatattctaccgacaaagacatctagtgcaatgttggatagaactaaaagataaatttatctttctcttattcctaatccaaatagaaggttttaaaatgtttaccattagcaccaaccaattattattattaagtgcatgcatatcctttaacattttttctctcttcctctttcttcctttttcactagtaaaacactttatttactatagttagaggacattttatttggttgaataatataaaattgatgacgtctgactatttttgacttataaaaagagtcattttacattgttcagcttacctgttatgacatttctccacttattttccatagatacacacagactctgtttttaaagtatttctgaatattaccatacttgttatttcagacaaatttgagaatcatttcatcaacttgaaaacattcagtgagtttgattggtacaatattgatttattaattcaggaaaaatcagacacttcttaataagaaagtatgtccttttaaaaattataagtcttctcctatggccttcactatgactttatatgcaaagttgtataagttcatttattttacgttgctgatatttttgtacatgaaacaattttccattatattaggttgggttagtgttggcacataaaaattttttcatttctgtatgttaattttgtcacaagataccttgccaaaatgttttattcctttaaatgcatttgtaatttttaaaatcttgggcataaagacagaccatctgctaataatgatcttggctctttattatattgtttgtctaatttttattaaattgcacttaaactataacaatggttgttataaacatctcccatctctaacttagatcactccctgttaaccataatgttggatttcttttgaaaagattattatatatacctgttggcattagtatttaagcaattttctagaatagtgtcttctcaggggatgactctaggccagtgatatatttgagagtgttcatcatgtaagacagttgtttaatccatgggatagcaggaaattttggaaaatatagaggaaagaaggttcagggctgagccatggggcaatccaagatttagatatttgtataaagatgagaatccagtaatatagcctaagaagaattcgtaatccaataatagctaatagaagaaagtatttcccaaaagggcagggtcaactctcaaaagcttctgagaggttatataagatggtacagagaattggccactgggttggggtcattggagacattgctgaagaagtacttgtcacatagcagtatcttgaggtaattggattgggttgagatgagactggagttaagagaacagcagcaaacttctttttgggaagtttactttaaattgtactttgctgctatgcttttgcaacacaaggtgttttctatcttttactcatctatgttttgcccggttcctatgttactcctcccggcaaccaccaccaccactgctttcccctattagaatgaagcagttctaactaagcctccttttcctcctccttattctcctgcttctccttttagctgcctttgaggtttagtctctcatatatggcaaccatataaagagaaaaaaataatgtgatgtatttttcatggattatgctgagataatttttgaaggcagttcactgttagtgggagaaggtgctgtggtctataggtgaggtctggaaggacttcagacaaatattcaagtgctgactaatttataaacccagagcagaggttttacttccagaattatttttacatataatatattcaatctaatagcattaaaatgctatccaagaatacacatagcattctaaaattttaagcttccgttttaatgaatactttaaagattttgagctagtcatatagaagattgggtttaaggttagaatgagataatgtggattatgttgagataatttttggaggcagttcattactagtgggcgagggtgctgtggtctgtaggtgaagtctggaagggcttcagacgaatattcaagtggcaactattttataaacccagagcagagttttatttccagaattagttttacatataaaatattcaatacacaaaatgctattcaaaaatgcatataacattctaaaattttaagcttcctttttaatgaatactttaaatattttgagatagttatatagaaaattgggcttaaggttagaatgagataatgttctagtaaattttagctgtctatatattctattaaacaattattacatatattgtgaccttttagttttatactagtagcatttttttattatgaagttagtaatgctggtcaaaatgtttagggtttaattttggtgatataatcattcctccacattttttggtagtcaatatgcagtaaaatgaggtaaatgctatagaatagcagactttagagacatatatatcttttatttaacagtgtactcccatatctaatcgtgtatttcatacgaaacagattcttaaatatttgttgaattttatataaaatattttggagtaagtgaatcaaggttttcacattttcatgtagttcttatgagaaaaaaatgtactctaaggtgaaaatagacactttatctgaatcttatatcttaatgattgtgggaaaatataaatttaaagagatttaaattaagagtttttattaaaatgattacctgcacatagttgggctttttgcttatatcttgacttataatttgtctatattttacacaagttcagagtctgaacttgtttgaatttttaagtaaaatctattttgatcggaacttctaaaaatctgccttagttcattattcttctttgatagcttataatgagctttaaaatataattcataaaaaatgcagttctttatgaaatgatatcattggaatgattttatatgtgcctaaagattatctactttattaaaacttaataagagtaggcagactcaatgtagagtaaatttcagataagttttggttggatgatattgatgatgttggctgaattaatttcttctcacacagttatttctatgctcctttctgtctgtttctgaattgtcttcttgcaaattacttgctttatttttatttctttgggtatctctttttttagattttcttttaaatatgtcgtataaagtagcacagtgctagaaaggcagatttccattttccttctttctcatgtatgagaatattaatttggtattgatttcagaagccacagttgtatctccataacagtaaaacaatcactgaaataataataataatattatttagtaaacaaaagaaaaagattggactcaatttcttatctgaaatcaagtcaataaacctgtatgtcagcatccttctactacattaagggagaacttagttggctgctaccaagatacaaatctcaccgttagtctggaccgtagtgattttatcatttaacaattgggttgaggcacttgcttatctagtttaaactttgcattcagtattctactaggtatagacaaagggctgtgggatcagaaaggtgacaattcttccaggtaaccaacctgggatggcaaggaaggtttcagaggagattagatttgggctggctatagaacaccgagtaggactttacagagaaaatggtggtgtgcaccacggagggaagaaatagggaacataaagtctctgaacatgagtgctctataattgctggatatatacttgaaaagtttaagttggaccatgtgtggaaaactctgttgaagaatctagtctttgctttgaaggttacatggggccatcagagggatttgtgcaaaggaattacacaatcatatgtatgtttttaaaaagcagattatgtggattttcacagaagacccaagaagaagagtaggtttgtgaatacagatgatgaatttgtcgtgggacatatttaattgatctgaccatggaaaacacaaatgaaggtattcaggcaattggaaatgaatatctattctgggagagatataccatttcaaattcaagttctaccattaatgctcatgtattgtgtgaatatttctatagtatttatatatgattactgtttaatgcacgtgttcaataaatattgattcaaaacattatgattgccgggcatagtggctcacacctgtgatcccagcactttgggaggccaaggcgggtggattgcttgaggccaggagttcaaaaccagcctggccgacaggtgtaatcctgtctctactaaaaatagaaaaaaaaaaaatcatctgggtgtggtggcgcatgcttgcaatccgagctactctggaggctgaggcaagagaattgcttgaacccaggagacagaggttgcagtgacccaagattgcaacactgcactgccagcactcaagcctggggacagagcaagactctgcctaaaaaaaaaaaaaaaaaaaaaattatgaggacacataagaagcatagttaattttattgtatttgtgaaattgtgtgagtaggaggatgccaatgtcacagatttggtgaagttttccttggaccttgaagaatgattggaaatttacctgataggtatatgataatgactgaaacaaaattggtagtgatttgtggtagtggctaaatagaagttgtgaactgaggcagcaaaataataaacttacaaaaattagccaggcacgtgcctgtagtcccaactgctcaggaggctgaggcaggagaattgcttgaacccaggaggcggaggttgcagtgagccgagatcatgccactgcactccaacctgagtgacagagcaagactctgtctctaaaaaaaaacccaaaaaaatatggaatgcatgaagaatttactcttttttacctctctgtctgcaataaattagcctttcctaatgcattatattttaattgttaactttttaaaaaatgttgtggatatatagtaggtgtatatgtttgtgggagacatgagatgttttgatataggacacaatgtgaaataagcacaccatggaaaatgggttattcatcctctcaagaatttatccttttgagttacaaataattcagttacactttttcacttattttaaaatatacaattaagttattattgactgtagtcatcctattgtgctaccaaacagtacgtcttattctatttttggtgcccatcctaatacgttatttttgatttttatcagaagccactgtatcttataaactgtattagggttacatgcaaaaggttaattcatctcatagttgccttagtattagtcattttaaaactccaatagatacatggtgaaaaaagaattggaaattggttactatattctctgatattttaaaaagatatgtgaattgttatttatcaggaaagaaaatgtgccgacgccagaatattaacactttattgtctaactttacacaaaaatatgggacagaaattatccacaatgaaaacaacggaatgttgaaatctgaacacatatgccagtgtttagttcatcttttctgaagaggcacagaagccaatgaggcacattcaggaaaattacttaaaatgtgaattacttaaaattacttaaaatgtgaataaatttgtcaccatgaatacatataccctgaaacgtagaaactggttctatgtaactggaatgcattgcccctcaggaataatgcaactgatgatcatggcttcccacatctgtgtgtgaaggaacagttcaccatatccagaccacactgctgatggtactacagtttgcctctttctccccacagcctgcattattggaatcatttgcacatccacccatgaaaaagattagagcatttatgcacattgaaaggtgactggagttcagaaaatctaggttctaaaaccaacactactaatagatagagagctggccttgggcaaatcatttagccccagcatgcttgagtttcctcatctattaaataaattgaaggaagtcatggatccttctgacattttaccaaaaaaaatgtgtattggtatatttttccagggatagatctgtgttctgccaattatggttcttgattacaaacaacaaaaccaacttcattaaaagggataaaaaatattttattagaaggctttaggctcagaatgcaactttgaacaattagctcctgcagcaacctggggaagcaaggcactgccaagaaccagttcctgctgccatcacttctgaatgtcagccactgcaggctgagcttcaaggctcccagaattgctatgctgttgcatttgccacactgcccacagacgttgtgcctttgctttcaccctcaagaataaaagccctgaccaagggtgtctgatgtgtgcctgttctagctgccagggtataggaagagggaatatcgttgaaggagggacccctgcctcctgctgaacctgggactacctccaagtagagattagttgaaggtcagccagcacaacactgtattgccatgtctttcaccagattctcaaagggatcgtgaccccatcatgtcagctagaaaatattatgaatcattgcattagattatctttaattacagctctgaaattatatgatcctaaatactaatttttctttcccccatcatccaccaactcagaatttctttaacaagatacaagttcagcaacagagtgactaacaacattgcaaggtcagccctgaagcatcttgtgattatttcagtgggtgtgtaattatgatggttgggctaatgacagggagtaacagatgtctcggagcactgtcacccaagcaaatttctggcaaaccagtagtgattcctcaaacaaaagaaatttactttctcatatagccttccggtgctgcattagatgtacattaagatacaatgtggtttaatggttagttgtgcaaactttgaggttaatgagaatggatgtaaattttgaatctatttcttcctagctggttcaccattggaaagttacttggcctcaatatgtctcggcttcctgtttagtaaaatgattgtaatgattctagtcaatgtgtggtgttggaaaatgaaatgatgtcatgcagggaatgatagtgtttgacacatagttaccactcaataaatcatgatgaaagtcagcataatgggactagttaaggggttcccaaacgatgaaccaaattcattgcaaaaatatttataattttaaattttaagacgaggataataaagatatttaggttatgctctttgacataggttctatgctaaaatgagttctatgaactataaaattgactacaaatagtcactaaaatagcacattgaaatattacctatgaccactttttttttctcatggagcagatagacccaagattaaaacattttaaaatggccacatcatactaaattatgtcagtatatataatgtattatgttatgttcaaggaatcatcaggataagttgtatatgaaatagccagagagttttataatggatttattcaaaaatgaatgaaacaaaaattagagaatagcaaatgtgaatgacttctgagacagcaactgccacttccactccagaccaccacggaatttcttcttgaacttcagcttaccttagggaggttggaaatgtgtatttgtgtaactattatcaggcacagactggaactattctaggagatttgggtttaatagtgtgctcacctccttgaaagccttagtgattccgggactctcctcataagtgtgcactttctttatactttccaggtaaatgtgaatgtggcaaatgcacctgctatcctccaggagatcgccgggtgtatggcaagacttgtgagtgtgatgatcgccgctgtgaagacctcgatggtgtggtctgtggaggtagtaacctttctcatagctgtatgctacctgcatgcaacttgctttacctgcctttgttattctactgactcttgctttttcaattgctgttaaaaataagataaacagaaagcaatataccattgaacctaaaagcaatatacaattaggtttgtaatgacttttatttccctgaactctttatttagcaggtatgtgaaagtacgcagtacactatcaataaaagatcattgaatctaagtactaagatactttatgatcgtgaaaggttttggggcaagtcagcattttaacatgattttcattactttatttataaacactggtaggagaaagtataatatcacccacaaacttgaaaaaatggagtaagattactcttagaaatcacaagaggtatacgctcagattctatgatgcctctcatacccaaacaagagctcactggcattaataaactgtccagagaatgagtgaggcagatagaaggtagtgagcagaggtaacccacaaaaatgagagtcccaggagtagagtgctgatccgagcacctccatggctgggaatgtgggtcaacattattcttgcattgcattcttgaaaaagttcatatcgctgaggctgatgcatgtgaattacagatctttccacgtttccagtataaatgaagtgatgtggacatggaattacattacaagaaaataattatatccctttattgggggaaagaaacagaatgtgtgtcttttctaacttttattttaagttcagggatgcataggtaggcttgttacatatgtcttattggagggtggagggtgggttgagggagaggatcaggaaaaataactaatgggtagtagagtgtgtgtcttaatggaaggctgaggcaccatccatccatcctatctgtctgtctgtctatctatctatctatctatctatctatctatctatctatcatctattatctgtgtatctattatctatctatatcaatcatccatatgcctgttctctctctaaccaacgataagacatttgaaacctgacaaaaaaatactttcttctttcctttctctgtgagttgaggggaaaagcccttttaacctgttaatgactgaggttagacttttttgaatttttgcagtcagaccttggtgatgacctggagcagtaggatataaaaaactcccacatgcttagcgtcccaataatggaacaccaggcataaattcgtaaaacatctgctgtgctgggcagtttatcttatgccattgtcatggcagccaccctaagagattgtttctactattttttctttcataaatggaaaatagagtgaggttggagaagttaacatcccataactaaaatgtggcagacccagaatttcagctctgatatttagttcacagatcgttccttatgtcagtcacagttttccctagagtgacaccaacgtgttttaacaatatgtcaatattattcttaggttaaatcctctgttcactggtattagttaaccagaaatacctatgtaggttttactctttttgtttgttaaggacatgacatatattaactcatttatttatcatagcaatatgtatgtatgtatatatacgtattcatgtataaaaagcttgcctggccccttgaaagtgccatctacatgtctctgctcttgttaccattgttacttttcttttcttttcttttcttttttttctttttgagacagagtctcactctgtcacccaggctggagtgcagtggtagaagcagagctcactgaaacctcaaactcctaggctcaagcaatcctctggccttaacttactgagtatctgggactacaggcacataccaccacagctggctatttattttttgtggagatttgggggtctcactaagtggcccagattgatcttgaactcctgggctcaagggattctcctgccttggcctcccaaagagctggaattacaggtgtgagccactgagcctggccagaaatggcttttgtatgttttttctgtctatttgttgctttggagtaatctcagtctcttccactttcatatttaggtcaatgtctcttgaaatgattgatcagcaatcagtcatccttggctttagattcttttcaatttctaataaaagattttcatatgggaattcctccaaattacgcatggtttaaactgaagtaattattttttcattaactaaacaaatattcattgagtgtctactatttgccagcactagacattcagtggtgaacatagagcatttgctctcctggagcttatggttgagcgtgaagggaggacattgagaaaggaatgaaaaggagctgagtgatctgaaaagagatttgattcaatgggaatatacataacggggatttaacataggctgaaggctaagaaagacttctctaatgccttcatatctggataacaactatgtaatgcagactatgtgctttacaggtattaactacacctcacaacaatacttggtagtaataggatacatggaacttggccaagtaggggaagtggggtacagtcagagagcagcttgtgctcagttgtgtgggagaaaagagagtgtgtgacgtgtgccaggaacatttgaggaccagagaaaaaccctgtgtgattgcagattagaaaaccaaagggaaaagagtgtgacgtgttttgtaaacatgttaataacttgaggctttactctaaaggtgacaggaaaccaaaggaagggcttaaacagagcttaaacatgatcacagtgttttaaaaagtacttctggttgtcagatggagtatggattgctccaaggactatgtgtgtttgtgggttggtaggtgaatctggatgttaggagatgagccctggtgagagatgaaggtgccttagctggatggaagacagtaaaggtggaggatcttgaatgtgttggagaacatgttagaagcagtggggtcaagagactaacaaaacccttcaccctgctgcaagagactccagcactctgttaaactcctagctctggttccctggcaacagatgaagatggtgcattgcagtgttaacaagcaacattgctcatggtcataatgatttatgattgataagtttcaactacattggaagagatgatgaattgaactataagcagctgatgggaacctcatgcttttggatttcataagtgtcataactctgccaacagtcttgtcccttgtgggctccttgaaagctgtttacggaatcatcgggaaagattttggctcctgttgggcgtgcgacttcttctaagccagaaaagcctcaacatctgtgcagtgtggatctcatctctgtgcatatgggctgtgttatcccaagagaaaatagtccccaattatatgagttcatcctcatgaactcctgcaagaactcccatgggtatatcctggtgcctgacagtgcctgctggtaagatgtggctcctgtcccacagccttcaaaggagattggtggcaagtgtcagcctgagagcttagttgaaacttagagctccctccccagagtacaagcatatttaaggaaattcatgattgcacaatatgaggggcagggtaggatcaaggatgacaccaggtttctgttttgagcaactgaatggtggaggagactatgcttgtcttgaccagttgtctccatttcttgaaaaattggtttcttcacagagagcaacagagatggagaaacttggatatgttgctccctttggaacatatcccttgggtatgttagttccctctcctagtccttattgtcacttctccttgtgaataacttattgtctttccattcttccatgatttttccaaattacctcctataggaagcctctctgaaatgatgtcctacttcctctataccgcaccacctgcatcgtagtgtgatgaagttgtattgagagtgtccctgtgtcccttttctttaagtctacaattctcatggatataatcaatctctctctctcattatcatatgctcaaagctaggataaaggttagtgctcaatatttttatttgaataaatgatcaagtaaaggattcacaattaaggagaatgagaaaggaagaactattccagttttggatacaggattcttcaagttgaggtgaggatgtgatttggaccttgaacaactagtatttagatgtgcagaaataggatgtgaagaatattttaggcctgggaaagctgggcaaaagcacacaggtgaaaagttatttattagatattgaaggaaaatatcgatttcattttttttttttacatcaagagctctttctcagctgcttctgtacccatcattagaaaggatttttttcacatattacttactcatgtattatttataatatatattatgtcaccttcatttcttatacttggctcatctttagatatcaggtctttaaaaatattgttaaattggtgtttttgctttcaaaattaaaaaaatatatagagagaaatggaaaccacaaaataaaaatcacccattaattgatcatcctagaataatatctgatgacactatgttgtatttcttcctaggttttgtttctgaggagtaaaattattttcaaaatataaattcataaatcttctttgggtattttgatattttgtctagagaaagtccacattgtatggtatcctcagttgctttaatgtacatggtgtgcactttgttgcattttttcatgtaagatttaagtgagaagaagtaaccattttctttggaattaagtgaggcagtgccatatagcaagacgaatgggaaccctgtattcagacagaccaggattttaattctgggtctatttcctgcttattgtagtaacttggacaggttgtttgtcttctctgctttggtttacctatgtatttgtttgacctgtctaccttggtttactcctatatacaataaggataataatccatttggctttatggaaagaaagagacataaagacggaaatgtgcctggtactatgtgccagtgaatatttgatgaatgccctgtatctgtaataaaaataaaagattgtagtggccatctgcattacagaacaaaataatacatctgtctcaggtatctggaagcactagctgcagagcgttttgcaaggaagttggactcacacaaatcagcagctctgtacctcggggaggaaattgcagctggtttttccaaagcaattagtcccccccatcatctctccagtggagaacaaatcttactaatatgagaatgtgaaacacacagacatcatccctctgttatggcttcagagaataacaaaataagagagtcactcattttggtaatttttttagttctccaccagacactaaaccataagatctgtggcctttcatatggagaatataaaacctatatatccaacatgtggccagagagtaaaatatggtacttgactccaaaatcagggactgtcttagcattttagcaaacaagcaaataagtaagataaaaaacatgtataaacttaactgatcagcagatgcatgagcactaagagccaatagtgtttatcccctttcctaccaataacactaaagatgattaaaccaattctgataggttggataaattagcaattgtacctgaaggtgaatgtaactaatttcataatttttacagttcagttttgattacaccaaaattacaacctggaaaagagtcatgaaaatgactagcagaaagaaaatcagcatgaagtgagatcgttcttcatttaattaacttgtgagtcatgttcaatcatcatagactgtctgtggatgttctcaaaacatctttattaaaagaagatgttatgcaacctatgcatgcatggatttattatcagataagtcactatttataaaaagcatgacttgtccagtgatagttcgtaagatttatttattttattggtatatcattttaagattacacaagtgaaatatattcacatactggcacatgtgtgtttaattgtttagcctaatataagttaaatcagagacttccctcctgtgtgccatatacctagggtgagaataagaactaggctgcttattgcttttcttctttcctctatactcctggaatagctacccatgagtccaatttaaaaaacaagaagggataatgaagagccacctcttaattacacaatcagttcacatttcttcagggagttctctagttcatcgctgcaatttgaaggagatcatgccgcctgagagtatgaattcagtgactcccaggcactgatggatttcttgtatgaggaagagatcagatcacacactcagactaaccctttcttaactgaacaatacagtcagaatgtgattgtctccaaattacatcttaaaattgcacacctgtttcgtgaatttgtaagaggatcagttagtcctgtgtttggctgaaggtgatagacacaaatactgagtcttcaggttgtcattccagggttggatggtgaggcgactgcctgagcaccacagtgtccctgaaccccatctctctcttctgctctgcccttccagtatgacgtttatcattgttatggtttggctgtgtccccacgcaaatttcatcttgaattgtagtttctataatccccaagtgtcgtgggagggaccaagtgggaggtaattgaatcacgggggtggttttctccatgttattctcatgatagtaagttctcacgagatctgaaggttttataaggggcttcccccttcactcgactctcatacttcttcttcctgccatcatgtgacgaaggacatatttgcttccccttccaccataattgtaagtttcctgaggcctccccagtcatgcagaactgtgagtcaattaaacctctttccttccaaattaccgagtcttgggcagttctttaaacacagatgttgttatcaatgaatggtccatgtagatgattctccaacagttccaccactcctgggtgttcctcttacaggtctaagtggcaacacagtcgtgttggtgagacaaaagatgaataaaactacttctatggtcttattttttaaactcaaatttccaggaacattccacttagtagacctccagtatgggacacgctcctttgtcatttcatgagacaacacaatcttagttttctccttccttactgaatgttcttgtctggcttctctagttacctaactctaaatattggggtccccaagactaatttctccctggatagctgcttcacttctagggctttaagtgccatccacatttgtaagctctaacatgtgtatgcctagagccagcactaacatgttctctgagcagcagcttgtgcctagctgcttacttgacctcactatctcattgtcttaagagtgtctcaaatacaacaggctcaaaacagagctgtttttctgccctcaacctctttctcctgaagtgcccctacccaataaacagcatcattattcacactatttcttctagctagaaaacttgtcttgtcttttcctcacttgccacatccagtccaacattgtgtcccacatatacaggctccatcaccaaaatagatttccatgtacttctctgtgtttccactgccaccactgtcctttaagcttctatcacttttcacttggaaaacagcaagaaccctctaacttccccatattcattcctcccaacataccttaatctgtcccacctagttgccaaatgagtttgcaaagtgtaaactatatcgtcacatcattcacttccttaatatccttctgtcatttctcaatcctcttaaaataaatttagattttttttaccaagagtaaatcatttgctatgttctcatttctgagaagggaatatttctccaccttcattattcagtgtttttgacttactattcttcaaacacgttggccttcttttactgcctgtaacatgccaagctatttcttgtcccaagaacttttcatttgtttttctaggctctgttcctagaacattggctgtctggctccttctcatcccttggctgtcactgaacccttccctgactaccctagttaacagtgttcttgctattgaatatactagcattttctttttgtcttctattactcaaatgttgcttatcgttattttcttccctagaagaccgtaattaccatgaagacagggccaatgcctattttacttactgttatattctaagctgttaatacaattcctgatacatagaaaatatttcttgaagagataactaaattattagagtttattaaaaagagggtattgaaagttgttttgttcttaagtaaagtcatataaatgacaactcaaagcatttgaatattaatgtattttgatgattggctgagctagataccaacttaacttcgtggaaggatataatagattagctaataataaaaaatcatcgccaggcacagtggctcacacctgtaatcccagcactttgggaggccgaggcgggcagatcatgaggtcaggagatcaagaccatcctggccaacacagtaaaaccctgtctctactaaaaatacaaaaattagctgggcgtggtggcacatgcctgtaatcccagctattcgggaggctgaggcaggagaatggcttgaacccgggagtcggagggtgcagtgagtcaaaattgccactgcgctccagcctggtgacagagcaagactccatctcaaaaaaataaaataaaataataataaataaataaaaaatcatctattttcttgcataacattttatattatttgcaatgagatgccataaaattattcttaataatattgtaaatcaaaggcagaatatcaacttctaaaaggggaaaaattgtctcatactacaacatggaaggatctttaagatatgttaaataaaataagccagtcatgaaaagaaaaacactgtatgatttcacttatataggtacctagagtagtcagatatatagacagaagctggaatggtgatttccaggagctgagaagagaagggaatgggacttactgttttatgggtgcttagtttcaatttgggaagatgaaaatattctagagatgaatggtggtgatggttgtacgacaatgagaatatacttaatgctactgaaccatacacttaaaatggttaagatggtaaattttatgttatatctattttaccataataaaaaatattgtagaaaaaagtagccataggtctactttaattatctgtttctttttatgtgggttttaatagattgtgtcttcacggaattggtccaaatgatccaggttatcagattcttggacaaatcattgtttgtaatattctattattatccttttaatgtccataaggtaagatataatcatctctctcttaattttcatattgaacatttgtgtcttctctctttttacttgtttagcctggcctaatatttatcaattttattgatcttttcaaatagccaacttttgttttattgattttctctgttggttttctatttccagttgtattgatttgtcatggaattgattgtatttcttttcttatgaccaatttagttttatattgctcttctttagtgttttaaagtgaaagattacatcactgattttatatttttcattgcttctgattgcattcatgctgtaaatttctttccaagtattactcttgctgtatcctacacattttcataatatgtattttcattttccatatagtactaattaaatttgaaaaaaaaaggcagaaaacaaaaaaaagacagaatatttttctatgcaatacagattaaatgatttcagttgtgtcaaattgtgataattcttaccaacctagggtcagtaagaaacatgagcatttgagaagttcatagcccaattgagctggtactagaagctctctttctcttcatttttggtttcttgtacaacagattctctgccttcaaagatggacaactttttatttaactctttaaggacatctggactttaagtggactttggttttcatggagaagtaaagatgtactcaatttaacaattattcattgagtagataggggcgtaggggtgccagttttctaacttggctctactctacagtttgatttgtgggtaaaaatgagaaagatgttttgaaaaagacaatttcaatctcctccaagtttttgaagatccactgtgtctcaggcattgtgttaggcactctgaagactacagtgctgacagaagtaatactcagaaaattcatagtagagtagtggattcatttgacacataactatataccatgagatggaagtcaaaaaagttccacaggaggtaaaaaaaaaaaaataaggtattacagaaattcagaggagagacaatgagtctcacttagggatattaggtaaatcttcacagaagggtagtcgctttttgctgagctttgaaaattactcagaacctgaatgtgtatagtaagggaaaggtacttctacctctgcaaaaacatgaggtcagaaaagcatgacaaatgtgcaggaaacaatgaatgggccagtttggttaaagggagaagagaaggaatacaattggaaatgtagcttctgtttttcaagaagctaaaacataacaaaggctagagtaggtaaactctatgccatgagtattaggaagttatacgggactaaatatcaaggcaagttgtgctgtaggaatctacgagccagagtattggagagacatgacaggaagttttttccaacgttgtgatggtgatgtaagtgggaatgttggaggtggtttcaacaagacttgacaacaagctggatgagggcagtaagggaaattcaaatgagactcaaaacatcatgaactggttgattgaaaggatagctgttacattaaaagaaatgagaaagacaagcagcttttggaaagaaaatcatatatggatgtaggagatcggtcagggtggtgggaaaaattgtagaagatgcaaaccttcttggaaggctggaagattttacaaaagctttggaaaaggatttggctgaaggcagccagattctcttatctggtgaaactaatctaaataagtaagttaacataggccttggaacctgggctttgatcatctgagtgcaggactactctctctggggaggggaggggacgggagagaccatgtaaattgcccacaagtgtgttgactcagagcctttgtgattaaatctatactgaataaatgcctgcagtgccagcttgtcagggccacggctgctgactctttacagcaccctccttggtgtctggtgtctgtgagcagcctggtcccctagcccactctttcactggatacctgtgtctgggtgcatttgttcatccgttgttccaccagggtctatgggtcggaccctgcctatgtagctctggaggtattaagtggggatgctaatagaacacaaagtgtggaatcatgaaaggggaatgtaggagaaaatcaggggctggagatacagccctgtggtcttggcagttatctgaaagcccaaaatttaatggatttttcaagaaagaaattatggagagattaaaaaagatgattaaagataaacattgggtgaatacctgcacttattcattcagtaaaaaaaaaaaaaaaaaaagtagaagaataaatagagacaaaggaggagtgttgaatgaggccaagagaattttgtggcatgccaatagagaagagacttgcaaggagagaaagtgcctgtgaatatcaaatatataccttcaaatgatgtggtggttgaaagagacaagaattaagaaatcctgctgtgtctcactttctaaagtgaaatatagaagcaaagcaacacattgggaagagtgtagacattggaatcagaggaactagagtcagttccgatctggctgagccaattatcggtcacatgtttacatgcatgctacttttaaactttaatggtttcagtttttgggttttttgtttgtttctttgtttgtttttactttgcatgtaaatcaagctaggtgaaaaagaccacaattacctcatttatttgtttatttatttacttttttccttttttgctaacctgtgtgacaagaacagtcattagccttagaaagtgccagagcacttgctgattgagtgcatgttaaaggtatggcagcgacatttttcttgcagatttagtagtcccccattcgtatccgatgtttttcccagaatattttttaaaagaatgtcagacattcctagtatcctgtctttctttcaggatcccaattttctccaggggagcaacatatgctggattaaaaaaccgctctcccagaccttctctggctgttaggaggcacttgttgcatggcctgtgaggtagggatgtggtataacccagggaaaatctctcttatttaatttaaaaagcaaaaaaaaaaaaaaaaacaacaacaacaaaaaaaaatagttttccaagaaaccctctccaggagacttctgcttacctctcagtgatcaaaaaccttttcaccacagttacttaccacgtcctaccgatccgcattctcgcaagtgtccttcactccatttactctactgcatttttcactgtatttctcatgccaaaacttgggcttctccaccagtctgcacacgttcatgctctcaattctcacagccatctatttcattctccactaaactgttagagggatttctgtagaaattaaagaaattcctatcactcctaaaaaaaaaagaaaaaataattataataattaattgcaaaccattaagcattggttactcatcctccctgtggagagctgaatggagggggagcagatggagcaaggttcactcctgagggtcctgccagagcaaatggtcaggagagaacggtgtcaacagcttcagagaggctaatcagtgtgaatgatgagcgtatctgtccctgggagaagagcagggaccactttgtccatggtgcttgattttgtatcccctagtgcatagcaaaatgctctgttgataacagatactcagtaactcttcgctaggcaaatagttgattcagagagaccctgctgtaaggtaatgcacatatcaggaaaaggaataaagggtcgagcggaaactgaaatggaagaaattgaaatggaatatcatgcaatctaatggtgtgttggtggcaggcaataaacaggtgtacatcctggtatatagctgtcacaaatacaatgttacatatataccaaaagataaacatctgaaaaaccaggaaccaatgtcaggaaccaaaccaaaaaaaatgtgccaaacatgaatccaagctaatgttaatttttatgcaataatagagagacaccattacttccacttgtatctgttgttatttgtaagcagagaggtatacagataaactaatatagtaccaaatgccatttgtatgaaagttacccttttgttttattagtaagcaataggagaacaatcaataaatactgccaccagtggtaatgtgactagccttgcaaattggtctggatggcatggtgtgtgcaatgaagaatagcgctaagactccatactgataaaaatgcaaatgaagaagtattttctatcaagaaaggtggtataattccatttaaaattattgcaagatttctttctctcaagtcatctcctatgctacattcaaatttattatgttaagctagaactctgttgtaagttctttcaaacaattacatgccaaattgactatgcataaagaagaatgtgttggatgggaaatgagatcctatggtttacacatttctttcttaaaactctctgcttcagctggttatttcctcatcctctcactcctttcctgtggttgcttcacaggccacggcacatgttcctgtggtcgctgtgtttgtgagagaggatggtttggaaagctctgccaacatccgcggaagtgtaacatgacggaagaacaaagcaagaatctgtgtgaatcagcagatggcatattgtgctcggggaagggtgagtatctctgctggtgcctggactccattcctgttctgacacatgatttgtagaacagcatgtagcaactgtctttcccagactgaactttgcatgaaagcaaaccactatgtcctctgctgtccccaacttgaagcttgaagattaaccaaatgaagttttggatctaagaaaatgaaatgcgtgtgagaggattcatgcaaaaatatccttgtatgcaaagttattgctgaatgaaatagaattaatacttttatcaagaaattaggacaacaaaatataccagatactaaatggacccaaaaatggggaaaaaaggcaaaagaatgattattgggctcacctctgaaacaacacagctcagaactacagaaaagtaatcacaagcatctgagctgcccaaagatatgactttgggaacttctggggctaaattatttagctgtatgtggagcaggggaagattgaaggtgtgagaagacataaaaggagacaaaatatttaatttagtttaatttttttaaaaaggaaagaaaagctatgggggaggggtagtatcccacaagtctgatggaattttctttgccctaaaaatcaccaattgttccaagtaaacatgtgcagcctgatataagaaaataggtaattgttcggttgggcaccgtggcccatgcctgtaattctagcactttgggaggccaaggcgggtggatcacttgaggtcaggagttctagaccagcctggccaacgtggtgaaaaatacaaaaatctactctattaaaaaaaacacaaaaaaattagccaggcattgtggctcacacctgtaattacagttacttgagaggctggggcaggggaggagcttaaacccaggacgtggaggtcgcagtaaactgagatcacaccactgcactccagcctgggcaacagagcaagactccatctcccagaaaaaaaaaaaaaaaaggtaataattaaacaaagaaaacaaaagcctgccaaatggttataacctacaagttggttgaatagaagccaccaacccaataaaacatttgccatggaaacatattaaaggaaaaagcaagccttctccatctcccatcctacacacatgcaaacacacacacacacacacacacacacacacacacacacacacatacacacaaattggaagaggattcccctgagtaaagaatgctaatagattaaattttgaacaccttgattttgatgtttctgtatactattcttgaagggactttaaaatcctgccattgtaatgcatatggcatcatctagaaagctgttgtgttcttctttgctagtgactaggaagacacagggagcctgaaagattctcacctcatgtctggggagcagcgcttcaaagaaactgaagttaggggcttcccagctctcctcttcagctcagtatcctctttacaccacagacacacttttttttttctgacaaggcacagctctggctgaagcttcatttaccctcaaaacctctgctggtcaggatgaccaggtaaataattttctgaagaagacagcaaagcaaaagtgtgctagagacactgaatcctgttgccaaagaaccacaccagtgaggctgccacacacgaaggaaggaggtctctgaagcaagatgtgccgtgtgtcccctaaacagtagcttttgttttgcctcgtatgcaagaccaatgctatcaagttgaaagagactttttggcagaacttcagacatcaaagaggatggatgctgtgactatctgtggtgccaagaagggggatgaaaatgaatgcagatgtattcacttcaatagatgacagtgtccttggtttccaggagttctgtgttcaacacttgtatttacaatgctcaggcaaggaggccatgccatcaacctaatgtcattacagcaggcaggtggaaaatgagtttaaagcaatcgctttgtgccttgtttgttctctcactaattcaatctaatctcaagccccaaacagatcttccaccagttctgttctcagggggcttcagcccctagaaacacctaccttgaattcaagctgtgttgggacaaccaaaaagaaggaaaggttaaaaggaagaaaacaagggaaagaattggggagaaggagattaaggaagaaaagcaggaggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagtccggcctgggtgacagagcgagactccgtctcaaaaaaaaaaaaaaaaaaaaaaaaaaagaaaagcaggaaaggaggcagggatggaattaaactgcaagagagaagtaggagagaataaaagagatgttatcagaggggaatgatctgtgtataaaaagatactgagaatgaatcgtttttgaattagatttttttttcctctgagcatggcttcagacatagagcacttaagtttagatacttttttacttggttttctgtaatggcattgtcactgggataagaatagaagcttttcacagaagctctactgaaaaagatacccatacatattaaaacactagtgtgcttatttatatttgtttattttaagagtcaactattgtttgtgtttgtgtgtttactacgctcactattgaatcattaacactttccataagcgggtcttccctaagacctgtccaactgcgagtacaggaagaacacacaaagccataccctccagggtaacaaatagcagtcttccatttcctaaactgaaggtcatgtaacaagagttgtttcttctcagaaaataaatatgcttatgaaagtcattacagccctaggaaagattctcatctttcagcatcataaatgtagaaaatacaaagaaaaaaataggttgactaaatattgactcaaaggcatttcctgaaaacaaaacaaaacaaagccaaagagtccctctagctaatgcctttgcaaattgtttgctttgggaggtggcgatatattcagagatcaatgaagggttgaaagcatatttgtgtaaactatttgtttatccttcaatgggtagggagtttgggagtccttaaacttaaaagggaatatgaaagctgcctcaaggctgcacattttgacattcatgttagtggaccggcctccggactgttggcagcagctgatcgtgatctcccttcttttccccttttatggagacatcaatgctggattatcgatgacgaaaggggataaaaccaggatcatggaactgtgatctatgataggcgcagaggataatggggatgccacagttactcctggttccagtggggagcactaccccacaacccaccctgagaaccacaggaaaagtaatgcatgaaatagactaagggactttaacatggtgatggaaaagaaaaacctgtttccgattttttgactggggccatgtatttctagatcaatttcatggacttgtccaaattttctatcatttttctcaaatttgtcaatgaaagtccctcaccctgatggtcacaaaagatgttcaagttctttctttatttgattatgggacagatcttagcagtgggcatgagatcgccatggcacacagcttggtggcctgtacccaccaaaaggctgaaacgtgcacttcccatgagctgtgaataaagctgtcacctcaggagacgatgaagaaatagcgttttatttctttacaaatttatagccaagacaataaatcactccatagaaaaatttaaaacaagatacattcttgtgaccttcataacagatggagtagttagtacaatagtgaaaactgcctgctgggatgtcaggttgcagcattttgtcaggcttgaatgaaaaagaaagtccaacattagtaatggaatgggcaactgacaaaggtgccttgcccttagactcaaattgtttttgtgaataaccaagagagatgaggttagtgcagtgccgggtcttccctaagcttagctacctttgcaaagtacatgatataattcattgtgggttgttttgttcatttggggatttatttggcttcaagactacacaattatatctttgccttgactacttcaagctagatccagataatcacgtccaatcttcttacagatgctgttgtgtgacaatggctgtaaacacatgtcattaactgtctccttaaactctcacagtgatacttcttgggtcccacatcttccaaagaagtccagcatacacacacactcacccacccacaacctgtcccacatccccagaaaagagaaagagtgaaagatgcttcacaaaatcggcctcagcctggtgttcaagttgcctcgctcaatatgcctgtgcagtcagacctgcaggaagaaacagctcatttttaaactactgtatatgaaagtttttgcctggagatacatcacagataggcagatcactaaaaagaagagtggattgaatcagagtgaagtcttcagttaactgtttgtttattgcctgtgaggtccaggacagtttcctttattctctcttccattctcatctttgaaggtaaaatttcatttctttccccttcctatgtcctaagatgccctgaagacacatgagaaaatgtggctgattccccagggatggaagccagcaaaaatgcacagaagggagatgggaacattctcaagggtccttatattgagaaagaaaatgaatggattagtggtgctgtggtgatgaactatctgccctaaaactcctgccaagatcagccagctgttctctggctaggctgggtctcaggggtgtgagtgggtcttggccagctgagttgaaccatttctcacctcttgatagtcatgcagcctacatctgtctgatggaaccctctccctgtgtgcttcccatttaagagaggcacaatttgacccatgttatggaagaaaacagctagagcgttctacaggaaaagtgctataataggtcctaataactattcacactgtgttattactatgtgctatctagttctagtttcacaagcagtagaataatttcctacctctaagatgcactgagcattgacaaacaggaaagaataacacagctgggaaaatgctgacctagaaatgctactgtttcatgacacatacaaaatcaatcctcattttttattctaagtatttcagcgactagtagactttcagaactggaatttactcatcaaatgttctatccatatatgccatattagctttagctgagcttaccagttttctgaaaatgctctactatggcatgaagctaagcattccagaagcaagagcagtgattagaatagttccagggccagaggataagtttgaagatgaaatataagatatttcatgaattgtgacatatataaaatgatatcctgggtgtatatatgaatattatgggcatataaaatcagcactactttagaaacaactaaagacagccaaatacttcaaataactaattttccttcactcatggaaataaaacactaagtatggtgcctttcgaggaaacttctctgatagtcaatgaaatactccatgtggtctttgttggcagatatatcactatccatttgttaaacaagcagtagagtgctgtacatttttttatgcctagaaatgtgaaagaaagtcttcaaaattaggataaagaaatctctaaaatcaggaaattcctcaccttgatgagaccacaagggaaccagcatcctttgcagactgacctgggagcagcagctcactgggtcctgagaaaccacagggctgtcagtcaattattaaaactgagaagacgtgtatatttcctcaagagcatgcaaatcaacctggaccctcaggaaaacaagtcaagactaaatacaattatgccatagctacgcaagaagttaaaaaacacaattgtcacaatctaaataattctgactgcactcttactttgagaagtgtgtcaagaaatggcaaacatttaatttggactttggggatttttgcagctgaaatgcatataccagtttccctgatatgaaatatcacatagttgagacacatgaacctgaatcctttcatgatatctgtgatgaccacaactcctttttcctgatcactttaatcacccaggctgttaactcatttttaatcactgtgttttaaaagaagcactaatgattgattcttgccccttttcaatatattttgaacttaccaattctgcagttttgttaaatatgtcaaaatactcttttcaactgcacattttttcaacgtgattttgactcaaaaagaatacagccatcttttagtaaatggaagtcatgtttggaaagaacaaccaacccaaggaaacagaaggaaaagaaagtcctttttatttgtttctttttcattgtaaagtctttcctgctgtcgttgaggcagtttttccatgtaagggtttttagtctgtcatggaaagctgtttagactgagagaacttctgtcttggataccattcatcatctcatttattttcttttattttaaatatatcattaataaaatttttactcagtaagtaaagatattttaaataaccaaagaggaagttttttagttaggtaggagaaatgggtgaagtggagggaaaaagagttgaatccagagcctcataaaatatgaactttgggagtaatttgagctatcccagtttatgacagagggtcctgaggatgagtctcacaaggcaaatatactgagtgactgtatgcatttttagcactttaattagccacccaatatgcaggtgtgctcctactccaagaaaatcatgtaaacgaaaatccaaaattataagcacaataatttagtagttgttttaattagaaatgcaacctaatttaatacaattccctattcatttcctttaaagagcaggcactttaaaaacatgattcaatttaggaggaaaaaatctatttttgaatacttttttggaagaccatctataagaatcaaccccatcctgctctcattgacatttcaaccagactgggccatgggacatttgttcaaggctaattgcaactgtctagatccataatgaaggctttcctgggtgacctttatgaattacagtaagtaaagctcccctctgagaaaccagccattcaatacacttttacctttggatgatgggttattagaagcctgttgtcagtgtgtcaacgatattctattcgagatggaaacctttagttataaggtgatggtgagtaatagcctttgtaatttcaggttcttgtcattgtgggaagtgcatttgttctgctgaagagtggtatatttctggggagttctgtgactgtgatgacagagactgcgacaaacatgatggtctcatttgtacaggtgcagtattaaccttttctaattgctctatgccacagtttgttatagagccaagagacactcgtcatgcaatgctttaggtggctggaccaacagggccaaccgtgaatatgaaatatctaccaaaggcgaagtgggcatttgggaaaaagccctcacaaaagcctcacattattcctaggcatagaagaatacaagagaatgaagctaaattttgtgattatttgggatccttccacaaagtaacctccccaccctcaaactcacatgtatgcagttgtatattgaacacagaaaagaattttgttggcaaccattttactttgaacatggtatagggaatgaaatattcttttaaacagaatctgggtaccactagttgatgtgttggttgcttttagggaactggatgtgtgtatgggggagaggtataaagagggctcagccgtgtcatagccactgctatcctaatttattgagtcctcataattggttataaattcatttgtttagccaagttacgaggaaacagagacatgtatacttctcctcagctctagctgaaggtaaaagatgactctttgtgtgtcattaagttagacctttgctttctgcccatccttactacgtaagactctcttcacggattacttggcctgcctcatgttatgtcaaagagccttatgtttttctgtatttattcataagtcagatataacttgctctttaagggaaaacaaaattgtcacctaaaagcctagctggagtgatacaggatggtgactatctgatcggtaaagggtggcaccaaataaatgccactaattgtttgaaagattagatgtctcgcagctgcttaataagatgtaataataacatcattgcacaataagaaaatctaccaaggatgaatgaaatgatttcattgtggacacttgtgatttataatagcatgtttaaatttggcacattttgatcataatcatgatacctatatgtattttattgcagggaatggaatatgtagctgtggaaactgtgaatgctgggatggatggaatggaaatgcatgtgaaatctggcttggctcagaatatccttaacaattacatgagagaggtctggattcttattttttctgggccattagaacagataaatgcgaaggaaaccatgtatattcaccactaggacaggttaaaaagaccattgtatgtttttctatttctgaattacgaatgaaatccgagtacctattagaaatgagttatgcaaatttagatgcaaataacattagaaaaaaaagattcttccataattaacataagtggttcctaacgagagcaatttttccacccaaaagtcatttggcaacatctacagacaattttgattgtcacactgggtcgggtaggaaggtatgctgcagacatttggtgggtagaggccagggatgctgctgagcatcccgcagtgtacaggacagcccccaaacaaggaattatccagccccaaatgccaatagggctcaaactgagaaacattgagttatatggctattagaaatccacattcttacacaagaaagaccatattagaatctaaggaaaacatgcatattcacattaattaatcgatcagatttttccagaattccgtatcagtcaccattttaatatggggacaatgaagacaagcacacaggaggtagaatatcagagtggggctggatcaagggcaaaaactggtcattaagtcatctgacattaaatcatttagccactaagttatttgtctactctcactttaaactcaccaaagaagattctcttaaagaaattatgaaaaatgtacaatttaacattttaaataaatagtgacagaagttgttta

SEQ ID NO: 1269 - DNA, 195791 bp, Homo sapiens
ttctgctaactttttatttattcaagtagaatccaatatgaaaatgaaataagcataaacaaacagttaaatttctactaaacctttaatcagctaagcaggccagaattttttaatgctgggcaagggctgtcatgaagaagatttatgaaagcagtgacaaaataatttcccaataaatacagtgcagatggggaaaatgatgactgggtcatcctcccacatagaaagaataacaagaggccagtacattgatcccacatataattttcaataaatgaggttcagtttggtctcaatgaactcttctgagaagaaaacattgaattttattaggtgtacacagagttaacaaataaattcccaaacagtttagtatgaaacattttgaacccctttagatccaatattgaacattttgcatggaatcttcattgtgtagtcaactgttcctggcctttcttggtagttgtcttccctaagctcaaacaaacagtgttaaactaaaaaggaaattaagaatgcaaaataaaagaaaataaatggaatggaccaaaatcctcatggatgaatgtgttggtttgcctttattttcatctaggataattcaacagactgtattctgagatcatggcaaggcacctctaacccagccactgggcaacatgagccccagatgctgagctagaggcatgtactggtgaaatacacagtaccggactcagcatgctgagctaaaaaaaatatttttcctaatatgtccagtttaaaaacttgtcattaaacaccaaaaatattaaagtctaattaatttataactaacgtttgcattgctgctgcaggaaagaacacaacagccgtcttgcccatgctctgctgagtatgaggggaacgcagccagaaacggggatggcgttaagtttggttcattaaaaacaggacggagtatatctgaaatggatttaggtagcgcaattcttgtaggttataattactgattttcctttttttttttttccaaataatgagaattaatagatgaaaaatgaaccttaatcaggcctacaaggcctacagaaatctttggacccactttctcaaaaaccagtgggtcttgctcgctgggcaaggcaaatgttaccattaccagtaagcttgtgatatgtataaaacacacacacacaaagaaactagagggggatgtcaaacacatatcatagagagcttccctggattgtgtttgagccatttcccacccaggcaatgccgaccttgggagcacagtatctgctactggacagagcgtatatgtgtgtttaatcgatagtgtgagccagagacaacaatctttcttaatctttctttatagatgcaatttgtaataataggtttagaaggcttcctgattccctgattgctctccgacctaagccaactgcaacatttaagatttagaggaacaaaatccctgcaaaaggtcacagacagtggagcgagcagccctgtaaaaatgggaagaagagaaatccgtaatagcacaggtttacagcgtctaactagaaattactcaatattatttgtgtgctacaaaattgaacttaaacacatagatttcgctgaaacaggactcaaaaaggattatgggtagctgtcagcaggcaaggtatcgagtgtacttgtgaagtatgtcattcacatgaagtgtcacagtcacagaaaagatattaaaaaggcattccatatctggtagggcattccatggtctgagtttagctggttatccaggtgtcttcttgttgtggggggtgcaacaggttgagatttatccacttgcaacagagaagttcggagacagcaaagaataagcattagcttacttcctgctgctcttcagccacggagcaggaatgtctggtgaggataaatcactcaactgtgctcaggacgaataagtcacaacacctgtgaggatctggctatgttgtcttactcttgttgactggtttgcctccattcattattgcagacgcacttgtgcttttacttggcgtcaccccaggcttcgggaccgtttccccaacatcatgcaaagatggttctcggtacatggcaactagtgatgggaagaaaggaggaggaaaagcaaacattgcttggttaggtgtgagaatggtccatccatacctgcatagaccactgcagtttgcccatttctgttttccctgaagtaaagcaattccattgagacagaattcctgttgtaaagcaatcatttccagcccacagaggacattactcccttcacattctctggtctgtatacctaaaatatgtatatgagtgtgcatggatttttgtctaggacagcaggtttaaatgggagctatggcctctttgtgggtccatgatgtaaaacacacacacacacacacactataggagaatgacaggcatttaacttaattctcaaaaaaagaaaactcagacatcccttccactgcacattaatatcaacacatgaacttctcattcacttcaatcaatctttgtgagctgcggtatttacatcctagaacattaaattactttctttcatgtggttcaaaagcaacatagtcatactagtgtcaacttcaaagctacacaaaataataacaaataactctcttcccataagccagagccttcaggagattatcatttcaatgttcatttcctacaatcatggaaaaagacccttgggcagcagaaggcaactcattttctgctatgttattaaaaatctaataattgacatgatacaggggcagaaaacagaatggcaagacagcaactgaaactacctgaataaactctgaggatttatctaaatagtgtctggtggcataatcatagtagttcacgtggctttttagaaaatgatttctggaagtcctgagaaaggacatataagagtgactgatggttggggaaaactagggattaaagtcatctgccatcagaaatacaagtgcattagagctgcccaaactgctttttaggtttttgaaagtttaaggtattttacgaagagcccttagatttagttaagatgaactaccatatgcattccctatgttcaagggggtagaatgtggcctttagtatcaatgcatcacgtgagttttcatcagcacacatacttgaaagtgcaaatgtacataaggtttctattaaattacttgctaaggtagcaaaaggaactaatgcgtatcctgaaagcacattccaatccctcactcctattactaattaaattagcagacaaaagcatgaagcattgaccttgattttctatgtagtgaagttgtatcgtccaacaatgatagactggattaagcaaatgtggcacatatacaccatggaatactatgcagccataaaaaatgatgagttcatggacatggatgaagctggaaaccatcattctcagcaaactatctcaaggacaaaaaaccaaacaccacatgttctcactcataggtgggaactgaacaatgagaacacttggacacaggaaggggaacatcacacacacgggcctgttgtggggtggggggatgggggagggatagcattaggagatatacctaatgtaaatgacaagttactgggtgcagcacaccaacatggcacatgtatacatatgtcacaaacctgcacgttgtgcacatgtaccctagaacttaaagtataataataaaatatatatatatatatatatatatatatatatataaaacaaagatatgaatgccctagagtaccaataattaaccaggtacttaatttgtcaaacatttccaataacattatttatattcggtatgggttttgaaagtttgaaattaattttcctctatcaagtaaacaatgtgataatctctgtcgttatagtacctacccccttaactgtttttagagtacttctgctaattttttgaaaacataaaaagtattatttctctctttctcatatatatatatgtatatatacacacaaaacactcatatacacataacaaatacatgagtgaaataccaagtatcattctataccacatcattgttgtctcagatattttctatgagatatgcaaaataactggttcccaaattttacctcggttaaatgacataacagcccttttgggttttgttacatttatgcagctaaagggtaaggttctaaaaatctagtcaattcttaactatttacaaaacataaaatgagtgaaaagagataaagcacggtggcaaataaacaatggtcttattagagcttctgtgggcttattttttaattttttatttgcatttaaatataggtgagtccaatgttatcaaaatttatttaaaacaatgaaagtgtatcatggatgtgttttttttgggaggaacagggaaatcctctaacttctttctactctaatcatccttatgatccaccatatactgagaataattcactcatatttcagactctggaataatctgtcttttcctgtataggccctggtagctaactgtttgggtttcaataaattgttctacagaaaaatataattaagagtgacactaagtcaacatcattgaaattacagaagtagtattagccaacaagagcgattttctgaatttaggcaaattgaaaattatacactcacagatgatgaagaattgactgttcaaatttttaaattattttatttcaatatagagaatatgcattatgaaaacaatatgcattttctcgtgatggctaagcctttcctgtaggaataaaacacaaaaagaaaattgagctgtccaagctagcttaaaatatttactgagttattgtagatctgatcttctgcaaaagagtaaacaaaagaacttgaatagaaacacatgtgaatatcctaaaatcaaatatttttgtaattctcaaatgttacatagataaaagtaaatgacacttttggcagaatcattaatgagagaggtgcagatgttgttgattaattaaaaaaactttgtagcctgctctttgggtatctgattggagtaaatgtgaaatttccattcatccggcatggatgactggatataccccttcctgcacacaaatgaatgtggataaattattttagtaaaagaagtaatgctacaaatgtatacagtgaagaattacacaatttgaaagcagatgtgtaatatcagcaagttctttaagagtcaagctattatctcttatttttctgtaattataataatccacaagtaggtaattactttcacctagataatatcaaaatggaaaatacttttgattccacgctcaaaacttattttttctaatatacttattatctttttctaatatacttatcatcgcagatttgtatcattacagatttaaaattgttttaacttaattaatttaaattatctaagggttagagtggttgtagcagtgaggatttgagcctttggaggtggcagagaagaaatttttcctggtacacatacatacacaaatatagtaaagtgtataaggggcacaaattctaaatcaataacttaagtaggcacctgtgcaaccatcacctagatcaaaataaatgacatttccagcactttgtgaaggtttcttagagccatggtagacctatcaatttgaaaaataaaatatgtaataagtctatgtaataataatgcatgcataatactcaccttccaatggcttgggtagaaaatgagctgctggtttggttttctttactctgttccctttcatagcttgcccttccttatttaatcccaaaaaccaggctctaccagattcctgttgtctgtacaacatggatgagtagattacataataattttcaaaaacagattctttaaacttgcattcaggggtaaaaagttcctgtggagagaaaatgaaacaaaagttagaggaaggaacttgatcttcactgtacattctactcattctctagaaagtttcccagcatggtgaaagagtgctttggcatggaggaccggatataccccttcctgcgcacagtaattgtctatacatttttaaaatatacaataaattgagaagaacctactattattgaaaatatatagaagcaaaagtatatcataagaaaacaatacatgagcaaactaaagatttaacttaaacagaagacaattcaaccagagtataatcagaaagggagcattaaagtagcatcagatattcacaataaagtgaaccaaataaaatacacatttcagatattttataatccattttacatgtttccataggaacagtgatataatactctacagttgccagttgctccttggatcactgaaatcacagggtgatacattttacttacaaaggaacaaactgaaacctcaaactaaaacttagacaatcagctggcttacttgccagccactagagctattgtataaccagatgaggttaggtgtcatgttagctggtcatagtgacagtagctgaaaataattcaatggggctccaaaggtttgagtcccgttggaactcttgaagataaacatcaaaagctgctccaactgaaaaaccacacagcatttttggaaagcatacagtttgttaaatactattatgctcaatgccatggtctgcattaattgatgagcagcacaaagcttactactttacaattattattaatgtcagaaatattcacagatgatttttatatacttcttactttgggatgaataataatgaatataatcccatgccaaataaataaaaaattaataagggtacaatctacatatgcatttttgatagccctctattaaaaataaatttgaagttcaacctgtctggttatagaccatgaaagacacctagctagttttaaataggtccaacactgtgctattctatatgtatataaaatatagatggaaaatagatccttactgtccttgatctttttgaaaataccactggactaaaaaatatacacaaagttttcatttttctttaatagattttattattgcagaaaataataatttttggttttcttctaaaaatgttgtatacctgttctgaaaaatattccttaggggctaaaaactaaaacattaagggcttgactttatgctaactgtaattaggaatgtgacctaatgtcatgtagaaatttcctttcaatattccccataaaagtgtgaattatcaaatgctgtctcatgcaggagacaatttattcagtgtgctgaataactttcattcactgagagctaatagttttccaaggggaacagcctttgttagtggcagatgcttttcaagacaaagatgacagttacagtgatcaatttgatgaaatcacaatagccaaatgacaggtttagccccctcctggagcaacttatgtagatctttatttcttcttgatgatgctacctcagattagaataagatcccatccaaataaatgttctggctttctactgagttctgcatctccatatatcctccaattagttttctcactaataaatgagagtccactgagtcaatgtccaggccatgcgcccgaaaaaaaagattgataaaacagtacatgttcatgcatttattgtgagtaaaacaaaatggaatgctataaatctggcttctccccaagagactaataaatatattggttgaaactatactttctcaaacaaaaggattagactttggcatttcacttgtctttttactgagacagggcagggcacctaagcatattgcttaccagttaaaaacctatctcaaaatcagctatgagtgacatgctgagagctgacttagtgggtcacttagtggaagtcaggggaatctggctctgcctcctgggcttcgggtgtctctgcccagaacctggctcactgatgctcatcctgttgctacaaacaccagaaacgtaggtccacaggattctcttctgatcgtcactgccataatgtccaaaacatgaatggtgcttgcaacaccatcagcaacttagggatgtattgtctccattatgaattcactgtgttgaatatggaagagaagaagatgcttgatgtagaggaagtaatttattctcggtggataccttaaggattctgacactatatcttttcagatgaaatgttcacatcataggactccaaagaagtcaattccacagcacctttctgtgagctgtgcccgtgacttcacagataggtgattctttctgtagaactattgccttcagttgcttgtgatagtggagactggtatattttcagccttcttatttgtggctaaataattaatgcacacacaaatgcacatgttacattcaaagatgttattgtctaatacattttctcaaaactttttgagaacttaatctgttcctccaatattgaagtctcaaataatcccagcatttcctatagaaccgatagaaccaatggaagttgaggttagttgctatttgatgtcataagtgatatactttcaacacgtaaatgggaagcaatggagcagataaacatcacctgtggaggcagacagtaggattcaaccctgaccccactagctgtgtgttcttggggaaattactcaatctctctgggcttcagtttcctcatctctaaaatgaggacaaaaatcatagggcaataaggtagttgggatgattgagtgaataaatacgtattacacatttagaagagaacttggtatacagtgagcactcaataattattctttaaaagtttctcattatttgtagtaaaaaatatatcctgatcagttatttcaattctgtgaaaatctcaccaaaagtcagctacataattagtcaatgaaaaccattttacacaaaatattgggttcagcatgaaatataccaagataaataatagtcattcatttcactgaaaaatgacagaacaatataatatttgttatgagtgacttacctataaaatactagagtgattatagggagaataaatggtattgtgaaaggcaagaggtgggaaatggcctggtacatttggagaactgtaaatagttcatcactgagatacacgctttgtgggacagaagtggagaatgttgtagatgggaagataggtttgagaaacataataaagggtcttgaaaactctaataaacaaattagatgtcttataagtgagaggaagacatgttgaattcctgaatatgcaagggaataataatagggcctgattcgtatgttataaatacaaatctgttgtcagtgtggaggatggtttcgaaaagttaagaacatgtcgtactgatgttttcaaccctaatctctcacaaaatgaacctgaaagttgtttgtagcacatgagtatatgtgtgttcacgttaatagttagtattaatattacaaatagagaaccagaacacacaaagtaaggggagaaataatatcaggattatgacacactgacttctgaactttctggtagccaggacaaaaagagaaagactataatgttacaaaaattattcaagaaagaaaatattttcctttttgaaaatgaaaagtttcttggcatgaatttttaaaaggtatttccttataagggacctaaaaaactgacattgaccaacataaacaaaaatgctcttgagagtaattgcacagtcatactttgtgcttcaatcctgcagtatgctttaggaaaacagattgcattgaaaatgtccaataggtagaactacttaaagtccagtaggtggaaataattgtaattgatgagatctccagggataatgtgcacagcacgggccacaaactcaaatgcctctaatgaccaggtagatacaggagtgaggaaagctggcatgatcatggcaccgtaatgaggataaatggcctctgactcaggctctgtggtgaggagatgaagacagtggtagaagcaatgatttttttaaaaaagcagccgtccctcacatggttctcctgtgaaaataaaaaccttagatctttagaagatctgatttttcaaaggaagtaagaaatgtaagtttctacagataatctccttttaacattggcaactatttcttagtttttgtttttcaaccttgagtgggtcaaggggccacagggaagcctgtgagccttcagtatgagacctccaatgtacagcagcaagaaccaaagaaagaggagccctactttgcttctcaaggcagtcctagtctaattgatagttgctatacagttggataatacaattattgtgccagtgaaacactctctaaaactggcagtgataatatgaaaatgcttatttaaatttaggcttaaatataaactctttgaatctgccaaaacgagatcgataaggagtttgatgtatctttttctcaccttgcctccttgactatgtttagaaccatcacccccaccacaacaaaatcaacaacagatgagttccagcagaagcttgaatattaatttgcaccactgccaaactaaatcatcaagtcataggatagaaaaatgcaataattaaacagaaatgttatatcttttttatgttgtggttgtttttgaaatgaaagcaccatctgtggtgtacttattatcttaacagtagcagcagaattcctcttctgagggaaatgcctttgtttaggaaaataccgtgatgggccatttgcttgtacaaagagagacttctggttggaaggagctctccttccataactcatcaggaatgaataactcagataatctggcaaaaccataacctcagaattgaaagtgaccttgagaatctaatccagtggtccagcaaactgactctcaggccaaacacaattttcacctgtttttgtaaataaggtttcattggaaaacaggcactttcctttgtttatatattgtctgtgtctgcatttacactacaaatttcagagctgcgtggtcgagaaagatctttatggctcacaaaacctaaaatgtttactatatggtcctttgccaaaagtttgccaatcctgatctaaggtaaaatttgaggactttccaacctaagtaattgagggaagagttattaacccagtagcaaattcctaaggagctaagcattcccaagttaaacttggattgcacatattttcacatatgcaaacatatacaacttgaaggaggagcttcaccagtgtttcatccttggaaaagcctttatgttctgttacgagcccaggcttccactaggaattagcccaccaactccacttagttactatgtcaccttggtgttatctaagactaaatgaaaattatgtttttgttaatgtcttcaagtttgcccaccatcaccatttaagggaaaactataaaaggggcattctgaacacaatcataacattttttagaatactaggcaattccaaaataacttaaaaagaggaaatagagaaacgatattagacacaagtagcaaatagcacataataaatacatgataaataatagctactaatatattactaacctctattttccagagtcatccacgaattcagtcccctcccagtaacagctcaataatgaccctcatcctggactccttaggagtatctctcctcagaggaggcttgaacttaaaggaggaggaggtctccaagtccaagttcttactttgagtataatattaaacaacaaagggttctttcaaatatcaaataagataagagaggtgaaaaataatttatggactagaaattaagttgtaatctgtagttatatttacaacgagaaattgagtttgaaagtgcaactcaaatgttgttatcatgaagaaggctgttatttaattattcttaatagatttcaacttaattacacatacctttagatgggaattcccatattcagatccacttaatctgaattctcaattttttttcttcccttttctacattttggagatttgatctactagagtttatctgaggtcagcagagatttatcccaatctctttcatcttttacagttttaaaatcaattgtatcctttaatgctactattctgacactaaccacttctttaaaacaaaaaggcagagtactcttaagattacttataaagaaaagaatatcgtgaacttttagaaagattttacagtcctgaagttgaaacaaaatatttgtagttaacactcaaaagcagaaaattaagttgactaatgtactttatttatataaagttgtatgtagtcaaaaatttttaatattgggctgtgactaatgcccacaggagaaaaaaaattagttaattggttgtgtgtgtacctcaaataaaagcataattatgtacgagtttaagagacaacttttggcagtgcacggtggtcactcctgtaatcccagcactttgggaggccaaggcaggcgatcatgaggtcaaaagatggagaccatcctggccaacatggtgaaaccccatctctaataaaaataccaaaattagctgggcgtagtggcacatgcctgtagtcccagctactcgggaggctgaggcaggagactcacttgaacctgggaggcagaggttgcagtgagcggagattgtgccactgcactccagcctggcgacagaacaagactccatcaaaaaaaaaaaaaaaaaaaaagagagagaggagagagagacaacttttatcctgattacaggacccaggaaatttaagtatatttctaccaacaaaggagtctcgacagcaacttatatttatagggccaaattctgttacttaagtagtttcccgggaaacaaaatggaaaattaaagcattttttggcagtaaaaatatttctcaacatttagagattaacacatcattagatacaataatttatttattaaatattatatgttactttgattcattatatttattacatgttttataacatttaataactaaatatcaaataatttgatttgaattttcacttattcaatataaatatgtattatatattttaaaatatgtattttatatgtgtgcataatttttaaatatacataaggagatgtctgtgtgtgtgtgtgcatgtgtgtgtgtgtgcacgtacatttaaaatgtggtattcagggaccagtagcaacttcatcacctggaagcttgttagaaatgcagaatcccaggcccacctcagacctacagaatcaggatttgcattttaacgaggtcccaggtgactgtatgcacattaaaattgggacatattggcatatattctcattactacatagaacaaatcaattaatgatcacattttaagagctgtcaattaaattgacattagtcataagcttgctaccatttcttaacattagtacaaaatttataaaagcaagaaaatagaaacaaaaatctgtggtatttacaatacgtctataagtaagatattttaagattataaataaaaatgtgtcccaacttgttctacaatgtaaaatctttctctctggaatatagacatgtataaactcctaaaataataatccttgtaagatgaacagatggcaccagtgctataaatattagccaaaaattcacaaaataaatatgctcaagaaagtattaagacaaccatatatcatttttacacatttgtcagttttcaactgtgttgcctcaatattaacaataataatgatgttaataactataattaacaccttatgcatatttctatgttgagcactgctctacacactacataatacactaatttaaccctcaccataatcgtatgggatgacactattattatccccattttagaactgaagaaaccgaggcacagaaggttgaagtaacttgcccgagtacgttactttcatcaagataaatataattatttaactattcctactaatttatcatattgttcaattgaaagaatttactttttaagatatgtgatcaattgcaaaaatgattctaattcttcatcctcctcctcccaaccaacgacctttgccatgtaatttgcagcattctcttactttgaacaaagataaagaaagtagaggcttaacaagtgcttgtgcagctgggattgccctccctcatgcctgggctactctcgctggaggagagagagagtggggagcagagccaggttgattcaatcaaaactaacctattcctagaggtgatcaagtcctgccgagatctacagagccacctagccaaggcccacttggtcttagtttcacaagcaatatgcatacgcttattgttttatgccaggttttgtggttgttcattatacagttgataactgatacatataattatcaatttcactgaatcactcattcaactagacatagaaaatatgtattttatgctgctgatttttatctacctctatacctacagataaaaaaatatatagatgaaagcagtaaggaattatatagcctatcaccctagcagaggtgacacgtctcttagaagcaacaaatataaggagcaaaaaggtaaagaaaaagaagcatattttaaaaagagtttttaagaaagtaccaaaaaatttataggtactcaaaatgaatctttcctcctcttcacgcaacctgtatccaccttttccccctcactgatcaattaaagaaacattgaacaaaatagaaattgggttggcttccctggattgccaattatccccataggaaaaaaaaaaaaaaagctcattgttgttattaactccccaggaaggggtagaatgggatgagggtgtcatagtgggtggtggcatgagtaaaaattgagctctaagatcaaacatgtttggtcatacatcagcttctcaaaggtacatttcttgggcatgtgtagggtaatatactaactgtatagaacattgtctaaaagaaaaatgtaaaatggatactgctttacgtgaaagaaatcaaactgtacatatgtaacaaaatcaagagaaagtgcttccatcagttttttaaacatttctggattatctgagtaaataatgtcaacagagaacaaatatacacagtaatatgcaaaacgtttctttgtttgacaaatactcaggcatcaaagtagagattagtgatagctcaaagccagatggtcagtttcgcctcatcctctattttaaggacacttcagactcagtgatttatactttcattgtaacacaaatatcacattaagccaaatatatatatgtatgtgtattgttatgtgtgtatacataagtgtatatatacataactatatcaatgaacatttgaatattttagaaatagggttatcttattcaaaagagaaataataaaatatacattcttcatagaagtatgatcaaggaacttgtgcctgtctatagattttatttcccctctgcaataaagcaagtacagaaattatgtgaaaacatttataaacttctatagaaatttaacagaatgttttttatatttgttgaatataacaataaaatctctgggcttttattttgtatatttttacgtttcctattaattgaattttattgtattttatgatattatctttctacaaaaactggcaattaataaaagtactgtccttcaccacatgcagtctgatggccactgctctattatacatgggtttggatatgaatgtacatccaattaaaggagagctaaggtgagaattggtgatggttaatatttatttacttatcggtatgaggcaaccagtatgctaaaggctttgcatacattacctcattgcattccttttaacagaatacagtgctgcaggtgaatatcttgatgagagtttgtacagttagtaagtggcgaagcaggttctaatgccaacctgagtctacagccttcgctctaaatcactaattataccagttctcaaaacaatacagttctaaaaggaaatcaaagagggaaatgtggcttaacaacagcaatggcaaccacaagattttttaagattattcaatttgtttagataaattatttctaaaagttatcagtcttagcaactattctattttttaatcttatttcattattttagccttatgttttataagcattgggttgggagtaggatatgacctggtgtggacggcctacttgatctagatttgttagatattactaataccaaaaatagaggaaagataaagggaggcataatttaagaaattactttgtaattaagagaccccaagaatctggaaaaagacaacaaatacctgtgttcttagtaataacggttttaatggtggcgattatcatgggagtggaggtgaaggaagatgcaagaaagatactcctgagtggaacaaatgttatggaaaatatttagttcttttatgtccaacgaaaaagtgatatgatcacagttttaatttactccaacagaatttttgttagccagaacaagaatagaatttgctgtgcaaaaaaatgaagtattttagtttatgtagttaggagatatcaattttgtgtcttgctatatcctaccaaaatctagtctggttactttatcttcctttatcaatattttctttcatttccttgtacttctctgcccattctgtcttgaataattgaatacaaaatgacatattttggaaaaaaaccaaatttgtgatttttactctgctggagtctatgaataaaaatccagttgttttcatcacatttttcctacccttaactatttgaattgtattttaataatattcttgcaattccatacgcttctctccttaggcctatgtgtacatgcatatacaagatttttctacttttttctctttcaaccacattttaaattagacctttatatcaaacattttaatattaagcatatgtgttgtaaacttttcctaataagaatgtaccccatcaaaaccacttatttatataaatagaaatgaaacaaaaggatcaaaaatacctgtttagccaacctttaaaatgaaagctttcatagaaaaatggaggaaatataagcaggttctacaattctcctaaaagaccatattcttcaaataataataatttctgattgagctttttgattttcaaagactattcttgtatactaaatttgatacaataatgctgtgaaagatgctttaagaagaaaaacagcaccatctccatgtcatagatgatgattttgtgtcttagaggacataatagattaagaagcatttatttctaccaatttgatatttcacctacatcatgctgctatttagtaaatatttattaataattacaatgttgaaaatacaaaacagataaaaggggtttaattttttccccagggcaccaaataaatcatcttactgggatatgaggaaattaagcatctgataagaatcagcaacactgaatttgtggaatacaaaggaagcccacatagttctgaaatgcaatgctgaggattattttctcttggttttgctttattagccgggaacacatcggccatgagtccccagattctggcaacaacttgtttgataattccaaaggttaacacaaaaggacaaacatgaaacactgaagagggaggccaggaaagcaagaaaagaggcaataccttctggggaaagagagaccctgaggaggggagaatgtcaacctgtgggttaaataactctaactagataaagctggagctgtgaaagttcaccatgctatagattttgtcctctaaaaatcagcagtgaattttcatattatattatgaaatgttatagaaattaatgaattatattgtcttactttccaggttgttagttgaaagtgtgagactataaagtgggaagaatcataatatttgtaattggtatatatatatatacccacacacacacacacatacaccaattgcagtgtgtgtgtatataccaattggtatatatatatatgtatatgtatatattgtatgtgtgtgtgtgtatatatatatatatatgccaattggtgtgtttatatgtgtgtgtgtgtatatctatctatatatatatataggtgtgtgtgtaccaattacaaagatgattcttcccacctcatagtctcatactttaacagtatatatatatatatatacatgtatatatatatatatatataccattacaaatactaaaattggtctaccagatattaaataacaaattaaaatttttgagtactgtgaacacatggaaacaaatttccatttattctttacttaatgatgtctaaaattcatgcattcatttattcagtaaatatttagtgagatcctagtatttagccatcactgttcttgatcttgagaagttagaataagcaaaagttgacatagtttaccattttttgaagtgtacagtctaatgagagacaaatgtttacactaatgatcgtattattacaaattaagaaaggttcttataagaaaaggaatgatttctatgagatcacatagataaatctggcctagcttgggtggtaaggaaaagcattgaattctgaactgagatctgaaacaccagtatgagttaactagactaagagcagcgtgaagaatattcctggaaagggtgatataatatacaaagaccctggggcaggaggagagacaaggcatttgaatgaaaaagagaaaacaacgaaatcagaatgcagaatgtgaacacacagcagtaggatttgggatttgggtattaggcatgagtgaaaccagtggtcacattaagggtgagggaagagagagacgctctcatattgttttatactcagtacctgttttaagaaaaaaagaaaaaacaacaaggaagtaaaaccaaagacaggcagcccagcgccaggcctgaaaccaggcctgggcctgcctggcctaaacccagtagttaaaaatcaacttagaaccctatgcctggcctaaactcagtagttaaaaatcaacttagaacccgatgttacccatagatttcaggcattgtataaaagaacattgtgaaactccctgctctgttctgtttcactctgactaccagggcatgaaacccctgtcacgtatcccctagattgctcaatcaatcacaaccctttcaggtgaaatctttagtgttgtgagcccttcaacgggacagaaattttgcaatcggggagctcagattttgaggcagtagcttgccgatgttcccagctgaataaagcccttccttctacaactcaatgtctgagaggttttgtctgcggctcattctgctacaagggttttcatcgttctctaaaagcaatgggaagacattagaagttttaagcaggaacatgtcacactcagatacaaatttggaaaggctagtctggccaaaatgtgaagcctaaaagagagccaatttggatataagaattctggtttgtccattatagtaccagaaagaaaaaaacataacagttgtgtgggccaaggcattggcaatggaggtggacaaaacatggctgattggagaaatatttaggaggtcagaaggtcagcactatgtaattgtatatggcagctgagggaacagagtgtcaagcagtgtgcaggtttctagcctgtggaactggatgacattttgtccatgttcattggtgcttctgaaaggtcaaatattgcagttttgtattcttgggcaaaaaaaaagcgtaagagtataacataagtttccagagtgctttctgtccttttacagaatatcatttcaaatatctatagggtaattttccacaatgttgcatgtttaagtttttccttagtaacctgttttttatttttattttttggtgggtatgtctttttttcagtaccaaattacttcagaaatcttcatgcattcctataacaaagacaaaccacatattgttagttgcagagcaaataagttgaaagataaagaactggaatttgaggggcaaaggtccttaaatttcttatggttttatgttttataaaaaagtccccggtcagtaagcaaagtggttcccacatcaccactgaaacataagaggacaatggccatgatagacttcccagttggaggcaacctgtaatcccagcactttgggaggctgaggcagatggaccacctgaggttaggagttcaagaccagcctgaccaacatggtgaaaccctgtctctactaaaaatacaaaaattagctgggcatggtggtgggtgcctataatcccagctatatgggagggtgaggcaggagaattgcttgaaccagggaggcagaggttgcagtgagctgagatcacaccattgcactccagcctggcagacagggcaagactccatctcagaatcaatcaatctgcaaaaggtttctctcatgagcagtactatagtaggagactatcagcttactaatggtgagcagtaaacagaaatgttatttccataggaaaccattatattcccagtcagtgaatccattaaacatcagtaaaagaccaaaaaaaccctgctgaagtaaaattcttaactttttcaggataatatatgagatatggttcttactgatgtcaacggcaaatccaccatttacaaattcatctaaacctttaaaaatagttgttatgctcacattttattacagtaaaaaaaaaaaaaaaagaattccatcagagtacttccctgccttttattattctatatactttgattctattcttggcacatttagctttccaaattaaattgtgtaaactttcagatctggtttcatagattagttcttctattcacttggtcagtccagtttgctgctgcaactaaaaaggccaactaaaaggtgggccccctaaggagaaaaattgaaagtaaattagcaagtattagcacacctttttacatagctgccctgagcctgtccctaggggaatgagtggtccctgaagcactacacttttaaggataatagaaaaatgcagagaaagaaaactaaatcaggtgaggggtcaggaagtggctagagttagagatcaataaatatgaatgtagttgtcccctaacccccatcaggccccagtgtgtgatgttcccctccctgtgtccatgtgttctcattattcaactcccacttatgagtgagaacatgtggtgtttggttttctcttcctgtgttagtttgctgagaatctagcttcatccatgtaattaggacaaatacctgatgcatgcagggcttaaaacctagatgactggttggtaggtgcatcaaaccaccatggcacatgtatacctatgtaacaaacctgcacgttctgcacatgtatcccagaactaaaaataaatgaatgctgttacattaaagtcatcaagaatgaatgaacaagaagagaaagttacagatgaaaaaccagtgattattgaggatggttaaccctaagcatagtgcagacattaagattaaagatttagaaaataaaaagattgaagatttagaaactaaacagacctggatttgcttcccaccccagcatcttactaacaactgtcttggaaacatcacttcaccttcaaaataaaatatttacctctatggaattattgaatttcatgaggattggcagtttttggtgcaaagtgtgccctcaataaatgttagccatagttatgattaaaagatgtgaaagaaaaataaatctcaggaccccaaaatcactaagtcaaagggaagagtcaagctgggaaatgcattgggcaaagctgcctcccattctattcctaaataagatagttacaaagataaaaaagctacatacctccctcgcaatttgtccacaaggaaattccttgtggacaggccgaactcaaagtcatccctctgttcacatgagacaaatccatgtctaattgcttcctctgccccattgttccactaaagcagatgaagacataagtgactatttctgtaaattgtgcattcactgaaaggctaatcagaaactcaaaagaatgcaatcatatttctcttatctacctatgacctggaagtcccctccctgcttcaagttgtcccgcctttccaggctgaaccaatgtgcgtcatacatacattgattgatgtctcatgtagccctaaaatgtataaaaccaagttttgccccaaccttcttgggcacatgttgtcagtacctcccgaggctgtcacaggcatatctttaaccttggaaaaatatactttctaaattgattgagacctgtctcagataccttttggtttacagagactaagaatgaagagatctgtaatactgtctggcagaattcatataactgtgaggcagatcaataaaatgaattcagatctgtttaccaattgtggaattctacaaatgggaacataagcttgttgtttaaggaggaaaatttaaggctttttaattaattaatttatttattttgctttattggaagatgctatgaatggaaccatcatcaaaacattgttatctgtgattgtctaatttgtaacaaaatattaataaaaactgaatgagggtgaatccctcttctttgaagaactgataaagaaggcaagtgtcacttgaaaatcatttagaaattatttttctcttgccttcacactgtcagtgatagaatgttcagataaagaaacatatacaacgaagcaatgtctatgctctgtctatatttaagtttgatgttcttttgaaagagaaaataaatattgaacatattcacatctgtagatatttttaccataagcttatttcaaagatttaagatattcatccattttcttaaaaactgaaccatatttaaagagggtttacaaatcaggtatatatacatatataattgcatcaagtatttaaaagctagagcactctatttgaatatagtatttaacctcaaaattgtttacaaatatactgcacatgttttaggaaattagaatagaaaccaaaataaaagttccaaaataagagttaaggatcctaaggaaatgcagcattgtaaaattgagatgattctgtgagcaacccctcaccatgttcccatgaccactaaaatggctgaggattaattcagtaacatttgcaacctttgtatcttactaaggtattaaaatgcacactaggaatataaacttctgcctttatgctttgattgggagcttgtgggtgatttttttattgtatatgttgaaagtagcatgctagagcctggccataaatccttataaaaatcctacagatctacatccagtgagactttacctatttcagggctgttaccacctaattcagggctgctacatgtatgtcatacaactctcggggacaaagtcacaattcctgaccttctggcttatgtagtttccccatctccctcctcaacatccagaaatcactattcatcttatttttgtgagttacatttttttcattttagcagaatgcattatattcaattagagtggggactttgtcagtcacctttgcaagtgagtctccagtgtccagaataatgcacagtagatgattaataaacacgtattaaatgagtgaatgaatgaataagtaagtggttttaaaaaatgttctctctgagcatccaggattgtatgtgggggaatacagcctaaaagaaatagcttttaaatctaagagctaggggatgtaaatattcccattgtatacttgtaagatctagagctgcaaaacaaaaacaaacgtgtcatttttattaagaattgatgctttaaatagtttatttcattttacttattaacacatgcgtgtatgttcattcggttagcatttattgagtggctaccttgtgctagactctcttctaggtgtttggggttcatgaataatcaaaataagttggatcccctgccctcaaagaccttatatttcagtagtgagaaaaagaaggcaccaaacatcaaataaatgtttgaacactagtatgtggtcagaattatgactagaatggcagaaatgacaaagaatcatatgccgctcctgattctgtaggggttcattttatttgggagaaaattaatatgtaagaacttaaataataagaatgtaactaaatgattattcatgtcttttcttgttggctgggtgaactacatagcacacttattctgcgagtgctttagtaaggatatatatacacgttttatttaatagagaagttttaaattcacagaaaaattgagcagagtacagagaattcccatatacccactgccccatgcctaactcctccccattatcagcgtcctgcactagagtggtatacttgttgcaatcaatgaacctacattggcacattatcatcactcaaagtacatactttacattagggttcactttgggtgctgtacattctatgggttttgtcaaatgtataaagtcacgcattactattatagtatcacaaagaacaatttcattgcctaaaaaatatctgtgtcccacacattcatcaattcctcccttctaatttaatccctggtaatcagtaatctttttactgtctccataattttgccttttccagaatgtcatatagttgaaatcatacagtatgtagtctttacaagtaggtctatttaacttagcaatatgcatttaagctcccttcatctcttttcatggcttgatagctcattagtagatactgttttaaatgtagatggtttggaagaacttttcaaagaaggtaggtttgaccacgtcttgaagaataaagcttatatggagagaagagtggagtgtaggtgggtttcatggtgagaacctacatatggaggtgaaatgttgagaacacacttaggggaatgaagatggaaacagtttgcttgggcagagtgctcgcaagattgtagatggaggtaaaagtggaaaaggaggtaggtttcagactgattcatttatagtgtcctagaaagaatgtgatagaaagaaagaacagatcaattcagcggagatgtgcaggatagatggaggaagaaaataaatatgtatggttaatatgtatggtatttagatgttacagaaattttaaatggcctgcaattagaaatatttaacattgtcacattggactcctctgaacccaaccctctcaaatgtggctgagattaattatttggaaccttaatgagttggttttgtgcaatttcttcattttatgagtctagacactaattcacaactattcagttagaacctagattatgctaagaggtttaccgagttcaaacagaaacttctcaaaagtaatgatgtaaaaggcatgtagagatgaaaacctatgccccaaatcaccagacaatattctctatcttgttctcagtctcaattcacatgcttctcagtcatcttatatactgacagtatttattattagaaaatactgaaaactctagctcagtggtgcttccccccaaaaatgttagtactcatgcaatgtcgaatgcaatttcaatatgttcatatactcctagagagtgcagttaagaattgttgctctaagtaattaggtaagtagatgaagctacttattttcccttctcttgctttattttaggcgagaagggcaaactgcataaagtgcctggtagagtttgtgtgatgatcaacagtaggtaggcaggagcatgagaaggcactttatcaatgccaggagtgtgctttactcaacctgagtgattatttacatgttaagcagtcagtgttgtccaatgtgaaaaatggtgtcccttctatcatgtgatattcacatgggaaaccccttaaaattatcataacgcattctctagccataattctggtatactttagaaacttaattgtattcatttccagaaactagcaatagttacagcaagaaacagcattctacaccttttgactctcagaaaacattagattattagattggaaaatatacttcattctgggtagactgtctaaactatgatatttgcctctaggtttgcctggtaactaaagtctctatggtgtataaggcattttgtggcaggaaagtggtatgttgagcattgtcaatgaagctcttctccattagataatgagccccaaataagaaatagatgagtacctgccaaagaaagaagcctcagaatagcctctggtaaaggcaatttagcgactgagctctgctaatgagtacatgatagatgctggggaaaaaatgtctttcatcaagactgtgtgattcatccagcaaacaagtattaggtacccattaactagcaagctctataataagtgtcagagattcagcagtgaaaaagatataatttcctgccctcaaggaagtttactgggaaatttagacagaaagaaaagttacaaaatgctactttgaaaattaaaaaattcaaacagatctaattaattacttttggcaagttctttaaatgatgactctccttctaattgttaagggatgagacaagactgcaggtagactaggacacttacatgaggctgatgatgaagaaaacgacaaaaactcaccttactgaccaacaaacatgaaaacatgctcaacattgctgatcatcattaaaataaaaatgaaaatcacaatgagatatcatctcacacccattaggatggctacagagggaacaaacctgtacaatggcagaaaatatctgcaaactatgcatccaacaaaagattaacatgcagaatctacaaggaattcagacaacaacaacatcagcaacaacaaaacaccacattaaaaagtggggaaaggaacaattcttaaaagaagacatacaaatggccaagaagcatatgaaaaaatgctcacatcactaatcaagagaaatgcaaattaaaaccacaatgagatatcatcttgcaccagaaagaataattatcattataaagtcaaaaaatgaaggtgtcggagaggatgcagaggaaaagaaaaggcttacacattgttggtggggatttaacttagtacagtatttatggaaaacagtacggagatatctcaaagaactaaaaatagaactaacattcaatccagcaatcccactactgggtctatatccaaaagaaaagaaattattctataaaaaaaagacacctggacttttatgtgtataacaacactactcaaaatagcaaagataggtagtcaacctaagtgtccatcaacagatgattggataaagaagatgttacatatatatgtatcacacacacaccatggaatactacccagccataaaaaaagaatgaaattatatattttgcaataacatggatggaactagaggtcattatcttaagtgaaataactcataagcatagagccaaataccacatgttctcacttataagtgggagttaaataatctgtacacatggacatacagtatggattaatagacactggagacttgaaagggggtgaggataggagggggacgacagataaattctttaatgggtacaacgtacactaaaagcccatactttaccactatacaatacagccatgtaaaaaaacagcaacaaagaaaaacagtactagtagcccctaaattatacaaattaaaaaacaaaaaataacaagtgctgtcaagtatgtggagaaattggagtctgtgtgcattgtttgtggaattataaaatcttgcagccactaaggaaaagagtatggaggtttctaaaaaaaaaaaaaaaaaaaaaaaaaaaatagaattactatataatccagcaacttcacttctgagtatatgtcccaaagaattgaaaacagggagttgaagagatacttgcacatccatgtttacaacagcattattcacaacatctgagaggtggaagcaacccaaatgtccagcaatggatgaatgaataaacaaaacttggtaggtacacacaatgggatatcatttagtttttaaaaggaagaattctgatacatgttacatgaatgaaccttgagaacattacgctaagtcaaatatgtcagtcacaaaaagacaaatactatacaaatccacttatatgaggtaactaaagtagctaaattcatagaaacaaattagaattgcggttgccggtggctagggagaggaggaaagggaagttgtttggtaggtgaagagtttcagattcgcagggtgagatttctggagatctgatggacagccatataaatataccgaacagtattcaagtgtacatttaaaaatggaaagattaagcaaactgtggtacatccataccatggaatatgacagtaataaaaaggaatgaactattgatacatgcagcaacatgtataaatctctagagaattatacagagcaaaacaacaataaaagtcaatcccaaaggttacatattgtcatatttcatctatgtaacactcttaaaatgacaaaaatacagaaatagagaataaaaaagggttaagatggtaaattttgtatttttatcacaattaaaatttctaagtatgcaaaaggaaaataaaccctattttacaacctccatgttcagaatccaatgttttctctacatgtgtgttagggttaggagacacgtttgactttttgtctatataaatctatataaagatttggagtttagcaaatgttgcatctgagaacatttgttacttttcaaaccagaattttatttgccctttcttcacatggactttgaaaaatacagtccaactgagagcttcctatcagatagtttaaaaaattataaactattgtgaaataattaaagagatgactactaaagctggtgtttgctgtgatctgacatgtttgtgtccctccccaaaattaatatgttggaacctaatccccactgtaatggtatttgaaggtggggctttggaaggtggttaggccatgaggatgaatccctcctgaaatgggattagtgctcttatgagggactgaagagactggagttctcccctttcaagtgaagacacatcgagaaaacactgtccccaaaccagaaagccctcatcagataccaagtcttccagcactttgatctggagttcccagcctccagaactgtgagacatatatttctgttgtgtataagctacacagtttatagtattttcgtgtagcagcctgaatagaataagatcatgtctatggtcagagcacaaataagatacagcaatctttacacttactctggcttgtgcaacaatgttatgtatcccagcatataactgccagaatggaacattccagacttactgatatagagcacttgactatatttcactatacatacagaatgacaaaaaaaaatgcaggatgaactgacaataacctttaaggatgaaaacaaactgcaagttataaaagtttttaaaaatagtagtacatacacaaacacatattttgaggaaaggttccaattttgagggatgaatggcattcatccatcttcttttctgctggagaagtctttgtgaaggaaaataatattgtgaataacaggagtgactgttatgtgatgtagaaatgaaaatgaaaactaatgcaaacagtaactgggagtgatggggctagtatggtcaccagaaaagataactgaccataggatctaaaaaccttgatccttggtgtttactcaaatgagttggaaacttacatccacacaaaaacttggtgtaaatgttcatggcagctttattcctaattgccaaaacttgaaagcaatcaagatggccttcaataggggaatatacaaacaagctttccagacaatggaatattattcagtgataaaggaaaattataaagccatcaaaaaatatgagaaaccttaaatgcatattactaagtaagagaagccagtctgaaaagcctatacactatacgattccaactatataacattctggaaaaggcagaacggagacagtaaaaatatcagtggttgccaaggtctagaggagagggggagggtggagagagggagggatgatgagtaagtgaacacacaggatttttagggcagtgacactatctgtatgttactataatggtagatacatgtcattatacatttgacaaaacccatagaatgtacaacacctagagttaactctaatgtaaactatggacgttagctaatattaatttatcaatattggctcgttcattataaaatttgtaccatactaatgtaagatgtgaataagggaaataggtggagggagggatgggagcaaaaggggtttatgggaacgctctacttactgctcaatttatctgtaaagctaaaactgcttttaaaagtttattaattgaaaaaattaaaagagaaatttgactcagggtggaggaggatgttggtctggaggcagaactgtcgtaggtgctgcaaaggctcccccactgatgtcttaataagttccacagtaggaattctcagcaattatgcatcagggaaaatacatacattaagtttccaagaaccacatttaaaagcccaggttgacgaagcaaaaatggaatctctaggtcaggagtgagaaaacaacaagcccttaggtcatatacagcctgccaactgtttaaggaaagtatggttggaagacagccaagaccattaatttacatattgcctaaggctgtttttgacgtccaaacgcagtggaggagtagcagttgagaccatctgacccacaagcctaaaacacttaacttgcactttacagaaaatgcctgctgactcctgctctagttcctattggctaaatatagcattcatgggattccctaatgttatatataaaaaaaataatgctgagatgtggaaaccttctctgggggaaaaaaacaaaacaaaacaaaaacaaacaaacaaacaaaaaaaacaactccatccttggacacatacctgtgagaatatgagatttgcagagactactgtggagaatttttttttctatctgatctatagaggtaacataatattcatgttgattcattaaaataactcaattgtgaaacagattaaacagcattctacaccatatattttatttcacttttaattatcacctttgatacactttaactcctatcagtaaatatgaatgggcacattttaaatgaagtctgtaagtaaagaaatatcaaccattaaagagaaaaatagaaatatgaagtacttgtttttgcttcactagaaataacatcaaaaacatgtttatatcatctttatcttttcaacagtctaatgcactgttgaccagagaagaatgaaatagttagaatttgatgtaaatgaatttttaacatattctatacaaattttaatcagttgcataaaatacaaaagaacagtaatctacatgtataaaatacaaacaagtcttaatattgtgaatgatgatattaaactaaaaataatattatgaatgatgatattaaatgaaagtacttggcaaagtcagtctctgtatcatttcagaatgcttttagcaacaagggaattgtagctgaatttgggatttcccaaactgcattggcttacgcagtggaaagtgagcccctttcatacagaaagtctctaaaccttggtgcttctagtgttagatcagtgcctctgagttcatcaggaactcatgttctctctattttttcccttctgccattctaagttattgatgacgttctcgcacataatggttgctctagctccaaacattatattttcatagaacagcatcccaagtaggctagaagagggcagggccaaaaaatggctatctttttggaaaaagaaaatagtttctcagcagctttctaaaaaatattatttatcttaatgttcagaaccaggggcacataaccacacctagactaatcactggataagcgaagtggggctgctatgacagatataaaaagtgaaatgtattaatcacagtttaattatggtttgataattgtttagtagcctttaaccaaacatcaacttccagaattaggacatatgaccccctaataaaagcaggttctgttagtgaggatgaaggaattcttttggaattaaggtaaatttatctttctcttgcaacattttaaatatataagtgatatatatttaatggtatgacccaattaaaaaatatgacatgcaaatgcaattcagtaataccacattccatatattatatatgatcaaatacacacacacacagacacacacagacagacacacacacacacacacacacacacacacacggtctgtaatttgaatggtggtaaaagaagacctaaattctattttagttccaccttctcaacttaaagtcttaaagtattttgttcctaaatattgatttgcttttttggattttgtggtttgcaaatttttattgttgtcattgaaaatgtaatttaaaccaatatttttcttattaaaatttccttgttggccaggcgcgatggctcacgcctgtaatcccagcactttgggaggctgaggcaggcgcatcacctgaggtcaggaattggagaccagcctgatcaacatggagaaaccccgtctctactaaaaataaaaatcagctgggcgtggtggcgcatgcctgtaatcccggctactgcagaggctgaagcaggagaattacttgaacccgggagacgcaggttgcagtgagctgagatggagccattgcactccagcctgggcaacaagagcaaaactccgtctcaaaaaaaaaaaaaaaatttccttgtttatctcaacagtgtaggagagtttctggtactcgttattgagtaaaagctcaaaaaacatcctttaaatgccaggcaaggagacctatgtttgaagaaagtagccagatgaggccattgaacactgcccatgaaaaaaacaaaaacaaaacaaaatagaaaacaaagtaagaaagcggccaaatctggagaccacgtatgcccgcgtgcctggaatagccatttctttgccttttcgtgctagctagattactcttaagaatgttttgaggatgaatgttgtcatcttcctagtttggagttggattaggtgtctcctaggctgtttctctggctccctgaagctcctcagctgctggggctcctaggggctgatccagggtgccgcatggtcactgtttcagtgcagatggtatggacaaaggagccatccacccatgtgtgtttcctcctgccttaataaaaaagtagagaaaagccagcttcttctttgttgccaagagttatcacagagctctgctcagacagtatctttccctgttgctctatctttgtcagtgtttctaatgtgtttaagccatatcactagagtataccttcattttaacaataacaaatggccaggtgcagtggctcacacctgtaatcccagcactttgggagggtgaagcaggtggatcgcctgaggtcaggagttcaagaccagcctggccaacatggtgcaacctcatctttactaaaaatacaaaactcagccgagcgtagtggcatgcacctgtagtcccagctacttaggaggctgaggcgggagaattgcttgaacctgggaggcggagattgcagtgacccgagatcacaccactgcaccccagcctgggtgacgaagtaagactccataacaaaaagaaaaaaataataataatttcttaacaaaaatagttgaacagttcctgtgatttccattctataaatggagaatctgaaaatccaaaatactcataataatgatgaagaggaagatgacagttattaaacttggagaaaaaaatcagttctcggttctcatttaactgtaaactagggttaaaatgctaagtagaatacacttcctaacagaaatggaagttaaatgacatatctttttgcctaagaacttatacggcatatcaacattgttgcaagaaaacaggaaggagtaaatatctaagtatgtacatataaacttatacaaacaaatactacagaaacattactatatgtgatatagtaatcataacaatgtctggaaatatcaaactttgggttaaaattacttttgagtttagttcaaaagaatgcagagaagacattctagaaatacttagaatagctcacgttagctacgttttttcacaaagatgcataacataagaataaaataattctcacttcacactacccaccctcttaatccttgtatattctttcccaattttctttatgtctgtcaattgcctcttaaactttacgttacacatgaagaaccagaggcgaggcatggtgtttcatgcctgtaatcccagcactttgggaggctgaatcaggattgcttgcacctcggagtttcagtttgcagtgaggtatgatcacaccgctgcactccaggtgacagagtaataccccgtctcttccaaaaaaaatgagtaaataaaaaataatgatcaaaagagttggctaaaaataaatcagatcaaattttcaaggaattcagaaaaattggggtaatttgatctcaaactggagagagaattgaagaaactgcctgaattgctgttctccacatggacaggactgtcatatcttatcagttgacaaacaattaggcatatttgtcatctgattagtctgcaactggtgggaaagtctgagtggcttcctcatgaagtaattgaattgcattttttctctttcaactctaatttgcaaaggaaagtttagccccatgtcagctttaggctgggttagtgataagagtatatgcttattctcaacccacatacacttttcaagaacgtcttctatagttttaaaatgggagttttttaattaatggaaaaagtacctaatcttaaagacaggagtagctattctcaggtaaataatacatgaacaagagagattgtaaaagttattagtgtagctcttcccaattctatataaaaatcatatgccattgttacagatactattttagtacgagagcacagcaggctgaattttcttggaagaaaggtttcaattcagactgcaaccttccttcaaaaatacaataatgataaagccacccatccttcaaagacttacctttttccaaagttaatatctccttatgaacttagattaaagttaaaaatttattttagactaattcatgccacataaaacctttctttgtgttttaatagaaatgcatttttataatatgctatttttctggcttgtagaggtagataaaaatgaaagtcatttgtacctgagaatccaagtttaattgccgtagtcttgttttgcatgagtttagttgttttttttatttgtaagataaccattcagtgttctagaaacactctttaaaatagtcttaaagccaggcacggtggctcacgcctgtaatcccagcactttgggaggctgaggtgggcggatcacgaggtcaggagattgagatcatcctggccaacatggtgaaaccccgtctctactaaaaatacaaaaattagccgggtgcggtggcacatgcctgtaatcccagctactggggaggctgaggcaggagaactgcttgaatccaggaggcggaggttgccatgagctgagatcgtgccactgcactccagcctgggtgacagagcaagactccttcctccaccaccaaaaaaacaaaaaacaaacaaacaaacaaacaaaaaactgtcctagaaaagaagcaaataacagttgaatctacatattttcatacaattggcactatcctgagcccagattttttctgtcaataattattaaagatcaaattttaaaaaattaagttagtataaaaagtgctcagaatacataaatattacttgtattcatagtgttgcaaattttgagttgaaattttaagtactacaaaaaaatatttattgaggtggttttaagaataacattgaactctgatatcaaaccgagagattttagcagaggagttataacacaaatgttttactttctaaatctgaactataaaagataaaccaaatatggtgttcaacattaatttcttaaggttgacctaaactgagctctctaattactatgtgaacatttggattttctttttctcctttggtatctagagaatatgtttgtcttatttctaaatcaccatataaaacttaacaaagtcctatagccttttgtttgcttgtttttatgaaacaaatttggggttctattttctcatatgtttagttgtgtgtgtcttttgggagaaaaggggggaatatattttgaattggaattgaagcagataattttaaaattcagagctgaatttattaataaggaattttatcctaaaatacaaactgagaaatttgcaatagcttggttttaaatattcccacaagactaatagattatttagaaattgaaagttattaattattcatgtaagaatcacttctcagcctctccttcaccttgagtaaacagttatacaatccaattttatgagatggctacagaagatgcccttactttatatgcaccctgatttagataaaggtcaccctctagtggggttgatatgtatttcaatctcaaacctcactcaattgccttgcctttgaatagcaaaatgattgattttgaaaaccaaatgcaaatccaggttcagggatttttatcagcgtgtcaaagatgaagagatacagattattgtatttagccccaggaaactgggattaagaaattcaaagacccactaagcttattaatgtcatgttaaagtcattgtgaataccttaaagtggatttaaatgacagtagaaaagtaagtagcctggtcctaatttctaaaatggaagaataaaaatctgccattttcctggttaagtatcacaattttagaacttctgcatcccatttagaacttatatatataaaacatctaacatgactgcttatattgtaggcaacctgtggattctcttgaagttaaacaattagaaaataagagcagtgtttgtaaattaaatataagctcaataatatgcttactatttattgaacacttaccttgaactaagtgcctttttgtacattatcttagttttataatgacaacagaaaataatctaaagaaaaactatgaaggatcaattatcattgttttattcagacaaggaaatggaagctgagagcagcagttctaactttagcatgcatcagaatcacccagaaagctagttaaaatgtaagtctggggacagagtaggagcgagtttgcatttctaacaagttcccaggtgatgctgatgctgtttgtctagggaccacactttgtaaatcactgcaccaagttagaatgcaaatatggcttttgctagcaaattccttcagtgtgagtatgatgagcacttgctagtagcttaatatattttactcttctgcccttgtagagcataacatggtaactatgtggacctagtaacaataaagatacagtaaccataaagacacaataactaaataattgcagggcttgcttggcacccagaaatctaaacctaatactttctcttatttcttgacctaactttctagttctctatgtggttggcaacaaatcgaaaaagtccatgaaaggatgtaacatcctacaggaacatatgtagtgactgagtatagatcagcagtcctcacaattcagtgtgcatttgtatctgggccccatgaatttcaaatcagcagttctgggttgagggatgaggtatctgctctaataagcaccctagatgattctgatgtaggtgttgtttccaacatgctttgagacaatctgacttaaagattcaacagatgtttggttgcttcttccatgagaaaacaacaataacaaaagcaccttttccatgagagatcaaatttccaaccaaatcttggtttagagcatgccagagctctgactatgactgctttctgagtcaagtgcagaacagagctactactgcacagagttatcgtgagtattgtcattttgacaattctgcatccaaacacacgttgatttgggtagagtcacaagacaggtgagaggtaagagcctatccctaacttttctgtccccttccactaaccccagcaattagggaaccgtagatgatgtcatgtggccaatgagatgctctcaactgggagtctgaatcttgagggggtgaggcacatatatatgtacatgtattagggaacctgggatggagtagagaatgcagtgatgaatccaagagtgatcaggatggctaaagatcataacgcatcagtgggcaataagcagttagcggaggtggggccagtggtgcagcccatgcagactgtatctggctgggctatttctcttctctcccatagtagcttggttgcctgggattcatacagattctctgagtgcccattacccttccgacccattgttacgattcttaacatctgatccctaggttggaaagacaggttcacatcattcaatgaataactgtctcacctattttaattttacatatgaccttcttactgatgtgactcctgggaaaataacttaatcttttgggcttcagtttgctcagctgtaaaattaagagggaggaggcaatgttctctatggcacttctcagtccttaagatcctgtcctatttagccttataatagtctttgggtgggagctattactgtagagaaaagaggatcagatttgttatctagcccttttctgcagaggtagaaatggaatttagataaatgaaaggatcagcctggaagtttcagaggctgtttccctctcttcttataagctaaacttagtggcagctaaaaaacctaataaactcctaagaggaaaaaggatttcccaactgacagagaaatcttgtgtttcttcatctaataccaacccctgagcctgcaaaaaataggggtgactccaatggtcttttccgcacagaatacagtactagcaactaaagagaaaatccactttttcatacaacatagggtaacaaagtatccttagatggaactatttttgatggaaacaaacctgagtgaaatatgaaccagtacgtgagaatgaaaggcaagactattcctatcagattctttgaaagcatttcagttcctagagtctgggaaataaaatatatctatttggggcttactctacgttcactgcttcctgtctagctttcaccctctattaaaaaggcttttgtctaagaccttcacttatttggtgacttaatattcaccctatcaatacctattgttaaatgatgcctattcacatgataattttcagagtcacaaagactgtcgcagggagagttaaagtggcaacaaaatcgatgaaaagtaagcataaagtgcactttgaaaatggctttccagtgtttcacgtgctcaaagaactgttcatgctgttcccttgatcaaaagccgtcagtggctccccatcccttaaactgcttttggcatgtgatactctgaaattgccttaaccaaccacctcatccatccatgtactcattcaaatggtaacaagtgcttactgagcatctattgcatgctgatcacctgatatagtattttctttaattccttccagcctccctggtattccccgtcttgcttccattactttatttttctcttcccaatacccactgatttttgaaacttatttgtttatgatctgtcttcttccactggaatgtaagtcctagagtagcctacaacaggtagacaatgagcatttgtctaataaatctaaagcatttaaaaatattcaaagtcagcaggcttaatattttgtagaattaattactctcttgaaggatgaaaaaaaaagtattacttcacctaaataccctattaaaaatttaatccttggataaaattctaatacagtaatcttacttttcaaaccaaaatattaattaggcacacttcttctccaattccatttactaacaaaggttataaggcccaatgccttaaattagagacatttgtcatagtaaaacaacaaaataatgctatgtgattctatgtagtttacatgtaaaaataacttttagctttatataatttgcgaaccttcaaataaatcacagaatatgcaggagaaaacacaaaccagattctttaacttatatactgcctaaaaatgaggaaaaatgagacataatgacacacatagatagagattttcttgctagttggaaaactcagatgagaaagttataccacaatctatgttgtattttggggtattttaaagaccacagtgactgctgcctgtcacttggccagtcaggggaaagttcaaaacttggaccccacgtgactgtgggtctctgtcagcaagtccccttctactgttctgaggcatgcagaaaggtcgactatagacaaatgcttatttaggtttcttggtcaagttagcagcaatgactatagttaacaataatatatagtttcaaagagcaccaaggaggatttgaatgttccctacacgaagaaataataaatgttagagatgatggctaggctaattaccttgatctgatcactgtacactatatataaaaacatcactatgtactccatgaatatatacaattatgatttgtcaattaaaaaattaaacattacaatttatcaagaaaacaacgcttgtcctcactaatggcagttgggtaggcatttctctgccattattcagttcataatctaatggcttaaaatcacaattaaaggctcccatctctgggaacacaaaccaacacaagagtccctaagagagaggccgccagggagttagaattggacaggaaccagctaattccagccctttttgattctgctgattttgatatctgaatactaagcagtataggttgatgatctgtgtagcaaccatgtgaggtactgtgctgtgctgtgagtagcctgctccattgatagagacttaataaacttggtaaagccaaaatccaaatggtaggagcattttgtctgatttctagtagcactgttaaacatgctttggaaaagcttggagggatgtgtgcctatgtgaaagagggttaagctacagaatgctgcagtaaatcttgcctggcaatgcaatattttgaaatagcaagacacaaatatgaaattggcaatatatgccttcagctggataagtgtttcagtgaattcttctaaccccattgtgcaaaatcccaaccttcggaccgagtttaagattctaaacaagaaactcacacatttattatatcaaaaatacctttgtcaggggcattatattcaagtaaatcaagcaaaggcataattgtccttctcactctatctgctttgagctatccattgaaagactaacaggaaatatatacttaggtaatacatataaatataataacaattcagtcagttgttgttggtctgagtgattatgtaacgtgggtcaagaaatgaaacaatatggcaaaaccaaaatagctggcccatcggcattgctgcaaatgctcccttagttgaatggagataaccatagttcaatcaaaataattgtaagtttgccatctttctttacacttcagtattaaatacctgctgggaacctgaaataggccagttttccttgaactgtatggaattagcaattgtcacatttcatttttccaaatccgtatcatgtcaaatcctacctcccatggtgtcacatttttccctcttgcccagaggaatattttcatgctagtcagtaggttgtatttaggcaggctctgacactgccatagggaatatcagtgctgcaccaaacacacaccctgcctccagcatccagccttcagccccatcataaaaaggtcagacgccatctttcagaccactaactgccatttctctttatcatcacaaggaaaggcaaacatagggtttgttggaagtgtgtagaatgcacagaagtaagcaaatttggcctaatgagtttggcagggttggaattagagagaatagagtgtgatgaagtgaaaggcacagcacagagacctgtgattacagttagaaacaccattttacctgtgacaaagtcaaagatcacaacattctccagtcagtcatccccagctgtggttaggccagctgtaaggcaaggggtgctctctgtagcactgattggcataagattggttgtctcaggtggctggaatgtaccactgtcaatatgtaatgtactcaacccatgggatggaatgaacagtattttaaggacctagttctttttttcctaataaggaaataccactttaatgacaagattgagacaggcatagtgaaggaactttgtgtgtggagacatcaggagtgaaatttggtcctgtatttatgcatttccttttcctctctagcgttaatttgaggtaagaaacttaacttcctggctgggcatggtgactcatgcctgtaatcccagcactttgggaggccaaggcaggtggatcacctgagagtaaggagtttgagaccagcctgaccaacatggtgaaaccccatctctagtgaaaatacaaaaactagccaggtgtggtgatgcacacccgtaatcccagctacttgggaggctgaagcaggagaatggcttgaacctgggaggcggaggttgcagtgagccgagattgcaccactgcactccagcctgggcaacaagaatgaaactctgtctcaaaaaacaaacaaacaaacaaacaaaacttaacctccccagagcagcagattgagactggcatggtgaaggagctttgtgtgtggagacatcaggagtgaaatttggtcctatatgtatgcatttccttttcctctctagtgtgaatttgaagtaagaaagttaacctccccagaacagcagctgaccaaagtggcagaagctagtaagaagtctgtcccctggggcacagggatccatcactgacactgttaagaattgttggcactgagtggaaataaaaagcacggtaaattttagttggttttattattcttattttaatactctgattccaatatactttcttgttggctgaaccctgggatagtttccgctgaccctctgcccctgctggaggtctctaagcttcagttcactgatttgcgtatggcaatttcagcatctgctcctactaccccacagaattgtgaggatcaaggtagtaatgggtgagaaagtgttctgtaattgtcaagcaagttgcgcagttaagcacatgattatctgaggtgtggagcagagtgaatgtgatggaaaattgaacctcactggtgatctcccaactctgtctttgctcttgctttagaattattttccctaacccacaagtgttgcagaaaaggggcgattaacaacaaaatgagattcactagtttgagcatcagcttgtttcttcactctccctgcttattctgagcagtttctcaagcttggcatgattggccttttgggccatgtcattctttgtcatagggctatcccatacgatgtaggcttagtgggattcctggtctctacccagaagattgcacctcccccaccacacccaagctgtgacacaatggcaagaggtactgaagttaaggaagccggaaaattttcaaatagtctttatttccaaatagtctcaaatgtacttttcataaagcaaccaattctgaattttaaaacagcttgtatggagttgaatttgaccttggatgagaattagcattttaatataccactaaatgatagtgatcccactgggttgaatacgaaaatcactcaaggactgtaacttcccccatctagagtctctatgtgtttgtcataaagtcatgctttatgcacacaatagatcagaggcattttgtgagcaaggagctctccttgtcccattttgatttggttcatatattctacaacctttatatgaaagcaatatcaaaggatgacttaggtcatcatgactacatcaggacaatgataatactctgcctctggcacatatattccttctcttaattctgctctttctcctccctactttatatttcagttgtcagatattagagttgacaagctaatgaaaattgaattgactactaaaaaactcacacatacaaagatagagaaattacttgaaaattccctgtttgggtcaattcaatgcagacccttgcttggctgcaactgtaaacccatccagcctctaaatggcattactctacaactgacaacattggtccctgggaacactgccatagattaggttaatagtggtaaaaagatgccttgctgtctctcacaaattgtgctagaagacaatgatggcctccatggaggcaagcaggtgaactgattgcttagggaaatctcagaattggttcgttataccttcctactctttcctttatagaatctttacttgccaaatatgtatttcatgctacagattcatacagttgtgaaatgaagaccacataagagaatcaatatgtgaaacaaatcctctgtgcatatagaagccttttatttattattattattattattttatttatttatttatttatttattttgagacggagtctcgcttttgtcgcccaggctggagtacagtggtgcgatctcggctcactgcaacctctgctacctgggttcaagcttctcctgccctcagcctcctgagtagctgggattacaggcacctgccaccatacccagctaatttttgtacttttagtagagacggggttttgccatgttggccaggctggtctcaaactcctgacctcaggtgatctgcccaccttggcctcccaaagtgctgggattacaggcatgagccactgtgcctggccagccttttacttcttaaacaaatctatggaaatcacacttctcaaaattgtgagcctcaataatttggaaaaccgggcttaataatcattaatcctcatctacaattttataaccagaaactgtactagctggaatgatatcattcaggtgcaagatatttgatgtgagtatgaaatgccaatattttaaaaaatgaattgcatagttccatcaagtcaaggcacgtgtgtgtttcctcatgatgtccatggaggcagaagtcacaaccttctctttttcttcctctcttccttttttccaattcttactacgggcttccatgagctaaaaattggttggtgttcacatagagacctgaataagtcaactccctgccctccaggattgcacagacaataagaggaagcagatatttatttagcagactcttgcaatatgttgttaggggcattatgacagaagggagcaaaacaggcaaaatagacacagaagatatgggaggaaggagttctcagaagagtgttgaacagcatcaaaagcagtggagaagttgagtaatatgagtgcagtactgggctgaagagtgtcctccaaaaatccatgtctacctggaactctgaatatgactttatgtggaaatgtggtctttgcagatgtaattagttaagtttactttaaataaggtcatagtagtttagggtgggcctaaatctcatgactggcatccatataaaaagaggagacacatggggcaaaaacacacacacaggggacaccatgtgaaggcagaggtagagattagggtgatgcgtctacaagccaaggaatgccaggcacctcctgggaatgaggagagaggcatagaactgattctccttcagatccttcagaaggcacccactataaataatacaggtagttttcctgtattatgcataatagtcttaaatagtcttaactaggctttaaatgcaattaatcactaatttgtaatgtttgtctgtttattctctcaatttatattgacaagagataaaataagaataacaataaaataaaagctctcctcaaagaagtctgaattatcgtaggcctttacatatcacatatctttttgttctaaatttttttctagccacgtatgtgatgatgaattaatatacactatgattaataattataaaggagcagcctgttctattgtacagagctgtggtttgtcaccatcgctgcctttgagaatctcctggggagctgttttaagtactgatgccagagtgccagcctccagagattctgatttaattggtctggtgtgatacgagatcattctttttttaaaagctccctagggtttcagaagtgcagcacaggttgaaagctaccgatatagagcaaagctttactaaaagctgatatgtggaagcaaagaatgtgaaatgactcctgaaggcaccaaactgacaatgcaaatcaaatccaagaacaagctctaaatgtgtgcttgtattttactgaatcccttttgtaaacccatgcaatattttaccccaatattattgcaatacaaactgggaaagataagatactggaatgtaacctgcatcagacagatagcaatatctcattgatttagagcagagcagaccaagttttggagtagagggagtagttcgatgactggcagagaagcgggtaagaatttaaagacaatagtagaatcattatctctctgctaccctgttgggacaaagctctctaaaataagcaactacacagaaggaaaaaaatggtcatttgaccatacgtattttgagagaaacaattacttttttaaaaattttaaagtgtggatttgaatttaatttttttatacaaatgaagtacttttgaatacagagctaagagtatattcttgacagcttgaaatagcttcttcattttcctctttgatgcccatatttgtatttcattgttttcataatttagagtaggcattattgtttctaaaacgaacataaaagcaaaacataaaaatcaacaacatgtaaatattttagtgtcaacagggaaatctctaactgtacataagataaaatatctattattttaaaaataatacataccttaaaatcatactctgaaaagactgaatcaagcaaaaaaaaagcttgatgaatgtccacataaaacagtgggaagaaaatatgtttaaaagtacatttactaacaaaacatgttcaaggtccatatgaggagaactgtaaggctctaatggaaaaatcaaagaagaaccaaatgaatgaagagatactccatcttcatgggtaggaagactcaatattgtcagcatatcagttatttccaacttgatctatagattcaattcaatcccaatcaaaatcccagtgacttagttggtggattttgacacactgatactaaagtttacacggagaggcaaaggtccaagaatatccaccacaatattgaaggagaaaaagagtgagaggactagcactacccaacctcaagactcactatacagttaccataaccaagacagtgaagtattggtgaaggaatagacagatagatcaatggagcacaggaaagagcaaagaaatagacccacataaatacagtcaactgacctttgacaaaggaacaaaagcaatacaataaagaaaaagtagtcttttcaactaacggtactgggacaactggaacgtccacatgcaaaacataaatccaaacatagatcatacgtccttcataacattaacttaaaatggatcacgtaaataaatgtaaaatgcaaaattataaaaatcctagaaggtaacctatgagaaaatctagatgaacttaggttgtgctatgactttcatatatgacaccaaaggcatgattcagggaagaaataattaataaactggacttcactaaaattaaaaatttctgctttgcaaatgactgtcaacattatgtgaagagaaaccacagactgggaggaaggttttttttgcaatagaaatatctgattttaaatatacaaatatctcttaaagcccagtaataaaaaacaatgcaagttgatttaaaaatggaccaaagaccttaacagataagttgccaaagaagatatacagatggcacataaacatatgaaaagatgttccacattatatgtcatcagggaaatgcacatcaaaacaaccactgcacgcctatttggaatgctcaaatccagaaaacttacacaatcaaatactgacaagaaagtattagacaacagaaactctcattcactgctggtgggaataaaaaaaaaatggtacaaccactttagaagacagtttgatggtttctcataacaactaaacattgtcttactacatgatccaccagtcatactccttgatatgtaccctaaaatgctaaaaacttctgtctacacgaaaacctgcatgcaaatatctatggcagctgcattcataatttgccaaaacttgaaagcaaccaagatggccttcagtaggcaaatggataggtaaactgtggaacatccaggcaatgaagtattattcatctctaaaaggaaatgagctgtcaatccatgaacagacatggaataaacttacgtgtgtattactaagtgaaaggagccaatcttaaaagcctacataccacatgattccaactgcatgacatactgtaaaaggcaaaacaatggaaacagtaaaaagatcagtggttgccaggaaatggggtggggaaaagaatgaacaggcagagcacagaagatttttagggcagtgaaaatactctgtatgatactataatcatggatacatgtcatcatatatttgtccaaacccacagaatgtataacaccaaggataaaccctaatgtaaatgatggactttgggtgctaatgatgcatcatgtaggttcatcaattgtcacaaatgcaccactctggtgggggatgttggtaacaggagagactctgcatgtgggggcaaggggcataaggggaatctctgtgccttcatctcactttttctgagcatctaagagtgctgtaaaaacataaaagtctttttttaagtacatttatatcaagattttattcctgtggattttcctgcattcacaacggaagaatcacttatgaattgtttgggtctaactgtaatttttgtacaaaccattcattgtgggctaatgtgtgctgttacattaatgctgttagtaattccctcatgtttgctatatatttttatctttacctcgttattgtatatattagtgagactacaaaacacaaacattttaactgaaatattaaatactgttttataagtgggattcattaaaacaaacatttggataatgaatgacaggttaaatttcatttaatgattaataaaataaatattgcactaaaaaagaatagcctgaaatactagtattagtcctattatctcagctcagggttgaaagtacttaaattattaataagacaaaacagtcatctaattgttttcttttcttgtatgacatttctgtaactacagaacaagaaagaaatgtcaattatatatcaatgagtaattcctgttaaagtgcatagtgaaaaataccaagtaagaaactacaaaagctaaaatgggttagcataatagtaagatactaaacctgatgcttttcaaaaaattgttaatttggagcaaatggacagaacacactgcatttataaacaacctaatcaatagtactcaaatatctactgcagtgttctaggaacattatttaaatcaaagaatgacatagaactatcaaggaactaacttattgaggaaatatacaacaaatagtaacaaaatgcacagatttaaaactatattaaacaaacaaaacacacagatttaaaattatattaaactatattaaattatattaaactatactaaattaaattaaaactgtgtgaatattttcaatctagtaaaatcaatgttgagttaattgatctaagatattgtagaggatgcttaatgcttaaatatcttagcatgggggctgtagtgcagaaggatgtttggtgcaaatcagcatggatcttcatattctttcccatggaaagattcaagcccctacagtgttagctccacttggcaccgtatttcattagcagtgtggtagcattctatctctacatccacaaagagagtagaagaaagctttggcaaatacattgaggctaatgagacacatgatgaaaggttaatttaacatgttacaaggctttaatcgtcaatgtgaaaaatgcccccccacccaagtattgacctgagaaaagatttctcctcattatggctaggctaaaaatcaggattaaagcattagtagattattatcactcatgtggcccaattttgttgagtagtaagtctgtgcacacaactaaaatgaacactttaaatatggcattgacagcttcaataaaattatacttgtagtaaattttagacttcaggcaaatacacatctggatgcttactcaatcagggttgttgtaatattgaatattaatctggcccatagataaattacagcctgattttctgatctatgaattcaggaaatgggctgaaaacatttttaggtaaaactttccgaagttttttcaacttgagttgtgtggaattctagggattctgcatacttggttttagattccttttttttgaaacacattttaatgatttttgaaataaaaatatacatactttaaaggagagggattaaaatttttctcttaaatttgagagtttagacaaactctcaagttaagtacttgtaccacctttccagcccatatacatgtataaaacaatgttgtcaaacagatgttattttctgtctgctcttgatacatttcaataaaatacataagtaatatattcaaatacaacagccattcacattcacaggaaagaaaaggcattgttgaaataagacatgaattattgtgttcaggaggacattggggaggcttcctagaccagagaaaatttggctatagttatgttatgtcacatatacattatgtgacaatgaagcaatattaaaaaagaagaacccacaaataactcaagttcaaagacaaaaataaattctagctttaaagttaaaagctgaaaagtgccagaattttctaactgcacaatctaaaagccaatccattgttgcctgctaattaagccaccacggggtttcatataattaatagcaaatcgtctctgaatggaaaaataaaatagttgcaacatgcctttacatagacatgcattttagacagtctgtctttaaactatagtatcaggacagactttccatgtagaagagatgattaattatgtcttgggttgggtgctctctttattttcttttctctcaggctagaaaagctttggtttctataattacttctcatttatctctagttaaatgtgggcgaaattttctattaattaaatttgaattcactctaattggtaagtttaaaacgacaggaataaattatagcacatattgcaacccaaataaggctgaattaaacagatacattatgtggcaatgaagcaatgttaagaaagaagatcccacaaattcttcaagttcaaagactaaaataatttctggcgttctgttaaggttagaaaataaggattctcttttattaggcaaatgtttggaagaagcatttgaaggctaccacttatagaatcaaagataattttcctacacagagcagaaaaagaggactcaccgaagactccaaattatgaactatttttaatcatttatttggcttagttatttataatcaatttactctgttgatttctaaacataaaaaatatatagatagcaaatggactatcagggacttcatgaagccattgtttttgattaaggaaaggtgtggtagctattctgcttaagtggcccctgttgtatgaattttgcaccaatgtttgctgatgtatttccttcctttagtgaagcaggaggtgatgcctatcagtaaatatcagtagacatattctgcattttcttctctccacactcagaaggaaagaattttaaaactcagcctcgcattttaaaacatattgaattataaaacttttaatgcagggaaatccctcagaaattctccagcctgatttcctcatttcacagatgagtaatcagttgctctgggagaggatgttatctgcccaaggtcacttagctaataggaaatctaatctgcgactaatgacaaatgtgtgctctttctttcacaccaagcacttgtgggcattttttttttcttgtcagtgatataggtgaacacaatttcataaaacttgcagatggacagaaactgagaggaagatctaatgtgtgagaaatgataaaataagagttcaaaagaaggttggcaacttagagaggtagaaagaaaatggcaaaatacaattttatagaaatcagtgtagagttctcctctgagttaaccacacatgcacagactcctcacacatttagttatggaatgaagaaggtacatcttaagaagagcttgtaccaggacagctagttgcagaaagactagcttaagtgggtttcatgaatccaagtgcagtgtctgctgtactgaagttaatggtctgttaatttggtttagagacagaagacttgggctaaagtcccaaccaggtgtgagtattatctgggtatcatctgtaatttttaaaaatgtattcctcccatactagatcataagagctagaaggggggcaccattcttgatgtattatctcctatatcctaggattttgcgctgtgccaagcatacagtagacactccattagtacttgttaaatcaattattaaggtaatgtaacttatcctctctgagccccagttttctcatttataaaattaagaacctacagttgtgaaagtgttttggaaactccaaagtgctgtggtaacataagcaattgctactgtcattgagaaatgctaccaataatacttagagaatttgatacaactcagtctgaaaaagctaagattagcagaacagagctgtctccaaatatttgaagaactattttatttaagggattggacccatttttgtatgtagttccagaggagcagatggtgaccactgtccaggcagatgtgtctcaatgtaaggacaacatctgtaatattaataattagaatgtatcctgtaattttctctctacccttggaaaccagtcgagatccagagtctttcactgggaggcttaaagcctagagcagccttggtgctagaggcggacagggataatgaactaatcttgaaccaattcatccatagcaatctcaatgctttcgttagctcttataggtatttaatacggccagaggaatgaaggtagtcttgctggtttagaagccctgcctaccacaacccctacaccaccccatcccctgcatagtctgatgtcatcactagtggaaatgtttaaacagcagtgaatatgcatgatagacagaatcttgcattggataaagagtgaatctttgaatttcaaggtcatattcagctgaatataagctagagaaattggaacttatgaaggtggtgatgaatacatgagcttaaaaaggattggaaagggccaggcacggtggctcatgcctgtaatcccagcactttgggaggctgaggcaggaggatcacatgaggtcaggagttcaaaaccagactggccaacatggtgaaaccgtgtctctactaaaaatacaaaaattagccagtgagccgagattgtgccattgccctccagcctgggcaacacgaatgaaactccatctcaaaaaaaaaaaaaaaaaaggattggaaagaagagatatgaacttctctttttgcttccctgaagtagagaaagcagagcttaagaaacaatttatatggactatgtgttccaacttcctaaaaatcaccatataaaattctatgtaggaaataaaaataattgcagattaacacagtttatatattaatcacatcagtttataaatataatgcacacacatgaaaaacacacaaaaatgtgtgttctaataaagaaattagatagaacagttcttaatttacttattttcattttggcacttctgtgaacttggttgtcaaatgcattaacccaaagaaaacttagcaatttgatgaaccttgaatccatttagaatttgtcttctctgctagaaaaagagaatgtatgtttttagaaaaacatttggcccacagatgatatgagaaaaagcttttcccatttaaatagctgctatttttataaatggaaccacatcaactcttccataaggagaaaacacactcttgtgaagagccgagaatttctggggtgagtgtgtgtgtgtgtgttagagttgccaagtagctttcccttacatttaagcaacatatcttaggaaagaaaagagatgcacttagagttatttccctgtccctgtgcaggttagtatagcagagtggaggtcttaagggaggatagggggcctagggaaaaagtgtaatgatgcctaaaggatttcctggaagttggcaggtaatgtgaaatgaaattggaagggtgaggaggctgtgttccccctgatgccagtgtgtgctttcatttgatattaatagttattgagccaagggggaaacatctttaccttgtaaaataattcattgctatcaattacgcacatgagctagaatgttcaggccacgttcacaaacttctcaattagaaacgctgtatttctgaaagtaattataaaatacattgcatggcaatgtttttccaagataaagaaaaattcatggaagcgttacacaactttctgaaattcaaaaccagcctagtcaacagggactaccttctacagattcattttcttattcacgtggtgcgcttacgagttccattaatatagatgaacattacacataggtatccagaaaagacatctgaggccttccacacttcacattattatcagtggggatatcagagggcagctttctttctgcatcatctctctgagtgaaagctggttatttaacttcatttgtcagctaatcagccagaacgtgaagctattaaaatttagaactgtcctctggaaaggtagatgttccgtgaaacgccaaaatgaaaattacctggtgttatgatgaccaccttaacttgaagccatcatcattaggatgcatttctcaaggcagcgtacagggcacacatggataatcatcagactgtattttcatctgaagcttgccattcagggactccatcctcagttctgggacaatagactaaatcccctctcaatttatacaaatcagtgtcagatctcagctggcaaaaggcagccttcgagggtgtctccttcaaaatggagaagaccacagctccagctagagtcactgaaaggcaagaagagcataagaaaatcccagctgcagaacaaaacgcatggttcttccacagcacatctcattgctgagatctggtcgcatgaagcatgttctatagctactcttctgtgtctcctggtaatttatgtgcaatactgtcttagtacattcggtattctttgtacattcaaaataccatgaactgggtggcttctaaacaacagaaatttatttctcacagttctggaggctgggaagttcaagttcaaggccctggcaaattcagtttttggtgagggtttccatttcatagtcaatgccttctttttgtgtcttcacagggtggaaagggcaagggttgtctctcaggccttttttaaaatgaagttgttaatcccattcatgcaggtgtcaccctcatgacctaatcaactcccaaagacctttgttatttggcttctagttatagatgtttcaaaaggcgaagtgttgtaccttttcaagctttgtatagtactatcatctgactgctttattcccccaaaattcatatgttgaaatagtcatctcaaaggggatggtattagacagtggggcctttggcaggtatttagtatttgtcttaacttttcatctaacttctaaattcctggccctgagtaccattgttttgtagcccctattctacctagatttctctggatgggagtcagtgcaaacttcttttgttataagaaggttgtattctgtcactagtgagtaacggaggaagagcaattaagaatggccttttattaagatgccagcctttgttgagcagtcttggtaatatcataatttgcaaaattcagaagctgatgtgagagttccagggctgtcaccaaaacccaggtttgacatctgaatttaactgacactgtttgcctgctttgaggctgtccttccattgtgtctctaactgcaaatgagaatgactccccgagggaagcctttgggatcacagatgcatcaacatctgggaatcaaatctctttcaattacattaattatctgctatgtgcaggagaaagttttgaatctaaaataacattaatttaatctcaaggttagagagagattttaaacttcctttaaaccccaaaatgccgaggcgggtggatcacccgaggtcaggagtttgagaccagcctgaccaacatggtgaaaccccatctctattaaaaatgcgaaaaaattagttgggcatggtgagaggcacctgtaattccagctagtcgggaggctagggtaggagaatcgcttgaacccaggaggtggaggttgcagtgagccgagatcgcaccattgcactccagcctgggtgacaagagcaagactccatctcaaaataaaataaaataaaacccagaggggaagaatctatatgcacactgtaatgaaactgtgataaaacatatgctcggaagcacatccttgaggtacttcgtgagagtgcctggtaaatcaaatgtctgggatgcttgcttcagtcagtgaggcaaaggaaagtccggctgccaaattatttacttaagaagtggttataatgttattttacccagttggaactgtctgcctatactagcttagtgctcaatacagttcaattctgttgatcatttttttcgaaatctcacgtacattcttctcatctaaagatgcccgttgccatcgctaagccaccctattgtccatctcttcccagtacaacccacaccatgtgaatgttgcaacaccacttccatcatggttcatcatggttctccttgtgtaagtagctcacctattgaagcaagcctaaacctccatcgccttgcctcagtctgcagctgatggtcttccacaccattcctgcaggcagcctcttcctggcagtcaggctgggctccttgctgaatggtctgtacagtgtgctccttggtacctgttttgcttttacctatgctatggtcactggctgtaacatccttctcctgtcctgcttcccatggtcaaatgtttgtcattctcaaggtccttttaggttctgccccacctggctctttaggcccacacaacctctccccgtttctaaaaagtgtttatagattacagcatgaattttgctgtggttgtgtgtttttatgagcatgtgtgactatgtatgtatctatagatagacactgcttgtaatttcttaaagaaaacagcttctgcttgttttgttcaaaatgtctgaagccaattgtttttgtttgcttttagaaaaaaaaaaaactgacatcaaggagagagcataacacagcccccactaccaccaattatgcagccgagtgagtttcccacatttggggaaatcacggaaatcagcacatcagaatgcaatgggtaagctcaccctgggaaaaaccattttcatgatcatgccatctcccctgccgggtaagaccagtctgtgaatttctctgttgtcataacatatgcccagcaaacatggatttgttatgttctacctcacttctagtgagatatatcacttaatgaaataagtgactgaaaagtcacagaagatttcaaagcaccatgttatctgccctcccttgcctcctagtccggaatcaccccctttagttatctcacctccctttatgtgatattaaagaatcatttgaaaaggccagaggttgtagctgggatcaaaagtcaggcagacaaatatgtcatgtgtccatattaacaacaatacacgtttcttcctgatttagaaatcaggctatagtttcacaatagtcaaaaaccaacagcaaacctgatagtcaaagcctagtaaggttcacttctttcattgtgttaatgtatgaatatttcagcgactaaggcacgtttccaagaaataagaattaaggggaaaatgtaatttagcaatatttttacataaaaccattatgtgtttaaatttatataaattccattttgaaatatttctcaaatatttctccaaatgtaaacaacagataaaagacacatgaatcaatgcatttgcatacatctaatctgaaggtataaatattttgggtttaaactattgatctgaatattgcactgaacactatcattattatcttaatatgttcatataaggtcccaaggtaatttgacatttttaatgtgtcctaatggtaacatgatttgactattatatttacaaaaggaacaactagcaccctactttctagcaaacaataatgtcatgtagaatctcttagagaaactgcatgggctatgtgtttctttagtaattttttcttggacaaatttaaagttgtatctttttattttcagcaagtatcatgccttgaaaaacctcccttctctgtggttctatggtaaagtatcaagggcatagactctgaaacctgatggtcgcacattcggattttgattcagctacttcttaactgactggcactgggcaattcacttaatatccctgagcatcagtttgggtatctggaaaggatacactggtggtggtacaatatttactatttaaagttgagatatggctaaaataaataattattaataaggttccccacttgttggattgatagaactgccagtacttgctaaagggaaacaagttgtaaaatactacaaactgtgtggagttagaaaggcacccttgcttcctttgctaccctctatcttttgaaggtagttgtggttcacaggatctcagcagccagaaatactgctgctgattttataattttccaccaggcacttgtgaatcaccatatgctctaacttttttttctaagaaattctggcagcatttaaaaaatgaagtcactatgccaatgtcaatctaaagatgccaatctacaacttaaagtctttgctacttttattcttcaacatgaagtccaaatctccactgttgacttgtcatggtcagtgtctttgtctaaatgacagtgtataatgacacatggtgggattttctctttgtttgaagtcaggtggggaaaggggtggtgcacttgacatgtctttattatttttctttaagaaacccttattaaacctttaaaactgatttttcccactcccttcaaactttgaagggtctttgtgcagttcacccagaacagaactcatcacacagcactgatacacaggctatggggaaggggagatcaggggcacggagaagcacaatgcaggggtttaacaagcatttcattaactgaatttaggaactctaacgttcctccgaagcagacggctccttgctctaagagctccagtgtcttcccacagcccatgcacctgcatggccttcccactgctgacaactctgcctctatttcgtgcgcgtgcctcatcagccacacatgtccatcttcctaatgatcctcgcgcttgctactcatggccacctcacggttcttacacttgctgtccaccccacatgctttccctccccaagcgtcttgccatagcatgctccccctgctctctctttgtctttgtctctctctctctctcactcactcatttcagttaagttgtatgtcccttgagtgctacatctgaaatagagccttcccaaactgatcttgcctttctcttattctgctctattttacttcaaagagtttatcactgcctgaatttctatgtattttcagttcactgtttcttccactaggctttgttccactagtctctggcctcaggaagactggatgttgtctttttttctaccgtattctcagcatcagagctgtgcctgatcacgatagaaactcaaagactaaatgaatacatgagtgtcatacatatatcgaatagtagactttcaattgttgcattttctaaaaaagcaggaaagagtcagggactagcatggtatatagcagagggctgacgtagttcctttaactgtattatctcatttaattattaaaaaatatggagtatctttcattctcattttagagctgaagcctctgattttagaatttaaattgcccaatctaaacttgtccaatctaaagatatacacttaggaagtgactgccagcatttaagccctgggttttagattccaaatttgatacttttgtctccacataacacagatgtaaaatagtttttaaagaagcttagagagtttacagacttgttgatttttagttaagtggttaatattactaggtaattgattcagcagctgggataagataaataattaaatgaatgtttatataagcaaagagccaaaccagcaattgaatcaataaagcctactatgctttcatttttctctggctctcctttccaacttcccttgaataaaggtatcccttaaaattcagtacatgttctttttggtctatggagatctcattctttttgatgacttcataaccttaattttgcatttctatgactgaccttcagtttgaattccagtcctgtctcctaatgtctactgaatattctcactttgagtttttttcgttatgtcctcaaagtcagtattactctatgtccccaactggctccttgtcctaaattttccttcccagacactaagcgttagccatatttaattacttagccaaataattgttatatcctattcattcttccttaaattatgtctatatattgcacttacatcaaatttactattttcactgccaatatcatatttcaaatccatgtgcattcacacctcgattgctacaatagctgcttttttgtggttttattttgtattttacttttgagttcacaggtacatgtgcaggtttgttacataggtcacctgtatcatggggatttgttgcacggattatttcatcaccaggtattaattaagcctagtacccattaattatttttcctgatcctctccctcctcctacccttcaccctctgaaagacctcagtgtccgttcttcccctctgtgtgtccatgagttctcatcatttggcaactacttaataagtgagaacatgtggtatttggttttcctttcctgtattagtttgctgaggataatggcctccagctccatccatgttcctgcaaaggacatgatctcattcttttttatggctgcatggtattctatggtgtatatgtaccatatttctttaaccagtctatcatagatgggcatttaggttgattccatgtctttgctattgtgaatagtgctgcaatgaatatacacttgcatgtgtctttatagtagaacaatttgtaatccctgtggtaatgggattgctgagtcaaatggcatttctgtctttaggtctttgaggaattgtcactctgtcttccacaatgattgaactaatttacactcccaccaacagtgtataagcattcctttttctccacaaccttgccagcatctgttattttttactttttagtaatagccactctgactggtattagatggtatctcattgtggttttgatttgcatttctctaatgatcagtgatgttgagcctttttttcatatgattgttggtgcatgtatgccttctttttaaaagtgttggccgggcgcggtggctcaagcctgtaatcctagcactttgggaggctgaggcgggtggatcacaaggtcaggagatcaagaccatcctggacaacatgggaaaaccctgtttctactaaaaatacaaaaattagctgggtgtggtggcacatgcccataatcccagctactcaggaggttgaggcaggagaatcgcttgaacccaggaggcggagattgcagtgagctgagattgcaccactgcactccagcctggtgacagagcgagactctgtctcaaaaaaaaaaaaaagtatctgtccatatcctttgcccactttttaatggcgttgaggtttttttttggtaaattttttaagttccttatagctgctagatattagacctctgttgaatgtatagtttacaaaaattatctcccattgtctaggttgcctgtttactctgttaatagtttcttttgctgtgcagaagctcttaagtttaattagatcctatttgtcaatctttgcttttgttgcaactgcttttggcatctttgtcatgaaaatctttgcctttgttgacattgccctaaatggtgttgcctaggttgtcttctttggttttcacagttttgcattttacatttaagtccttaatccatcttgagttaatttttgtatatggtgcaagaaaagggcccagttttaatcttctgcatatggctagtgagttatcccagcaccattgactgactagggaatgaatcctttccccattgcttttttgttgttgttgttaggtttgtcaaagatcagatagttgtaagtgtgcagtcttatttctgagttcactattttgttccatcggtctgtgtgtctgtttttgtaccaaagccatgctgttttggttactgtagccctgcagcagcttcttgattgatctctttgtttcctgattcctctaacttatcctgtacattagtgccaaattgatattccttaaagttctttcaacaagtcactgctcacagttcaaagtttgaacatcatagcttagaagtagctatctacaatgtggtcccaatagaccttctgatcttaacttctattattctttaatatcctctagttcagagaagtcttttaaatatgccctactcatttttgctgccagaaaattttctacattctgatcattttggggaatatagtttcttcttctctcaatttattcagatcccacaaggctccacttatgacccaccttcatgaagccatttctgattgggttgccacattgctcaattccaggagaaaccattaacatatttgtgctccagggagcaaatttcttgtttactttctaatattaccctttcttccctttagactttagtcttatgtaaagtttaattgatgtcattctgaagattatttaaccttttcaatgtttgaatggtaacatataatgaatataatcttcccatttcccagctattttcccattcttatctaatctttctcttgtcccacttgtcaattttactcatggctttccagggtcagcatgtgtttatgaaacacctgctgtgtgtcttgaactgtttaagacaatagacatacactgttgaatgaattagacttgatctttgctttggtgcagcactcatatcactgcatacgcaatctatgggatcaagtgtggcaagggggaagtatcagatgctaaggtggctttaacaataggctagtgaggtcatgaaaggggccccagacatctatttcatgcatagttctcaggatcacttctagctttatttatactgttccacatgaagaggaaacaaccaaccccagatctgctaaaatgtgttcagggtctcacattgtctcctaggtactctatttgagtagaatgagaagtgcagtcattacatctgccacaaaaaagcacatgtcttccaaatgtacatataatgcatacatggatgtgacattggtatatctttagttttaatattttaaaaattatatatagatatgtaaattattcaaaggcagggagcatcccttctgctttgtaaagaatatttgcggtgagggttagcaaccccagctgatcatgacagactctatttaaatatccacagtttcaaagcctagcttctcccaaagattaaaaaaaaaaaaacccaaaccaaaacaaagcaaaagctattagaaaacaatattattttctatattaataaataaagaaaaacaatattaaagtagataatataaagtaaaacaatattatctaagagctgggcaacttgatgtatgtagggtttgcagctgtgtcattttaagccattcttgatattactaactgggtactacaagttaaactttaagtttaaactaaactacattatctgtctatcacctatctatctatttatctattaactattatcaatatctatctttaaagtaggataccttatatattgtaaccgtattctattatcaaagtagctggctctatagtattatatgtgttcagagggtttttttcctcctttcataaatcatttttgagtcttttctacgggatagagagaatcaagtgtaaggtgtattgaagattaagttaatttatagtgcttctctttgctatcagtgtattctcaatgttttaataacaatgcatggaccccactccctatgttttaggacatagagtgatcactgcattttgcccaagtttcattgtcacctgccaggaactgaactggacataagattcatccatgttcctgaagacccttctctgccatctggcatgcaccctgagtcagtgtccaggagcttggctgatagaaccagccactggatgtcaccctttctctataaccaacaaacagcgctggctgctcacaaccaccaccaaagtgcccactgctggtctgatgtgttggcagtaagacaccagctcacagattagaccacaccttcaacctcacctcccagaattctaagagaactcatcttcactaagtctgtctgtcatcatgaactacctattatgttttgttttctcccatttctctgagaacaggaatttttacatagggaaagacttaattatttgcttagagatttctgatgattcttgatgatgaagagaaaatactttttgtattagttttctagggctgccataacaaaataccatggttggaggggtggaggacggggagttaaacaacagaaatgtatttcctcacagtctaaaaaagtctaaggtctaagaaagtctaaggtctacggaagtctaagtgttggcaaggttgttccctcctaagccttctcctcttcttcttggccatcctcccctgtatcctcacaggtcttccctctgtacatgtctgtgtcctaatttcctctttgtgtaaggacaccaatcaaattggattagggcccaccctaattacatcattttgatttcattacctccttaaaagccttatcttcaaaggcaatcatattgggggttaggactccaacataccctcaaaaatttgggggaaggaggcagaattcaacccataaagcttttctttttccagatcatctgattcttgtgtattctcttattgttgctgacaattaaaccacatagcatttatataggctggtggaagttggatggtgttgtgccttttaagaaacttgaaaagaaccaactgtctccacactggattttctcaacacacaagccagggaggtcaacactgatgactcacatcatgtcgctatttaatcctgtcccaccttctaacatacaatctgtcttgtcttcccaattccactttgctatgtattatctaaaatgcagaatccaaggctaattctgctctttatttccaggtgctcattcaaaatatataataagcaatgtgaaaaaaacactaggctataattcagaaaatgtgacatcatccatgtcacaataatgtatcttcaacacactgtccaagagtatatcataaagctaagccaataatactttccctgatttcaaatagtgttgtaataaagttaagctctaatgaatgtgttttgaaagctgtaaagtaccatctagcatattgaatagctgtcactgtccatttttatgattattgtcatatgaatgaatggatgaaccgctgttttatcctttaaaaccagctagtttccattcctatggatcgcataactctctccacttacctttattagagtgttccttatactgtattttaaatctaactttactgatctgtttttccactgagttacaaacccctggaaaaaaaggattgtgtctgcaagcagctcagtttcctcaacgcataaccctacatggttctcaggagaaactccctgtgctttctgatgactgactgcctctcctcagagcatgtcagctgcatttctttctgggtagcaagcatcctgtcttcttttctgtcctcctacccggtgcctccaagcccccacccatccatagtggtatgtaagcatctttccagtctcttctgctgttaccccagcaatgtgtgggactgtgcttgggtttggtgtttcttttcaccttgttactcatctctgtccactgaaaagcttaaaccacacagaaatgccaggctgttttcaattaccttttaatttatgtatttattttgagacagagtttagctcttattgcccaggctagggtgcagtggcaggatttcacctcactgcaacctccgcctcccaggttcaagtgattctccggcctcagcctcccgagtagctgggattacaggcttgtggcactacgcccagctaatttttgtattttttagtagagacagggttttgccatgttggtcaggctggtctcaaagtcctgacagcaggtgatccacctgcctcagcctcccaaagtctgggatgacaggcgtgagccaccacccctgccccctgccccctcctccactttttttttcctgaaatcatagggcagttctgctagcatggtatagagtgcaggtactccagggcagggtgacccagtgatatgggataaccacccagctactttgagattgttgaaatgtctgctttctgatttccctgtccaggctgtctctgtcagattagagcaattaaatgataatgaggactgtacataggaaaattaattctggggactgtaattagcatcctccctatgggaaacttatacatgtgtgtaagcactgaggaaaaccctgaaatatctgctagtataataaaaagaggcagttttgagatagaatgctggattaatttattatgaaccggaagcatgttgttgtaagagagacaaattcgattcctttaatgtgacttcgacattacatgcttgccttccttgcttactttgaatgtgatcaagttcaaaactagatacaagggggaggagagacaggcatttaactggatttctcaaagtgtattttctatgcaattctctagtttgtgtttgtgatattaaccagaagaattttcttttcagttctggaagcatcaacagccctacttgttaggattttggatatttctttgcccttttttcccaggattcttcctgatttaagagaaatcctaattctttaatgttatttgtgccttttttgactatatatatatatatatatatatatatatatatatatagagagagagagagagagagagagagagagagagagagacagagagagagagagagagagacagagatagataaatagtctatactctgtacatttattataagattatcttctttccttcaacagaacgacccatgatttggttttccaaatctttcttcagggatttattagccagggtgactcacagatgtctctgattttagagcttctatttctctttcactgtggtgtacttgaacatgtgtaagaacttttccattcaaatttttcagtatctagaattaatgtctggaatggagctctctttcttaagacatcattttccctatttccatgcttcccaccacttatattctcttttgtgtctccaggcttgtgattctggaaccattaggggttctttcttcctcaacaggtcagcaagtacctaatattatcaacttttcagagattcataggtgccttcatgccccagtttctgatctccaggttagtcctgtgagatttggtcttcatttcccagcccaaaacataatttgtgactcacctggaaaatcatgccccttacgctctgctaaattagatcctctttttgaaacatatttcacagattctctgaccatcataaagttgattcatgtaagtttctaaattcttctctaatcatttggatcacttcaaaatgtaaagcataagctgtcatgcacctgaggttcatgggttctccaactttaaaaggttccagtaaaattcaaaggatctcaggactacccgaggtaaactggggtgagaagacgaattttaaaacaaatatatgaaactttttatagatagtattagttttctaagataaaaaagtatattaaattaaaaattccaataacatttatatatattaataaggactttttattaaaaagcttctattatgcctcagacaattttcagaatctcctcttaatatttaaatgactttacattattattcatattattattaataataatgcccttacattattcttatttttttcttcattgcaaataatgtatactgaaagaggcttcttctccttgcttttggtcttcaaccagatgttcaatgcctttctgatattaagacttcagattctacctctgggtcccatctctatcatcaaatcttataatcatttcagtttgttccctaggtgaggttctaattctagtattttggttttttttttcattttctattaatttctcccaaatctcatttttaccaagctttattttttaaaatagtaacttctttttactctcttttatccactctaccttttttaaaattagtaatcaaggcattccatcttttatgtaattatatccaataagagtaactgccgtaaacatttaagaactaagctgttcctaataatgtctagagcatagtcaactacatttgagtgaagagaactaggattggggtagatttactagctggctctattcattttcttttttttttttttttaacttttgtttagattcagtgggtacatgtgcaggtttgttacatgggtatattgtgtgatgggaaggagggaaggtgcaaaggcaaaaaactacccattgggtactatttatttgcttttaactatctatgtgtgtcccatcattaagtgtacattgttaaaataaatacaccacctagacgttaaacaccaatttccataaagctaggtgcattcttcacacttcagcatgcctcattgtccctttttggaaaatttttaatgccttatacctgagtccaccataaaggtgttggttaaatagttctgggcttatgttggagaatgagtattttatgtaaggatcctggtgattttgatgcaacttgatcttggatcacattatgataaatatagatgaagaagtagaaaagagtaattagccgtaaatctgcagaaccttgcaattcattatatttgtttttatgtgtaccaactataacgtgaatttggtatcgatatttgtgccaaagatataggtgcttgcatttgaaagtgcatgctgtgttttcttttgttctatcaataagtcagatgaagtaaagaatttgcaaaatgttgatgaaacatatttgctaacacacaagcattagctctttttgtaagtggctgtaaaggaacacttggtgggcaaggaagtcctgtgctctgtctcttcccctttacagctgggtggccttgaataaacacaaaacctctcaaatgtgtgtcccttctgagtatactctgcggatggcacttcctacttcaaagggttgttgtgaggctcaaatgaaaatgtactgtaaggtgctgtaaccggcatgaaatataggcggcatgaatattttggggtgtgaagcattgtatgctggattttctagccttaatgagctgacaattttattctcccatttctacactcaccactcctaacctttacattacatttttttgtaagttttgaagtctcaccttatttcctctggaatttctcaaaatatagtagtcgacaaaggacagtcatttgacaaatgtttcaagtgaaggactttacaagcatacctactcattagtaaaggcttcttgctaatattactttcaactcctttctccaatacttccttacaagcaaggagattattattagggagagagtcaatcatggccttctgcaactgctaaggcacagcagactggcagatttctaaaaaccaagatcactcaagatgacctttgaccttcctaccccatttccacccattattgttaattttaactcttctgaccaactttgagtaaaatgtgcaaatgttcactgaaacccacagtgtaaaaatgtgtctaaaaaatttgtgagcattaaggaaatgagatgactgagtcaaacccattcatttggagaacccacttgaaaagtaatgttccctggatatcaaatgacaagctggatgtgtttatatattggcattagaccctgaaattaacacagtactaactttccctagagaatgatgcaatgaaatgtactacccaatgaacataaatagaaattattactgaagccttatttggcctttgtgacaagtgagaaaatatatgtaaatctaaatgattacaataaaaagatctataattgttaacaggaaataatatccaaacaagagactaccttcttaacagtgtagagtttaaggaaaatgcaagtagaataagtgaagaaagaaaaacaaaattggcaagagtggtataaagattaacaactacagtgaactgtagctattttcctattgtcagatgaaatccttagatttgaggaaaagagctgtggtccacacccaaacaccaccattgctttggattgctgaaacaacaggaaataaagctaagacatttctggtacaaaatgacagctcttcattttagtgtcactcaggttgacaactgatgcacaggatacatgtcacaactcatcactgcctatcttgagggtatgggccttgcaagcctccagcaaaaatgaaaactctgaacaacacagtgaaatctcatttcacaagatgaactagaatcaaggccattttcgtggaggaaaaaaatcatagaaaagggttattgatttatgccccaaatagactgccattgcaagagggctgtgaaaaatataaattgttgttagttgtaaatccaacatcataaaacaaatcttgtgcacaagtattttctttgcccctcatgccatcatttttgttgttttaaccaattaactctacatttaaaaatgaggagaattcacataaagctgtgatttctagcttctcttgaaaaatcagaagatttagcaaggggccctatagtccttgatggaacaatcagttggagctgagtagaacctggctattttcattttttaaaaaatttgattggctttttttgtatactgacaaattatagttatatatatatatgaagtacaaagcaatgttatgatttctgaatacaatgtggaattattaaatcaagctaattaacttatccatcacctcaaatatttgacattttcttgcaacaaaaacatttcagaattactctcttagtgatatggagatgtacattactcagttattagctgtattcactacactgtgcaacagatctataaaaaatactcaaaattatttatcctatctaactgaggctttgtatcctttgattatcatttccccattccttccaccccccagcctctggtaaccaccatctaccctctgttttcatgagtgcaattgttttacattccacatataagtgagaataaaagtgttttacattccacatataagttataagaaaaggaaaacttttctgtatgagaatgtgtggtatttgtctgtgtttggcttatttcacttagcataatgttctccaattccattcatgttattgcaaatgacagaacttcttccctttgtaaggctgaatagtatttcattgtgtatatgtatgtatcacattgtctttatctatttatgtgttgatggacacttcgactgattccataagttggccattgcacatagtgccacaatcaacatgggagtgcagacatctcttggacataatgatttcgaatcttttaggtaaatacccagaaaagggattgctggatcatatggcaattctatttttagttatttgaggaacctccatacaattttccataatggcagcactcattcacagtcccaccagcagtgcacagcctcttctgtccctcaacctgacccatcacttcctacacccaaactgattcactcattgacgcacctgaccccctaaatatgtgagtttgagatcatttgctaaaccataaatagggctgttgtgtgatttattcccttcacattttattttgaaaataatcaattagctatatatatattagtgagactctgatgtttgtagctctgtcataggtgataaggcttcttgcagatacatggaaatatatgggagataggtaaataccttcagggagaattggaatgccactgcatcacacacacacaaacttccaatgtcacatcagcaattcaagcagttatgtcctcataaatgggtgcagttggcttctgaccatattcattctgtcattcttctgactcaatttctttttttgctttatctgtttttactttatttcctctccatctttgtctctcctccttttcttgctcactgtctctctccccctggttctctttcctgccagtaactactgaggctctctgtaagcatctgtgctctctctcagtctctagtcattcctagcactttgcagtcagctctctttctctacggttattaaatctaccaaaggaaaacatctgatttggtcagtagtcaggtgctactcaatatagaatattcctgttgggtagactttctggccctgatcagaagggactgagataaataccacatgggcaaaccaagcaggaccacttatgtacaacactgccagcggtccctttttctagggccaaatcgcaagcattttgatacacgaactaatatcacagacagggcttctctgctttagcagcagttcacagcttgaaatttttttcctgtttctcatctttgagtcccttggggatttagtgctacctagcagcagagaattaaaaacaaaaaccactacaacaacaaaaatgtgtccctgaaacccatgctatattcaactgaatattctaatgtctttgattacaaagccatctctagcaatttaatacaattatgaaatggaaaagttggcaaatgcaaaacaatagctcgtgttcaaggtatgtctttattaggggaagtttatcgaaacagatgtttatgctatttcctataaactagattctaaaatattttattctataaagatgtattgactttatatgaaaaaattattgaaaaatctacaagatggtgaaactctttagaactatatttctattacaagtttatttttaatttcaaaaatgtactgcataaatgcagcaaaacctttattgtcacatattaaaacatgtacattattgtgtgcaaattaaaatttcattaccttaaaccaaaaagtgagttggccagatagtaaataatttaggctctaaggctgaaaagcgcttgtattaattactcaactccaccactattttgccaaagcagtcacagacaatatgcattcacatgaatgagtgtggctgcattccaataaagctttatttatagaaataggggacaggccagatttaaccagcagttacagtttgccaaatgctgccctaagctgttgtttgattgttaagctataagaagagagaaagtccttttaggactgcatataagaagtatatttaaaaagaaaagaaaagggaaacttttctatagcatcttctccattgtttaattatttcttttgtttaaggtaactagtaacttagaccttctgggatatgaggaggggaaattaaatcccctgaatctgtgaggtttgctgtctccttaaaaattcagcttttccatacccctgactcatatcatagaatagtggcagtaaggcaacacatactttctttttatcttgccttcatattcctgaaccatcagaagtagaaaataaaaatagcaatggcagcctggatagcagagaaaagcagcacaaagcaaaacgagaagccaacactagaggggcaaacctgccatgacaattactcaaccatagtacaggaatcacgtcttaggatgcacacacaatcacggtacatcaagtgagtcacagataaattcatgttgtaaatatttagtgggtgattaccatgtagccatgttaatccaaaaagttggattttgctacatgcagaaatcattagacagtattctattaagcatagaaatagctctgtaatcttgtgtgttttctctgaaaatacagctgaattgaggaaaaaatgccaaatacgatagaatttagcttgtgtaaagtgtgctacatgtagatattaaatgtaatctcagatacttaccaaaaaacactttatatatgtccaaagtatatggcagtaatggccaaaattaacagcagttcctagaaaaataacctataatatttttagaaatcgtaaaatataaagttccactgagtggtcatgtttttcttcagtaaatagcttaaaattaatatttttaagttatatgaacatgatttaatatatactaaacccattactaaaattcatttctttaaattctcaatgatcactctagcaagaacctgcaataacgccttcgataaaacaccttgctgtagccttccagatctctccactctgatcctgcctcccctgaccctttatatcttggtgctcaccttccatactgttctgtgtctactctgctataatgttgagcctgagcatgcactggggggtccttatgcccccatattttgtttttgtggcctcttaccatcagttatgggataaattatattccccccaaattcatatattgaagtccatacccctaccacttcagagtacaactgtatttgaagacagggtcttaaaggggcaattaaagacaaatacgatcatgaagataggccctaatccaatagtattggtatccttataaaaagaggagatttgtacataggcattcagagaggaatgactatgaaaagacacaagagatgacagccagctatgagtgaaggagagaggcctcagaagaaacaatcctgccggcaccttgatttcagaattccagcctccaaaactgtgaaaaaaatacatttctgtgctttaagccccccggttggtagtacattgttacggcagccctagcagacaaaaatatcctgattgctgtcccctcctgcaaggtcattcaagctattgctctactttctatgtccagattaatcagggcctccttggccaaatatttccaaatcctgacctccacgggataactatcttctctgtggtgcagggcttggggctggaattacaaaagccagacccagcacccaactccactgcctatcagcttgggaaatattctcgcaagtcttctttttctcatatttaaaattagaattataatacccaccttacaacatgagacagtgtgtgtgcaaacacagttgttgtttctttgtaaacttactgaatgcatttttcttgaattacaacatattctatgctacatcacttttaattgtttatgcttctggtttttccttctaggtagcaggatgctggagtatacgggttaagtttatttatctttatagacagggtggctaggacagctcttgccctatggttcctcaaagagtactttctggacacaaaatgaaatgaccaattaatttgtcacatgtaattgtgcgtcctttataaaggtgtgtttgttggtgactggaatgacgcacataaacaggggtcaattttctcataaaatatctacagtatataaatggtagggttgggcatgagggaggagccacagtagaagttaacagaacaaatatttattggaaggtgattagtcgacagagagcgcatcatattagcaggctgaccaagctttgatttcagcctttgctttccagtgttaggtactggctttgagagttgcactccatttgttcattatgaaaatgtattatctgaccaaagaaaatgaagatttgcaaccttaggcactaactaaagagaatgtcatgaattgatgtgtgtgtgtgtgtgtgtgtgtgtgtgtgtgtgtgtgtgtgtgtgttcaacctcagtagaaacagagatggttagagtcaataagaaaatgttagcttggaaattaggaaccttcaaaaaaccaaataatcatttgttcaataatcattgtcttgaagttgtttcaaaaagcagtcttttgttcaaagacataaagacaacaacaaagaatttggaaaactcatgatatttatcagtaaatggtaagatttgaaagttacgaaagtacttgctaacgttactcgctgttcttcgataagctgtagtttaaaatgtcttcccttttatatcctttcagtacttttaaatgactctgtttttttgtatttgatcttaaggaactttgcattctaataaaagaaaaaagctgacttgaatcgctatgtttttctatcaaaagaaaacaacaaatcctggtctcaacatgtctcacagttttccctggagtaagcataaaaacaaaacatattaggagcatgtagtgagcaatttaattccatagagatgtttcctgtcctgtaagtaaaaccaacaaggaaggaggtaagaatttgttttctaattaatgatgtgtgtcctagaaaactggctgggtctttatctcagcctctgagctgaaaactatcttaacgatgaagtagtttgagattaaaatagctcaattatgttgatcataaacaggtgtccttattgacattttaactcatgacagttcatctagaaagtaatagatgagaaaaaaatatctaaactgaatagcactcttccacatctcagatctctaactggtcttttggtgggtggggttggggggcatgtggtcaacattgaatatgcacataggttaatgaagaatcttgctatgaataggctaatacaattttaaaattgtgtacatcttgcgagttgccattttaagggctgtgtggaatcatgggttgcatttgcctgtgtctaagggaaggctgtttagatatgtgcttatttaagtcactgaaatgtaggattaaggaagtgaaatgtgtatttgtgagtgtttgtgtgtatacactaaacttatgactgtgcaggctggcgtaagcagtgagaaagtcagcttcatcaacgaccttggcatgacatttgcaaaattctgagctaactgcagttttaaagtgttgtttcctaaaactatacagtattctgctactcggcagatgtataaataattagagcattaatcatttctcaatgagttaatctaaggtaaagattgcctcatacatatacggtaaacacaaaataactatttgctgcatacgaatgacttccagcgaattttttatgcaacatgagtgtacacaattgttcaacatctactcaagtctcagcataatttggctttttctttacctgaagtccatttgggaatgggaggttggagactttttttctccctgtctgatctttcttatttcaaattcatgctgttctctctgatactcattttgtctttcaaacctgaagtttcataggatatatgagcccaaaggatagagaagtcacatcagtgccttcgtgtgacattgatgtgatatctcagaagcctgtcttcactcttttccagactcagctgctgttctcttggtaagcagaggggagcctgcaagcagtgtaggcaagtgccctgctgaggtgatttgccacagcagaagatctctttgcatagtttagtgctggaaataaaggatttaaggcagcaaaacatggcgttaggtcaatttaaataatgcgtggcaatgacagaaacagtgagcagccgatcatttgggggaaattgataaatatatagtatgcacgtattagtctgcaatagtcattactgtttctcactgtctggattgaagatcgttgattctgctctacctggcagacccttcccacttccttcccaaagtctactattcttaggataattggaagactacccaaagcaaaaagatcaatggaaggacagtgatacaaatgaacattaggaactaaggactttataaaaatgctcaaaatgaacaactcaaggggaaaaggacaccgaaaaatagtcttcagaattgtccacagtaatgatttcatggaaattacaaggagggttgcatgataacatgtatagaagattgtatatggattttatcagacttagtgcagacaaatgaattgccttttaagtaaactttacatagaaggaatgtcgatttttaaggaatgttccctacctacttctccacagacacgtctccatagagacataaaaaaaatggccctttattttaatgagttagcattttagaatttgcagacagaaagagtgtctcgaataaaaattgagtatctgaaaatcattatgggttgtgtgtcagctgaaaatttatttcactttcctgtgggactaccctcccctttgtcacttaaatggttttagaacagggtaacctcaagttacctaaagtaatttatatttcaaagactatttcatgtccttacaaatgatacggaaatataaaatataaaaacaaatgagaattgacatctattcttcaaatttaactgcaaaatatgatagtcataagttacatgtgtaataatgtgataatattcatataaaataatagtaataacagtggatattataataaacatgaagtgtgtcaaaccaaaagggacttatccatttgctgtttgcacgaatctaaaaatcttgtcctcaattattcaaaaacagcaaccgatcataatgcttcttctaactataatgcaataaaagtttccatctataaaataggtatctacttcaaaaattgaaattaaatgtatcaacaattcctatgttctgtgtgtccagacacttttgattggcatattttgttgaaggagacagatggcaagacagtctgaggaagtgcagctcagctttacggagaacattttcaccttgttctagggagttttggatacagagttcacaccttagcagggaaactttcacaaccataatcaaaagtcatagaaaatattactttaaaaagtgtgcagctgtgctctaacagaactttatttacagaaataggtgatcgtccagatttcaggccatcctgaaccttcatatcattatgcacttaataatgaatctgcctggaggagggactgttaaactgttttagaaaacgtgagataatgctcagacattctctttaaaaggaatatcaaaactgggtgcccgcaagcaggtgtctgagtgagggacagctacctcgaagctggctctcaaagagcacaaacttgaaagctatctcaaatcgctattttggcatctgctgttattgatgctaaatgaataattcttttcttcacgtgattgaaacctgaacagaacacaagttctgaaaacacaaggtctttgtctacaaggaaagctatgaggaaccatatagagtcttagggtctataaggagagctatgctgcgtttggaaaatatgatctaaaacaattaattatatatttactgcatattcagtatatgctcaatgcagatgttgacaattttttttttttttctaaagagacagtatagattttgggctttggagtatcaagtctcttgcaactcctcactctgctgttgtaatgtgaaagcagccatagaaaatattactttaaaaagtgtgcagctgtgctctaataaaactttatttacagaaataggtgattgttcagatttggcccagggatcatttcttgcagacccatgtgctgagatttgagggttttcagaagctagttctgactgatctatttagaagtggtaatagaaagaagtgggagcatctgagaaaacaggttggttaagaattagtttgaaacacaagctccagcaagaactgaggatgactttggcagagttcagtgttgatggtgaaatggaaatggagaatatctgatggacgtaagagctatttaattggtagagaggggcctctcagggaggcagctagctcaatgctggagagcactaagccaaggcatcatgccctacactgcccagattagcaaaacagtacagtcaggatggctaaaggtgacaccaagaaaccaaagggtaagatgtctgcttgtgctctctttgtgcagatgtgcagagaagaacataaaaagaaaaacccagaggtccctgtcaatttagcagaatttttcaagatgtgctccgacaggtgaaagacagtgtctaggaaagataagtataaatctgataaaatggcaaaggcagaaaaagtaggttcggatggggaaatgaacgattatgaccagctcagggaggcgagaagatgtcccaagaaggccaccatctgaattctttccgttctgttcagaagtccacttcaaggtcaaatctgcaaatcctggcatccgtggcaaaaagctgggtgagatgtggaataacttaagtgacaggacaaagcagactgacatcactaaggcagagaagctgaaagagaggtatgagaaggacgttgctgacagtaagtgtaaaggagagtttgatggctcaaagcaccccactaaagttgcctggaaaaaggtggaagaggaagatgaagaaaacatggaggacaaagaggaaggggaggaggaggatgaaaaaaaaactgttttatctgtctctttgtgaatactttagaggaggagagtgctgtaactgacacatctatttgagaagtgtctactgccctcactaggtttaatgacaaaatctgatcagaatcatattgtagtttttcaaagtggtctagaaattgtcagtggtttatgtcaagtggccatgggtgtctggagcatcctgaaactgtatcaaaattatatgtatttccaaacatttttaaaaataaaaaggcaatcttgtgttttcttcacactgtgcactttgctgtttgcatgataaggcatttaaaagatgtttctggcatttaaaaacatgtgtaaggtgatgtttactatttggctatgggctagaaatcctgaggtgtcaggtgtacatacatatcttttgtaaaaagaacaaaatagagacaaacttttgaggcccctggcttcgtgttgaggctgtgggagaagaggccttttggagaaactggagctcagtgcatgcactgtgaggctggacctgctgccactgcaatgggcccccatttagctttagttgtcttgtttctgtatatagtcagatagcattctgctgccattctttgctctggacaaagggggtcagctggcgtgaaaattgtttggattttttttagttaagtgctgtcattttgaaacttttttttttttttttttgagacaaggtccttctctgtcacccaggctggagtgcaggagcatgatcacagttcattgcagcctcaacctcccaggatcaagggatcattccacctcagcctcccaagcaactgggaccacagctgcacgtcactacactcagctaattaaaaaaaaaattatggaattgggggtctcactatgttgccaaggcttgtcttgaactcccaggttcaagcaatcctcctgccttagcctcccaaagtgctgggattacaggcataagctatcatacccagctgaaactttggtcttaaacaaactgcagaactgttcattgtcagcaaagggaagagccactgcatcaatcaaagttcaagaacctctgtgcttaaacataattggcaatattgtttttttgtatgtttagaatgctgaagttaataaacagtaattgtatgtttagaatgctgaagttaataaacagtaaagttaaataagcagtaatgcattttaaaaaataaatggtagactatatagaacttagtaacagattgactatatgatcctgtagatgtgtcctggatggcacctaggcttctggcatgaggaattggacagatgttgctgcatttattgagccagcaaacactggaggaagccaggttttgggcggaaggacacgaattcaatctcagacatattgcatttcagatgcatgtgagacatggttatggaacttctgagtaggcagttgaattaatatacaagtttggagctcggaagaggaatttaagctggaaatatatagaagctatttgcatttagttgaaaattttaggcataggaataggtgtgtgaggctggaaagggcataagatcaagttcgaaggaaccacaatatttaaagattacttagaaaaaaaaaaagccagagaataagaaggagcatgggaaggatgtgttaccatggagatcactgaggtggtccagatggggaatctatgtctacggttacttcaaagttagatgcgatgagcatttaacaacttgcagtacttagagaccttagtgagaacggtttcaatacagttcttttagtttgggctggatgtgtaaggagagtggacaccacattaaagtgggtcccagagtagatagaaagtgatggaatgaaatggagaaacaaaaaaactacagcaatggtaatgaagagggatcacaatgcatcccaaaggaattctggaaatttgttggtgtgtaaaggtaagtactgctggtatttagcatacaaaactcacagacactcctacacacaagaagatagtcccccacacaagaagggagttatcctgcatgctgcacagattttccatgcctcatgggacactcaggtagatgaaaaacctacttataagcatctgcacttaaatcacaactccattagacatacacaagcacacatacacacatatgctgatgtgggaaggcacatttaaattatctagatttaagttgtaactgtattttatacatacaaaatacatatatatatatatacacacacacatacatatatacatacactaatgtatattccatatactagctcttacaaaaatgcaactaccatgtaaaccaaagaaagattatcttttgttttacttgacagttaccaagaattgtttcgcatttaagaaaattatatctttgatggttccctcattaatggtgcctggatacccaatgcaacacacctacatcaaactgcatttgtaactgttggattcataatgattctacctaagatgcaagcatacggcatcattgtgccttgttgtatggatatgcttgagaagtcacatgctgaaatacatatattttaaatttgacagtatctcctacaatattttctttatattatagtaaggtattacattacagtttaaaacttatgactataagcaggtgatattatctatgaatttcatgtgaaattagcaaagggacagtctcaaatgtttgctgtataaagtgtatttgaagcctgatagggttgagaaacactcagctacagtaagtaaaaacagctctcttagtggttgccttgttgagaagatcttgaaaacaaggttgaaaatacaaaagaaactgtgtggaggtctacaaagatatttatcataggtaaatcattatgtctaaaatgttatagaaatttctattaatggtggtttgtatttttaaaatataagaaatataaaagctatagacagctgtaatttggttccaaaggctttgaaattcacttttattgctgtgtttctgagcttctcccaggtaagaaatataaacattttatccaatgtcagacacacaaattcagacagttaattctgggggccaatgaaaggccattaagggcaccaaacatgtagtggcgttttcctacagagaagttaaagatttgtatgcaagcaatagcttccagtctctgctaatctgaaatatggctatataatattctttttaagaacaattttgagtgactaacattatcaaaattgcacagacaaccagtgtacaataaatataacattctgaccaccccccttcccacaagcaggttaacttcaatgttattctatgaagctgttactatgtatgatgccaacttcaataccacccaagtcaaaaaacacttcaataaaaatatatcaaaaaacaaaagcccaaatggagttctaaaaaattttcctgaaacaaggcaaattcatcagtttttattagtgcatattatatgacatatgtatattcaatttaggtatataaatgtatagatatgtataaaaatgtatatacatatacatatatttatcagtttcattattgtatatggaacatacatatacgtaatatatgtatatgaaaatatataatgtatatacatataaaattcatgtgtcacattggtatgtaaatatttaatatgtaaaagcattaatgaaaaatatggccgggagcagtggctcactcctgtaatcccagcactttgggaaccctaggtgggtggatcacaaggtcaggagttcaagaccagcctggccaacgtgatgaaacccagtctctactaaaaatacaaaattaacaaggcatggtgatgtgtgcctgtaatcccagctactcaggaggctgaagcaggagaattgcttgaatctggaaggtggaggttacagtgagccaagattgtgtcactccacaccagcctgggtgacagagcaagactccgtctaagaagaaaaaaaaaaaaaaaaggaagaaaaatatatgtatatgtacattgagaaaatttttttttttgttttcattccaaaatatgaacaaaaagtaattaaaaaatcatcttagcatctgggatttattaggcattgaaatatttgataaatgtaagagtcaatgacaaattatattttatgaaaaagggacacagctttaaaataatctagtttaatagaatcatttaggtactggagcacagtactttatgaaattgtgctatagtatcctgaaaatgttatttaatttgcctgtatcaaagtattaaaaataaaactagctggatttttctttctaacattaacagtattattaatagcatcaccaaatttaggcccaacttgaaataaaagggacctaatgatgtcatgtttggggagtaaagactattgttcctgaaaagaatcctggggttccctcacagtgatagagcttccgaattcaacataactagatttaatacctactcagagtgactttttttcatttctctggaataaaatctccttataactttcactgcggacttctatccagcataacatagcacactaaatttaaaaacaaaaggaagcggagaagattataagaaaaagaaaaggggcagggatggtgcaagaaagaaaacaagaatacaatgaagaaaagtattgactataaccttattcttttagttcactccagacagcacatcactcttagtggactagccaccaatgctgagcataaattatatttttttatctatcagtttctggacataatcactactcattcccattttgatcattgaaaagaattagagttgcatcagtactttaacttatttcttgagcaaatccacaaactcatcaatgctcctcaagctgctaattctgctgagtagaattttctactaaagtagaaagggctcaatggccctataacattataatgtttcctggaattggatgaagactactcaccttaaatattctctctgaaagctaaaaggtatcaaagcaatatgatatatgtattcatttacgtccttctattaagtggactgttttttggattatatgtgcattttgctgtgttgagctcttaattaaagcatcatttttctcacctaacattttataatttggaaagaataaaatatatatatgctctaggtaggtacaattccctgacccttaggccagggaaaataattactgagtatatccaatttctataacaggaaaggtatacttaatctatatcacttcgaaacaaaggagtgagtggaaaggaggtggctggaagtgcagatttaaatagaggatggttgggaagactgttacatgctgccacgtcaaagagatattttaatgatttgagcttacaattttacatttaataacttctataataacatgtcattgaagtaagaagaatgctggattctcaggccctcaaaagggttttatatagtacagaaatgatattattctgcataatactggtagacaccagaaattatttgtgtctgagtggataatgcagtggttgaaaggttggagcagttgaagagatgcaaataatagctaataagcaagaaatatactatatattgttatcccacacagagtttagctctgtggtttgtgtctaggaggtacaatatatgtttatggaatgagaaaactaatgaatatttccaaaaaagtagcaaatagaaactcatagctcaagtgatttgcagtgttaattaaagaagataaacccatttattgtaacttacatgcatctgtgaatctactaaatatccttctgagagatagctttctctatctctcatccctattccttctgttatccttttcatcttttcttttctttctcccatcttctttctgtgcttctttacctataccattctccatttgctaatcattatttagaaatgaaatgtgcattaattaatttcaatctaatacaaattatattatgctcaattttaaaactgaattaatgtttgtcatatctttaaaaattacaatagtgaatttgtgatttttaaataaattataagaaatactgtcttcaccttcaatccaaggaatgacaaaacagcttttgctaacaaaactaaaatgagctattagtaatgaaaatatgacgtggtagctataacttggcctctcttgttggatagccatgattctacaacacacctgctatttattggaaatgaatactgagagataggagtcccagaagataagagattgagctaacctattacttcagacatttttttcaggtaaagactttaagcatatattgaatgaggttggcaatgtctagatataaaacagaaatatctgtaaattatgttactttgaaatactttactattaatatagaaaacaatcataaaatatagtaatttagtgcataatgtaatttacaacttcctatatcatgtgggaaatataagtcctcgtgtgcagctcctggatacaccgctgttgaattcattttactctcttccactctaattagttcccaggatgcagacaacatttgaatgcatgctttcaaatctccgggagttcttggcttttgataaattggggaattgatccagtactatctcactttaatatgtgtcctatattaagagtgtgacagcaaaacttattttttcacaattcaagcaaaaattttcccgttttatgttttacaataacataatatgtaaagataagttgataaacatgtacatactcagaaaaattactttatgtagagaaaaagaacttaacttggattctagaatattatttttgttttcagaacacatgattaaaaatctttaaccttatgcctttttaccaatggccaataactatggtgacagtcaatagtctcatgtcctatctgtagatgctatcacactgccaggctctcccaggtgcaggctatgaagagtttatcataaaatctaaaaacagcaaaactcacaatagttaaatgggactccattttgctgcttcagtaaacagttgtattaattatcctacaaatgtgcacagtggactattaccaattgagaggacacaagctggcagacttaaacaggtaaagagacatatagaaaagcaacaacaagctcatcacattttcccactctggatctagggcaaaagatctagttagagtgcataactgattaaaggattataatataacagagcatgaaatggggttgtataggactcctaaattttgcagtttctgaatgctgtgtagattaactcatgtctaaatgggttatggggttgattgatagatgtcaacccagcaaacagagccagctatccaataaattaattttattctcacaaccaccctataaggttttttttccattataattcacatcttatagaggaagagaccccccaaggtcacacaactagataattagctagtgaactggaagagtctggatttgaatcaagattttgacctaactacttaagatcttgaaaacagaatccacagcttaatcatctgtgtgttcctatagtatttacagattagtagcttttagtcagttgtatacaattgtactaagacataatgtcaaaactcccacttcatcattactacccaaatgtacatattagaatttctaggtccaaaagttgacaaaaccattagtaggaggggtgggccatgttcattaagccatagtgttttctagttcgctgttgagcaagttttagccctgcagttttcaccaccagtactcactcagcattctggtttttatttatttatgtatttatttttatgatctatgcaggcaactgtgcatagtattgtgttttataacggtttgtttgaatttacttacagttaaaataaagtttaaattaaaaataatagaatagtcatagttccatccttcccaccatttacatcatgaggataataccataattcacattatactctatttgatgcattagatgaagcctgcttagtgggcaatctaatgctgacgaccatatcactgctacatgtcatgcttcttagagatctcctgcttcgctgacatgcaggactggatgaccctgtccttgccagtcttccacatcacttaagccctctcttatcttgcctttgtgcagtctctgtcttacagcctcatctttgcattctaaacctgataggacatttttgacatcaataaccaaccctcaagggagctctttctttaggctgattcacaatccatttctacagacaggaaggcctttatttagtttccaaaatattctgctttttcaaatatttctgactgtcttggattttcaaagaaatttcggattcctgtcctttccgtaagatgctgtagggaaaaaaatggaaaagcatgggtcctaacttgggtatgacacttaatctttactggtttcacttatttaaaaaaacacacacttaatttttagagcagttttaggtcacagccaaactgagagaaaggtatgaagattttccatatgcatcctgctccaaaacacacatatccgccccccccggcccccgcattatcgacattccccattggagtggtgcgtttgctacaatctatgaaactgcactgacaaattataatcagccaaagtctatcccttacattagggttcactcttggtgctgcacattccatgggtttgggaaaatgtataatgacatatatccactattatactatcacacagaatattttcactgaagtgaaaaatcctctgtgctccaccaatttatttctccctcctcataacccctggcaaccatggatctttttcctgtctctatcattgtgctctttccagaatgtcatatagtgaaatcatacagtatgtagccttttcagattggcttatttcaattagtaagagacttctaacattcttccatgtctttttgtggcttgataactcacttccttttagtgctgaataataccccattgtttgggtgtgccagttatttatctatgctcatactaaagtgcatgttggttgcttccatgttttgggaattatgaataaagctgctataaacatctgtgtgcattttttatgtgtacacatatgttttcaattcctttgcatagaggccaagggacatgattgctggattgattgtgtggcaagattatgtctagttttgaaagaaactgccaagttgtctttcaaattgctgtaaaattttacatcccaaccagcaatgactgagggttcctgttgctccccagcgtttgacattaacagtgtcctagattttgaccactctaataggtgtgtagtggtagcaaactgctgtttgaatgagcctcactggttcatctctaacaggaaaggactagcctaaatatttaagtttatcttgtatgtataaagttggaaggtctctaacaagtaattttgtaaagcttaaattacacagtgaaagatgaacaagtaaattttattatttaattccctaaattgaaggatgatgtgaaaaagactcccagaaactgtcatatctgatttcaaaagatttatcactgaacagttagaagacttctgctaagcacttcaaattatatctaagttcattcatctattaaaaaagagatgaaaagatgtcattcttccccattagagtcattcacaggaagctatgtgatagcattctaaattatttaaagatattacaggattggaaattttgttactcgaatcatcagttaattgataaattttagactttagagaatttttggtgcagatgttctgaggaccatagactcccaagttgtgaatgaatagggtacagaggaaatgcaaactaaggtggtaaataatacatcttcatgttctctaatatcatattaaacctcagcatttctttcaactatagacataagcagcaaatgacagtgatattgtcaaaacctaacattttgttatccataaactttatagatcttttatatttagttgttgcagagatctcaaaatatttatgatcatcaccacttagattggccactagattttatttaatgtgttaatttcaaaaagcacatatatcactatttttttatatttttaaaactatatatatatatatatatatatatatatatatatatatatatttttttttttttttttttttttttttttacggagttttgctgttgtcaccaaggttggagtgcaatggcgctatctcagcccactgcaacctctgcctcccagcctggttcaagcaattctcctgcctcagcctcctgagtagctgggattacaggcacatgccaccacacccagctactttttgcatttttggtagagatggggtttcaccatgttggccagggtggtctcgaactcctgacctcaggtgatccacctgcctcagcctcccaaagtgctgggattagaggcgtgagccaccatgcccagctaaaactctctttcaatataattgctttccttagcaatcctatacttttgtgcatttcaaaatgctttctttaaatgttgaagtcaaagacttaagcagactgccaaagaggtgaagttcatggcaaaaccattccttgtgtacaggtggtgagagttggtgacatccttatggtagcacatggaggtacccaaagaacccttacctgcatccagatctcctgaattttaaacgagtgtcctttccaccaggccatgccttctctccaactcactgctatggtctgagtgtgtcctccaaagttcccatgttgaaacttaatgaccaatgtgatagttttaaaaggtgggggctttaggaggaggttactgaggactgagccctcatggatagaaatggggctctagtaaaagggcttgagcgggtgggttggctctccccactcttctgccatgtgagaacacagcgtttgtctgtttggcacttttgacccactctaccattagatgatgcagcaagaagccttcaccagacaccaaatgccagtggcttgatcttgaacttcccagcccctagaatggcaaaaagtaaatttccgttcttcatctattatccagtctcaggtattttgttatagtagcacaaacagatgcagacagtcaccatttacaatgcccttgctatttgaacctcaaacagtgtatgagcaggaataaatagtatttcaaattggcccagtacaaagtgttccagaaacagatgtatttaaaattaaaataaaggcatcaggtatttgaattgcattacctctaatggaagttaatgtaggtaaactccttcttcagaacactctgttcgcagagatacttgttcctaaaaccataataacagcatacctttgacaggggattcgaggaaccaaaacaatcatcaggcttaatgtaaatgaccactgaaagtggtagaaagcagcaacaaacattttaaagggcaaaggacctagtattgacataactaaagaattcattcattaaacagtttatttccatgttgtaagctgttggatgaagttatggatgtttccacttatttagaggggaaatcaagttattcttacaggctcagcaagtagacagacaactaaatatttgctacaaaaagcatggtttccagaacagaagcatctgcatcacctgagagttggttagaaatgcagaatctcagttcccatcccacaactactgaatcagaatcccattttaactagatccccaggtgattcacgtgcacattcaggtttaagaaaccttgtccaaagaacactggagctgaaaaaaaatgttggcatgggggtgaaagactgtaggaagaaagagaatgtaactgaaaaacatgtgaaataaaattatgcaaaagcagttatgtgaccttaaaaatgtatcttcacaatatttaacagctttctaattttacgccataaaatttaccttttaagggtaaaattcaatgagttttaataaagttagacaatcatgcaatcataaccacaattcagttttagaacactttcatcattcttaaaaattcccttttgcctctttgtagccaatcctcactttcatccctacccccaagtgactgctgacatggtttctgagtctgtaattgtgtcttttgtggaaacttcatataaatggaatcatataatatttagtgtttcatgcttggcttctttcacccagcataatgtttttgaggtaaacctacagggatcagtgagtaagcattttattctacagatatgccacattttatttatccattcatcaagtgatggctatttgggttgtttccagtgttgggcttactatgaataatagagccataaacattttcatataagtctttctatttccacgatagttttgaaaagtattaattggcagtcagatttacaagtaacctgtaaataaaataaaaccaaacaataacaataaaagactcaaagagacttattagtacccctgatggtcattctggcaacatgtgtaccaacaaggtgggtatctatgcatgcgcagagggagcctcatgctatcaagtggaagaaagaatgttgttctgcaattccacaagagggttagaggaagaatgacgttcctactagaactggatactgatatctgagctggtggaaagaaagaaaagatgggagtctacagtaagcatccatgtttttggtaaattaccataactggactggtgtgggaggagtgaagtggagggtggagtgagtgattaagcctgggaaacaaatgacaggcagaggaggaaaggcatgaaagaggtaatgttaagatgaaaggcttactcagagtggtcaagtattgggtctttaaagaatgcttatcacctgggcaatatggcacctccaaagggctaatcacagagaccctccaacaggtcactgatgcctgcctggaattctttcatgaagctgcagctaccaggtacttcaggctgccctaaaccttatattttaagaagcactgaaaacaagagaagggagaagggcggattggagttactttggcaaaaggcaatataaatgaagctaagtgagggcttcatcgtatcttatcacagtcaccagcactagtggtgactcccttcaatgacttaaaagggatctcctccttagctcacccaaggtgctaactagttgcagctggaagaggatggtgtagcccattgagataatacccccccaccccatgtagatttctcctaagcactttatcaagaagaaactcggtggttctgagtgcctgattaggcaaaagtcaagaatgatatgaggaagaaactgaggagtgtagtgctgacaggtgggtgatgggtataagcaagagaaggaataagccctcttagctagagacaaggggaatttcatctgaattaacagtcaaattaaaactttgatcatttttggcatcattgtgaaggctattaaaaagttggcttggccgggcgcggtggctcacgcctgtatcctagcactttgggaggccgagacgggcggatcacgaggtcaggagatcgagaccatcttggctaacacggtgaaaccccgtttctactaaaaatacaaaaaattagccgggcgtgttggcgggcgcctgtagtcccagctacttgggaggctgaggcagcagaatggcatgaacctgggaggcggagcttgcagtgagccgagatcgcgccactgcactccaacctggggaacagagagagactccgtctcaaaaaaaaaaaaaaaatttggcttacccgaaatctaaagggagatatcagggttaaatgtattatttaatgtttatctctctgacttttggaacttcttgctctccctcccccgccaacatggtgaaagagaaggattaaaaattcacctaaaagtgaaattatacaattggctaacaaataagaaaatagcaacttattccctgaaatataattacctgggtcactgttttgatctgtgatttaataaaacaaaattatatgaaaagccctacagctacagagatctgaaaaaattatacatcttaagcagtaatttacttggactggatacaaaaagttcagctcatcttatcatgacttttgcatattttaataaaaaatatgctattctaaatctttattaaagctcttatgccctcatgcataagtttaattctatcatataggtatctgattataaaattctaggttaactgaaggagatatctaaaatattattcataatatttatttttatcagaaaataaaaccatatgaaagtaaattttaaaataattatcactttatttctacagcagaaggattatcactgttaccagtgggaaattttctctattgtaatgttaagcatacttgttactttgctaagcccaagtttaaaaaattcaattttgattaattttttattcatttcaggcaggttttgaaagctaagtaaaataattttttcttctttcaaaagaaacttttcaggccacacctcacctgcctcttcctctcctctttaaataattttgtgaaaggactaacagagcacacttgttggattgttctgagaacttaagtaatttccaaaaaggtacataagtgaatctactgttatcatctcccaggatcacagggcctggtttctcagtgagcatcagaatactagcaaagctcaggctacatcttctttattttatataatcattgcttaagaaatgattccctctttttcctttttttttctctttaatacaaacatgtgaagtttgtcttacaattaattaacaaagaatctttaaatacctgaaacagcataaaataaaaccctggataaaccttaaatacaaaatttgctctaaaatgtaaacactgattacttttttgagacttatcttcaaatttaaaaaaaggtggcagattattcagaaaagcaaagcacagtcaaattgcattttttcctttctgtccaatatacctgcaggtacacaatttcatcatctctaatgctattacttggttttgcaatatagtctttgaaaaggtacttcaactaatcttttatttttcactttaattcactttttccctttaactggtgaaaagttggagaaataaagaggttacattcagcctctggtgttctgggtgaaggcgctctgctaagtgacactgcctttcttctccggacctcaacagcactcagggtgccactaggatctggctgctgcatgagtttatacaaaacagagaaaatgaatgaaattttcctagcattagtaacagtctgagaaacatttctacccttttgtctcatagaggattgtcaagtatggttctgatgatgaaaacaagagaaaaatagagattgtaaaaatattagttaccacgtacgattgtgtacaacagaagcaatctaaacaaattgtatgccatctcatttttcttcactctctcagttattcagtcagtcaagatgcatctaagtgcttactatacatctgaaactgtatgcaagactcttggaaggtcaaggtgactaagacacaaaccatgacttggagatgttctaacagagggagaaatacctgcagacacgtgaaaccttcagaagctcagtgaagcttgaatccactaagaatattctgtgtcatactgtcaggagtgaaagattcatttttgcttctcttgttattttcttgaaacttctttaggtgggaatatttctagaccaaactcaaactcagaaattctgataaagaaatcattatcaaccatactatacattttgctatcagttttggcccttccaaaggacttgagcttggatgctgccaaaacaggtcctccctgtgccatgtaggatattttgggtagcatcctccctcctagcttctgctaattctccagctttcttataattgtgaaagaccattgaaaaataggtatatatgtgctatagtcaactgaagccagactgaaaccaatggggattacctgcacaaccataacataaattagaaattcttgtggttttggggggtaatacaactatatgctttagcatttggatggttcggagaactctattaatagatattaataggtatcttaagcagaattacaacctgccagtaatgtttcccaataaattatctttctaatgataccaaaatggtttataagctttcagagagtaacacaacttaactaacttaagataaacaaaggtctatttcaccaaaggaagcagaacgtgaacctttaaaatggcaataatccctatgcagagctaagcccacctaaaatgattttagtaataggatttccagttttcctatttttcccaacattcgttcatctatgcattactcatccattactcctggtcaaaaattacccctttcattatttcttctgttcccttattgtgaagcttaccccccaggttacaatctgggtcctcttgagcagttacaaatttaaaaaggcaaaactgacagcagccacttattgagcatttactgtatacccagtgctttgtacccagtcaatcattgtaacaagcttacaaggtagggattgtttatcccaaatttacagtagagtaaactaaagctcagggagcttagagaagtcactaatacctcagaacacttaaattaactgaggtcttaaaaattaatttgtgacaaattaaatcatctaaagaagggcagcaagaaaagaagggaaaggagagaaaaacagccaagattattttcttcataagacagttatttctcttatgaaaaataaaatatactcaactgaaagtcccagaatgtggcatgaattaatccagagatcctgtgataacccggttagcagtggggaatcttgccccaaaattgggttcacagactcaatgtgaataggagagaaatgggcactttagtaaggggatagctatcttccattatattctacctatcagtgatgtaaaagtaaacttaaattacaagtaaataaaaatgaattatatggcgtaattttgtacttaaaatttgaggatgtgaaattgaatctttcaagttacttcaaaataactgcatcagcaatcgtcagcttagttttatttccagcatcagacaagaaggtatctcctattttctagcaatgatactcattcattcccaaagttattataatatggatttttagaatagttttgaagatacatgataaatcaaatacatgtcttatgataagagagaaaacatgtcctggtgtcttctgtcttgggactttaaatcctcacttttgcacagccatgcacttctccctctgatgttgagggcatccctgatggatgcgacggaaagatatttcagagaacaggctgtgtaattagaaaaaaggatggtacatgagcctcaacattatactcatcatttttctcatctaagatccacaagcttttggaaaatcagctttcctagctatttcttggctgacagcaggtaaaaagatttaagatgagaattaattacaccgatataaagttatcaagggacaagcctatgggacttgctcattggccccaaaggatataaaatgtcagagaaacagtggcagcaatatatcaatgaaccaaatgtttctgatgtttgacaaaacatattatggcaataaatgatgctgtgttctgtaatgagattgtataaagaaaaaaaaacagtttttcagcagatatgctacttaaagcaagatttctttatgcatatcaccaatagtgaacagattagtcctatataattttaataattttgcaattaagaatcatggaaaacagattaaaataaaataaacgttggctgataacaaaattaaaattgtgaaatcagactaaaatgaacatatccaagatgaagactagcctttacattcaggttgtgtttctgggttgaacgtgtgcagcaaagtcataattaacatttaagaaggaaagttaatttgaattaaagcaatatcatgtttctcatataaaagcttatcaaaatacaattacatatatattcatttatgtagatagtatctatggctatgcaaggggaattgtgaaaagctactttgaaagtgctttcttaggctatgattatacccccttttttctgctttagtgaagtataacttacacatattaaactgcccaagtattaagcttatagctacagctacagtacacacacacaccacacaccacacacacacacacacacacacacacaacacacacacacacaccacacacacagataccagatcaataaatagaacatttttagcactggagatacacttgtgcttctttttagtccagtctcccccgagaggtaactactattctgacttctatcatagaagattagattttgctttttttttttttgagacagagtctcgctgtcgcccaggctggagtgcagtggcatgatctcggctcactgcaggctccgccccccgggattcacgccattctcctgcctcagcctcccaagtagctgggagtacaggcgcccgctaccacgccgggctaattttttgtatttttagtagagacagggtttcaccgtgtcagccaggatgttctcgatctcctgacctcgtgatccacccgcctcggcctcccaaagtgctgggattacaggcgtgagccactgcgcccggcccaaattttgctctttttaaaaatttcacacatattgatcgtgcagcatttattcttttgtgtctggtttctttttctcctttttatgtctgtgagatccatctgagttcttgtgtgtatcaatagtgtgttactttcactgctgtgtagtattctgtgttatgaatatgttgtaatttatttatccattctactactgatggaaatttcatttgttccggtttgggggccattattcataatgctgttattaagattatttgtacatgaacttttagtagaaacatttgtctctcttgactatatacccaggagtggacatgctatgtttgaatgtgtaaatatgtttaacgttagtagattttgccaaaatgttttcccaaatggttatagcaactgacatgccaatagccgtatatgagagttctttctgttctacaacactaccagcattcagtattctcagccatgttaattttagcaattctggtgggagtctaatggtatcagtttgtggtattttaatgagtaatgatgctgagcaccttttcataaatttcttggctatctgtgtatcttcttttgtgaagtgctgtttcaatttatttgcccatttttaagtaatttgtcagtcttgtttcttgtttcataagaatactttaaatattctgggcatgagttctttgtcagatataagaactgcagatatcatcttttcactctcataatgctgtcttgtaaggaacagttctgaattttaagaaagttcagttgatcacttatttttttaagtgaatagtgcttttaacatactgtaggaaaactgtgtctactctctgatcattgagatagtcatttgtgttgtcttttagaaaccttttctttgccttactttttgcatttaagttcctacttcaaatctgtatgtacatataataggtggtagggattatggctcccactcccttctttctgaaatagatatgctattgattaagcacctttttatggaaaaggccattccacacccactgaattgcagtggagactttaccataattcaggaaaatatactagtctattccaatattaaattttcctatacttgtaccaaaagcacaaactgtcttattgtgacattggctcttagtaaatcttgagatctgttagtgtgagtacttcaaattgtttcttcaataacattgacatttccatataaattttaaaatcagcttgtaaatttctaccaaaaaaaaaaaaaacctgctgggattctgacatggatcctaataaatctttagattaatttgaagagatataacatcttaacagtattgagtcttccaattcatgactatggcatgtttgtacatatttatggagtacatatgatattttgatatgagcatgcattgtgtaacgatcaaatcagggccaattggaatattcatgacctcaaacattcatcatttctttgtgttgggaacatttcaaatccactcttctagttattttaaagtatacaataaattattttaagtatagtcaccatattgtgatactgaaaactaggtctaaatcccactacttaactacatttttgtatctattaactaatctctcttcatccttctgtccacaactatctttcccagccactggtaaccatcattctactttccacccacattagatttttttttaagctcccacacatgtgtgacaacatatgatatttgggtttctgtgcaggattatttcacttagtataatgtagcatatgccaaaatttcattcctttttatggctagatgatattccattgtatgaatatgctaattttgtgtatacattcatcctttcatggatatttgtgttgtttttaccttttggctattatgagtaaagctgctataaacgtttgaatacaagtatttgtgtggatttatgtttgcatttctttgggtaaaagtctaggagttgaattgctgggtcatatggcaattctatgtttaattgaggaattgacattgttttcaaaggagctgttcttcgtgctattattctactctctctctctctgtatatgtatatacatacaaaaaatagtatattttatatatattataaatacatgttttgtatatataatatatattttgtatatattcatatatacacatatatctttatatatttgtttgttttgagatggagttttgctcttgttgcccaggctggagtgcaatggcgcgatctcggctcaccacaaccaccgcctcccaggttcaagcgattctcctgcctcagcctccccagtagctgggattacaggcatgcaccactatgcccagctaactttgtatttttagtagagacggggtttctccatgttggtcaggctggtctcgaactcccgacctgaggtgatccacctgcctcggcctcccaaactgctgggattacaggcgtgagccactgcacccagcctatcattatatatttataaagatatcttatacaagatatactatgtatagtatctataaagatacatattatatgtacatatatcttttatatatataaaatagtatctatatttagtataaataattttcagaaatatattaaaaatcctatatggcattgttactgttatttttcttaataatcaattataatatttatgcacacatttaaaatatctggtattctacataattctatgttctgttatatgcttacatttgatgatgaatttattttattttgaacaatttcctaatagtataccttgtagtgagttgctagtgaagaattcactcagatattatttgtccaaagtacttaaaattaaattgtgagggatgcttttgcttgttatagaattatagactgacttcttttttttaacactttaatgattactttctttttttcttcaggattcatactttctactagaaggtcagcttaaattttattgttcattccttgcaattttttggttgcctttagacattgttatttgcttggttttcaaccgtttgaatatgatgggcttatatttactttgtgtgtgtgcgcgcgtgcacgcttaccattcttggggttctctgtgcttgttaatcacacttcttctgtaagttttttcaccagcttgctcagccatagactctgcattgattacttcttcgttttctctcctttcttgagatgatgtctctatttttgtttgattttttaaattactatgccattttcatctaaggtaaataaatatttggtattaaaactaaaatgaagaattgagatatgatttttgattaaaaaatatttggtcttagtccaggcttcctggcacacagctcctaaaacccttgaaatctacaaaataatgtctttttatgtgcatttgagatgactgatggctgaaacctcctgaatagtcttaggatgggagctggttgccagaggaaccgaccacgtgatttgaggattccagctttcggcctcattcctaacctccaactgaggagaggggctgaaggttaagttgatcaccaatgattttaatcaatcatgcctactaaatgaagcctccatgaaaacttaaaaggacaaggtttggagagcttccgggttgctaaatacatccccttgccaggagggtagctgccccagctccacagggacagaagctcctgcacttggatgccttctgaacctcaccttatgtatctcttcatttggctttcatttgtatcctttcatatgtcctttgtaataaatcggccattggtagtaaagcatttccctgagttctgtaaaccactctagcaactgatggaacctgaggaagaggtgggaagccacaatttacagctggtcggtcagcagttccagaggccaggacttccaattagcatctaaagtgggagggagtcttgtgggactgaacccttaacctgtgagatctgacactaactccaggcagatagtgtctgaattgaattgaatcataggactcccgtttgtatccaatggagagttgaagtgtgtgaagaaaatcacatctggcatcagaagtaaagattcttgagagtatactaagagaagaaatggtttgtttcttcctattactcatggatttcaacacaatcctgagtctgtaacttttactaaagtgctattcttgaaataggagggctataagaaaataccattaattttatctctacattttcaatctttgccgattattaagaaatctagaatagactgtgatacctcctatcttaccagatagtatggtataatactcatcactatagttagcgttacagaaaagtccactcagatataaagcatgcatactgaatcagattttgaggtgtaaatatcattagaatgcattatgtatcaaataaaaaataaaatctaaataaatatttatccattatttacaaaacctaaagtagatggggcaggggctattaaaatacattgagattcaagtgtctcaagctatttgtaaggtggtcatgcacttaacttgagacagttccacccaagacataaataacattagaagtatcccatgaggattgtaagggggttgaatttgatatttcctgatataaagtttttgaaaataagaatcaaatcacatatatccctaaaagataatacaaggagtcctctaacattggtttataagaccatgtcaatctgttatgcaatgtttttatcatatatttgtaagacacatcctgtttaccaaattataattcagtttatatacaaatgcatatctgtgtaacttttatctatcattttaagcctctattgcctttggaagggaagtagaatagaaatgatgcatttcaaaaacgagaattttctttctcaccgttaaaacatgcagccataaatatattcatcttttagtcttttttctaccattctctcaatgtttccatatttaaataccatttcactaacctccccccgtccccgatacacagaaacacctagcaataaagctttatcctgaggcacattctacagaaatttatgagtctgaggataatttgattcacttgtctcaacctatcactaaatacccacattgacattaatcaaattttgagtagaccgatcagacacaaataaccaatgaaatagctatcccagttaaatctcaaattgtattggtcaattaatattgacttcagagaattcatcacctcaaacttcccatatcccaaagctctcaatttgcttttcgtaaaaatgtagtatgtggaatggaaagtacacagcaccatcttagatttgtttctaattaaaataaatagaaatgtcttatattcttatatagtaaaatctattaattagtagttgtacctaaaatggtgtacataatttgatgccagataaatgagctggataattgatatcactaaaaattttaaattactctaaatttagcttacatttaaaaattaagtatggaatttttatttaacagacgtctgcaaatatttttacaatatgtataattctaatgtattgagaattgaattgagcaatgcagagtagtgctcactgtggcttttctgacatgtaggacttcaaaatatttagcttatgaaataaccaattgcctcggtagtcacagcaataactactagataaagacactataggtacagaggtaacataatcttgtgaacatttattaaaacagtaaatcttactttgtaggaaataaaaggatacacttttatggtaatttacattcttaagaacatgacagcttccagctagaagagaaagaaatttctatttttgttaatacataatataatcatacatagaaatttcatttttaaatgcaaacttttagagagttaatgtttagacagtagatgtcataattttaaaatggattttgtatagcactagaaaataacctttacatttaaaatgcagatagcttggtgtaaataaccttctttatatttacaatgcacatagcttggtgttattgacaaaatagttaccagaggtagtatattgccaaatattaacttgttaagtagtgtaaggataataaaatgttatatcaacctccaactgttccagttgtttggtattccaaaataaatgtgagtttttatatttgtattttaaagtatagtgtatcatccttatttaaaaccatctaagatttattttttatacatttctttataaatgctttttatacttatttacttcaagaaagagtaaggctattcataagatatatataaaatacctgtgaaagtatgtgctaaaattcattacttcaattatttttgtggtttattataaagaaatatttgacaatgaaaacaacattttttaacctaggctttttttataacccagattgtctatgagattcagactattcatggaaaccacaattatgaaacattacattaataattactgctaacttaagtaaaaccaaagcacagagtttcactttagtttcattaattgaatcatgccaacatagatctttattaccataagacatcttcaagtactcagagtcattaacctaaatcattagaggtgaatttaagcaaatcgtcttcaaatcaaatgtggctaatttctaaaaaaaaaaaaaaagaaagaaaaaagtgtggtatactggtatgctcactttaggcatgtcaggatataaatttcaaaatcatgtctgaattattatgaaatctactactttaatctcccaagtcattcaaataaataatttatacattacaaataaaacacacatatatatcttaaatatgcatacacacacacatatatcacatacagatattgttctgactcttttaaaaagaacaacagccacgaatagatgatttgcagttcttgtaatgcaatagttgaactacctattacaagtcaatctgcagacgccaatatgtccaaaatgccaataagttttgtctacatgactaagtcaagcaaagtgcaggaaaatcatttctgtaagactgctcatcgagaattgaatatgcacactggatcctgcctccaagtcacttaaaatgaacatactcgtccctggtaactgtttctatgaccaaatgataatcattaattgtcaaacaattgatagaactatttcaaatactttaaaaataaaagacttttttttttttttgcaagatgagagaaagcatgtcttgtactgtttgagtttacctgataatcagtgttatcatgatgaagtttccaaattgaagactgaaaaggcatcctgtattcttcgcattcatacagcactgagttccacatatgcacacggctagcactgatgtttagattaaatcagtaataaccatgatctcccaaatggatgagtttaatccacaggttaattcaattccatacatgctctaattttattccgattatccatgctgggttgagataaaaatatctcttgctttaaaaaagaagggacatgtatttttaaaagtctactgatgtgctgtggttgcatttatttttatatatgtactcaggaatggaaggcaaagagaactagttccaccgtagttccctcacacctttcctgtcttctcactagaaactcattaccaatatcatactaggtgttagagactgctgatagcaaacaaagtaaaggtcagggaaattcatttgtggtttctgcccctcggggtctgtaactgctgtgtttctggtgtttccaaattcaagtttttgctatttatccctgggctgggagatagatctaattgcaggtaagcactgacatccaggaataaagaaaaagcaaagtcaaggaataatattattctcatccaaaagtctttacagaaagcatacataaagttgggaaagaaaccagctagctcacagctattctggttattagacatccctgtggaagaagcacctttaaagatgcagatgtcaaagagcagggtaatattagctttgaatctgtgtgaaatcagttctgtgcagtatcataatgtgttattacaggtttctcctgagtttaatttacaaagaagaagcaaccataataagagaataaaaattgtataaatcacaaacattgaaagcctgaaaacaggagttttaatagtggttaaaaagtagtgaattatactgcttttgtaccacctaagaatacactagccagtcagcattgccaatcagtctttaaagtgttcactcttcagctattccggaggtattgagaacaaataagaatttaccctatttaaaacccatttccagcatcgtcatcataaaaaaaaaatgtggttcattaggaaaactgatgacccagggctaaagtaaataccaggatctgccagagttggaagaatttcagaaataactgccttggttgaatgaccccatcagggactcacagtagactcttgattcactaggggttaagatttcaaaactctattagcattccagtaattttcacagtgaggcaaacttttcagcccactattctgtttagtcctcatagcaaatatatgaggtgggctcttcacctccatttttcaggttctgaaaatgaggctcacaatttttaagtgatgtttctgggtattatgacttagaatcataggcttcaaaacctttgtccttttcattgtggcacaggcactgggtgagaatagggatggccattattcccaccacttactccctgggagaccttaggcaggcgactgaatctcctgaagtattagttatcttgcatgtaaaatgtatgtaacaggaaccatccctgcctactgaatagagttgcagtgctttaaatgaaacagtggctgcagcagaaacctgggaaagcatacttgtagctctagagaagtctagtagcaaccatttgatttttttctccacgtcatcatcatcatcttggaagaggctcttacagttatcctgggcctgggagaggaggcagtgataatagagaaattgttgtgatgaaggatagaaagaaggaaaagcacagagtttatgtcagcagcaccagatgttctatcatttgccaagtgccctgggaagtacaggtccctggcaggctggaattttacagctgcagcaaatgtttccagtatgagacaagaaggactaaattcaggaaataaatttagttaccggttgtacatgggctgagatgcaaattaacgtgaggttgagaacattacctcaagaggcgaatttcgtgtatttgaactctgcttctaccaccttctagccctttgatcctaagtaagtcactttctctctctgtgactcattttcctaatttttaggaaatttctaaattttcaaatttttcctatattaactcctgttagcattgtaacataagcttaggggcctaaagcaacacaatttcatcttacagttttgcagatgagaagtctatcaagggtctcactggctaaaatcaaggtgttggcagacttatgttccattttggtggctctagggagagaatctaccttttcacctttccagctctagaggctgcctgcattccttggcttgtggctcctctcttcatctctaaagccagaaatggcagccaaataccatttcatcactccgatcctcttctgcttctctcttctacttttaagtaatcttgtgattatatctggtccacctgcataattcaggctaatctcatctcaaggtcgttaatttaattacatatgctgtatctcttttgccatgtaaggtaacagtaatagggtacattttgcctttccaatgtgaacattttggtgggagacattattttgcctaccctaccatcccatatgattttttgagaatgaaatgaaacatgtcaggcacttagaaaagtaccagacgtctaataagtattacatatgttagttactatttatttatttatttatttatttatttatttatttatttacgttggccaggctggtcttgcactcctggcctcaaacaatcctcccaccttggcctcccaaagtgctgaaattataggcatgagccaccatacccaacctgttagttactattgaattttcatcagagagttataggatattccattcaatttcatcttctatcatacgcttcatgaatatttcctgttgtggaaaacccaggcactagcagtaactctggattcaaaaacactgcaacatacattcaggaagattctgtagctctgagaccgaattgcaatcctagaccattggaaagtgaatttccccaggagagacaaaatggctttgttgtctcaagaattttctaaatttgagaattcattattcactcatttagtaagcatttacttttctactgtaccagactctgcatagatctttgcctcaattcacctgtcaatgagctagaaagttgatagatcaattcctggcttaaaataagaccaattatcaatgcattctgctgtcaagctcaaataggcacaactgttctgtgctagagtaaaatctaaggttgcagagaaacagagagcatgtcagtgctgatggagaaggattggtagaaataagctgccaatattgggcgtgatagtgtgtgattgggatttaaagtagaatgaataatggccaccaaatatatcaggtcttaatccctggaaccagtaaagattacgttattagaaaaaaaagttttgcagatacaattaagttaaggatcttggcattgggagattatcctttatcatctgggtaaagattaagttccatcacatatgtctcctcgtaagaaaggcagagggagatccgatatacgcagaagagaaggcactgtgaccacagaggcagagattgagtgatgtgtccacaggccaagggatgctggaaaccaccggaaaccaggaaaggaaaggaagagattattctctaagtgctccagagagagcacggcccagctagcagcttgatttgaacagactgaaactgatctctgacctctggcctggagaagcatcaatgtgtgagcatcagtgtctgctgttttaagccatgaattttgtggtaattggttaccgcagccacaggaaactcacactggaagtattgaaaaggtggggaactcagatatttaaagggaaggaacgtcattaaatctaggaagaagaagcttgagttggtcacttctgaagaaattgtagagatcagctggacttgatagaggaggagacaagacacgatgacctgcagcatggttggcattttcaaccccaagaattgagagaacccaagaacggagtggaagtaaaagcaagtagaatgaaggtagcagctgagactgaaattatccctccctaccccgctttcatgtaccctggcagtgggaccactgctccatgataatgatattgaagagtgaaaaggacatgaacttttaaatgaagagtaatgagatagaaagacataagaattctcgagaaaggttttaggagtagtgtgggatgagtttatatcacaaaattaagataaaaagaagcaattgagttattcatgaaagagtttggaatctatatgtttaaaaagaactaccagggttgccattcttctgtggttttctcacaaattctagtcaattgtctgtaaatgaatttacttttgtttgccggatctctttgacatcacaccagaaagaaaccacacacgaggaaaagcagtagttcaccgccctggaatcagaggtctagcatgggtagcccagggctgagaaggtttccactttttcctatcactcatgtcaggccagggtgggtaggaggtagggtctctccatgcagtgcataccccattctgcacctttctaaacaggtatggcattaagagcttatttgcttttaaaggatcagtgtagccatgagtctgaactattctgatacacaaatacttttcagaatgggaagtttctgtctgataaatgcctctgaaaagtcagatttatcagcctcattgctcttttgtatgtgcttttgagcttgtgaaggaaaaggagtggattctcagttaagacatattttcaacagcgttgactgaatagttgttatgggcataaactattcaatgcttggggatacggagttgaggaaatagggttcttgttcttcagacaaaaaaataaggtctacaagtttaatttataactagacaatgagaagacaatccctttcaagttgtgcaaagacacaagatgcctacattttttaaaggactatatagaaatactgctctgtgtgtatatacatatatacagacagataggtgtgtgtatacatatgcatatgtgtgtatatatgtatgtacatacatatatagaaatcataaagactatttgcttgatgttggctagtttgcacacagttcaaatttgcaagtaattcttcatccccactggtttcattgctattcagcatcttgccaatttccattaaaattcaaagcctgtcgttgtgtcttgctgtttaattgtagacttggggcaactaaacttacgttgaatgctgaagttagcaaacctcctaagctgatgaatgcactttgttatatcctgacacaaatatctgaaatgtaatgaaacattctacacaaacaagatcataatcctaattcatatctagtgctattcacaagagaacaccatagctgcttcatttctgaaacgaataatatcatattcctctagtgatcaagcaatcacctccaagtgagactacaatagagactgaaaaaatgtgaaacactgtagaacttgaactgaaatgtcaaagtgctcctagtagattttgcactttaggtagtacatctttatttgatgcattctctctgatttcacaggattcatttgctctattttgctatggcctgttattagaccatagtgttgatctctgagtactttgcacatttgcatcaaaacattgttgtaatctaagcacttgagcacatgggtaccttgactatgtctcatttcacaaacgaaatgacacattccaaatcaaaccatcagcaaagggatggcaaatatgtggtggtccatagctacagagagtcactacctgagaaaaagatacaagcttttacttaattcagcagtttcattaaattcagtcaaaagattcttccaaacacccacttatatgtgctaagtggcaggtagtatgtgttattattttcaacaggaaataagaaggctgagtatcattctaaaacaggatttcaaagggagacctggaaaaagaactgaatacatttaaatctccattctcaacaggacaatcatttgggacataattcttcctttccgttacagaacaatccagaaaaaaaggttgggaaacagattggtgaaggtacttagtcactcaaaacctcctagatgtcaatggtgataaacaacaaataaatgtatatgaatgagagttcatatttaaccagcacaagagttataaatgaggaatacagtgttagggtcctaagtattctggttaagatgttctggtaccataagtttcttactaatcttaaccaagtcaaagcaaattctgtaaatattacttatatttacaggccacacatggactagacataacatatttgttgttggttcacagggagaaacagaggttaactatgatggcctatggatatctggaaataagagaaagaatttgtaaatcatgacaaaggatagcactgcatttaaaatcatttatgataaatctacattcaacttctcttattatttcaaaacaaggtttcaaatttactctttagattgatacattggagttggaaataacctttgaagataaagtaatagtgctgcttctgcacagcctttcaaggttgtgtatgtgggtgtgtgtgtgagagagagactgaaatagagagagagagagggaaagagagagattgatttatatttccctttttcaatatccaatttctcacaaacttgatgaaactggacagttgcacattttttcaattgctaatttttgcctacctcaaggacaaaaatcaagttatcttattgttgttttagttttcatttccctgaatatgtttatatgccgtttgcagtgtcttgctcttatatttttccaattttattggtcgactatatcttgttattgccaatatagcagggtaatcgatatgactttttttgatatgattttagctgtagccgaatatcaagggtaaaataggcacagcgtggtcccaagtcctaacgtgcagtgctaacccccctaaacaggacatgtggagggtctgagaaaccagctctgctcaaatacacaataagctctgtgagtaaagtggagacactggcaagatggaggtctctggagagaatggttagggcactgtgcttgcggctacccactcctgccatcatgggaataagtggatgtgcctcccttactttaaagtcaagcaggaaacaagatttcaagaaaacttgagaaagcttaagatatgttcctggatattaaacagccacagcaatggggtctgactgttgctggaagaaatctaaaggctacaggctgcctggaagtacaatgcaaaagagagagagggctgtgttgggagccagttgtacttttaaaaatggggggtttgcatagaccagatgcagaatccataatagtgataagcagcagaatagtgacctggtgcagtgatatgtttctaaaacaggcagtaattactctaatctgaggtgactgacagtaagtcagaacatgactgtggtattagcactttgcttgtaaaagactgagcaatttgaagtctccagtgagggaactggagagaacaagagaacaagctggtaaatgtgcatctgccaagaacaaaaggctcttatgactgctctaagacaaataagattctacctgactgtatgctctcattttcctccctccaaaatagcaactagttattacaggtttctcagcaataactagataggcccaaattagataaataaagatgttttagttgcaataagaatttggaatttagtgctatactggaccagaattttaaatgtcaggaagtttttgtgactgaacaagcacaaaaagtgaggacctacctgaggtaacaaccgaaggagtcagtaattagtttgtagagccaactggaagtggagtagaagaagaataataaggctgatttataaattcatcctcgtatatctaacttgtttggcaaactaaattataaaaaatacatattttgcacgtatttatcttgtattcatataccttattagttcctagttattgttaaggatttgatcttttccaagtgtatgacagtatcatatacaattaaaactttaatttctagtatttatgattattttattttattgtcctattgcattaagtagaaccagcaagagatttttgagagctggcagaagagaaatcatgcctaattagttcaccattttgatgccactggaatttgcattttatagttaatgtaatatgtaatgatgatttttgtataaatagttcatgtttatagagctcatatttcaattcacccacaattttttaattagaattgatagctgaagtttattagactttcttttagcatctatgaatataatgagaggaactttctccttcatgtttttagtataatgttgggctaaactacgtgaagaataaatcctacttaggcatgtcgtgttcattatctaatgaaacactggagttagttgctaatatttttattttgaatttttcaagtgtgactgagctggtactatatgtgtgtgtgtgtgtatgtgtgtttgtgtgtgtgtatttgtgtgccatcttggtcatgttttgttagaatggctatctacattttaatattctctagttattttctcattatctgtccgatttgccacttctggcctaactaaaaaaatgtaggtgtatctgagtttaaatgtgagctctgctatgccagttattacttgtgtgaactctagggaattgctaccttaagtctcagactcttgaaaagataaggtttgttgtgagaataaaatgagagaatgtgtggaaaaccttacaatcaagcttgttgcgtaatgtgctgaataaatgatggctatcatcacaaatgcccttagggcatttgtatatgaaacgtatatctaacaacaatgatgttttaaaggcttttatattgatctttgagaaattcttcttttaagaaagacaactttataaactctgaggtccctcaacctatatacctggggccatggctaacaaactcctaagtcaaacttccttaaaataatctaacgataatcactttcacaattttcaatttatcctgaaatatattctgattgtccttgcgatggttaatattgtgtcaacttgattggattgaaggatgcaaagtagtgctcctgggtgtgtctgtgagggtgttgccaaaagagattaacatttgagtcagtggactgggaatgcagacccaccctcaatctgggtgggcactatctaatcagtggccagtgcagccagaataaaagcaggcagaagaacgtggagagactagactggcttagtcttccggcctgtgtccttctcccatggtgctggatgcttcctgccctagaatatcggactccaagttcttcagctttgggattcggactggcttccttgctcctcagcttgcagaaggcctattgtgggacctcaccttgtgatcatatgagtcaatattgcttaatatttctaaactcccctttatgtatacacctgtcctattagttttatccctctagagaaccttgacatatacagtcctcaatagggacttcttcttaaccctgttcatatatatatatttttaaaaagtctcatctgtgaccctgcaacttcctgcagccctcggtttcgttctgtgatgtcctgttattcccctaagaggtgacatggagacagcgggctcccctgtgattcccagccactctttgggatgcttggctccatccttgacaaagattttgctccaggcacagtgattcatcctaaagccaaaatatgcatgggagtcactatccaaatattaaaatttatatttgaaagagaattgctggtagaaatgagtgcttatgcaaggaattttggtcacttggtaatcacataaccttcataagaactcttctaaagtaaatgtactttttaccctcctgttcttataaggatctaacataaataagcaagaagttctggcactgtgtcaagtagaccgaaaacaaaatcctcatgtaaataaacattgctgtaatatgaccttgaactaggcagctaactcaggaaaaaacaaaggttcttcaagagaagcaactaatgcaaataagttatacctaattaaaactcctaaataatgaaaaagttgataaacaatttgtgccaagcaaaaattccaatggacagcagtaatcaatgaggcagaagcttgtattttccacttcttttcagacacgtttttgtctgcttttagagctataagtagaggaagccagggtatctcttacaaatatcaagcgaggtttcaaaattattgacacagatgcccagaccctttcccaaaccattatattagattcataggcatcaatataatttaaaagtcacccaaggtgtagtcaaggctgaactctccttctttaaattaacatgaaagatgtgataatacaaatggtgtgtctctactaatttctagaacctaataattttaacacccatttcaccgcactgttccatgtctgatgaaacatgcaattttaatatactctattcaaaaccttttattaattttaagttgaatgcaaagttagggtctctttgattccttctagcaatcatggcccatgtgaagtctaatttatagacatacaaatgtgatcctgagaaaagtcttggattttaactttaaggaaaaatagaatttagtacttgaaggcgacatttagaaatagaaagacagattgggtttgggccaattatgactctcatgaaaaagtaataccagtgctcctggcttaatacaggccacagaaaactggaagggaggtttaggatagcctcagaaaacatatatatgtattttttgatttgtaatttttgtgggtaaatagtagatgtatatatttatggagtacaggagatgttttgatacaggcatgcaatgcattataaccacatcatggaaaatgaggtatcgtaattcaaatacagagtttccttattgattatgtctatggtgttttcccaactgctctttttgttgctgaaattgaattatagttaatggaatattaaagaaagccataggttaacggtacatcattttgacgatcatcacatcatgtgtacagactcaaaatgaagaaaatgtaatgtatgctctatgctttgaaaaccaaattagaagtctatcttcactccaaggatctttctgcctgcagaaataaggctagaacctactctctgagctaggagaaccgagctaggagaaaataaaatcaatttcactcgggaagaatggctgatctgtttttgtgtccctttaactccagcagtttaataaatacttgtgatttaatgcccaatgaagatattattgaaggaaaaccaagcctcaatctcttcttggcaaatgagaaataactacttggaaatgtaaataccagttcaattaattccaatgtaaagtggacacctgatgatatttcaaatatgctgttataaagaaaatactgagtatgtttattttaaaaggattctaaatttgttttaaattataaactagttttcagttattctgccctattcttctatgaaattcacagaaattattgtggccattttatatttgttatttccccccatttaaaatacgttatgaaaaaccaatccctaatttctcatagcttattttattatttgaagacaactttttcttatttctcagttacttaaaacagatatatttagtgtctgttattttatttccctcagtgatgcatatacaataactcttattcactaatataattattaatatataatttatagaaatttgactggctctattatataactttgatagctacaagactcatatttataaattgatagttaaaaggtattcagaagaatggtattgaaataatactgtaagaaatcatggattgaagtcaaaggcattgctacctacatttaaatcattcatgcagtgttgtaaatgtactattttgtgcatgtatatcaaccaaattgttgcaacacataggtcagcatgcacacataacagagccctttcccctaaaatggcatgcttttttcttatcataatcttaactattcaaacctatttatatttagagaaaatcaagaatatgtgtttttacaatggataataaatagtctaactgagttcagtagttttaaacattttatgtctacataaactggtacaaagatgccattatcggggcaattatcctctaggtctccttgtaatgaggagtttacgctgtcaagtgtgggaaatttacaatctcaagtgtggagcttaagtggaaaagtcctccttggtaaatataatggattaattatgttttcctgtaaggaacctatgaaatcagggaagtccaagtttggtgtccccttggtatttgggatgaaaattaatacttctttcaatggtagtagttctcctttgatttaaaaaaaacttaagtggcatatacaataaggagataaaaattaaaaagctatttaaattccttactttattatttttttctcattgcattatgttatccaccccgaatacactgtaaacatggcataaggggatagtggtttaccaggaaatcacccaactggccaccgattgaactgaaaaaagtaatctctatatactcttatactgggttccaggtcaaagatctgtgctgattttttttccagtatctaaactgcttagcaagtcaaagaaactttgagttagcctaagttaaattgtagcaataatagacattttcccaaaataatttactattaagcatacatattatttactactgagcatacataatgcaaaatcccattatagtaaactcaaacaaattcagtctcatatctcagaagtcataaaacctaagactagcaagaaaagtgttcagaggtagaaagcagttgccagcattgattgaacatcggaatggtaacagtcactaggaaatcaatgcttgaccttatagtagttgcttggtggccaggttcctaggactcgtctttctgtaggacacacaaactgtcttgttgtcagtgttctctttgaatcatgcctcagattttctgctggcccagtgttttgatcatctgtgtccctgaattacaaatgcaagactttctgcttctttcagcattcctcacccctcccaccttttctatagcagtccccaggagctcaccttttctgcacgtgaaaagaatactcactcagtataatcatttatgtgaaccacctaattaccctgcaggatatgactcatttgcatataattaaatgtattcagttttaaaatattttaaattttctttggcaacgttatgatctattcatggtcactgagctatagaatttattgctcatttggtgtggttttaggcttatagctaatctttgctgaagtattttagatacaggtaatagaaaaaaagcaattaagctccatatggtgccaaatttcttttgtcctttttccagtattcttctctgccctcagaaaacaggcgtcagaggttgctatcacatcctcatttcatctttgtgcctcttctcttttcctctgctctctttaccttaataacccatctaggactttcctcccttcagcacattagcagtcctttttataaggtcaagcttcacttgtcggtgttattacctgtacaatattagttttacaaatggcaaatggaaaaataaagatcctcttcaacacagaagcccacaagggcaggagtgcttatggcttcaacaggtcaaattcagacccagaaaaggaagaggattggtgaatacatgtgaggactatgttcaggaagccaaagggtatgtgctactggacgcctgggtaggaatgttcaaactactctgagaaaacaaaaggactgtagaaagagtcttattttagtgcaaatagtaatagtaacaggaaagaagacagttgaggagagggagagaacagacgtgaggccagcagatctgaccagcatgactcggagagcaaggagcatcactaagcatgtttcatcatggttttagtcttttgcctgaagcattgtttgtttctattacatcatgcatgccaatccccaaattacttacaaaaattacttcaaatatcactataactagggtgactatataatttatcctccaagctgggacacctttgaggataaaagagggtgctattaatatttacactggaacaacttgtgtgaagcagaagtgtcctggccaaactcggacaaacgatcatcctaacgactgttcgtctatacggaaacatacacacgattgaggctttcaacaacaaatatgtattaagcacctgtagtgtggctgggtgtataatacagttgcatctctaattaggggtgaccgagttctaaaattagcaagcaaggcagaagttaaatgtatcaaaagtattcttgagcacttcttaaacctatgaattttttgaagattaatgtatcattttaacacaggtaacagatctagtttttcctctagcattaaaccaatcaacccctgcccctacctcactgtatttcagaagaagtaggagacatgcatttagggggcgatgtgtattacaatttcatattgctacatctactgtacagcaaagtgtagtcactgtgtagagatgcttatagcataagggatccacagagctgagtctgacagtggggggcaggccaatgcctcccattgatgctcactctgggcacatgctcagatgttctgccaccatttattcgtaagtatttcaagtccatatgtatggttgactttgagtaacttatgcataatatgatgctactttcaaaattgaaatatatacttaacttgagtagttaactctagttataggaaaaagatggcaacataaacaaatccttatgatatcataaggaacacaaggattacgtaactagatatagggactaggaagaaataataactacatctgcttcagggggatcagtgaacgtggactttctcctaatctatggtcaatgaatagaaattttcctgacagtgaatccatgaattgtggcttggggagacagggaggtgagcatattgaaagacagtgaaatgcatgtaaagagagctctgtcaaactctgtgggatttacagtaagaacatgagacctacaaatagaacaaatactgttagttatctatatctttcatttttaaattgttgtgagaaagaaagaaccctaataggagacctaaaattaatccatagtgtcatattgtaaagaccttctgtggacaagatagaaagtgattatttaaatgaaatgtgttaaaggacagagttagtttcaaagatataagccctttcaactacaaaaagcctttttgtgtgtgtgtcttctatttattgccacaaatatcaggacacaaactgaagcctctaaaatgcaacagtcttaaaatcatgaaaaatacatctttgtattgctaacaattgggggatttactaaaaccaggaagaccagatacatggaaaagtagtataatcagtgatttttgagattatactacttatacagagatcactgtttgaaaacatgtttgttgcactctcaacctcacaagacaccattccttgaaactgacttcaagactgtgcataagagcatcaccttccatagaaatctttcagctttgaagccctggctaatgaagaacatatatttaaagcccgtttatcataataaccatataattacagaatttagcattttatttaaccatatttaattctattttacagctctcttacagtatggctgagcttctttttattttctttttaccctctcatcccttgcagaacagaaccaccgattttataatatatgatactctggacttagcatgggcagtgcacttttcccattttatatttcccaaatattcagtgataaaatataatcattacatacatagtgtacatttccattgacgttcaggaaaaatataatctccctatatcacatacagctatttgcttaggaaaaatttctgtgggggtacctgtgtgtgcttgaacacgcataccttggcaaatccaaaacatttaactaggagcaaagagttatggtgcagagtctagaagactacactgcaaatgccagcaactaacactcccgtgtcccctgacatcgtaggaatttacagggacgggtttaagtccagaaaatgtttcatttcagctgactgtctctggtacttggtagaataataataaattcccaagatctgttttagatgtgaactctcagcctggaaggacttgtcctacaagatacaaatcaccatgccatgcccttgttagtactttgcaaacgtcaggtaatgtcagcaactcagaaaatagacaataatacagtacgccttcatcggtgaagcaaaatttcctgaaaaattaaattttaggtgatatttagaaatttgctgtttttcaaaaattgtcacaacagctatcacagtctacgtttgcatgtcgaagcatttctaatcctagaccataaatgttttgcttaaaaactctttatgtgtgcagaccttgcaaaacaacaaaaaacagttctgatctgatatgaaaactcggggagcaattcctctaattataacagctgggtagggagaatttctgctggcatggaaaagaacagacttctaatatggccatttacaaaggcaaatgtaaaggtgaatgattaacttgaaaatacccaatggcagaaactgattatgacttgggactattggtgaaagcacaacatggagacaggaaaacacagagatatgacagtgaaggcatgctgagagagacagaaacaataaaatgaagtatgagacagaaagagaaggtgactagataaaagggtagtcaggagataatcttagacttgtaaacaaatgcttataagcaaataaagaatggcaccagaggcgtaaatgaggtactgtaacatgctaggagtgtttcaagaacaggaaaagtcattctttgtgttgagatgcagtgggattaggggcagtgggactggaatgaatggcttcatagattatgttgacagaaagctttgaattccagagaaaagagtcatgactttcctttgcagggggtaggtggtggcagggctcagtgcatataactatagtcatatgtatagtgaacatatctggtcgaagtgccaataatctggccaacatgcaactatatatttccaatattttgccacattgttcactcaaagtccagtggacagttactttcatagaaattgagtctaacgtatttgccaaatgtatacaatttattaatagtgctaccatgatacctaacattgtagtttaagttttaaaactagtaataattagtggaggcttcagataaagaaatactaatgtctatcaatgaaatgaacggagttaaacatcttttaaaaaaggaaaagaaaacatgttttgaccacaaagctccaggtgattttttcctatgggcatatcactttgttaactggaatactacattaaaaaaattactccatctttttttaaaaaaaaaatcatcagcctttatgaaactcagaaaaccagaaaaatttgtgaattacttggtagcatgtcagcatattaagagctactaaaaatgcagacattttccagttacataaactgactctctggaatggaatgtgtgcagtctatattgactacaccctcatttcactgcatttttgccgactcttaaatgttcccctcttctctgttgaaatttaatctccttgatttcttcagtgatgctgtggctaagatggagaatgaaaagagtgggcacataggatgacctcagcacagccaacgttgatcttaaaattcagatttctccctgatgggatgactacatgataacttacgtctacatactaagatagccagagtggctgtttcagaatttattatatcaatgtttttagtcctggccaagtcctctctaaaggcctccaggtaagtgtaagttcatggctttaaaagtgtatgcgaaattgagttcattcagtggagaatgaaaattagcattacaaaagaattatgtgggaagacagaagggcttagaggagccaagtctggcagatggatttttcatagtcaattaattgggagaagaagtcatgcagtataatggaaaataaatctgaattctcttctgccttttcaagcgggtcctcgataaattcctcatcctttctaaccctcagatttttcatacctcaattgaagaagttaaaacattcgacctatgatgttcctttccattctaaaattcaacacttctacctagccaactttgagacagaacaaaagaaaatgacctccctagaaaacagtactagaatttaggttagaaataaagaagaaacactcatctgggttgagaaagttagtaaaactatccctgtctctggagatctttacaaagaaactgtagttttatatgcctggggtcactgtcagtgatcactgcctctgattgaaggcagctgaatgcctatcaacaccctcctagctatagcccactgagactctcaatctgtgtcaactctgtctgcctctcttatatgagctataggataattttaggtgctaacattaagtataacttagctcttttatctctgaatcagaaatgggaacaaatgtaatagacagtaaactagtgaatgttaaatataagacaactgcatctttctttttgttatgaacatgatcgtgtgcatgtttgtgattaagcatgtctgtatagacaaaaacatgataattagccaagtattggggtgattgatggaaatcaagtttctgttgaagacttcataccatactctgtgaaatgaatgaaataaacatttaaccctttcagagaaactccaattcttgttaatacatcttcaaatctacagttattgaagaatatcataggctttgccttaagaagaatctctttaatgtagtcccatataataaaaagcagaatacagttgatctcagactgaagaaatccaatgaaatttaaagcctattaaaaacattaagacattttccaatcacaggaaacgtttaacagagcatgtaaagtacaaacatctgagagaaagaaaattatgattaaaatgtagtctaccttgcatttagtagagtaatggaaacaaccagtattaaatgtggtaggaaagcaggtctatttgtcaacgcaagcagggaactctcatctttatgaagaaattttaaaatggtttagacagttagaaaactacattaatattctaaacttaacatatttcatttaaggaggcaaccattttatacctcttgaaaggcttaggattatatttttttaaaaatcaaggaaatgaagcatatttaatatgcataaatttatattatgccattttatcttttcatcaaccctgtcaagatatgcattttacctttcatactactgaatacatggattcttagagacccaaaggttgaacaaagaggaaataaaaaaaattagaacataagagtaatcttatataccatcagaattacaacataactctatagactcctactccagttgtctttccattgcatttctatttaataaaatgtcaagctccaaaaacctaaaaaagtgtaatgtaataatttagtatcaaaaacaagagaaaggaggaggcaaaagaaatgagtgactgccaagggagacacattccttcagcgagaatgaggtttagatttgttatatgttttagagatgattggtaaatccaggaactataggtaatttttccagccaccggataacagaaaaagagagactataaccatgaaagtcactctgggctggaataatagtcaaactaattctcaaatggtttgagaaaatagtactaatataaacccaaagagagaggggaagacaaggagagaaaagtatttgtaaacgtggcaaaacattaaacaattactgacccttgatgaagggtatagaagttattctcagtatttttacaacttttctgtaagtttgaagatatataaaaataaaaaaataaaagtctgtttggaatttaaagaaactcatacaaaaaaaatcttctgaatgttaatagtttctttactttgcaaacctgaaaaaattaaaatgttggtataaatgaaaaaaagtgtattggacttgtatttttcttttactttctcgctcattttttgtatcttctgacctcctttcctctcttccttccttgctcagttcttccagcctgtattttaaactaggacatttttgtagtgctgattatttgaatgtgacatgtgccactagttagaatttttctgtctctgtgtgtggaaaaatctattcacacatctatacttttaacaaattgcagctttgagtagtttctgctgactcctgacatatgttcagcatttagagtgggaaaagggggttttctgaggactggaagggacacaaaatcaccgtaagcgaccggaaaccaaatgcttacaaataacaaaatcaggaggtgtttgcttacaattttatttaaatggaggaacatttttgttttactacattaactccctagttgtctaccattaattttcataaacatgggcagccgcttgtgcacaaaaagtaggaaggtctccaactcaagcttctccacactttccttctctaggcacaggggcactgatgtagaagatgccggatgtttatacttagaatccatactatctttcaatgaatacgttaatgatatttacataaaatgtatgacttacgtatgcgaccaaatctagacaaatatgaggaaacatgattattaaacaagataaacctagatccaaaaaagaaatggatgagagagagatacatggctgagcatagtttaggtgtattttggccaagctttcctttatggatggtatagaactccatgcctgatcctgcattgttgagaggcaattaagttcctgaaaatgttcctcctgggagtcatgagcaccaggtcaaactccagctctccccctaattaactgagtgaacttgggagactcattcagctcctctgggatatccaccatcatgaaaggaagatgtgggacaaggctaccaccaaagctctgagatctgtaggccattccaaattaaacacacaagttagaattttttataaatgtggttccttaataaagaaaaaaagtatgagatttataagaagcaaatatgagagagggagaggaaggcaggaagaagaggaagggtcaaataatccattatccaaatgcaatgtaagcaaaataaattctaactcaagtggatataatatttaagtgttctggccaggcacgctggctcacacctataatcccagcactttgggaggctaaggtgggtggatcacttgaggtcaggagttcgagaccagcctggccaacatggtgaaaccctgcctctactaaaaatccaaaaaaaaaaaaaaaaaaaaaaaaaatagccgggcatagtggcaggcgcctgttgtcccagctcctcgggaggctgagataggagaatcattctaacctaggaggtggaggttgcagtgagctgagatcgtgccactacactccagcctgggaaacagggcgagactctgtctctaaaggcaatatatatatatatatatatatatatatatatatatatatatatatatatatagaattatatattctatatatatatatatatatatatagaattatatattctatatatagaattctagaattatatattatataattctatatatagcatatatattctatatatatagaaatggatatatacattctctatatattctatatagagaatagaatatatatagaatatatatagaatatacatataatacatatatagagagagaagatatatagagtgtgtatatatattctatatccagaactattgcccaatagatttttgctcaatctgaaatgctagaagtcatgagaataattttcccttcttcatattttacttgcaactttctaaccaaaacagtttcatttattcagtcatttctttcaacatgtttttgagtctctgagatgcagaaggtgttacatatcatttatgagggataggaagttaaataagatgcgcattatggattgaactgtgtttccccaaaagacatcaaactcctaactgctagtagctatgaatgaatgtaactatgttcagaggtagagtctttaaagtgagttgaaacatgacagtactcagagccgtgcttgacacttagcactcattttaattaagttaaaatgagctattagagtgggccctaatccaatatgtctggtgtctttataaagagggacaatgaacacagagacagagacaggcacacaggcggatttacctagttctgtgggatctgccatgtgatcatgacagcaaggtcaggatggtgcttctaccagtcaagggatgcctaagattgccagcaaactcagcatgggagaagtatgggtcagatttctccccctgagccctcagaaggaaccaagagtgctgacacctcgatctcgggcttctgaccttgacaactgagatgatccatttctgttggttacgccaccaggtttgcggtactttgttaccgcagtcctagcaaactcctacaaccagtcacttgcatttaagcaatgtacaatctggacaaggaaataatataaaattatcaagtaatattctactgcaatggatttaagggaggtttaaacaaggcgattcaaaagcgagggacttcaacctatgcctctggcttcttctcatcccctttcctagctcgcctttctctcctcctcctcgtcgtcttcatcactactaacattttaagagcccttgctaagtgtaaggcatcattctgagtactttaatcttttaactcattcaatagtcacaattgaaaagccatcatttaaaaccaaagaaaaccaaggcatttgctggtatttaaatagtgacctaaatgaaattgttagttgcctatgaatataatcaaggacaccaagccctctggcatttcaaatatttcaattactatccactaagggaagtagcctcctatggtcacacagcttgtaggtggtggaatcagaggctcagtcaggtcagccgtgcctagggctggggctctcaaggaacagattctgcttttctttggataatctgctagcgtagaaaagactttcccagtggaagattagaagcaaaaataaagtaacatttgaaattacacttatgctactgaggtgtttttattttactaaaataattacatcacaggctggttgccatatctatcaatatcactgcaattctgaaatgccagccaccgaaacacatgagtgttcaaagaaaagctgacgtcaagaaaacgtgggtctatgtacttcaactttattcatatcattgtaatccttccaataagacattaatacatatcataattcctaattacccacaagcatgacaatatttctaatggtagaattttcaaacaaccttctatactgaagaatatggggtttttcttatacataacactattttatccttttcttgaaggaggaaaaaaacaatcccaagttacttgctgacaaaagtcaatgacaagacagtgtgaaacagtaacaccatttgcgtatgtggggctgtctgcacagtcataacacttgagtgtggattttggggtaagtgcttttaaatacatcctttctttaagttttatgacactctcttaaaggaaatgtctttgtcaggacagaaaatcaggactcagagatccacaacagacctaatgacacataagaagaatacttgatgtcaaaactccttattctttccctacctgatccacctttcccaggacaaggacccatgataccagatacctatgtttcccaacacgatatgcaaatagatgtcttgcttagtggataataattgaaatattttaaatgccagagaacttggtgtccttgattatattcacagaaaactaacaatttcatttaggtcactatttaaataccagcaattgaagcaaattccaccctaaatcaatgtctgctgaattaatgactatggtaaggaaattaataatttccttgagggaatcctacagaaataggcagatacttggaaagtgctatttatttagaatattaaggacttaggaacaccttgcttgatgcaggtgtataagagacacaatgagagagatggttgcccagtcttgtgatcacctgagagtgtgtagaatgatcacataaaaagatcaaaataactatgggaggtatgtaggatacccaatcttggcccgccaccttgtttctcttattctatttccaagacaacctttctgtcaccccactgtctattctggttcatggggaagtatctgacctcatcacccctttgggagtggcaaggaaagggactgacagtcactgaaagaagcaactttgacactaacctattaccaacaaattctctcttcatagtgaaagcaataataatatacatatctgataaatctgcacaaaaatacttcagtgtattatttatttatttttattttcaatttttttagttagagacagggccttgctatgtctcccagactggggtgcagtggcatgatcatggctcattgtcacctccaagtgctgtgctcctatgatcctcctcagcctcccaaatagctaggactacaggtgcacactaccacacctggataatattttaaaattttattttttgtagagacagggtctcactatattgccgaggctgatctgaagctcctatcctcaagtgatcctcctgcctcggcctcccaaagcactgggattacaggtgtgagccaccatgcatggccatataaatattttgaatattcccacacattatagccctcactactaatcactttggggaataaaaaaaattacagactgatactcaagtattcattatatatattttaactcctcatcaaaagaaaaggattctctattaattttatttcaaattcattatgtgacctcaaaattattacatgcattgacggctctattttgatttcagtctcaaacatctctgcacaaccatcatatttgctgaatcactattatatgatgagataaaaatgctcatttaaactatctattctacattgcagtactgttgagatatgttcctaacgcaggcaaacacaatgttagaaattattacatttaactccatttgcagatatcttacaggtactcaaactgtgtgcgtacaatttagaagaatcatgtgtttggatggaatcttttctttatttgagattataacaagtatgtatatgcatttatgcataattataaatgcttattgctgttatcataattttagtcttcctaagatttctaagagtgatcccaaagtatataagagaatagaaacaacactcattcattccctactaaactgatgtttcatcactgagattgctctatggtattagaagaactgtcagagagaggagaatactgctgctcacactaaacacaccaggcttactgcagagctgttgaaattctgacttgttcctcatgtgtatatgatggacatggtgatgtttgctgacctagtataattaattgccaccattctgtcaaaatgtaatcacaatatctgaagattaaacgaaacataatggagtgttttatgcatttcttggaaagcatttcaaatgtcatcatcatgttgtaaaaagtcattcagaattctcaaggtcactcagaggcccatatgcttaaataagtgctggtcctattgccaactctcattcaatcttttgagctgggcattttctcctcccatgatacctgtccacctatcaatcctactctgtaacctaagaaatgaattccagaagtcatttgcctttgaagagttaaaaatatcagaagttgtgaattatagatcttacacaatagccctaaggatggattttattttcatagcctccacaaatgagtgtgcaggaaaatcccttaactataacaaagagaaaaatacctatgagtacatatcagaataccaaattttatgtgtgtacccttcccattgtgtaggaaagactttgtcttattagttcatgattatataataattgtacacaaatgcacacacacacacaacacatttaagaaactcattttacttttctctagtggtatcacacccacgcattctgcattcaacccttcaggttatagacttatccttaacaaactcactttgacgtgacattaatgataataatttcttaatacattaacagtgactctgggctttgggtttcctacttttgcacaacctgggctttatgtgtcttcatcttcaacttgctgttcttactgtcaccatttcacataatcaagaatgaaatatatcactttttaaatgtcaaaactattttaaagtaccaaatgcttctaggtaaaacactgacatcaatagaaaatgtaattagacattgaacagaatggttaagttcattttaacattctaccactgtataaattagtatacactaattatttgccagatatgaaaagtttcagcagacccctgggccagtctctttcttgttcagaaaatggctggaatatctgataattgaaattaagtcctgctatgtgccatattcaacagtatttcctaatcactattagaaacataatgaagttattatttataaaaaagttaaaattgcatcatattttggacctgatagttcatggtttgaaaagtctgagggatttttaattggcttgaagaactgaccatgaagcataaagtaaaataaagactggctttcgtggctcagagaaccagagtgtaatttaacatactttgcatttaaacaaccgcatattgctgacatggttttctttttatggttgttgttgttattgcatggatgatgcataaaaattaatcatacctttgtctgcattcaaattcctacaagttttttttttttttaagaacacaggggaactcttgcccaattcttctgtctatccacttcagtgtgcaagccttcttgtacaatgtaattttaaattaaataaagtctcactgctacttctcctgagtatccatttggctttgctaactctgtaaaaccgtctttcaaatgactcaaactacattaggaaaatagctaaaccatttatggcatctgtggaaaaaatttcttaataatttttattattttaatacaagatttcaagttagagtttatttctccatggacattaaaagaatgcctcttacttcctctctaggtaaaaattgtctagacaacttttgaatggtttaaaagttgatttctgttattaatattgctagaaatatagatttctaattgatatttttgaaaaatagtgtagaatttaggcatagtggctaccattaaatgggaggtagagttattcgactggcaatatctattactatataccaagaggaagaattttattcaataattactactgataattttaatacaaaaattatattacctctgttgataacaatttatgattataaaacaggaagtgaaatgttaaatggcaatatttaaataataatgtggtcgaggctatgacttcttccagagttgcataattttgttaccattattttaccatttaacacaaccgtaagaatatgagcacattttgattacaaagaaggcacttgcaaataaatttgcatctttgcattgtaagcattttaccttctatgcttctgacttctaataaaacagttgtttcttataacacaataactatacaactctcaaaggtaatatatcatcatgttacaattttattctatattacctataagcaagaaagacattgatttcttcaaagctatgtctgaaatacagctaggaatccgatacttttgaaccataacacagtattgcccaccatagaaaataatttgctgtgacaggcatctcttttgcacgtggtctacggtataggtaatagaaacagtattataaaaggtccatagtggaaaggcagatgagttcattggagatgtttacattaacggggagtcattaagtatcaactctttgtcattgtttcctcatgaagggcacacacagttaatttatttcataacatcaacagatgcttttctcatggaataaaccaatattcaccaatttattgggttagtaccattagacactagtgtcagcttaatagtaaagtagaatgatgtttcttttttgcccacataatgatttctgctaaataatagataggagccaggatgaatgcccaaataaaatacctccaccttgtcagagaacaaaaatctagttattcctaagcctcacaaaaaatacgttattcccattcagtctctacctcaattagaacagcaaatagcaaccaattatggtgcttttgtatgggctgggacatgtttattaacatgtgactcatctctctttatttaatatagtggagtggtcaaatcttaaaaccaaggtctaaccctggacaaaacccctcagagatctaatatgtttctgctgaaaagaacattgtgcaccctttcaatgaaattgccttccaggctggatgagttatctgaacaccaacaaccaacatttagtgaaaccctaaatagcacagagcacaatatgtctttccataatgtagtgaagtcaaacttaaaatgtagtgagcatggaactcacatctgtagaaactcttaggtcccacaagactgcatctgcgtctatctttgtcatcactatttttctctaagctctagaatgtgttagatcaattctggtggacaggtcatattaccataaaaatgtggccaatattttcagtcaaataaatacacactattgtttcaatagcttatagttttaaaactatataaaatccatagaaacaaacaacataaaaaagaaaaaacaatgaaagttatcactgagggagttattttgccaatttttagtatacaacttgtgaagaaaaatgtatagtttggcttttcaataagaattgttttagttattcctctggaaaaaaagaaaaaagttgttttacatatttttgtgaatttctaaaataaattatttttcttattaattccaaagtgattaagaaatgggattagttattggagctgcattgaggatactgagagaaataccccatatctgttcagagcccagggttctcacagtgcctgacaggtacctcccatacactgtccctcccagaagtaggaagaagaataattatcttaaaaaaaaaaaaaaggaaaataactcaacttggatagatggtatattgagatttcagtcatgagtcctctcacatgtgtgtataatttttaaagatgcacaattttgcttcaaattttaatagctataatagctattaattgttgtttcaatgttacagttgatttgtcatttaccatatgatatattggcttccttggcatttacgtaatttgttgccatttttgtaacatggagagtgaaaacaaagagagaatacattttgaaatagtgtttcatctattgttttaggccttcatgttttagatcatctttgaaactccttacatataaaaattattttcaccatctaccacctaccatgtaccattcacaaatatagctaaccaaaatttgaaacattttgatcaatataaatgttgttactatttacagtagtttatatagtttttaacccccagaggaaatcaggataaaaatgcaaactgcagtgatgtttatgactttcttctttgacgctgaaagaaaatataaaaccaaagtattttgtgtcattttatgaacatgtagaaataacaaagctctttttctaattataattattaatgctcttgctttaaaacgttcaagtttaagtggtggcaacatttactaaaaattagggttttattttttctcccctgagattctctcttaagttaaagacgacattaccactcacttcattaatgcaaatatggccatattagaatgcagccgttgaacatctgcctctgtgtctgtggatttatcatgctctttcagcaaagcagcgtgtaaataagtacttttctgcaattttaacttgagaaattgacatatcttctttgctgacactgaattttttcagcggggaaaaaagacaagtgatgtgcacagtacatttcatgaacatgaagccactcgaggaataaattaataaaatgtactgtgaaaattggtttcaccttaacaataattaatcaagaagtacagattaaaaactccctacatagctgtcactacttgaggaaatgggacaaatattttcatggaatcacagattctgagaaaagatagaactcttagaattcatctagtcaaaatgtccttcaatggttaacttaactgttgtctattggactttcaggtttttgttattttttctttttcaattttaaaccacaatttttaacttatctttgaagtcttcgcacatgttgtacaatagctgacaatggaaggagtacaataaatatttgctgaaagagcaaataaatgaattcattaatatacactttgataccaagagctctactcctcagcatatatttaagttatgaatattgagttgaatggttttccacatatttcttgcaaacccttttgttagtagtttgtgtgtttgatatttgttaagtaggtcgtatggttttggttgtagttaggaaatacgtgttatgatgggcccatatgggaacaacccactgtccacactggacatggaggacgagccacttctgtctcatactgagcaccttgatgtaactgctgatcacctctggaaggagaaggacatctcctctaacccagaaatggaacttgtctggaaatctctgcttagatacagacaaaatgaagcttcagagaaaacagaaggctagggaaaggaagcgatttattaaatacagttttatctatttttattgtttttttttaatctaaaaagcaaccacctctgaaacaatccaggttggttgacattgacaacctgctccaataggatgctcttgtcatgcccttcaactcagcaggcgcctgccagccctgttgtcgatggtctcaggctgatttctcctttgagctttacgtggtgcagactacatctctttttcaagattgcaaaccagccattattggttgaaaatttaatgtcttgctttctttctatcatttcttatttcattttctgaagtctcagcagaagtcttgtctttctctataccatcttggtgctcgaggagacatttcttgtccttttcttcccacagactaagaggagtgaccacaaccagaagttttctctatgcactccccaaaggccaactcatctggttaatggaaaaggtgagctctatgtatggtcatgtcattctgcttactcctagttcaagccctgaactaggaatttataaattataataatagtaatgacaataatcaatggtagatataaaagcaggcagttgaaaagtctgatttgtgggaaagtagtttagaccttggtcaccagcactagacatgcctgggatatatattcaaaattatgattccttttttgatttttagaaatggagtctcactctgttgcccaggctggagtgcagtggtgtgatcgcaactcactgcagcctggaactcctgggctcaagttatctccccatctcagcctcccaaagcactgggattataggcatgagccactgtgcctagccctcaaaattatgattcttgaggcatgttgaaaccacttaattggagtcttggattctgttttgttaatatctgagatcaggtcattttcaaaatcatttcaataagtcttataaatattgatgtttgtgaaccactatgagaggatctgaagccctgatattcccttcatatattattagcatcaattttgtagaaacacaagttttgaatttaattcagctagtattctgctctattatccagtatccaaaattgagcatgtagattctatatacttatgaatcaaaatatgtgagaaagatttctcaagacctcatgttatttaataaacttctttgtaatatctaactttatgctgatgtcactgacccagcatattcatctttgtctcacatgcaggaagaatagaaaaacaattaccatctgtcacagaattgattctatctgcacagctttcccaagacagccctgagatgtgatccttctaggatcaatgagcttcatcatcatccaatagtcattccatgactataatccacttggatgtcctgtgggcaaactaagcaggtccctaaccaaatgcagcatcttactccatccacccaccctgtcctgcttctgggctttattttcttagtgaaaagcatcacagcttacctagttctaagccagtcttaccagatgagctgtgactctgctgtctccatacccagacaaccatgaagttctttccacagttcctcagaaaacacttttaaatatctctgattttttccacccctttaattcagaagttgcagacactagtgtctgcaaggcacataaacaaagtcaacatatgtacagaaacaaagggagcctgtgtgtgttgtgtcttcctttctaaaattaaggagtggttaccatgtggccacagtagtggagtgcatgcctcacctaaaggcattcagatcacacagaacccctgcccccacagcacacatacacacacgcacattatccaaaaacaagccaagaaaacgcaatgacaaatgtttcgtagttttcaagccttatttagctttctttcttaattcaagttttcagtatcctcattcggataactgcggtagattttagacactgctgacatccctttccactcattctcactgtcaccagtgaaatcctctggaagttaactatgatcatagcggttttcttgtttgtttgttctttgttttgcctgaaattcacatgaagcaaacacagccatcactctagaagaggacttttgggaaggggaaataggtgaatgtgtccaaggggctagagcagataaggtaattttggtatggtaggaaactgggctgagctttaagagggatggttttgtttttctacaccacgtagaaagttagaatcaggagtcaggtggattccaggaacatggtggagtaggcagaaaacaaggtctccctttctcttcttgtgatgggttttcttcatttccttcctttttcatcctcccatcctctctcctttctcttcttttctcttttctttccacaatgctgccaaagcatctgactactgctgttctattatcttctttcctttatatttattttttttcctcttctttttcttaggctctcagtatctttttcactatccactccaatgtctctctttatattccataaaatgtcactggaatctggatagtatcaaagtaatttatttctgttatctagcttcaacctaacaaataaaaaaattggatattccataatttctgttgtccaaaagatgatttataactagttaaatgcagtttactagctgtatttgtttctcaaattcttttcctttccagttagtgaccctaagtagataatggcattcttggacataaccaattacattctgtgcatcaatattcaatgtcatgggaattacacgaatgctggatgttgaaattagcattagggggaaaattagctgaagtatcatacttgctttattaatactataaattatcttggccaagataccaagaaaggataatagccatttcaacctggcagatatatccaactgaactctaatgtgaaagaagtcacagaaaagcttgattaaaaaaagaaatattgttaaagcatgacaagtaaagctttaaagtatgtgcaaatgtaaaactgttatttaacattttattaatataaacagaaacactcataatcgtgggataaatgtatatataatttgaggagaatgcataattccaatgaaacatacacatacatatgagaattatatatgtgtgtctatgtgtatatatatccccaaaaagtgttagatattgtttgtgcagaaaaacatgcatagtgtcatagattgttataataattggagacattaataatcatctcaagtttaatatactttttatgataaagaaaccaacctgttcagagagatgaagaataaaagataaagaataaaataatttccattcttaaaggggcacctgtgtgtaactagatgaacttggtatagctttgccttagtgctcccagggagaatgaaaggctcttccccaggatgagcaaccctcaaatgctgccaaggcccttggtctgcctgcaatggatgttgatggccagtgatggccactagagctcagtttatttgattaagcacatgcactgcctggtagcaaacaacaacaaaacaaataaacataaaacctgggggaggaggaataggaagccctgccaatgtctgagtaaatagtgaacatttttatgagaatcggcatgtaaaggtgttactcagagacaggacaggtgctagggatgggcaatgaattcacgcaatactccatgagtgtgtacttacaggtgagggacatgtatgtctttgggtgtgttactcttagggaagattagaaagactctgaaggatgataggtaccatactgataaaacagagcagttgtatttctataccctaaacttgagcaacgaagagaggaataaatttcaagaggaaaataacattgttccaccttgttttgctagaattatagatcctgcaagaagatgaacagttcatggaagcatgaggtgggttgctcggatgcttttatgcctgggtgctcttggaaagctaaggacagacggaaacacaactcaggacacatcaataagagaagcctgctggcacagaggagggcaggtgaaaccacctttgtagaagaggctcatttgaaaatgctcctgaaagatatgatatcagaacactatcttatgtagagtggataagactttgatgatcttgaaaatgcttactgaggaatacatagcatttatctttctttccttgattaaagaactttcatatatacatatttatcctgtatggataggtaggagaggtgatgccagcccacagagatgaccagtccctattccagaagttctgagttgttgcttaagtgaagaagtatgctggtctgctttcaaacttctgtaaacttcagcttagtggtagaacagttagaaaatccaaatatttagtttcaatgcctgagtagtccatttactgattttcaccaactctgttaccatcaccttggtctaacgttatcaccgtctcccccagataccattgcagcaatgcttgttgtgtgattgtccacagttgaaatagtaactttagaataaccggcagaagtgagggagggtgacccttacaaactgttgattctcgggcctcccattagacccactgaactaaaatatctagatggtgatccaaggaatctgtacttttcttggctttccaggtgattcgcgtgagccctaatatttgcaaaacatggtaaccttgaattttcctggtttatttttaaaatcaacatgaaaaaggattatatttctctccacttatacaatctggttaacagattcagatgagatgctaatttcaggagaacactggcacttacgaccgcgaagatgcctgcacctagaacatggaagcactgatggcaccaggaggaaaataatattctcataaatgccagcctgtgataaaataccaataaggaatctctatgcattttatgtaagattaccttatcattcagaaaaatcaatcatactaaaaccagaattgtaaaccccataattaacttgaaggattcaagagaaatcatgtaatctgacagatgagggggcagactaggagagattaggaagttttaacacaggtattggttgtcagatccaggacccaggtgttctgaataaagcccagagatttactcattgtatcatcagtctcttttacgtccttctttttcttctccatctttcttatgccagaaacacattctcacttcaactatcctttatccctgccctgatgatgaatgacattttcctttcattaccagtttttccttattgtttacaatttacattccaaaccttagctttctacggaagattttcttagtctttcaaagtcacaggcttggaaaacaaacaagcaaacaaaaaacttgactgcttctctcagcactagaaatagtgataagtggttaaagtacatttttgttcataaacatcattttaaactgtctaattttttggcagaattattactctgacagtttctattctgcgtccttgtagcccacactgtaccttcaatcaaatggcttgtatccgacattaaatctcttgtagcacaatatcaagtaccatattgcaatcattaggaccacaaaagaaataactatcatcatattgaagaaaagatcccccagagaacaggtgcctttagcattggaaatgggaacttacatctcagtcaagtaccttttatctgtctccagaaggtggaattatctgacacattaagtatcttatttggatagcaaaggagtatgaaagttacttcctgaaataaaaatagaggaagatacacctcaagtcaaatcaccgttgtgatattcgtttaccagaattcaaattagatgacctgagtattttattgactacttctaaacctatggatcttcaaaaaaatcaatttcatattagactctagtttacactgcacaaaaattaaattaactttttaaaaaattaggataaacttagaatggatgacttcatttgtctgatttaaatctccattaacttctttctttaaatctgagcttgactggagctgtcattttttcaaaaatttactcatcttagttcaaaacttcttagttgggttaacaacgtttgtcatggcttttaaaacttaaagcttaaatgttaaatgtaataaatataaaaaaaattaatacccataatataatatcaaactttttcttgacaaattttctattattttaattttaactcaaaaatctttaaaggaaacagattatgtttgaaattatacttctcaataattgcactgaaatacagtttatttcctaggtaacaattccctaaaagtttttcattacatcataatgtgtttataacttcttgttagaaaaggtgtcagaccatattatgaaaaaatgtctggcacataaaagcagtgataataaaacagttaaaaatgtaagctaatgagtcatactaactatgctccaatcttatcttttctatctaccacctgagtgactttgggcagattcttaaactctctgtatatcagtgtccttattttaataatatttgcttataaaaggttattgggataattaaatgagctaatacaggtaaagtgcttagaacagtgctagacagagtggattgtacaaatatcatcactattgttattgtatagatatagctattattttataggataataattgctatattgtgctctatattactattttagtaggctctcagtaacaaattatggaataaatacttgcagataattatttgtactgaaatatttgaagttcaaatttttttacattgaaataaacagagcagtttaattaggaggtactgatatagattcataatcgcttttggtttttatccaagtcctctttccaaagatggctaagacatacagtggcctggcctaggcacaggagatcccttagggtaggggctgagtgaactgtgtctcttaccagactttgggttcagaacaaagagtcaaggatgggaagaggagaacaccaacatctgtaagtcagagaataaagccaccaaaggggaggcctggaagccaagcaactggagaatcagaaggaagaagggagaggagagaacaacgtacccagtaacaagccttaaattgttcccgggactcaccctgggcaaatgctattgcacgcagtgaccctcatgagatctgatttctgcatgcggaaaccatatttaaaatgcaggggactggacttggcagttaacacatttcttgtttctattcctactgcttagcctgcaccaagcataatcaatacttttattttaggctaagacacatactcaaaatgatataccctacctttaaaaaagaatggcatacatttacaaccacatgacaaaaaataaataaataaaaagcaactctctcagcagcacaaagataaaacaaatatttcaatttccctgtcatcaacatatgtatcagagtacagcaatgtgatacaattactaacagaaagatagaactagaagctacagtagacactgcatctaatgatgtttaggcccctaaaatattacttgggaagaagataaagaaacaaaaataacagagcaagttccaaatcaaaaagattgagctgtatctgaaaataaagcatctctagaaagtaatccttttcgtatttaattttttctaaagggagcatagggaattctagcttgatcctgctggcaacatgctgcatattcgtcttgtgcgagagaacacaatttgcataatgtgggacccagttctctgtgtgggaacacccttcagggaactcagaataagaagagccagcacttttgagctcagcatgaagggaatccacagcgcagacttcatttccctgtgacaggatttcccaaattgactgaagaaaatagattacattttctgggaggccccctggagaatgtttctgtttaagacacacacacacacacacacacacacacacacacacacacacacacgcgcacacacacaatatgtgtatatttatctatagttttgttggtggtgatatttaacaatgacagagtttcaacgaatttacatgaggatgacatgtaagagcatattttaatgcatttaagactttatcaatttttgctcaagggataatagaaaaaagcacctttaagtctttactgcttaaacctgtggcagaaataaattctaactacattatatgcatgaatacagcatatctgagtgcaaatcggttgtaaatagaaaatatttcagaagaggtcatatggctagaaaagtgctcagcttccaataaatattaccacaaaacacagaggcttgcaagaaatacacatttcaatattataagtagttattttttcagtaaaatatccacacaatttgaattcttactttagaaaatactctccttttacttttctctttttttagaattcatattgtttcttttaaaaacattataagaaactctctaagataagtgcatttctaactagaaatacaaaagattagattcacgtgtatactaggttattttttaaaatatggcaaaagcactatttaagacatagtattacacttcctttagataaactcatattactaaacactggtgaataataaacagcttctaagcattctcgcaaagatcaaatactaaggcaaaaactggcagaaacaacagacatagaactttctttttgttgttgctgccattgttattttacatgcattgaacgaatggccgagatctttggcgtcttacttactgatgggtagaggtaaccttctccattcatggctatatacaaccctgttttcactccctggatggcaacaacacgtagtcccactggtatgaggttgaagagtgctgtgaagataaacattgtctatcatgaatgggcaggaagaagcagggcagagtgtaattttttctttctgatttattttatttaagaaacatcatctttgccaatactttctagaaattccaattaaataacttatattttgctttataagtaagaagtttctgctatgggtaaaatgagtacttcagcttcaacctttaaatgtgagcagtcttgctgacagcattctgaagggctgatgcgacaataaacagaaccaagcctgtaatcgtgcctctagaaacactgtctctgacaccattagataccaaaagaaatcaactgtgaagtctctcaaagagcagaattttaaaagtccaagtcgagtgtttattctgacccttcgcacagaaggtgtgatttgtcattgcaatgaggtcaggccagaagttaaacaggtgattccaaaactaaatgacggtggtagaaccaatatgatacgccagcgaagccaggaaaagatgtgcacctgccaaggagctaaatttagaaagaactaatcaaaactgaatggcatgcaaatgtcagagaggctactcatttatgtttccatgttttgtttcttctctgttgataaaatgttaaaagcattttatatatttttgcatagtgcagatagcaacgttataacattaaaaaaacttaacatccctttaatgtatttccatggcagtgctgcatgttgaatgtttagtaggttttcttgcatcagtcttagagataactgcttgatgattttggagattttattatagatacatttgtaagagaactattaattatttacagtgaggttatctgctgctactcaagtccttcttaactaagtctaattctaagcaggacagaacaggaaatgaaagcactaaaatagtgatgtaagtgtaagtacagtatccaaactcaggctctcaactgtattgcacaaaaccaagtcatttgaaaaatgtgggcaatttggacttcattccaagggtctaagtagtacataattaaaaacaaactttacaaattgtgttatatttaattctcagggacatgtttcctcctaataggttgaagaaaattacaccctctcttctgattattacaagctactgttttcaagatcccaagatgtctgtgctacacaaatataaaaggaaaacctcaggccagagccatgaatattatccctggaaaaatactcaggggcatctatggttagttggatattagtttcactacgtaaactaatatcagattttctgctataggattttaggggattatgttattcttatgaaagaattagttttttttcctcatttccattatttaatattaaatatagatgtggagttgttgagtacagctacctgtgccatttggcgactctcagtattccttcttggtgggagatggctatattcactcttgtttagaacacctgaactgtaccatctccccttacatcttgaaagaatgggcaccatagaataattcctgatttatacacaaaattttggagggaaaaccataatcatatgactgtccacgcaaggtacactaacttaatcaattcaaatttaattattctaactttcctcttctaactttcacacactcagaatgatatttgtaggtgccacatattttatataggccaggtagtataattttagaaaacaaatagatcatgaattcaccaaaatgatgtggttatgggaaacataaaaattatataagatagtttaaaatgatcatactgaaaaaatactagtgtttttcccttgtgttttggttgggacctgaattataaaatacaaggtattggccgggcgtggtgttatcccagcacttcgggaagccgaggcgggtggatcacctgaggtcaggagttcgagaccagcctgaccaacatggtgaaacctcgtctctactaaaaatacaaaattagccaggcgtggtggggcatgcctgtaatcccagctactcaggaggctgaggcaggagaattgcttgaacctgggaggtgaaggttgcagtgagcctagatcacgccactgcactttagcctgggcaatgagcgaaactccatctcaaaaataaataaataaataaataaatacatacatacatacatacatacatacataaaacaaggtattataatttacagaatgatagtggaaagtgaatgcttatgtacactaaaatgtggagaaccattcagagctggccatgatggaaccggtactagttaaaaacacagatacccacattaattgagatataattttatttctccactctctttgcttcttacataattataaggcaatgtcacaaagcctaggggagtaagaataatggagatgtttttgtgactttgttcattcatggaacattctagttcttcatataacagtgattttcaactctggccgcacgttaaaactagctgtgttcataacatagaatggccaggctcaaccccatacctattaaatcacaatctttgggaacgggtttaggacataaggaatttttttgaaaagctcctcaaataaccctaatatacaactaaggacggtgagaactgccgtcctaaatcctgtggggtggtggccactgagtgatcgaaatattttacacatcaagttaccaggttgagcatttctaaggtgagagggacttttgaggttttaacattaccatagttaatagtgtattgatatctgtagagtcctattctgcttgtagtagctattgtctgtcagtaggaacaatgaagtttaagagcacagaaaaaatccatggcatccccaaaagcaaagtggggggaaagaaaactcacccactaataaagtaccgtagttcatggggatgctgacatttagaagaactttaaatgagagtggtaatgaggttacctaggtgctcacttccttttgtgaaagatctttccattattatggtagtcaataataaagcagttgacttgctacagtattttctccaccagaaccatttacccatcatccacaatttttgtgctacttttccttcccagagatctacatatattagactggaaacccttggagaacaggggcaccaacgtttgcctaccagtgggcctttttcccctcttcttaattcatctgaaatttttaacaaaggcagtttagcaggatggttctgtctttttttcattctaaatatccatatttagtgtgggaaatgtattgaactcaattcatgaagatacgaaagttcaagccctcaattttgttatttagtgactttaacagtgctatctgggtgagtttttggtttttttaaaattatttttgctagttatggataactaacccatggtttgtattcagggagtcataaaaaatggaaacatgtttatgaatgattattcataatgtttatgttcagtatgtttatgaatgattattcataaacatgtttccattttttataactccctgaatacaaaccatgggttggttattcataactaggaaactatatgattattacatcacctctgtcctcacaacaaaagagctgtactctaagtaggacctgacagcctttctaaagcacattcctatttttaaagaatttttcagtgcttacatttttcataagattcatgagactattgaaatgaactagagaaaagaaaatgtctttaaattcatcctaagaaacaccgttttgcaatttgcataggccagaggacataaaaatgaagttaattagtaatttccattacttttataaatctgctacgattctgccaattgtattaaattttatagtcatataatttgtagaaccttttgaggagggaatattgattttacccactgtttttctttatttctttgcaaatgttgaaatagtaacaaaactaaactaactggcttacagtgcacttgaaatgcaatataatgtctcagaaaagctgtggaccagaactttgcacaggaatttgagcccctcgagtgtgggcattatgattttcttctgatttgcttttacaaaggggatcctgtttcatctttcttctcaggactgtgtctcactagcatttagagtgtcagaagaaatttcaagattcgttctgagtttttgctccttctactgcagatacagaagaaaaaaaaaaaacatatatttacagaacagaaggtggagtgttttttagtatctcagctttccagtttagtctttaaaattattcagataaccagacctgtatgtgtgcacataataaatctgcacttccatatttagaaagtgcttattcaattctgaagcagtatgcttttaaaaggcaatgtctaatagacacttctcaaaataatattgattcctatcattaaaggtaaccaattttgttggctctgcaaaaattacacaaagaaaaaatgctagagaaaaaacacataaaacctttgtttgagtgaaattatttttcacgtagtccaataaagcaatatatttatgaagctatggtgtatgtcctgtcttgaaaacttttgtcataaaatggatggcatcagtctttagcctgatgaatctttcagagtgtcatagctcacctagtgatcagagttatgggaaactagttattacgttctaatcctcccaggccaaacaaaatgagagaacactgaagacatcagaaattatgaatcgctaaactttgtgacctacacaacagtaacacgtaagagaaaggaaatggtttttgtcaacaaatgggtaaagagtttaaggggaaaagaaactgagcagagatacatgtattagcctgaaccataagaaactgacatcttttgttggtcaaagattgtcaactaccaataatctttgaaagttcaaactaataacaaaagctgcaaaagtacatgtttggcataaaacgcctcctctttcttctgtagctgaattgttttaccttctcttttcctatatcaaaaaggaaataaactaaaaataaaccaataaacaaacataaaaaggaaaaatttaaaaataaaaaagagtgatatgagacacaaagagagtaaagagattagaaattgacacggaggacaatgtagatatacacaacaattaaaaaggaattgaagaaaaaataaaaagtgaagcaatgcacaaaatacaaaaagtgaacacgatggctggaaaaataatgatatttcacatggcaaaacgacatgtaaaaataacctattttgtatcgctaactactgccagaatcagtgttactggcaatttgatcactggaatttaaaaaaggaagtgctgaattttaaattgagctgataaaaataaataaaataaaaataaaaaaggaagtgccttctgatttgattatgtgtattattcaaaccctcacttcttttcatggaatgatgtttatatgtgaagaataagacatacattaatgaaaaaattcatatctatttttgatccaccgataatgtttcttatgattaagtatttctaataaaaatagttttgcttttcactaactcccccaaacagtaaaaagtgtgcttattttggaactaatatgctaaattaaaaatgaatcagatgccaatataaacagaaaatgggagagcaaaacacagacagttgagtaaggagaggcaccagacggagaaatgttatacataaagaaataggaaaaagaacacagacatttatacagtggaagatgtgtagctttttaattaaaaatgatcacagatgcaattctgcaaacactttgcacaatgaatttcaaagtacacaacctttatgtttttttctataagaaagttttttttgttaaatgcaaagaattttaaattatatttctattatgtaaaaaaacaaaacaaaactattccttgtagcttttgagtttccacaggcatcgttaagaacctcagagcctgataaaataatacatccaaagaaaacatgtaattaatttttacctaaatacactagtgtacttacttaacttttacaataataagattaaaagtaacagtaattttctgggtatgataactgtctgaataaaaaacaaaaatagtaacataatcatctttaaaccataggtttctttggttactccattaatattttcatccacgtagtttaaataaaattgtaaatggcatcctagtgtgtaacatttgtaaagatgaaccaacacgaccaaacatttgcaaatgaatcttaaaaagtcatttaagtagcagtgtatcttctaccaactatgtaactggtggcctgaggttgtcacttactagaattagtgctgtcatccttggttccatcgagagctccatcggggtgcatttgcaagtagtagccttgcctgcaatataacctggtcactatacccttgagctggggatctgaaaggcaaacatagttatcataagcctcacaatgtgtcaccatagtttcctttatcttttctgtttctctttcttttttcagaagaggacattttatacaagtagcatattttattttgtctctcagattcttctgtgttttatcaaacctgcagtattctatttatagaaggtaaaggaaatgcagtagtaagccacagaaacaggctgttttataaaactggtatatgcatatttaaattattaattaaaactattaaactaattaagctgtcagtttaattattagtttaaactataaacgaattattataaacaatattatcattcatgatggcaggacaagaattttgcaaactggtgactctcagaaattttattaaaaggttttttaatggagttctccttttacttaagttgacaagtattcccaaaattaaaaacaaacaaaacaaaaaatacctatattttaaaaacattcatactaacatatgatacatattcttaggaaaagccccaatttggagaaaacccctggatgtgtgaagggtcattgttacttccatggaagtatctgtgctgcttagacatattcacaggaaaacggaaaactctacttgtgagctcaggggaaacacagcaaacccacgcatatgaggtcagctctgaggcaatcaaatagagaaattagacaaattaaactgctaaactcattaacttgtataactaaaaaggacagtcaagttatacaatatgaaatctgattctttgtcaacgggcattgagatagagggcagtggaagtttatttaaacaaaaagggaaatcatgtggtaatagatcctcatttgatgattcattgaaaagacatccactctagtaatccagtgcttcacaaagagtcagttgtacctttgaaaacaaatatttgcatgtggttttgcaaaagccatccccatctcagggatagattggatgtgggacatcataatcttcaccatggcaactggcatctctccacaacagctgaatgggccatgctaatgcaatccgctgtcgaaacagtcggacgttactgagtaatgaaacctagcaccttataatcaatagaaaaattgtggtcttgcaaataggtgaagacaaaaaaatttttttgagagctatccttaagctctttattagtcctgaagaaattacaaagaatttcagtatctatttctatgcacatcatttaaaactgatcatttgagacgtgactccattgtacctagacttgcttcatagatggtataatattggaaaaatccttttggaaaataatgcacgaacagcagatcatcacaacatcagtgtgactagctgtattagaatatgaaagcttttaaaagagtaggattttaaaaataaatatctaagtgattattgcattgcgttacatatgttccttattctgtagtatataacttcccaaatcacataattctaagatatgcactagtggaaaaaaaatactattgtgcctaagtctgcccatcacctggaagacctgactgggctaagtactaaagacttcttccttagttttgctgtattttatttatgctcttcactgaaaatatgtagcatggaaaagaagcgaataaaagcaaaaagagttaaaaacatgaaaaagagaattttttattattctcttgtcaagaaaaaaaatgagaatattagtgatttacaatttttctgtaaaacttttatgttctgacatcacttattcctaagcagtctcctatttgagctactctgtcttctggagttgaattaactagatcaggcgaggcagtgagaagccacctacccacccactcacacgcgccctcatgcttatacagagagatttgggattatgcctcattttgggtgagggagcacaaataaaatgtaaaattatgtttttctcctttaacttcgagaaaatacaaccaaattgattttgattcatctggttacatattgtttgacgtttttcctttttagaaatcataacgccattgattctattcttctcaggtgccaggcattattagaagcacattctattattaactcttggatcctcaccattaccttacttaatagaagcccacttggaggatgaagaaatcgagacacagagcaattaagtagtaataatatgacaaagggtacataaccagtaagttaacagctggaatctgatcactcagctctggaccctgcccacttaactgctacctaatgcagcctgtacaagcggaataattgaactaaaatgtcttcaacactaaaaataaaatgcaaatcaaatctctttaaaaaaccaaaaccaacttgtattttgaagattaactgccactgtgtctaaacccaaatcctgctagccagagctgaatttgtgattacaaagcagtaacgcaaaggttagaaaggatcaaagatcttgaaaaacctcttctcagatccatctcacttttccattggccacatttccaatacatctctgccccattaaaaccttaccaaaattgctagttcagtactataagtttaaaacaaatgggttgctcaattccttttgatgcatcttccgcatctctcgctctttttctttttttctattttcactgccagcccctcattacctctcttaggtggtcttcccacctgcagttttccttttcaaatccttcatgtctggaaatatgcagtgactcttcaccatccactgagttacgtatgcaccttaccgcagtaaggccctatcttatctgatggctctgctcactatagcccttatccatcccctgcaagtagcctcacctgggtcactgtgggttacctataaatattccataatttcccacatctatcctgttcccttaaccttatctgtctcaaatatggccacctgcattaaaatgcccctttgcacatctgtgtaggcatgcacccacatgcacacacctttgcagagctgcctccttttcctcctccccactctggttctatcaacacgtccatttcctcaagagcactttcctgaaacttcagatgacatcaaattcttcctttggacaattttatggtaattttatggtatcataggtgaatgtgtagcaatttatgtgttcctggttaagtagatttataagttatattatctagtttacctaaagttagaatagtttagggggaaaaatcccatagagagaataaggattagaggtgatacgaataaaataagctaaaataaacacaaaacaaataacaaagatgagatttttcttttacatggattttgtggttaaaaacaagtatagaaactagtaacaaaaacaaatgatgatctattgaaatctaacatgaaattagccaaaagagtttgaaaatgtaaagacaatctgaaatatagttactaggataaaaaatgaaacttcatcctaaatgcacataccttcagatataaaagtgtggaaatattacatgtgtaagacaaacatgtattaatgtaatatgtaaaaatacatgtaatatgtaaaaaaatgctcatttttttcaataaactgatagaataagaaggcttgcatgatatttttctagtaaacgttaaatataaggcctacaagtatttttgttttaaatactgatgtatcccaaagtcttacaatacagattcccaatgaataattgaaaaataaatatctaaagtcctacacctatattttagctagccatgcaaaaatgcaaaatactttttaactcataaaattattagttctttattctcttctgaaacattcgtgttcagaatacctactctgcttaagaaaatataaaaacttagaatctcttctttgcctgtcttaattccccttttcctccagttttgtcttttattttctatttagtgtgcctgataattttactaaaaacgttttgaagatactccttgcacaaaactctgtgctaacaatgatctgtgatattaaaatagaaataatgaaaactaatgtgcatacatatcaagaaaaaaagatgtttcataatatattaccctcaacactcagaactgaaagaaatgcaaatcagtccgactgccttcagattcaggggaaaaatacacaacatttttaattaaaacactcattctcttagaaatgagttcaattaaattaaacaccgtcataaatggttttcatgcaatgggaagactggcgaaagaagaatcaggataaccaatcaaatggtgtacttattttaaattatgatttaaatggaaaaatgtacactatgacatatgtttttctgtagcaaatacattaatgtatatacatcatacgaactatgtttatatacacataaatctcagtactaattggttatcagtataggttcttaaacgtaagttctcttctattagctatggaaaaaatcacacatttttatagggtaaaaacaacttttgtaatgtacatttttgcagaaaaaaatgtggcagatctaattagattttggcactcccagtagcagaaaatagtatttgaataatttgcttaaagatatatattatcatataatccaaccacaaaaataaactgtgtccaggaacttttccaaaggactgagaaaataaaggtgggatagggacactaaggaaaatgatagataaaattaaaggcatgggaaaatttgctatctttgtttatcccttaagattacattgaatttcctttatggattgacccaatgctacctcgagaaccccttccctctaggaacctggttccagttacttcagagtgattacccaactcacggtcccattccaatgtactattatgtgtgttaaattttaacacttcttccacaggctagaatagctctccaccacttctctgcctatcagaatcctatgtctgcaggcactagagatagcatctggcattaacaacaaacaggccaggcacagtggctcacgcctgtaatcccagcactttgggaggctgaggtgggcagatcacctgagttcaggagttcgagaccagcctgaccaacatggagaaaccccatctctactaaaaatacaaaattagccgggcatggtggcacacgcttgtaatcccagctattctggaggctgaggcatgagaatcgcttgaacccgggaggcagagattgtggtgagctgagcgcaccattgcactctagcctgggcaacaagagcaaaactccatctcaaaaacaaactaacaacaacaaaaataaacaaatgaaaaacccaaacagctcttgccctcaaagagtttgctgtttattgaggagaggaaagaaactataatatggctttatatcaatcagccatgtgttaaattagcgggtttgcatgtctttctgctctgcaaataaatgataaatcccttgataatttgcatattactcaaaataacctaccacggtgcttgccacagaacagatgctcaaatagtatttattgaaccgaattcactttctgttttgtttttaaagtggctatatatctataaatggtttttgaggcaaaatgaattttttatattgtatttaagagttggagaaaagcatgcttgagctaaagataaatgtgggttttgaaacggaaacacaaataattttaagctttttaactactgtagctaaaacatttcctctaggtaaagtatattaagagaatgactatgggcaaagactttttctaggggaaaatgtttgaagagatcattaaagggaagggagactgtaagaatcctgcttaatacttgacccttatctccaaggaacagacttaacaggagtatcttgggattcctagcccagggttgaactctcactagctttttgaatatccagtgtatataaactacagaaggaaggaaatctttggaactcagaaaagcactctttccaacactattttctaatgaaattttctcattgcaaagttctaacatattagaaacacattggagctctcatggcccacacaatccagaaatggacaataaaatggccaaaatatcaaatctattgtcccaccttatttattcatcacatacaaagatgaataattgtatgataaaacatcgtgtgctttggcctactaatttattatttttaagttgtaattacatattttccaaattaaatcctaaatatcaattatgtaattgcaaaatacaatcagcaaaattcttgtgcatatttaagtaagaaaagaaagaaaagcacgtatcttttggtgataacatttgggatccaagtcaatccatcacttacaatcacatctagaaaaagctttcctgattctatattgtgccaggaattcctgatttgtgaatgatttcatttgctccttcccagaacacaagcgcaccagcaaagaagctgtatgctctgtctgaggtgctggtgtgtcgctcaagtgccggctgtggcactgacagatgtgggtgtgttactcatcttcagactccttgttaatatgtcaatgacaccaaacactaaaagacacttatggtactttcaggaacttttatgtatccttctattaacataaacattagtaaggactacactgccagctgagagagtacatatgtcccagattatgaagcaaagaggattttatgtaagttcttaaatgctattgtcatctaaagagggaaatatgagataattcagtttaattgttatctaaatactattctttttttaactgtagatacagtattatgttaaatttaatacacagatttaacatattcagctaaaacactacgcagaatgattcacttctcctttcggaaactagaaataggattccctaaatttaaagaatctgaagaaaaactgctgcttgattcattcacagaattttccacagccagttaaacctatagcagaccgtattaatttgttcttcagctgccattacattgtctgaaatacagaattagcatgacaaaaagtagatgttaaagaaccaaagacatctgtcgaaaaaaaaatgcatttttatgtaacaaaattcagaatcaaaagcctttcagggaaagttatattgcatcaggatattgcattaaccatgaaaacaagaattacaccagatgtgcagttttatctatttcttcagataaatagtagagcagtaaactgggaactttgtctgaaaaaaatatattttctgttttttttttttatacatttgctttagagccaggaagcatttctttaaatgttttatgttaaaaaaataagcagtgggtgaatttaagaaaataactgcacatggcaaggactgatctattcatcctccagagttgaggctcatatatttaagaagtaacattttggagcaagaatatcactcatcttgtctgttcatatctagaactatttagagacctccacctaatgggtagatagttggaaatgatagtgataaacactttaaagctacttccatttaaagaaaggtacaaacatctgagctctgttcccttctgagtttcttttccagacatttgtcttctagctgcttctgggaggagatgggagtgataaaattttttttttattaataatcctctctacagaatctcccaaacagcaagggaaggagaagaaaagaggcggcattcagagatacgatacctatgaatccaagtagacatctacacttttaaccagacaggaaaaacatttaaaccagatgttatgtacagaaagaaagaaaagaatactcctggaaatcagtgtgaaaatttcatgaaggatactgtagcatttgctcttgaattcagttgcaaccagttatatgcatctctaaaacccaaagtttctccttattttatcaccaggaagtgatgcctcttgaccatttttatttattaaggcttaaaattttagaaaggcagttcataacatcacccttaatcaatcttacagacacatctatctctagaattctgcaacacagccacagaaatacaacattttacattggaaaacaggaggagaaatcctttctatgttttgtttaagcatgttttcaaatgccaagatatttaacttgctcctttaggaggcatttactgtgaatctactttgttccaagcgttttgttaggagctgagaggaatttacaaccaaagcagattgctgtcaattgtccacatcatcattaaaccaatagcatgatgtgagtcctaaaacaatgaggctgtataaacagaaaggtaatatccagcgctaatgataacaatagtaagaataatagctatcatttcctgagcatacactttgggccagaaacgactctaagtgctcttcttaaaaatactaactcatttaatatgcatagcgactttttgagctaggtagcattattatcctcactttaaagataagaaaatgaggccaggtatggtggctcacacctgtaatcccagcactttgggaggcagaggctggcggatcacctgaggtcaggagttcaacaccagcttggcctacatggtgaaactccatctctactataaatgcaaaaattagccgggtgtggtggcatgtgcctgtaatcccagctactctggaggctgaagcaggagaatcaattgaacctgggaggcggaggttgcagtgagcccagatcgcaccactgcactccagcctgggcaacagagtaagactccatctcaaaaaaaaaaaaaaaaaaaaaaaaagacaaggaaatggaggcagagagtcactatatgatgtgtgcaagagcaacacaaaaaggaaatgatggcgtgaatgtgaaagcctctgtgatctggcctctcacgctgcccaggtaccactcagctgtgctctaggtggacatcccagtgttctcagaccacccctgatacaaacacacagtgaaggggcactgacagatgagaggagagtgacagacagggtgggcctggggaaaaccgtgtaagaaaatgtttaatctgaagatgatgacatgtcattttcaacaatttgtggggctgtcacaaaaacagggaatggaatgatttagttttgcctcagaagacagaattaggacaaataagtagagtgacaccaagatggaacataaataagggcagtggttgctgtccctttggtcactgctagattccaggtgcctagaacagagcctgtcatatagtaggtgctcaataaatacatcattaatatatgaataaatacatccaaaaggacaatgaaatgtccaatactcctagctatcctgtgtaagaatcaactctcccacaaagtaatgcattccctgtcgctgaaagtgttcaagcagttggatggtcatttgctacaggaactgggaagggaattgctgctttgaaaaaaatcttgagaaaaaaagcataccttatttaaacggtggaaatgtattatcatttaaaaagcactagtttaggatccctgtctccctgcctaatcttgaccaaacacacacacagacacatacatacacacacacacacacacacacacagagtaaagtatggcaaacgctgcccctttcttcttaggggcttgactatgaataattagtaagtgaggaagggtggacatgagtgaaggaatggagaggagaaaaggaaacagtttcttataaaattgttaaaagaaaacagacagaccttgcttattagagcaaaagtttaaaaacatggaaacctattgcagtcaaaagtttgagaatgttttgatacttcataaagcaaactgtgagatgtggagttgcacgcagtccagggctattttagaggtagtttgagctggaagaacatttgcactagagcatggattcaactttcttttcatattttttgcatttcagttgttttctttcaattttaatttgactctatttcacaaatatagttacatagtcatagtgtcctaatttaacaagcaatcccactgtgtggacatgttttcagggtggagggtgggagggaggaagagaaagaggcgaggtgattcagaaacagatcctctttccactttcccccgactctcccaaatgtacatttaagtccttcactttaattggatttatggtttgtagctttggcatcagagccatacttttaatttctaaaaaaagaaaatgctgggaaaggcactactcagcgcacattttggcacactcctttcgaatggcataggtagccactgaattccttatccctaggggttctatatttttacattcatgcttcttgctcagtacatgaagtttccctttacccaaaagcctttttttgtgtgtgtaactgatgtggcacaggcctctgaaaaaaaaaaaaaaaactgcagggtcctggagaaccataggccagagaaacctggagctgcaaagaaggacaagatctggaaggtttgcagctagccctcaatgaaccaggtttcaagtgaatgccatgaggaaactgaaagtcaaaactttaaaataccacactcaggaacaccacctaactatcatattcccatgcctgtttttggtttcctttaattttatagtacagctttgcaggggatagaaaacctaatatttcaaaccagttttaaaatttcaggttaatgcttcaggacatgtttgtgaaaaccaaacaaaaactcctcctttaatttcagctctatgaaaagacagtgttaagatccaaatctactaggaagtttaaggtattttcttccttaaaacatttacagctttatgtggccatcaggttggattatatggaaaacagctcagcatcaaaaaacactttatagtaatttatatgatgtcactggccaaggaagatgatcatcctttagaagtaactataaaaatgcttgctatgaagaacaagctagaggcatcacactgcctgacttcaaaatatactacaaagccatagtaactaacactgcatgatactggcataaaaacagacacatagaccaatggaacagaatagagagcccagaaatgaatccacacatttttgttcacaaactcatttttgacaaaggcaccaagaaaacacttggggaaaaggacactttctttaataagcagtgctaggaagactggatatccatatgcaaaaccatagatccccatctctcactatattaaaaaatcaactgaaaatgtattaaagatttaaatgtaatacgtaagacctgaaactttaaaactaccagaagaaatcattaaagaatttctcaggacattggtctgagcaagaattttggggttaagacctcaaaagtgtaagcaagaaaagcaaatatagataaatgggattatatcaagctgacaaacttttgcacagcagaggaagccaccaacagaatggagacacaacctacagaatgagaaaatatttgccaactatctatctaacaagggattaataaccagaatatataagaaacttgaacaattcaacaacaacaaaataacaaaccccatttaaaaatggacaaagatctgaatagacattcttgaaagaagacatacaaatagccaacagttatatttttaaaatgttcagcatcactaatcaccagaaaaatgcaaatcaaagccacaatgagatactatctcaccccagttgacatggctataatcaaaatgaggaaaataacatatgccggggaggatgcagagaaaggggaaccctcatatgctttttggtgggaaagtaaattagtacagccactatggaaaacagtatggaggtttctcaaaaaataaaaaagggaactatcatatgatccagcaatcccactgctgggtatatgaaaaaaaagtctgtgctctcatgtttgttgtatcactcttcacaattgccagaatatgggggtcaatgtccatcaatggatgaatggacaaagaaaatgtgatgtaaatatatttcatatatatgtgtgtatatatatatatatatacacacacacacacatacacacatgcacatatataatggaatttatataatatacaatgaaatattattcagccatacaaatgagtgaaatcccttcatttgcagcaacatggatggaactggaggaccttatgttaagtgaaataaggcacagaaagacagatatctcatattcttgtgggagctaaaatagttgatctcacggagatagcagaatggtggtttgcaggggctgggaaggagtaggggtaaataatgaagaaaggttgtttaatgggcacaaaaatacagttaaatagaaggaataaggtccagtatttgatagcacattagggtgactatagttagcaataatttattgtacatttcaaaatagtaggaagaaagatttggaatgttccccacacaaagaaatgataaatgtttgaggcaatggatatcctagttaccctgatttgatcattacacattgtagttatgtatctaaatatcacatgccccagaaatatgcacaatctttatgtatcaaaaaattaacaataaaaatgcttgctatagatacaaattgttaacatctggtcattttaatccaggtggttagtggaaagctttggagagaaagtgagatgaaattgagtcagagatggccaagatgtggatgatggaatgaagtacctttttcaggtaaggagatgtcctcctgggaggaagtccaaagtattttttgaagacagatgggtttggaggctttggggataacagtaggtgaggctgatggcagtctgcaggcagctctgggcacgcatgaaactcaagctaaaagtctgcacactgaacatcagagaaatagtaaacatattttctcagctttttctcaagaagtgacccatcggagtcacattttagagaacactgggaactgctggtagcggtaacctattcttcactcaatagatgattggtaaaataaatgttaaaattttaacctgaaaaagtactggactgtatttctaaatttctaattctgaaatgttaagcttttctgtggagaatggtagcattttctgtgtgcatatacatacacataaatatatacatgaatgtgtgtgtgtgtgtaaaatttaaagcttgtgctcaagaattgggaggctttttaaaaaattatgtgactttaggtaattcaatatgattcctactgacatttccacatggggttaatttaaataatttttaatcaagcttactctgttgccttatgatggaggatatataacaagatcattagtagacaatagcaaagctttaaatccctgtcaacatttttctgaaatgtgttcatgcagttaaataaatgagcatctccctgatcaactcaaaggcagacaactgtaaaggaccacatgtcttcaagattaccttctgatatagagcacaacaaaacacttcttcaaagatatagttcttcttacttgtgtctaatggtgtgaaagcatcaaagggagtattattaaatgaattgtgtccccctaaaactcatatgttgaagtcttaaccagaatgaactacatttgcagacagagcccttaaagacataattaagttaaaatgaggtcattaggttgggccttagtccaataggtctggtatccttatggaagaggagattaggacctcagacaactacaggtaaaagaccacaggtagacccagggcgaagacagcatctacaagccaaggagagaggcctcaggagaaatcaagcatgccagtgccttgatcttgaccttgcagctttcagaactgtgagaaacacatttctgttattgaagccaccaagtctatgatactttgttaaggtagccccagcagactaatagaggaattgccatttaaaaaaaataaagttcaactgccacgttcaccgatttagagacaaaaccgccttcacttcagaggactatgtagctaactatgagaaaaatctgagttgtagcacccggctcccaggatagtttttgccttttctcattcactaaagtatttgaagaaaggaatttgatattcactttctgtctcaacatttaagtactatgatatgttttctagatttttaagtttaatggaattgtagagctattttatggccctgattttactcatgtgaaatataaataaatgaaaaaaaataaccagacatatttataaacccacgtctgaagaaatccatccatctccacattgggaaatagactgcaaaccactcatcaagcaaaacgtcaagctgatgttttgtcagataaaagaaagagcaagggaacttcacgatgtactttttaacccagaaacttctaacatacattatttccatctgaaacctaccccatgcaatacatgaagaaaatctgcatctgagaacgtgcatcatctgcttagtattgtctggttaatgagagagagttgattccaacctctacatgtttcaggctctgagagtgctttgcagtgctacttagcctatgctcatgcatttttatcatattcatctttattcaaatgatttcctatgactctacacctgtcaaaacactgccctatatcaaggcttagcttaaatatccccatttatgaaatagtttctaatctctcctgtcaagaaccagtctttgtgttccctaattatgatattgtaccaaaccatctttgctgagttctaaaattcagttcctttaaacaatacaaaagcaaaaacaaaacaaaacaaaacaaaagacatagctcctttagactaaaaagtgtaatagttcagttctgatataatttttaacttatgcgagggcttcagtactagataggaacaactgcttttctgcatatttcagagccttgctgaggaggtttgggtgcttttgtctcatgactttctttctttcttaagcagtccacacctgtagcacacctctaagtttaataagtgaaaagcatttcctgtcttacctgaaaaaaaaaacacattgttcttggaaaacggactaacgctgactgcccaggacttgtaaaaacctttctgtctgctttgctctgcagtgtgccagggagaaccatttggggacctctgttcctctaagtccctccaggaaaatgaaatctatagctcctaaggtcatcccagaaaggcagaactttaaataaaaatcctcagatctcggcaagaacagcagaaaataggttacaacaatatggggtgtatccacaatgctctactctcacacaacctccatgtgggaacaaaatgtttcccagtcaaggaacagaatttacgcttctgtacgttcatggaagcagacaggtcaaggggtcctgtagctgcgcattaccttggtgatgccacacacagcaagatgtccaggcccagagccacgtgtacttctgcctgccttgctcagacatctgcagcactgactccggataagacgggattgggggtggaggaggaaagaacttgaagtaggggcaaaggtggagccagttaccctctcaccagctccctgagttggataaggtgccttacctttcaagagccttttttttttcttattgataagaagacaaggggaataatgtctaccccatcaaggtaggatcaccaagatccagtggatggtggtttcagaactgttatctggcccttagtacaggctaagccgaggttaaaactttttcttcttttgctatttattttcactgtaccttttacaggaaattaagtttgaattcataattcacatcttttgtgaaactggcaaccataatacagagaggtgagtattttgtgtgaggagacccactaccctttgctttgtacctcttcttctataatagcccctgtagtctagttaccttgctccaaatgcctgggccctcacatcacattggccttccctgtctccagttgtgaggaatataacccaattccagatgtgccctctggagatgggccctttgctctcagcgttcagatagtgccatcccagaatactttatagccaccaccttgcaaaaagcaacctaatgcctagtagtaatacaagaatgcatccttctctttctggtcctcatagtctgctctgtatcttcccatatgcagtcaccatgctggttgtaataacaacagtaataagaatgacagccatcatttagccattattcactgtgtcaaacacactactaagaattttataaacattaattgacatcatcctttgaaaaccatgcaaatctattattaatgcactaattttatttatgtaaatacacaaatctatatatgtatttctatatatatacatacatacatatacaaatatacatatgtatacacacacatatataaatatacatataaaattagaaacttaacccaatcagaaatttaacaatgttcacacagttagaaagttgtaaatctaggtttttgatccaagctgctgaatgtagtagtaaataatcacacagttttaatttattccaccaatcacagagagaacttctgatacatgcttcagatggagaatatcagaaatagagaaagaagttgagaggtgagagctctataaataaatacagagaatgagagtgtgcatgttagaggtacgaagatgtgacatagcaaaaaacaagaaaagctatccaattacttggcagacttacaggagaactgataagattaccaatagctaattttcaagatgtctagagtttgcatagcaaggaaaataaaataatagggaattgaacacaacacaatccaaagatgcaaaagaagcatcttttcaattttttttgattatttaaaaatgtgtcccttatctaaactcttaattttcccctaaggaaaagtgccttatattacctaaaaaatttttgttatgaagatttccatgtaggttcccactgtacattctttgaaaagtgttttagaaacaaacaaaaaaataggcctcatccttattgtttaccatttagccacatatattatttgggcatcagaaaggcctagtaaaagctaattaagatcaaaacattcttaacttgataattcttttaacagcagagaggaaatccctgggccttgtaattacatgggccattgaacatgtgaagtaaaaggaattaagcttgttatgactcactaccacgtccccaaaataccccaaacccagtgttatatggctaaagggaaaatgaatttgcagagaacaaggaggtagtttgtcccatattcatcctaaaatctccaggaacaaaatctaacatttgacagtaggctggtctccccatagtgtgctgggaaaacagtggggttcagttgccaattagctatgtggtttaatgtaagtcatagcctcttgaatttctctgaaaggtggacataaccatatctggccaaataacagcacaggatgctgtatgaatctcaaatgttattttagataagaaagtagcatcaccacggaatgaggatggaaaagatggccaagtgtccaaatcttgggaggtctgttaattatacaaaaaatgaattgcatcctaagaatatttgaggtcagtagattaaagcaggcagtggcaagatcatacgtagacaggtgaactatcactctggtcactggatgttgggtatgatgcatgcagttaagatgccatacccatgaccctgcagtagatgccagatcctttctcagaggctggacagtgacaaggacttaattgtgagagtaatgtgggaggcaggatggtaggattttaatagaggcttgttctctgcgtgggctgcctgctattgaaagccagtctctgcatcttttcaaatggctagttcctattcaccctgtcatcacctctctgtccatgattgcctctggcaggtttttcctgctcctgcaccttgagctgcatgaagtcagcctgggttgtaccatcacaatattctgcagccaagtgctgctatggcattaaccatgatgtattgtgattatgtgtccatgtgattgctttgctgtggtggagagaacaatggctccctgaaagcacctacattcttatacctgaagtgtgtgactgtgttacatgacatggcaaaagggcctttgcatacaagattaagttagggactgtggcatggtgagattatcctggattatttgggtgtgtccagtgtaataacagggtccttaaaaggagagtggaaggcagaggtgactattaagtaattatcagaaaaatgcaacattgttgaccttgaagttcaaggaaagtgccacgtgataaggaatgtagatggcctctagaaatggaagaaggcaaagaaatggattcttttctacagcttccaaaaaggatcagagccctactgacaagtcaattttagcctggcgagatccacgtcagaattttagcccacagaactataagataatcagtttatgttctttcaagccattaagtttgtaatgacttattgttacagcagtgagaaaccaatacacctgacaagattcttagcatctcatggggagggtctgtgttttctttgactcccagaggcatcataaggcaggtcctctgtgttagtgaaagtgctttcactaaacacaacagctcaacccaacctttcctggcttttttttttttcacactttttatcttgcagagatatggaaagatatttaagaaagagtgacaataatatcaggcttcttttgcatttggaatagccctttagagttttaaaggtgatttcatataccttaactcatttgagatttaacaactcctgctaagattggattgtatctacattatgattaaaataacttacaaatatacaaatatggaagagaagatagaaaaatgaaaatggttaggtgagagaaaaggtaaagctttaaattcacctttgtgtgattattgtcatgatactttatttagcttgctggtgcttctaattgaagaaacaccacctgtataggccatagacataaaatattagcagtagatagcatctcaggaattatctattagtccaatgaactcccccagtcagggcaactgactgagacttatccttgtcctaagtacaaagaagcagtctcagaaacacaaagtcctgccccacacccagcgctacagctgcgaagttgacaaagaaatttccgctcccattttaacctactatttctgccaagaggctctttatagcatgttatattgcttaacatatacccactgacagatttcattggtaactaatgtagagtgagcattagatgtgaaactgagcttctctagcttcctatcatggtttgggacatataataagattttcctttactgtaagattaaagaaaaaaaggagggaaggtgaggagaaatctacttagtagcaatggtgtcagtaattgaaactgacaaagatattgttgctctttattagtcaccttcaactttgcctttccagcacaatttgcatttgcatcgagaagcatagcatggaaaaagaaaaaaaatattaattctactgtaaccttagacaacaaaataaaatagatgaaaacattttttgccctcatttaagaatcacataaagaatattagttcatccaatatggagacatgtttcaaatcattaaatctggaactcttaaattatttgctgaatatatcctcagtaattcaacttttgaaattctgttaatattaatatccatctctggacttccttaaataaaggtttaagtgtacatccttttcttgtcatgttaatgtgggtatatgcttcagagatcttacctaagtcattaaattcctaatgactgtttgggaaagatcattttacaaggtatattaagtaacatttttaaagaaatcattggattttcaacagtttctgaagtttgataatgtaattttcttacaaatgcctttagtcctttataagtataaagtaaggatgtcaatttcagtatataaatccaggcaaagcataaagaaatactttatgtatttcatctccattcctccagttacttcctacttctgttcattcattcaaagttaattttgcacaataaaaatacttgttcttattctagacatgaatgtaacatgttgtctcacactaagtaaagaatcactcaaaatcttaagacctttaaaaaccaagtgaaagatgattactctcatcagaagggtcactgaagtgcaaacatacctgcccgagagaagtaactttaaaaaggtaaaacgtaagaaaagaatgcatcaatttgcaatgaatcaactttctatactttgcattaggaagttaaaaagggaacatctgttgtttgctatttagagacaaaaatgaaaggagagatttgtgagagttatatggagtgcctagaaatattctataacaaaaatgctccagtgattctcacgtattttttttacgtaagtactttcaatggtagaggaaagtaaatggtcacgtttcctggtgagcctgagggatggagtctcaaagcatctggtaatcaggaatttctttggaatcttgtattctacttgaatatcctaacaattataatctactaaatacctgtttggtttgatatcaagtattttaaattacttaaccataattaaaattgatactgcacaaagatatacctatgggttctcatacccatgtactgcttggttctccaagggtattcatacccatttgcaaagtttgctagctagcagaaacctcccttccctttctttttactattaaggtggggcaatagcagtgcctgaatatttttctcattttgtgttcatatcatcaagtcagtatcaaataaatatcttgcctttttcttgccccaaatcaacgcttcccataccaccaaggacagtttcagatgatggcactcacactaaggtgctgtggcttttgcattgcgtttgcctgaactccatagctccctcttctatgccccccactctgtacatttcacctctcacctaccatcactccctggctattagatcactcctcagcaagcctatgggtcatatccgcagactttgtgttctaatattcagattttctcatagtgtgactccaactccgcaatggagaaaaacataatgagaggcagcaaaaggctccaaaaagaaaacattaatgcttttaacagcggggaatctgagtggaaaggaaatcccttctttcctgtcacttagggatgaaggaagagttgaaaaatataatagatcctttcctacagcctcagataagcaattttttggagggcatatgtgtacctacatgcacgcaggcagacatgtatatctgtgtgtgtgctttatctacaatgatgcaatgctgcatcaacagtaatcaataaaaccaattaggagagttatttctcatcaggctctgacaatgactcaccatgagaccataataggggatttcacagttttgggccttatctatgttttggggtaactttatctataaaataagatgactgaactgataatcattgaaactgcttctaggcaagacataagaaaatatactagagacaaataaggataagaaagatggaagtaagtaacaaataacttctatctttttctcccaattcacatttccaaactgatttatatcattattcctggaaatgaaattagaaacatggtatgctaggatatatattattatgtgtacaggagaagaaaagggttctgatccatagacatgtggaaagatttacctaggtcctgggtttgccccgctcaccatatgtgcctagagtgtgacaactcacaaatgctctcacatgcattatctcattcaagttttacttgtgagttaagcagaatagatagaattataaacttagttgagaaataaggatattaagattagagcagccgagtcacttattcaaaagcacacaggtctaatgtggaagagctctgcaaatagaggtctatttggggtgtggccaaagctggcagcagcatcacaatgaaccacaggcttcagagaagaatactcagatttcttgtcagggctactccagtctttgcagggtgcttatgagtaagaatacacctgttgcccagagttatagcagcctggagtaagagatatgctgtttccaacctctcttgtgaactttaagagctaagtcataattagatcccacacaaatctttattagagactttttcaggtaagctcataggtttttaacattctggaaggtggtttgataatctacaactttgttgctgccaggaaataaacttggaaagtgaaagaataacccaatttttacaacaaaaatactagtagtattagtagcataggttgagcattcctaatttaaaaatctgaaataaaaaatgctccaaaatctgaaacttcttgaacactgacatgatgttcaatggttatgctcaaagtaaatgttcattgaagcctttaggatttttaatttattttattttttattttttggagacagagtcttactctgttgcccaggctggagtgcagtggtgcagtctcggcttactgcaaactctgcctcccgggttcaagtgatcctcccatctcagcctccttagtagctgggaccacaggtgtgtgccaccacgtccagataatgtttgtatttttagtagagacaagttttcatcatgttggccaggctggtattgaactcctgacctcaagtgatccacctgcctcagcctcccaaaatattgggattacaggcatgagccatggcaccttgagttttctatttttagatgagggatcttcaaacagtaagaatagtgcaaatattcaaaaatattttaaaaatctgaaatctgaaacacttttggtcctaagcatttcacacaagagatactcaacctgtataaaggcatgaaacatacaacacacacacacacacacacacacacacacacacatatccccagaaatgagtattgacagaaatacccatctccgtcacagattttattaaaacttagagtggaatatggatttactcagtgggtaatgttctgaaagatcaaatcaaataaaaagctagtcaatatttttcttccaaaaaattcaaagaatttacatacaaatttggtgctgaagacttggtcatgagctttatataagaaaaacatcctctctatttttgtcaagatatttgatagtctttctatatttaagaagtagggacccaaaatggaaataatatttcctaatagccagtttctctaagaattatgacttaaaattttcacttctagttataaccaactatcaagcataagaccaacactcctaccatatgtgaaagctagatatttttaaaaacaagaagagaaaagaaagaaaattggttgatggcactggagagcttccaaggcaaccaggagttaaggggccaacattttggaagaaaggaaaacatatggagatgagcactgtgttgtacattactctttctctcaagaatttgctgcttcaaaagtggaggaaggcaaaaagctgagaatcagagcaaagcttttggcaatccacaatgctaaggagacaaaaattagagttcaaggcttgccaataaagagtagccttggtaaacatccaggttttcagttggagcccctataaactatacgttagccaaaaatcaaactagaaatagacaagctagcacacacatatatgtgaaagccaatttcaaatatatttcatactacagtaaactggaatcttctgccccaactgtaataaaaagaaaaaaaatcctcctcaaagacgataaaatcatagcttctatagttttctttctaaaatgtccaacactcaattaaaactactgaaattgccaaagataccaaagggaacaattaaaaaaataaatacatataggagttaacagacacagattttaaaataactataattaatatatttaagaaaatcaagtaaatgatggagatataaccaaagaactgaattaatcaaatggaagttttaaaactggaaaaaaatataatactggaaaggtaaattcaatggatgagttcaatagcaagagaagaataaataattttaaaatgttttaattgaaaatagccaccctaaagcaaagaacataaaaaatgtataaaatctaaaaaagggagtaaaaacatgtgggacattatgataaagaccaaagaaagctggtgttattatactatagcaaataaaaagtaaacatgaaagtgaaaagcaatatattctgatataaggatatatctaccagtaagatataataatgttatattagcctataaagaatgaaggcaaaaactgacaggtctggaggaaatatagaaaaattcacaatcataatgggagatatttaatgcagtttgcttcagtaactgataaaaatggagaaaagaaagtaaattaaaaaataaaaatttgaactacaaaatcagtagacttaatgtaattgtcatacagagaatattgcacctggctacaaaataaaacatacattttgttttcaatttgctattttatttgttctctgattatggtagatttagtctagaaatttagtaattttttgttataaaaagataaccagacaattgttaaatattttgaaattaaacaagcacttctaaataatcctaagtgaaagaaatcacagaataagaaaatattttactaagtgaaaattaaaatataacagagagctactttttagtgtagctaaagccatgactacaggtaaatttaccattttccatgaatgtttaaattcttcaatggcttaaaatcaacaagcttacaatttatacttgcacaaagttaaaagaacgcaaatttaacctaaaggaattaaaaacaaataataaaattaagaagaaattttaatacaaaaaaattacaataggaaaaatcagctaagccaaaagtcacttctttgaaaaagactaaataaaatttaatacacccaaacgaaactgcatgagataaaagagaaaaggtacaagtcgtcaatctcaaaaaaagggggacttcactacagattttatgaactactagcagagataacatgaatgaacctgcaaatacaatattaggtaaaagaagccagacacaataaagtacatgctgcataacatcattgatatatagttttttcaagtaggcaagactaatatattgtgttagaagtcaagagagtggctgcttttagttttcattgattggaaaagcacatgaggagcgtttcttgggggccgggtagtgctctattcttgatccgcatggtcttcacacaagtgtatttattcactctgtaaaaattaattaagttgtgtatgatttgtggacttcttttaatgtgcatgttatatctcaataatatttattttgaaagtgaaagagcattttgaatgtaaaaactgctatatttatgaaatagaattaaatgacctccatatcatcttcaatatataggttatttaataaatctgcccaagtgctctactctaggaattttgtgtatcttcaactttagtcttgcttgagaaatactgaaaggattttctcatcaaaataaaagaaatgccttttagaggagaaataaaagctaggaatggacagaaagaggattataatttttcccacaggttgggaagaacatttattctgttaggttgtctcctggattttatggtgtttcaaattttatgaaacaagaaaatataaagaaagtctttctgaaaaaaaaaatatggtggaattcctattattgaaatagcaacatttgcgagaaagggatgggagaagatgaactaaagccataattcttgatgtctccctcccacttcccaagtagtgacttccaaatctgatttcttgcaactagccctctgtccatttttcttatttgttatcaaagagaccccaagtgaagagggagtcatatcaaaatggggaattcagatgggatgcggtggctcatgcctgcaatcccagtactttgggaggccggggcgggtgggtcacctgaggtcaggagttcaagaccagcctggacaacatggtgaaactctgtctgtactaaaaatacaaaaatcagctagaggttatggtgtgcacctgtaaccccagctgcacaggaggctgaggtgggagaattacttgaaccccagaagtggaggttgcagtgagccgagatcgcaccactgcactccagcctgggggacagagcaagactctgtctcaaaaaacaaacaaataaacaacccaaaaaacccaactaatcaaacaaacagatacgcgaggagtttgtgcagaagaaatagaaaagtactactactaccatagattatatgacccaggaaaaattacttaacatctgtcagtttccattctttcgtttgaaaaataaagagaatattatctactttaaagggttttttaagctttactgagacataattaacatacaaaaatgcaattcattttgatgagtttggacatattcatatacttgtgataccatcaccacatcaaagtttttgtgaagttcaatgcagataatgatgaagtttgatgagctaagatattggttgctttatttttacttgaaaccataggaatatctcagttttatcaatttagcaacattcttagattattcaaaacaaaaagtgcttaaagaggaccatatacttagagccactctgagatgagaatatatacaagagtaggcaaggtcccccatcccaagaattctggcacctacattttagaggtttatcgctcccttttttttattatattattattttctgtccttatgctctttctctttctttttttaagcttcttggcttttcttgtgtctatctaaggttctttacagtgtccagaggtatttaaatgaaagaggctcatacgtttcttaacaacaaacccaagagacaaatacccaatatttgtgtgtgttatatagtttcttaattggaactttaaataccatgccaatatatgcagtttacagcccaccccatttttcctcatgaaacaagatgcttgcagccaatagtgatgcagccaatattgataccaagccactattaactcatatgtttaatcaaaccatctgtgtgtaatacaatctaaatgaaatcaccttaaatgcaagcgccagtaagtgcagaataactaacttcctgaagccataaagcaattctcttgacttataattattttcttcacttgcaaaattactatttactgagagttttatcaagggatgtctttcctgctcaaaatcctgtcatggttttgagaatctgaaatttcactggctgactgctaatcagaaacacattagtctagccttctttcaaaggaggcacttttaataaaaatctaatagctttagttctatgtttgaataatgcaacttattaaaattgagaacctcacttatttagtgcttctctctctcttccaaagaaagccagctgatactgttatctcaaactggttagtatccagtggtctcagttttctagttcatccaatgttgccatctagatcagcttgccagttttctggggttttttgtttgtttgtatattgctcttttccaatgaattctagtggctatttagaagcatgcatgctgttgctgaggaatatgttcaatattatctaccagaacttcagactgaagatctgaaattcctgtgaggcaatttgacattcatttaagttacagatcagagttgtggagactctaattgtggtgtgtgtgtgtgtgtgtgtgtggtcattcatgttagttagacctcttttcctaggcttgtcattatttccatatttcctcattgaagctttattctctttaaatgggttttaactttgcacctagtgtgactgctgttatgtacacaagctgtaatttttaaaaataattctgtacagattcgaaccctagaagaaaataatgagacttgttaagataaaacaaataaaagtgtctggaagaatcgagttctataaatactgggaggcattaaacagacttttagtggagacttgggtaggctttttttttcctgtctctatattcaaatctgtgaatacaggagaattgtagcttttatatgcctaaatatagagcagggtgactatagggaaggagggagggctgtgtgccacaaatatacagaatctatagaatatacaaagatgattaaccaactattttcaggctgcatttaatgagcagctaacaggaagcatggagtctaagccaaccctaaagaaagggggtaaggcagagacagggagacaggcactgaacatagactgtcagcatctagaggacagtcctgttctccagagggccttttgtgtttgtttgcttgtttgtatgagtgtacggagtacaggtgcaattttgttacaggcatagattgcatagtgttgaagtcatggataccttaagtatccatcctacaaattaaaaccacaatgtaggtggccttctaatgtaacatataattgctctggcaaaggaatacactactgtctcaatgttctaagatctaattcatgagggactctacacagcgtgcaaaagaagaactgaaagctgagaggcatctatcaaattgtcttgttcaatgggttcattgcatagaggtctctgcgtgttaacagacctgcccaagttttccagccagtttgtgggagcacaaggcccagtgtgtctacctccagggctttaccagcaccgaccacaccatgaagagtggcagttttttgtggacctttgggctctagtaaggatagtggtaaataatactgatggaaatgtgtgagacaaaatgcaggtgaaatttggggtattttcttatattcaggttttaagaaaaaaaaaatcaacaggcctatctctggagatgccaatgagaatgttgcagaaaatttaaaaaagagaaggaatagcagtgtgaggctagtcaattatgatgacaccagttattgctaaaaaatggatattgcaaagtgctgtttccttttttaaaaagtgaacaaatagaaagacttagcttgtaaacgaatgttcctggggagattctgctggagaattcattataactactaccatagggcaaaagcaaaactcacaaagacacaaacattgtacctttacctttaggttagcctgatttgttagtatagaaagttgcaaaaagtacttaacagtgtaatatgcatctcagtttcacttgactatacaaccatgcagaaagtaaaaatgataacatttatgggagtgtttggacactaagggcatttctaatgataaaaaatgtgtcagttcagcagcagtagcatgggaacaggaaacctttgctcatgagtgccatattcttgaaactttagcaacttttgcaacttttacaattttccaaaatgcaaaggcattgggatgcagaaaacaaaagttggtcaaacatgaaatacttgaaatcttgtaggaaaacttcaatcttgcttcaccctctttagtggcttactccaaaaggaaagtctaagagatgatggaacagacgtgtctgaactctgctgtcctgtataacttttaaaactattgtcccatgcattgaacagaaaggagtggaggcagatctggagaaggctcttttctgcagggtggccatcatttgtaacattactgtcccagcagtttctgcatcatgttctctcagaggattataaattattctactataaagacacacgcacatgtatgtttattgcagcactattcacaacagcaaagacttggaacctacccaaatgtccatcaatgatagattggataaagaaaatgtggcacatatacgccatgggatactatgcagacataaaaaaggatgagttcatgtcctttgcagggacatggatgaagctggaaaccatcattctcagcaaactaacacaagaatagaaaaccaaacatcgcgtgttctcactcataagtgggagttggacaatgagaacacatggacatggggagggggacatcacacgctggggcctgttgggaggtggggagctaggggagggatagcattaggaggaatacctaatgtagatgacaggttgatgagtgcagcaaaccaccatggcacatgtatacctatgtaacaaaactgcacattctgcacatgtaccccggaacttaaagtataataataataataaattataggaatgaacagagggaatcttgtggttgacattctagcctgttctatgggtacatccaggaagacactagagtataatgctgacttttattatgattaaggattcattgagttaattctaaaactgtaccccatatttgtcagacttgtgttcaaatactacccctgaccactatgagttcctggaaaaattccttcacttcctctcatccatgaaatgaaaataataccaacaacaccctgttgttgggagaagtatgagatgtggtatgcaacacttctcatctgagcagatgcagtgaagatgtctggttactttccctacactttcctttaattcatcaggtatgaaaccaagaagactgcttctacctagcatagatttgtacaatatccttatccctgtattcagatcagatcccaccccagagagaagcaagacagcaaatgcattcagtcttctctaccccaagtttggcctcagcatgaaattctcttcatgaaaacagcagtcatctcatttgctggaataaggatgaggtaattattgaacaatctaagccacagaaatgattaaggtgctggtggcatttacttatgcagaaagattaatagggttaaacaattgtaagttggccaaatggtaagaggaataaaaaagccatgaacaaatatttaaagggcatgttgtatccaaggataagcaggaattatttacagaaattcaaagagataaaatgaggcatgtggtgtaataaaaagacattaagcaatgagaatcgcactattttaaaggctttttcaaaagaaagagaattgttggattctgaagaaaacaaacaagtaaatacccatccatcattgaagagtttcctgagaaaagacactgcattcatgtctcgttgttgagccaagtagttacatgttaccccggaaaatctcaatggaagagataatattatcatgtctataaatttgttcatctactctaattgccagctctttgccatttgcttataccttaaaagctgtttgtcattttgacaaaaaattaacatagaaaaactaaaaacacaaatgtagaaacattaccttaatcatgtctgtgtaataggtaggtaaagaagaggtagaacatattatcaatacttgaaacccttaggtgtaaaaataaggaacaaatctatccatgaaaacgttccacatagagaaaatgaactatgataaacggcccttccaaagtttatgactatttctttctacataatgcttaaacttgagtgatatttatcattaagcaaactaatattttagtttgccaatgattatttgctatgatagtaattaaggagtctgaaaagcagccgttgcttaatcacaaatctattatatttaaatacaaagactaattctcagaaagaccattcatcttcttctgttttatagagacaagccactctgtccaaacacaaatacatgtgatgaaaggaatattcttcccaagtaaggaaacaccaagcattgccttctaatggtacccgaataccaactgagtactattagtgtttggctgaacatcaaatcacatggaatagttaacgtattaatactctcaattagaaacccaaatatatcgtcactataaaaagatgatcgcataaagggtactggttgggtaaatggtaggtttaaagtatttcgatgctaactttaccactttgtagtaaaaaatacaaatttattatgaaaatttgaatgccaaatactatacgggtaggataagaactgaaaacagaatcttgagtttgatcacttgcaggtcatgggtgaccgtgacaagaacagtttgttactggggacaaacacctgtttagaaagggtccaagagagaatgggagaaggatagttgcaatttctctttcaaagagttttgccagtaacagacaattaattcaatagctagagagaaatgcataaccaagaggggattcttttttaacatggggtaattatttaagatgttctaaatattagagcatatttaaatactgttaaggataatacaggaggatgtgggataacacagtaggatgatgcagaagagaagaaaattattggattgatttccctgagtaggagagatggtctaatgctaaatttgatgaggtcttgaacttagattacagcactaggagtttatccccaagttcagtaaaaaaataaaaagaggagtaaatggatagatctgcagatagacttataaaagcagttgtggagtatgtgaacatttatttcttattatttctactttctcagacaaatagaagtaaggatatagctgagagtagaaatgggagaggagacataagaggtttgaagggaagtaaggtaagaaatatgatccagttaagtgaaaatggattttaaaaaagaaatgtaccaaggggccccctgaggttattgactgtgaatttaaagtaggaccaatgtgtctgcgtatttttcttcagccaaattcagccttgtaagtgcaggcaaatagtaggcaggcagatgggctaaacagttagcagatcttctcctaatcccagccccactcttcaaagctatgcaagctttttatttttgtttccgattcctcatctgtaaaatgaatgaatggataatattagtgtattatcgattactggataatttagtgtattaatgaatggataatgtagtgtacctaccacatgggtttgttgtgaagattaaatagtactcaatagacacagagtgtcatgcaggtagttgttaaatacattaataattatccaattattggacctcttcaaagagaactacaaaccactgctcaatgaaataaaagaggatacaaacaaatggaagaacattccatgctcatgggtaggaagaatcaatatcatgaaaatggccatactgcccaaggtcatttatagattcaatgccatccccatcaagctaccaatgactttcttcacagaattggaaaaaactactttaaagttcatgtggaaccaaaaaagagcccgcattgctaagtcaatcctaaaacaaaagaacaaagctggaggcatcatgctacctgacttcaaactatactacaaggctacagtaaccaaaacagcatggtactggtaccaaaacagagatatagatgaatggaacagaacagagccctcagaaataatgccacatatccacaactatctgatctttgacaaacctgacaaaaacaagaaatggggaaaggattccctgtttaataaagggtgctgggaaaactggctagccataagtagaaagctgaaactggatcccttccttacaccttacacaaaaattaattcaagatggattaaagacttaaactttagacctaaaaccataaaaaccctagaagtaaacctaggcaataccattcaggacataggcatgtgcgaggacttcatgtctaaaacaccaaaagcaatggcaacaaaagccaaaattgacaaatgggatctaattaaactaaagagcttctgcacagcaaaagaaaccaccatcagagtgaacaggcaacctacagaatgggagaaaatttttgcaatctactcatctgacaaagggctaatatccagaatctacaatgaactcagacaaatttgcaagaaaaaaacaaacaaccccatcataaagtgggtgaaggatatgaacagacacttctcaaaagaagacatttatgcagccaaaagacacgtgaaaaaatgctcatcatcactggccatcagagaaatgcaaatcaaaaccacaatgagataccatctcacaccagttagaaaggcgatcattaaaaagtcaggaaacaacaggtgatagagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggactataaatcatgcttctgtaaagacacacgcacacatatgtttcttgcggcactattcacaatagcaaagacttggaaccaacccaaatgtccaacaatgatagactgggttaagaaaatgtggcacatatacaccatggaatacaatgcagccataaaaaatgatgagttaatgtcctttgtagggacatggatgaagctggaaaccatcattctcagcaaactatcaccaggacaaaaaaaccaaacaccgcacgttctcactcataggtgggaattgaacaaggagaacacatggacacaggaaggggaacatcacacacgagggcctgttgtggggtgggggtaggggggagggatagcattaggagatatacctaatgttaaatgacgagttactgggtgcagcacaccaacacggcacatgtatacatatgtaacaaacctgcgctttgtgcacatgtaccctaaaacataaagtataaaaaaataaataaaataaaaagtaaatcagaccaaaataataataataataattatccaattatagccattgctatgcgttcatttatctcaattgtattctatgcttctgctgcatatatgtcctgacaaatgtggtatgtttcattcactcaacaaatacttctgaagtgttagctgtatgccaggcactggtgagacaatgactttgaagtggcccttccctatggtgatgccgtatgggttcctatcaatcccaatatcaaaaaccataaaatcatagggagaaacatacattccacaaaataaattacaaaatttaattttatgaaaggagacatttttctgaatgacaaagtagtacctatcataaaatggtgtagacactgtgtctgcatttctacgcatgcctactggtatactgtcaccccagtaaacagcaaatggtgacattttcatgtgatctgagtttcttaaattgaatgctggaccattatagaccaaaactatgaaattagttgttttctaatgcaaacactgtaactggctttaaattgcattgacgtctctgaaatggtctcttagagatttggattcgtgtgtgtgtgtgtgtgtgtgtgtgtgtgtgtgtgtgtgtgtgtgtgtgtgtgtgttttagttgttgggtgctaaaacaatatttgaaatattatataacatttgtattatctaaatatcatagtcctctttggctaaagtttctcaacatttggggagacattaatataaattatatctaagaaaaatatagaattccataactaagtggataaatcatatttagaaacctttccttttaaatttctaccatttaaaaaaatttaaataaataaaatttagaagacgtaactttacaccaaagagaagggaggttcttgttgggtttgaaaatacttgttctcacagtaacatcatagagaatggaattactaacaaaaatcacaagtttggggctaaatgtaaaagtattcaaattcaaaatgtgaagtgaagcccgtaattgattacggtaactttgggacagaaggttttgtgtatctgaaatcttgttaggaaaggtcacaggatttcttcaccagacagttggccatagattattaatatatgtaaactcaactcaatctatggatataactaaacccaaagcaaaccatcttctttatgtttaattacattatacctaatctgttacactattttacactttacttattgaactactgaggtattaaacattttcagaaacctatagcaaatatggactgtgaaatcataacaattaagccacaggaggaaaatgcataaacaatgaatgccttttttgtctctaacattatttcattgaccaatctggtaatattctcataagattccctgcttagaaattgcatttatagtatgtcccttgttaaaaacaaaacaaaacaaaactcaacattttaatttagaagaccataatttgatctaaccttaatacaactaacaaataataaaattataattatcaaaaagttagcaacaggtattaatatgtagtaagactccaatgggtatggccttagaaaaccaacaccaaagagaaaatatcttccaaaaaataaaaagtgctttgaagaaaaatgttcccttgttttagtttagccaaaacagccaaaacaaacaagcatgtggtctttgtatgagcacatggtaatgacactaaaacagtagcgcacaaaaacagtgtttttttttttttttgatgactatttgctgtggattattttctgagacggtagacacttgtttccttacatagcaccttgtaagaaggaaggacacttttcttagaataactgatggatttcactatcacactggagcaaagcagtttatttctataggtgtacatgcatttctgctttttatattatgcattaacttgaaaacacattttaagtacctcactttccattccttatacatactgtaatttattttagttaaaatgttagtaagaagcccaggcacctgctgattaagcatacatggcacataataccatagctctcatgatcacagccccaaaaaagtaaatctcaagaaacaactgcattagcagccatgccaaagatttagaaaggttattatcctgtgaacaattatggttcttgtttgattgaaaaattcataataaaaacataacacttttggggatacaatgttcattatacaccattgtagtcagtggctactttagttttcatttttgttaagattccaaataataaaactatttgcaaactgttgatttccttgtaaattcccctttctttggctaaatcaatatatgtaaatatctttgttcatatattagttaagctttaaaatgaggttgtttatgttcttgcattcttataaataacccacaaatatgtaatccctctaattctcttaaaaaaagatataattatatttatttagggaaagtaaaaaaggtataaaatttgaaaagtatttttatgtctaaaattatctagttagatcactctggttcaaggatactttcttttttagcttgggcctattaaccttccttatttcactccaatccaagggcaatgaggagaacccagtgtatggcaaacactctcaagatttgagagcctatgaagatgcagaaaacacagactttgcttcttccctacaatcagctgaatatgtatacttaattaattattatcaggtatatataaacaacaacagtgacgtatgaaataccacaggagaattatttttaattgtatccaataaatgaaggcttctcagaggagatggcattttctctcagcttttcaaaatgagaataatttcataatttcaacaggtgaatgtagaagtgaggagaagatgctagacacacagtaaagcacaaacaaaaggataaggatttgaaagcatatgactaatttgcggggtgtgtggcattgtattgtgtttgaaatctgtggaggtcggtggagggtagatggagctgaatctggaaaggtgggttgcagtcatgctgcctaccacaccattaatagccatcttgcaaatttctgtccttcacaagagtaagtcaactggtataaacatcactcttctataggggtaggggtgatggagataggaaagagtgtgggtgtagggctccaactcaataatctttacattaaataaattactacttaataaaggattttttaaaaccctacatttcaaaaatgtgtattacccttccccaaaacacaaaatgtggagctattctttattctgttttcaagcatatcacactatattctacttgacaatgtgcttaaaatttctatgcctcttttttttctcccaatgggacaatattttttccacctcaaggtctctgcacacacattgctttttctacctgctcttaaaatctctgcatccttcttacctgtcatctctcaacctgtggatcccagtgttgcccaccctgactactttatctaattagatccctctccccacccctctctcctccataattctttatcccagctctcttcatgctttataggactttgaattttattatttcttattaatttgttcctttccataggcaatgactctctaccccatgtttgtgagctccatgatggcaggaacttcaactcttctattcactgctgtatgtatatataatacctgctacagagcctaacagattgtaaagattcaataattgttatattattttcagctataaagacatataaaaccatcagacttaaaggttgtatctttaataaatatgattttttaaaattttctgagggcaattccctatgtaaagagtgtgtaataagaaggtaaatatgcttgaaaatatgttcgacaataagacttaattaaatgaataattatattgttatatataataatataaaagcatactattatatgtcgatatataatttacataacataaagtcttaatatttgttttgcttaaaattagtgatactaataaattaatccttttctgatactcaagagatatatctgtatttttctcctctgaagaatatatatacttttatataagaaatataagaagaataaaaaattctcatacaatttccttataacgtatcttcccttctattttcctgtccaaagtaaggtagaaaagtgacctcaaatatatttttcttacagaacattgaagattgcttatcatttcaaaatcaggaataccaacagagcagtcagggttgaaaatggagaaacggaccattagaaaactcagacagctttctatactgacaaaaaagtaaacacccaacttaaaattcattaagtgtaaagcaaatcctccttcgccacccaatatggcacaaaacatttattgttcatatttataaaataatctactggctatattcttaagaaatacacacaagttttaatcattgtttatattaaaataagcttatttagtagatagtatgttaatttactttatgtagacagccaatttggagctgtatgtggtgaaaactgtattctaaaagatagtctgtttgatgacataagaggataagcacaatttaagtcataatagattgatcctccgtctatcaacggtgattaaggcagtcgagttggtctcattacacaaaggtgggctgaataaggctctaggctaatgtggaaaattaaaatccatttttttcttaatggctcctacactggtctgaaaatatgattgatcccaaattctccaacaagaagttcttattttacttatataattttatttctctaacagaacttccactctgattttcttcctatctttgcctttgaagcttgatagtaagagcaagtaatctccaatttcttaaatgtgacaacaagaaattgtccttttaaaatattcagcattagcctttaaaaaaaaagcatcaaaacttttggtcatcaatttgcaaatgtaaggacacgcactcactctttgagaaacacatgtatagcttatgcttctatcccccgtctttggaacaacagggcatttaaaacaaatacagctgggagccgacaatgtaatgtgctgggcaaacatatactcccattaacgtaaatagattcttcaatgtttcctaccaaccccacttggttatgaaaagccagcaatgcccatttcccccacagaacacaccacatgctcgcaaaacaaccagccttagcaactggatgcagagacaggcagagagagagacaaaagcgcctggctcctgaataggatgccttctcagaccctggcatttcaaaggcagtgaaaggtcatcctaggtactagtttctcaaagaaatacctgtagtaaggtaactattctagtcacctttatatagtaacggcttgtatctcaggcaattcgccagtttttcaattaaaactgacacatattagggatttttacttctgccccccgctccccgcaattcggattctttctttagactccctgagcctctgtccccatcccaggatttgactgaagggctgcagagcccagggctgcgcgctaagcagccttctgctgaacctcagcggactgggccatagttcacacaccctccactccttctacagcagctcccgctgggggcaccgccaggatatccacatttgtccaaggtctgggaacccgggaggtttctaggagaccccagagaccaagtgaggccaggcccaccccatggaaacccccaccagctcagatcagactgcgagcggtggctcgaccccgggtgtggcaggaaggggtgccccgcgttccagagccagtgccagtccctatcctcccgggaagccgagactcagggggaacaggtttcccagagcccagcctgcagggacgcggagggcaggagccgccggcgaggagcagccaacttgccatctctggcggctgcacttctcggcggctacaggttgcccgacagcggactccagggtccccgcgacggcacccagagtgctcagaagggaggccggggccggggtgggccgggaaaaccgagggagggaaggagcctggagaagctccgtttaggcggggagggggcgacccggggcgcatctcccgaccatgacccccacagaccttggcgccgcaacctgcgcttcttgaggccgaagatgcgcactttggagaagatatccaccaggttgccgttgcagagcccgcggttcttgctggggctgctccgcctcctgctggcagacggccggtcccagtgctgctcccgcgcctgccgcttctggcggatcaagccgctagcgatggccgcggccat

SEQ ID NO: 1270 - DNA, 680920 bp, Homo sapiens
ttctgctaactttttatttattcaagtagaatccaatatgaaaatgaaataagcataaacaaacagttaaatttctactaaacctttaatcagctaagcaggccagaattttttaatgctgggcaagggctgtcatgaagaagatttatgaaagcagtgacaaaataatttcccaataaatacagtgcagatggggaaaatgatgactgggtcatcctcccacatagaaagaataacaagaggccagtacattgatcccacatataattttcaataaatgaggttcagtttggtctcaatgaactcttctgagaagaaaacattgaattttattaggtgtacacagagttaacaaataaattcccaaacagtttagtatgaaacattttgaacccctttagatccaatattgaacattttgcatggaatcttcattgtgtagtcaactgttcctggcctttcttggtagttgtcttccctaagctcaaacaaacagtgttaaactaaaaaggaaattaagaatgcaaaataaaagaaaataaatggaatggaccaaaatcctcatggatgaatgtgttggtttgcctttattttcatctaggataattcaacagactgtattctgagatcatggcaaggcacctctaacccagccactgggcaacatgagccccagatgctgagctagaggcatgtactggtgaaatacacagtaccggactcagcatgctgagctaaaaaaaatatttttcctaatatgtccagtttaaaaacttgtcattaaacaccaaaaatattaaagtctaattaatttataactaacgtttgcattgctgctgcaggaaagaacacaacagccgtcttgcccatgctctgctgagtatgaggggaacgcagccagaaacggggatggcgttaagtttggttcattaaaaacaggacggagtatatctgaaatggatttaggtagcgcaattcttgtaggttataattactgattttcctttttttttttttccaaataatgagaattaatagatgaaaaatgaaccttaatcaggcctacaaggcctacagaaatctttggacccactttctcaaaaaccagtgggtcttgctcgctgggcaaggcaaatgttaccattaccagtaagcttgtgatatgtataaaacacacacacacaaagaaactagagggggatgtcaaacacatatcatagagagcttccctggattgtgtttgagccatttcccacccaggcaatgccgaccttgggagcacagtatctgctactggacagagcgtatatgtgtgtttaatcgatagtgtgagccagagacaacaatctttcttaatctttctttatagatgcaatttgtaataataggtttagaaggcttcctgattccctgattgctctccgacctaagccaactgcaacatttaagatttagaggaacaaaatccctgcaaaaggtcacagacagtggagcgagcagccctgtaaaaatgggaagaagagaaatccgtaatagcacaggtttacagcgtctaactagaaattactcaatattatttgtgtgctacaaaattgaacttaaacacatagatttcgctgaaacaggactcaaaaaggattatgggtagctgtcagcaggcaaggtatcgagtgtacttgtgaagtatgtcattcacatgaagtgtcacagtcacagaaaagatattaaaaaggcattccatatctggtagggcattccatggtctgagtttagctggttatccaggtgtcttcttgttgtggggggtgcaacaggttgagatttatccacttgcaacagagaagttcggagacagcaaagaataagcattagcttacttcctgctgctcttcagccacggagcaggaatgtctggtgaggataaatcactcaactgtgctcaggacgaataagtcacaacacctgtgaggatctggctatgttgtcttactcttgttgactggtttgcctccattcattattgcagacgcacttgtgcttttacttggcgtcaccccaggcttcgggaccgtttccccaacatcatgcaaagatggttctcggtacatggcaactagtgatgggaagaaaggaggaggaaaagcaaacattgcttggttaggtgtgagaatggtccatccatacctgcatagaccactgcagtttgcccatttctgttttccctgaagtaaagcaattccattgagacagaattcctgttgtaaagcaatcatttccagcccacagaggacattactcccttcacattctctggtctgtatacctaaaatatgtatatgagtgtgcatggatttttgtctaggacagcaggtttaaatgggagctatggcctctttgtgggtccatgatgtaaaacacacacacacacacacactataggagaatgacaggcatttaacttaattctcaaaaaaagaaaactcagacatcccttccactgcacattaatatcaacacatgaacttctcattcacttcaatcaatctttgtgagctgcggtatttacatcctagaacattaaattactttctttcatgtggttcaaaagcaacatagtcatactagtgtcaacttcaaagctacacaaaataataacaaataactctcttcccataagccagagccttcaggagattatcatttcaatgttcatttcctacaatcatggaaaaagacccttgggcagcagaaggcaactcattttctgctatgttattaaaaatctaataattgacatgatacaggggcagaaaacagaatggcaagacagcaactgaaactacctgaataaactctgaggatttatctaaatagtgtctggtggcataatcatagtagttcacgtggctttttagaaaatgatttctggaagtcctgagaaaggacatataagagtgactgatggttggggaaaactagggattaaagtcatctgccatcagaaatacaagtgcattagagctgcccaaactgctttttaggtttttgaaagtttaaggtattttacgaagagcccttagatttagttaagatgaactaccatatgcattccctatgttcaagggggtagaatgtggcctttagtatcaatgcatcacgtgagttttcatcagcacacatacttgaaagtgcaaatgtacataaggtttctattaaattacttgctaaggtagcaaaaggaactaatgcgtatcctgaaagcacattccaatccctcactcctattactaattaaattagcagacaaaagcatgaagcattgaccttgattttctatgtagtgaagttgtatcgtccaacaatgatagactggattaagcaaatgtggcacatatacaccatggaatactatgcagccataaaaaatgatgagttcatggacatggatgaagctggaaaccatcattctcagcaaactatctcaaggacaaaaaaccaaacaccacatgttctcactcataggtgggaactgaacaatgagaacacttggacacaggaaggggaacatcacacacacgggcctgttgtggggtggggggatgggggagggatagcattaggagatatacctaatgtaaatgacaagttactgggtgcagcacaccaacatggcacatgtatacatatgtcacaaacctgcacgttgtgcacatgtaccctagaacttaaagtataataataaaatatatatatatatatatatatatatatatatataaaacaaagatatgaatgccctagagtaccaataattaaccaggtacttaatttgtcaaacatttccaataacattatttatattcggtatgggttttgaaagtttgaaattaattttcctctatcaagtaaacaatgtgataatctctgtcgttatagtacctacccccttaactgtttttagagtacttctgctaattttttgaaaacataaaaagtattatttctctctttctcatatatatatatgtatatatacacacaaaacactcatatacacataacaaatacatgagtgaaataccaagtatcattctataccacatcattgttgtctcagatattttctatgagatatgcaaaataactggttcccaaattttacctcggttaaatgacataacagcccttttgggttttgttacatttatgcagctaaagggtaaggttctaaaaatctagtcaattcttaactatttacaaaacataaaatgagtgaaaagagataaagcacggtggcaaataaacaatggtcttattagagcttctgtgggcttattttttaattttttatttgcatttaaatataggtgagtccaatgttatcaaaatttatttaaaacaatgaaagtgtatcatggatgtgttttttttgggaggaacagggaaatcctctaacttctttctactctaatcatccttatgatccaccatatactgagaataattcactcatatttcagactctggaataatctgtcttttcctgtataggccctggtagctaactgtttgggtttcaataaattgttctacagaaaaatataattaagagtgacactaagtcaacatcattgaaattacagaagtagtattagccaacaagagcgattttctgaatttaggcaaattgaaaattatacactcacagatgatgaagaattgactgttcaaatttttaaattattttatttcaatatagagaatatgcattatgaaaacaatatgcattttctcgtgatggctaagcctttcctgtaggaataaaacacaaaaagaaaattgagctgtccaagctagcttaaaatatttactgagttattgtagatctgatcttctgcaaaagagtaaacaaaagaacttgaatagaaacacatgtgaatatcctaaaatcaaatatttttgtaattctcaaatgttacatagataaaagtaaatgacacttttggcagaatcattaatgagagaggtgcagatgttgttgattaattaaaaaaactttgtagcctgctctttgggtatctgattggagtaaatgtgaaatttccattcatccggcatggatgactggatataccccttcctgcacacaaatgaatgtggataaattattttagtaaaagaagtaatgctacaaatgtatacagtgaagaattacacaatttgaaagcagatgtgtaatatcagcaagttctttaagagtcaagctattatctcttatttttctgtaattataataatccacaagtaggtaattactttcacctagataatatcaaaatggaaaatacttttgattccacgctcaaaacttattttttctaatatacttattatctttttctaatatacttatcatcgcagatttgtatcattacagatttaaaattgttttaacttaattaatttaaattatctaagggttagagtggttgtagcagtgaggatttgagcctttggaggtggcagagaagaaatttttcctggtacacatacatacacaaatatagtaaagtgtataaggggcacaaattctaaatcaataacttaagtaggcacctgtgcaaccatcacctagatcaaaataaatgacatttccagcactttgtgaaggtttcttagagccatggtagacctatcaatttgaaaaataaaatatgtaataagtctatgtaataataatgcatgcataatactcaccttccaatggcttgggtagaaaatgagctgctggtttggttttctttactctgttccctttcatagcttgcccttccttatttaatcccaaaaaccaggctctaccagattcctgttgtctgtacaacatggatgagtagattacataataattttcaaaaacagattctttaaacttgcattcaggggtaaaaagttcctgtggagagaaaatgaaacaaaagttagaggaaggaacttgatcttcactgtacattctactcattctctagaaagtttcccagcatggtgaaagagtgctttggcatggaggaccggatataccccttcctgcgcacagtaattgtctatacatttttaaaatatacaataaattgagaagaacctactattattgaaaatatatagaagcaaaagtatatcataagaaaacaatacatgagcaaactaaagatttaacttaaacagaagacaattcaaccagagtataatcagaaagggagcattaaagtagcatcagatattcacaataaagtgaaccaaataaaatacacatttcagatattttataatccattttacatgtttccataggaacagtgatataatactctacagttgccagttgctccttggatcactgaaatcacagggtgatacattttacttacaaaggaacaaactgaaacctcaaactaaaacttagacaatcagctggcttacttgccagccactagagctattgtataaccagatgaggttaggtgtcatgttagctggtcatagtgacagtagctgaaaataattcaatggggctccaaaggtttgagtcccgttggaactcttgaagataaacatcaaaagctgctccaactgaaaaaccacacagcatttttggaaagcatacagtttgttaaatactattatgctcaatgccatggtctgcattaattgatgagcagcacaaagcttactactttacaattattattaatgtcagaaatattcacagatgatttttatatacttcttactttgggatgaataataatgaatataatcccatgccaaataaataaaaaattaataagggtacaatctacatatgcatttttgatagccctctattaaaaataaatttgaagttcaacctgtctggttatagaccatgaaagacacctagctagttttaaataggtccaacactgtgctattctatatgtatataaaatatagatggaaaatagatccttactgtccttgatctttttgaaaataccactggactaaaaaatatacacaaagttttcatttttctttaatagattttattattgcagaaaataataatttttggttttcttctaaaaatgttgtatacctgttctgaaaaatattccttaggggctaaaaactaaaacattaagggcttgactttatgctaactgtaattaggaatgtgacctaatgtcatgtagaaatttcctttcaatattccccataaaagtgtgaattatcaaatgctgtctcatgcaggagacaatttattcagtgtgctgaataactttcattcactgagagctaatagttttccaaggggaacagcctttgttagtggcagatgcttttcaagacaaagatgacagttacagtgatcaatttgatgaaatcacaatagccaaatgacaggtttagccccctcctggagcaacttatgtagatctttatttcttcttgatgatgctacctcagattagaataagatcccatccaaataaatgttctggctttctactgagttctgcatctccatatatcctccaattagttttctcactaataaatgagagtccactgagtcaatgtccaggccatgcgcccgaaaaaaaagattgataaaacagtacatgttcatgcatttattgtgagtaaaacaaaatggaatgctataaatctggcttctccccaagagactaataaatatattggttgaaactatactttctcaaacaaaaggattagactttggcatttcacttgtctttttactgagacagggcagggcacctaagcatattgcttaccagttaaaaacctatctcaaaatcagctatgagtgacatgctgagagctgacttagtgggtcacttagtggaagtcaggggaatctggctctgcctcctgggcttcgggtgtctctgcccagaacctggctcactgatgctcatcctgttgctacaaacaccagaaacgtaggtccacaggattctcttctgatcgtcactgccataatgtccaaaacatgaatggtgcttgcaacaccatcagcaacttagggatgtattgtctccattatgaattcactgtgttgaatatggaagagaagaagatgcttgatgtagaggaagtaatttattctcggtggataccttaaggattctgacactatatcttttcagatgaaatgttcacatcataggactccaaagaagtcaattccacagcacctttctgtgagctgtgcccgtgacttcacagataggtgattctttctgtagaactattgccttcagttgcttgtgatagtggagactggtatattttcagccttcttatttgtggctaaataattaatgcacacacaaatgcacatgttacattcaaagatgttattgtctaatacattttctcaaaactttttgagaacttaatctgttcctccaatattgaagtctcaaataatcccagcatttcctatagaaccgatagaaccaatggaagttgaggttagttgctatttgatgtcataagtgatatactttcaacacgtaaatgggaagcaatggagcagataaacatcacctgtggaggcagacagtaggattcaaccctgaccccactagctgtgtgttcttggggaaattactcaatctctctgggcttcagtttcctcatctctaaaatgaggacaaaaatcatagggcaataaggtagttgggatgattgagtgaataaatacgtattacacatttagaagagaacttggtatacagtgagcactcaataattattctttaaaagtttctcattatttgtagtaaaaaatatatcctgatcagttatttcaattctgtgaaaatctcaccaaaagtcagctacataattagtcaatgaaaaccattttacacaaaatattgggttcagcatgaaatataccaagataaataatagtcattcatttcactgaaaaatgacagaacaatataatatttgttatgagtgacttacctataaaatactagagtgattatagggagaataaatggtattgtgaaaggcaagaggtgggaaatggcctggtacatttggagaactgtaaatagttcatcactgagatacacgctttgtgggacagaagtggagaatgttgtagatgggaagataggtttgagaaacataataaagggtcttgaaaactctaataaacaaattagatgtcttataagtgagaggaagacatgttgaattcctgaatatgcaagggaataataatagggcctgattcgtatgttataaatacaaatctgttgtcagtgtggaggatggtttcgaaaagttaagaacatgtcgtactgatgttttcaaccctaatctctcacaaaatgaacctgaaagttgtttgtagcacatgagtatatgtgtgttcacgttaatagttagtattaatattacaaatagagaaccagaacacacaaagtaaggggagaaataatatcaggattatgacacactgacttctgaactttctggtagccaggacaaaaagagaaagactataatgttacaaaaattattcaagaaagaaaatattttcctttttgaaaatgaaaagtttcttggcatgaatttttaaaaggtatttccttataagggacctaaaaaactgacattgaccaacataaacaaaaatgctcttgagagtaattgcacagtcatactttgtgcttcaatcctgcagtatgctttaggaaaacagattgcattgaaaatgtccaataggtagaactacttaaagtccagtaggtggaaataattgtaattgatgagatctccagggataatgtgcacagcacgggccacaaactcaaatgcctctaatgaccaggtagatacaggagtgaggaaagctggcatgatcatggcaccgtaatgaggataaatggcctctgactcaggctctgtggtgaggagatgaagacagtggtagaagcaatgatttttttaaaaaagcagccgtccctcacatggttctcctgtgaaaataaaaaccttagatctttagaagatctgatttttcaaaggaagtaagaaatgtaagtttctacagataatctccttttaacattggcaactatttcttagtttttgtttttcaaccttgagtgggtcaaggggccacagggaagcctgtgagccttcagtatgagacctccaatgtacagcagcaagaaccaaagaaagaggagccctactttgcttctcaaggcagtcctagtctaattgatagttgctatacagttggataatacaattattgtgccagtgaaacactctctaaaactggcagtgataatatgaaaatgcttatttaaatttaggcttaaatataaactctttgaatctgccaaaacgagatcgataaggagtttgatgtatctttttctcaccttgcctccttgactatgtttagaaccatcacccccaccacaacaaaatcaacaacagatgagttccagcagaagcttgaatattaatttgcaccactgccaaactaaatcatcaagtcataggatagaaaaatgcaataattaaacagaaatgttatatcttttttatgttgtggttgtttttgaaatgaaagcaccatctgtggtgtacttattatcttaacagtagcagcagaattcctcttctgagggaaatgcctttgtttaggaaaataccgtgatgggccatttgcttgtacaaagagagacttctggttggaaggagctctccttccataactcatcaggaatgaataactcagataatctggcaaaaccataacctcagaattgaaagtgaccttgagaatctaatccagtggtccagcaaactgactctcaggccaaacacaattttcacctgtttttgtaaataaggtttcattggaaaacaggcactttcctttgtttatatattgtctgtgtctgcatttacactacaaatttcagagctgcgtggtcgagaaagatctttatggctcacaaaacctaaaatgtttactatatggtcctttgccaaaagtttgccaatcctgatctaaggtaaaatttgaggactttccaacctaagtaattgagggaagagttattaacccagtagcaaattcctaaggagctaagcattcccaagttaaacttggattgcacatattttcacatatgcaaacatatacaacttgaaggaggagcttcaccagtgtttcatccttggaaaagcctttatgttctgttacgagcccaggcttccactaggaattagcccaccaactccacttagttactatgtcaccttggtgttatctaagactaaatgaaaattatgtttttgttaatgtcttcaagtttgcccaccatcaccatttaagggaaaactataaaaggggcattctgaacacaatcataacattttttagaatactaggcaattccaaaataacttaaaaagaggaaatagagaaacgatattagacacaagtagcaaatagcacataataaatacatgataaataatagctactaatatattactaacctctattttccagagtcatccacgaattcagtcccctcccagtaacagctcaataatgaccctcatcctggactccttaggagtatctctcctcagaggaggcttgaacttaaaggaggaggaggtctccaagtccaagttcttactttgagtataatattaaacaacaaagggttctttcaaatatcaaataagataagagaggtgaaaaataatttatggactagaaattaagttgtaatctgtagttatatttacaacgagaaattgagtttgaaagtgcaactcaaatgttgttatcatgaagaaggctgttatttaattattcttaatagatttcaacttaattacacatacctttagatgggaattcccatattcagatccacttaatctgaattctcaattttttttcttcccttttctacattttggagatttgatctactagagtttatctgaggtcagcagagatttatcccaatctctttcatcttttacagttttaaaatcaattgtatcctttaatgctactattctgacactaaccacttctttaaaacaaaaaggcagagtactcttaagattacttataaagaaaagaatatcgtgaacttttagaaagattttacagtcctgaagttgaaacaaaatatttgtagttaacactcaaaagcagaaaattaagttgactaatgtactttatttatataaagttgtatgtagtcaaaaatttttaatattgggctgtgactaatgcccacaggagaaaaaaaattagttaattggttgtgtgtgtacctcaaataaaagcataattatgtacgagtttaagagacaacttttggcagtgcacggtggtcactcctgtaatcccagcactttgggaggccaaggcaggcgatcatgaggtcaaaagatggagaccatcctggccaacatggtgaaaccccatctctaataaaaataccaaaattagctgggcgtagtggcacatgcctgtagtcccagctactcgggaggctgaggcaggagactcacttgaacctgggaggcagaggttgcagtgagcggagattgtgccactgcactccagcctggcgacagaacaagactccatcaaaaaaaaaaaaaaaaaaaaagagagagaggagagagagacaacttttatcctgattacaggacccaggaaatttaagtatatttctaccaacaaaggagtctcgacagcaacttatatttatagggccaaattctgttacttaagtagtttcccgggaaacaaaatggaaaattaaagcattttttggcagtaaaaatatttctcaacatttagagattaacacatcattagatacaataatttatttattaaatattatatgttactttgattcattatatttattacatgttttataacatttaataactaaatatcaaataatttgatttgaattttcacttattcaatataaatatgtattatatattttaaaatatgtattttatatgtgtgcataatttttaaatatacataaggagatgtctgtgtgtgtgtgtgcatgtgtgtgtgtgtgcacgtacatttaaaatgtggtattcagggaccagtagcaacttcatcacctggaagcttgttagaaatgcagaatcccaggcccacctcagacctacagaatcaggatttgcattttaacgaggtcccaggtgactgtatgcacattaaaattgggacatattggcatatattctcattactacatagaacaaatcaattaatgatcacattttaagagctgtcaattaaattgacattagtcataagcttgctaccatttcttaacattagtacaaaatttataaaagcaagaaaatagaaacaaaaatctgtggtatttacaatacgtctataagtaagatattttaagattataaataaaaatgtgtcccaacttgttctacaatgtaaaatctttctctctggaatatagacatgtataaactcctaaaataataatccttgtaagatgaacagatggcaccagtgctataaatattagccaaaaattcacaaaataaatatgctcaagaaagtattaagacaaccatatatcatttttacacatttgtcagttttcaactgtgttgcctcaatattaacaataataatgatgttaataactataattaacaccttatgcatatttctatgttgagcactgctctacacactacataatacactaatttaaccctcaccataatcgtatgggatgacactattattatccccattttagaactgaagaaaccgaggcacagaaggttgaagtaacttgcccgagtacgttactttcatcaagataaatataattatttaactattcctactaatttatcatattgttcaattgaaagaatttactttttaagatatgtgatcaattgcaaaaatgattctaattcttcatcctcctcctcccaaccaacgacctttgccatgtaatttgcagcattctcttactttgaacaaagataaagaaagtagaggcttaacaagtgcttgtgcagctgggattgccctccctcatgcctgggctactctcgctggaggagagagagagtggggagcagagccaggttgattcaatcaaaactaacctattcctagaggtgatcaagtcctgccgagatctacagagccacctagccaaggcccacttggtcttagtttcacaagcaatatgcatacgcttattgttttatgccaggttttgtggttgttcattatacagttgataactgatacatataattatcaatttcactgaatcactcattcaactagacatagaaaatatgtattttatgctgctgatttttatctacctctatacctacagataaaaaaatatatagatgaaagcagtaaggaattatatagcctatcaccctagcagaggtgacacgtctcttagaagcaacaaatataaggagcaaaaaggtaaagaaaaagaagcatattttaaaaagagtttttaagaaagtaccaaaaaatttataggtactcaaaatgaatctttcctcctcttcacgcaacctgtatccaccttttccccctcactgatcaattaaagaaacattgaacaaaatagaaattgggttggcttccctggattgccaattatccccataggaaaaaaaaaaaaaaagctcattgttgttattaactccccaggaaggggtagaatgggatgagggtgtcatagtgggtggtggcatgagtaaaaattgagctctaagatcaaacatgtttggtcatacatcagcttctcaaaggtacatttcttgggcatgtgtagggtaatatactaactgtatagaacattgtctaaaagaaaaatgtaaaatggatactgctttacgtgaaagaaatcaaactgtacatatgtaacaaaatcaagagaaagtgcttccatcagttttttaaacatttctggattatctgagtaaataatgtcaacagagaacaaatatacacagtaatatgcaaaacgtttctttgtttgacaaatactcaggcatcaaagtagagattagtgatagctcaaagccagatggtcagtttcgcctcatcctctattttaaggacacttcagactcagtgatttatactttcattgtaacacaaatatcacattaagccaaatatatatatgtatgtgtattgttatgtgtgtatacataagtgtatatatacataactatatcaatgaacatttgaatattttagaaatagggttatcttattcaaaagagaaataataaaatatacattcttcatagaagtatgatcaaggaacttgtgcctgtctatagattttatttcccctctgcaataaagcaagtacagaaattatgtgaaaacatttataaacttctatagaaatttaacagaatgttttttatatttgttgaatataacaataaaatctctgggcttttattttgtatatttttacgtttcctattaattgaattttattgtattttatgatattatctttctacaaaaactggcaattaataaaagtactgtccttcaccacatgcagtctgatggccactgctctattatacatgggtttggatatgaatgtacatccaattaaaggagagctaaggtgagaattggtgatggttaatatttatttacttatcggtatgaggcaaccagtatgctaaaggctttgcatacattacctcattgcattccttttaacagaatacagtgctgcaggtgaatatcttgatgagagtttgtacagttagtaagtggcgaagcaggttctaatgccaacctgagtctacagccttcgctctaaatcactaattataccagttctcaaaacaatacagttctaaaaggaaatcaaagagggaaatgtggcttaacaacagcaatggcaaccacaagattttttaagattattcaatttgtttagataaattatttctaaaagttatcagtcttagcaactattctattttttaatcttatttcattattttagccttatgttttataagcattgggttgggagtaggatatgacctggtgtggacggcctacttgatctagatttgttagatattactaataccaaaaatagaggaaagataaagggaggcataatttaagaaattactttgtaattaagagaccccaagaatctggaaaaagacaacaaatacctgtgttcttagtaataacggttttaatggtggcgattatcatgggagtggaggtgaaggaagatgcaagaaagatactcctgagtggaacaaatgttatggaaaatatttagttcttttatgtccaacgaaaaagtgatatgatcacagttttaatttactccaacagaatttttgttagccagaacaagaatagaatttgctgtgcaaaaaaatgaagtattttagtttatgtagttaggagatatcaattttgtgtcttgctatatcctaccaaaatctagtctggttactttatcttcctttatcaatattttctttcatttccttgtacttctctgcccattctgtcttgaataattgaatacaaaatgacatattttggaaaaaaaccaaatttgtgatttttactctgctggagtctatgaataaaaatccagttgttttcatcacatttttcctacccttaactatttgaattgtattttaataatattcttgcaattccatacgcttctctccttaggcctatgtgtacatgcatatacaagatttttctacttttttctctttcaaccacattttaaattagacctttatatcaaacattttaatattaagcatatgtgttgtaaacttttcctaataagaatgtaccccatcaaaaccacttatttatataaatagaaatgaaacaaaaggatcaaaaatacctgtttagccaacctttaaaatgaaagctttcatagaaaaatggaggaaatataagcaggttctacaattctcctaaaagaccatattcttcaaataataataatttctgattgagctttttgattttcaaagactattcttgtatactaaatttgatacaataatgctgtgaaagatgctttaagaagaaaaacagcaccatctccatgtcatagatgatgattttgtgtcttagaggacataatagattaagaagcatttatttctaccaatttgatatttcacctacatcatgctgctatttagtaaatatttattaataattacaatgttgaaaatacaaaacagataaaaggggtttaattttttccccagggcaccaaataaatcatcttactgggatatgaggaaattaagcatctgataagaatcagcaacactgaatttgtggaatacaaaggaagcccacatagttctgaaatgcaatgctgaggattattttctcttggttttgctttattagccgggaacacatcggccatgagtccccagattctggcaacaacttgtttgataattccaaaggttaacacaaaaggacaaacatgaaacactgaagagggaggccaggaaagcaagaaaagaggcaataccttctggggaaagagagaccctgaggaggggagaatgtcaacctgtgggttaaataactctaactagataaagctggagctgtgaaagttcaccatgctatagattttgtcctctaaaaatcagcagtgaattttcatattatattatgaaatgttatagaaattaatgaattatattgtcttactttccaggttgttagttgaaagtgtgagactataaagtgggaagaatcataatatttgtaattggtatatatatatatacccacacacacacacacatacaccaattgcagtgtgtgtgtatataccaattggtatatatatatatgtatatgtatatattgtatgtgtgtgtgtgtatatatatatatatatgccaattggtgtgtttatatgtgtgtgtgtgtatatctatctatatatatatataggtgtgtgtgtaccaattacaaagatgattcttcccacctcatagtctcatactttaacagtatatatatatatatatacatgtatatatatatatatatataccattacaaatactaaaattggtctaccagatattaaataacaaattaaaatttttgagtactgtgaacacatggaaacaaatttccatttattctttacttaatgatgtctaaaattcatgcattcatttattcagtaaatatttagtgagatcctagtatttagccatcactgttcttgatcttgagaagttagaataagcaaaagttgacatagtttaccattttttgaagtgtacagtctaatgagagacaaatgtttacactaatgatcgtattattacaaattaagaaaggttcttataagaaaaggaatgatttctatgagatcacatagataaatctggcctagcttgggtggtaaggaaaagcattgaattctgaactgagatctgaaacaccagtatgagttaactagactaagagcagcgtgaagaatattcctggaaagggtgatataatatacaaagaccctggggcaggaggagagacaaggcatttgaatgaaaaagagaaaacaacgaaatcagaatgcagaatgtgaacacacagcagtaggatttgggatttgggtattaggcatgagtgaaaccagtggtcacattaagggtgagggaagagagagacgctctcatattgttttatactcagtacctgttttaagaaaaaaagaaaaaacaacaaggaagtaaaaccaaagacaggcagcccagcgccaggcctgaaaccaggcctgggcctgcctggcctaaacccagtagttaaaaatcaacttagaaccctatgcctggcctaaactcagtagttaaaaatcaacttagaacccgatgttacccatagatttcaggcattgtataaaagaacattgtgaaactccctgctctgttctgtttcactctgactaccagggcatgaaacccctgtcacgtatcccctagattgctcaatcaatcacaaccctttcaggtgaaatctttagtgttgtgagcccttcaacgggacagaaattttgcaatcggggagctcagattttgaggcagtagcttgccgatgttcccagctgaataaagcccttccttctacaactcaatgtctgagaggttttgtctgcggctcattctgctacaagggttttcatcgttctctaaaagcaatgggaagacattagaagttttaagcaggaacatgtcacactcagatacaaatttggaaaggctagtctggccaaaatgtgaagcctaaaagagagccaatttggatataagaattctggtttgtccattatagtaccagaaagaaaaaaacataacagttgtgtgggccaaggcattggcaatggaggtggacaaaacatggctgattggagaaatatttaggaggtcagaaggtcagcactatgtaattgtatatggcagctgagggaacagagtgtcaagcagtgtgcaggtttctagcctgtggaactggatgacattttgtccatgttcattggtgcttctgaaaggtcaaatattgcagttttgtattcttgggcaaaaaaaaagcgtaagagtataacataagtttccagagtgctttctgtccttttacagaatatcatttcaaatatctatagggtaattttccacaatgttgcatgtttaagtttttccttagtaacctgttttttatttttattttttggtgggtatgtctttttttcagtaccaaattacttcagaaatcttcatgcattcctataacaaagacaaaccacatattgttagttgcagagcaaataagttgaaagataaagaactggaatttgaggggcaaaggtccttaaatttcttatggttttatgttttataaaaaagtccccggtcagtaagcaaagtggttcccacatcaccactgaaacataagaggacaatggccatgatagacttcccagttggaggcaacctgtaatcccagcactttgggaggctgaggcagatggaccacctgaggttaggagttcaagaccagcctgaccaacatggtgaaaccctgtctctactaaaaatacaaaaattagctgggcatggtggtgggtgcctataatcccagctatatgggagggtgaggcaggagaattgcttgaaccagggaggcagaggttgcagtgagctgagatcacaccattgcactccagcctggcagacagggcaagactccatctcagaatcaatcaatctgcaaaaggtttctctcatgagcagtactatagtaggagactatcagcttactaatggtgagcagtaaacagaaatgttatttccataggaaaccattatattcccagtcagtgaatccattaaacatcagtaaaagaccaaaaaaaccctgctgaagtaaaattcttaactttttcaggataatatatgagatatggttcttactgatgtcaacggcaaatccaccatttacaaattcatctaaacctttaaaaatagttgttatgctcacattttattacagtaaaaaaaaaaaaaaaagaattccatcagagtacttccctgccttttattattctatatactttgattctattcttggcacatttagctttccaaattaaattgtgtaaactttcagatctggtttcatagattagttcttctattcacttggtcagtccagtttgctgctgcaactaaaaaggccaactaaaaggtgggccccctaaggagaaaaattgaaagtaaattagcaagtattagcacacctttttacatagctgccctgagcctgtccctaggggaatgagtggtccctgaagcactacacttttaaggataatagaaaaatgcagagaaagaaaactaaatcaggtgaggggtcaggaagtggctagagttagagatcaataaatatgaatgtagttgtcccctaacccccatcaggccccagtgtgtgatgttcccctccctgtgtccatgtgttctcattattcaactcccacttatgagtgagaacatgtggtgtttggttttctcttcctgtgttagtttgctgagaatctagcttcatccatgtaattaggacaaatacctgatgcatgcagggcttaaaacctagatgactggttggtaggtgcatcaaaccaccatggcacatgtatacctatgtaacaaacctgcacgttctgcacatgtatcccagaactaaaaataaatgaatgctgttacattaaagtcatcaagaatgaatgaacaagaagagaaagttacagatgaaaaaccagtgattattgaggatggttaaccctaagcatagtgcagacattaagattaaagatttagaaaataaaaagattgaagatttagaaactaaacagacctggatttgcttcccaccccagcatcttactaacaactgtcttggaaacatcacttcaccttcaaaataaaatatttacctctatggaattattgaatttcatgaggattggcagtttttggtgcaaagtgtgccctcaataaatgttagccatagttatgattaaaagatgtgaaagaaaaataaatctcaggaccccaaaatcactaagtcaaagggaagagtcaagctgggaaatgcattgggcaaagctgcctcccattctattcctaaataagatagttacaaagataaaaaagctacatacctccctcgcaatttgtccacaaggaaattccttgtggacaggccgaactcaaagtcatccctctgttcacatgagacaaatccatgtctaattgcttcctctgccccattgttccactaaagcagatgaagacataagtgactatttctgtaaattgtgcattcactgaaaggctaatcagaaactcaaaagaatgcaatcatatttctcttatctacctatgacctggaagtcccctccctgcttcaagttgtcccgcctttccaggctgaaccaatgtgcgtcatacatacattgattgatgtctcatgtagccctaaaatgtataaaaccaagttttgccccaaccttcttgggcacatgttgtcagtacctcccgaggctgtcacaggcatatctttaaccttggaaaaatatactttctaaattgattgagacctgtctcagataccttttggtttacagagactaagaatgaagagatctgtaatactgtctggcagaattcatataactgtgaggcagatcaataaaatgaattcagatctgtttaccaattgtggaattctacaaatgggaacataagcttgttgtttaaggaggaaaatttaaggctttttaattaattaatttatttattttgctttattggaagatgctatgaatggaaccatcatcaaaacattgttatctgtgattgtctaatttgtaacaaaatattaataaaaactgaatgagggtgaatccctcttctttgaagaactgataaagaaggcaagtgtcacttgaaaatcatttagaaattatttttctcttgccttcacactgtcagtgatagaatgttcagataaagaaacatatacaacgaagcaatgtctatgctctgtctatatttaagtttgatgttcttttgaaagagaaaataaatattgaacatattcacatctgtagatatttttaccataagcttatttcaaagatttaagatattcatccattttcttaaaaactgaaccatatttaaagagggtttacaaatcaggtatatatacatatataattgcatcaagtatttaaaagctagagcactctatttgaatatagtatttaacctcaaaattgtttacaaatatactgcacatgttttaggaaattagaatagaaaccaaaataaaagttccaaaataagagttaaggatcctaaggaaatgcagcattgtaaaattgagatgattctgtgagcaacccctcaccatgttcccatgaccactaaaatggctgaggattaattcagtaacatttgcaacctttgtatcttactaaggtattaaaatgcacactaggaatataaacttctgcctttatgctttgattgggagcttgtgggtgatttttttattgtatatgttgaaagtagcatgctagagcctggccataaatccttataaaaatcctacagatctacatccagtgagactttacctatttcagggctgttaccacctaattcagggctgctacatgtatgtcatacaactctcggggacaaagtcacaattcctgaccttctggcttatgtagtttccccatctccctcctcaacatccagaaatcactattcatcttatttttgtgagttacatttttttcattttagcagaatgcattatattcaattagagtggggactttgtcagtcacctttgcaagtgagtctccagtgtccagaataatgcacagtagatgattaataaacacgtattaaatgagtgaatgaatgaataagtaagtggttttaaaaaatgttctctctgagcatccaggattgtatgtgggggaatacagcctaaaagaaatagcttttaaatctaagagctaggggatgtaaatattcccattgtatacttgtaagatctagagctgcaaaacaaaaacaaacgtgtcatttttattaagaattgatgctttaaatagtttatttcattttacttattaacacatgcgtgtatgttcattcggttagcatttattgagtggctaccttgtgctagactctcttctaggtgtttggggttcatgaataatcaaaataagttggatcccctgccctcaaagaccttatatttcagtagtgagaaaaagaaggcaccaaacatcaaataaatgtttgaacactagtatgtggtcagaattatgactagaatggcagaaatgacaaagaatcatatgccgctcctgattctgtaggggttcattttatttgggagaaaattaatatgtaagaacttaaataataagaatgtaactaaatgattattcatgtcttttcttgttggctgggtgaactacatagcacacttattctgcgagtgctttagtaaggatatatatacacgttttatttaatagagaagttttaaattcacagaaaaattgagcagagtacagagaattcccatatacccactgccccatgcctaactcctccccattatcagcgtcctgcactagagtggtatacttgttgcaatcaatgaacctacattggcacattatcatcactcaaagtacatactttacattagggttcactttgggtgctgtacattctatgggttttgtcaaatgtataaagtcacgcattactattatagtatcacaaagaacaatttcattgcctaaaaaatatctgtgtcccacacattcatcaattcctcccttctaatttaatccctggtaatcagtaatctttttactgtctccataattttgccttttccagaatgtcatatagttgaaatcatacagtatgtagtctttacaagtaggtctatttaacttagcaatatgcatttaagctcccttcatctcttttcatggcttgatagctcattagtagatactgttttaaatgtagatggtttggaagaacttttcaaagaaggtaggtttgaccacgtcttgaagaataaagcttatatggagagaagagtggagtgtaggtgggtttcatggtgagaacctacatatggaggtgaaatgttgagaacacacttaggggaatgaagatggaaacagtttgcttgggcagagtgctcgcaagattgtagatggaggtaaaagtggaaaaggaggtaggtttcagactgattcatttatagtgtcctagaaagaatgtgatagaaagaaagaacagatcaattcagcggagatgtgcaggatagatggaggaagaaaataaatatgtatggttaatatgtatggtatttagatgttacagaaattttaaatggcctgcaattagaaatatttaacattgtcacattggactcctctgaacccaaccctctcaaatgtggctgagattaattatttggaaccttaatgagttggttttgtgcaatttcttcattttatgagtctagacactaattcacaactattcagttagaacctagattatgctaagaggtttaccgagttcaaacagaaacttctcaaaagtaatgatgtaaaaggcatgtagagatgaaaacctatgccccaaatcaccagacaatattctctatcttgttctcagtctcaattcacatgcttctcagtcatcttatatactgacagtatttattattagaaaatactgaaaactctagctcagtggtgcttccccccaaaaatgttagtactcatgcaatgtcgaatgcaatttcaatatgttcatatactcctagagagtgcagttaagaattgttgctctaagtaattaggtaagtagatgaagctacttattttcccttctcttgctttattttaggcgagaagggcaaactgcataaagtgcctggtagagtttgtgtgatgatcaacagtaggtaggcaggagcatgagaaggcactttatcaatgccaggagtgtgctttactcaacctgagtgattatttacatgttaagcagtcagtgttgtccaatgtgaaaaatggtgtcccttctatcatgtgatattcacatgggaaaccccttaaaattatcataacgcattctctagccataattctggtatactttagaaacttaattgtattcatttccagaaactagcaatagttacagcaagaaacagcattctacaccttttgactctcagaaaacattagattattagattggaaaatatacttcattctgggtagactgtctaaactatgatatttgcctctaggtttgcctggtaactaaagtctctatggtgtataaggcattttgtggcaggaaagtggtatgttgagcattgtcaatgaagctcttctccattagataatgagccccaaataagaaatagatgagtacctgccaaagaaagaagcctcagaatagcctctggtaaaggcaatttagcgactgagctctgctaatgagtacatgatagatgctggggaaaaaatgtctttcatcaagactgtgtgattcatccagcaaacaagtattaggtacccattaactagcaagctctataataagtgtcagagattcagcagtgaaaaagatataatttcctgccctcaaggaagtttactgggaaatttagacagaaagaaaagttacaaaatgctactttgaaaattaaaaaattcaaacagatctaattaattacttttggcaagttctttaaatgatgactctccttctaattgttaagggatgagacaagactgcaggtagactaggacacttacatgaggctgatgatgaagaaaacgacaaaaactcaccttactgaccaacaaacatgaaaacatgctcaacattgctgatcatcattaaaataaaaatgaaaatcacaatgagatatcatctcacacccattaggatggctacagagggaacaaacctgtacaatggcagaaaatatctgcaaactatgcatccaacaaaagattaacatgcagaatctacaaggaattcagacaacaacaacatcagcaacaacaaaacaccacattaaaaagtggggaaaggaacaattcttaaaagaagacatacaaatggccaagaagcatatgaaaaaatgctcacatcactaatcaagagaaatgcaaattaaaaccacaatgagatatcatcttgcaccagaaagaataattatcattataaagtcaaaaaatgaaggtgtcggagaggatgcagaggaaaagaaaaggcttacacattgttggtggggatttaacttagtacagtatttatggaaaacagtacggagatatctcaaagaactaaaaatagaactaacattcaatccagcaatcccactactgggtctatatccaaaagaaaagaaattattctataaaaaaaagacacctggacttttatgtgtataacaacactactcaaaatagcaaagataggtagtcaacctaagtgtccatcaacagatgattggataaagaagatgttacatatatatgtatcacacacacaccatggaatactacccagccataaaaaaagaatgaaattatatattttgcaataacatggatggaactagaggtcattatcttaagtgaaataactcataagcatagagccaaataccacatgttctcacttataagtgggagttaaataatctgtacacatggacatacagtatggattaatagacactggagacttgaaagggggtgaggataggagggggacgacagataaattctttaatgggtacaacgtacactaaaagcccatactttaccactatacaatacagccatgtaaaaaaacagcaacaaagaaaaacagtactagtagcccctaaattatacaaattaaaaaacaaaaaataacaagtgctgtcaagtatgtggagaaattggagtctgtgtgcattgtttgtggaattataaaatcttgcagccactaaggaaaagagtatggaggtttctaaaaaaaaaaaaaaaaaaaaaaaaaaaatagaattactatataatccagcaacttcacttctgagtatatgtcccaaagaattgaaaacagggagttgaagagatacttgcacatccatgtttacaacagcattattcacaacatctgagaggtggaagcaacccaaatgtccagcaatggatgaatgaataaacaaaacttggtaggtacacacaatgggatatcatttagtttttaaaaggaagaattctgatacatgttacatgaatgaaccttgagaacattacgctaagtcaaatatgtcagtcacaaaaagacaaatactatacaaatccacttatatgaggtaactaaagtagctaaattcatagaaacaaattagaattgcggttgccggtggctagggagaggaggaaagggaagttgtttggtaggtgaagagtttcagattcgcagggtgagatttctggagatctgatggacagccatataaatataccgaacagtattcaagtgtacatttaaaaatggaaagattaagcaaactgtggtacatccataccatggaatatgacagtaataaaaaggaatgaactattgatacatgcagcaacatgtataaatctctagagaattatacagagcaaaacaacaataaaagtcaatcccaaaggttacatattgtcatatttcatctatgtaacactcttaaaatgacaaaaatacagaaatagagaataaaaaagggttaagatggtaaattttgtatttttatcacaattaaaatttctaagtatgcaaaaggaaaataaaccctattttacaacctccatgttcagaatccaatgttttctctacatgtgtgttagggttaggagacacgtttgactttttgtctatataaatctatataaagatttggagtttagcaaatgttgcatctgagaacatttgttacttttcaaaccagaattttatttgccctttcttcacatggactttgaaaaatacagtccaactgagagcttcctatcagatagtttaaaaaattataaactattgtgaaataattaaagagatgactactaaagctggtgtttgctgtgatctgacatgtttgtgtccctccccaaaattaatatgttggaacctaatccccactgtaatggtatttgaaggtggggctttggaaggtggttaggccatgaggatgaatccctcctgaaatgggattagtgctcttatgagggactgaagagactggagttctcccctttcaagtgaagacacatcgagaaaacactgtccccaaaccagaaagccctcatcagataccaagtcttccagcactttgatctggagttcccagcctccagaactgtgagacatatatttctgttgtgtataagctacacagtttatagtattttcgtgtagcagcctgaatagaataagatcatgtctatggtcagagcacaaataagatacagcaatctttacacttactctggcttgtgcaacaatgttatgtatcccagcatataactgccagaatggaacattccagacttactgatatagagcacttgactatatttcactatacatacagaatgacaaaaaaaaatgcaggatgaactgacaataacctttaaggatgaaaacaaactgcaagttataaaagtttttaaaaatagtagtacatacacaaacacatattttgaggaaaggttccaattttgagggatgaatggcattcatccatcttcttttctgctggagaagtctttgtgaaggaaaataatattgtgaataacaggagtgactgttatgtgatgtagaaatgaaaatgaaaactaatgcaaacagtaactgggagtgatggggctagtatggtcaccagaaaagataactgaccataggatctaaaaaccttgatccttggtgtttactcaaatgagttggaaacttacatccacacaaaaacttggtgtaaatgttcatggcagctttattcctaattgccaaaacttgaaagcaatcaagatggccttcaataggggaatatacaaacaagctttccagacaatggaatattattcagtgataaaggaaaattataaagccatcaaaaaatatgagaaaccttaaatgcatattactaagtaagagaagccagtctgaaaagcctatacactatacgattccaactatataacattctggaaaaggcagaacggagacagtaaaaatatcagtggttgccaaggtctagaggagagggggagggtggagagagggagggatgatgagtaagtgaacacacaggatttttagggcagtgacactatctgtatgttactataatggtagatacatgtcattatacatttgacaaaacccatagaatgtacaacacctagagttaactctaatgtaaactatggacgttagctaatattaatttatcaatattggctcgttcattataaaatttgtaccatactaatgtaagatgtgaataagggaaataggtggagggagggatgggagcaaaaggggtttatgggaacgctctacttactgctcaatttatctgtaaagctaaaactgcttttaaaagtttattaattgaaaaaattaaaagagaaatttgactcagggtggaggaggatgttggtctggaggcagaactgtcgtaggtgctgcaaaggctcccccactgatgtcttaataagttccacagtaggaattctcagcaattatgcatcagggaaaatacatacattaagtttccaagaaccacatttaaaagcccaggttgacgaagcaaaaatggaatctctaggtcaggagtgagaaaacaacaagcccttaggtcatatacagcctgccaactgtttaaggaaagtatggttggaagacagccaagaccattaatttacatattgcctaaggctgtttttgacgtccaaacgcagtggaggagtagcagttgagaccatctgacccacaagcctaaaacacttaacttgcactttacagaaaatgcctgctgactcctgctctagttcctattggctaaatatagcattcatgggattccctaatgttatatataaaaaaaataatgctgagatgtggaaaccttctctgggggaaaaaaacaaaacaaaacaaaaacaaacaaacaaacaaaaaaaacaactccatccttggacacatacctgtgagaatatgagatttgcagagactactgtggagaatttttttttctatctgatctatagaggtaacataatattcatgttgattcattaaaataactcaattgtgaaacagattaaacagcattctacaccatatattttatttcacttttaattatcacctttgatacactttaactcctatcagtaaatatgaatgggcacattttaaatgaagtctgtaagtaaagaaatatcaaccattaaagagaaaaatagaaatatgaagtacttgtttttgcttcactagaaataacatcaaaaacatgtttatatcatctttatcttttcaacagtctaatgcactgttgaccagagaagaatgaaatagttagaatttgatgtaaatgaatttttaacatattctatacaaattttaatcagttgcataaaatacaaaagaacagtaatctacatgtataaaatacaaacaagtcttaatattgtgaatgatgatattaaactaaaaataatattatgaatgatgatattaaatgaaagtacttggcaaagtcagtctctgtatcatttcagaatgcttttagcaacaagggaattgtagctgaatttgggatttcccaaactgcattggcttacgcagtggaaagtgagcccctttcatacagaaagtctctaaaccttggtgcttctagtgttagatcagtgcctctgagttcatcaggaactcatgttctctctattttttcccttctgccattctaagttattgatgacgttctcgcacataatggttgctctagctccaaacattatattttcatagaacagcatcccaagtaggctagaagagggcagggccaaaaaatggctatctttttggaaaaagaaaatagtttctcagcagctttctaaaaaatattatttatcttaatgttcagaaccaggggcacataaccacacctagactaatcactggataagcgaagtggggctgctatgacagatataaaaagtgaaatgtattaatcacagtttaattatggtttgataattgtttagtagcctttaaccaaacatcaacttccagaattaggacatatgaccccctaataaaagcaggttctgttagtgaggatgaaggaattcttttggaattaaggtaaatttatctttctcttgcaacattttaaatatataagtgatatatatttaatggtatgacccaattaaaaaatatgacatgcaaatgcaattcagtaataccacattccatatattatatatgatcaaatacacacacacacagacacacacagacagacacacacacacacacacacacacacacacacggtctgtaatttgaatggtggtaaaagaagacctaaattctattttagttccaccttctcaacttaaagtcttaaagtattttgttcctaaatattgatttgcttttttggattttgtggtttgcaaatttttattgttgtcattgaaaatgtaatttaaaccaatatttttcttattaaaatttccttgttggccaggcgcgatggctcacgcctgtaatcccagcactttgggaggctgaggcaggcgcatcacctgaggtcaggaattggagaccagcctgatcaacatggagaaaccccgtctctactaaaaataaaaatcagctgggcgtggtggcgcatgcctgtaatcccggctactgcagaggctgaagcaggagaattacttgaacccgggagacgcaggttgcagtgagctgagatggagccattgcactccagcctgggcaacaagagcaaaactccgtctcaaaaaaaaaaaaaaaatttccttgtttatctcaacagtgtaggagagtttctggtactcgttattgagtaaaagctcaaaaaacatcctttaaatgccaggcaaggagacctatgtttgaagaaagtagccagatgaggccattgaacactgcccatgaaaaaaacaaaaacaaaacaaaatagaaaacaaagtaagaaagcggccaaatctggagaccacgtatgcccgcgtgcctggaatagccatttctttgccttttcgtgctagctagattactcttaagaatgttttgaggatgaatgttgtcatcttcctagtttggagttggattaggtgtctcctaggctgtttctctggctccctgaagctcctcagctgctggggctcctaggggctgatccagggtgccgcatggtcactgtttcagtgcagatggtatggacaaaggagccatccacccatgtgtgtttcctcctgccttaataaaaaagtagagaaaagccagcttcttctttgttgccaagagttatcacagagctctgctcagacagtatctttccctgttgctctatctttgtcagtgtttctaatgtgtttaagccatatcactagagtataccttcattttaacaataacaaatggccaggtgcagtggctcacacctgtaatcccagcactttgggagggtgaagcaggtggatcgcctgaggtcaggagttcaagaccagcctggccaacatggtgcaacctcatctttactaaaaatacaaaactcagccgagcgtagtggcatgcacctgtagtcccagctacttaggaggctgaggcgggagaattgcttgaacctgggaggcggagattgcagtgacccgagatcacaccactgcaccccagcctgggtgacgaagtaagactccataacaaaaagaaaaaaataataataatttcttaacaaaaatagttgaacagttcctgtgatttccattctataaatggagaatctgaaaatccaaaatactcataataatgatgaagaggaagatgacagttattaaacttggagaaaaaaatcagttctcggttctcatttaactgtaaactagggttaaaatgctaagtagaatacacttcctaacagaaatggaagttaaatgacatatctttttgcctaagaacttatacggcatatcaacattgttgcaagaaaacaggaaggagtaaatatctaagtatgtacatataaacttatacaaacaaatactacagaaacattactatatgtgatatagtaatcataacaatgtctggaaatatcaaactttgggttaaaattacttttgagtttagttcaaaagaatgcagagaagacattctagaaatacttagaatagctcacgttagctacgttttttcacaaagatgcataacataagaataaaataattctcacttcacactacccaccctcttaatccttgtatattctttcccaattttctttatgtctgtcaattgcctcttaaactttacgttacacatgaagaaccagaggcgaggcatggtgtttcatgcctgtaatcccagcactttgggaggctgaatcaggattgcttgcacctcggagtttcagtttgcagtgaggtatgatcacaccgctgcactccaggtgacagagtaataccccgtctcttccaaaaaaaatgagtaaataaaaaataatgatcaaaagagttggctaaaaataaatcagatcaaattttcaaggaattcagaaaaattggggtaatttgatctcaaactggagagagaattgaagaaactgcctgaattgctgttctccacatggacaggactgtcatatcttatcagttgacaaacaattaggcatatttgtcatctgattagtctgcaactggtgggaaagtctgagtggcttcctcatgaagtaattgaattgcattttttctctttcaactctaatttgcaaaggaaagtttagccccatgtcagctttaggctgggttagtgataagagtatatgcttattctcaacccacatacacttttcaagaacgtcttctatagttttaaaatgggagttttttaattaatggaaaaagtacctaatcttaaagacaggagtagctattctcaggtaaataatacatgaacaagagagattgtaaaagttattagtgtagctcttcccaattctatataaaaatcatatgccattgttacagatactattttagtacgagagcacagcaggctgaattttcttggaagaaaggtttcaattcagactgcaaccttccttcaaaaatacaataatgataaagccacccatccttcaaagacttacctttttccaaagttaatatctccttatgaacttagattaaagttaaaaatttattttagactaattcatgccacataaaacctttctttgtgttttaatagaaatgcatttttataatatgctatttttctggcttgtagaggtagataaaaatgaaagtcatttgtacctgagaatccaagtttaattgccgtagtcttgttttgcatgagtttagttgttttttttatttgtaagataaccattcagtgttctagaaacactctttaaaatagtcttaaagccaggcacggtggctcacgcctgtaatcccagcactttgggaggctgaggtgggcggatcacgaggtcaggagattgagatcatcctggccaacatggtgaaaccccgtctctactaaaaatacaaaaattagccgggtgcggtggcacatgcctgtaatcccagctactggggaggctgaggcaggagaactgcttgaatccaggaggcggaggttgccatgagctgagatcgtgccactgcactccagcctgggtgacagagcaagactccttcctccaccaccaaaaaaacaaaaaacaaacaaacaaacaaacaaaaaactgtcctagaaaagaagcaaataacagttgaatctacatattttcatacaattggcactatcctgagcccagattttttctgtcaataattattaaagatcaaattttaaaaaattaagttagtataaaaagtgctcagaatacataaatattacttgtattcatagtgttgcaaattttgagttgaaattttaagtactacaaaaaaatatttattgaggtggttttaagaataacattgaactctgatatcaaaccgagagattttagcagaggagttataacacaaatgttttactttctaaatctgaactataaaagataaaccaaatatggtgttcaacattaatttcttaaggttgacctaaactgagctctctaattactatgtgaacatttggattttctttttctcctttggtatctagagaatatgtttgtcttatttctaaatcaccatataaaacttaacaaagtcctatagccttttgtttgcttgtttttatgaaacaaatttggggttctattttctcatatgtttagttgtgtgtgtcttttgggagaaaaggggggaatatattttgaattggaattgaagcagataattttaaaattcagagctgaatttattaataaggaattttatcctaaaatacaaactgagaaatttgcaatagcttggttttaaatattcccacaagactaatagattatttagaaattgaaagttattaattattcatgtaagaatcacttctcagcctctccttcaccttgagtaaacagttatacaatccaattttatgagatggctacagaagatgcccttactttatatgcaccctgatttagataaaggtcaccctctagtggggttgatatgtatttcaatctcaaacctcactcaattgccttgcctttgaatagcaaaatgattgattttgaaaaccaaatgcaaatccaggttcagggatttttatcagcgtgtcaaagatgaagagatacagattattgtatttagccccaggaaactgggattaagaaattcaaagacccactaagcttattaatgtcatgttaaagtcattgtgaataccttaaagtggatttaaatgacagtagaaaagtaagtagcctggtcctaatttctaaaatggaagaataaaaatctgccattttcctggttaagtatcacaattttagaacttctgcatcccatttagaacttatatatataaaacatctaacatgactgcttatattgtaggcaacctgtggattctcttgaagttaaacaattagaaaataagagcagtgtttgtaaattaaatataagctcaataatatgcttactatttattgaacacttaccttgaactaagtgcctttttgtacattatcttagttttataatgacaacagaaaataatctaaagaaaaactatgaaggatcaattatcattgttttattcagacaaggaaatggaagctgagagcagcagttctaactttagcatgcatcagaatcacccagaaagctagttaaaatgtaagtctggggacagagtaggagcgagtttgcatttctaacaagttcccaggtgatgctgatgctgtttgtctagggaccacactttgtaaatcactgcaccaagttagaatgcaaatatggcttttgctagcaaattccttcagtgtgagtatgatgagcacttgctagtagcttaatatattttactcttctgcccttgtagagcataacatggtaactatgtggacctagtaacaataaagatacagtaaccataaagacacaataactaaataattgcagggcttgcttggcacccagaaatctaaacctaatactttctcttatttcttgacctaactttctagttctctatgtggttggcaacaaatcgaaaaagtccatgaaaggatgtaacatcctacaggaacatatgtagtgactgagtatagatcagcagtcctcacaattcagtgtgcatttgtatctgggccccatgaatttcaaatcagcagttctgggttgagggatgaggtatctgctctaataagcaccctagatgattctgatgtaggtgttgtttccaacatgctttgagacaatctgacttaaagattcaacagatgtttggttgcttcttccatgagaaaacaacaataacaaaagcaccttttccatgagagatcaaatttccaaccaaatcttggtttagagcatgccagagctctgactatgactgctttctgagtcaagtgcagaacagagctactactgcacagagttatcgtgagtattgtcattttgacaattctgcatccaaacacacgttgatttgggtagagtcacaagacaggtgagaggtaagagcctatccctaacttttctgtccccttccactaaccccagcaattagggaaccgtagatgatgtcatgtggccaatgagatgctctcaactgggagtctgaatcttgagggggtgaggcacatatatatgtacatgtattagggaacctgggatggagtagagaatgcagtgatgaatccaagagtgatcaggatggctaaagatcataacgcatcagtgggcaataagcagttagcggaggtggggccagtggtgcagcccatgcagactgtatctggctgggctatttctcttctctcccatagtagcttggttgcctgggattcatacagattctctgagtgcccattacccttccgacccattgttacgattcttaacatctgatccctaggttggaaagacaggttcacatcattcaatgaataactgtctcacctattttaattttacatatgaccttcttactgatgtgactcctgggaaaataacttaatcttttgggcttcagtttgctcagctgtaaaattaagagggaggaggcaatgttctctatggcacttctcagtccttaagatcctgtcctatttagccttataatagtctttgggtgggagctattactgtagagaaaagaggatcagatttgttatctagcccttttctgcagaggtagaaatggaatttagataaatgaaaggatcagcctggaagtttcagaggctgtttccctctcttcttataagctaaacttagtggcagctaaaaaacctaataaactcctaagaggaaaaaggatttcccaactgacagagaaatcttgtgtttcttcatctaataccaacccctgagcctgcaaaaaataggggtgactccaatggtcttttccgcacagaatacagtactagcaactaaagagaaaatccactttttcatacaacatagggtaacaaagtatccttagatggaactatttttgatggaaacaaacctgagtgaaatatgaaccagtacgtgagaatgaaaggcaagactattcctatcagattctttgaaagcatttcagttcctagagtctgggaaataaaatatatctatttggggcttactctacgttcactgcttcctgtctagctttcaccctctattaaaaaggcttttgtctaagaccttcacttatttggtgacttaatattcaccctatcaatacctattgttaaatgatgcctattcacatgataattttcagagtcacaaagactgtcgcagggagagttaaagtggcaacaaaatcgatgaaaagtaagcataaagtgcactttgaaaatggctttccagtgtttcacgtgctcaaagaactgttcatgctgttcccttgatcaaaagccgtcagtggctccccatcccttaaactgcttttggcatgtgatactctgaaattgccttaaccaaccacctcatccatccatgtactcattcaaatggtaacaagtgcttactgagcatctattgcatgctgatcacctgatatagtattttctttaattccttccagcctccctggtattccccgtcttgcttccattactttatttttctcttcccaatacccactgatttttgaaacttatttgtttatgatctgtcttcttccactggaatgtaagtcctagagtagcctacaacaggtagacaatgagcatttgtctaataaatctaaagcatttaaaaatattcaaagtcagcaggcttaatattttgtagaattaattactctcttgaaggatgaaaaaaaaagtattacttcacctaaataccctattaaaaatttaatccttggataaaattctaatacagtaatcttacttttcaaaccaaaatattaattaggcacacttcttctccaattccatttactaacaaaggttataaggcccaatgccttaaattagagacatttgtcatagtaaaacaacaaaataatgctatgtgattctatgtagtttacatgtaaaaataacttttagctttatataatttgcgaaccttcaaataaatcacagaatatgcaggagaaaacacaaaccagattctttaacttatatactgcctaaaaatgaggaaaaatgagacataatgacacacatagatagagattttcttgctagttggaaaactcagatgagaaagttataccacaatctatgttgtattttggggtattttaaagaccacagtgactgctgcctgtcacttggccagtcaggggaaagttcaaaacttggaccccacgtgactgtgggtctctgtcagcaagtccccttctactgttctgaggcatgcagaaaggtcgactatagacaaatgcttatttaggtttcttggtcaagttagcagcaatgactatagttaacaataatatatagtttcaaagagcaccaaggaggatttgaatgttccctacacgaagaaataataaatgttagagatgatggctaggctaattaccttgatctgatcactgtacactatatataaaaacatcactatgtactccatgaatatatacaattatgatttgtcaattaaaaaattaaacattacaatttatcaagaaaacaacgcttgtcctcactaatggcagttgggtaggcatttctctgccattattcagttcataatctaatggcttaaaatcacaattaaaggctcccatctctgggaacacaaaccaacacaagagtccctaagagagaggccgccagggagttagaattggacaggaaccagctaattccagccctttttgattctgctgattttgatatctgaatactaagcagtataggttgatgatctgtgtagcaaccatgtgaggtactgtgctgtgctgtgagtagcctgctccattgatagagacttaataaacttggtaaagccaaaatccaaatggtaggagcattttgtctgatttctagtagcactgttaaacatgctttggaaaagcttggagggatgtgtgcctatgtgaaagagggttaagctacagaatgctgcagtaaatcttgcctggcaatgcaatattttgaaatagcaagacacaaatatgaaattggcaatatatgccttcagctggataagtgtttcagtgaattcttctaaccccattgtgcaaaatcccaaccttcggaccgagtttaagattctaaacaagaaactcacacatttattatatcaaaaatacctttgtcaggggcattatattcaagtaaatcaagcaaaggcataattgtccttctcactctatctgctttgagctatccattgaaagactaacaggaaatatatacttaggtaatacatataaatataataacaattcagtcagttgttgttggtctgagtgattatgtaacgtgggtcaagaaatgaaacaatatggcaaaaccaaaatagctggcccatcggcattgctgcaaatgctcccttagttgaatggagataaccatagttcaatcaaaataattgtaagtttgccatctttctttacacttcagtattaaatacctgctgggaacctgaaataggccagttttccttgaactgtatggaattagcaattgtcacatttcatttttccaaatccgtatcatgtcaaatcctacctcccatggtgtcacatttttccctcttgcccagaggaatattttcatgctagtcagtaggttgtatttaggcaggctctgacactgccatagggaatatcagtgctgcaccaaacacacaccctgcctccagcatccagccttcagccccatcataaaaaggtcagacgccatctttcagaccactaactgccatttctctttatcatcacaaggaaaggcaaacatagggtttgttggaagtgtgtagaatgcacagaagtaagcaaatttggcctaatgagtttggcagggttggaattagagagaatagagtgtgatgaagtgaaaggcacagcacagagacctgtgattacagttagaaacaccattttacctgtgacaaagtcaaagatcacaacattctccagtcagtcatccccagctgtggttaggccagctgtaaggcaaggggtgctctctgtagcactgattggcataagattggttgtctcaggtggctggaatgtaccactgtcaatatgtaatgtactcaacccatgggatggaatgaacagtattttaaggacctagttctttttttcctaataaggaaataccactttaatgacaagattgagacaggcatagtgaaggaactttgtgtgtggagacatcaggagtgaaatttggtcctgtatttatgcatttccttttcctctctagcgttaatttgaggtaagaaacttaacttcctggctgggcatggtgactcatgcctgtaatcccagcactttgggaggccaaggcaggtggatcacctgagagtaaggagtttgagaccagcctgaccaacatggtgaaaccccatctctagtgaaaatacaaaaactagccaggtgtggtgatgcacacccgtaatcccagctacttgggaggctgaagcaggagaatggcttgaacctgggaggcggaggttgcagtgagccgagattgcaccactgcactccagcctgggcaacaagaatgaaactctgtctcaaaaaacaaacaaacaaacaaacaaaacttaacctccccagagcagcagattgagactggcatggtgaaggagctttgtgtgtggagacatcaggagtgaaatttggtcctatatgtatgcatttccttttcctctctagtgtgaatttgaagtaagaaagttaacctccccagaacagcagctgaccaaagtggcagaagctagtaagaagtctgtcccctggggcacagggatccatcactgacactgttaagaattgttggcactgagtggaaataaaaagcacggtaaattttagttggttttattattcttattttaatactctgattccaatatactttcttgttggctgaaccctgggatagtttccgctgaccctctgcccctgctggaggtctctaagcttcagttcactgatttgcgtatggcaatttcagcatctgctcctactaccccacagaattgtgaggatcaaggtagtaatgggtgagaaagtgttctgtaattgtcaagcaagttgcgcagttaagcacatgattatctgaggtgtggagcagagtgaatgtgatggaaaattgaacctcactggtgatctcccaactctgtctttgctcttgctttagaattattttccctaacccacaagtgttgcagaaaaggggcgattaacaacaaaatgagattcactagtttgagcatcagcttgtttcttcactctccctgcttattctgagcagtttctcaagcttggcatgattggccttttgggccatgtcattctttgtcatagggctatcccatacgatgtaggcttagtgggattcctggtctctacccagaagattgcacctcccccaccacacccaagctgtgacacaatggcaagaggtactgaagttaaggaagccggaaaattttcaaatagtctttatttccaaatagtctcaaatgtacttttcataaagcaaccaattctgaattttaaaacagcttgtatggagttgaatttgaccttggatgagaattagcattttaatataccactaaatgatagtgatcccactgggttgaatacgaaaatcactcaaggactgtaacttcccccatctagagtctctatgtgtttgtcataaagtcatgctttatgcacacaatagatcagaggcattttgtgagcaaggagctctccttgtcccattttgatttggttcatatattctacaacctttatatgaaagcaatatcaaaggatgacttaggtcatcatgactacatcaggacaatgataatactctgcctctggcacatatattccttctcttaattctgctctttctcctccctactttatatttcagttgtcagatattagagttgacaagctaatgaaaattgaattgactactaaaaaactcacacatacaaagatagagaaattacttgaaaattccctgtttgggtcaattcaatgcagacccttgcttggctgcaactgtaaacccatccagcctctaaatggcattactctacaactgacaacattggtccctgggaacactgccatagattaggttaatagtggtaaaaagatgccttgctgtctctcacaaattgtgctagaagacaatgatggcctccatggaggcaagcaggtgaactgattgcttagggaaatctcagaattggttcgttataccttcctactctttcctttatagaatctttacttgccaaatatgtatttcatgctacagattcatacagttgtgaaatgaagaccacataagagaatcaatatgtgaaacaaatcctctgtgcatatagaagccttttatttattattattattattattttatttatttatttatttatttattttgagacggagtctcgcttttgtcgcccaggctggagtacagtggtgcgatctcggctcactgcaacctctgctacctgggttcaagcttctcctgccctcagcctcctgagtagctgggattacaggcacctgccaccatacccagctaatttttgtacttttagtagagacggggttttgccatgttggccaggctggtctcaaactcctgacctcaggtgatctgcccaccttggcctcccaaagtgctgggattacaggcatgagccactgtgcctggccagccttttacttcttaaacaaatctatggaaatcacacttctcaaaattgtgagcctcaataatttggaaaaccgggcttaataatcattaatcctcatctacaattttataaccagaaactgtactagctggaatgatatcattcaggtgcaagatatttgatgtgagtatgaaatgccaatattttaaaaaatgaattgcatagttccatcaagtcaaggcacgtgtgtgtttcctcatgatgtccatggaggcagaagtcacaaccttctctttttcttcctctcttccttttttccaattcttactacgggcttccatgagctaaaaattggttggtgttcacatagagacctgaataagtcaactccctgccctccaggattgcacagacaataagaggaagcagatatttatttagcagactcttgcaatatgttgttaggggcattatgacagaagggagcaaaacaggcaaaatagacacagaagatatgggaggaaggagttctcagaagagtgttgaacagcatcaaaagcagtggagaagttgagtaatatgagtgcagtactgggctgaagagtgtcctccaaaaatccatgtctacctggaactctgaatatgactttatgtggaaatgtggtctttgcagatgtaattagttaagtttactttaaataaggtcatagtagtttagggtgggcctaaatctcatgactggcatccatataaaaagaggagacacatggggcaaaaacacacacacaggggacaccatgtgaaggcagaggtagagattagggtgatgcgtctacaagccaaggaatgccaggcacctcctgggaatgaggagagaggcatagaactgattctccttcagatccttcagaaggcacccactataaataatacaggtagttttcctgtattatgcataatagtcttaaatagtcttaactaggctttaaatgcaattaatcactaatttgtaatgtttgtctgtttattctctcaatttatattgacaagagataaaataagaataacaataaaataaaagctctcctcaaagaagtctgaattatcgtaggcctttacatatcacatatctttttgttctaaatttttttctagccacgtatgtgatgatgaattaatatacactatgattaataattataaaggagcagcctgttctattgtacagagctgtggtttgtcaccatcgctgcctttgagaatctcctggggagctgttttaagtactgatgccagagtgccagcctccagagattctgatttaattggtctggtgtgatacgagatcattctttttttaaaagctccctagggtttcagaagtgcagcacaggttgaaagctaccgatatagagcaaagctttactaaaagctgatatgtggaagcaaagaatgtgaaatgactcctgaaggcaccaaactgacaatgcaaatcaaatccaagaacaagctctaaatgtgtgcttgtattttactgaatcccttttgtaaacccatgcaatattttaccccaatattattgcaatacaaactgggaaagataagatactggaatgtaacctgcatcagacagatagcaatatctcattgatttagagcagagcagaccaagttttggagtagagggagtagttcgatgactggcagagaagcgggtaagaatttaaagacaatagtagaatcattatctctctgctaccctgttgggacaaagctctctaaaataagcaactacacagaaggaaaaaaatggtcatttgaccatacgtattttgagagaaacaattacttttttaaaaattttaaagtgtggatttgaatttaatttttttatacaaatgaagtacttttgaatacagagctaagagtatattcttgacagcttgaaatagcttcttcattttcctctttgatgcccatatttgtatttcattgttttcataatttagagtaggcattattgtttctaaaacgaacataaaagcaaaacataaaaatcaacaacatgtaaatattttagtgtcaacagggaaatctctaactgtacataagataaaatatctattattttaaaaataatacataccttaaaatcatactctgaaaagactgaatcaagcaaaaaaaaagcttgatgaatgtccacataaaacagtgggaagaaaatatgtttaaaagtacatttactaacaaaacatgttcaaggtccatatgaggagaactgtaaggctctaatggaaaaatcaaagaagaaccaaatgaatgaagagatactccatcttcatgggtaggaagactcaatattgtcagcatatcagttatttccaacttgatctatagattcaattcaatcccaatcaaaatcccagtgacttagttggtggattttgacacactgatactaaagtttacacggagaggcaaaggtccaagaatatccaccacaatattgaaggagaaaaagagtgagaggactagcactacccaacctcaagactcactatacagttaccataaccaagacagtgaagtattggtgaaggaatagacagatagatcaatggagcacaggaaagagcaaagaaatagacccacataaatacagtcaactgacctttgacaaaggaacaaaagcaatacaataaagaaaaagtagtcttttcaactaacggtactgggacaactggaacgtccacatgcaaaacataaatccaaacatagatcatacgtccttcataacattaacttaaaatggatcacgtaaataaatgtaaaatgcaaaattataaaaatcctagaaggtaacctatgagaaaatctagatgaacttaggttgtgctatgactttcatatatgacaccaaaggcatgattcagggaagaaataattaataaactggacttcactaaaattaaaaatttctgctttgcaaatgactgtcaacattatgtgaagagaaaccacagactgggaggaaggttttttttgcaatagaaatatctgattttaaatatacaaatatctcttaaagcccagtaataaaaaacaatgcaagttgatttaaaaatggaccaaagaccttaacagataagttgccaaagaagatatacagatggcacataaacatatgaaaagatgttccacattatatgtcatcagggaaatgcacatcaaaacaaccactgcacgcctatttggaatgctcaaatccagaaaacttacacaatcaaatactgacaagaaagtattagacaacagaaactctcattcactgctggtgggaataaaaaaaaaatggtacaaccactttagaagacagtttgatggtttctcataacaactaaacattgtcttactacatgatccaccagtcatactccttgatatgtaccctaaaatgctaaaaacttctgtctacacgaaaacctgcatgcaaatatctatggcagctgcattcataatttgccaaaacttgaaagcaaccaagatggccttcagtaggcaaatggataggtaaactgtggaacatccaggcaatgaagtattattcatctctaaaaggaaatgagctgtcaatccatgaacagacatggaataaacttacgtgtgtattactaagtgaaaggagccaatcttaaaagcctacataccacatgattccaactgcatgacatactgtaaaaggcaaaacaatggaaacagtaaaaagatcagtggttgccaggaaatggggtggggaaaagaatgaacaggcagagcacagaagatttttagggcagtgaaaatactctgtatgatactataatcatggatacatgtcatcatatatttgtccaaacccacagaatgtataacaccaaggataaaccctaatgtaaatgatggactttgggtgctaatgatgcatcatgtaggttcatcaattgtcacaaatgcaccactctggtgggggatgttggtaacaggagagactctgcatgtgggggcaaggggcataaggggaatctctgtgccttcatctcactttttctgagcatctaagagtgctgtaaaaacataaaagtctttttttaagtacatttatatcaagattttattcctgtggattttcctgcattcacaacggaagaatcacttatgaattgtttgggtctaactgtaatttttgtacaaaccattcattgtgggctaatgtgtgctgttacattaatgctgttagtaattccctcatgtttgctatatatttttatctttacctcgttattgtatatattagtgagactacaaaacacaaacattttaactgaaatattaaatactgttttataagtgggattcattaaaacaaacatttggataatgaatgacaggttaaatttcatttaatgattaataaaataaatattgcactaaaaaagaatagcctgaaatactagtattagtcctattatctcagctcagggttgaaagtacttaaattattaataagacaaaacagtcatctaattgttttcttttcttgtatgacatttctgtaactacagaacaagaaagaaatgtcaattatatatcaatgagtaattcctgttaaagtgcatagtgaaaaataccaagtaagaaactacaaaagctaaaatgggttagcataatagtaagatactaaacctgatgcttttcaaaaaattgttaatttggagcaaatggacagaacacactgcatttataaacaacctaatcaatagtactcaaatatctactgcagtgttctaggaacattatttaaatcaaagaatgacatagaactatcaaggaactaacttattgaggaaatatacaacaaatagtaacaaaatgcacagatttaaaactatattaaacaaacaaaacacacagatttaaaattatattaaactatattaaattatattaaactatactaaattaaattaaaactgtgtgaatattttcaatctagtaaaatcaatgttgagttaattgatctaagatattgtagaggatgcttaatgcttaaatatcttagcatgggggctgtagtgcagaaggatgtttggtgcaaatcagcatggatcttcatattctttcccatggaaagattcaagcccctacagtgttagctccacttggcaccgtatttcattagcagtgtggtagcattctatctctacatccacaaagagagtagaagaaagctttggcaaatacattgaggctaatgagacacatgatgaaaggttaatttaacatgttacaaggctttaatcgtcaatgtgaaaaatgcccccccacccaagtattgacctgagaaaagatttctcctcattatggctaggctaaaaatcaggattaaagcattagtagattattatcactcatgtggcccaattttgttgagtagtaagtctgtgcacacaactaaaatgaacactttaaatatggcattgacagcttcaataaaattatacttgtagtaaattttagacttcaggcaaatacacatctggatgcttactcaatcagggttgttgtaatattgaatattaatctggcccatagataaattacagcctgattttctgatctatgaattcaggaaatgggctgaaaacatttttaggtaaaactttccgaagttttttcaacttgagttgtgtggaattctagggattctgcatacttggttttagattccttttttttgaaacacattttaatgatttttgaaataaaaatatacatactttaaaggagagggattaaaatttttctcttaaatttgagagtttagacaaactctcaagttaagtacttgtaccacctttccagcccatatacatgtataaaacaatgttgtcaaacagatgttattttctgtctgctcttgatacatttcaataaaatacataagtaatatattcaaatacaacagccattcacattcacaggaaagaaaaggcattgttgaaataagacatgaattattgtgttcaggaggacattggggaggcttcctagaccagagaaaatttggctatagttatgttatgtcacatatacattatgtgacaatgaagcaatattaaaaaagaagaacccacaaataactcaagttcaaagacaaaaataaattctagctttaaagttaaaagctgaaaagtgccagaattttctaactgcacaatctaaaagccaatccattgttgcctgctaattaagccaccacggggtttcatataattaatagcaaatcgtctctgaatggaaaaataaaatagttgcaacatgcctttacatagacatgcattttagacagtctgtctttaaactatagtatcaggacagactttccatgtagaagagatgattaattatgtcttgggttgggtgctctctttattttcttttctctcaggctagaaaagctttggtttctataattacttctcatttatctctagttaaatgtgggcgaaattttctattaattaaatttgaattcactctaattggtaagtttaaaacgacaggaataaattatagcacatattgcaacccaaataaggctgaattaaacagatacattatgtggcaatgaagcaatgttaagaaagaagatcccacaaattcttcaagttcaaagactaaaataatttctggcgttctgttaaggttagaaaataaggattctcttttattaggcaaatgtttggaagaagcatttgaaggctaccacttatagaatcaaagataattttcctacacagagcagaaaaagaggactcaccgaagactccaaattatgaactatttttaatcatttatttggcttagttatttataatcaatttactctgttgatttctaaacataaaaaatatatagatagcaaatggactatcagggacttcatgaagccattgtttttgattaaggaaaggtgtggtagctattctgcttaagtggcccctgttgtatgaattttgcaccaatgtttgctgatgtatttccttcctttagtgaagcaggaggtgatgcctatcagtaaatatcagtagacatattctgcattttcttctctccacactcagaaggaaagaattttaaaactcagcctcgcattttaaaacatattgaattataaaacttttaatgcagggaaatccctcagaaattctccagcctgatttcctcatttcacagatgagtaatcagttgctctgggagaggatgttatctgcccaaggtcacttagctaataggaaatctaatctgcgactaatgacaaatgtgtgctctttctttcacaccaagcacttgtgggcattttttttttcttgtcagtgatataggtgaacacaatttcataaaacttgcagatggacagaaactgagaggaagatctaatgtgtgagaaatgataaaataagagttcaaaagaaggttggcaacttagagaggtagaaagaaaatggcaaaatacaattttatagaaatcagtgtagagttctcctctgagttaaccacacatgcacagactcctcacacatttagttatggaatgaagaaggtacatcttaagaagagcttgtaccaggacagctagttgcagaaagactagcttaagtgggtttcatgaatccaagtgcagtgtctgctgtactgaagttaatggtctgttaatttggtttagagacagaagacttgggctaaagtcccaaccaggtgtgagtattatctgggtatcatctgtaatttttaaaaatgtattcctcccatactagatcataagagctagaaggggggcaccattcttgatgtattatctcctatatcctaggattttgcgctgtgccaagcatacagtagacactccattagtacttgttaaatcaattattaaggtaatgtaacttatcctctctgagccccagttttctcatttataaaattaagaacctacagttgtgaaagtgttttggaaactccaaagtgctgtggtaacataagcaattgctactgtcattgagaaatgctaccaataatacttagagaatttgatacaactcagtctgaaaaagctaagattagcagaacagagctgtctccaaatatttgaagaactattttatttaagggattggacccatttttgtatgtagttccagaggagcagatggtgaccactgtccaggcagatgtgtctcaatgtaaggacaacatctgtaatattaataattagaatgtatcctgtaattttctctctacccttggaaaccagtcgagatccagagtctttcactgggaggcttaaagcctagagcagccttggtgctagaggcggacagggataatgaactaatcttgaaccaattcatccatagcaatctcaatgctttcgttagctcttataggtatttaatacggccagaggaatgaaggtagtcttgctggtttagaagccctgcctaccacaacccctacaccaccccatcccctgcatagtctgatgtcatcactagtggaaatgtttaaacagcagtgaatatgcatgatagacagaatcttgcattggataaagagtgaatctttgaatttcaaggtcatattcagctgaatataagctagagaaattggaacttatgaaggtggtgatgaatacatgagcttaaaaaggattggaaagggccaggcacggtggctcatgcctgtaatcccagcactttgggaggctgaggcaggaggatcacatgaggtcaggagttcaaaaccagactggccaacatggtgaaaccgtgtctctactaaaaatacaaaaattagccagtgagccgagattgtgccattgccctccagcctgggcaacacgaatgaaactccatctcaaaaaaaaaaaaaaaaaaggattggaaagaagagatatgaacttctctttttgcttccctgaagtagagaaagcagagcttaagaaacaatttatatggactatgtgttccaacttcctaaaaatcaccatataaaattctatgtaggaaataaaaataattgcagattaacacagtttatatattaatcacatcagtttataaatataatgcacacacatgaaaaacacacaaaaatgtgtgttctaataaagaaattagatagaacagttcttaatttacttattttcattttggcacttctgtgaacttggttgtcaaatgcattaacccaaagaaaacttagcaatttgatgaaccttgaatccatttagaatttgtcttctctgctagaaaaagagaatgtatgtttttagaaaaacatttggcccacagatgatatgagaaaaagcttttcccatttaaatagctgctatttttataaatggaaccacatcaactcttccataaggagaaaacacactcttgtgaagagccgagaatttctggggtgagtgtgtgtgtgtgtgttagagttgccaagtagctttcccttacatttaagcaacatatcttaggaaagaaaagagatgcacttagagttatttccctgtccctgtgcaggttagtatagcagagtggaggtcttaagggaggatagggggcctagggaaaaagtgtaatgatgcctaaaggatttcctggaagttggcaggtaatgtgaaatgaaattggaagggtgaggaggctgtgttccccctgatgccagtgtgtgctttcatttgatattaatagttattgagccaagggggaaacatctttaccttgtaaaataattcattgctatcaattacgcacatgagctagaatgttcaggccacgttcacaaacttctcaattagaaacgctgtatttctgaaagtaattataaaatacattgcatggcaatgtttttccaagataaagaaaaattcatggaagcgttacacaactttctgaaattcaaaaccagcctagtcaacagggactaccttctacagattcattttcttattcacgtggtgcgcttacgagttccattaatatagatgaacattacacataggtatccagaaaagacatctgaggccttccacacttcacattattatcagtggggatatcagagggcagctttctttctgcatcatctctctgagtgaaagctggttatttaacttcatttgtcagctaatcagccagaacgtgaagctattaaaatttagaactgtcctctggaaaggtagatgttccgtgaaacgccaaaatgaaaattacctggtgttatgatgaccaccttaacttgaagccatcatcattaggatgcatttctcaaggcagcgtacagggcacacatggataatcatcagactgtattttcatctgaagcttgccattcagggactccatcctcagttctgggacaatagactaaatcccctctcaatttatacaaatcagtgtcagatctcagctggcaaaaggcagccttcgagggtgtctccttcaaaatggagaagaccacagctccagctagagtcactgaaaggcaagaagagcataagaaaatcccagctgcagaacaaaacgcatggttcttccacagcacatctcattgctgagatctggtcgcatgaagcatgttctatagctactcttctgtgtctcctggtaatttatgtgcaatactgtcttagtacattcggtattctttgtacattcaaaataccatgaactgggtggcttctaaacaacagaaatttatttctcacagttctggaggctgggaagttcaagttcaaggccctggcaaattcagtttttggtgagggtttccatttcatagtcaatgccttctttttgtgtcttcacagggtggaaagggcaagggttgtctctcaggccttttttaaaatgaagttgttaatcccattcatgcaggtgtcaccctcatgacctaatcaactcccaaagacctttgttatttggcttctagttatagatgtttcaaaaggcgaagtgttgtaccttttcaagctttgtatagtactatcatctgactgctttattcccccaaaattcatatgttgaaatagtcatctcaaaggggatggtattagacagtggggcctttggcaggtatttagtatttgtcttaacttttcatctaacttctaaattcctggccctgagtaccattgttttgtagcccctattctacctagatttctctggatgggagtcagtgcaaacttcttttgttataagaaggttgtattctgtcactagtgagtaacggaggaagagcaattaagaatggccttttattaagatgccagcctttgttgagcagtcttggtaatatcataatttgcaaaattcagaagctgatgtgagagttccagggctgtcaccaaaacccaggtttgacatctgaatttaactgacactgtttgcctgctttgaggctgtccttccattgtgtctctaactgcaaatgagaatgactccccgagggaagcctttgggatcacagatgcatcaacatctgggaatcaaatctctttcaattacattaattatctgctatgtgcaggagaaagttttgaatctaaaataacattaatttaatctcaaggttagagagagattttaaacttcctttaaaccccaaaatgccgaggcgggtggatcacccgaggtcaggagtttgagaccagcctgaccaacatggtgaaaccccatctctattaaaaatgcgaaaaaattagttgggcatggtgagaggcacctgtaattccagctagtcgggaggctagggtaggagaatcgcttgaacccaggaggtggaggttgcagtgagccgagatcgcaccattgcactccagcctgggtgacaagagcaagactccatctcaaaataaaataaaataaaacccagaggggaagaatctatatgcacactgtaatgaaactgtgataaaacatatgctcggaagcacatccttgaggtacttcgtgagagtgcctggtaaatcaaatgtctgggatgcttgcttcagtcagtgaggcaaaggaaagtccggctgccaaattatttacttaagaagtggttataatgttattttacccagttggaactgtctgcctatactagcttagtgctcaatacagttcaattctgttgatcatttttttcgaaatctcacgtacattcttctcatctaaagatgcccgttgccatcgctaagccaccctattgtccatctcttcccagtacaacccacaccatgtgaatgttgcaacaccacttccatcatggttcatcatggttctccttgtgtaagtagctcacctattgaagcaagcctaaacctccatcgccttgcctcagtctgcagctgatggtcttccacaccattcctgcaggcagcctcttcctggcagtcaggctgggctccttgctgaatggtctgtacagtgtgctccttggtacctgttttgcttttacctatgctatggtcactggctgtaacatccttctcctgtcctgcttcccatggtcaaatgtttgtcattctcaaggtccttttaggttctgccccacctggctctttaggcccacacaacctctccccgtttctaaaaagtgtttatagattacagcatgaattttgctgtggttgtgtgtttttatgagcatgtgtgactatgtatgtatctatagatagacactgcttgtaatttcttaaagaaaacagcttctgcttgttttgttcaaaatgtctgaagccaattgtttttgtttgcttttagaaaaaaaaaaaactgacatcaaggagagagcataacacagcccccactaccaccaattatgcagccgagtgagtttcccacatttggggaaatcacggaaatcagcacatcagaatgcaatgggtaagctcaccctgggaaaaaccattttcatgatcatgccatctcccctgccgggtaagaccagtctgtgaatttctctgttgtcataacatatgcccagcaaacatggatttgttatgttctacctcacttctagtgagatatatcacttaatgaaataagtgactgaaaagtcacagaagatttcaaagcaccatgttatctgccctcccttgcctcctagtccggaatcaccccctttagttatctcacctccctttatgtgatattaaagaatcatttgaaaaggccagaggttgtagctgggatcaaaagtcaggcagacaaatatgtcatgtgtccatattaacaacaatacacgtttcttcctgatttagaaatcaggctatagtttcacaatagtcaaaaaccaacagcaaacctgatagtcaaagcctagtaaggttcacttctttcattgtgttaatgtatgaatatttcagcgactaaggcacgtttccaagaaataagaattaaggggaaaatgtaatttagcaatatttttacataaaaccattatgtgtttaaatttatataaattccattttgaaatatttctcaaatatttctccaaatgtaaacaacagataaaagacacatgaatcaatgcatttgcatacatctaatctgaaggtataaatattttgggtttaaactattgatctgaatattgcactgaacactatcattattatcttaatatgttcatataaggtcccaaggtaatttgacatttttaatgtgtcctaatggtaacatgatttgactattatatttacaaaaggaacaactagcaccctactttctagcaaacaataatgtcatgtagaatctcttagagaaactgcatgggctatgtgtttctttagtaattttttcttggacaaatttaaagttgtatctttttattttcagcaagtatcatgccttgaaaaacctcccttctctgtggttctatggtaaagtatcaagggcatagactctgaaacctgatggtcgcacattcggattttgattcagctacttcttaactgactggcactgggcaattcacttaatatccctgagcatcagtttgggtatctggaaaggatacactggtggtggtacaatatttactatttaaagttgagatatggctaaaataaataattattaataaggttccccacttgttggattgatagaactgccagtacttgctaaagggaaacaagttgtaaaatactacaaactgtgtggagttagaaaggcacccttgcttcctttgctaccctctatcttttgaaggtagttgtggttcacaggatctcagcagccagaaatactgctgctgattttataattttccaccaggcacttgtgaatcaccatatgctctaacttttttttctaagaaattctggcagcatttaaaaaatgaagtcactatgccaatgtcaatctaaagatgccaatctacaacttaaagtctttgctacttttattcttcaacatgaagtccaaatctccactgttgacttgtcatggtcagtgtctttgtctaaatgacagtgtataatgacacatggtgggattttctctttgtttgaagtcaggtggggaaaggggtggtgcacttgacatgtctttattatttttctttaagaaacccttattaaacctttaaaactgatttttcccactcccttcaaactttgaagggtctttgtgcagttcacccagaacagaactcatcacacagcactgatacacaggctatggggaaggggagatcaggggcacggagaagcacaatgcaggggtttaacaagcatttcattaactgaatttaggaactctaacgttcctccgaagcagacggctccttgctctaagagctccagtgtcttcccacagcccatgcacctgcatggccttcccactgctgacaactctgcctctatttcgtgcgcgtgcctcatcagccacacatgtccatcttcctaatgatcctcgcgcttgctactcatggccacctcacggttcttacacttgctgtccaccccacatgctttccctccccaagcgtcttgccatagcatgctccccctgctctctctttgtctttgtctctctctctctctcactcactcatttcagttaagttgtatgtcccttgagtgctacatctgaaatagagccttcccaaactgatcttgcctttctcttattctgctctattttacttcaaagagtttatcactgcctgaatttctatgtattttcagttcactgtttcttccactaggctttgttccactagtctctggcctcaggaagactggatgttgtctttttttctaccgtattctcagcatcagagctgtgcctgatcacgatagaaactcaaagactaaatgaatacatgagtgtcatacatatatcgaatagtagactttcaattgttgcattttctaaaaaagcaggaaagagtcagggactagcatggtatatagcagagggctgacgtagttcctttaactgtattatctcatttaattattaaaaaatatggagtatctttcattctcattttagagctgaagcctctgattttagaatttaaattgcccaatctaaacttgtccaatctaaagatatacacttaggaagtgactgccagcatttaagccctgggttttagattccaaatttgatacttttgtctccacataacacagatgtaaaatagtttttaaagaagcttagagagtttacagacttgttgatttttagttaagtggttaatattactaggtaattgattcagcagctgggataagataaataattaaatgaatgtttatataagcaaagagccaaaccagcaattgaatcaataaagcctactatgctttcatttttctctggctctcctttccaacttcccttgaataaaggtatcccttaaaattcagtacatgttctttttggtctatggagatctcattctttttgatgacttcataaccttaattttgcatttctatgactgaccttcagtttgaattccagtcctgtctcctaatgtctactgaatattctcactttgagtttttttcgttatgtcctcaaagtcagtattactctatgtccccaactggctccttgtcctaaattttccttcccagacactaagcgttagccatatttaattacttagccaaataattgttatatcctattcattcttccttaaattatgtctatatattgcacttacatcaaatttactattttcactgccaatatcatatttcaaatccatgtgcattcacacctcgattgctacaatagctgcttttttgtggttttattttgtattttacttttgagttcacaggtacatgtgcaggtttgttacataggtcacctgtatcatggggatttgttgcacggattatttcatcaccaggtattaattaagcctagtacccattaattatttttcctgatcctctccctcctcctacccttcaccctctgaaagacctcagtgtccgttcttcccctctgtgtgtccatgagttctcatcatttggcaactacttaataagtgagaacatgtggtatttggttttcctttcctgtattagtttgctgaggataatggcctccagctccatccatgttcctgcaaaggacatgatctcattcttttttatggctgcatggtattctatggtgtatatgtaccatatttctttaaccagtctatcatagatgggcatttaggttgattccatgtctttgctattgtgaatagtgctgcaatgaatatacacttgcatgtgtctttatagtagaacaatttgtaatccctgtggtaatgggattgctgagtcaaatggcatttctgtctttaggtctttgaggaattgtcactctgtcttccacaatgattgaactaatttacactcccaccaacagtgtataagcattcctttttctccacaaccttgccagcatctgttattttttactttttagtaatagccactctgactggtattagatggtatctcattgtggttttgatttgcatttctctaatgatcagtgatgttgagcctttttttcatatgattgttggtgcatgtatgccttctttttaaaagtgttggccgggcgcggtggctcaagcctgtaatcctagcactttgggaggctgaggcgggtggatcacaaggtcaggagatcaagaccatcctggacaacatgggaaaaccctgtttctactaaaaatacaaaaattagctgggtgtggtggcacatgcccataatcccagctactcaggaggttgaggcaggagaatcgcttgaacccaggaggcggagattgcagtgagctgagattgcaccactgcactccagcctggtgacagagcgagactctgtctcaaaaaaaaaaaaaagtatctgtccatatcctttgcccactttttaatggcgttgaggtttttttttggtaaattttttaagttccttatagctgctagatattagacctctgttgaatgtatagtttacaaaaattatctcccattgtctaggttgcctgtttactctgttaatagtttcttttgctgtgcagaagctcttaagtttaattagatcctatttgtcaatctttgcttttgttgcaactgcttttggcatctttgtcatgaaaatctttgcctttgttgacattgccctaaatggtgttgcctaggttgtcttctttggttttcacagttttgcattttacatttaagtccttaatccatcttgagttaatttttgtatatggtgcaagaaaagggcccagttttaatcttctgcatatggctagtgagttatcccagcaccattgactgactagggaatgaatcctttccccattgcttttttgttgttgttgttaggtttgtcaaagatcagatagttgtaagtgtgcagtcttatttctgagttcactattttgttccatcggtctgtgtgtctgtttttgtaccaaagccatgctgttttggttactgtagccctgcagcagcttcttgattgatctctttgtttcctgattcctctaacttatcctgtacattagtgccaaattgatattccttaaagttctttcaacaagtcactgctcacagttcaaagtttgaacatcatagcttagaagtagctatctacaatgtggtcccaatagaccttctgatcttaacttctattattctttaatatcctctagttcagagaagtcttttaaatatgccctactcatttttgctgccagaaaattttctacattctgatcattttggggaatatagtttcttcttctctcaatttattcagatcccacaaggctccacttatgacccaccttcatgaagccatttctgattgggttgccacattgctcaattccaggagaaaccattaacatatttgtgctccagggagcaaatttcttgtttactttctaatattaccctttcttccctttagactttagtcttatgtaaagtttaattgatgtcattctgaagattatttaaccttttcaatgtttgaatggtaacatataatgaatataatcttcccatttcccagctattttcccattcttatctaatctttctcttgtcccacttgtcaattttactcatggctttccagggtcagcatgtgtttatgaaacacctgctgtgtgtcttgaactgtttaagacaatagacatacactgttgaatgaattagacttgatctttgctttggtgcagcactcatatcactgcatacgcaatctatgggatcaagtgtggcaagggggaagtatcagatgctaaggtggctttaacaataggctagtgaggtcatgaaaggggccccagacatctatttcatgcatagttctcaggatcacttctagctttatttatactgttccacatgaagaggaaacaaccaaccccagatctgctaaaatgtgttcagggtctcacattgtctcctaggtactctatttgagtagaatgagaagtgcagtcattacatctgccacaaaaaagcacatgtcttccaaatgtacatataatgcatacatggatgtgacattggtatatctttagttttaatattttaaaaattatatatagatatgtaaattattcaaaggcagggagcatcccttctgctttgtaaagaatatttgcggtgagggttagcaaccccagctgatcatgacagactctatttaaatatccacagtttcaaagcctagcttctcccaaagattaaaaaaaaaaaaacccaaaccaaaacaaagcaaaagctattagaaaacaatattattttctatattaataaataaagaaaaacaatattaaagtagataatataaagtaaaacaatattatctaagagctgggcaacttgatgtatgtagggtttgcagctgtgtcattttaagccattcttgatattactaactgggtactacaagttaaactttaagtttaaactaaactacattatctgtctatcacctatctatctatttatctattaactattatcaatatctatctttaaagtaggataccttatatattgtaaccgtattctattatcaaagtagctggctctatagtattatatgtgttcagagggtttttttcctcctttcataaatcatttttgagtcttttctacgggatagagagaatcaagtgtaaggtgtattgaagattaagttaatttatagtgcttctctttgctatcagtgtattctcaatgttttaataacaatgcatggaccccactccctatgttttaggacatagagtgatcactgcattttgcccaagtttcattgtcacctgccaggaactgaactggacataagattcatccatgttcctgaagacccttctctgccatctggcatgcaccctgagtcagtgtccaggagcttggctgatagaaccagccactggatgtcaccctttctctataaccaacaaacagcgctggctgctcacaaccaccaccaaagtgcccactgctggtctgatgtgttggcagtaagacaccagctcacagattagaccacaccttcaacctcacctcccagaattctaagagaactcatcttcactaagtctgtctgtcatcatgaactacctattatgttttgttttctcccatttctctgagaacaggaatttttacatagggaaagacttaattatttgcttagagatttctgatgattcttgatgatgaagagaaaatactttttgtattagttttctagggctgccataacaaaataccatggttggaggggtggaggacggggagttaaacaacagaaatgtatttcctcacagtctaaaaaagtctaaggtctaagaaagtctaaggtctacggaagtctaagtgttggcaaggttgttccctcctaagccttctcctcttcttcttggccatcctcccctgtatcctcacaggtcttccctctgtacatgtctgtgtcctaatttcctctttgtgtaaggacaccaatcaaattggattagggcccaccctaattacatcattttgatttcattacctccttaaaagccttatcttcaaaggcaatcatattgggggttaggactccaacataccctcaaaaatttgggggaaggaggcagaattcaacccataaagcttttctttttccagatcatctgattcttgtgtattctcttattgttgctgacaattaaaccacatagcatttatataggctggtggaagttggatggtgttgtgccttttaagaaacttgaaaagaaccaactgtctccacactggattttctcaacacacaagccagggaggtcaacactgatgactcacatcatgtcgctatttaatcctgtcccaccttctaacatacaatctgtcttgtcttcccaattccactttgctatgtattatctaaaatgcagaatccaaggctaattctgctctttatttccaggtgctcattcaaaatatataataagcaatgtgaaaaaaacactaggctataattcagaaaatgtgacatcatccatgtcacaataatgtatcttcaacacactgtccaagagtatatcataaagctaagccaataatactttccctgatttcaaatagtgttgtaataaagttaagctctaatgaatgtgttttgaaagctgtaaagtaccatctagcatattgaatagctgtcactgtccatttttatgattattgtcatatgaatgaatggatgaaccgctgttttatcctttaaaaccagctagtttccattcctatggatcgcataactctctccacttacctttattagagtgttccttatactgtattttaaatctaactttactgatctgtttttccactgagttacaaacccctggaaaaaaaggattgtgtctgcaagcagctcagtttcctcaacgcataaccctacatggttctcaggagaaactccctgtgctttctgatgactgactgcctctcctcagagcatgtcagctgcatttctttctgggtagcaagcatcctgtcttcttttctgtcctcctacccggtgcctccaagcccccacccatccatagtggtatgtaagcatctttccagtctcttctgctgttaccccagcaatgtgtgggactgtgcttgggtttggtgtttcttttcaccttgttactcatctctgtccactgaaaagcttaaaccacacagaaatgccaggctgttttcaattaccttttaatttatgtatttattttgagacagagtttagctcttattgcccaggctagggtgcagtggcaggatttcacctcactgcaacctccgcctcccaggttcaagtgattctccggcctcagcctcccgagtagctgggattacaggcttgtggcactacgcccagctaatttttgtattttttagtagagacagggttttgccatgttggtcaggctggtctcaaagtcctgacagcaggtgatccacctgcctcagcctcccaaagtctgggatgacaggcgtgagccaccacccctgccccctgccccctcctccactttttttttcctgaaatcatagggcagttctgctagcatggtatagagtgcaggtactccagggcagggtgacccagtgatatgggataaccacccagctactttgagattgttgaaatgtctgctttctgatttccctgtccaggctgtctctgtcagattagagcaattaaatgataatgaggactgtacataggaaaattaattctggggactgtaattagcatcctccctatgggaaacttatacatgtgtgtaagcactgaggaaaaccctgaaatatctgctagtataataaaaagaggcagttttgagatagaatgctggattaatttattatgaaccggaagcatgttgttgtaagagagacaaattcgattcctttaatgtgacttcgacattacatgcttgccttccttgcttactttgaatgtgatcaagttcaaaactagatacaagggggaggagagacaggcatttaactggatttctcaaagtgtattttctatgcaattctctagtttgtgtttgtgatattaaccagaagaattttcttttcagttctggaagcatcaacagccctacttgttaggattttggatatttctttgcccttttttcccaggattcttcctgatttaagagaaatcctaattctttaatgttatttgtgccttttttgactatatatatatatatatatatatatatatatatatatagagagagagagagagagagagagagagagagagagagacagagagagagagagagagagacagagatagataaatagtctatactctgtacatttattataagattatcttctttccttcaacagaacgacccatgatttggttttccaaatctttcttcagggatttattagccagggtgactcacagatgtctctgattttagagcttctatttctctttcactgtggtgtacttgaacatgtgtaagaacttttccattcaaatttttcagtatctagaattaatgtctggaatggagctctctttcttaagacatcattttccctatttccatgcttcccaccacttatattctcttttgtgtctccaggcttgtgattctggaaccattaggggttctttcttcctcaacaggtcagcaagtacctaatattatcaacttttcagagattcataggtgccttcatgccccagtttctgatctccaggttagtcctgtgagatttggtcttcatttcccagcccaaaacataatttgtgactcacctggaaaatcatgccccttacgctctgctaaattagatcctctttttgaaacatatttcacagattctctgaccatcataaagttgattcatgtaagtttctaaattcttctctaatcatttggatcacttcaaaatgtaaagcataagctgtcatgcacctgaggttcatgggttctccaactttaaaaggttccagtaaaattcaaaggatctcaggactacccgaggtaaactggggtgagaagacgaattttaaaacaaatatatgaaactttttatagatagtattagttttctaagataaaaaagtatattaaattaaaaattccaataacatttatatatattaataaggactttttattaaaaagcttctattatgcctcagacaattttcagaatctcctcttaatatttaaatgactttacattattattcatattattattaataataatgcccttacattattcttatttttttcttcattgcaaataatgtatactgaaagaggcttcttctccttgcttttggtcttcaaccagatgttcaatgcctttctgatattaagacttcagattctacctctgggtcccatctctatcatcaaatcttataatcatttcagtttgttccctaggtgaggttctaattctagtattttggttttttttttcattttctattaatttctcccaaatctcatttttaccaagctttattttttaaaatagtaacttctttttactctcttttatccactctaccttttttaaaattagtaatcaaggcattccatcttttatgtaattatatccaataagagtaactgccgtaaacatttaagaactaagctgttcctaataatgtctagagcatagtcaactacatttgagtgaagagaactaggattggggtagatttactagctggctctattcattttcttttttttttttttttaacttttgtttagattcagtgggtacatgtgcaggtttgttacatgggtatattgtgtgatgggaaggagggaaggtgcaaaggcaaaaaactacccattgggtactatttatttgcttttaactatctatgtgtgtcccatcattaagtgtacattgttaaaataaatacaccacctagacgttaaacaccaatttccataaagctaggtgcattcttcacacttcagcatgcctcattgtccctttttggaaaatttttaatgccttatacctgagtccaccataaaggtgttggttaaatagttctgggcttatgttggagaatgagtattttatgtaaggatcctggtgattttgatgcaacttgatcttggatcacattatgataaatatagatgaagaagtagaaaagagtaattagccgtaaatctgcagaaccttgcaattcattatatttgtttttatgtgtaccaactataacgtgaatttggtatcgatatttgtgccaaagatataggtgcttgcatttgaaagtgcatgctgtgttttcttttgttctatcaataagtcagatgaagtaaagaatttgcaaaatgttgatgaaacatatttgctaacacacaagcattagctctttttgtaagtggctgtaaaggaacacttggtgggcaaggaagtcctgtgctctgtctcttcccctttacagctgggtggccttgaataaacacaaaacctctcaaatgtgtgtcccttctgagtatactctgcggatggcacttcctacttcaaagggttgttgtgaggctcaaatgaaaatgtactgtaaggtgctgtaaccggcatgaaatataggcggcatgaatattttggggtgtgaagcattgtatgctggattttctagccttaatgagctgacaattttattctcccatttctacactcaccactcctaacctttacattacatttttttgtaagttttgaagtctcaccttatttcctctggaatttctcaaaatatagtagtcgacaaaggacagtcatttgacaaatgtttcaagtgaaggactttacaagcatacctactcattagtaaaggcttcttgctaatattactttcaactcctttctccaatacttccttacaagcaaggagattattattagggagagagtcaatcatggccttctgcaactgctaaggcacagcagactggcagatttctaaaaaccaagatcactcaagatgacctttgaccttcctaccccatttccacccattattgttaattttaactcttctgaccaactttgagtaaaatgtgcaaatgttcactgaaacccacagtgtaaaaatgtgtctaaaaaatttgtgagcattaaggaaatgagatgactgagtcaaacccattcatttggagaacccacttgaaaagtaatgttccctggatatcaaatgacaagctggatgtgtttatatattggcattagaccctgaaattaacacagtactaactttccctagagaatgatgcaatgaaatgtactacccaatgaacataaatagaaattattactgaagccttatttggcctttgtgacaagtgagaaaatatatgtaaatctaaatgattacaataaaaagatctataattgttaacaggaaataatatccaaacaagagactaccttcttaacagtgtagagtttaaggaaaatgcaagtagaataagtgaagaaagaaaaacaaaattggcaagagtggtataaagattaacaactacagtgaactgtagctattttcctattgtcagatgaaatccttagatttgaggaaaagagctgtggtccacacccaaacaccaccattgctttggattgctgaaacaacaggaaataaagctaagacatttctggtacaaaatgacagctcttcattttagtgtcactcaggttgacaactgatgcacaggatacatgtcacaactcatcactgcctatcttgagggtatgggccttgcaagcctccagcaaaaatgaaaactctgaacaacacagtgaaatctcatttcacaagatgaactagaatcaaggccattttcgtggaggaaaaaaatcatagaaaagggttattgatttatgccccaaatagactgccattgcaagagggctgtgaaaaatataaattgttgttagttgtaaatccaacatcataaaacaaatcttgtgcacaagtattttctttgcccctcatgccatcatttttgttgttttaaccaattaactctacatttaaaaatgaggagaattcacataaagctgtgatttctagcttctcttgaaaaatcagaagatttagcaaggggccctatagtccttgatggaacaatcagttggagctgagtagaacctggctattttcattttttaaaaaatttgattggctttttttgtatactgacaaattatagttatatatatatatgaagtacaaagcaatgttatgatttctgaatacaatgtggaattattaaatcaagctaattaacttatccatcacctcaaatatttgacattttcttgcaacaaaaacatttcagaattactctcttagtgatatggagatgtacattactcagttattagctgtattcactacactgtgcaacagatctataaaaaatactcaaaattatttatcctatctaactgaggctttgtatcctttgattatcatttccccattccttccaccccccagcctctggtaaccaccatctaccctctgttttcatgagtgcaattgttttacattccacatataagtgagaataaaagtgttttacattccacatataagttataagaaaaggaaaacttttctgtatgagaatgtgtggtatttgtctgtgtttggcttatttcacttagcataatgttctccaattccattcatgttattgcaaatgacagaacttcttccctttgtaaggctgaatagtatttcattgtgtatatgtatgtatcacattgtctttatctatttatgtgttgatggacacttcgactgattccataagttggccattgcacatagtgccacaatcaacatgggagtgcagacatctcttggacataatgatttcgaatcttttaggtaaatacccagaaaagggattgctggatcatatggcaattctatttttagttatttgaggaacctccatacaattttccataatggcagcactcattcacagtcccaccagcagtgcacagcctcttctgtccctcaacctgacccatcacttcctacacccaaactgattcactcattgacgcacctgaccccctaaatatgtgagtttgagatcatttgctaaaccataaatagggctgttgtgtgatttattcccttcacattttattttgaaaataatcaattagctatatatatattagtgagactctgatgtttgtagctctgtcataggtgataaggcttcttgcagatacatggaaatatatgggagataggtaaataccttcagggagaattggaatgccactgcatcacacacacacaaacttccaatgtcacatcagcaattcaagcagttatgtcctcataaatgggtgcagttggcttctgaccatattcattctgtcattcttctgactcaatttctttttttgctttatctgtttttactttatttcctctccatctttgtctctcctccttttcttgctcactgtctctctccccctggttctctttcctgccagtaactactgaggctctctgtaagcatctgtgctctctctcagtctctagtcattcctagcactttgcagtcagctctctttctctacggttattaaatctaccaaaggaaaacatctgatttggtcagtagtcaggtgctactcaatatagaatattcctgttgggtagactttctggccctgatcagaagggactgagataaataccacatgggcaaaccaagcaggaccacttatgtacaacactgccagcggtccctttttctagggccaaatcgcaagcattttgatacacgaactaatatcacagacagggcttctctgctttagcagcagttcacagcttgaaatttttttcctgtttctcatctttgagtcccttggggatttagtgctacctagcagcagagaattaaaaacaaaaaccactacaacaacaaaaatgtgtccctgaaacccatgctatattcaactgaatattctaatgtctttgattacaaagccatctctagcaatttaatacaattatgaaatggaaaagttggcaaatgcaaaacaatagctcgtgttcaaggtatgtctttattaggggaagtttatcgaaacagatgtttatgctatttcctataaactagattctaaaatattttattctataaagatgtattgactttatatgaaaaaattattgaaaaatctacaagatggtgaaactctttagaactatatttctattacaagtttatttttaatttcaaaaatgtactgcataaatgcagcaaaacctttattgtcacatattaaaacatgtacattattgtgtgcaaattaaaatttcattaccttaaaccaaaaagtgagttggccagatagtaaataatttaggctctaaggctgaaaagcgcttgtattaattactcaactccaccactattttgccaaagcagtcacagacaatatgcattcacatgaatgagtgtggctgcattccaataaagctttatttatagaaataggggacaggccagatttaaccagcagttacagtttgccaaatgctgccctaagctgttgtttgattgttaagctataagaagagagaaagtccttttaggactgcatataagaagtatatttaaaaagaaaagaaaagggaaacttttctatagcatcttctccattgtttaattatttcttttgtttaaggtaactagtaacttagaccttctgggatatgaggaggggaaattaaatcccctgaatctgtgaggtttgctgtctccttaaaaattcagcttttccatacccctgactcatatcatagaatagtggcagtaaggcaacacatactttctttttatcttgccttcatattcctgaaccatcagaagtagaaaataaaaatagcaatggcagcctggatagcagagaaaagcagcacaaagcaaaacgagaagccaacactagaggggcaaacctgccatgacaattactcaaccatagtacaggaatcacgtcttaggatgcacacacaatcacggtacatcaagtgagtcacagataaattcatgttgtaaatatttagtgggtgattaccatgtagccatgttaatccaaaaagttggattttgctacatgcagaaatcattagacagtattctattaagcatagaaatagctctgtaatcttgtgtgttttctctgaaaatacagctgaattgaggaaaaaatgccaaatacgatagaatttagcttgtgtaaagtgtgctacatgtagatattaaatgtaatctcagatacttaccaaaaaacactttatatatgtccaaagtatatggcagtaatggccaaaattaacagcagttcctagaaaaataacctataatatttttagaaatcgtaaaatataaagttccactgagtggtcatgtttttcttcagtaaatagcttaaaattaatatttttaagttatatgaacatgatttaatatatactaaacccattactaaaattcatttctttaaattctcaatgatcactctagcaagaacctgcaataacgccttcgataaaacaccttgctgtagccttccagatctctccactctgatcctgcctcccctgaccctttatatcttggtgctcaccttccatactgttctgtgtctactctgctataatgttgagcctgagcatgcactggggggtccttatgcccccatattttgtttttgtggcctcttaccatcagttatgggataaattatattccccccaaattcatatattgaagtccatacccctaccacttcagagtacaactgtatttgaagacagggtcttaaaggggcaattaaagacaaatacgatcatgaagataggccctaatccaatagtattggtatccttataaaaagaggagatttgtacataggcattcagagaggaatgactatgaaaagacacaagagatgacagccagctatgagtgaaggagagaggcctcagaagaaacaatcctgccggcaccttgatttcagaattccagcctccaaaactgtgaaaaaaatacatttctgtgctttaagccccccggttggtagtacattgttacggcagccctagcagacaaaaatatcctgattgctgtcccctcctgcaaggtcattcaagctattgctctactttctatgtccagattaatcagggcctccttggccaaatatttccaaatcctgacctccacgggataactatcttctctgtggtgcagggcttggggctggaattacaaaagccagacccagcacccaactccactgcctatcagcttgggaaatattctcgcaagtcttctttttctcatatttaaaattagaattataatacccaccttacaacatgagacagtgtgtgtgcaaacacagttgttgtttctttgtaaacttactgaatgcatttttcttgaattacaacatattctatgctacatcacttttaattgtttatgcttctggtttttccttctaggtagcaggatgctggagtatacgggttaagtttatttatctttatagacagggtggctaggacagctcttgccctatggttcctcaaagagtactttctggacacaaaatgaaatgaccaattaatttgtcacatgtaattgtgcgtcctttataaaggtgtgtttgttggtgactggaatgacgcacataaacaggggtcaattttctcataaaatatctacagtatataaatggtagggttgggcatgagggaggagccacagtagaagttaacagaacaaatatttattggaaggtgattagtcgacagagagcgcatcatattagcaggctgaccaagctttgatttcagcctttgctttccagtgttaggtactggctttgagagttgcactccatttgttcattatgaaaatgtattatctgaccaaagaaaatgaagatttgcaaccttaggcactaactaaagagaatgtcatgaattgatgtgtgtgtgtgtgtgtgtgtgtgtgtgtgtgtgtgtgtgtgtgtgttcaacctcagtagaaacagagatggttagagtcaataagaaaatgttagcttggaaattaggaaccttcaaaaaaccaaataatcatttgttcaataatcattgtcttgaagttgtttcaaaaagcagtcttttgttcaaagacataaagacaacaacaaagaatttggaaaactcatgatatttatcagtaaatggtaagatttgaaagttacgaaagtacttgctaacgttactcgctgttcttcgataagctgtagtttaaaatgtcttcccttttatatcctttcagtacttttaaatgactctgtttttttgtatttgatcttaaggaactttgcattctaataaaagaaaaaagctgacttgaatcgctatgtttttctatcaaaagaaaacaacaaatcctggtctcaacatgtctcacagttttccctggagtaagcataaaaacaaaacatattaggagcatgtagtgagcaatttaattccatagagatgtttcctgtcctgtaagtaaaaccaacaaggaaggaggtaagaatttgttttctaattaatgatgtgtgtcctagaaaactggctgggtctttatctcagcctctgagctgaaaactatcttaacgatgaagtagtttgagattaaaatagctcaattatgttgatcataaacaggtgtccttattgacattttaactcatgacagttcatctagaaagtaatagatgagaaaaaaatatctaaactgaatagcactcttccacatctcagatctctaactggtcttttggtgggtggggttggggggcatgtggtcaacattgaatatgcacataggttaatgaagaatcttgctatgaataggctaatacaattttaaaattgtgtacatcttgcgagttgccattttaagggctgtgtggaatcatgggttgcatttgcctgtgtctaagggaaggctgtttagatatgtgcttatttaagtcactgaaatgtaggattaaggaagtgaaatgtgtatttgtgagtgtttgtgtgtatacactaaacttatgactgtgcaggctggcgtaagcagtgagaaagtcagcttcatcaacgaccttggcatgacatttgcaaaattctgagctaactgcagttttaaagtgttgtttcctaaaactatacagtattctgctactcggcagatgtataaataattagagcattaatcatttctcaatgagttaatctaaggtaaagattgcctcatacatatacggtaaacacaaaataactatttgctgcatacgaatgacttccagcgaattttttatgcaacatgagtgtacacaattgttcaacatctactcaagtctcagcataatttggctttttctttacctgaagtccatttgggaatgggaggttggagactttttttctccctgtctgatctttcttatttcaaattcatgctgttctctctgatactcattttgtctttcaaacctgaagtttcataggatatatgagcccaaaggatagagaagtcacatcagtgccttcgtgtgacattgatgtgatatctcagaagcctgtcttcactcttttccagactcagctgctgttctcttggtaagcagaggggagcctgcaagcagtgtaggcaagtgccctgctgaggtgatttgccacagcagaagatctctttgcatagtttagtgctggaaataaaggatttaaggcagcaaaacatggcgttaggtcaatttaaataatgcgtggcaatgacagaaacagtgagcagccgatcatttgggggaaattgataaatatatagtatgcacgtattagtctgcaatagtcattactgtttctcactgtctggattgaagatcgttgattctgctctacctggcagacccttcccacttccttcccaaagtctactattcttaggataattggaagactacccaaagcaaaaagatcaatggaaggacagtgatacaaatgaacattaggaactaaggactttataaaaatgctcaaaatgaacaactcaaggggaaaaggacaccgaaaaatagtcttcagaattgtccacagtaatgatttcatggaaattacaaggagggttgcatgataacatgtatagaagattgtatatggattttatcagacttagtgcagacaaatgaattgccttttaagtaaactttacatagaaggaatgtcgatttttaaggaatgttccctacctacttctccacagacacgtctccatagagacataaaaaaaatggccctttattttaatgagttagcattttagaatttgcagacagaaagagtgtctcgaataaaaattgagtatctgaaaatcattatgggttgtgtgtcagctgaaaatttatttcactttcctgtgggactaccctcccctttgtcacttaaatggttttagaacagggtaacctcaagttacctaaagtaatttatatttcaaagactatttcatgtccttacaaatgatacggaaatataaaatataaaaacaaatgagaattgacatctattcttcaaatttaactgcaaaatatgatagtcataagttacatgtgtaataatgtgataatattcatataaaataatagtaataacagtggatattataataaacatgaagtgtgtcaaaccaaaagggacttatccatttgctgtttgcacgaatctaaaaatcttgtcctcaattattcaaaaacagcaaccgatcataatgcttcttctaactataatgcaataaaagtttccatctataaaataggtatctacttcaaaaattgaaattaaatgtatcaacaattcctatgttctgtgtgtccagacacttttgattggcatattttgttgaaggagacagatggcaagacagtctgaggaagtgcagctcagctttacggagaacattttcaccttgttctagggagttttggatacagagttcacaccttagcagggaaactttcacaaccataatcaaaagtcatagaaaatattactttaaaaagtgtgcagctgtgctctaacagaactttatttacagaaataggtgatcgtccagatttcaggccatcctgaaccttcatatcattatgcacttaataatgaatctgcctggaggagggactgttaaactgttttagaaaacgtgagataatgctcagacattctctttaaaaggaatatcaaaactgggtgcccgcaagcaggtgtctgagtgagggacagctacctcgaagctggctctcaaagagcacaaacttgaaagctatctcaaatcgctattttggcatctgctgttattgatgctaaatgaataattcttttcttcacgtgattgaaacctgaacagaacacaagttctgaaaacacaaggtctttgtctacaaggaaagctatgaggaaccatatagagtcttagggtctataaggagagctatgctgcgtttggaaaatatgatctaaaacaattaattatatatttactgcatattcagtatatgctcaatgcagatgttgacaattttttttttttttctaaagagacagtatagattttgggctttggagtatcaagtctcttgcaactcctcactctgctgttgtaatgtgaaagcagccatagaaaatattactttaaaaagtgtgcagctgtgctctaataaaactttatttacagaaataggtgattgttcagatttggcccagggatcatttcttgcagacccatgtgctgagatttgagggttttcagaagctagttctgactgatctatttagaagtggtaatagaaagaagtgggagcatctgagaaaacaggttggttaagaattagtttgaaacacaagctccagcaagaactgaggatgactttggcagagttcagtgttgatggtgaaatggaaatggagaatatctgatggacgtaagagctatttaattggtagagaggggcctctcagggaggcagctagctcaatgctggagagcactaagccaaggcatcatgccctacactgcccagattagcaaaacagtacagtcaggatggctaaaggtgacaccaagaaaccaaagggtaagatgtctgcttgtgctctctttgtgcagatgtgcagagaagaacataaaaagaaaaacccagaggtccctgtcaatttagcagaatttttcaagatgtgctccgacaggtgaaagacagtgtctaggaaagataagtataaatctgataaaatggcaaaggcagaaaaagtaggttcggatggggaaatgaacgattatgaccagctcagggaggcgagaagatgtcccaagaaggccaccatctgaattctttccgttctgttcagaagtccacttcaaggtcaaatctgcaaatcctggcatccgtggcaaaaagctgggtgagatgtggaataacttaagtgacaggacaaagcagactgacatcactaaggcagagaagctgaaagagaggtatgagaaggacgttgctgacagtaagtgtaaaggagagtttgatggctcaaagcaccccactaaagttgcctggaaaaaggtggaagaggaagatgaagaaaacatggaggacaaagaggaaggggaggaggaggatgaaaaaaaaactgttttatctgtctctttgtgaatactttagaggaggagagtgctgtaactgacacatctatttgagaagtgtctactgccctcactaggtttaatgacaaaatctgatcagaatcatattgtagtttttcaaagtggtctagaaattgtcagtggtttatgtcaagtggccatgggtgtctggagcatcctgaaactgtatcaaaattatatgtatttccaaacatttttaaaaataaaaaggcaatcttgtgttttcttcacactgtgcactttgctgtttgcatgataaggcatttaaaagatgtttctggcatttaaaaacatgtgtaaggtgatgtttactatttggctatgggctagaaatcctgaggtgtcaggtgtacatacatatcttttgtaaaaagaacaaaatagagacaaacttttgaggcccctggcttcgtgttgaggctgtgggagaagaggccttttggagaaactggagctcagtgcatgcactgtgaggctggacctgctgccactgcaatgggcccccatttagctttagttgtcttgtttctgtatatagtcagatagcattctgctgccattctttgctctggacaaagggggtcagctggcgtgaaaattgtttggattttttttagttaagtgctgtcattttgaaacttttttttttttttttttgagacaaggtccttctctgtcacccaggctggagtgcaggagcatgatcacagttcattgcagcctcaacctcccaggatcaagggatcattccacctcagcctcccaagcaactgggaccacagctgcacgtcactacactcagctaattaaaaaaaaaattatggaattgggggtctcactatgttgccaaggcttgtcttgaactcccaggttcaagcaatcctcctgccttagcctcccaaagtgctgggattacaggcataagctatcatacccagctgaaactttggtcttaaacaaactgcagaactgttcattgtcagcaaagggaagagccactgcatcaatcaaagttcaagaacctctgtgcttaaacataattggcaatattgtttttttgtatgtttagaatgctgaagttaataaacagtaattgtatgtttagaatgctgaagttaataaacagtaaagttaaataagcagtaatgcattttaaaaaataaatggtagactatatagaacttagtaacagattgactatatgatcctgtagatgtgtcctggatggcacctaggcttctggcatgaggaattggacagatgttgctgcatttattgagccagcaaacactggaggaagccaggttttgggcggaaggacacgaattcaatctcagacatattgcatttcagatgcatgtgagacatggttatggaacttctgagtaggcagttgaattaatatacaagtttggagctcggaagaggaatttaagctggaaatatatagaagctatttgcatttagttgaaaattttaggcataggaataggtgtgtgaggctggaaagggcataagatcaagttcgaaggaaccacaatatttaaagattacttagaaaaaaaaaaagccagagaataagaaggagcatgggaaggatgtgttaccatggagatcactgaggtggtccagatggggaatctatgtctacggttacttcaaagttagatgcgatgagcatttaacaacttgcagtacttagagaccttagtgagaacggtttcaatacagttcttttagtttgggctggatgtgtaaggagagtggacaccacattaaagtgggtcccagagtagatagaaagtgatggaatgaaatggagaaacaaaaaaactacagcaatggtaatgaagagggatcacaatgcatcccaaaggaattctggaaatttgttggtgtgtaaaggtaagtactgctggtatttagcatacaaaactcacagacactcctacacacaagaagatagtcccccacacaagaagggagttatcctgcatgctgcacagattttccatgcctcatgggacactcaggtagatgaaaaacctacttataagcatctgcacttaaatcacaactccattagacatacacaagcacacatacacacatatgctgatgtgggaaggcacatttaaattatctagatttaagttgtaactgtattttatacatacaaaatacatatatatatatatacacacacacatacatatatacatacactaatgtatattccatatactagctcttacaaaaatgcaactaccatgtaaaccaaagaaagattatcttttgttttacttgacagttaccaagaattgtttcgcatttaagaaaattatatctttgatggttccctcattaatggtgcctggatacccaatgcaacacacctacatcaaactgcatttgtaactgttggattcataatgattctacctaagatgcaagcatacggcatcattgtgccttgttgtatggatatgcttgagaagtcacatgctgaaatacatatattttaaatttgacagtatctcctacaatattttctttatattatagtaaggtattacattacagtttaaaacttatgactataagcaggtgatattatctatgaatttcatgtgaaattagcaaagggacagtctcaaatgtttgctgtataaagtgtatttgaagcctgatagggttgagaaacactcagctacagtaagtaaaaacagctctcttagtggttgccttgttgagaagatcttgaaaacaaggttgaaaatacaaaagaaactgtgtggaggtctacaaagatatttatcataggtaaatcattatgtctaaaatgttatagaaatttctattaatggtggtttgtatttttaaaatataagaaatataaaagctatagacagctgtaatttggttccaaaggctttgaaattcacttttattgctgtgtttctgagcttctcccaggtaagaaatataaacattttatccaatgtcagacacacaaattcagacagttaattctgggggccaatgaaaggccattaagggcaccaaacatgtagtggcgttttcctacagagaagttaaagatttgtatgcaagcaatagcttccagtctctgctaatctgaaatatggctatataatattctttttaagaacaattttgagtgactaacattatcaaaattgcacagacaaccagtgtacaataaatataacattctgaccaccccccttcccacaagcaggttaacttcaatgttattctatgaagctgttactatgtatgatgccaacttcaataccacccaagtcaaaaaacacttcaataaaaatatatcaaaaaacaaaagcccaaatggagttctaaaaaattttcctgaaacaaggcaaattcatcagtttttattagtgcatattatatgacatatgtatattcaatttaggtatataaatgtatagatatgtataaaaatgtatatacatatacatatatttatcagtttcattattgtatatggaacatacatatacgtaatatatgtatatgaaaatatataatgtatatacatataaaattcatgtgtcacattggtatgtaaatatttaatatgtaaaagcattaatgaaaaatatggccgggagcagtggctcactcctgtaatcccagcactttgggaaccctaggtgggtggatcacaaggtcaggagttcaagaccagcctggccaacgtgatgaaacccagtctctactaaaaatacaaaattaacaaggcatggtgatgtgtgcctgtaatcccagctactcaggaggctgaagcaggagaattgcttgaatctggaaggtggaggttacagtgagccaagattgtgtcactccacaccagcctgggtgacagagcaagactccgtctaagaagaaaaaaaaaaaaaaaaggaagaaaaatatatgtatatgtacattgagaaaatttttttttttgttttcattccaaaatatgaacaaaaagtaattaaaaaatcatcttagcatctgggatttattaggcattgaaatatttgataaatgtaagagtcaatgacaaattatattttatgaaaaagggacacagctttaaaataatctagtttaatagaatcatttaggtactggagcacagtactttatgaaattgtgctatagtatcctgaaaatgttatttaatttgcctgtatcaaagtattaaaaataaaactagctggatttttctttctaacattaacagtattattaatagcatcaccaaatttaggcccaacttgaaataaaagggacctaatgatgtcatgtttggggagtaaagactattgttcctgaaaagaatcctggggttccctcacagtgatagagcttccgaattcaacataactagatttaatacctactcagagtgactttttttcatttctctggaataaaatctccttataactttcactgcggacttctatccagcataacatagcacactaaatttaaaaacaaaaggaagcggagaagattataagaaaaagaaaaggggcagggatggtgcaagaaagaaaacaagaatacaatgaagaaaagtattgactataaccttattcttttagttcactccagacagcacatcactcttagtggactagccaccaatgctgagcataaattatatttttttatctatcagtttctggacataatcactactcattcccattttgatcattgaaaagaattagagttgcatcagtactttaacttatttcttgagcaaatccacaaactcatcaatgctcctcaagctgctaattctgctgagtagaattttctactaaagtagaaagggctcaatggccctataacattataatgtttcctggaattggatgaagactactcaccttaaatattctctctgaaagctaaaaggtatcaaagcaatatgatatatgtattcatttacgtccttctattaagtggactgttttttggattatatgtgcattttgctgtgttgagctcttaattaaagcatcatttttctcacctaacattttataatttggaaagaataaaatatatatatgctctaggtaggtacaattccctgacccttaggccagggaaaataattactgagtatatccaatttctataacaggaaaggtatacttaatctatatcacttcgaaacaaaggagtgagtggaaaggaggtggctggaagtgcagatttaaatagaggatggttgggaagactgttacatgctgccacgtcaaagagatattttaatgatttgagcttacaattttacatttaataacttctataataacatgtcattgaagtaagaagaatgctggattctcaggccctcaaaagggttttatatagtacagaaatgatattattctgcataatactggtagacaccagaaattatttgtgtctgagtggataatgcagtggttgaaaggttggagcagttgaagagatgcaaataatagctaataagcaagaaatatactatatattgttatcccacacagagtttagctctgtggtttgtgtctaggaggtacaatatatgtttatggaatgagaaaactaatgaatatttccaaaaaagtagcaaatagaaactcatagctcaagtgatttgcagtgttaattaaagaagataaacccatttattgtaacttacatgcatctgtgaatctactaaatatccttctgagagatagctttctctatctctcatccctattccttctgttatccttttcatcttttcttttctttctcccatcttctttctgtgcttctttacctataccattctccatttgctaatcattatttagaaatgaaatgtgcattaattaatttcaatctaatacaaattatattatgctcaattttaaaactgaattaatgtttgtcatatctttaaaaattacaatagtgaatttgtgatttttaaataaattataagaaatactgtcttcaccttcaatccaaggaatgacaaaacagcttttgctaacaaaactaaaatgagctattagtaatgaaaatatgacgtggtagctataacttggcctctcttgttggatagccatgattctacaacacacctgctatttattggaaatgaatactgagagataggagtcccagaagataagagattgagctaacctattacttcagacatttttttcaggtaaagactttaagcatatattgaatgaggttggcaatgtctagatataaaacagaaatatctgtaaattatgttactttgaaatactttactattaatatagaaaacaatcataaaatatagtaatttagtgcataatgtaatttacaacttcctatatcatgtgggaaatataagtcctcgtgtgcagctcctggatacaccgctgttgaattcattttactctcttccactctaattagttcccaggatgcagacaacatttgaatgcatgctttcaaatctccgggagttcttggcttttgataaattggggaattgatccagtactatctcactttaatatgtgtcctatattaagagtgtgacagcaaaacttattttttcacaattcaagcaaaaattttcccgttttatgttttacaataacataatatgtaaagataagttgataaacatgtacatactcagaaaaattactttatgtagagaaaaagaacttaacttggattctagaatattatttttgttttcagaacacatgattaaaaatctttaaccttatgcctttttaccaatggccaataactatggtgacagtcaatagtctcatgtcctatctgtagatgctatcacactgccaggctctcccaggtgcaggctatgaagagtttatcataaaatctaaaaacagcaaaactcacaatagttaaatgggactccattttgctgcttcagtaaacagttgtattaattatcctacaaatgtgcacagtggactattaccaattgagaggacacaagctggcagacttaaacaggtaaagagacatatagaaaagcaacaacaagctcatcacattttcccactctggatctagggcaaaagatctagttagagtgcataactgattaaaggattataatataacagagcatgaaatggggttgtataggactcctaaattttgcagtttctgaatgctgtgtagattaactcatgtctaaatgggttatggggttgattgatagatgtcaacccagcaaacagagccagctatccaataaattaattttattctcacaaccaccctataaggttttttttccattataattcacatcttatagaggaagagaccccccaaggtcacacaactagataattagctagtgaactggaagagtctggatttgaatcaagattttgacctaactacttaagatcttgaaaacagaatccacagcttaatcatctgtgtgttcctatagtatttacagattagtagcttttagtcagttgtatacaattgtactaagacataatgtcaaaactcccacttcatcattactacccaaatgtacatattagaatttctaggtccaaaagttgacaaaaccattagtaggaggggtgggccatgttcattaagccatagtgttttctagttcgctgttgagcaagttttagccctgcagttttcaccaccagtactcactcagcattctggtttttatttatttatgtatttatttttatgatctatgcaggcaactgtgcatagtattgtgttttataacggtttgtttgaatttacttacagttaaaataaagtttaaattaaaaataatagaatagtcatagttccatccttcccaccatttacatcatgaggataataccataattcacattatactctatttgatgcattagatgaagcctgcttagtgggcaatctaatgctgacgaccatatcactgctacatgtcatgcttcttagagatctcctgcttcgctgacatgcaggactggatgaccctgtccttgccagtcttccacatcacttaagccctctcttatcttgcctttgtgcagtctctgtcttacagcctcatctttgcattctaaacctgataggacatttttgacatcaataaccaaccctcaagggagctctttctttaggctgattcacaatccatttctacagacaggaaggcctttatttagtttccaaaatattctgctttttcaaatatttctgactgtcttggattttcaaagaaatttcggattcctgtcctttccgtaagatgctgtagggaaaaaaatggaaaagcatgggtcctaacttgggtatgacacttaatctttactggtttcacttatttaaaaaaacacacacttaatttttagagcagttttaggtcacagccaaactgagagaaaggtatgaagattttccatatgcatcctgctccaaaacacacatatccgccccccccggcccccgcattatcgacattccccattggagtggtgcgtttgctacaatctatgaaactgcactgacaaattataatcagccaaagtctatcccttacattagggttcactcttggtgctgcacattccatgggtttgggaaaatgtataatgacatatatccactattatactatcacacagaatattttcactgaagtgaaaaatcctctgtgctccaccaatttatttctccctcctcataacccctggcaaccatggatctttttcctgtctctatcattgtgctctttccagaatgtcatatagtgaaatcatacagtatgtagccttttcagattggcttatttcaattagtaagagacttctaacattcttccatgtctttttgtggcttgataactcacttccttttagtgctgaataataccccattgtttgggtgtgccagttatttatctatgctcatactaaagtgcatgttggttgcttccatgttttgggaattatgaataaagctgctataaacatctgtgtgcattttttatgtgtacacatatgttttcaattcctttgcatagaggccaagggacatgattgctggattgattgtgtggcaagattatgtctagttttgaaagaaactgccaagttgtctttcaaattgctgtaaaattttacatcccaaccagcaatgactgagggttcctgttgctccccagcgtttgacattaacagtgtcctagattttgaccactctaataggtgtgtagtggtagcaaactgctgtttgaatgagcctcactggttcatctctaacaggaaaggactagcctaaatatttaagtttatcttgtatgtataaagttggaaggtctctaacaagtaattttgtaaagcttaaattacacagtgaaagatgaacaagtaaattttattatttaattccctaaattgaaggatgatgtgaaaaagactcccagaaactgtcatatctgatttcaaaagatttatcactgaacagttagaagacttctgctaagcacttcaaattatatctaagttcattcatctattaaaaaagagatgaaaagatgtcattcttccccattagagtcattcacaggaagctatgtgatagcattctaaattatttaaagatattacaggattggaaattttgttactcgaatcatcagttaattgataaattttagactttagagaatttttggtgcagatgttctgaggaccatagactcccaagttgtgaatgaatagggtacagaggaaatgcaaactaaggtggtaaataatacatcttcatgttctctaatatcatattaaacctcagcatttctttcaactatagacataagcagcaaatgacagtgatattgtcaaaacctaacattttgttatccataaactttatagatcttttatatttagttgttgcagagatctcaaaatatttatgatcatcaccacttagattggccactagattttatttaatgtgttaatttcaaaaagcacatatatcactatttttttatatttttaaaactatatatatatatatatatatatatatatatatatatatatatttttttttttttttttttttttttttttacggagttttgctgttgtcaccaaggttggagtgcaatggcgctatctcagcccactgcaacctctgcctcccagcctggttcaagcaattctcctgcctcagcctcctgagtagctgggattacaggcacatgccaccacacccagctactttttgcatttttggtagagatggggtttcaccatgttggccagggtggtctcgaactcctgacctcaggtgatccacctgcctcagcctcccaaagtgctgggattagaggcgtgagccaccatgcccagctaaaactctctttcaatataattgctttccttagcaatcctatacttttgtgcatttcaaaatgctttctttaaatgttgaagtcaaagacttaagcagactgccaaagaggtgaagttcatggcaaaaccattccttgtgtacaggtggtgagagttggtgacatccttatggtagcacatggaggtacccaaagaacccttacctgcatccagatctcctgaattttaaacgagtgtcctttccaccaggccatgccttctctccaactcactgctatggtctgagtgtgtcctccaaagttcccatgttgaaacttaatgaccaatgtgatagttttaaaaggtgggggctttaggaggaggttactgaggactgagccctcatggatagaaatggggctctagtaaaagggcttgagcgggtgggttggctctccccactcttctgccatgtgagaacacagcgtttgtctgtttggcacttttgacccactctaccattagatgatgcagcaagaagccttcaccagacaccaaatgccagtggcttgatcttgaacttcccagcccctagaatggcaaaaagtaaatttccgttcttcatctattatccagtctcaggtattttgttatagtagcacaaacagatgcagacagtcaccatttacaatgcccttgctatttgaacctcaaacagtgtatgagcaggaataaatagtatttcaaattggcccagtacaaagtgttccagaaacagatgtatttaaaattaaaataaaggcatcaggtatttgaattgcattacctctaatggaagttaatgtaggtaaactccttcttcagaacactctgttcgcagagatacttgttcctaaaaccataataacagcatacctttgacaggggattcgaggaaccaaaacaatcatcaggcttaatgtaaatgaccactgaaagtggtagaaagcagcaacaaacattttaaagggcaaaggacctagtattgacataactaaagaattcattcattaaacagtttatttccatgttgtaagctgttggatgaagttatggatgtttccacttatttagaggggaaatcaagttattcttacaggctcagcaagtagacagacaactaaatatttgctacaaaaagcatggtttccagaacagaagcatctgcatcacctgagagttggttagaaatgcagaatctcagttcccatcccacaactactgaatcagaatcccattttaactagatccccaggtgattcacgtgcacattcaggtttaagaaaccttgtccaaagaacactggagctgaaaaaaaatgttggcatgggggtgaaagactgtaggaagaaagagaatgtaactgaaaaacatgtgaaataaaattatgcaaaagcagttatgtgaccttaaaaatgtatcttcacaatatttaacagctttctaattttacgccataaaatttaccttttaagggtaaaattcaatgagttttaataaagttagacaatcatgcaatcataaccacaattcagttttagaacactttcatcattcttaaaaattcccttttgcctctttgtagccaatcctcactttcatccctacccccaagtgactgctgacatggtttctgagtctgtaattgtgtcttttgtggaaacttcatataaatggaatcatataatatttagtgtttcatgcttggcttctttcacccagcataatgtttttgaggtaaacctacagggatcagtgagtaagcattttattctacagatatgccacattttatttatccattcatcaagtgatggctatttgggttgtttccagtgttgggcttactatgaataatagagccataaacattttcatataagtctttctatttccacgatagttttgaaaagtattaattggcagtcagatttacaagtaacctgtaaataaaataaaaccaaacaataacaataaaagactcaaagagacttattagtacccctgatggtcattctggcaacatgtgtaccaacaaggtgggtatctatgcatgcgcagagggagcctcatgctatcaagtggaagaaagaatgttgttctgcaattccacaagagggttagaggaagaatgacgttcctactagaactggatactgatatctgagctggtggaaagaaagaaaagatgggagtctacagtaagcatccatgtttttggtaaattaccataactggactggtgtgggaggagtgaagtggagggtggagtgagtgattaagcctgggaaacaaatgacaggcagaggaggaaaggcatgaaagaggtaatgttaagatgaaaggcttactcagagtggtcaagtattgggtctttaaagaatgcttatcacctgggcaatatggcacctccaaagggctaatcacagagaccctccaacaggtcactgatgcctgcctggaattctttcatgaagctgcagctaccaggtacttcaggctgccctaaaccttatattttaagaagcactgaaaacaagagaagggagaagggcggattggagttactttggcaaaaggcaatataaatgaagctaagtgagggcttcatcgtatcttatcacagtcaccagcactagtggtgactcccttcaatgacttaaaagggatctcctccttagctcacccaaggtgctaactagttgcagctggaagaggatggtgtagcccattgagataatacccccccaccccatgtagatttctcctaagcactttatcaagaagaaactcggtggttctgagtgcctgattaggcaaaagtcaagaatgatatgaggaagaaactgaggagtgtagtgctgacaggtgggtgatgggtataagcaagagaaggaataagccctcttagctagagacaaggggaatttcatctgaattaacagtcaaattaaaactttgatcatttttggcatcattgtgaaggctattaaaaagttggcttggccgggcgcggtggctcacgcctgtatcctagcactttgggaggccgagacgggcggatcacgaggtcaggagatcgagaccatcttggctaacacggtgaaaccccgtttctactaaaaatacaaaaaattagccgggcgtgttggcgggcgcctgtagtcccagctacttgggaggctgaggcagcagaatggcatgaacctgggaggcggagcttgcagtgagccgagatcgcgccactgcactccaacctggggaacagagagagactccgtctcaaaaaaaaaaaaaaaatttggcttacccgaaatctaaagggagatatcagggttaaatgtattatttaatgtttatctctctgacttttggaacttcttgctctccctcccccgccaacatggtgaaagagaaggattaaaaattcacctaaaagtgaaattatacaattggctaacaaataagaaaatagcaacttattccctgaaatataattacctgggtcactgttttgatctgtgatttaataaaacaaaattatatgaaaagccctacagctacagagatctgaaaaaattatacatcttaagcagtaatttacttggactggatacaaaaagttcagctcatcttatcatgacttttgcatattttaataaaaaatatgctattctaaatctttattaaagctcttatgccctcatgcataagtttaattctatcatataggtatctgattataaaattctaggttaactgaaggagatatctaaaatattattcataatatttatttttatcagaaaataaaaccatatgaaagtaaattttaaaataattatcactttatttctacagcagaaggattatcactgttaccagtgggaaattttctctattgtaatgttaagcatacttgttactttgctaagcccaagtttaaaaaattcaattttgattaattttttattcatttcaggcaggttttgaaagctaagtaaaataattttttcttctttcaaaagaaacttttcaggccacacctcacctgcctcttcctctcctctttaaataattttgtgaaaggactaacagagcacacttgttggattgttctgagaacttaagtaatttccaaaaaggtacataagtgaatctactgttatcatctcccaggatcacagggcctggtttctcagtgagcatcagaatactagcaaagctcaggctacatcttctttattttatataatcattgcttaagaaatgattccctctttttcctttttttttctctttaatacaaacatgtgaagtttgtcttacaattaattaacaaagaatctttaaatacctgaaacagcataaaataaaaccctggataaaccttaaatacaaaatttgctctaaaatgtaaacactgattacttttttgagacttatcttcaaatttaaaaaaaggtggcagattattcagaaaagcaaagcacagtcaaattgcattttttcctttctgtccaatatacctgcaggtacacaatttcatcatctctaatgctattacttggttttgcaatatagtctttgaaaaggtacttcaactaatcttttatttttcactttaattcactttttccctttaactggtgaaaagttggagaaataaagaggttacattcagcctctggtgttctgggtgaaggcgctctgctaagtgacactgcctttcttctccggacctcaacagcactcagggtgccactaggatctggctgctgcatgagtttatacaaaacagagaaaatgaatgaaattttcctagcattagtaacagtctgagaaacatttctacccttttgtctcatagaggattgtcaagtatggttctgatgatgaaaacaagagaaaaatagagattgtaaaaatattagttaccacgtacgattgtgtacaacagaagcaatctaaacaaattgtatgccatctcatttttcttcactctctcagttattcagtcagtcaagatgcatctaagtgcttactatacatctgaaactgtatgcaagactcttggaaggtcaaggtgactaagacacaaaccatgacttggagatgttctaacagagggagaaatacctgcagacacgtgaaaccttcagaagctcagtgaagcttgaatccactaagaatattctgtgtcatactgtcaggagtgaaagattcatttttgcttctcttgttattttcttgaaacttctttaggtgggaatatttctagaccaaactcaaactcagaaattctgataaagaaatcattatcaaccatactatacattttgctatcagttttggcccttccaaaggacttgagcttggatgctgccaaaacaggtcctccctgtgccatgtaggatattttgggtagcatcctccctcctagcttctgctaattctccagctttcttataattgtgaaagaccattgaaaaataggtatatatgtgctatagtcaactgaagccagactgaaaccaatggggattacctgcacaaccataacataaattagaaattcttgtggttttggggggtaatacaactatatgctttagcatttggatggttcggagaactctattaatagatattaataggtatcttaagcagaattacaacctgccagtaatgtttcccaataaattatctttctaatgataccaaaatggtttataagctttcagagagtaacacaacttaactaacttaagataaacaaaggtctatttcaccaaaggaagcagaacgtgaacctttaaaatggcaataatccctatgcagagctaagcccacctaaaatgattttagtaataggatttccagttttcctatttttcccaacattcgttcatctatgcattactcatccattactcctggtcaaaaattacccctttcattatttcttctgttcccttattgtgaagcttaccccccaggttacaatctgggtcctcttgagcagttacaaatttaaaaaggcaaaactgacagcagccacttattgagcatttactgtatacccagtgctttgtacccagtcaatcattgtaacaagcttacaaggtagggattgtttatcccaaatttacagtagagtaaactaaagctcagggagcttagagaagtcactaatacctcagaacacttaaattaactgaggtcttaaaaattaatttgtgacaaattaaatcatctaaagaagggcagcaagaaaagaagggaaaggagagaaaaacagccaagattattttcttcataagacagttatttctcttatgaaaaataaaatatactcaactgaaagtcccagaatgtggcatgaattaatccagagatcctgtgataacccggttagcagtggggaatcttgccccaaaattgggttcacagactcaatgtgaataggagagaaatgggcactttagtaaggggatagctatcttccattatattctacctatcagtgatgtaaaagtaaacttaaattacaagtaaataaaaatgaattatatggcgtaattttgtacttaaaatttgaggatgtgaaattgaatctttcaagttacttcaaaataactgcatcagcaatcgtcagcttagttttatttccagcatcagacaagaaggtatctcctattttctagcaatgatactcattcattcccaaagttattataatatggatttttagaatagttttgaagatacatgataaatcaaatacatgtcttatgataagagagaaaacatgtcctggtgtcttctgtcttgggactttaaatcctcacttttgcacagccatgcacttctccctctgatgttgagggcatccctgatggatgcgacggaaagatatttcagagaacaggctgtgtaattagaaaaaaggatggtacatgagcctcaacattatactcatcatttttctcatctaagatccacaagcttttggaaaatcagctttcctagctatttcttggctgacagcaggtaaaaagatttaagatgagaattaattacaccgatataaagttatcaagggacaagcctatgggacttgctcattggccccaaaggatataaaatgtcagagaaacagtggcagcaatatatcaatgaaccaaatgtttctgatgtttgacaaaacatattatggcaataaatgatgctgtgttctgtaatgagattgtataaagaaaaaaaaacagtttttcagcagatatgctacttaaagcaagatttctttatgcatatcaccaatagtgaacagattagtcctatataattttaataattttgcaattaagaatcatggaaaacagattaaaataaaataaacgttggctgataacaaaattaaaattgtgaaatcagactaaaatgaacatatccaagatgaagactagcctttacattcaggttgtgtttctgggttgaacgtgtgcagcaaagtcataattaacatttaagaaggaaagttaatttgaattaaagcaatatcatgtttctcatataaaagcttatcaaaatacaattacatatatattcatttatgtagatagtatctatggctatgcaaggggaattgtgaaaagctactttgaaagtgctttcttaggctatgattatacccccttttttctgctttagtgaagtataacttacacatattaaactgcccaagtattaagcttatagctacagctacagtacacacacacaccacacaccacacacacacacacacacacacacacaacacacacacacacaccacacacacagataccagatcaataaatagaacatttttagcactggagatacacttgtgcttctttttagtccagtctcccccgagaggtaactactattctgacttctatcatagaagattagattttgctttttttttttttgagacagagtctcgctgtcgcccaggctggagtgcagtggcatgatctcggctcactgcaggctccgccccccgggattcacgccattctcctgcctcagcctcccaagtagctgggagtacaggcgcccgctaccacgccgggctaattttttgtatttttagtagagacagggtttcaccgtgtcagccaggatgttctcgatctcctgacctcgtgatccacccgcctcggcctcccaaagtgctgggattacaggcgtgagccactgcgcccggcccaaattttgctctttttaaaaatttcacacatattgatcgtgcagcatttattcttttgtgtctggtttctttttctcctttttatgtctgtgagatccatctgagttcttgtgtgtatcaatagtgtgttactttcactgctgtgtagtattctgtgttatgaatatgttgtaatttatttatccattctactactgatggaaatttcatttgttccggtttgggggccattattcataatgctgttattaagattatttgtacatgaacttttagtagaaacatttgtctctcttgactatatacccaggagtggacatgctatgtttgaatgtgtaaatatgtttaacgttagtagattttgccaaaatgttttcccaaatggttatagcaactgacatgccaatagccgtatatgagagttctttctgttctacaacactaccagcattcagtattctcagccatgttaattttagcaattctggtgggagtctaatggtatcagtttgtggtattttaatgagtaatgatgctgagcaccttttcataaatttcttggctatctgtgtatcttcttttgtgaagtgctgtttcaatttatttgcccatttttaagtaatttgtcagtcttgtttcttgtttcataagaatactttaaatattctgggcatgagttctttgtcagatataagaactgcagatatcatcttttcactctcataatgctgtcttgtaaggaacagttctgaattttaagaaagttcagttgatcacttatttttttaagtgaatagtgcttttaacatactgtaggaaaactgtgtctactctctgatcattgagatagtcatttgtgttgtcttttagaaaccttttctttgccttactttttgcatttaagttcctacttcaaatctgtatgtacatataataggtggtagggattatggctcccactcccttctttctgaaatagatatgctattgattaagcacctttttatggaaaaggccattccacacccactgaattgcagtggagactttaccataattcaggaaaatatactagtctattccaatattaaattttcctatacttgtaccaaaagcacaaactgtcttattgtgacattggctcttagtaaatcttgagatctgttagtgtgagtacttcaaattgtttcttcaataacattgacatttccatataaattttaaaatcagcttgtaaatttctaccaaaaaaaaaaaaaacctgctgggattctgacatggatcctaataaatctttagattaatttgaagagatataacatcttaacagtattgagtcttccaattcatgactatggcatgtttgtacatatttatggagtacatatgatattttgatatgagcatgcattgtgtaacgatcaaatcagggccaattggaatattcatgacctcaaacattcatcatttctttgtgttgggaacatttcaaatccactcttctagttattttaaagtatacaataaattattttaagtatagtcaccatattgtgatactgaaaactaggtctaaatcccactacttaactacatttttgtatctattaactaatctctcttcatccttctgtccacaactatctttcccagccactggtaaccatcattctactttccacccacattagatttttttttaagctcccacacatgtgtgacaacatatgatatttgggtttctgtgcaggattatttcacttagtataatgtagcatatgccaaaatttcattcctttttatggctagatgatattccattgtatgaatatgctaattttgtgtatacattcatcctttcatggatatttgtgttgtttttaccttttggctattatgagtaaagctgctataaacgtttgaatacaagtatttgtgtggatttatgtttgcatttctttgggtaaaagtctaggagttgaattgctgggtcatatggcaattctatgtttaattgaggaattgacattgttttcaaaggagctgttcttcgtgctattattctactctctctctctctgtatatgtatatacatacaaaaaatagtatattttatatatattataaatacatgttttgtatatataatatatattttgtatatattcatatatacacatatatctttatatatttgtttgttttgagatggagttttgctcttgttgcccaggctggagtgcaatggcgcgatctcggctcaccacaaccaccgcctcccaggttcaagcgattctcctgcctcagcctccccagtagctgggattacaggcatgcaccactatgcccagctaactttgtatttttagtagagacggggtttctccatgttggtcaggctggtctcgaactcccgacctgaggtgatccacctgcctcggcctcccaaactgctgggattacaggcgtgagccactgcacccagcctatcattatatatttataaagatatcttatacaagatatactatgtatagtatctataaagatacatattatatgtacatatatcttttatatatataaaatagtatctatatttagtataaataattttcagaaatatattaaaaatcctatatggcattgttactgttatttttcttaataatcaattataatatttatgcacacatttaaaatatctggtattctacataattctatgttctgttatatgcttacatttgatgatgaatttattttattttgaacaatttcctaatagtataccttgtagtgagttgctagtgaagaattcactcagatattatttgtccaaagtacttaaaattaaattgtgagggatgcttttgcttgttatagaattatagactgacttcttttttttaacactttaatgattactttctttttttcttcaggattcatactttctactagaaggtcagcttaaattttattgttcattccttgcaattttttggttgcctttagacattgttatttgcttggttttcaaccgtttgaatatgatgggcttatatttactttgtgtgtgtgcgcgcgtgcacgcttaccattcttggggttctctgtgcttgttaatcacacttcttctgtaagttttttcaccagcttgctcagccatagactctgcattgattacttcttcgttttctctcctttcttgagatgatgtctctatttttgtttgattttttaaattactatgccattttcatctaaggtaaataaatatttggtattaaaactaaaatgaagaattgagatatgatttttgattaaaaaatatttggtcttagtccaggcttcctggcacacagctcctaaaacccttgaaatctacaaaataatgtctttttatgtgcatttgagatgactgatggctgaaacctcctgaatagtcttaggatgggagctggttgccagaggaaccgaccacgtgatttgaggattccagctttcggcctcattcctaacctccaactgaggagaggggctgaaggttaagttgatcaccaatgattttaatcaatcatgcctactaaatgaagcctccatgaaaacttaaaaggacaaggtttggagagcttccgggttgctaaatacatccccttgccaggagggtagctgccccagctccacagggacagaagctcctgcacttggatgccttctgaacctcaccttatgtatctcttcatttggctttcatttgtatcctttcatatgtcctttgtaataaatcggccattggtagtaaagcatttccctgagttctgtaaaccactctagcaactgatggaacctgaggaagaggtgggaagccacaatttacagctggtcggtcagcagttccagaggccaggacttccaattagcatctaaagtgggagggagtcttgtgggactgaacccttaacctgtgagatctgacactaactccaggcagatagtgtctgaattgaattgaatcataggactcccgtttgtatccaatggagagttgaagtgtgtgaagaaaatcacatctggcatcagaagtaaagattcttgagagtatactaagagaagaaatggtttgtttcttcctattactcatggatttcaacacaatcctgagtctgtaacttttactaaagtgctattcttgaaataggagggctataagaaaataccattaattttatctctacattttcaatctttgccgattattaagaaatctagaatagactgtgatacctcctatcttaccagatagtatggtataatactcatcactatagttagcgttacagaaaagtccactcagatataaagcatgcatactgaatcagattttgaggtgtaaatatcattagaatgcattatgtatcaaataaaaaataaaatctaaataaatatttatccattatttacaaaacctaaagtagatggggcaggggctattaaaatacattgagattcaagtgtctcaagctatttgtaaggtggtcatgcacttaacttgagacagttccacccaagacataaataacattagaagtatcccatgaggattgtaagggggttgaatttgatatttcctgatataaagtttttgaaaataagaatcaaatcacatatatccctaaaagataatacaaggagtcctctaacattggtttataagaccatgtcaatctgttatgcaatgtttttatcatatatttgtaagacacatcctgtttaccaaattataattcagtttatatacaaatgcatatctgtgtaacttttatctatcattttaagcctctattgcctttggaagggaagtagaatagaaatgatgcatttcaaaaacgagaattttctttctcaccgttaaaacatgcagccataaatatattcatcttttagtcttttttctaccattctctcaatgtttccatatttaaataccatttcactaacctccccccgtccccgatacacagaaacacctagcaataaagctttatcctgaggcacattctacagaaatttatgagtctgaggataatttgattcacttgtctcaacctatcactaaatacccacattgacattaatcaaattttgagtagaccgatcagacacaaataaccaatgaaatagctatcccagttaaatctcaaattgtattggtcaattaatattgacttcagagaattcatcacctcaaacttcccatatcccaaagctctcaatttgcttttcgtaaaaatgtagtatgtggaatggaaagtacacagcaccatcttagatttgtttctaattaaaataaatagaaatgtcttatattcttatatagtaaaatctattaattagtagttgtacctaaaatggtgtacataatttgatgccagataaatgagctggataattgatatcactaaaaattttaaattactctaaatttagcttacatttaaaaattaagtatggaatttttatttaacagacgtctgcaaatatttttacaatatgtataattctaatgtattgagaattgaattgagcaatgcagagtagtgctcactgtggcttttctgacatgtaggacttcaaaatatttagcttatgaaataaccaattgcctcggtagtcacagcaataactactagataaagacactataggtacagaggtaacataatcttgtgaacatttattaaaacagtaaatcttactttgtaggaaataaaaggatacacttttatggtaatttacattcttaagaacatgacagcttccagctagaagagaaagaaatttctatttttgttaatacataatataatcatacatagaaatttcatttttaaatgcaaacttttagagagttaatgtttagacagtagatgtcataattttaaaatggattttgtatagcactagaaaataacctttacatttaaaatgcagatagcttggtgtaaataaccttctttatatttacaatgcacatagcttggtgttattgacaaaatagttaccagaggtagtatattgccaaatattaacttgttaagtagtgtaaggataataaaatgttatatcaacctccaactgttccagttgtttggtattccaaaataaatgtgagtttttatatttgtattttaaagtatagtgtatcatccttatttaaaaccatctaagatttattttttatacatttctttataaatgctttttatacttatttacttcaagaaagagtaaggctattcataagatatatataaaatacctgtgaaagtatgtgctaaaattcattacttcaattatttttgtggtttattataaagaaatatttgacaatgaaaacaacattttttaacctaggctttttttataacccagattgtctatgagattcagactattcatggaaaccacaattatgaaacattacattaataattactgctaacttaagtaaaaccaaagcacagagtttcactttagtttcattaattgaatcatgccaacatagatctttattaccataagacatcttcaagtactcagagtcattaacctaaatcattagaggtgaatttaagcaaatcgtcttcaaatcaaatgtggctaatttctaaaaaaaaaaaaaaagaaagaaaaaagtgtggtatactggtatgctcactttaggcatgtcaggatataaatttcaaaatcatgtctgaattattatgaaatctactactttaatctcccaagtcattcaaataaataatttatacattacaaataaaacacacatatatatcttaaatatgcatacacacacacatatatcacatacagatattgttctgactcttttaaaaagaacaacagccacgaatagatgatttgcagttcttgtaatgcaatagttgaactacctattacaagtcaatctgcagacgccaatatgtccaaaatgccaataagttttgtctacatgactaagtcaagcaaagtgcaggaaaatcatttctgtaagactgctcatcgagaattgaatatgcacactggatcctgcctccaagtcacttaaaatgaacatactcgtccctggtaactgtttctatgaccaaatgataatcattaattgtcaaacaattgatagaactatttcaaatactttaaaaataaaagacttttttttttttttgcaagatgagagaaagcatgtcttgtactgtttgagtttacctgataatcagtgttatcatgatgaagtttccaaattgaagactgaaaaggcatcctgtattcttcgcattcatacagcactgagttccacatatgcacacggctagcactgatgtttagattaaatcagtaataaccatgatctcccaaatggatgagtttaatccacaggttaattcaattccatacatgctctaattttattccgattatccatgctgggttgagataaaaatatctcttgctttaaaaaagaagggacatgtatttttaaaagtctactgatgtgctgtggttgcatttatttttatatatgtactcaggaatggaaggcaaagagaactagttccaccgtagttccctcacacctttcctgtcttctcactagaaactcattaccaatatcatactaggtgttagagactgctgatagcaaacaaagtaaaggtcagggaaattcatttgtggtttctgcccctcggggtctgtaactgctgtgtttctggtgtttccaaattcaagtttttgctatttatccctgggctgggagatagatctaattgcaggtaagcactgacatccaggaataaagaaaaagcaaagtcaaggaataatattattctcatccaaaagtctttacagaaagcatacataaagttgggaaagaaaccagctagctcacagctattctggttattagacatccctgtggaagaagcacctttaaagatgcagatgtcaaagagcagggtaatattagctttgaatctgtgtgaaatcagttctgtgcagtatcataatgtgttattacaggtttctcctgagtttaatttacaaagaagaagcaaccataataagagaataaaaattgtataaatcacaaacattgaaagcctgaaaacaggagttttaatagtggttaaaaagtagtgaattatactgcttttgtaccacctaagaatacactagccagtcagcattgccaatcagtctttaaagtgttcactcttcagctattccggaggtattgagaacaaataagaatttaccctatttaaaacccatttccagcatcgtcatcataaaaaaaaaatgtggttcattaggaaaactgatgacccagggctaaagtaaataccaggatctgccagagttggaagaatttcagaaataactgccttggttgaatgaccccatcagggactcacagtagactcttgattcactaggggttaagatttcaaaactctattagcattccagtaattttcacagtgaggcaaacttttcagcccactattctgtttagtcctcatagcaaatatatgaggtgggctcttcacctccatttttcaggttctgaaaatgaggctcacaatttttaagtgatgtttctgggtattatgacttagaatcataggcttcaaaacctttgtccttttcattgtggcacaggcactgggtgagaatagggatggccattattcccaccacttactccctgggagaccttaggcaggcgactgaatctcctgaagtattagttatcttgcatgtaaaatgtatgtaacaggaaccatccctgcctactgaatagagttgcagtgctttaaatgaaacagtggctgcagcagaaacctgggaaagcatacttgtagctctagagaagtctagtagcaaccatttgatttttttctccacgtcatcatcatcatcttggaagaggctcttacagttatcctgggcctgggagaggaggcagtgataatagagaaattgttgtgatgaaggatagaaagaaggaaaagcacagagtttatgtcagcagcaccagatgttctatcatttgccaagtgccctgggaagtacaggtccctggcaggctggaattttacagctgcagcaaatgtttccagtatgagacaagaaggactaaattcaggaaataaatttagttaccggttgtacatgggctgagatgcaaattaacgtgaggttgagaacattacctcaagaggcgaatttcgtgtatttgaactctgcttctaccaccttctagccctttgatcctaagtaagtcactttctctctctgtgactcattttcctaatttttaggaaatttctaaattttcaaatttttcctatattaactcctgttagcattgtaacataagcttaggggcctaaagcaacacaatttcatcttacagttttgcagatgagaagtctatcaagggtctcactggctaaaatcaaggtgttggcagacttatgttccattttggtggctctagggagagaatctaccttttcacctttccagctctagaggctgcctgcattccttggcttgtggctcctctcttcatctctaaagccagaaatggcagccaaataccatttcatcactccgatcctcttctgcttctctcttctacttttaagtaatcttgtgattatatctggtccacctgcataattcaggctaatctcatctcaaggtcgttaatttaattacatatgctgtatctcttttgccatgtaaggtaacagtaatagggtacattttgcctttccaatgtgaacattttggtgggagacattattttgcctaccctaccatcccatatgattttttgagaatgaaatgaaacatgtcaggcacttagaaaagtaccagacgtctaataagtattacatatgttagttactatttatttatttatttatttatttatttatttatttatttacgttggccaggctggtcttgcactcctggcctcaaacaatcctcccaccttggcctcccaaagtgctgaaattataggcatgagccaccatacccaacctgttagttactattgaattttcatcagagagttataggatattccattcaatttcatcttctatcatacgcttcatgaatatttcctgttgtggaaaacccaggcactagcagtaactctggattcaaaaacactgcaacatacattcaggaagattctgtagctctgagaccgaattgcaatcctagaccattggaaagtgaatttccccaggagagacaaaatggctttgttgtctcaagaattttctaaatttgagaattcattattcactcatttagtaagcatttacttttctactgtaccagactctgcatagatctttgcctcaattcacctgtcaatgagctagaaagttgatagatcaattcctggcttaaaataagaccaattatcaatgcattctgctgtcaagctcaaataggcacaactgttctgtgctagagtaaaatctaaggttgcagagaaacagagagcatgtcagtgctgatggagaaggattggtagaaataagctgccaatattgggcgtgatagtgtgtgattgggatttaaagtagaatgaataatggccaccaaatatatcaggtcttaatccctggaaccagtaaagattacgttattagaaaaaaaagttttgcagatacaattaagttaaggatcttggcattgggagattatcctttatcatctgggtaaagattaagttccatcacatatgtctcctcgtaagaaaggcagagggagatccgatatacgcagaagagaaggcactgtgaccacagaggcagagattgagtgatgtgtccacaggccaagggatgctggaaaccaccggaaaccaggaaaggaaaggaagagattattctctaagtgctccagagagagcacggcccagctagcagcttgatttgaacagactgaaactgatctctgacctctggcctggagaagcatcaatgtgtgagcatcagtgtctgctgttttaagccatgaattttgtggtaattggttaccgcagccacaggaaactcacactggaagtattgaaaaggtggggaactcagatatttaaagggaaggaacgtcattaaatctaggaagaagaagcttgagttggtcacttctgaagaaattgtagagatcagctggacttgatagaggaggagacaagacacgatgacctgcagcatggttggcattttcaaccccaagaattgagagaacccaagaacggagtggaagtaaaagcaagtagaatgaaggtagcagctgagactgaaattatccctccctaccccgctttcatgtaccctggcagtgggaccactgctccatgataatgatattgaagagtgaaaaggacatgaacttttaaatgaagagtaatgagatagaaagacataagaattctcgagaaaggttttaggagtagtgtgggatgagtttatatcacaaaattaagataaaaagaagcaattgagttattcatgaaagagtttggaatctatatgtttaaaaagaactaccagggttgccattcttctgtggttttctcacaaattctagtcaattgtctgtaaatgaatttacttttgtttgccggatctctttgacatcacaccagaaagaaaccacacacgaggaaaagcagtagttcaccgccctggaatcagaggtctagcatgggtagcccagggctgagaaggtttccactttttcctatcactcatgtcaggccagggtgggtaggaggtagggtctctccatgcagtgcataccccattctgcacctttctaaacaggtatggcattaagagcttatttgcttttaaaggatcagtgtagccatgagtctgaactattctgatacacaaatacttttcagaatgggaagtttctgtctgataaatgcctctgaaaagtcagatttatcagcctcattgctcttttgtatgtgcttttgagcttgtgaaggaaaaggagtggattctcagttaagacatattttcaacagcgttgactgaatagttgttatgggcataaactattcaatgcttggggatacggagttgaggaaatagggttcttgttcttcagacaaaaaaataaggtctacaagtttaatttataactagacaatgagaagacaatccctttcaagttgtgcaaagacacaagatgcctacattttttaaaggactatatagaaatactgctctgtgtgtatatacatatatacagacagataggtgtgtgtatacatatgcatatgtgtgtatatatgtatgtacatacatatatagaaatcataaagactatttgcttgatgttggctagtttgcacacagttcaaatttgcaagtaattcttcatccccactggtttcattgctattcagcatcttgccaatttccattaaaattcaaagcctgtcgttgtgtcttgctgtttaattgtagacttggggcaactaaacttacgttgaatgctgaagttagcaaacctcctaagctgatgaatgcactttgttatatcctgacacaaatatctgaaatgtaatgaaacattctacacaaacaagatcataatcctaattcatatctagtgctattcacaagagaacaccatagctgcttcatttctgaaacgaataatatcatattcctctagtgatcaagcaatcacctccaagtgagactacaatagagactgaaaaaatgtgaaacactgtagaacttgaactgaaatgtcaaagtgctcctagtagattttgcactttaggtagtacatctttatttgatgcattctctctgatttcacaggattcatttgctctattttgctatggcctgttattagaccatagtgttgatctctgagtactttgcacatttgcatcaaaacattgttgtaatctaagcacttgagcacatgggtaccttgactatgtctcatttcacaaacgaaatgacacattccaaatcaaaccatcagcaaagggatggcaaatatgtggtggtccatagctacagagagtcactacctgagaaaaagatacaagcttttacttaattcagcagtttcattaaattcagtcaaaagattcttccaaacacccacttatatgtgctaagtggcaggtagtatgtgttattattttcaacaggaaataagaaggctgagtatcattctaaaacaggatttcaaagggagacctggaaaaagaactgaatacatttaaatctccattctcaacaggacaatcatttgggacataattcttcctttccgttacagaacaatccagaaaaaaaggttgggaaacagattggtgaaggtacttagtcactcaaaacctcctagatgtcaatggtgataaacaacaaataaatgtatatgaatgagagttcatatttaaccagcacaagagttataaatgaggaatacagtgttagggtcctaagtattctggttaagatgttctggtaccataagtttcttactaatcttaaccaagtcaaagcaaattctgtaaatattacttatatttacaggccacacatggactagacataacatatttgttgttggttcacagggagaaacagaggttaactatgatggcctatggatatctggaaataagagaaagaatttgtaaatcatgacaaaggatagcactgcatttaaaatcatttatgataaatctacattcaacttctcttattatttcaaaacaaggtttcaaatttactctttagattgatacattggagttggaaataacctttgaagataaagtaatagtgctgcttctgcacagcctttcaaggttgtgtatgtgggtgtgtgtgtgagagagagactgaaatagagagagagagagggaaagagagagattgatttatatttccctttttcaatatccaatttctcacaaacttgatgaaactggacagttgcacattttttcaattgctaatttttgcctacctcaaggacaaaaatcaagttatcttattgttgttttagttttcatttccctgaatatgtttatatgccgtttgcagtgtcttgctcttatatttttccaattttattggtcgactatatcttgttattgccaatatagcagggtaatcgatatgactttttttgatatgattttagctgtagccgaatatcaagggtaaaataggcacagcgtggtcccaagtcctaacgtgcagtgctaacccccctaaacaggacatgtggagggtctgagaaaccagctctgctcaaatacacaataagctctgtgagtaaagtggagacactggcaagatggaggtctctggagagaatggttagggcactgtgcttgcggctacccactcctgccatcatgggaataagtggatgtgcctcccttactttaaagtcaagcaggaaacaagatttcaagaaaacttgagaaagcttaagatatgttcctggatattaaacagccacagcaatggggtctgactgttgctggaagaaatctaaaggctacaggctgcctggaagtacaatgcaaaagagagagagggctgtgttgggagccagttgtacttttaaaaatggggggtttgcatagaccagatgcagaatccataatagtgataagcagcagaatagtgacctggtgcagtgatatgtttctaaaacaggcagtaattactctaatctgaggtgactgacagtaagtcagaacatgactgtggtattagcactttgcttgtaaaagactgagcaatttgaagtctccagtgagggaactggagagaacaagagaacaagctggtaaatgtgcatctgccaagaacaaaaggctcttatgactgctctaagacaaataagattctacctgactgtatgctctcattttcctccctccaaaatagcaactagttattacaggtttctcagcaataactagataggcccaaattagataaataaagatgttttagttgcaataagaatttggaatttagtgctatactggaccagaattttaaatgtcaggaagtttttgtgactgaacaagcacaaaaagtgaggacctacctgaggtaacaaccgaaggagtcagtaattagtttgtagagccaactggaagtggagtagaagaagaataataaggctgatttataaattcatcctcgtatatctaacttgtttggcaaactaaattataaaaaatacatattttgcacgtatttatcttgtattcatataccttattagttcctagttattgttaaggatttgatcttttccaagtgtatgacagtatcatatacaattaaaactttaatttctagtatttatgattattttattttattgtcctattgcattaagtagaaccagcaagagatttttgagagctggcagaagagaaatcatgcctaattagttcaccattttgatgccactggaatttgcattttatagttaatgtaatatgtaatgatgatttttgtataaatagttcatgtttatagagctcatatttcaattcacccacaattttttaattagaattgatagctgaagtttattagactttcttttagcatctatgaatataatgagaggaactttctccttcatgtttttagtataatgttgggctaaactacgtgaagaataaatcctacttaggcatgtcgtgttcattatctaatgaaacactggagttagttgctaatatttttattttgaatttttcaagtgtgactgagctggtactatatgtgtgtgtgtgtgtatgtgtgtttgtgtgtgtgtatttgtgtgccatcttggtcatgttttgttagaatggctatctacattttaatattctctagttattttctcattatctgtccgatttgccacttctggcctaactaaaaaaatgtaggtgtatctgagtttaaatgtgagctctgctatgccagttattacttgtgtgaactctagggaattgctaccttaagtctcagactcttgaaaagataaggtttgttgtgagaataaaatgagagaatgtgtggaaaaccttacaatcaagcttgttgcgtaatgtgctgaataaatgatggctatcatcacaaatgcccttagggcatttgtatatgaaacgtatatctaacaacaatgatgttttaaaggcttttatattgatctttgagaaattcttcttttaagaaagacaactttataaactctgaggtccctcaacctatatacctggggccatggctaacaaactcctaagtcaaacttccttaaaataatctaacgataatcactttcacaattttcaatttatcctgaaatatattctgattgtccttgcgatggttaatattgtgtcaacttgattggattgaaggatgcaaagtagtgctcctgggtgtgtctgtgagggtgttgccaaaagagattaacatttgagtcagtggactgggaatgcagacccaccctcaatctgggtgggcactatctaatcagtggccagtgcagccagaataaaagcaggcagaagaacgtggagagactagactggcttagtcttccggcctgtgtccttctcccatggtgctggatgcttcctgccctagaatatcggactccaagttcttcagctttgggattcggactggcttccttgctcctcagcttgcagaaggcctattgtgggacctcaccttgtgatcatatgagtcaatattgcttaatatttctaaactcccctttatgtatacacctgtcctattagttttatccctctagagaaccttgacatatacagtcctcaatagggacttcttcttaaccctgttcatatatatatatttttaaaaagtctcatctgtgaccctgcaacttcctgcagccctcggtttcgttctgtgatgtcctgttattcccctaagaggtgacatggagacagcgggctcccctgtgattcccagccactctttgggatgcttggctccatccttgacaaagattttgctccaggcacagtgattcatcctaaagccaaaatatgcatgggagtcactatccaaatattaaaatttatatttgaaagagaattgctggtagaaatgagtgcttatgcaaggaattttggtcacttggtaatcacataaccttcataagaactcttctaaagtaaatgtactttttaccctcctgttcttataaggatctaacataaataagcaagaagttctggcactgtgtcaagtagaccgaaaacaaaatcctcatgtaaataaacattgctgtaatatgaccttgaactaggcagctaactcaggaaaaaacaaaggttcttcaagagaagcaactaatgcaaataagttatacctaattaaaactcctaaataatgaaaaagttgataaacaatttgtgccaagcaaaaattccaatggacagcagtaatcaatgaggcagaagcttgtattttccacttcttttcagacacgtttttgtctgcttttagagctataagtagaggaagccagggtatctcttacaaatatcaagcgaggtttcaaaattattgacacagatgcccagaccctttcccaaaccattatattagattcataggcatcaatataatttaaaagtcacccaaggtgtagtcaaggctgaactctccttctttaaattaacatgaaagatgtgataatacaaatggtgtgtctctactaatttctagaacctaataattttaacacccatttcaccgcactgttccatgtctgatgaaacatgcaattttaatatactctattcaaaaccttttattaattttaagttgaatgcaaagttagggtctctttgattccttctagcaatcatggcccatgtgaagtctaatttatagacatacaaatgtgatcctgagaaaagtcttggattttaactttaaggaaaaatagaatttagtacttgaaggcgacatttagaaatagaaagacagattgggtttgggccaattatgactctcatgaaaaagtaataccagtgctcctggcttaatacaggccacagaaaactggaagggaggtttaggatagcctcagaaaacatatatatgtattttttgatttgtaatttttgtgggtaaatagtagatgtatatatttatggagtacaggagatgttttgatacaggcatgcaatgcattataaccacatcatggaaaatgaggtatcgtaattcaaatacagagtttccttattgattatgtctatggtgttttcccaactgctctttttgttgctgaaattgaattatagttaatggaatattaaagaaagccataggttaacggtacatcattttgacgatcatcacatcatgtgtacagactcaaaatgaagaaaatgtaatgtatgctctatgctttgaaaaccaaattagaagtctatcttcactccaaggatctttctgcctgcagaaataaggctagaacctactctctgagctaggagaaccgagctaggagaaaataaaatcaatttcactcgggaagaatggctgatctgtttttgtgtccctttaactccagcagtttaataaatacttgtgatttaatgcccaatgaagatattattgaaggaaaaccaagcctcaatctcttcttggcaaatgagaaataactacttggaaatgtaaataccagttcaattaattccaatgtaaagtggacacctgatgatatttcaaatatgctgttataaagaaaatactgagtatgtttattttaaaaggattctaaatttgttttaaattataaactagttttcagttattctgccctattcttctatgaaattcacagaaattattgtggccattttatatttgttatttccccccatttaaaatacgttatgaaaaaccaatccctaatttctcatagcttattttattatttgaagacaactttttcttatttctcagttacttaaaacagatatatttagtgtctgttattttatttccctcagtgatgcatatacaataactcttattcactaatataattattaatatataatttatagaaatttgactggctctattatataactttgatagctacaagactcatatttataaattgatagttaaaaggtattcagaagaatggtattgaaataatactgtaagaaatcatggattgaagtcaaaggcattgctacctacatttaaatcattcatgcagtgttgtaaatgtactattttgtgcatgtatatcaaccaaattgttgcaacacataggtcagcatgcacacataacagagccctttcccctaaaatggcatgcttttttcttatcataatcttaactattcaaacctatttatatttagagaaaatcaagaatatgtgtttttacaatggataataaatagtctaactgagttcagtagttttaaacattttatgtctacataaactggtacaaagatgccattatcggggcaattatcctctaggtctccttgtaatgaggagtttacgctgtcaagtgtgggaaatttacaatctcaagtgtggagcttaagtggaaaagtcctccttggtaaatataatggattaattatgttttcctgtaaggaacctatgaaatcagggaagtccaagtttggtgtccccttggtatttgggatgaaaattaatacttctttcaatggtagtagttctcctttgatttaaaaaaaacttaagtggcatatacaataaggagataaaaattaaaaagctatttaaattccttactttattatttttttctcattgcattatgttatccaccccgaatacactgtaaacatggcataaggggatagtggtttaccaggaaatcacccaactggccaccgattgaactgaaaaaagtaatctctatatactcttatactgggttccaggtcaaagatctgtgctgattttttttccagtatctaaactgcttagcaagtcaaagaaactttgagttagcctaagttaaattgtagcaataatagacattttcccaaaataatttactattaagcatacatattatttactactgagcatacataatgcaaaatcccattatagtaaactcaaacaaattcagtctcatatctcagaagtcataaaacctaagactagcaagaaaagtgttcagaggtagaaagcagttgccagcattgattgaacatcggaatggtaacagtcactaggaaatcaatgcttgaccttatagtagttgcttggtggccaggttcctaggactcgtctttctgtaggacacacaaactgtcttgttgtcagtgttctctttgaatcatgcctcagattttctgctggcccagtgttttgatcatctgtgtccctgaattacaaatgcaagactttctgcttctttcagcattcctcacccctcccaccttttctatagcagtccccaggagctcaccttttctgcacgtgaaaagaatactcactcagtataatcatttatgtgaaccacctaattaccctgcaggatatgactcatttgcatataattaaatgtattcagttttaaaatattttaaattttctttggcaacgttatgatctattcatggtcactgagctatagaatttattgctcatttggtgtggttttaggcttatagctaatctttgctgaagtattttagatacaggtaatagaaaaaaagcaattaagctccatatggtgccaaatttcttttgtcctttttccagtattcttctctgccctcagaaaacaggcgtcagaggttgctatcacatcctcatttcatctttgtgcctcttctcttttcctctgctctctttaccttaataacccatctaggactttcctcccttcagcacattagcagtcctttttataaggtcaagcttcacttgtcggtgttattacctgtacaatattagttttacaaatggcaaatggaaaaataaagatcctcttcaacacagaagcccacaagggcaggagtgcttatggcttcaacaggtcaaattcagacccagaaaaggaagaggattggtgaatacatgtgaggactatgttcaggaagccaaagggtatgtgctactggacgcctgggtaggaatgttcaaactactctgagaaaacaaaaggactgtagaaagagtcttattttagtgcaaatagtaatagtaacaggaaagaagacagttgaggagagggagagaacagacgtgaggccagcagatctgaccagcatgactcggagagcaaggagcatcactaagcatgtttcatcatggttttagtcttttgcctgaagcattgtttgtttctattacatcatgcatgccaatccccaaattacttacaaaaattacttcaaatatcactataactagggtgactatataatttatcctccaagctgggacacctttgaggataaaagagggtgctattaatatttacactggaacaacttgtgtgaagcagaagtgtcctggccaaactcggacaaacgatcatcctaacgactgttcgtctatacggaaacatacacacgattgaggctttcaacaacaaatatgtattaagcacctgtagtgtggctgggtgtataatacagttgcatctctaattaggggtgaccgagttctaaaattagcaagcaaggcagaagttaaatgtatcaaaagtattcttgagcacttcttaaacctatgaattttttgaagattaatgtatcattttaacacaggtaacagatctagtttttcctctagcattaaaccaatcaacccctgcccctacctcactgtatttcagaagaagtaggagacatgcatttagggggcgatgtgtattacaatttcatattgctacatctactgtacagcaaagtgtagtcactgtgtagagatgcttatagcataagggatccacagagctgagtctgacagtggggggcaggccaatgcctcccattgatgctcactctgggcacatgctcagatgttctgccaccatttattcgtaagtatttcaagtccatatgtatggttgactttgagtaacttatgcataatatgatgctactttcaaaattgaaatatatacttaacttgagtagttaactctagttataggaaaaagatggcaacataaacaaatccttatgatatcataaggaacacaaggattacgtaactagatatagggactaggaagaaataataactacatctgcttcagggggatcagtgaacgtggactttctcctaatctatggtcaatgaatagaaattttcctgacagtgaatccatgaattgtggcttggggagacagggaggtgagcatattgaaagacagtgaaatgcatgtaaagagagctctgtcaaactctgtgggatttacagtaagaacatgagacctacaaatagaacaaatactgttagttatctatatctttcatttttaaattgttgtgagaaagaaagaaccctaataggagacctaaaattaatccatagtgtcatattgtaaagaccttctgtggacaagatagaaagtgattatttaaatgaaatgtgttaaaggacagagttagtttcaaagatataagccctttcaactacaaaaagcctttttgtgtgtgtgtcttctatttattgccacaaatatcaggacacaaactgaagcctctaaaatgcaacagtcttaaaatcatgaaaaatacatctttgtattgctaacaattgggggatttactaaaaccaggaagaccagatacatggaaaagtagtataatcagtgatttttgagattatactacttatacagagatcactgtttgaaaacatgtttgttgcactctcaacctcacaagacaccattccttgaaactgacttcaagactgtgcataagagcatcaccttccatagaaatctttcagctttgaagccctggctaatgaagaacatatatttaaagcccgtttatcataataaccatataattacagaatttagcattttatttaaccatatttaattctattttacagctctcttacagtatggctgagcttctttttattttctttttaccctctcatcccttgcagaacagaaccaccgattttataatatatgatactctggacttagcatgggcagtgcacttttcccattttatatttcccaaatattcagtgataaaatataatcattacatacatagtgtacatttccattgacgttcaggaaaaatataatctccctatatcacatacagctatttgcttaggaaaaatttctgtgggggtacctgtgtgtgcttgaacacgcataccttggcaaatccaaaacatttaactaggagcaaagagttatggtgcagagtctagaagactacactgcaaatgccagcaactaacactcccgtgtcccctgacatcgtaggaatttacagggacgggtttaagtccagaaaatgtttcatttcagctgactgtctctggtacttggtagaataataataaattcccaagatctgttttagatgtgaactctcagcctggaaggacttgtcctacaagatacaaatcaccatgccatgcccttgttagtactttgcaaacgtcaggtaatgtcagcaactcagaaaatagacaataatacagtacgccttcatcggtgaagcaaaatttcctgaaaaattaaattttaggtgatatttagaaatttgctgtttttcaaaaattgtcacaacagctatcacagtctacgtttgcatgtcgaagcatttctaatcctagaccataaatgttttgcttaaaaactctttatgtgtgcagaccttgcaaaacaacaaaaaacagttctgatctgatatgaaaactcggggagcaattcctctaattataacagctgggtagggagaatttctgctggcatggaaaagaacagacttctaatatggccatttacaaaggcaaatgtaaaggtgaatgattaacttgaaaatacccaatggcagaaactgattatgacttgggactattggtgaaagcacaacatggagacaggaaaacacagagatatgacagtgaaggcatgctgagagagacagaaacaataaaatgaagtatgagacagaaagagaaggtgactagataaaagggtagtcaggagataatcttagacttgtaaacaaatgcttataagcaaataaagaatggcaccagaggcgtaaatgaggtactgtaacatgctaggagtgtttcaagaacaggaaaagtcattctttgtgttgagatgcagtgggattaggggcagtgggactggaatgaatggcttcatagattatgttgacagaaagctttgaattccagagaaaagagtcatgactttcctttgcagggggtaggtggtggcagggctcagtgcatataactatagtcatatgtatagtgaacatatctggtcgaagtgccaataatctggccaacatgcaactatatatttccaatattttgccacattgttcactcaaagtccagtggacagttactttcatagaaattgagtctaacgtatttgccaaatgtatacaatttattaatagtgctaccatgatacctaacattgtagtttaagttttaaaactagtaataattagtggaggcttcagataaagaaatactaatgtctatcaatgaaatgaacggagttaaacatcttttaaaaaaggaaaagaaaacatgttttgaccacaaagctccaggtgattttttcctatgggcatatcactttgttaactggaatactacattaaaaaaattactccatctttttttaaaaaaaaaatcatcagcctttatgaaactcagaaaaccagaaaaatttgtgaattacttggtagcatgtcagcatattaagagctactaaaaatgcagacattttccagttacataaactgactctctggaatggaatgtgtgcagtctatattgactacaccctcatttcactgcatttttgccgactcttaaatgttcccctcttctctgttgaaatttaatctccttgatttcttcagtgatgctgtggctaagatggagaatgaaaagagtgggcacataggatgacctcagcacagccaacgttgatcttaaaattcagatttctccctgatgggatgactacatgataacttacgtctacatactaagatagccagagtggctgtttcagaatttattatatcaatgtttttagtcctggccaagtcctctctaaaggcctccaggtaagtgtaagttcatggctttaaaagtgtatgcgaaattgagttcattcagtggagaatgaaaattagcattacaaaagaattatgtgggaagacagaagggcttagaggagccaagtctggcagatggatttttcatagtcaattaattgggagaagaagtcatgcagtataatggaaaataaatctgaattctcttctgccttttcaagcgggtcctcgataaattcctcatcctttctaaccctcagatttttcatacctcaattgaagaagttaaaacattcgacctatgatgttcctttccattctaaaattcaacacttctacctagccaactttgagacagaacaaaagaaaatgacctccctagaaaacagtactagaatttaggttagaaataaagaagaaacactcatctgggttgagaaagttagtaaaactatccctgtctctggagatctttacaaagaaactgtagttttatatgcctggggtcactgtcagtgatcactgcctctgattgaaggcagctgaatgcctatcaacaccctcctagctatagcccactgagactctcaatctgtgtcaactctgtctgcctctcttatatgagctataggataattttaggtgctaacattaagtataacttagctcttttatctctgaatcagaaatgggaacaaatgtaatagacagtaaactagtgaatgttaaatataagacaactgcatctttctttttgttatgaacatgatcgtgtgcatgtttgtgattaagcatgtctgtatagacaaaaacatgataattagccaagtattggggtgattgatggaaatcaagtttctgttgaagacttcataccatactctgtgaaatgaatgaaataaacatttaaccctttcagagaaactccaattcttgttaatacatcttcaaatctacagttattgaagaatatcataggctttgccttaagaagaatctctttaatgtagtcccatataataaaaagcagaatacagttgatctcagactgaagaaatccaatgaaatttaaagcctattaaaaacattaagacattttccaatcacaggaaacgtttaacagagcatgtaaagtacaaacatctgagagaaagaaaattatgattaaaatgtagtctaccttgcatttagtagagtaatggaaacaaccagtattaaatgtggtaggaaagcaggtctatttgtcaacgcaagcagggaactctcatctttatgaagaaattttaaaatggtttagacagttagaaaactacattaatattctaaacttaacatatttcatttaaggaggcaaccattttatacctcttgaaaggcttaggattatatttttttaaaaatcaaggaaatgaagcatatttaatatgcataaatttatattatgccattttatcttttcatcaaccctgtcaagatatgcattttacctttcatactactgaatacatggattcttagagacccaaaggttgaacaaagaggaaataaaaaaaattagaacataagagtaatcttatataccatcagaattacaacataactctatagactcctactccagttgtctttccattgcatttctatttaataaaatgtcaagctccaaaaacctaaaaaagtgtaatgtaataatttagtatcaaaaacaagagaaaggaggaggcaaaagaaatgagtgactgccaagggagacacattccttcagcgagaatgaggtttagatttgttatatgttttagagatgattggtaaatccaggaactataggtaatttttccagccaccggataacagaaaaagagagactataaccatgaaagtcactctgggctggaataatagtcaaactaattctcaaatggtttgagaaaatagtactaatataaacccaaagagagaggggaagacaaggagagaaaagtatttgtaaacgtggcaaaacattaaacaattactgacccttgatgaagggtatagaagttattctcagtatttttacaacttttctgtaagtttgaagatatataaaaataaaaaaataaaagtctgtttggaatttaaagaaactcatacaaaaaaaatcttctgaatgttaatagtttctttactttgcaaacctgaaaaaattaaaatgttggtataaatgaaaaaaagtgtattggacttgtatttttcttttactttctcgctcattttttgtatcttctgacctcctttcctctcttccttccttgctcagttcttccagcctgtattttaaactaggacatttttgtagtgctgattatttgaatgtgacatgtgccactagttagaatttttctgtctctgtgtgtggaaaaatctattcacacatctatacttttaacaaattgcagctttgagtagtttctgctgactcctgacatatgttcagcatttagagtgggaaaagggggttttctgaggactggaagggacacaaaatcaccgtaagcgaccggaaaccaaatgcttacaaataacaaaatcaggaggtgtttgcttacaattttatttaaatggaggaacatttttgttttactacattaactccctagttgtctaccattaattttcataaacatgggcagccgcttgtgcacaaaaagtaggaaggtctccaactcaagcttctccacactttccttctctaggcacaggggcactgatgtagaagatgccggatgtttatacttagaatccatactatctttcaatgaatacgttaatgatatttacataaaatgtatgacttacgtatgcgaccaaatctagacaaatatgaggaaacatgattattaaacaagataaacctagatccaaaaaagaaatggatgagagagagatacatggctgagcatagtttaggtgtattttggccaagctttcctttatggatggtatagaactccatgcctgatcctgcattgttgagaggcaattaagttcctgaaaatgttcctcctgggagtcatgagcaccaggtcaaactccagctctccccctaattaactgagtgaacttgggagactcattcagctcctctgggatatccaccatcatgaaaggaagatgtgggacaaggctaccaccaaagctctgagatctgtaggccattccaaattaaacacacaagttagaattttttataaatgtggttccttaataaagaaaaaaagtatgagatttataagaagcaaatatgagagagggagaggaaggcaggaagaagaggaagggtcaaataatccattatccaaatgcaatgtaagcaaaataaattctaactcaagtggatataatatttaagtgttctggccaggcacgctggctcacacctataatcccagcactttgggaggctaaggtgggtggatcacttgaggtcaggagttcgagaccagcctggccaacatggtgaaaccctgcctctactaaaaatccaaaaaaaaaaaaaaaaaaaaaaaaaatagccgggcatagtggcaggcgcctgttgtcccagctcctcgggaggctgagataggagaatcattctaacctaggaggtggaggttgcagtgagctgagatcgtgccactacactccagcctgggaaacagggcgagactctgtctctaaaggcaatatatatatatatatatatatatatatatatatatatatatatatatatatagaattatatattctatatatatatatatatatatatagaattatatattctatatatagaattctagaattatatattatataattctatatatagcatatatattctatatatatagaaatggatatatacattctctatatattctatatagagaatagaatatatatagaatatatatagaatatacatataatacatatatagagagagaagatatatagagtgtgtatatatattctatatccagaactattgcccaatagatttttgctcaatctgaaatgctagaagtcatgagaataattttcccttcttcatattttacttgcaactttctaaccaaaacagtttcatttattcagtcatttctttcaacatgtttttgagtctctgagatgcagaaggtgttacatatcatttatgagggataggaagttaaataagatgcgcattatggattgaactgtgtttccccaaaagacatcaaactcctaactgctagtagctatgaatgaatgtaactatgttcagaggtagagtctttaaagtgagttgaaacatgacagtactcagagccgtgcttgacacttagcactcattttaattaagttaaaatgagctattagagtgggccctaatccaatatgtctggtgtctttataaagagggacaatgaacacagagacagagacaggcacacaggcggatttacctagttctgtgggatctgccatgtgatcatgacagcaaggtcaggatggtgcttctaccagtcaagggatgcctaagattgccagcaaactcagcatgggagaagtatgggtcagatttctccccctgagccctcagaaggaaccaagagtgctgacacctcgatctcgggcttctgaccttgacaactgagatgatccatttctgttggttacgccaccaggtttgcggtactttgttaccgcagtcctagcaaactcctacaaccagtcacttgcatttaagcaatgtacaatctggacaaggaaataatataaaattatcaagtaatattctactgcaatggatttaagggaggtttaaacaaggcgattcaaaagcgagggacttcaacctatgcctctggcttcttctcatcccctttcctagctcgcctttctctcctcctcctcgtcgtcttcatcactactaacattttaagagcccttgctaagtgtaaggcatcattctgagtactttaatcttttaactcattcaatagtcacaattgaaaagccatcatttaaaaccaaagaaaaccaaggcatttgctggtatttaaatagtgacctaaatgaaattgttagttgcctatgaatataatcaaggacaccaagccctctggcatttcaaatatttcaattactatccactaagggaagtagcctcctatggtcacacagcttgtaggtggtggaatcagaggctcagtcaggtcagccgtgcctagggctggggctctcaaggaacagattctgcttttctttggataatctgctagcgtagaaaagactttcccagtggaagattagaagcaaaaataaagtaacatttgaaattacacttatgctactgaggtgtttttattttactaaaataattacatcacaggctggttgccatatctatcaatatcactgcaattctgaaatgccagccaccgaaacacatgagtgttcaaagaaaagctgacgtcaagaaaacgtgggtctatgtacttcaactttattcatatcattgtaatccttccaataagacattaatacatatcataattcctaattacccacaagcatgacaatatttctaatggtagaattttcaaacaaccttctatactgaagaatatggggtttttcttatacataacactattttatccttttcttgaaggaggaaaaaaacaatcccaagttacttgctgacaaaagtcaatgacaagacagtgtgaaacagtaacaccatttgcgtatgtggggctgtctgcacagtcataacacttgagtgtggattttggggtaagtgcttttaaatacatcctttctttaagttttatgacactctcttaaaggaaatgtctttgtcaggacagaaaatcaggactcagagatccacaacagacctaatgacacataagaagaatacttgatgtcaaaactccttattctttccctacctgatccacctttcccaggacaaggacccatgataccagatacctatgtttcccaacacgatatgcaaatagatgtcttgcttagtggataataattgaaatattttaaatgccagagaacttggtgtccttgattatattcacagaaaactaacaatttcatttaggtcactatttaaataccagcaattgaagcaaattccaccctaaatcaatgtctgctgaattaatgactatggtaaggaaattaataatttccttgagggaatcctacagaaataggcagatacttggaaagtgctatttatttagaatattaaggacttaggaacaccttgcttgatgcaggtgtataagagacacaatgagagagatggttgcccagtcttgtgatcacctgagagtgtgtagaatgatcacataaaaagatcaaaataactatgggaggtatgtaggatacccaatcttggcccgccaccttgtttctcttattctatttccaagacaacctttctgtcaccccactgtctattctggttcatggggaagtatctgacctcatcacccctttgggagtggcaaggaaagggactgacagtcactgaaagaagcaactttgacactaacctattaccaacaaattctctcttcatagtgaaagcaataataatatacatatctgataaatctgcacaaaaatacttcagtgtattatttatttatttttattttcaatttttttagttagagacagggccttgctatgtctcccagactggggtgcagtggcatgatcatggctcattgtcacctccaagtgctgtgctcctatgatcctcctcagcctcccaaatagctaggactacaggtgcacactaccacacctggataatattttaaaattttattttttgtagagacagggtctcactatattgccgaggctgatctgaagctcctatcctcaagtgatcctcctgcctcggcctcccaaagcactgggattacaggtgtgagccaccatgcatggccatataaatattttgaatattcccacacattatagccctcactactaatcactttggggaataaaaaaaattacagactgatactcaagtattcattatatatattttaactcctcatcaaaagaaaaggattctctattaattttatttcaaattcattatgtgacctcaaaattattacatgcattgacggctctattttgatttcagtctcaaacatctctgcacaaccatcatatttgctgaatcactattatatgatgagataaaaatgctcatttaaactatctattctacattgcagtactgttgagatatgttcctaacgcaggcaaacacaatgttagaaattattacatttaactccatttgcagatatcttacaggtactcaaactgtgtgcgtacaatttagaagaatcatgtgtttggatggaatcttttctttatttgagattataacaagtatgtatatgcatttatgcataattataaatgcttattgctgttatcataattttagtcttcctaagatttctaagagtgatcccaaagtatataagagaatagaaacaacactcattcattccctactaaactgatgtttcatcactgagattgctctatggtattagaagaactgtcagagagaggagaatactgctgctcacactaaacacaccaggcttactgcagagctgttgaaattctgacttgttcctcatgtgtatatgatggacatggtgatgtttgctgacctagtataattaattgccaccattctgtcaaaatgtaatcacaatatctgaagattaaacgaaacataatggagtgttttatgcatttcttggaaagcatttcaaatgtcatcatcatgttgtaaaaagtcattcagaattctcaaggtcactcagaggcccatatgcttaaataagtgctggtcctattgccaactctcattcaatcttttgagctgggcattttctcctcccatgatacctgtccacctatcaatcctactctgtaacctaagaaatgaattccagaagtcatttgcctttgaagagttaaaaatatcagaagttgtgaattatagatcttacacaatagccctaaggatggattttattttcatagcctccacaaatgagtgtgcaggaaaatcccttaactataacaaagagaaaaatacctatgagtacatatcagaataccaaattttatgtgtgtacccttcccattgtgtaggaaagactttgtcttattagttcatgattatataataattgtacacaaatgcacacacacacacaacacatttaagaaactcattttacttttctctagtggtatcacacccacgcattctgcattcaacccttcaggttatagacttatccttaacaaactcactttgacgtgacattaatgataataatttcttaatacattaacagtgactctgggctttgggtttcctacttttgcacaacctgggctttatgtgtcttcatcttcaacttgctgttcttactgtcaccatttcacataatcaagaatgaaatatatcactttttaaatgtcaaaactattttaaagtaccaaatgcttctaggtaaaacactgacatcaatagaaaatgtaattagacattgaacagaatggttaagttcattttaacattctaccactgtataaattagtatacactaattatttgccagatatgaaaagtttcagcagacccctgggccagtctctttcttgttcagaaaatggctggaatatctgataattgaaattaagtcctgctatgtgccatattcaacagtatttcctaatcactattagaaacataatgaagttattatttataaaaaagttaaaattgcatcatattttggacctgatagttcatggtttgaaaagtctgagggatttttaattggcttgaagaactgaccatgaagcataaagtaaaataaagactggctttcgtggctcagagaaccagagtgtaatttaacatactttgcatttaaacaaccgcatattgctgacatggttttctttttatggttgttgttgttattgcatggatgatgcataaaaattaatcatacctttgtctgcattcaaattcctacaagttttttttttttttaagaacacaggggaactcttgcccaattcttctgtctatccacttcagtgtgcaagccttcttgtacaatgtaattttaaattaaataaagtctcactgctacttctcctgagtatccatttggctttgctaactctgtaaaaccgtctttcaaatgactcaaactacattaggaaaatagctaaaccatttatggcatctgtggaaaaaatttcttaataatttttattattttaatacaagatttcaagttagagtttatttctccatggacattaaaagaatgcctcttacttcctctctaggtaaaaattgtctagacaacttttgaatggtttaaaagttgatttctgttattaatattgctagaaatatagatttctaattgatatttttgaaaaatagtgtagaatttaggcatagtggctaccattaaatgggaggtagagttattcgactggcaatatctattactatataccaagaggaagaattttattcaataattactactgataattttaatacaaaaattatattacctctgttgataacaatttatgattataaaacaggaagtgaaatgttaaatggcaatatttaaataataatgtggtcgaggctatgacttcttccagagttgcataattttgttaccattattttaccatttaacacaaccgtaagaatatgagcacattttgattacaaagaaggcacttgcaaataaatttgcatctttgcattgtaagcattttaccttctatgcttctgacttctaataaaacagttgtttcttataacacaataactatacaactctcaaaggtaatatatcatcatgttacaattttattctatattacctataagcaagaaagacattgatttcttcaaagctatgtctgaaatacagctaggaatccgatacttttgaaccataacacagtattgcccaccatagaaaataatttgctgtgacaggcatctcttttgcacgtggtctacggtataggtaatagaaacagtattataaaaggtccatagtggaaaggcagatgagttcattggagatgtttacattaacggggagtcattaagtatcaactctttgtcattgtttcctcatgaagggcacacacagttaatttatttcataacatcaacagatgcttttctcatggaataaaccaatattcaccaatttattgggttagtaccattagacactagtgtcagcttaatagtaaagtagaatgatgtttcttttttgcccacataatgatttctgctaaataatagataggagccaggatgaatgcccaaataaaatacctccaccttgtcagagaacaaaaatctagttattcctaagcctcacaaaaaatacgttattcccattcagtctctacctcaattagaacagcaaatagcaaccaattatggtgcttttgtatgggctgggacatgtttattaacatgtgactcatctctctttatttaatatagtggagtggtcaaatcttaaaaccaaggtctaaccctggacaaaacccctcagagatctaatatgtttctgctgaaaagaacattgtgcaccctttcaatgaaattgccttccaggctggatgagttatctgaacaccaacaaccaacatttagtgaaaccctaaatagcacagagcacaatatgtctttccataatgtagtgaagtcaaacttaaaatgtagtgagcatggaactcacatctgtagaaactcttaggtcccacaagactgcatctgcgtctatctttgtcatcactatttttctctaagctctagaatgtgttagatcaattctggtggacaggtcatattaccataaaaatgtggccaatattttcagtcaaataaatacacactattgtttcaatagcttatagttttaaaactatataaaatccatagaaacaaacaacataaaaaagaaaaaacaatgaaagttatcactgagggagttattttgccaatttttagtatacaacttgtgaagaaaaatgtatagtttggcttttcaataagaattgttttagttattcctctggaaaaaaagaaaaaagttgttttacatatttttgtgaatttctaaaataaattatttttcttattaattccaaagtgattaagaaatgggattagttattggagctgcattgaggatactgagagaaataccccatatctgttcagagcccagggttctcacagtgcctgacaggtacctcccatacactgtccctcccagaagtaggaagaagaataattatcttaaaaaaaaaaaaaaggaaaataactcaacttggatagatggtatattgagatttcagtcatgagtcctctcacatgtgtgtataatttttaaagatgcacaattttgcttcaaattttaatagctataatagctattaattgttgtttcaatgttacagttgatttgtcatttaccatatgatatattggcttccttggcatttacgtaatttgttgccatttttgtaacatggagagtgaaaacaaagagagaatacattttgaaatagtgtttcatctattgttttaggccttcatgttttagatcatctttgaaactccttacatataaaaattattttcaccatctaccacctaccatgtaccattcacaaatatagctaaccaaaatttgaaacattttgatcaatataaatgttgttactatttacagtagtttatatagtttttaacccccagaggaaatcaggataaaaatgcaaactgcagtgatgtttatgactttcttctttgacgctgaaagaaaatataaaaccaaagtattttgtgtcattttatgaacatgtagaaataacaaagctctttttctaattataattattaatgctcttgctttaaaacgttcaagtttaagtggtggcaacatttactaaaaattagggttttattttttctcccctgagattctctcttaagttaaagacgacattaccactcacttcattaatgcaaatatggccatattagaatgcagccgttgaacatctgcctctgtgtctgtggatttatcatgctctttcagcaaagcagcgtgtaaataagtacttttctgcaattttaacttgagaaattgacatatcttctttgctgacactgaattttttcagcggggaaaaaagacaagtgatgtgcacagtacatttcatgaacatgaagccactcgaggaataaattaataaaatgtactgtgaaaattggtttcaccttaacaataattaatcaagaagtacagattaaaaactccctacatagctgtcactacttgaggaaatgggacaaatattttcatggaatcacagattctgagaaaagatagaactcttagaattcatctagtcaaaatgtccttcaatggttaacttaactgttgtctattggactttcaggtttttgttattttttctttttcaattttaaaccacaatttttaacttatctttgaagtcttcgcacatgttgtacaatagctgacaatggaaggagtacaataaatatttgctgaaagagcaaataaatgaattcattaatatacactttgataccaagagctctactcctcagcatatatttaagttatgaatattgagttgaatggttttccacatatttcttgcaaacccttttgttagtagtttgtgtgtttgatatttgttaagtaggtcgtatggttttggttgtagttaggaaatacgtgttatgatgggcccatatgggaacaacccactgtccacactggacatggaggacgagccacttctgtctcatactgagcaccttgatgtaactgctgatcacctctggaaggagaaggacatctcctctaacccagaaatggaacttgtctggaaatctctgcttagatacagacaaaatgaagcttcagagaaaacagaaggctagggaaaggaagcgatttattaaatacagttttatctatttttattgtttttttttaatctaaaaagcaaccacctctgaaacaatccaggttggttgacattgacaacctgctccaataggatgctcttgtcatgcccttcaactcagcaggcgcctgccagccctgttgtcgatggtctcaggctgatttctcctttgagctttacgtggtgcagactacatctctttttcaagattgcaaaccagccattattggttgaaaatttaatgtcttgctttctttctatcatttcttatttcattttctgaagtctcagcagaagtcttgtctttctctataccatcttggtgctcgaggagacatttcttgtccttttcttcccacagactaagaggagtgaccacaaccagaagttttctctatgcactccccaaaggccaactcatctggttaatggaaaaggtgagctctatgtatggtcatgtcattctgcttactcctagttcaagccctgaactaggaatttataaattataataatagtaatgacaataatcaatggtagatataaaagcaggcagttgaaaagtctgatttgtgggaaagtagtttagaccttggtcaccagcactagacatgcctgggatatatattcaaaattatgattccttttttgatttttagaaatggagtctcactctgttgcccaggctggagtgcagtggtgtgatcgcaactcactgcagcctggaactcctgggctcaagttatctccccatctcagcctcccaaagcactgggattataggcatgagccactgtgcctagccctcaaaattatgattcttgaggcatgttgaaaccacttaattggagtcttggattctgttttgttaatatctgagatcaggtcattttcaaaatcatttcaataagtcttataaatattgatgtttgtgaaccactatgagaggatctgaagccctgatattcccttcatatattattagcatcaattttgtagaaacacaagttttgaatttaattcagctagtattctgctctattatccagtatccaaaattgagcatgtagattctatatacttatgaatcaaaatatgtgagaaagatttctcaagacctcatgttatttaataaacttctttgtaatatctaactttatgctgatgtcactgacccagcatattcatctttgtctcacatgcaggaagaatagaaaaacaattaccatctgtcacagaattgattctatctgcacagctttcccaagacagccctgagatgtgatccttctaggatcaatgagcttcatcatcatccaatagtcattccatgactataatccacttggatgtcctgtgggcaaactaagcaggtccctaaccaaatgcagcatcttactccatccacccaccctgtcctgcttctgggctttattttcttagtgaaaagcatcacagcttacctagttctaagccagtcttaccagatgagctgtgactctgctgtctccatacccagacaaccatgaagttctttccacagttcctcagaaaacacttttaaatatctctgattttttccacccctttaattcagaagttgcagacactagtgtctgcaaggcacataaacaaagtcaacatatgtacagaaacaaagggagcctgtgtgtgttgtgtcttcctttctaaaattaaggagtggttaccatgtggccacagtagtggagtgcatgcctcacctaaaggcattcagatcacacagaacccctgcccccacagcacacatacacacacgcacattatccaaaaacaagccaagaaaacgcaatgacaaatgtttcgtagttttcaagccttatttagctttctttcttaattcaagttttcagtatcctcattcggataactgcggtagattttagacactgctgacatccctttccactcattctcactgtcaccagtgaaatcctctggaagttaactatgatcatagcggttttcttgtttgtttgttctttgttttgcctgaaattcacatgaagcaaacacagccatcactctagaagaggacttttgggaaggggaaataggtgaatgtgtccaaggggctagagcagataaggtaattttggtatggtaggaaactgggctgagctttaagagggatggttttgtttttctacaccacgtagaaagttagaatcaggagtcaggtggattccaggaacatggtggagtaggcagaaaacaaggtctccctttctcttcttgtgatgggttttcttcatttccttcctttttcatcctcccatcctctctcctttctcttcttttctcttttctttccacaatgctgccaaagcatctgactactgctgttctattatcttctttcctttatatttattttttttcctcttctttttcttaggctctcagtatctttttcactatccactccaatgtctctctttatattccataaaatgtcactggaatctggatagtatcaaagtaatttatttctgttatctagcttcaacctaacaaataaaaaaattggatattccataatttctgttgtccaaaagatgatttataactagttaaatgcagtttactagctgtatttgtttctcaaattcttttcctttccagttagtgaccctaagtagataatggcattcttggacataaccaattacattctgtgcatcaatattcaatgtcatgggaattacacgaatgctggatgttgaaattagcattagggggaaaattagctgaagtatcatacttgctttattaatactataaattatcttggccaagataccaagaaaggataatagccatttcaacctggcagatatatccaactgaactctaatgtgaaagaagtcacagaaaagcttgattaaaaaaagaaatattgttaaagcatgacaagtaaagctttaaagtatgtgcaaatgtaaaactgttatttaacattttattaatataaacagaaacactcataatcgtgggataaatgtatatataatttgaggagaatgcataattccaatgaaacatacacatacatatgagaattatatatgtgtgtctatgtgtatatatatccccaaaaagtgttagatattgtttgtgcagaaaaacatgcatagtgtcatagattgttataataattggagacattaataatcatctcaagtttaatatactttttatgataaagaaaccaacctgttcagagagatgaagaataaaagataaagaataaaataatttccattcttaaaggggcacctgtgtgtaactagatgaacttggtatagctttgccttagtgctcccagggagaatgaaaggctcttccccaggatgagcaaccctcaaatgctgccaaggcccttggtctgcctgcaatggatgttgatggccagtgatggccactagagctcagtttatttgattaagcacatgcactgcctggtagcaaacaacaacaaaacaaataaacataaaacctgggggaggaggaataggaagccctgccaatgtctgagtaaatagtgaacatttttatgagaatcggcatgtaaaggtgttactcagagacaggacaggtgctagggatgggcaatgaattcacgcaatactccatgagtgtgtacttacaggtgagggacatgtatgtctttgggtgtgttactcttagggaagattagaaagactctgaaggatgataggtaccatactgataaaacagagcagttgtatttctataccctaaacttgagcaacgaagagaggaataaatttcaagaggaaaataacattgttccaccttgttttgctagaattatagatcctgcaagaagatgaacagttcatggaagcatgaggtgggttgctcggatgcttttatgcctgggtgctcttggaaagctaaggacagacggaaacacaactcaggacacatcaataagagaagcctgctggcacagaggagggcaggtgaaaccacctttgtagaagaggctcatttgaaaatgctcctgaaagatatgatatcagaacactatcttatgtagagtggataagactttgatgatcttgaaaatgcttactgaggaatacatagcatttatctttctttccttgattaaagaactttcatatatacatatttatcctgtatggataggtaggagaggtgatgccagcccacagagatgaccagtccctattccagaagttctgagttgttgcttaagtgaagaagtatgctggtctgctttcaaacttctgtaaacttcagcttagtggtagaacagttagaaaatccaaatatttagtttcaatgcctgagtagtccatttactgattttcaccaactctgttaccatcaccttggtctaacgttatcaccgtctcccccagataccattgcagcaatgcttgttgtgtgattgtccacagttgaaatagtaactttagaataaccggcagaagtgagggagggtgacccttacaaactgttgattctcgggcctcccattagacccactgaactaaaatatctagatggtgatccaaggaatctgtacttttcttggctttccaggtgattcgcgtgagccctaatatttgcaaaacatggtaaccttgaattttcctggtttatttttaaaatcaacatgaaaaaggattatatttctctccacttatacaatctggttaacagattcagatgagatgctaatttcaggagaacactggcacttacgaccgcgaagatgcctgcacctagaacatggaagcactgatggcaccaggaggaaaataatattctcataaatgccagcctgtgataaaataccaataaggaatctctatgcattttatgtaagattaccttatcattcagaaaaatcaatcatactaaaaccagaattgtaaaccccataattaacttgaaggattcaagagaaatcatgtaatctgacagatgagggggcagactaggagagattaggaagttttaacacaggtattggttgtcagatccaggacccaggtgttctgaataaagcccagagatttactcattgtatcatcagtctcttttacgtccttctttttcttctccatctttcttatgccagaaacacattctcacttcaactatcctttatccctgccctgatgatgaatgacattttcctttcattaccagtttttccttattgtttacaatttacattccaaaccttagctttctacggaagattttcttagtctttcaaagtcacaggcttggaaaacaaacaagcaaacaaaaaacttgactgcttctctcagcactagaaatagtgataagtggttaaagtacatttttgttcataaacatcattttaaactgtctaattttttggcagaattattactctgacagtttctattctgcgtccttgtagcccacactgtaccttcaatcaaatggcttgtatccgacattaaatctcttgtagcacaatatcaagtaccatattgcaatcattaggaccacaaaagaaataactatcatcatattgaagaaaagatcccccagagaacaggtgcctttagcattggaaatgggaacttacatctcagtcaagtaccttttatctgtctccagaaggtggaattatctgacacattaagtatcttatttggatagcaaaggagtatgaaagttacttcctgaaataaaaatagaggaagatacacctcaagtcaaatcaccgttgtgatattcgtttaccagaattcaaattagatgacctgagtattttattgactacttctaaacctatggatcttcaaaaaaatcaatttcatattagactctagtttacactgcacaaaaattaaattaactttttaaaaaattaggataaacttagaatggatgacttcatttgtctgatttaaatctccattaacttctttctttaaatctgagcttgactggagctgtcattttttcaaaaatttactcatcttagttcaaaacttcttagttgggttaacaacgtttgtcatggcttttaaaacttaaagcttaaatgttaaatgtaataaatataaaaaaaattaatacccataatataatatcaaactttttcttgacaaattttctattattttaattttaactcaaaaatctttaaaggaaacagattatgtttgaaattatacttctcaataattgcactgaaatacagtttatttcctaggtaacaattccctaaaagtttttcattacatcataatgtgtttataacttcttgttagaaaaggtgtcagaccatattatgaaaaaatgtctggcacataaaagcagtgataataaaacagttaaaaatgtaagctaatgagtcatactaactatgctccaatcttatcttttctatctaccacctgagtgactttgggcagattcttaaactctctgtatatcagtgtccttattttaataatatttgcttataaaaggttattgggataattaaatgagctaatacaggtaaagtgcttagaacagtgctagacagagtggattgtacaaatatcatcactattgttattgtatagatatagctattattttataggataataattgctatattgtgctctatattactattttagtaggctctcagtaacaaattatggaataaatacttgcagataattatttgtactgaaatatttgaagttcaaatttttttacattgaaataaacagagcagtttaattaggaggtactgatatagattcataatcgcttttggtttttatccaagtcctctttccaaagatggctaagacatacagtggcctggcctaggcacaggagatcccttagggtaggggctgagtgaactgtgtctcttaccagactttgggttcagaacaaagagtcaaggatgggaagaggagaacaccaacatctgtaagtcagagaataaagccaccaaaggggaggcctggaagccaagcaactggagaatcagaaggaagaagggagaggagagaacaacgtacccagtaacaagccttaaattgttcccgggactcaccctgggcaaatgctattgcacgcagtgaccctcatgagatctgatttctgcatgcggaaaccatatttaaaatgcaggggactggacttggcagttaacacatttcttgtttctattcctactgcttagcctgcaccaagcataatcaatacttttattttaggctaagacacatactcaaaatgatataccctacctttaaaaaagaatggcatacatttacaaccacatgacaaaaaataaataaataaaaagcaactctctcagcagcacaaagataaaacaaatatttcaatttccctgtcatcaacatatgtatcagagtacagcaatgtgatacaattactaacagaaagatagaactagaagctacagtagacactgcatctaatgatgtttaggcccctaaaatattacttgggaagaagataaagaaacaaaaataacagagcaagttccaaatcaaaaagattgagctgtatctgaaaataaagcatctctagaaagtaatccttttcgtatttaattttttctaaagggagcatagggaattctagcttgatcctgctggcaacatgctgcatattcgtcttgtgcgagagaacacaatttgcataatgtgggacccagttctctgtgtgggaacacccttcagggaactcagaataagaagagccagcacttttgagctcagcatgaagggaatccacagcgcagacttcatttccctgtgacaggatttcccaaattgactgaagaaaatagattacattttctgggaggccccctggagaatgtttctgtttaagacacacacacacacacacacacacacacacacacacacacacacacgcgcacacacacaatatgtgtatatttatctatagttttgttggtggtgatatttaacaatgacagagtttcaacgaatttacatgaggatgacatgtaagagcatattttaatgcatttaagactttatcaatttttgctcaagggataatagaaaaaagcacctttaagtctttactgcttaaacctgtggcagaaataaattctaactacattatatgcatgaatacagcatatctgagtgcaaatcggttgtaaatagaaaatatttcagaagaggtcatatggctagaaaagtgctcagcttccaataaatattaccacaaaacacagaggcttgcaagaaatacacatttcaatattataagtagttattttttcagtaaaatatccacacaatttgaattcttactttagaaaatactctccttttacttttctctttttttagaattcatattgtttcttttaaaaacattataagaaactctctaagataagtgcatttctaactagaaatacaaaagattagattcacgtgtatactaggttattttttaaaatatggcaaaagcactatttaagacatagtattacacttcctttagataaactcatattactaaacactggtgaataataaacagcttctaagcattctcgcaaagatcaaatactaaggcaaaaactggcagaaacaacagacatagaactttctttttgttgttgctgccattgttattttacatgcattgaacgaatggccgagatctttggcgtcttacttactgatgggtagaggtaaccttctccattcatggctatatacaaccctgttttcactccctggatggcaacaacacgtagtcccactggtatgaggttgaagagtgctgtgaagataaacattgtctatcatgaatgggcaggaagaagcagggcagagtgtaattttttctttctgatttattttatttaagaaacatcatctttgccaatactttctagaaattccaattaaataacttatattttgctttataagtaagaagtttctgctatgggtaaaatgagtacttcagcttcaacctttaaatgtgagcagtcttgctgacagcattctgaagggctgatgcgacaataaacagaaccaagcctgtaatcgtgcctctagaaacactgtctctgacaccattagataccaaaagaaatcaactgtgaagtctctcaaagagcagaattttaaaagtccaagtcgagtgtttattctgacccttcgcacagaaggtgtgatttgtcattgcaatgaggtcaggccagaagttaaacaggtgattccaaaactaaatgacggtggtagaaccaatatgatacgccagcgaagccaggaaaagatgtgcacctgccaaggagctaaatttagaaagaactaatcaaaactgaatggcatgcaaatgtcagagaggctactcatttatgtttccatgttttgtttcttctctgttgataaaatgttaaaagcattttatatatttttgcatagtgcagatagcaacgttataacattaaaaaaacttaacatccctttaatgtatttccatggcagtgctgcatgttgaatgtttagtaggttttcttgcatcagtcttagagataactgcttgatgattttggagattttattatagatacatttgtaagagaactattaattatttacagtgaggttatctgctgctactcaagtccttcttaactaagtctaattctaagcaggacagaacaggaaatgaaagcactaaaatagtgatgtaagtgtaagtacagtatccaaactcaggctctcaactgtattgcacaaaaccaagtcatttgaaaaatgtgggcaatttggacttcattccaagggtctaagtagtacataattaaaaacaaactttacaaattgtgttatatttaattctcagggacatgtttcctcctaataggttgaagaaaattacaccctctcttctgattattacaagctactgttttcaagatcccaagatgtctgtgctacacaaatataaaaggaaaacctcaggccagagccatgaatattatccctggaaaaatactcaggggcatctatggttagttggatattagtttcactacgtaaactaatatcagattttctgctataggattttaggggattatgttattcttatgaaagaattagttttttttcctcatttccattatttaatattaaatatagatgtggagttgttgagtacagctacctgtgccatttggcgactctcagtattccttcttggtgggagatggctatattcactcttgtttagaacacctgaactgtaccatctccccttacatcttgaaagaatgggcaccatagaataattcctgatttatacacaaaattttggagggaaaaccataatcatatgactgtccacgcaaggtacactaacttaatcaattcaaatttaattattctaactttcctcttctaactttcacacactcagaatgatatttgtaggtgccacatattttatataggccaggtagtataattttagaaaacaaatagatcatgaattcaccaaaatgatgtggttatgggaaacataaaaattatataagatagtttaaaatgatcatactgaaaaaatactagtgtttttcccttgtgttttggttgggacctgaattataaaatacaaggtattggccgggcgtggtgttatcccagcacttcgggaagccgaggcgggtggatcacctgaggtcaggagttcgagaccagcctgaccaacatggtgaaacctcgtctctactaaaaatacaaaattagccaggcgtggtggggcatgcctgtaatcccagctactcaggaggctgaggcaggagaattgcttgaacctgggaggtgaaggttgcagtgagcctagatcacgccactgcactttagcctgggcaatgagcgaaactccatctcaaaaataaataaataaataaataaatacatacatacatacatacatacatacataaaacaaggtattataatttacagaatgatagtggaaagtgaatgcttatgtacactaaaatgtggagaaccattcagagctggccatgatggaaccggtactagttaaaaacacagatacccacattaattgagatataattttatttctccactctctttgcttcttacataattataaggcaatgtcacaaagcctaggggagtaagaataatggagatgtttttgtgactttgttcattcatggaacattctagttcttcatataacagtgattttcaactctggccgcacgttaaaactagctgtgttcataacatagaatggccaggctcaaccccatacctattaaatcacaatctttgggaacgggtttaggacataaggaatttttttgaaaagctcctcaaataaccctaatatacaactaaggacggtgagaactgccgtcctaaatcctgtggggtggtggccactgagtgatcgaaatattttacacatcaagttaccaggttgagcatttctaaggtgagagggacttttgaggttttaacattaccatagttaatagtgtattgatatctgtagagtcctattctgcttgtagtagctattgtctgtcagtaggaacaatgaagtttaagagcacagaaaaaatccatggcatccccaaaagcaaagtggggggaaagaaaactcacccactaataaagtaccgtagttcatggggatgctgacatttagaagaactttaaatgagagtggtaatgaggttacctaggtgctcacttccttttgtgaaagatctttccattattatggtagtcaataataaagcagttgacttgctacagtattttctccaccagaaccatttacccatcatccacaatttttgtgctacttttccttcccagagatctacatatattagactggaaacccttggagaacaggggcaccaacgtttgcctaccagtgggcctttttcccctcttcttaattcatctgaaatttttaacaaaggcagtttagcaggatggttctgtctttttttcattctaaatatccatatttagtgtgggaaatgtattgaactcaattcatgaagatacgaaagttcaagccctcaattttgttatttagtgactttaacagtgctatctgggtgagtttttggtttttttaaaattatttttgctagttatggataactaacccatggtttgtattcagggagtcataaaaaatggaaacatgtttatgaatgattattcataatgtttatgttcagtatgtttatgaatgattattcataaacatgtttccattttttataactccctgaatacaaaccatgggttggttattcataactaggaaactatatgattattacatcacctctgtcctcacaacaaaagagctgtactctaagtaggacctgacagcctttctaaagcacattcctatttttaaagaatttttcagtgcttacatttttcataagattcatgagactattgaaatgaactagagaaaagaaaatgtctttaaattcatcctaagaaacaccgttttgcaatttgcataggccagaggacataaaaatgaagttaattagtaatttccattacttttataaatctgctacgattctgccaattgtattaaattttatagtcatataatttgtagaaccttttgaggagggaatattgattttacccactgtttttctttatttctttgcaaatgttgaaatagtaacaaaactaaactaactggcttacagtgcacttgaaatgcaatataatgtctcagaaaagctgtggaccagaactttgcacaggaatttgagcccctcgagtgtgggcattatgattttcttctgatttgcttttacaaaggggatcctgtttcatctttcttctcaggactgtgtctcactagcatttagagtgtcagaagaaatttcaagattcgttctgagtttttgctccttctactgcagatacagaagaaaaaaaaaaaacatatatttacagaacagaaggtggagtgttttttagtatctcagctttccagtttagtctttaaaattattcagataaccagacctgtatgtgtgcacataataaatctgcacttccatatttagaaagtgcttattcaattctgaagcagtatgcttttaaaaggcaatgtctaatagacacttctcaaaataatattgattcctatcattaaaggtaaccaattttgttggctctgcaaaaattacacaaagaaaaaatgctagagaaaaaacacataaaacctttgtttgagtgaaattatttttcacgtagtccaataaagcaatatatttatgaagctatggtgtatgtcctgtcttgaaaacttttgtcataaaatggatggcatcagtctttagcctgatgaatctttcagagtgtcatagctcacctagtgatcagagttatgggaaactagttattacgttctaatcctcccaggccaaacaaaatgagagaacactgaagacatcagaaattatgaatcgctaaactttgtgacctacacaacagtaacacgtaagagaaaggaaatggtttttgtcaacaaatgggtaaagagtttaaggggaaaagaaactgagcagagatacatgtattagcctgaaccataagaaactgacatcttttgttggtcaaagattgtcaactaccaataatctttgaaagttcaaactaataacaaaagctgcaaaagtacatgtttggcataaaacgcctcctctttcttctgtagctgaattgttttaccttctcttttcctatatcaaaaaggaaataaactaaaaataaaccaataaacaaacataaaaaggaaaaatttaaaaataaaaaagagtgatatgagacacaaagagagtaaagagattagaaattgacacggaggacaatgtagatatacacaacaattaaaaaggaattgaagaaaaaataaaaagtgaagcaatgcacaaaatacaaaaagtgaacacgatggctggaaaaataatgatatttcacatggcaaaacgacatgtaaaaataacctattttgtatcgctaactactgccagaatcagtgttactggcaatttgatcactggaatttaaaaaaggaagtgctgaattttaaattgagctgataaaaataaataaaataaaaataaaaaaggaagtgccttctgatttgattatgtgtattattcaaaccctcacttcttttcatggaatgatgtttatatgtgaagaataagacatacattaatgaaaaaattcatatctatttttgatccaccgataatgtttcttatgattaagtatttctaataaaaatagttttgcttttcactaactcccccaaacagtaaaaagtgtgcttattttggaactaatatgctaaattaaaaatgaatcagatgccaatataaacagaaaatgggagagcaaaacacagacagttgagtaaggagaggcaccagacggagaaatgttatacataaagaaataggaaaaagaacacagacatttatacagtggaagatgtgtagctttttaattaaaaatgatcacagatgcaattctgcaaacactttgcacaatgaatttcaaagtacacaacctttatgtttttttctataagaaagttttttttgttaaatgcaaagaattttaaattatatttctattatgtaaaaaaacaaaacaaaactattccttgtagcttttgagtttccacaggcatcgttaagaacctcagagcctgataaaataatacatccaaagaaaacatgtaattaatttttacctaaatacactagtgtacttacttaacttttacaataataagattaaaagtaacagtaattttctgggtatgataactgtctgaataaaaaacaaaaatagtaacataatcatctttaaaccataggtttctttggttactccattaatattttcatccacgtagtttaaataaaattgtaaatggcatcctagtgtgtaacatttgtaaagatgaaccaacacgaccaaacatttgcaaatgaatcttaaaaagtcatttaagtagcagtgtatcttctaccaactatgtaactggtggcctgaggttgtcacttactagaattagtgctgtcatccttggttccatcgagagctccatcggggtgcatttgcaagtagtagccttgcctgcaatataacctggtcactatacccttgagctggggatctgaaaggcaaacatagttatcataagcctcacaatgtgtcaccatagtttcctttatcttttctgtttctctttcttttttcagaagaggacattttatacaagtagcatattttattttgtctctcagattcttctgtgttttatcaaacctgcagtattctatttatagaaggtaaaggaaatgcagtagtaagccacagaaacaggctgttttataaaactggtatatgcatatttaaattattaattaaaactattaaactaattaagctgtcagtttaattattagtttaaactataaacgaattattataaacaatattatcattcatgatggcaggacaagaattttgcaaactggtgactctcagaaattttattaaaaggttttttaatggagttctccttttacttaagttgacaagtattcccaaaattaaaaacaaacaaaacaaaaaatacctatattttaaaaacattcatactaacatatgatacatattcttaggaaaagccccaatttggagaaaacccctggatgtgtgaagggtcattgttacttccatggaagtatctgtgctgcttagacatattcacaggaaaacggaaaactctacttgtgagctcaggggaaacacagcaaacccacgcatatgaggtcagctctgaggcaatcaaatagagaaattagacaaattaaactgctaaactcattaacttgtataactaaaaaggacagtcaagttatacaatatgaaatctgattctttgtcaacgggcattgagatagagggcagtggaagtttatttaaacaaaaagggaaatcatgtggtaatagatcctcatttgatgattcattgaaaagacatccactctagtaatccagtgcttcacaaagagtcagttgtacctttgaaaacaaatatttgcatgtggttttgcaaaagccatccccatctcagggatagattggatgtgggacatcataatcttcaccatggcaactggcatctctccacaacagctgaatgggccatgctaatgcaatccgctgtcgaaacagtcggacgttactgagtaatgaaacctagcaccttataatcaatagaaaaattgtggtcttgcaaataggtgaagacaaaaaaatttttttgagagctatccttaagctctttattagtcctgaagaaattacaaagaatttcagtatctatttctatgcacatcatttaaaactgatcatttgagacgtgactccattgtacctagacttgcttcatagatggtataatattggaaaaatccttttggaaaataatgcacgaacagcagatcatcacaacatcagtgtgactagctgtattagaatatgaaagcttttaaaagagtaggattttaaaaataaatatctaagtgattattgcattgcgttacatatgttccttattctgtagtatataacttcccaaatcacataattctaagatatgcactagtggaaaaaaaatactattgtgcctaagtctgcccatcacctggaagacctgactgggctaagtactaaagacttcttccttagttttgctgtattttatttatgctcttcactgaaaatatgtagcatggaaaagaagcgaataaaagcaaaaagagttaaaaacatgaaaaagagaattttttattattctcttgtcaagaaaaaaaatgagaatattagtgatttacaatttttctgtaaaacttttatgttctgacatcacttattcctaagcagtctcctatttgagctactctgtcttctggagttgaattaactagatcaggcgaggcagtgagaagccacctacccacccactcacacgcgccctcatgcttatacagagagatttgggattatgcctcattttgggtgagggagcacaaataaaatgtaaaattatgtttttctcctttaacttcgagaaaatacaaccaaattgattttgattcatctggttacatattgtttgacgtttttcctttttagaaatcataacgccattgattctattcttctcaggtgccaggcattattagaagcacattctattattaactcttggatcctcaccattaccttacttaatagaagcccacttggaggatgaagaaatcgagacacagagcaattaagtagtaataatatgacaaagggtacataaccagtaagttaacagctggaatctgatcactcagctctggaccctgcccacttaactgctacctaatgcagcctgtacaagcggaataattgaactaaaatgtcttcaacactaaaaataaaatgcaaatcaaatctctttaaaaaaccaaaaccaacttgtattttgaagattaactgccactgtgtctaaacccaaatcctgctagccagagctgaatttgtgattacaaagcagtaacgcaaaggttagaaaggatcaaagatcttgaaaaacctcttctcagatccatctcacttttccattggccacatttccaatacatctctgccccattaaaaccttaccaaaattgctagttcagtactataagtttaaaacaaatgggttgctcaattccttttgatgcatcttccgcatctctcgctctttttctttttttctattttcactgccagcccctcattacctctcttaggtggtcttcccacctgcagttttccttttcaaatccttcatgtctggaaatatgcagtgactcttcaccatccactgagttacgtatgcaccttaccgcagtaaggccctatcttatctgatggctctgctcactatagcccttatccatcccctgcaagtagcctcacctgggtcactgtgggttacctataaatattccataatttcccacatctatcctgttcccttaaccttatctgtctcaaatatggccacctgcattaaaatgcccctttgcacatctgtgtaggcatgcacccacatgcacacacctttgcagagctgcctccttttcctcctccccactctggttctatcaacacgtccatttcctcaagagcactttcctgaaacttcagatgacatcaaattcttcctttggacaattttatggtaattttatggtatcataggtgaatgtgtagcaatttatgtgttcctggttaagtagatttataagttatattatctagtttacctaaagttagaatagtttagggggaaaaatcccatagagagaataaggattagaggtgatacgaataaaataagctaaaataaacacaaaacaaataacaaagatgagatttttcttttacatggattttgtggttaaaaacaagtatagaaactagtaacaaaaacaaatgatgatctattgaaatctaacatgaaattagccaaaagagtttgaaaatgtaaagacaatctgaaatatagttactaggataaaaaatgaaacttcatcctaaatgcacataccttcagatataaaagtgtggaaatattacatgtgtaagacaaacatgtattaatgtaatatgtaaaaatacatgtaatatgtaaaaaaatgctcatttttttcaataaactgatagaataagaaggcttgcatgatatttttctagtaaacgttaaatataaggcctacaagtatttttgttttaaatactgatgtatcccaaagtcttacaatacagattcccaatgaataattgaaaaataaatatctaaagtcctacacctatattttagctagccatgcaaaaatgcaaaatactttttaactcataaaattattagttctttattctcttctgaaacattcgtgttcagaatacctactctgcttaagaaaatataaaaacttagaatctcttctttgcctgtcttaattccccttttcctccagttttgtcttttattttctatttagtgtgcctgataattttactaaaaacgttttgaagatactccttgcacaaaactctgtgctaacaatgatctgtgatattaaaatagaaataatgaaaactaatgtgcatacatatcaagaaaaaaagatgtttcataatatattaccctcaacactcagaactgaaagaaatgcaaatcagtccgactgccttcagattcaggggaaaaatacacaacatttttaattaaaacactcattctcttagaaatgagttcaattaaattaaacaccgtcataaatggttttcatgcaatgggaagactggcgaaagaagaatcaggataaccaatcaaatggtgtacttattttaaattatgatttaaatggaaaaatgtacactatgacatatgtttttctgtagcaaatacattaatgtatatacatcatacgaactatgtttatatacacataaatctcagtactaattggttatcagtataggttcttaaacgtaagttctcttctattagctatggaaaaaatcacacatttttatagggtaaaaacaacttttgtaatgtacatttttgcagaaaaaaatgtggcagatctaattagattttggcactcccagtagcagaaaatagtatttgaataatttgcttaaagatatatattatcatataatccaaccacaaaaataaactgtgtccaggaacttttccaaaggactgagaaaataaaggtgggatagggacactaaggaaaatgatagataaaattaaaggcatgggaaaatttgctatctttgtttatcccttaagattacattgaatttcctttatggattgacccaatgctacctcgagaaccccttccctctaggaacctggttccagttacttcagagtgattacccaactcacggtcccattccaatgtactattatgtgtgttaaattttaacacttcttccacaggctagaatagctctccaccacttctctgcctatcagaatcctatgtctgcaggcactagagatagcatctggcattaacaacaaacaggccaggcacagtggctcacgcctgtaatcccagcactttgggaggctgaggtgggcagatcacctgagttcaggagttcgagaccagcctgaccaacatggagaaaccccatctctactaaaaatacaaaattagccgggcatggtggcacacgcttgtaatcccagctattctggaggctgaggcatgagaatcgcttgaacccgggaggcagagattgtggtgagctgagcgcaccattgcactctagcctgggcaacaagagcaaaactccatctcaaaaacaaactaacaacaacaaaaataaacaaatgaaaaacccaaacagctcttgccctcaaagagtttgctgtttattgaggagaggaaagaaactataatatggctttatatcaatcagccatgtgttaaattagcgggtttgcatgtctttctgctctgcaaataaatgataaatcccttgataatttgcatattactcaaaataacctaccacggtgcttgccacagaacagatgctcaaatagtatttattgaaccgaattcactttctgttttgtttttaaagtggctatatatctataaatggtttttgaggcaaaatgaattttttatattgtatttaagagttggagaaaagcatgcttgagctaaagataaatgtgggttttgaaacggaaacacaaataattttaagctttttaactactgtagctaaaacatttcctctaggtaaagtatattaagagaatgactatgggcaaagactttttctaggggaaaatgtttgaagagatcattaaagggaagggagactgtaagaatcctgcttaatacttgacccttatctccaaggaacagacttaacaggagtatcttgggattcctagcccagggttgaactctcactagctttttgaatatccagtgtatataaactacagaaggaaggaaatctttggaactcagaaaagcactctttccaacactattttctaatgaaattttctcattgcaaagttctaacatattagaaacacattggagctctcatggcccacacaatccagaaatggacaataaaatggccaaaatatcaaatctattgtcccaccttatttattcatcacatacaaagatgaataattgtatgataaaacatcgtgtgctttggcctactaatttattatttttaagttgtaattacatattttccaaattaaatcctaaatatcaattatgtaattgcaaaatacaatcagcaaaattcttgtgcatatttaagtaagaaaagaaagaaaagcacgtatcttttggtgataacatttgggatccaagtcaatccatcacttacaatcacatctagaaaaagctttcctgattctatattgtgccaggaattcctgatttgtgaatgatttcatttgctccttcccagaacacaagcgcaccagcaaagaagctgtatgctctgtctgaggtgctggtgtgtcgctcaagtgccggctgtggcactgacagatgtgggtgtgttactcatcttcagactccttgttaatatgtcaatgacaccaaacactaaaagacacttatggtactttcaggaacttttatgtatccttctattaacataaacattagtaaggactacactgccagctgagagagtacatatgtcccagattatgaagcaaagaggattttatgtaagttcttaaatgctattgtcatctaaagagggaaatatgagataattcagtttaattgttatctaaatactattctttttttaactgtagatacagtattatgttaaatttaatacacagatttaacatattcagctaaaacactacgcagaatgattcacttctcctttcggaaactagaaataggattccctaaatttaaagaatctgaagaaaaactgctgcttgattcattcacagaattttccacagccagttaaacctatagcagaccgtattaatttgttcttcagctgccattacattgtctgaaatacagaattagcatgacaaaaagtagatgttaaagaaccaaagacatctgtcgaaaaaaaaatgcatttttatgtaacaaaattcagaatcaaaagcctttcagggaaagttatattgcatcaggatattgcattaaccatgaaaacaagaattacaccagatgtgcagttttatctatttcttcagataaatagtagagcagtaaactgggaactttgtctgaaaaaaatatattttctgttttttttttttatacatttgctttagagccaggaagcatttctttaaatgttttatgttaaaaaaataagcagtgggtgaatttaagaaaataactgcacatggcaaggactgatctattcatcctccagagttgaggctcatatatttaagaagtaacattttggagcaagaatatcactcatcttgtctgttcatatctagaactatttagagacctccacctaatgggtagatagttggaaatgatagtgataaacactttaaagctacttccatttaaagaaaggtacaaacatctgagctctgttcccttctgagtttcttttccagacatttgtcttctagctgcttctgggaggagatgggagtgataaaattttttttttattaataatcctctctacagaatctcccaaacagcaagggaaggagaagaaaagaggcggcattcagagatacgatacctatgaatccaagtagacatctacacttttaaccagacaggaaaaacatttaaaccagatgttatgtacagaaagaaagaaaagaatactcctggaaatcagtgtgaaaatttcatgaaggatactgtagcatttgctcttgaattcagttgcaaccagttatatgcatctctaaaacccaaagtttctccttattttatcaccaggaagtgatgcctcttgaccatttttatttattaaggcttaaaattttagaaaggcagttcataacatcacccttaatcaatcttacagacacatctatctctagaattctgcaacacagccacagaaatacaacattttacattggaaaacaggaggagaaatcctttctatgttttgtttaagcatgttttcaaatgccaagatatttaacttgctcctttaggaggcatttactgtgaatctactttgttccaagcgttttgttaggagctgagaggaatttacaaccaaagcagattgctgtcaattgtccacatcatcattaaaccaatagcatgatgtgagtcctaaaacaatgaggctgtataaacagaaaggtaatatccagcgctaatgataacaatagtaagaataatagctatcatttcctgagcatacactttgggccagaaacgactctaagtgctcttcttaaaaatactaactcatttaatatgcatagcgactttttgagctaggtagcattattatcctcactttaaagataagaaaatgaggccaggtatggtggctcacacctgtaatcccagcactttgggaggcagaggctggcggatcacctgaggtcaggagttcaacaccagcttggcctacatggtgaaactccatctctactataaatgcaaaaattagccgggtgtggtggcatgtgcctgtaatcccagctactctggaggctgaagcaggagaatcaattgaacctgggaggcggaggttgcagtgagcccagatcgcaccactgcactccagcctgggcaacagagtaagactccatctcaaaaaaaaaaaaaaaaaaaaaaaaagacaaggaaatggaggcagagagtcactatatgatgtgtgcaagagcaacacaaaaaggaaatgatggcgtgaatgtgaaagcctctgtgatctggcctctcacgctgcccaggtaccactcagctgtgctctaggtggacatcccagtgttctcagaccacccctgatacaaacacacagtgaaggggcactgacagatgagaggagagtgacagacagggtgggcctggggaaaaccgtgtaagaaaatgtttaatctgaagatgatgacatgtcattttcaacaatttgtggggctgtcacaaaaacagggaatggaatgatttagttttgcctcagaagacagaattaggacaaataagtagagtgacaccaagatggaacataaataagggcagtggttgctgtccctttggtcactgctagattccaggtgcctagaacagagcctgtcatatagtaggtgctcaataaatacatcattaatatatgaataaatacatccaaaaggacaatgaaatgtccaatactcctagctatcctgtgtaagaatcaactctcccacaaagtaatgcattccctgtcgctgaaagtgttcaagcagttggatggtcatttgctacaggaactgggaagggaattgctgctttgaaaaaaatcttgagaaaaaaagcataccttatttaaacggtggaaatgtattatcatttaaaaagcactagtttaggatccctgtctccctgcctaatcttgaccaaacacacacacagacacatacatacacacacacacacacacacacacagagtaaagtatggcaaacgctgcccctttcttcttaggggcttgactatgaataattagtaagtgaggaagggtggacatgagtgaaggaatggagaggagaaaaggaaacagtttcttataaaattgttaaaagaaaacagacagaccttgcttattagagcaaaagtttaaaaacatggaaacctattgcagtcaaaagtttgagaatgttttgatacttcataaagcaaactgtgagatgtggagttgcacgcagtccagggctattttagaggtagtttgagctggaagaacatttgcactagagcatggattcaactttcttttcatattttttgcatttcagttgttttctttcaattttaatttgactctatttcacaaatatagttacatagtcatagtgtcctaatttaacaagcaatcccactgtgtggacatgttttcagggtggagggtgggagggaggaagagaaagaggcgaggtgattcagaaacagatcctctttccactttcccccgactctcccaaatgtacatttaagtccttcactttaattggatttatggtttgtagctttggcatcagagccatacttttaatttctaaaaaaagaaaatgctgggaaaggcactactcagcgcacattttggcacactcctttcgaatggcataggtagccactgaattccttatccctaggggttctatatttttacattcatgcttcttgctcagtacatgaagtttccctttacccaaaagcctttttttgtgtgtgtaactgatgtggcacaggcctctgaaaaaaaaaaaaaaaactgcagggtcctggagaaccataggccagagaaacctggagctgcaaagaaggacaagatctggaaggtttgcagctagccctcaatgaaccaggtttcaagtgaatgccatgaggaaactgaaagtcaaaactttaaaataccacactcaggaacaccacctaactatcatattcccatgcctgtttttggtttcctttaattttatagtacagctttgcaggggatagaaaacctaatatttcaaaccagttttaaaatttcaggttaatgcttcaggacatgtttgtgaaaaccaaacaaaaactcctcctttaatttcagctctatgaaaagacagtgttaagatccaaatctactaggaagtttaaggtattttcttccttaaaacatttacagctttatgtggccatcaggttggattatatggaaaacagctcagcatcaaaaaacactttatagtaatttatatgatgtcactggccaaggaagatgatcatcctttagaagtaactataaaaatgcttgctatgaagaacaagctagaggcatcacactgcctgacttcaaaatatactacaaagccatagtaactaacactgcatgatactggcataaaaacagacacatagaccaatggaacagaatagagagcccagaaatgaatccacacatttttgttcacaaactcatttttgacaaaggcaccaagaaaacacttggggaaaaggacactttctttaataagcagtgctaggaagactggatatccatatgcaaaaccatagatccccatctctcactatattaaaaaatcaactgaaaatgtattaaagatttaaatgtaatacgtaagacctgaaactttaaaactaccagaagaaatcattaaagaatttctcaggacattggtctgagcaagaattttggggttaagacctcaaaagtgtaagcaagaaaagcaaatatagataaatgggattatatcaagctgacaaacttttgcacagcagaggaagccaccaacagaatggagacacaacctacagaatgagaaaatatttgccaactatctatctaacaagggattaataaccagaatatataagaaacttgaacaattcaacaacaacaaaataacaaaccccatttaaaaatggacaaagatctgaatagacattcttgaaagaagacatacaaatagccaacagttatatttttaaaatgttcagcatcactaatcaccagaaaaatgcaaatcaaagccacaatgagatactatctcaccccagttgacatggctataatcaaaatgaggaaaataacatatgccggggaggatgcagagaaaggggaaccctcatatgctttttggtgggaaagtaaattagtacagccactatggaaaacagtatggaggtttctcaaaaaataaaaaagggaactatcatatgatccagcaatcccactgctgggtatatgaaaaaaaagtctgtgctctcatgtttgttgtatcactcttcacaattgccagaatatgggggtcaatgtccatcaatggatgaatggacaaagaaaatgtgatgtaaatatatttcatatatatgtgtgtatatatatatatatatacacacacacacacatacacacatgcacatatataatggaatttatataatatacaatgaaatattattcagccatacaaatgagtgaaatcccttcatttgcagcaacatggatggaactggaggaccttatgttaagtgaaataaggcacagaaagacagatatctcatattcttgtgggagctaaaatagttgatctcacggagatagcagaatggtggtttgcaggggctgggaaggagtaggggtaaataatgaagaaaggttgtttaatgggcacaaaaatacagttaaatagaaggaataaggtccagtatttgatagcacattagggtgactatagttagcaataatttattgtacatttcaaaatagtaggaagaaagatttggaatgttccccacacaaagaaatgataaatgtttgaggcaatggatatcctagttaccctgatttgatcattacacattgtagttatgtatctaaatatcacatgccccagaaatatgcacaatctttatgtatcaaaaaattaacaataaaaatgcttgctatagatacaaattgttaacatctggtcattttaatccaggtggttagtggaaagctttggagagaaagtgagatgaaattgagtcagagatggccaagatgtggatgatggaatgaagtacctttttcaggtaaggagatgtcctcctgggaggaagtccaaagtattttttgaagacagatgggtttggaggctttggggataacagtaggtgaggctgatggcagtctgcaggcagctctgggcacgcatgaaactcaagctaaaagtctgcacactgaacatcagagaaatagtaaacatattttctcagctttttctcaagaagtgacccatcggagtcacattttagagaacactgggaactgctggtagcggtaacctattcttcactcaatagatgattggtaaaataaatgttaaaattttaacctgaaaaagtactggactgtatttctaaatttctaattctgaaatgttaagcttttctgtggagaatggtagcattttctgtgtgcatatacatacacataaatatatacatgaatgtgtgtgtgtgtgtaaaatttaaagcttgtgctcaagaattgggaggctttttaaaaaattatgtgactttaggtaattcaatatgattcctactgacatttccacatggggttaatttaaataatttttaatcaagcttactctgttgccttatgatggaggatatataacaagatcattagtagacaatagcaaagctttaaatccctgtcaacatttttctgaaatgtgttcatgcagttaaataaatgagcatctccctgatcaactcaaaggcagacaactgtaaaggaccacatgtcttcaagattaccttctgatatagagcacaacaaaacacttcttcaaagatatagttcttcttacttgtgtctaatggtgtgaaagcatcaaagggagtattattaaatgaattgtgtccccctaaaactcatatgttgaagtcttaaccagaatgaactacatttgcagacagagcccttaaagacataattaagttaaaatgaggtcattaggttgggccttagtccaataggtctggtatccttatggaagaggagattaggacctcagacaactacaggtaaaagaccacaggtagacccagggcgaagacagcatctacaagccaaggagagaggcctcaggagaaatcaagcatgccagtgccttgatcttgaccttgcagctttcagaactgtgagaaacacatttctgttattgaagccaccaagtctatgatactttgttaaggtagccccagcagactaatagaggaattgccatttaaaaaaaataaagttcaactgccacgttcaccgatttagagacaaaaccgccttcacttcagaggactatgtagctaactatgagaaaaatctgagttgtagcacccggctcccaggatagtttttgccttttctcattcactaaagtatttgaagaaaggaatttgatattcactttctgtctcaacatttaagtactatgatatgttttctagatttttaagtttaatggaattgtagagctattttatggccctgattttactcatgtgaaatataaataaatgaaaaaaaataaccagacatatttataaacccacgtctgaagaaatccatccatctccacattgggaaatagactgcaaaccactcatcaagcaaaacgtcaagctgatgttttgtcagataaaagaaagagcaagggaacttcacgatgtactttttaacccagaaacttctaacatacattatttccatctgaaacctaccccatgcaatacatgaagaaaatctgcatctgagaacgtgcatcatctgcttagtattgtctggttaatgagagagagttgattccaacctctacatgtttcaggctctgagagtgctttgcagtgctacttagcctatgctcatgcatttttatcatattcatctttattcaaatgatttcctatgactctacacctgtcaaaacactgccctatatcaaggcttagcttaaatatccccatttatgaaatagtttctaatctctcctgtcaagaaccagtctttgtgttccctaattatgatattgtaccaaaccatctttgctgagttctaaaattcagttcctttaaacaatacaaaagcaaaaacaaaacaaaacaaaacaaaagacatagctcctttagactaaaaagtgtaatagttcagttctgatataatttttaacttatgcgagggcttcagtactagataggaacaactgcttttctgcatatttcagagccttgctgaggaggtttgggtgcttttgtctcatgactttctttctttcttaagcagtccacacctgtagcacacctctaagtttaataagtgaaaagcatttcctgtcttacctgaaaaaaaaaacacattgttcttggaaaacggactaacgctgactgcccaggacttgtaaaaacctttctgtctgctttgctctgcagtgtgccagggagaaccatttggggacctctgttcctctaagtccctccaggaaaatgaaatctatagctcctaaggtcatcccagaaaggcagaactttaaataaaaatcctcagatctcggcaagaacagcagaaaataggttacaacaatatggggtgtatccacaatgctctactctcacacaacctccatgtgggaacaaaatgtttcccagtcaaggaacagaatttacgcttctgtacgttcatggaagcagacaggtcaaggggtcctgtagctgcgcattaccttggtgatgccacacacagcaagatgtccaggcccagagccacgtgtacttctgcctgccttgctcagacatctgcagcactgactccggataagacgggattgggggtggaggaggaaagaacttgaagtaggggcaaaggtggagccagttaccctctcaccagctccctgagttggataaggtgccttacctttcaagagccttttttttttcttattgataagaagacaaggggaataatgtctaccccatcaaggtaggatcaccaagatccagtggatggtggtttcagaactgttatctggcccttagtacaggctaagccgaggttaaaactttttcttcttttgctatttattttcactgtaccttttacaggaaattaagtttgaattcataattcacatcttttgtgaaactggcaaccataatacagagaggtgagtattttgtgtgaggagacccactaccctttgctttgtacctcttcttctataatagcccctgtagtctagttaccttgctccaaatgcctgggccctcacatcacattggccttccctgtctccagttgtgaggaatataacccaattccagatgtgccctctggagatgggccctttgctctcagcgttcagatagtgccatcccagaatactttatagccaccaccttgcaaaaagcaacctaatgcctagtagtaatacaagaatgcatccttctctttctggtcctcatagtctgctctgtatcttcccatatgcagtcaccatgctggttgtaataacaacagtaataagaatgacagccatcatttagccattattcactgtgtcaaacacactactaagaattttataaacattaattgacatcatcctttgaaaaccatgcaaatctattattaatgcactaattttatttatgtaaatacacaaatctatatatgtatttctatatatatacatacatacatatacaaatatacatatgtatacacacacatatataaatatacatataaaattagaaacttaacccaatcagaaatttaacaatgttcacacagttagaaagttgtaaatctaggtttttgatccaagctgctgaatgtagtagtaaataatcacacagttttaatttattccaccaatcacagagagaacttctgatacatgcttcagatggagaatatcagaaatagagaaagaagttgagaggtgagagctctataaataaatacagagaatgagagtgtgcatgttagaggtacgaagatgtgacatagcaaaaaacaagaaaagctatccaattacttggcagacttacaggagaactgataagattaccaatagctaattttcaagatgtctagagtttgcatagcaaggaaaataaaataatagggaattgaacacaacacaatccaaagatgcaaaagaagcatcttttcaattttttttgattatttaaaaatgtgtcccttatctaaactcttaattttcccctaaggaaaagtgccttatattacctaaaaaatttttgttatgaagatttccatgtaggttcccactgtacattctttgaaaagtgttttagaaacaaacaaaaaaataggcctcatccttattgtttaccatttagccacatatattatttgggcatcagaaaggcctagtaaaagctaattaagatcaaaacattcttaacttgataattcttttaacagcagagaggaaatccctgggccttgtaattacatgggccattgaacatgtgaagtaaaaggaattaagcttgttatgactcactaccacgtccccaaaataccccaaacccagtgttatatggctaaagggaaaatgaatttgcagagaacaaggaggtagtttgtcccatattcatcctaaaatctccaggaacaaaatctaacatttgacagtaggctggtctccccatagtgtgctgggaaaacagtggggttcagttgccaattagctatgtggtttaatgtaagtcatagcctcttgaatttctctgaaaggtggacataaccatatctggccaaataacagcacaggatgctgtatgaatctcaaatgttattttagataagaaagtagcatcaccacggaatgaggatggaaaagatggccaagtgtccaaatcttgggaggtctgttaattatacaaaaaatgaattgcatcctaagaatatttgaggtcagtagattaaagcaggcagtggcaagatcatacgtagacaggtgaactatcactctggtcactggatgttgggtatgatgcatgcagttaagatgccatacccatgaccctgcagtagatgccagatcctttctcagaggctggacagtgacaaggacttaattgtgagagtaatgtgggaggcaggatggtaggattttaatagaggcttgttctctgcgtgggctgcctgctattgaaagccagtctctgcatcttttcaaatggctagttcctattcaccctgtcatcacctctctgtccatgattgcctctggcaggtttttcctgctcctgcaccttgagctgcatgaagtcagcctgggttgtaccatcacaatattctgcagccaagtgctgctatggcattaaccatgatgtattgtgattatgtgtccatgtgattgctttgctgtggtggagagaacaatggctccctgaaagcacctacattcttatacctgaagtgtgtgactgtgttacatgacatggcaaaagggcctttgcatacaagattaagttagggactgtggcatggtgagattatcctggattatttgggtgtgtccagtgtaataacagggtccttaaaaggagagtggaaggcagaggtgactattaagtaattatcagaaaaatgcaacattgttgaccttgaagttcaaggaaagtgccacgtgataaggaatgtagatggcctctagaaatggaagaaggcaaagaaatggattcttttctacagcttccaaaaaggatcagagccctactgacaagtcaattttagcctggcgagatccacgtcagaattttagcccacagaactataagataatcagtttatgttctttcaagccattaagtttgtaatgacttattgttacagcagtgagaaaccaatacacctgacaagattcttagcatctcatggggagggtctgtgttttctttgactcccagaggcatcataaggcaggtcctctgtgttagtgaaagtgctttcactaaacacaacagctcaacccaacctttcctggcttttttttttttcacactttttatcttgcagagatatggaaagatatttaagaaagagtgacaataatatcaggcttcttttgcatttggaatagccctttagagttttaaaggtgatttcatataccttaactcatttgagatttaacaactcctgctaagattggattgtatctacattatgattaaaataacttacaaatatacaaatatggaagagaagatagaaaaatgaaaatggttaggtgagagaaaaggtaaagctttaaattcacctttgtgtgattattgtcatgatactttatttagcttgctggtgcttctaattgaagaaacaccacctgtataggccatagacataaaatattagcagtagatagcatctcaggaattatctattagtccaatgaactcccccagtcagggcaactgactgagacttatccttgtcctaagtacaaagaagcagtctcagaaacacaaagtcctgccccacacccagcgctacagctgcgaagttgacaaagaaatttccgctcccattttaacctactatttctgccaagaggctctttatagcatgttatattgcttaacatatacccactgacagatttcattggtaactaatgtagagtgagcattagatgtgaaactgagcttctctagcttcctatcatggtttgggacatataataagattttcctttactgtaagattaaagaaaaaaaggagggaaggtgaggagaaatctacttagtagcaatggtgtcagtaattgaaactgacaaagatattgttgctctttattagtcaccttcaactttgcctttccagcacaatttgcatttgcatcgagaagcatagcatggaaaaagaaaaaaaatattaattctactgtaaccttagacaacaaaataaaatagatgaaaacattttttgccctcatttaagaatcacataaagaatattagttcatccaatatggagacatgtttcaaatcattaaatctggaactcttaaattatttgctgaatatatcctcagtaattcaacttttgaaattctgttaatattaatatccatctctggacttccttaaataaaggtttaagtgtacatccttttcttgtcatgttaatgtgggtatatgcttcagagatcttacctaagtcattaaattcctaatgactgtttgggaaagatcattttacaaggtatattaagtaacatttttaaagaaatcattggattttcaacagtttctgaagtttgataatgtaattttcttacaaatgcctttagtcctttataagtataaagtaaggatgtcaatttcagtatataaatccaggcaaagcataaagaaatactttatgtatttcatctccattcctccagttacttcctacttctgttcattcattcaaagttaattttgcacaataaaaatacttgttcttattctagacatgaatgtaacatgttgtctcacactaagtaaagaatcactcaaaatcttaagacctttaaaaaccaagtgaaagatgattactctcatcagaagggtcactgaagtgcaaacatacctgcccgagagaagtaactttaaaaaggtaaaacgtaagaaaagaatgcatcaatttgcaatgaatcaactttctatactttgcattaggaagttaaaaagggaacatctgttgtttgctatttagagacaaaaatgaaaggagagatttgtgagagttatatggagtgcctagaaatattctataacaaaaatgctccagtgattctcacgtattttttttacgtaagtactttcaatggtagaggaaagtaaatggtcacgtttcctggtgagcctgagggatggagtctcaaagcatctggtaatcaggaatttctttggaatcttgtattctacttgaatatcctaacaattataatctactaaatacctgtttggtttgatatcaagtattttaaattacttaaccataattaaaattgatactgcacaaagatatacctatgggttctcatacccatgtactgcttggttctccaagggtattcatacccatttgcaaagtttgctagctagcagaaacctcccttccctttctttttactattaaggtggggcaatagcagtgcctgaatatttttctcattttgtgttcatatcatcaagtcagtatcaaataaatatcttgcctttttcttgccccaaatcaacgcttcccataccaccaaggacagtttcagatgatggcactcacactaaggtgctgtggcttttgcattgcgtttgcctgaactccatagctccctcttctatgccccccactctgtacatttcacctctcacctaccatcactccctggctattagatcactcctcagcaagcctatgggtcatatccgcagactttgtgttctaatattcagattttctcatagtgtgactccaactccgcaatggagaaaaacataatgagaggcagcaaaaggctccaaaaagaaaacattaatgcttttaacagcggggaatctgagtggaaaggaaatcccttctttcctgtcacttagggatgaaggaagagttgaaaaatataatagatcctttcctacagcctcagataagcaattttttggagggcatatgtgtacctacatgcacgcaggcagacatgtatatctgtgtgtgtgctttatctacaatgatgcaatgctgcatcaacagtaatcaataaaaccaattaggagagttatttctcatcaggctctgacaatgactcaccatgagaccataataggggatttcacagttttgggccttatctatgttttggggtaactttatctataaaataagatgactgaactgataatcattgaaactgcttctaggcaagacataagaaaatatactagagacaaataaggataagaaagatggaagtaagtaacaaataacttctatctttttctcccaattcacatttccaaactgatttatatcattattcctggaaatgaaattagaaacatggtatgctaggatatatattattatgtgtacaggagaagaaaagggttctgatccatagacatgtggaaagatttacctaggtcctgggtttgccccgctcaccatatgtgcctagagtgtgacaactcacaaatgctctcacatgcattatctcattcaagttttacttgtgagttaagcagaatagatagaattataaacttagttgagaaataaggatattaagattagagcagccgagtcacttattcaaaagcacacaggtctaatgtggaagagctctgcaaatagaggtctatttggggtgtggccaaagctggcagcagcatcacaatgaaccacaggcttcagagaagaatactcagatttcttgtcagggctactccagtctttgcagggtgcttatgagtaagaatacacctgttgcccagagttatagcagcctggagtaagagatatgctgtttccaacctctcttgtgaactttaagagctaagtcataattagatcccacacaaatctttattagagactttttcaggtaagctcataggtttttaacattctggaaggtggtttgataatctacaactttgttgctgccaggaaataaacttggaaagtgaaagaataacccaatttttacaacaaaaatactagtagtattagtagcataggttgagcattcctaatttaaaaatctgaaataaaaaatgctccaaaatctgaaacttcttgaacactgacatgatgttcaatggttatgctcaaagtaaatgttcattgaagcctttaggatttttaatttattttattttttattttttggagacagagtcttactctgttgcccaggctggagtgcagtggtgcagtctcggcttactgcaaactctgcctcccgggttcaagtgatcctcccatctcagcctccttagtagctgggaccacaggtgtgtgccaccacgtccagataatgtttgtatttttagtagagacaagttttcatcatgttggccaggctggtattgaactcctgacctcaagtgatccacctgcctcagcctcccaaaatattgggattacaggcatgagccatggcaccttgagttttctatttttagatgagggatcttcaaacagtaagaatagtgcaaatattcaaaaatattttaaaaatctgaaatctgaaacacttttggtcctaagcatttcacacaagagatactcaacctgtataaaggcatgaaacatacaacacacacacacacacacacacacacacacacacatatccccagaaatgagtattgacagaaatacccatctccgtcacagattttattaaaacttagagtggaatatggatttactcagtgggtaatgttctgaaagatcaaatcaaataaaaagctagtcaatatttttcttccaaaaaattcaaagaatttacatacaaatttggtgctgaagacttggtcatgagctttatataagaaaaacatcctctctatttttgtcaagatatttgatagtctttctatatttaagaagtagggacccaaaatggaaataatatttcctaatagccagtttctctaagaattatgacttaaaattttcacttctagttataaccaactatcaagcataagaccaacactcctaccatatgtgaaagctagatatttttaaaaacaagaagagaaaagaaagaaaattggttgatggcactggagagcttccaaggcaaccaggagttaaggggccaacattttggaagaaaggaaaacatatggagatgagcactgtgttgtacattactctttctctcaagaatttgctgcttcaaaagtggaggaaggcaaaaagctgagaatcagagcaaagcttttggcaatccacaatgctaaggagacaaaaattagagttcaaggcttgccaataaagagtagccttggtaaacatccaggttttcagttggagcccctataaactatacgttagccaaaaatcaaactagaaatagacaagctagcacacacatatatgtgaaagccaatttcaaatatatttcatactacagtaaactggaatcttctgccccaactgtaataaaaagaaaaaaaatcctcctcaaagacgataaaatcatagcttctatagttttctttctaaaatgtccaacactcaattaaaactactgaaattgccaaagataccaaagggaacaattaaaaaaataaatacatataggagttaacagacacagattttaaaataactataattaatatatttaagaaaatcaagtaaatgatggagatataaccaaagaactgaattaatcaaatggaagttttaaaactggaaaaaaatataatactggaaaggtaaattcaatggatgagttcaatagcaagagaagaataaataattttaaaatgttttaattgaaaatagccaccctaaagcaaagaacataaaaaatgtataaaatctaaaaaagggagtaaaaacatgtgggacattatgataaagaccaaagaaagctggtgttattatactatagcaaataaaaagtaaacatgaaagtgaaaagcaatatattctgatataaggatatatctaccagtaagatataataatgttatattagcctataaagaatgaaggcaaaaactgacaggtctggaggaaatatagaaaaattcacaatcataatgggagatatttaatgcagtttgcttcagtaactgataaaaatggagaaaagaaagtaaattaaaaaataaaaatttgaactacaaaatcagtagacttaatgtaattgtcatacagagaatattgcacctggctacaaaataaaacatacattttgttttcaatttgctattttatttgttctctgattatggtagatttagtctagaaatttagtaattttttgttataaaaagataaccagacaattgttaaatattttgaaattaaacaagcacttctaaataatcctaagtgaaagaaatcacagaataagaaaatattttactaagtgaaaattaaaatataacagagagctactttttagtgtagctaaagccatgactacaggtaaatttaccattttccatgaatgtttaaattcttcaatggcttaaaatcaacaagcttacaatttatacttgcacaaagttaaaagaacgcaaatttaacctaaaggaattaaaaacaaataataaaattaagaagaaattttaatacaaaaaaattacaataggaaaaatcagctaagccaaaagtcacttctttgaaaaagactaaataaaatttaatacacccaaacgaaactgcatgagataaaagagaaaaggtacaagtcgtcaatctcaaaaaaagggggacttcactacagattttatgaactactagcagagataacatgaatgaacctgcaaatacaatattaggtaaaagaagccagacacaataaagtacatgctgcataacatcattgatatatagttttttcaagtaggcaagactaatatattgtgttagaagtcaagagagtggctgcttttagttttcattgattggaaaagcacatgaggagcgtttcttgggggccgggtagtgctctattcttgatccgcatggtcttcacacaagtgtatttattcactctgtaaaaattaattaagttgtgtatgatttgtggacttcttttaatgtgcatgttatatctcaataatatttattttgaaagtgaaagagcattttgaatgtaaaaactgctatatttatgaaatagaattaaatgacctccatatcatcttcaatatataggttatttaataaatctgcccaagtgctctactctaggaattttgtgtatcttcaactttagtcttgcttgagaaatactgaaaggattttctcatcaaaataaaagaaatgccttttagaggagaaataaaagctaggaatggacagaaagaggattataatttttcccacaggttgggaagaacatttattctgttaggttgtctcctggattttatggtgtttcaaattttatgaaacaagaaaatataaagaaagtctttctgaaaaaaaaaatatggtggaattcctattattgaaatagcaacatttgcgagaaagggatgggagaagatgaactaaagccataattcttgatgtctccctcccacttcccaagtagtgacttccaaatctgatttcttgcaactagccctctgtccatttttcttatttgttatcaaagagaccccaagtgaagagggagtcatatcaaaatggggaattcagatgggatgcggtggctcatgcctgcaatcccagtactttgggaggccggggcgggtgggtcacctgaggtcaggagttcaagaccagcctggacaacatggtgaaactctgtctgtactaaaaatacaaaaatcagctagaggttatggtgtgcacctgtaaccccagctgcacaggaggctgaggtgggagaattacttgaaccccagaagtggaggttgcagtgagccgagatcgcaccactgcactccagcctgggggacagagcaagactctgtctcaaaaaacaaacaaataaacaacccaaaaaacccaactaatcaaacaaacagatacgcgaggagtttgtgcagaagaaatagaaaagtactactactaccatagattatatgacccaggaaaaattacttaacatctgtcagtttccattctttcgtttgaaaaataaagagaatattatctactttaaagggttttttaagctttactgagacataattaacatacaaaaatgcaattcattttgatgagtttggacatattcatatacttgtgataccatcaccacatcaaagtttttgtgaagttcaatgcagataatgatgaagtttgatgagctaagatattggttgctttatttttacttgaaaccataggaatatctcagttttatcaatttagcaacattcttagattattcaaaacaaaaagtgcttaaagaggaccatatacttagagccactctgagatgagaatatatacaagagtaggcaaggtcccccatcccaagaattctggcacctacattttagaggtttatcgctcccttttttttattatattattattttctgtccttatgctctttctctttctttttttaagcttcttggcttttcttgtgtctatctaaggttctttacagtgtccagaggtatttaaatgaaagaggctcatacgtttcttaacaacaaacccaagagacaaatacccaatatttgtgtgtgttatatagtttcttaattggaactttaaataccatgccaatatatgcagtttacagcccaccccatttttcctcatgaaacaagatgcttgcagccaatagtgatgcagccaatattgataccaagccactattaactcatatgtttaatcaaaccatctgtgtgtaatacaatctaaatgaaatcaccttaaatgcaagcgccagtaagtgcagaataactaacttcctgaagccataaagcaattctcttgacttataattattttcttcacttgcaaaattactatttactgagagttttatcaagggatgtctttcctgctcaaaatcctgtcatggttttgagaatctgaaatttcactggctgactgctaatcagaaacacattagtctagccttctttcaaaggaggcacttttaataaaaatctaatagctttagttctatgtttgaataatgcaacttattaaaattgagaacctcacttatttagtgcttctctctctcttccaaagaaagccagctgatactgttatctcaaactggttagtatccagtggtctcagttttctagttcatccaatgttgccatctagatcagcttgccagttttctggggttttttgtttgtttgtatattgctcttttccaatgaattctagtggctatttagaagcatgcatgctgttgctgaggaatatgttcaatattatctaccagaacttcagactgaagatctgaaattcctgtgaggcaatttgacattcatttaagttacagatcagagttgtggagactctaattgtggtgtgtgtgtgtgtgtgtgtgtggtcattcatgttagttagacctcttttcctaggcttgtcattatttccatatttcctcattgaagctttattctctttaaatgggttttaactttgcacctagtgtgactgctgttatgtacacaagctgtaatttttaaaaataattctgtacagattcgaaccctagaagaaaataatgagacttgttaagataaaacaaataaaagtgtctggaagaatcgagttctataaatactgggaggcattaaacagacttttagtggagacttgggtaggctttttttttcctgtctctatattcaaatctgtgaatacaggagaattgtagcttttatatgcctaaatatagagcagggtgactatagggaaggagggagggctgtgtgccacaaatatacagaatctatagaatatacaaagatgattaaccaactattttcaggctgcatttaatgagcagctaacaggaagcatggagtctaagccaaccctaaagaaagggggtaaggcagagacagggagacaggcactgaacatagactgtcagcatctagaggacagtcctgttctccagagggccttttgtgtttgtttgcttgtttgtatgagtgtacggagtacaggtgcaattttgttacaggcatagattgcatagtgttgaagtcatggataccttaagtatccatcctacaaattaaaaccacaatgtaggtggccttctaatgtaacatataattgctctggcaaaggaatacactactgtctcaatgttctaagatctaattcatgagggactctacacagcgtgcaaaagaagaactgaaagctgagaggcatctatcaaattgtcttgttcaatgggttcattgcatagaggtctctgcgtgttaacagacctgcccaagttttccagccagtttgtgggagcacaaggcccagtgtgtctacctccagggctttaccagcaccgaccacaccatgaagagtggcagttttttgtggacctttgggctctagtaaggatagtggtaaataatactgatggaaatgtgtgagacaaaatgcaggtgaaatttggggtattttcttatattcaggttttaagaaaaaaaaaatcaacaggcctatctctggagatgccaatgagaatgttgcagaaaatttaaaaaagagaaggaatagcagtgtgaggctagtcaattatgatgacaccagttattgctaaaaaatggatattgcaaagtgctgtttccttttttaaaaagtgaacaaatagaaagacttagcttgtaaacgaatgttcctggggagattctgctggagaattcattataactactaccatagggcaaaagcaaaactcacaaagacacaaacattgtacctttacctttaggttagcctgatttgttagtatagaaagttgcaaaaagtacttaacagtgtaatatgcatctcagtttcacttgactatacaaccatgcagaaagtaaaaatgataacatttatgggagtgtttggacactaagggcatttctaatgataaaaaatgtgtcagttcagcagcagtagcatgggaacaggaaacctttgctcatgagtgccatattcttgaaactttagcaacttttgcaacttttacaattttccaaaatgcaaaggcattgggatgcagaaaacaaaagttggtcaaacatgaaatacttgaaatcttgtaggaaaacttcaatcttgcttcaccctctttagtggcttactccaaaaggaaagtctaagagatgatggaacagacgtgtctgaactctgctgtcctgtataacttttaaaactattgtcccatgcattgaacagaaaggagtggaggcagatctggagaaggctcttttctgcagggtggccatcatttgtaacattactgtcccagcagtttctgcatcatgttctctcagaggattataaattattctactataaagacacacgcacatgtatgtttattgcagcactattcacaacagcaaagacttggaacctacccaaatgtccatcaatgatagattggataaagaaaatgtggcacatatacgccatgggatactatgcagacataaaaaaggatgagttcatgtcctttgcagggacatggatgaagctggaaaccatcattctcagcaaactaacacaagaatagaaaaccaaacatcgcgtgttctcactcataagtgggagttggacaatgagaacacatggacatggggagggggacatcacacgctggggcctgttgggaggtggggagctaggggagggatagcattaggaggaatacctaatgtagatgacaggttgatgagtgcagcaaaccaccatggcacatgtatacctatgtaacaaaactgcacattctgcacatgtaccccggaacttaaagtataataataataataaattataggaatgaacagagggaatcttgtggttgacattctagcctgttctatgggtacatccaggaagacactagagtataatgctgacttttattatgattaaggattcattgagttaattctaaaactgtaccccatatttgtcagacttgtgttcaaatactacccctgaccactatgagttcctggaaaaattccttcacttcctctcatccatgaaatgaaaataataccaacaacaccctgttgttgggagaagtatgagatgtggtatgcaacacttctcatctgagcagatgcagtgaagatgtctggttactttccctacactttcctttaattcatcaggtatgaaaccaagaagactgcttctacctagcatagatttgtacaatatccttatccctgtattcagatcagatcccaccccagagagaagcaagacagcaaatgcattcagtcttctctaccccaagtttggcctcagcatgaaattctcttcatgaaaacagcagtcatctcatttgctggaataaggatgaggtaattattgaacaatctaagccacagaaatgattaaggtgctggtggcatttacttatgcagaaagattaatagggttaaacaattgtaagttggccaaatggtaagaggaataaaaaagccatgaacaaatatttaaagggcatgttgtatccaaggataagcaggaattatttacagaaattcaaagagataaaatgaggcatgtggtgtaataaaaagacattaagcaatgagaatcgcactattttaaaggctttttcaaaagaaagagaattgttggattctgaagaaaacaaacaagtaaatacccatccatcattgaagagtttcctgagaaaagacactgcattcatgtctcgttgttgagccaagtagttacatgttaccccggaaaatctcaatggaagagataatattatcatgtctataaatttgttcatctactctaattgccagctctttgccatttgcttataccttaaaagctgtttgtcattttgacaaaaaattaacatagaaaaactaaaaacacaaatgtagaaacattaccttaatcatgtctgtgtaataggtaggtaaagaagaggtagaacatattatcaatacttgaaacccttaggtgtaaaaataaggaacaaatctatccatgaaaacgttccacatagagaaaatgaactatgataaacggcccttccaaagtttatgactatttctttctacataatgcttaaacttgagtgatatttatcattaagcaaactaatattttagtttgccaatgattatttgctatgatagtaattaaggagtctgaaaagcagccgttgcttaatcacaaatctattatatttaaatacaaagactaattctcagaaagaccattcatcttcttctgttttatagagacaagccactctgtccaaacacaaatacatgtgatgaaaggaatattcttcccaagtaaggaaacaccaagcattgccttctaatggtacccgaataccaactgagtactattagtgtttggctgaacatcaaatcacatggaatagttaacgtattaatactctcaattagaaacccaaatatatcgtcactataaaaagatgatcgcataaagggtactggttgggtaaatggtaggtttaaagtatttcgatgctaactttaccactttgtagtaaaaaatacaaatttattatgaaaatttgaatgccaaatactatacgggtaggataagaactgaaaacagaatcttgagtttgatcacttgcaggtcatgggtgaccgtgacaagaacagtttgttactggggacaaacacctgtttagaaagggtccaagagagaatgggagaaggatagttgcaatttctctttcaaagagttttgccagtaacagacaattaattcaatagctagagagaaatgcataaccaagaggggattcttttttaacatggggtaattatttaagatgttctaaatattagagcatatttaaatactgttaaggataatacaggaggatgtgggataacacagtaggatgatgcagaagagaagaaaattattggattgatttccctgagtaggagagatggtctaatgctaaatttgatgaggtcttgaacttagattacagcactaggagtttatccccaagttcagtaaaaaaataaaaagaggagtaaatggatagatctgcagatagacttataaaagcagttgtggagtatgtgaacatttatttcttattatttctactttctcagacaaatagaagtaaggatatagctgagagtagaaatgggagaggagacataagaggtttgaagggaagtaaggtaagaaatatgatccagttaagtgaaaatggattttaaaaaagaaatgtaccaaggggccccctgaggttattgactgtgaatttaaagtaggaccaatgtgtctgcgtatttttcttcagccaaattcagccttgtaagtgcaggcaaatagtaggcaggcagatgggctaaacagttagcagatcttctcctaatcccagccccactcttcaaagctatgcaagctttttatttttgtttccgattcctcatctgtaaaatgaatgaatggataatattagtgtattatcgattactggataatttagtgtattaatgaatggataatgtagtgtacctaccacatgggtttgttgtgaagattaaatagtactcaatagacacagagtgtcatgcaggtagttgttaaatacattaataattatccaattattggacctcttcaaagagaactacaaaccactgctcaatgaaataaaagaggatacaaacaaatggaagaacattccatgctcatgggtaggaagaatcaatatcatgaaaatggccatactgcccaaggtcatttatagattcaatgccatccccatcaagctaccaatgactttcttcacagaattggaaaaaactactttaaagttcatgtggaaccaaaaaagagcccgcattgctaagtcaatcctaaaacaaaagaacaaagctggaggcatcatgctacctgacttcaaactatactacaaggctacagtaaccaaaacagcatggtactggtaccaaaacagagatatagatgaatggaacagaacagagccctcagaaataatgccacatatccacaactatctgatctttgacaaacctgacaaaaacaagaaatggggaaaggattccctgtttaataaagggtgctgggaaaactggctagccataagtagaaagctgaaactggatcccttccttacaccttacacaaaaattaattcaagatggattaaagacttaaactttagacctaaaaccataaaaaccctagaagtaaacctaggcaataccattcaggacataggcatgtgcgaggacttcatgtctaaaacaccaaaagcaatggcaacaaaagccaaaattgacaaatgggatctaattaaactaaagagcttctgcacagcaaaagaaaccaccatcagagtgaacaggcaacctacagaatgggagaaaatttttgcaatctactcatctgacaaagggctaatatccagaatctacaatgaactcagacaaatttgcaagaaaaaaacaaacaaccccatcataaagtgggtgaaggatatgaacagacacttctcaaaagaagacatttatgcagccaaaagacacgtgaaaaaatgctcatcatcactggccatcagagaaatgcaaatcaaaaccacaatgagataccatctcacaccagttagaaaggcgatcattaaaaagtcaggaaacaacaggtgatagagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggactataaatcatgcttctgtaaagacacacgcacacatatgtttcttgcggcactattcacaatagcaaagacttggaaccaacccaaatgtccaacaatgatagactgggttaagaaaatgtggcacatatacaccatggaatacaatgcagccataaaaaatgatgagttaatgtcctttgtagggacatggatgaagctggaaaccatcattctcagcaaactatcaccaggacaaaaaaaccaaacaccgcacgttctcactcataggtgggaattgaacaaggagaacacatggacacaggaaggggaacatcacacacgagggcctgttgtggggtgggggtaggggggagggatagcattaggagatatacctaatgttaaatgacgagttactgggtgcagcacaccaacacggcacatgtatacatatgtaacaaacctgcgctttgtgcacatgtaccctaaaacataaagtataaaaaaataaataaaataaaaagtaaatcagaccaaaataataataataataattatccaattatagccattgctatgcgttcatttatctcaattgtattctatgcttctgctgcatatatgtcctgacaaatgtggtatgtttcattcactcaacaaatacttctgaagtgttagctgtatgccaggcactggtgagacaatgactttgaagtggcccttccctatggtgatgccgtatgggttcctatcaatcccaatatcaaaaaccataaaatcatagggagaaacatacattccacaaaataaattacaaaatttaattttatgaaaggagacatttttctgaatgacaaagtagtacctatcataaaatggtgtagacactgtgtctgcatttctacgcatgcctactggtatactgtcaccccagtaaacagcaaatggtgacattttcatgtgatctgagtttcttaaattgaatgctggaccattatagaccaaaactatgaaattagttgttttctaatgcaaacactgtaactggctttaaattgcattgacgtctctgaaatggtctcttagagatttggattcgtgtgtgtgtgtgtgtgtgtgtgtgtgtgtgtgtgtgtgtgtgtgtgtgtgtgtgttttagttgttgggtgctaaaacaatatttgaaatattatataacatttgtattatctaaatatcatagtcctctttggctaaagtttctcaacatttggggagacattaatataaattatatctaagaaaaatatagaattccataactaagtggataaatcatatttagaaacctttccttttaaatttctaccatttaaaaaaatttaaataaataaaatttagaagacgtaactttacaccaaagagaagggaggttcttgttgggtttgaaaatacttgttctcacagtaacatcatagagaatggaattactaacaaaaatcacaagtttggggctaaatgtaaaagtattcaaattcaaaatgtgaagtgaagcccgtaattgattacggtaactttgggacagaaggttttgtgtatctgaaatcttgttaggaaaggtcacaggatttcttcaccagacagttggccatagattattaatatatgtaaactcaactcaatctatggatataactaaacccaaagcaaaccatcttctttatgtttaattacattatacctaatctgttacactattttacactttacttattgaactactgaggtattaaacattttcagaaacctatagcaaatatggactgtgaaatcataacaattaagccacaggaggaaaatgcataaacaatgaatgccttttttgtctctaacattatttcattgaccaatctggtaatattctcataagattccctgcttagaaattgcatttatagtatgtcccttgttaaaaacaaaacaaaacaaaactcaacattttaatttagaagaccataatttgatctaaccttaatacaactaacaaataataaaattataattatcaaaaagttagcaacaggtattaatatgtagtaagactccaatgggtatggccttagaaaaccaacaccaaagagaaaatatcttccaaaaaataaaaagtgctttgaagaaaaatgttcccttgttttagtttagccaaaacagccaaaacaaacaagcatgtggtctttgtatgagcacatggtaatgacactaaaacagtagcgcacaaaaacagtgtttttttttttttttgatgactatttgctgtggattattttctgagacggtagacacttgtttccttacatagcaccttgtaagaaggaaggacacttttcttagaataactgatggatttcactatcacactggagcaaagcagtttatttctataggtgtacatgcatttctgctttttatattatgcattaacttgaaaacacattttaagtacctcactttccattccttatacatactgtaatttattttagttaaaatgttagtaagaagcccaggcacctgctgattaagcatacatggcacataataccatagctctcatgatcacagccccaaaaaagtaaatctcaagaaacaactgcattagcagccatgccaaagatttagaaaggttattatcctgtgaacaattatggttcttgtttgattgaaaaattcataataaaaacataacacttttggggatacaatgttcattatacaccattgtagtcagtggctactttagttttcatttttgttaagattccaaataataaaactatttgcaaactgttgatttccttgtaaattcccctttctttggctaaatcaatatatgtaaatatctttgttcatatattagttaagctttaaaatgaggttgtttatgttcttgcattcttataaataacccacaaatatgtaatccctctaattctcttaaaaaaagatataattatatttatttagggaaagtaaaaaaggtataaaatttgaaaagtatttttatgtctaaaattatctagttagatcactctggttcaaggatactttcttttttagcttgggcctattaaccttccttatttcactccaatccaagggcaatgaggagaacccagtgtatggcaaacactctcaagatttgagagcctatgaagatgcagaaaacacagactttgcttcttccctacaatcagctgaatatgtatacttaattaattattatcaggtatatataaacaacaacagtgacgtatgaaataccacaggagaattatttttaattgtatccaataaatgaaggcttctcagaggagatggcattttctctcagcttttcaaaatgagaataatttcataatttcaacaggtgaatgtagaagtgaggagaagatgctagacacacagtaaagcacaaacaaaaggataaggatttgaaagcatatgactaatttgcggggtgtgtggcattgtattgtgtttgaaatctgtggaggtcggtggagggtagatggagctgaatctggaaaggtgggttgcagtcatgctgcctaccacaccattaatagccatcttgcaaatttctgtccttcacaagagtaagtcaactggtataaacatcactcttctataggggtaggggtgatggagataggaaagagtgtgggtgtagggctccaactcaataatctttacattaaataaattactacttaataaaggattttttaaaaccctacatttcaaaaatgtgtattacccttccccaaaacacaaaatgtggagctattctttattctgttttcaagcatatcacactatattctacttgacaatgtgcttaaaatttctatgcctcttttttttctcccaatgggacaatattttttccacctcaaggtctctgcacacacattgctttttctacctgctcttaaaatctctgcatccttcttacctgtcatctctcaacctgtggatcccagtgttgcccaccctgactactttatctaattagatccctctccccacccctctctcctccataattctttatcccagctctcttcatgctttataggactttgaattttattatttcttattaatttgttcctttccataggcaatgactctctaccccatgtttgtgagctccatgatggcaggaacttcaactcttctattcactgctgtatgtatatataatacctgctacagagcctaacagattgtaaagattcaataattgttatattattttcagctataaagacatataaaaccatcagacttaaaggttgtatctttaataaatatgattttttaaaattttctgagggcaattccctatgtaaagagtgtgtaataagaaggtaaatatgcttgaaaatatgttcgacaataagacttaattaaatgaataattatattgttatatataataatataaaagcatactattatatgtcgatatataatttacataacataaagtcttaatatttgttttgcttaaaattagtgatactaataaattaatccttttctgatactcaagagatatatctgtatttttctcctctgaagaatatatatacttttatataagaaatataagaagaataaaaaattctcatacaatttccttataacgtatcttcccttctattttcctgtccaaagtaaggtagaaaagtgacctcaaatatatttttcttacagaacattgaagattgcttatcatttcaaaatcaggaataccaacagagcagtcagggttgaaaatggagaaacggaccattagaaaactcagacagctttctatactgacaaaaaagtaaacacccaacttaaaattcattaagtgtaaagcaaatcctccttcgccacccaatatggcacaaaacatttattgttcatatttataaaataatctactggctatattcttaagaaatacacacaagttttaatcattgtttatattaaaataagcttatttagtagatagtatgttaatttactttatgtagacagccaatttggagctgtatgtggtgaaaactgtattctaaaagatagtctgtttgatgacataagaggataagcacaatttaagtcataatagattgatcctccgtctatcaacggtgattaaggcagtcgagttggtctcattacacaaaggtgggctgaataaggctctaggctaatgtggaaaattaaaatccatttttttcttaatggctcctacactggtctgaaaatatgattgatcccaaattctccaacaagaagttcttattttacttatataattttatttctctaacagaacttccactctgattttcttcctatctttgcctttgaagcttgatagtaagagcaagtaatctccaatttcttaaatgtgacaacaagaaattgtccttttaaaatattcagcattagcctttaaaaaaaaagcatcaaaacttttggtcatcaatttgcaaatgtaaggacacgcactcactctttgagaaacacatgtatagcttatgcttctatcccccgtctttggaacaacagggcatttaaaacaaatacagctgggagccgacaatgtaatgtgctgggcaaacatatactcccattaacgtaaatagattcttcaatgtttcctaccaaccccacttggttatgaaaagccagcaatgcccatttcccccacagaacacaccacatgctcgcaaaacaaccagccttagcaactggatgcagagacaggcagagagagagacaaaagcgcctggctcctgaataggatgccttctcagaccctggcatttcaaaggcagtgaaaggtcatcctaggtactagtttctcaaagaaatacctgtagtaaggtaactattctagtcacctttatatagtaacggcttgtatctcaggcaattcgccagtttttcaattaaaactgacacatattagggatttttacttctgccccccgctccccgcaattcggattctttctttagactccctgagcctctgtccccatcccaggatttgactgaagggctgcagagcccagggctgcgcgctaagcagccttctgctgaacctcagcggactgggccatagttcacacaccctccactccttctacagcagctcccgctgggggcaccgccaggatatccacatttgtccaaggtctgggaacccgggaggtttctaggagaccccagagaccaagtgaggccaggcccaccccatggaaacccccaccagctcagatcagactgcgagcggtggctcgaccccgggtgtggcaggaaggggtgccccgcgttccagagccagtgccagtccctatcctcccgggaagccgagactcagggggaacaggtttcccagagcccagcctgcagggacgcggagggcaggagccgccggcgaggagcagccaacttgccatctctggcggctgcacttctcggcggctacaggttgcccgacagcggactccagggtccccgcgacggcacccagagtgctcagaagggaggccggggccggggtgggccgggaaaaccgagggagggaaggagcctggagaagctccgtttaggcggggagggggcgacccggggcgcatctcccgaccatgacccccacagaccttggcgccgcaacctgcgcttcttgaggccgaagatgcgcactttggagaagatatccaccaggttgccgttgcagagcccgcggttcttgctggggctgctccgcctcctgctggcagacggccggtcccagtgctgctcccgcgcctgccgcttctggcggatcaagccgctagcgatggccgcggccatggtggccccgggaacgggtccggggagggagggcgcgggaggacggcgagccgggggcaccggaggggaaggcggcggcgcagaccgtggctcgccctcggggcagaggagggggtgccaggcgggactggggagaggggaaggggggctcagtcctgaccgggacccatcgccctctccgcggggcgcggggccaggcgcgcagatgcgcccagggcgcagccggacgatcccgggaagccggacgtcgtggccgccgccgcttggccacgtccgagtggagagcgggaccgcggctgcgggcgctgctggtcaccgctcgtcgcaggaaccccggcgggggtcgccaccgccactcgcgctgccttctcgccctgcccggctcccgggcgggaggtagagccggccggcggctccccgggcgccggctggagggcgggtcccggcagggtctctgcgcgtccgtcggtccgggtcgcgctgggcaggactcagcgccgggctccagctgcccgcgggccggtgccgccgccggcgccgcccgctctcggcttctgccggtgattgtcaagtgctttggaaatcagcatctggagagaccaatcttctcccctgagatctctaatcaaacgctccgttcccaccccactacaccccctccacctatgtggtccccctcctgatgtacctcttcagaaagaaacaaaacgtataggtaataatgatttaaaaataataagaaagaaagctaagatggattgcagggatggggtgctaagaggccgagccaaagcaggtggaattgaaggaacatcggggcgctttttcttagatgcaactcgctggttcccgagccttccgcggcttggttggggcttctcggtcttaacgtggttaccggtgcactgaaactctcagcagcggttggagggcgaggtggtttccgccctccctgctaatccctccagcaccaacgcccccccgtcgccacccccaaccccgggttggagggaggagcctccactcctcacctagtccacccaaacttgcaggaccctcccttctgctgcaggaagggtaggtttgtcattttgaaaggctacacggagcaaaaaggagggaatggaaagagagaaggtgtgattaagcgagatagaaagaccccactcccaaatatgctccccagccctgggaggaggagatgacagccgcagtagctgctacagaacagcagctgggtaggataaacgcccaggagaatgttgaagaagtcagggcagaaatataaggggcagaggagggtgtcacactattccagggacagtgaaaagcagccagacaggacactccaatttgagctgtcatcttctggtgtccctgggcaaagaagctctgtcagggagcaaagccatctgaactgtgtctgaaattcaaatacaacagccggcgtctcctcccccttgattttctgtctgtgtcccgacagcggttccctcctggatacctgaaaatgtgaaggtccaagagaaagggcggcagtggagggcacccgaaaaaaacaaaaagccggggggaggttgggagagaaacacttcatgcttggatgaacacagttccgtggtttctaggatacaccagagtggcagaaccaagtgcagctctggctccgggcttcttacttttctcctcttccctttacactgctttgcctatcagctcaggcagctaaagagaaagaaatgctcgaactagacttctggaaattcagtgtgaagcaagggggagagatggctcacttggtaatcaagagacttgcaacaaccttcttctccagtgactgctttagagctggaaagagggcaagcacactacgcaggcagccctgggagcagttctcaaccaaaacacactttctctttgtctcaggaataggcagtagagtactcgccaccaggcaactggggggaagtgcagcagattacagggaggctgggcaccttctgctctaagcaacttatccacagcttctccatggaagcagccactgctgggctgttgtttgttaccttcactccacatttaccaacaagtctccttttgggaaggaaatgcaacctgatgagagtgtgtagatttagatctaaggcagggatcattggctttacgacggtgtttgtcatatattacaaagtgtacttctggaagtttattttctacactttgctatgttacatctacaaattctacaattattaaaaggaatatgctagagttgttttgctagaaacttgcaatccctagtcactcataaaatagcaaaagtgagaaaaaggggaatgctaattattttgctctgcctttccctctctattttcagtttcatatgtctcttttcttccatttttttgtgagtgtgcatttatgttgtgttgctgtagtcctgcttaaaaagggaaagatgtctatagagagatgaaaataactaaatggctattgagtgtgtctgttgttttaattcactgaaatgagtcctactgaacattaagagtcactactcttggtttctattattgaagaaacgccatttgtacatttcagaagttctagatttgaatttgcaaatgactgtaagattaaagcatccaggtttattatcaaaggcttcttgcagtgagtgtttcaaaaaagtaaaatgttaagtatagtgacctcttaaatctagtatgacttccccaacacacctagtttatttttaaaggttctttaagccttttgatgtatgtgccaacaatattaatttgaaaagagtgacattaagcttcttgttcttatagccgtgcctctatttttgcaggcattttcttatgctgcagtctttcccccaaatccttggacttgggggtcaggaggtcagtttttggccctctcagagccctcccttcgttgttcagcagcctcggaccagcctgacattcagcaccgcggacagggatcccgccccagccctacctctcccagcagaagcaagttcgctgatggagaaaagcgctggctgtgagggtctctgacactttcctcccctaaaagcagtttctcacttttttccctcatgatgggaaggaaattgatcttcacagcttctaccgacgttaataacaccttggaacacaaagcctttcagcttttccataaccgagagatactctttctttctcgagcgtcccgacccctggcgcagcgcctgaacagcggactccggagtctccgggcatctattctggctgtgaatttcaggagcctcaagcggtcatttctcttcaacgtagcttcctattttaagggatcttggagaggggggcagcattgggataatcaaggtcttttaggttaatccctgcgttttcattttacctccccaaaacgctgtttagttgtttacggatggaggtaagtgaaagaaaacgcaagagagccatctgctgtcttaagctgtgataaaagaatgtgcaaagctagggtgaaaaccaattcagggccggtgaacacaaatgtaaaggttactgtagttcagaaaataatttgtcactcatcagaacctccttggagttgttaattttacctttgacgttataaagaggaaaataaagtacggcccaggtggtgtagctcctcaccaagctattgggagcctgaactctcatttcagaggttcttggttcatttcttgactctgcaacttcctagctgtataatgacctccaaggtgttgctttagtctctctcagcctcaatttcttcatctctcaaattgaggtgaaaacagagcctccttttcaactgctgtgagattaaatttagtaaataaatgtaaagatcctagtaccacatctggtgcaccctaattgaaaatgacagctatgactgtattatcatcatcttccagtttactcatttctatcttgtaaattcttttgcagtttccatgttttttcaatatcaaaatatatgtattccctatgtatatttcctcaccaccacccccccacagtggatgcatgacaagattttagataattcgaaacataagaagttattttaaattttgacgaaataagtcccaagttcaaaccttagttattattaactacatttgtgaactgagtcccgtaagcctactttcacaccaactgattgataataaaaacatttctctacctttcagagactatgatgagggtctatgagaaagtacttctaaaaacactaaaatactatacaagcatcagtttggaaggtaattagtacactgtgcttgatggtctcctgaagatgctatgatccttttggtcctccaactttaagtatgttgttccctctacctggaaaatttctattgccctatcctcacactcctcttgatgattaaaaaaaaaaaatcatcagctaaagagtaaggcatgagccaccatggcttgccaacagatttttaaataaaaataaagagactttttggctctgtcttgatggagcttatagtttaggtctcagcatagatatcttctctgggaaacttcttgccacctacccctaattaacactgaatctagggcaccttctaaaaacttcatcattcctctactaacaccagcaattgttgaataaagagagagctatattgaaacttctacaaagatgtctgataggtaagtgtctcatgcttaaaatggccatgaacgaactactgttcttccttcttaaacctgttcttccaatcctcgccacttctgaaatggcaacttcattcttgttcctcaggctgaaaactttagtatcatattaatgtcatttctttctctaataccccgtatatatttgtgtaagatctattctgtctatctgcaaaatatatccaagatatcactctcaccacctccactactacctaccaccatcatcttttgggtgattatactacaatagtaactacgaaatcccatacttcaaaaccaaagtcctcactgtagtggcctgccatggctcatgtgatttgtgccccatctctgccttcagttgttctctgacatcatctctattcatctcccttcacttaccacttgctgtccatcaaaccacctggcatgatcctatgacaggacttttatacttgctgttgcatttgactctcatctcctatgaatctttcctcacatctttgctcataaatctatttaaaattacaactcataaacacagacatttccttcttgctaccctgctttatggttctacatagcacgtacaacttttaaaatttccatgtactttccttatttatttgggctgtcttccccgtttaaaatataagcctataaaggtacagactttgtctcctttgtttactgccacatatccagtgtttaaaatggtgccaggcaagtaggtgctcaataaagatttgtgtattgaaaggattaagacattggatatctgaacaaatagacagttaataccaaataagaggaacagaaaatcttgcttaatccagtctgtcaaggatgaagtaccccatggtacctaaagagatccttgatctctttaagcaccaagacacctaaaattctatctggattacacacaatctcaacttcataaataggatacaccgaaaatactttagcctttgcttgatgtcctgggctcaaccaaacatgacaaacagtttgagttctgaatttcaacagtgacaccctcggggcttactgaaggatgtgagactgtttccatttgaatcaaaaaggacttctggtatttgtgattcaccacttctccacacttcctaacacacacacagttttctatcttgcctcctcattttcagattgttgattgataaattgacaatatgccctttttcaaatttgctacatctaatcatgtaatccattatagaatttgacaccagataaatgtatttgttaaaattatctataaatattaaagtatataaactcgaagtgaggagagtatacaaacaagaaacagccttattgaaattgaattgattattaaattttttcctattgcattctgagttccattatgttctggatgactttgtggcatacattgtttgccttccaagtagataagtttcgatacagtttactaaaaaaaaaaagtgcctggattttgttttttatttatccttcaaatgaacaaaaaaatccaaaaaacatattttgtacattgatatatatattaaattctatcatgttatttttccaaataaaaatctattacttttccttcatttctgccattgccacggccactatttcgcctttcctaaatttgtcaaatttaagaagctgttaattttaagattattttaggtacttcgatgaaagaaataaaaacacttcattaagctatgttattttatagattataatacgcatatgaattctaaaggtgtttatacataaaaagtattggcatctaagaatcactaaaatatgacgtgtacttgatcgttttcatacattaagtgactcactccgttttgtcacatggtttcctttgtgaatcacttttgacatttttcaacatctccaaaattaaagataaaatatgaaagtccaacattattttttccacaattaaattattataaaccaatttggggtgagcttcagtggaattaaagatgatatatattggcatttgtttaaatctcctttctcgataaatgggttctatttgaaaatgtttgaaatacttccggaaaagtaatcgatattgatgtcccttttcattttttactcatttggaagaatatttaaaaagtcatattagtatgtacttggggcaaattttcaactagttaattaagactgactgcttatccgctcattacagtttaagttcaagatcacatttttttccgtgatagtattattgacctttattttagaatcaaaggttgatctaactgaatattaaataattctaaattagattttcaaaaaccaagtgattgcattaatgttataacagtcttgttgattaattttgctggatatatttatttctggtaggcaacagatttctatctattaaaaaactggaaggaattttattgttgcttaatgttttgattcaataaaggaaaagtagaaactattgatactaaaaacttgtgaacattctttcctatagaagcaataccagattgatactagcagatggtttagctttacaaatttagtgattttcttttaatccagctaatacgttggaaaaaatattctcagtagcttccagccttcaatactaaagtgaatccaaaatgggcatagaagtcatttctgagttgtgaatattggcaaatcttttcctactctaaatcagtagtggaagattaaaataccaagcattttaataatagatcagtgaatttttaacactactgaatacctcaacagaaaaaaaattactcaatttccaagaaagtttgagaaaggaaagttcatttataatctcaatgcaaagagagtccctgtgcacatgtgatataatctttttcatatttagcactgtaatgagtttttcaataatttctagaatgaccactttcataggaaataagtgagctggattaagattatgttctttgcatttagcatacatgagttaaacatatatgtaaacttgtacatctgcacacacatgttgtatgcatttgtgccaaaacacacaactaaatttctgactctgttaaaggtaattaaaatagtgatttttttaaaaaagccattttcaaactcccagttcatgcctcctagtaacctgttttcattactaccttcacagtatagaacttttacattcacatttgaaagttttctggataatagttaagtgggaattaataataaattagagaatatttcggtcataattatttaaatgggaacaagagcatgtctgtttataaaacatccaaataatatgtgtataatagtatgtgaaaagcttttagttctagtgaagtggacatcatgatctctattttacagaagaggcaattaagccccagacatgttaaatgattgccaaagttacacagctatgaagtggaagaacaagatcttaagcacatgccttttctatcacactatctgccacccagaagtcagctatttgaaatatacatgtctgacacagtgaccagtgtagaataagaactcttacatgggagccaaggacttccagaagctccaaggatgggtgtaggattatctgattcccctgaaatttatgctgaaaaaaaggtgtgcatgtgcatgttgataacaccagggttcacaatttttattcaactgttaaaaagctctgtgagcaaagcaagaataagaaccgaaaactgtagaggagggcaaagaaagaatgagaatgagaacacaacatccaattctacattttctgactataaaagtacaattagaatataaaaataaatgacaaataaaaattgcctctaatcccaacattcaaatgttttggtatatttttccagttttttagaacgttattttacatacaaatttgctatcatatttttggcccaggttggtgactgagaagacacaaatgcagtaaaagccagtgcatcaaagaccatacactttaattatatgacctgaaagcgtaccagggactacatattctacattcttccaaaaactctctacaactaagagggcacttcctcctgcaggttctgcaggctctaatctctggggacaactggtacttcagtgtgcagggtttcagaaagtctagttaaataccggaagccttcaggttctggcaaagttgctattaatctgcctctgatcttgtaatctacttctaaaagatgcaagtgaaagtaatttccaaagtgcatgcatgtaggaaatgttataattttaaattaatgccttattcctgagcctagtttctactttgtatgtaactgctaaaaatatagatcttaaattattcccgagtctttctcagtaacctacagtgtaagtttcatattgcttctgtaacaaattagcataaacttagttgcttttaaaaatacacatttattctcttccagttctgcaggtagacagtcccaaatcaatctcactggatttaagtcatgatgtctgcagagccttctggaggctttgagagaagaatccatttccctgctgctttttgtttgtttaatcttccagaggccacctgccttcctggctcacagaccatgtcttgcatcttgcttccattgtcacatttcctactactgactctgatcctcctgcctccctcttcaagatcctagtgatttcactgggcccacccaataatccaggggaatctccccatcccaggatccttaacttaatcacatctgcaaaatcgtgtaaactgacgtattcacatactcacaagttgcagggataaggatatgggcaccttgggggaggcaatcattctgtctaccacacctaccctgtatccaaaacacacagaaacagaatccttcctagcctttgacacttacccacgcccctctgatggacagaatagctgcttccaaataccagtttttaaatgagagtccggtttcctaccaacataattttttaaacaccagcagctgtttactcgattgaatctctaatgattgcctgctcctgcttcctaggctgctttactcccctgctcagtgttacctgttatcatttgctggaccgctccagtaccacctgcttacctgaatttcttataactttaattattgcatcgctcagaaaaaaacgtacagcaattctcagtgattgtggagacaggaccattaggctccccagtgaattgtgagaatgcatttttctaagccccacataaatccatgaagaatttaatttcttgagtttataacatgcctttcatgagatttaaggccatagaatctagctaaataaaactaaagctagacatgtgatgctttacaaaatgagatttggggcctaaggctattgccaaatgaaggaaatacattctgcaagtcttttttccccattccactttcatttttatatagctgtaggggaagtagataattggtctttccttttagaaatttagatgaactccttaggtaagaatttgccttaaccgtataggttgacactgactgcaaatggaaaggtgccatttatgcaaaagatttttaaagaaatcagaaatatttcctgaagctttatgcggacagaggaagaggaacctcaggaaaaagaattatttcagagagaacatcatggatatttttaaataaacaagttttagagccccgagacaagccctgctcaccacatttttctttgctcactccttcaccccttttggcctttttgtgttgtttctctctgtaccctcctctgaggtcctacagagatttgaaactggctttcagggatgagggtacccaatggttaaaagaaggctttggctgtgagtcaggaatagcggccattgcacttgacaggttttgttttatatgtattgtatatatacataaaatatttgaaagcaccaagacatatcagcaaatgaatctctccccgacagggagggataaactgtccaaacacaaatttttccccaagacacctaatcgatgcagtcagctgtgctcaggagaggcctgcactggccatgctcacaggcttgtgttcatttctccatgaaatgggcttcgtgatcctctcaagagatttagttctagcaggacaagtttcagattcatttatgtcatgggtatttgagtacagataggagacagcagttttacatatttgtactgtacaaagtttagatctgagcccttgttgccctgctgcaagagtcaaagctgatactcaaatactctaattcccagctctttgtcataggtttcatttccaggaccgggagttgcccctttctggcctctttgaagggtcattctaccctcggtgagtcaacgatgtgcacaggctcccagcttccctgcctctccggggatcatttctttgactcctacacactcctggctttcccaacacacagctcctgatcagaggggctccacctccccagagcctggagcagtgcctgacccaccacaggtgctcagtcagtgtttgtcaaagggaggatgagactcagacaggaatagtcccaggttctggactgttcctgatgtctttaatcctcctcccaacggtaagacacatatgccctccgtcccgtttccctctttcatccccggtgacactagaacttttcaaaatatctaaaaaaaatagtccctctctagaagaagctacttttactcttgaagcactaaaagaggccctgtgggcagaggcttgtggagttctggatgaccacgagctggacactctgcatgtggaaggaagtggaaggtctgctgcccaggagattttcctaacattttaataaaagggaatggcatatgcaaaggaaaaggaagaaagtcaaccaaatgcaggctttcggcttcattgataataatgagtctgaaaataaagacactttttagtacatattaacataatcgaggaccattttttattcaaatcactgaaaactaatacaacttgaattttttaatagtatacttaaaacattctaaacttgctgtggtgtgtgtgtgtgtgtgtgtgtgtgtgtagtttttgctaacttcaatcaacagggaaagtcactgagcacaggatattttcatattatatttctcaattttattcgtttatggctttgaactgaaatcttactgttatcttattttccctatttttttttgagacagagtcccactctgttgccaggctgaaggttagaacaagaagtagccttagagatgatttaaaactaataatcccattttactgatcaacacactgaggcccatggaggttaggtaatttgctaagctcacggctaactggcagcagctctcagcctgatttctcttctcctgatgtggtgtgccaggacctctccatcacagctctgtacttctcagaaggccttggctacaatgcagaagagtggccattatactctctccagagcatttctggaacatggctatctctcttttcttgttaagcacagtccattttttttttctatgcagctatacatactattattaaatgctctgagttggatatgaattactgcctccaatgtttgcaaaataggcctcgcttggacaatatattcataaaaacataattttcagaaaggtttacctcttggtttatatgatcaacctttatttatcatcaaataattcattacattaatgcgtctattgagcgctaactctgcaccactgtacttgacccggcattcaggcatctccccttgagtggctcagaatatagcggggaagatgttgacataggcgcttgtgcctaagtgtctcagatgctgggtgtgaagcacgtgcaagaacagtggaaagagtcagctccacctggtatgggttgggaaaggtctcatggaaacagtaacacctggagctgagattaaaaagatgggagatagtcaccagctagtcaaggtgggtatggggattgcagtcagaaaatgtcaaaatagaggaaccctgagttacaggcacagcctaatctgtgaaggtaagcggaagcagcctaatctgtgtcaggggaaaaggatacaaaaagcctgtcagtgacgaaattaggaattttgtatgtcactggggacattcacaccagctgtagaaccagctgaggtaataaacattaaataatattcatgaagagctattttccacataggtttgcagtagacccactcaattacctgggcgttgtcacgtcatctgactattttcatgctgacctcttcccatgcttttctattaatgtgtgagacatggtcattggacttaaaaatgtacacattatatggcatctttatttatatgtgttatatatcattaaatatatacatatatgcacatatatacatgcacacattcacataaaatagactgaagtataaacagtgtttatcagtaggtggtgggttgtagccctttatgttttttattctttgcacttttccctgacttttcacaaggagcatgtgcaacttgcataatcatagaaggatgactttgtttttaatataggtgttcatttagtaaagagaaaaaaggggcaacacatacataaaggaaaaagtctgtagctgtggagcaagctgtggatatccactagctgattagagggctttacttccaaattttaattcatcccattactcgttttaacgtgagagcttattctatttatatcaaaaggcttgcatttctaattcttaaacatcaaattttttcccttcccttcctgttttcaaagacatgaaatagttctgttccaataagacacttgaaaaaacaaaccaaatgagaaacccaacaaaaacaacaacaaaacatttttccttgaaaaatcaaggttgcaaatctcagaggcaacttcagtatagctttttagagaaatattgagagtatttacaaggtcttatgtcaaaaagagccaaattaatttcctgcattaaaatattgctctctttatggtcataccttggctcctgggtaaacatacttcattgtatttatagcacactcatgtccccatatcctagtgttaatactgtattgataaacacagaaatgaatctcagccactggaatgctccattttcataacattccttatgtggttacacaatcattcagcgattttctttttagcctagagggactcagtcagttgcaaagttttttccatcaactttccttggctacttggtatgaacagtttaatttcattttcttcacagacgaaaagtattttacactgtaacaatccttgcatatcattgtagattcaaacatgctcactcacacacacactcacacacagagttaaactaatactgctaatccctctaggtatgtcaaggaaaataaaaatatctgcttccatatagagttccagaggctagtttgttaaatccacatttattcttctgctcaaaagtttagtaggaaggggacttacaatcatctggtcctacagtgttctaacagccctgtaaagagaatgcctgttttccacttagacggtccaacaagttagagtccaacaaatttacccctctccttttttgagatggcttgtgttttagcatgcccttctcagaattggccccaaagcctggttttctaaaatgtccagtcatctttcacttattgcccatcggaacaaaatatttatccttcttccatatgatggtctttaaatattttatgacaaaacctaccctatttatttctgtccctttagtttcaggagacctcactgacgttgacccacccaggagagctattgctgagatcaaacgaaccctgtaggttttttctgcttgtctctggaatgcaaaggcgcccttcccatcctcttcattctccctggtcctggcttcccagctccttccattctccctcacgctgtctcagttccaagtcttcactcatttcactgtctcttggtttttcaccagcaatttagttagtagtttgcatttgctttctttggcacttcttcagaatacacattttgatgctctctttagtcacaacaccaagagacttcacaatgaggctgcaattatctcaattctctgaaaaccttaggactggatgctcccctctctcctcctccaccatgtctgaaaggcatgagagattttcagcttccctgagtcagggactttgttttgttcactgtgcatccagtctaccctcagcggctagcactgtgcttggcccacagaagcaattcaatgaacagctgttaagagtaactttgaaaggttggtttcctccgggtgagccggacaggacactgatgcccacgtgaaagcctcacatcagaaatgcacaccacagagaaaatggaataagtacttcagcggatctgtacctcgcaaagcacctgaagaacgcgattgacccattttaaacttcctacatgtcactcctaagtcttcttcaccacatttcctattagaaattagtttattatttgaatccagcagagctccaaagagctgcctattggaatcaaataggacacttctaaaaggttctctggggatgggtgtgtcttggttataagaactttccctaaaagctctccaagatcaatgccaaatattaagatattatataaatgatcagggattccattaaaattaaggcaatatcttttcaaagattttgtggaaacgcatttctttcatatgctgacctgcagccttgctctgcaattttccttttagtttgtacaaaacagagttctttagtggaagacagtcttgcctttattttgagcccacaggaaaaggtgtatggcgttcttttcattgctttttaaaaataaattccaggccgggtgcagtggctcatgcctgtgatcccagcactttgggaggcctaggtgggtggatcacctgaggtcagaagtttgtgaccagcctggccaacatggtgaaacccccatctctcctaaaaatacaaaaaagttagctgggcgtggtggctggtgcctgtaatcccagctactcaggaggctgaggcaggagaatcgcttgaatctgcgagtcggaggttgcagtgagccaagatcacgccattgcactccagcctgggtgacataagtgagactccatgtcaaaaaaaaaaaaaaaggaaaaaagaaattacaaaacataaaactcgataataaaattacagatttacataggatagtactggggaagctttgtttcttgagccacaagtaactactggctgagttgaattaggagataggcaagtttcctaaaatgaagttatctgtcagtcggttgcccctacacacttttgataaatccctctcccttttaaaattacagtaaaaaaaaaaaaaaaaaaagcactgagaaaaaattatgaggacaagaagcaggttctgaaatcccaggccaagatatatttggctttagtgtttaacacggtggacaagtttagaaagataaaaacccaattcaatgaattttgagatcaaaattgatgagatgggagatagcagctgaggggaaaatggaaacagctaacgagctacagtgatgtcctgaagtcctatttcttcctaggtgtgtttctttttaaaataatctatttttgtcataatttttcactctattcatctccatctttcttacttgatcataatatgaagatgactgaattaatttcagtaaagttagtgatattttatatattctgttcttaatattttaaaaacttagtttaactatttttatccgtcaaaacaagttcaaacaaatccattaaaactaaccaaagttatcgatatcccttttcttggcctctttgcatgtgtttgcagacattctgtgtctaactctaactcccatttgttctatgaataatgggaggttagaggttcttccattattcatagaacaaatgctttgagagcaataaataagaagttatccggtacaagatttgctaactgtctttgtgaatttctgttgaattctacagaattactgttattaataatgtattggtagtccgggcatggtggttcatgcctgtaattccagcactttggaaggctgagacaggaggatcactttaggtcaggaattcaagaccagcctggccaacacagtgaaaccctgtctctactaaaaatacaaaaattatctggacttgggggcgaatgcctgtagtcccagctactcgggaggctgaggcggcagaatcacttaaatctgggaggcagaggttgcagtcagccaagatcgcaccactgcgatccagcctggacaacagagtgagactctatctcaaaaaacaaacaaacaaacaaacaaaaacatatataatgtattggtatatttaatctgtcttaaattttacatattactctttcttacattaatttagataaccaaatattactctaaatattattgctcatatgtatatatatttgacaaataatactttatatatgtgtgactgtgtatgttttatatatgtatacacacatatatatatacatgtatgtatatgtataattcagagcaggaaacaaattttaacacaatttcttttggattgtccttgttggcagaggataaaactatcaactcttgtattcaatttggttaatatttttaagtgatgacttttcttcctagcaagaaaataatgggaagataagaaacatttaaatgatttggtaaacaagtgtggttgttgctaaattagaaagcagtctgcaagatgcagcggcaggtgaaggcagctgattcttcaaagcacaacagaaacgaaccaaatgtcatctgtagaatgcaaaacaaagtggtatattcgtacattttagtactacctatcagtaaagaaagcccaaatcactggtataccagtaacaagaataaacttccacatcattatgttgagcagttaagaagccagacacaaaagagcacaatcgtgattccattttaaaaaatggaatgtggtatctatagatatcagaagaatttttgtctctgaggtgggagattgactggaaagcatcaagaggcaactttttggggtgctggaaatattatttgccttgatatgggcaatggttacagggattacacatttgtcaaaattcatcgatatgtttacctaagttatttactttgtatatgttagacctcaataaagtgctattcaaaataaacaaataagaacattaattcaaatgaacatcagaaaaacccattaactgaaatgaagcatcaatcccatgcacaattttagggcatgcagattctctgaaagtccaaatgcccctcactctacactgccattttctatacatgaagaccccctgatggttggtggagattgggagaatggaatgttctactgctgcagactgtctgccgggtgagtatttccatggttcccactgttacaaaggaaactcaattctatttttttaatattgttcagtgaggacacttaatatgagatgtaccctcttaacagattttcacgtgtataatacagtgttgttatctacagacacgatattgtacatattgtattggctcctagaactttttcatcttgcataacttgttttaggctcactgagatacaaaaggagattgtggagctacagatacagtacactgaactcaaagaaagaaaagtagggcaattatttacaagaatacattttaataaaatatttcttactaaagttgaaataataaaggaaatctcatcatttcctgaaatgaggcttaggccaatgtaagcaagctgatgtgagagcagtatcctcctttctgccccttcagggctacatccagcagctgcttggggcccctagaatccactgttgagtcctcactaaccaggcaattttggcttctcacattctgctgacagagcagctaggtgcttcttggtcctgattctcaagctgaccccaactgctatggtttggctgtgttcctgcccacatctcaccttgaattgcagttcccataatcccctgtgtcatgggaaaaacaggtggggagtgattggatcatgagagcggtttctcccatgctgttctcatgatagtcagtgagttcacatgagatctgatggttttataagtgtctggcatttcccctgcttgcactcattctctttcctgctgccctgtgaagaggtgccttccactatgattgtaagctttctgaggcctccccagccatgcggaaccatgagtcaattaaacctctttcctttataaattacccagtgtcaggtattttttcacagcagcatgagaacggactaatataccaaccaaatccccagaaacatatgccccccaaaacaaaacacacagagatgttctatccatccagcaaatgtctcttttctccacagagcttctaagttgtcatctagctaccgtgactgattaatttgagaatgcattaaatgcatcatattttcctgcttaggtgagattagagatttttaaacatagtatgaaatcccaaaaggataatattttggtggttctatgacaggtcaatgaaggggaaatttttaaggtagtcatagaaaggatctgtccatggtcttaaacatcccatataaactaacatgtactgaatgccaggcacagcagcaagctttaacataccttatcttatttaatccttgagacaattttataaaggagaaattctcccttccattgtccagatgaggcagccagtgcgctcctgcagggtcatgctgtttgcagtctgctgagaccagctcaggactccttcttaatgcctgacccacgagggttgtgggcacttacgtggtcaagaagtgaaaagaatttcacagttgatttattagtgatttactgagaagcgctgagttttgagggatgcacaaatcctgccacttgccttcaggtgccctaaagtccataccttaggccacgtctcctaaccctaaacattgccgagtaacagtcaccatggatttcagaactcaagtcaggaataccagttgccagtatcagccttccaactttgtaactatgagaggcaggtgactgtggataggaaaacacaggcatttcagggacatttcaacagtttgtggggatcacgggataacatattttaattagtgcctgttccaaaagatctagaatgtaggaccaccatgccaagtcagcaccagaaatatatcctctgggagctagctgccttcttcctaaagttctcttatttttcttgtttccagagcaagcaatgaatgctatttgttcactatcttccccacaatactgagcccatggcgtatattgtcaataatatgtgctgaaagaataaatgaaggactgaatgaatgagagaatattctcagaatggaacattcagtcaattgctacaaagccttaatttaccatccataagatatttgcaaatgaatgttctcttcctaggcagaaaaattaattagtgtatagaagcaaatcagtttaaaaatgtcagatcaaaggggtagagatgggggtgtttgaaacaccagtggaatgaagactgtattttatacaactcataatctctgtgaaaaatgcaaactccccttgctaaaaaggatggcgctttaatttgtcacagcatccccaagcctgcctcagccctaaaggacattccagacttgaaacccactgccactgtagataaaattctctctttacatctatgtctttttatggattagtggaactaattgagaataatgaacatatcagaataattcccagtaatctgtggtactgacatggaagctaattgttacaggctgaattatgttcctcccaactccatatgttgaagacctaacccctagtacctcagaatgtgactgcatttggagacagggtgatcaagtgaaaatgaggctgtcaggtgggtcctactgtaatctgactggtgttcacattaaaggaaatctggacacacagagatcccagggttgtgcacacacagagatgaaacatgtgaagatgcagtgagaaggtggccgtgggcaagcccaggagagaggcctcagaagaaatcaaccttactgacaccttgaccgtggactgctagcatccagatctatgagaaaattcattgctgttttttgtttgtttgtttgtttgtttttgagaaggagtcttgctctgtctccaggctgaagtgcagtgatgtgatctcagctcactgcaacctctgcctcccggattcaagcgatttgattctcctgtctcagcctcccaaggagctgggactacaggtgctcaccaccacgcccagctattttttgtatttttagtagagacagggtttcaccatgttggccaggctggtctcagtctatcgaccttgtgatctgactgcctcagcctccaaaagtgctgggattacaggcatgaggcaccgtgcccagcccatttctgttatttaagccacccagtctgtggtattttcttatgacagtcctagaaaactaatacattatttgaaaatgaactcaacccttctgttaaaagaaaaaaatctgaaatcaagaaggcctgccttcatgcaccgaatagacaagcaatggctttatactggcttccagacagggcaccacagaggccaggtcctcatggggttctgccagccacgtgctgcctgcattgacatcagtgggggtcggaatggtcaacccatcaagccttcacttttgatttcactctcatcttggagactaaatccacttatgaataaaaagcaccatccccttgcagacaaagattacatttgaccatttgcttcatacacaacaacaacaaaaaaaatccattggcatagagagggctgtctgtcatgtgtatttaccaagaatgatttctctttttcaagcactgttaacattaattatgatgaacatctggtagagaatatcttcatgaaattagtgtttataattctttcctcagcttttatcttgagttaatattagacatgaatatggaaagaacattgatttagttcctaataaaaagggctaccaaaatactactctgccaagtttgtcccaataaaatccatgccattgagaaaattttgtttgtagaaaattagtatttatttttcccttttataaattaatgaggattatacaacttatttttccttctaaatgtatcctcttggatctcaaagctaagcacatttttaaaatataattgttatcctcagcctagatatcgggtgtatgtctctccctcaccactacatttcatttgaccttcagtatttaaaccaacaaatgtaccaaactttgcttttcccccataagcttcttcaaattcttagctggaattaggacatagatgataattcagaattatcctttttagaaaataagataacttcattaaggagagtagttcttcactgagggcatttttgccctccagggaacatttgataatatccgaagacatttttcagttatcataatggagtggggatgagcactgatggccagggatgtgctaaacattgtacatcatgcagcacatcccttcccaaaaccaagtattaaccagctcaaaatgccaatagtgccaaggctgaggagccctggcatggagtgagcagattggaaacatcagaataatttggtatggccctagtcaaacattcagtgtttgaggatggaaaaacctatattgatctctaacttttcctttgttatactttctcattccagagaaacaattgttcaatacaatctgtgcgtttcatagatattcttggtttcctttgtctgagtattagtggcagaatttcttcagctctcctaaaaatacgtttaaagttactaacagcaccattacacaaactcgttttaatgattagaaatagcttagtaagccacaggcagcttactaaacaatctcagtccatttcttactttatttttgtctgactttccatggtcccaagagttacagcacatcctttctgtccattatctctgacagtaagcctaactcctaccttaagtaaggttgagtgaagatgttacacttaggccaggaagccccagggtgttgggttaatgcgaaatcctaaaatgcaccactgaccatggttattagatttgcatcttgagtaacaaagttctgtaaaaatctcaccaatgtgcagtcttctatcctcttccttgtttctaattcacagactgtaaatgtcaatctgttttgtatacctgcattatccgtctgaaccagtctcactatcagaaggattcaatatggacattctttgtatttaatctagtttattggaaaaaagttaaagtcaaaaaccacctcatattaaataaaaacgagacaaagaaatggcatgctttagaaagaaatagcatgaatgaaagggtcaaaaagtgaaagaaccatgatatacaagagaagaaggaaaaaaagtagttggagaaaacaataaaattttgcagacggatatattacaacagacagaacaaggtaattcagagagctctgggtgggatgcagaatcctttgcttctcttttctccttaactggcaaaatggccttggccaagtcacctctctggacctgcaaaagaggacttatcttgaatgatctggcttcaagtccttctaagcagtaaatccctagttgtatccatgccttgggttggctactgagaaactcaaggatcacacactgaaataggcaggctgtcaaatacaagtcgaatacaggagaaagtgaagaacagtgttttaaaagggtgatcgggaggtctcccaaaagaggtcacctcttcctctggaagtatgcaagaggtggcggtcaagggagaggaagggaggctcaagcattcaatagagccttaattctccagtgggagatgaatgagaaaaatatcccctgtgcacacctgttctttccaaggtgaatgggaaagagtacaggcagagagggtggcctactttccattcttcaaacatgaaaagcttgtgctcgccttgaggcttttgtacaaattgcttttttctacttgaactacttgatagggttgaccctgtcctttcattcaggtttctactccatatcacctcctcagaaaggcattccctacccatccaatctaaagtaactgacaatccacagtaaccacctgcactctttagacctcacctattttctctgtctgctcaagtcttttgtcagcatatctcattttgatttttgtctttatacatttgatgatcagtcttcctcctctacagtgtaaattccatgagatcaggggtcccttaggttttgttcattgctctattccctgctcccagcacagtaaaattcaacaaatattgaaagaattttttaaaaaatatttttcattcataagcaaatttttcatatgcaaaataaaatttgcatgtggaaagatctagaagacagaaaatgaaaacaaagtaagttaagaacagatagagtcttttggggacatctctaagacttagaaaaaaaaacaagtcttgatcctgcaggtcaagtgaaaacctgaagggtcacagaagaataaacacatgagctgaaaagagcaacattgcggagcgatttatgttttcaaactactcagtcctgatgtctaggaccttacagctccaaatctcaaaaaatgggattcatcacaaagcaaggacacagtgagcagagatggagtcaacaccttttcacaaaatttaacaatcatcatcgatatgcacagccttcatgtgtagtgtatgctcccagctacagctgtagttacccaatctcaaagcaagtaaacagcaagattccacactagctcttaactggccaagctatatttctataactagaattgctatttgtggatttccataagttataataacacgataagaccactttatccatgtattctagtgactttttcttcctatagcaaaaagaaaaatacatctttcaccatttacaagtacaaatttcaaggagaaattttaaaaggagagtaacaaactgtcctgagttgcagcaagactcctgagagttccatttcctgggccctctgctgcctgtttttggcattgaacccaggaatcttttctaaagcacacagaaatcttgcaaaagaggccatttctagttaggcttttgtccaactgtctagttaaataaattaaattcttagattacaaaatgtgcttcaaaggtttaacaaattgaaatgtccttaagtatttcaaataaattaaggaagaattcccattcccatagtcttctactttcctcttccacacctatgatgaatgtcctgaaaagaataaacccaggtaaatttttggcgagtaattgttttaaatgatgacaaaacttagttgcatcatggtaatcatttcttttgcttattgggtagcattaagtacaaaccttagtttgtaaaactatatgttttactctcttaatattttaaacctcaactatcttaataggaattgttactatgttgttttcttaggtttagagaggcaaattgattgctgatcaatcattaattgactattgggctaatataaaactaatatttttctcttaaataataatggcatcttttcacattgcatgccttaaaacccttacctgagaatacatcctggtgaaagtaaaatgttattcctcacatacagcaactgtgtaaagtgtggtgcaattatctgatttgccagcagtggacactgttactctagttatcaccatcgagtaactagagaaaagcctgtttagtgtctcaggaaatgccttctccttattcccttagacagagcagaagcctgtaacataggcaactattctggaaaaacaacaaaataaattctagaaaaaaaatactagtgttattcttgaacatgaaaatattattaagaaataatttttcacagttaaaaatttagtactcatttgattttgtctttttaatttatggaacagatctattagctgcagaatgtccaatcatcatcattctccagtgtatcttatgcatctgcaaattatatctctctgagaaaacactgacaatcagtgaaagaaacaaactgagctaaaaagcagtggtccgcatcagttctggcttcctaggaactagttctgcaattctgggcagattatcattttactctgatcttagtcatctcctgtctgtaaaagaagtagctaaactagaaaatggccaagaactcctacactggtgtctgtgtttctatgactctctcaggatagactagagctaaaagcctttgcttcacttgtataatcaggtaaggtgttaattgtttaatctctagccagaaaataactatataaaacagctcttccttccttaatgaggccagaagcataggcttcagccctcagggttggcattatggaaatcaatcggcagagctaatgaaaaccaggcagtgggctcaaaatagaacccctcttaatccccactttctgccctgcacagcagggggcctcagcttcccatagccatggtgtttactttgtgtcaagcaagtattagtattaatcccattttagagatgaggaaactgaagtacagaatgctaataactagtccatggataacaactagtaaatgtaggatctgaatcttgtaactaggcagtctagctggaaagcctatactcttgaaactactaggttcactcttccgggttccatactgactctcagtataatactctcctgttttagacttaaccgtgtgtctgctaccatctactagattgtgaattgcttcagagtagaaaaccagagaggcatggtcgaaagacatggatataaaccagtggttctcaactccaagtgattgccacccccaggggtaatttggcaaaatctaaagacagtttttgttgtcacaagggggaagaggtgttactgacatctagttggtagaagccagagatgctgctaaacattctacaaggctcaagacagcccctcacaacaaagtattatccaggtctaaacatcaattgttgcaggggttgagaaaagctgctgtagaataagagaagctgggtttgaaccccgactctgccacttacccgctgcatgcattcagacacttgcacaaactccgtaagcctctcaatctcctcccttaaaaatggcaaaaggctgggtgcagtggctcacgcctgtaatcccagcactttgggaggccgagacaggcggatcacctgagttcaggagtttgagaccagcctgaccaacatggagaatccctgtctctacttaaaaaaaaaaaaaaatatatatatatatatattcacaaaattagccaggtgtggtggcgcatgcctgtaatcccaggtactggggaggctgaggcaggagaatcacttgaacccaggaggcggggttgtggtgagccgagatagcaccattgcactccagcctgggcaagagtgaaactccgtctcaaaaaaaaaaaaaaaacaaaaaaaaaacatggtaaaaaacaaaaccactttcagcagacaattatggttgtgaggtggattaaatgcttttagactgtgaagttgtctgcatattttcaaagacagtgccatactgcagaaagagcagaagttttatggccaaagaggcatgaatacttaaactttccaagcccagttttctttatctattagaaaagaggaatggatagggaatttctactttatggtcttcctcaggattaaatgaagtaatgcaaagattatatcattgtaatgtttgtcacagaacacatccctaaaagtgattatttctgtcctccaaagtatttacatattatttttttcttttggtcaatcttgtatgcaaactccactctctgcaaacaacattccttccttcccaaaccaaatccaattgtgttctattatctaaaactttatttattaaaacagatgtcaggttagatctgacttgagggtcatagtttgccaatccctgagttggactatcaaatacgtattaaagattaaaacttaattacaatattaaagctcactatttatacccatgttcattgcagtattattcataatagccaaaacgtgggagcaacccaaatgtccataaaagatgaatggataaacaaaatgtagtatacacaggcaaatcaatattactcagccctagaaagaaaggaaattctgactcatgctacagcatgaatgaactttgaggacattatgctaagtggaataagccagtcacaatagaacaaatattgaatgattccccctttataaggtacctaacatagccaaattgataggtacagacagtagtatggtggttgccagaggatggagtggggagggagtggagagtaagtgtttaatgggttcagagttttggttttgcaacatgaagaaaagttctagagatgaatggctgtgatggttgcaagacaatgtgaatgtacttagcatcataaaactgtacacttaaaaatggttacaggccaggcgcggtggctcacgcctgtaatcccagcgctttgggaggccgaggcagcaggtggatcacctgaggtcaggtgttcgagaccagcgtgaccaacatggagaaaccccatctctactaaaaatacaaaattatctgggtgtggtggcgcatgactgtaatcccagctacttgggaggctgaggcaggagaatcacttgaaccccacaggcggaggttgcagtgagccaagatcgtgccattgcactccagcctgggcaacaagagtgaaactccatcccaaaaaaataatggttacaatattaaattatgcatgttttaacacaattttaagaaaaaaataattgaataaaagggcaaaaaataatccaaacacgtaagtcttcacttgctctactcctgttgtattttatatgaactgttagaacagttagccatacacaattgctgctggagttgggggagacctctatcttggcagggatgctggtggaccgtggcaagaggctgaacctctgggcctgcacctcggcctgataaagcaactcttgtgtctgctactgccctcccatggtcaccccatattacaaacactgcctcagcagcctgtttcccttctgccttccttctgtctgcactcccacaaaaccagggacagcatcctcatccctacctcccactgcattagcagtgggtattcctgacctgccaaagcccaggcagctctgctgctgtgacacggcacacttttcaacacggggaggaaatggaaggatgcagtgtttaacgcccacggagcattatggcactgttgccctccatggtggcatgggcaagatgacctttaattgacctcaagtctcattctcttatttatagactgttttatacgtgggtcactagggaatttattctgtctcccatccctacactctgaatcatcgtgaagccttaatcaattcttaatcaaaaatcaattctttcatttttttcagtctctaagaaagaattctcatttcccttattcaaactaatatccatgctaatcttttataccttggatttaaagtcaccttgggttggggcaacagggttctcactcgtgtttaagatctccttatttcagcctcatacgatcaaagggcagtcttccccttttctctttcaccctcaggactcccatgccttggagctgactcttccaggcagtttccacagatctgcagtcctgctctgccactgtctctctgttgtccccacatctacccaacgtcctgttgtattgcccttctgatttcatttaataaaagcagctgcttctccatcaaaaaaaaaaaaaaaaaaaaagaggctgagtcccaagtccccctctagcagtttggatgttttttgataacagaaattccaaatcaaactgtcttaaacaataagaaaatgtattatttaacatgtagtaactccaaaggcaatgcagtccatatggttgatccagtagttccactatgttctcaaatatcacccttctggtctgtccatttccctgttctgccatctgtggagttagtttttcctcctcaggctaacagtaaaatgactacagcaacttctggcaccatgaacagttgctgtaacatccaggaggaaaacagattgtctctcacagggactactttttaagaatacaaactcttttctccaaagtcctccaagttcactgtccaggactaggtcacaaggctgatgttaagtctgtcactggtggattacattagataaattcaatggaggcttgtttctggatttgggaggtaggatcatttcatgaggcacttggctgcctgattttaatagtttttataatattgaacccagtgaggttattatatttttatatctagaggaagaactctttagtgccccgagtttttatccacttaatgctgagattctctgataatgcaatcctaaagataaatttttctttaacatgagttgtttctgacatttctcaaaagaagacatacaagtggctaggaaacttatgaaaaaaatgctcattatcactatcagagaaatgcaaatcaagaccacaatgagataccatctcactccagtcagaactattattaaaaagtcaacaaataacagatgttggcgaggctgcagagcaaaaggaatgcttatacactgttggtgggaatataaattagttcagccactgtggaaagcagcttggcgatttctctaagaacttaaaacagatctaccatttgacacaacaatcccattactgagtatacacccaaaggaaaataaattgttctatgaaaaagacacatgcatttgtatgttcatcacagtgctattcacagtagcaaagacatggaataaaatgtaggtgcccatcaataatggattggattagaaaaaaatgtgatacatatataccatggaatactatacagccataaaaaagaatgaaatcatgtcctttgcagcaacatggatgcagctagaggccattattctaagtgaattaatgcaagagcagaaaaccaaataccacatgtcttcacctataagtgggagctaaccattgagtacacatgggcaaaaagatgggaacaacacacagtggggactactagagggggtagggagggatcatggattgaaaagctacctactgggtactcttcccactacataggtgacaggatccataccccaaacctcagcatcattcaatgtactcatgtaacaaacctgtacatgtaccccttatgtctaaaataaaatttgaagaaaaaaattgttgtttccaaaaattaaagcaatatgtaagaagcaataataatatgtagaacaatttaatggtagaaacaagacttttaaaaacagaccaattctttcaggacaaataaagaatattgattcaaataaaatttaaagtttcatgttttaaagaaagaaaaactttgctgagaggtgatggtatccaagcaggccatttgaatggatttctactaccattttgtcttttgtcaattcttagcgttgtagtcaaaagatgttttcgatatgctaaaacttagcaatggtacatagtaaatgctaaggtgaagcaaagacatttggtcatatctttgtagggcatattatatgttacttttggagtttattttttattagtagcaattagtcatccacatgtattttgaaatagctcaggtttccttgcccaatatatagcatgccaaatgcaaattcagaattatgttgttaaagaattctataggaaccactgaaaagacagaagagaaagagggagatagaagagggaatagatgtggttgaaataggtatactacacatatgtaacaaacctgcacgttgtgcacatgtaccctagaacttaaagtataataaaaaaatatatatatatatatataaagaaacaagtatactacattttcactatgggaagagcagacttctaggcttctctaaagaagtcagcttaatcacaaatgcaaatattaaaatgagctcattcgtaatgatagtaaatgggttcccaacacataagcttcccaatacataatgcttcccaatacataagcttcccaatacataatgacaaagaagcaaaaatgagtggtaaataaaaaggtttttttaattatgaaaaaagaacaaataaaaaggaagtttggcacagaatgttaacatttgccaaagttttttaaaataaatacaatcatcaaacgtttttagaataggggaaatgctagctcaactttgccttgaattttttaaatacaaacataatcttcctgcaattttgcaaaagtttttttttctgtcttattttttaaaatcactgttccatactcttaagcccaattcaagtgactatgatggtctcatttgtacgaatttgaaggtttggagaaaatattgatttcctatctcttttccagttgtatgggtgtgttgggggctggggagatgggcagcaacaggaactgggtgatgaactacaagataatggcacaaaccgctttcaccagtggtttgtccattttacgtttaggttaatatttctaaatatgtgcctcggttttctctctatgaaatggtcaataaactgcattttgtggagattgaaatctgaccaaaatcgaaaaggtggcccaatatttgtccctaccgggaacctttcctggtaataactcaaaattctgtcctactttctaatgcgatcactgcccagtgtggacttccatggtgacacagttctgatgactactgcttggagtcctttctgtctagaaagttgctttcctattcttcctgagtgcttctcacagctgcttggctgcggaactgcagaaacctgaggggctgaacgagtggttctttggagccactggggtactatttagtaaatggatgccatttgcagataccattaatttggtaagtgctgaaaagtaaacagaaaagaaattcagtaaaggcacattggttcttagacatgcatgccctttagttactgtactatggggatttaagagggctcatgcatattcccaaatgcctatattttccccagaaagatgttaactcactgaaaaagagctaaagaagagttagtaaaatatttcaaattgcttgctgtgggatacactaagttttcaccaagcagcattgcatccatttttgttgagagaacctcaatctcattcattgtggcaatatgctcaactccagggaatgaaacacagctgctctaagccaaccatggctaacccacttcccttttctagaaattcatttcccctgctttccttgaagatatgtgtagctattggacccagttgctttttaaagggaggtcttgggcaggtggcaggaagtagggtgtggtaggagaggtgatgaggcaagttttctttttctttttctttttttttcattttcctccttgataaactgacaatccatttctgtctggcctctttctgtatgggacatccttataagcaagagatgctcagagctatggaagtcatcttgtacctaccagatgcccaataagaacagaaaagcctgggtttctaagtcattaaagagccactcaacgagtctataatgacctctctccagacattccaagttacacaaagaatgaaaaacccaacataaatttctaaactaagctactagtagttggctactctgttacatgtagctgaatgtatcctaattgatacgcttaggtattttctaggtatgaataaaaagcaacattagttatccttaactcaggacctccatggacagctatacatgattgtgttgatttgtgttattttaatcttcttcattagttagtaaagtccttagtgatagaaagcatgccttttactgtcttttaatatcctgtctctaaacatgacacctagagtgagatgcttcagaaatactcaattaaaatttgcataactgtcaactcagtaatgtcaaacaacttaggatcactgaaaccagcctctcaaagatatctgtttgtgtagtcacaacttcaaaatgccttttcgttcaaagggaaaagctagttaagccaggcctttgctctcagcaggttttgcatttgaatgccaaatttaaaaatgtgatcatcctattaaacagaaaacctaatcatgtttttttttttttttttttgtctttaaggagttttcaagctaataggagaagaacaggtttgcagagttaaaaagaaaatggtagttcaagtggtcaaattaaaaaatggcaagataccacaaacaaaaaggggttactttttcctgaaatgcttacttactctttaaagaaaagtgttggaaagtgctccaaagagcaggtaggtttttggtacgtaaaactactagtagcttagtttagaaatctctgttgggtttttggtttttgggttaatgtggggtgaataatgagaattctaactaaagaaaatagctagagctacagcatggatttttggtgaaatttatactacaaaagtaatgcagtcagataaatggctatttgacatcatatcattgaagattctataaatcaggctaagaacgttgtcctttattaaggaacaaacatggaaaattgcctaaggtttgtaatcaaagaatgatgttcatatgatttgatgcatgttgtagaaggttgcactatgaaagaggtattattagcaatacgggcacaagttcagaggttttaccagtctaagagggtgatgaaagtctaagcatagagcatggcagtggaaagaggaagagaaataatttaatccctttattttttttcagttttctagaaccaattataatctgtaaattggacaattttaggaattttattaagaagcaagtcattgattatattaaatagattctagaagtttggaaacattaaggaacatggtaaaagaattagactcaaattatatttcccaagaaaattaatattccttgtttctttaaaagggatgaatttcaacattatttgtcttgtttatgactacttgagcttgttgattttcaaactagttgatttcaagccttcagattcaccaatttagaatctgatgtcattctcaaataataaacaggattttcacaagaattccaaattggaatctaattaataattatgtggccatgtcctcacagcatacagtgcagcagcatcatcatttatcattcttatggttaataataacattaataaaccagaccatcctcttttcaatccttaaatttgttaatactggaaggagaatactacatcatattcaatttcttggaatcacctatcaaatatttgagtatggccaatatatcaactctagtgtttacagaattttccaatcatattaacaaaatgaccccattgtgtttaatactttgtgctttataaatgtgatacaatttatttaattaaacccagtcaacatttgtcaagtgcctactattttaaatgctggaagatattttgttcatatttttttttcattttgtctttgaaataagcatccaaactatgcattattatcccacttcatagataagaatatgaaggataagaagatgacttgtctacaatcttgcaagagtacagtaggtcttggaaaggattccaagtctttccactgcaaattcaaggctggcttgtttaccatacactatgatcatcagaagtttccctttgttatacggcatgaagttacattttaaaatgaggacttctctagatcctgtttttcttttacacctgtcttcataactgcttctttgtccgtttttggctacttttttttttttctgtctttattgtctgaaagaaaaaaagtcccaagcaaaaaatgttttgtctgaggtgattagtttgttgcataagaataataaatctgaatgatgaaacgacacaattggcaaaaataactttcctgtggctgtttccataggtagttaagggcatcacatcaagtacctgccttcatagagctctttttttccctgacatggcaaagaacaggcaaatatcacctatcaaagaaacctggcaccaaaataaacttcatctggactattcctaaaccacttctgatgaatggatcaacataaaagttaaaaaatgtcttggaggtcaggtgtggtggcccacgcctttaatcccagcactttaggaggccaaggcaggcggattacctgaagtcaggagtttgagactagcctgaccaacatggtgaaactccgtctctactaaaaatacaaaaaaaattagctgggcatggtggtaggcgcctgtgatcctagctactcaggagactgaggctggagaattgctcgaacccgggaggtagaggttgcagtgagccaagattgcaccactgcactccaacctgggtgacaagagtgagactccatctctaaataaataaataaactgtcttggaaagttgtgtagatagcccattttttaccctccctctactatttggccagagttgctttattactttacaatctcagaagcgtcaacagttgttctatgtcattttgagaagtttgtcaacatctcagtcctaccttcacctgttctgtttgcacagactgaaaaccatcttttcttcaggttcatctgtgcaccaacggttttatattcttctgacttttttctgtttatcttttcctttttaattaattccaccacctgcacacagttgtcaactctctctactcagctgaacaccctgagtgtttaacccagcaggggatctgggagctgttctgctaggacagagatgaacaaatgtggcagcaaagtgataggtggcttctggactcgaacccaatgtcatattcactcctggaccactcttctctaaaggttctttctactgcttgaaatgttacttggtcaactgctacctttctgtatgtgtatatatatatgtgtgtgtgtgtatatatatatatatataatttttattttttttttttgagatggagttttgctcttgttgcccaggctggagtacaatggcgcaatcttggctcactgcaacctctgcctccccggttcaagcgattctcctgcctcagcctcccaagtagctgggattacaggcacgtgccaacacggctggctaattttgtatttttagtagagacggggtttcaccatgttgatcaggctggtcatgaactcctgacctcaggtgatccacccacctcggcctctcaaagtgctggggttacaggagtgagtcaccgtgcccggccagctttctagatttttaccaacctattactacaaattttagatcaaagcatccatcaccctctgtctatgtctcaacaaaaaagattaattgaagttgagggaataactagagattgcttgaacattgtctgcagtctaaagtttctttcattacagcactgtgggcttgacagaaaactgtccttctaaatttttgaagaagcaggtaaaagcaaggtcggattaggttttactgctccatggtcagtgttgagaacattcccatagaactaaatgcgtcaactaatcaccagagaagccgagatgtcagactcaactctgtaacgtcaaaaaacctgaccaggcgtgaccttgacttgttctgttcagtaaaattagtccctgaagagttatggagcatcaacaatgtatgaggcactgggcggggtgggggggtggtaactgaatttgatgcaataactagagcctgctcaaataatgtccctggtctaaagttttatttcattgtagcactatgggcttgagagaagacaggccctcttctaaatttttgaagaaacacgtaaaagcaaggccatgttaggatttactgcccaatggtcagtattgagaacattcctttatgcttgcaagaagttaaaaataaagatctgagacacattatggttttcatccttctgttggttgttaacctctttcttcaataaaaggctaagggaaagtccaatatataaaacctgtgtaggctgagctatgctcccatggcccctgagggcactcggcagaagacagttctgaattcactgaaagtgtgtgtgtgtgtgtgtgtgtgcttgtgcacgagtgtgtgcacatgcacagccataagataagcaaacattagaggtaacaaaatagcagtataagttctagcagctatgagaattcagagactgaaggaaatcagtattggaagtggctgttaaacatctcagctaacagatttagcctggaggagagtgtcttagtcaggaggaatagatgaaataatatggtctctatggactaataatcccccattctccaacttaaatctgaaatgaagactatttccaaaataaaaattagacagaaactcttgctggggcttttaccaactgttaggttgtttttggttcttttatttgaacaaagctgccacctgtactgaggcctctaactcttgaatagtgtggatgggcgcattcccagctggagactgtacgtagatctagcaagccagaatgagctatgatcactgcagcctgaacactttcattttagttgtctgaaaattttagcaatacaccaaagttgttttctaaatggaactcagttttcaggaatctctttgaactagtaggcaatttcctttaaatcgttctacactgcaattgggtttagcttctaatgtggcttcaatgattctcacaaccagcaggcctcctgccttcatgagtggggcaatgatttgtggcttgtgtcagccatggaaaagctggtttcttgtgaaagtacaaagggacacaatttgtgatgcaaggaaacaagctcacaaagacataaaaattagctttccacatgatttattctactgcttcatgtcaataaaatgggaaaatggtttaaaaatattataaaatgcataggtaggtaggtgtcaaagttatagatgacagcattggatgtgcgtgacacgccaccttcacatgcaagtctcctgaggggaagggtgagacatgagtgtccaatactgaccagaaactatgtggacagctgatttcaatggtattccctatggtaaaattactatggtaacatttatgtttcttaacagattgatctggaatcaagacctttgctccaacataaaagggaagagacacttgatgaagaaagcagttccatggataatccaagagagctatttaccatccaagttaccttttcttcattaaccgaattttttaaaagataaatctcagatgggtacataaaccaaagacaattgctgcctcgtgttacctagacaaagcagaggggcaagaaacaagtcccacgttttcactttcacttttcatttaagtatttggcaagttggttcactggtgaagactcagagagaaatataaggaagaaacaaagtggtctataaaaatattgtcacttcatcatctcaaaatatttcctgcaacctctgcaactctctgaggaagcaagtcaattctactagtttcccaggcatgaggcatgctgcatgaaaaatctctacccaagtaaagaaaatggcccattggttcacatattcatgtgataaattgcactgttaatatgaatattaaactttagatagatagatacagatacagatagacggataacatctctctttacataaaacacacttgacattgcgtattatcatgtaactcctctccaattttagattacactatcgtattatagtggtgaataatttttaagtcaaatagaaaaatacctgaatttgcccaacatctatattaggaaatgatcattccatgaggtgaaatatacaaggcctggaatgtatcgggagactggtagtttattgctggcttcctcactctctggctagattctctggaaaaatttgtcttagttctgagcctcggttctcaacaatatacaaacaacaataacgatggacctaaatatctgctggggttaatgaggtaaaaatataatatccacaagctatttaagtagtaacatatcatatagaataacttttataactaaggtttgatttgcaaaaggagtcacagttggtggtctttaaatgcaaagctccctatcttcagatattattcactttaccaaaaaaaaaaaaaaagaaaaagtaaaagtatttactgaaaatcttcaagactataaagaaatgtggctgagatgctcccaggaaagaagaaaaagagacgtccttcctttgtttttgtttttttctctctctctttcttatgtatagatttcattatttcattttagaggtagaaaattaaactcttactaccatgacacatttaattgagagaataatgagaccatagctaaatataatcaatatattcaagataatgtatagaaatttaatcaagaatctgcttcatgaatgcagatgctttccaggatataaagatactgaacttcaaggagggcctatcttcccagtgtttcactccagcaactcaaatttgcattgagatatgtgaagtataatacaaaacagaatatacaatacagatatatgaatcaacatcccttgaatgctgcacttttcttgtctaatttccaaacttcggtgtgtttctttcagtgtaaagtaaaaaagtaagtaaatttactaaggcttttcttttggggcaagaaaagcaggtgagagtagaagaaaggaataaagagacactatatatgttagacaaagaggaataagacgaagaaaatacagaaccttaggagaaactgaaccagagctcacagagtattgaatagtcagcaaactaagtaaatgcaaagacaaacagctttgctattcaaagtatggtccccagaccaacagcattgccattggtcagtaacttgttagaaacacaaattctcgatcttgttcaacccaccaaatcagactccccattttaacaagctttccaagtgactcatatgcatattagtatttgagcagatctaactcagagtcatccattttggcctattatgattagagctcatcttttccatccaccctaatttctcataaccagaaaatcatttcccataggcaatctttatccatttacacaggcctactatttgcaaacacatatgagactcaactctagaggatgtgtggcatgacttaaggaaaccattgtcactctcttaatccacgttatatatgatcacatgtgtgttcaaaggcagttacttcttatccatctgactatgacaagaaaaaaaaattggtgaagaacatggaatgaaagggccaaatgggtccaaaataatgaactaaaatagagtaaataaatatagtaaatagtataggaaaataacgatttaaaatataataaaatgtactataaattacagtaaataaaacacattgtctatggcaaacgtgttaacatctgtaaacaactttcacctgaatacctaattgttggaagtgatgccttcctcctactcagctttcagagaacttgagagctttcctaaactcagagagcttctctaaagcatgttctgtgtctgtgaggttggcaatttataaaggaaggtgtttctattcctccagaagcaatgctctgaatgaccttggacagaagttaaccaaaagtgacccatgattggcagcttccagtgttggcagggaatctgaagatgttaagcatgtaggagtgccagcccctggcaaaattgtgaactcatttcatcactcctttactttcctttacttcctcctgtcccacttatgagtccaaagcccttgcacatcctcctggaccccagtggtcctgctctccattcagtctggtttaggcctccttgcttttctgaactgttgcaatggctctcctggcttgtgttctctctacactccacttgctgctcttcaaagcacaataaagtcagaaggtattaattcttatctcacaagtcttcgactctgactacatatagaatactactataagtcttgacagagaaaaaaagagcatccctgtcatttagaagccagcctcacactcagatattctcttgtgtataaacaatctcagaacatatgcacctcagataaaagtcactctgagaccataacaaagtgagacaaagcaagggtattttataacgttgcctaagcaatgacaaaatcaaggtcactgcgcctccaccaaaataccaaacatcccctcttggcataacataagcaattgctatggctttatcaattgcatttctatcctcaatgtagtcactcctccctatggataagacttattgagatacacaatcagagatttgccattactctctgacagcattcagaacacacctccccaccccttagaccaccctgaaattacccaagcaaaccttcaatcttctaatgcagcagatgacttcaggatgactgtttcactgcagatcatcaggcattatctagattctcataaggagtgcacaacctagatccctcgcatgcacagttcacaatagggttagtgttctatgagaatcttgtgccaccctgatctgacaggaggtggagctccggcggtcatgctcctcagccaccactcacttcctgctgtgcagcttggttactaacaggccatcagggttggaacctctgctctaatagtttccttctagcaccctcctaccgagataccccacagttgcccatggtgtgtgttctctctcgctgcaatgtgtagtaacaaaatttgtttaactacaggtatattactggtggtctttgggtgaaaagcattaacaattcagtgtcatcttgaatgccctccctgactttgtttcacaactttcagtcgcatatttgtttcattaaactacttgtatttcctcaacatgcactgtattttcacaatgctgcacgtgctgagctgttattccaacttggagtttctttcctctgactcccagctactgaaaccctgttcacctttcaaagctcaggttaaattccacaagcaaatttctctgatttctctggtcaaagcctattactttcttctgagtgttttgttcatactctatttgacatttactttatttgatcttgcactatagtgatttgtattcttctttacttcttcactcgctatagaagctccatgagaattccagtcatgcttcatccatcctctcctttctgtggtgattgcctggtctctgctcggtatataacacaattttaataaatatttgctaaattgaatctggagatgaagtctaaaactgctcagttaaagttgaaaactttgagaggtgtctgtaaattaatttaataatctcagcttaaccatttaaagcttttcatctatgttatagtaacgaacatatttattgaataaaatgtcaaattatcaaactgtttgttgactaacacaaatcagtttcacttgcctcaacctgaatatttttattattttcaattcagcaattactaaaagtggtattaagcatataagctggccttgagaattttctttaaataaatgtttactttgtctcctttcttaattaagttctgggacatatgggcagtgtgcgcatgtttgttacataggtaaacatgtcctatggtggtttgctgcacctataatccatcacctaggtattaagcccagcatgcattagctatttttcctgatgctctccctcccccagcatactccacctgacaggccccaatgtgtgatctgttcctctccatgtgtccacatgttctcattgttcagcacccacttataagtgaaaacatgtggtgtttggttttctgctgaggataatggcttctagctccatccatgtccctgcaaaggacatgatcccattcctttttatggctgcaaagttttccatagtgtatatgtaccacattttctttatctagtccatcactgatgggcatttaggttgattccatgcctttgctattgtgaatagggctgcaatgaacatacacgtatatatatctttacaatagaatgatttatagtccttcgggtgtatatccagtaatgggattgccaggtcaaacggtatttctggttctaggtctttggggaatcaccacactgtcttctacaatggttgaactaatgtacattcccaccaacagggtaaaagtattcctatttctcctcagcattgtcagcatctgctgtttcttgactttttaataatcgtcattctgactggagtgagatggtatctcattgtggttttgatttgcatttctttaatgatcgttgatgtttagctttttttcataggtttgttggcaggataaatgtcttcttttgagaagtgtctgttcatatcttttgcccattttttaatgggatttttttgtagtaaatttgtttaagttccttgtacattctggatattagacttttgtcaggtggataaattgcaaaagctctctcccattctgtaggttgtatattcactctgatgacagtttctttcactgtgcagaagctcttaagtttaactagatcccatgtgtcaattttttgcttttgttgccattgctttcaacattttcatcatgaaatctttgtccatgcatatgtcctgaatggtactgcctagattttcttctagggtttttatagttttgggttttgcatttaagtctttaaaccatcttgaggtaatttttgtaatacatgtaaggaagaggtccagtttcaattttctgcaaaagtctagtcaattttcccagaaccatttattagatagggaattctttccccattgcttgtttttgtcaggcttgttgaagatcaggtggttgtaggtgtctggtcttatttctgagttctctattctgttccattggtctgtgatatgctttggctctgtccccacccaaatctcatcttgtagttctcataatacccatatgttatgggagcaacctggtgggagctaattgaatcatggggacggttacctccatgctgttctcatgatagtgaatgaggtgtcaggagatctaatggttttatgagggccttttccccttttgctcagcacttctccttgctgccaccatgtgaagaaggatgtgtttgcttccccttctggaatcattataagtttcctgaggcctccccagtcctgtgaaactgtgagtcaattaaacctctttcctttataaattatccagtctcaagtatttcttcatagcagtgtgagaatggactaatacagtctatgtatctggtttttgtaccagtactatgctgttttggttactgtagcctcatagtatggtttgaagttgggtagtgtgatgcctccagctttgttctatttgcttaggattgtcttgtttatacaggcttttttttggctccatatgaattttaaaataatggttttaattctgtgaagaatgtcaatggtagtttaatgggtatagcattgaatctataaattactttgggcattatggccattttcaagatattgattcttactaaccatgagcatgaaatgtttttacatttgtgtcctctctgatttccttgagcagtggtttgttgctctccttgaagaggtgcttcacttcccttgctagatgtattcctaggtatttgattctctttgtagcaattgtgaatgggagttcattcatgatttgactctctgtttgtctgttgttggtgtataggaatgcttatgatttttgcacattgattttgtatcctgtctctcttttcttaatcagattataattttgatataatattaggaaatgtaaactgaattaataggtcctaataacccatagaatgactaaagttgtgatcaaaaccaaaggcactcaagggaatatcagaaaaaaaacactattgaaaaatagacataagataatttgtcataaagccatttaggataaaataaagttcattttcactgaaattgtaaaataaattatacagaactctactacactttatgaatagcttcagttaaattttttatattttgaatataaaatttgtgataacttcatgacagttgtatgcaacatgtttatttttatacatgtattgtttggagactaaatagcacaataatttagagtactgcatccagcttgctgctccgtttccctatctgaaaagcagtggtgataagagcccctaactttgtcctttgccgtgaagattaagtgaataaatgtaaactgcttgcacctgcaccttgcacatgggaagtggaattgagtgttaactgttattactatatttcatcttccgtagaactgccatagcttccttcctggctttctttctttggatatgatcatgcttcttccatttaaaatcattgaaagtctcccgttactggcaggatcaagttccatggcattctcatgccattcaatcctgttcactctcaactgctgacactcagcaaattttattttaatccaaatacttaaggagagaatgaaatgttggtttcttttctaaggaccattgctccaaccaacctacatctgacgattgcttcgtgttttcacacttgtgactcttctattctagaaatgttaattcccccattttatttatctagggagtgccccaccctttcttctttctttgttcaaatttcagttgttttggctgtattctctgactctactagatatactgagttgctccatttccttgattctccaccttctacatgcctccaaatggtccctctaattctgacatttgtggggcactcattcacccttttttccccctatgtcacaaactaatgctcattcccatccttaactgtgccccactctgccggaagttccttgtttttctaagatacagtagaaatcaaaatatgcaatagctcttcattttctacacataaatgcatgagctcctgaccatggctttcaaggatatccatgatatgaatgcatttatattctgtcacccttctgtatggataaacttgttagtagccatgttggtttcagtagcatcattgaactcattctgtgttcacaatgaattactttattattatccaacaaagatttaatcaacaaatactactttccatatactgtgttagtcatgggagatacagagacatttccagttgtagaaaatttgagattatgaggatttttaagtacttagtataaggcaggaatgtcataaattcaattttataggaaaacagtgtaatgtactcagacaagaggagttgaaacactttgtgtgaggaaagacaacatacatgtaataaaaagatataataataaatgctgaagtggttttcaaacatgatttatttttaaaccacaaagtcataagggaatttatcatgaaacatgaccatcttaaaaccacgattttctcagcaagatcactgaaggtaaaagttggatgtttggcttttgacatttatatacagtattgaataatcaagaaagttcatttcagttcaatgtattaaatatattaaattaagggtttcccctctgtggataaattattcctatcccaatgactttttagttgtaaagatttttttttaacctgggtatttaaaagttttcatgtattgtttgacaaacatatattatttatactaataaatgtgtatccccacaactggatacgaaatgcaaacaggttcctaaggatgatgtttaatgaaaacttgccaaacaggatttctgatctatgcattctgggagctgggtctatccagcccatgaagaacagcctgctttgcaagggctgaggacttcaatcctgtcttgtgacattgcctgacacccgtttttagagcctcatcattgtgatatcacacaacatgaacaaagaaatatgatgatataagccatcatccagagagtatcactgagcccagagaaagacttgagactcttccatgtgctggtggcccaaaaagtaccatgttaataataaaaataattactctttagatggcatcttctctgctatagttctccttcttttctagcaattaaagaatagtatttccctttccttttctactttcattttttttctttcttttcaatggcaagcttcataagccaatgtctatcttttattcaggatacaaatagttgtgcactttccctgatagagaaactcccaatagctatggttagctttctgttttcatatttagcacattctcattctggttctccttctggcttttgtgcatattatctccttcaaaaccttctcttttatggccaggcatagtgggtcatgcctgtaatcccagcactttgggagggcaaggcaggcaaaccacttgaggtcaggagttcaaaatccgcctggccaacatggggagacccccttgtctactaaaaatacagaaaaaaaaattagctgggcgaggtgggaggcacccgtaatcccagctactcgaggggctgaggcatgagaattgcttgaatccagcaggcagaggttgcagtcagccgagatcaagtcactgcactccagcctgggtgagagagcaagactgtctaaaaaaaaaaaaaaaacctcctcttgtggttaactacagagtgaagttattgcaaacgctacacatgccttcacaggtggtaagctgcacaaagatctccatgagtcaatgctatgtgaagaactgcatggcagaataacttcacagtctgctcacttactatataaaatgatgaaaaatttaaatgttgtcaaatttgaccaaacatcaaatataaaaaaaattcttatctgacttggagtttattttaaaaattttaataactaagggattaagaacaactgacagaatcatcagaggctctgcctttaagtcttgacaatttggcaaattttattttaatccaaatacttaaggagagaataaaacgttgttttccaggatctaatgttaggatgaatgtgagatcctaaaaaggattttgtgttagtttttttttttttgtaagtaacatgaaagaaaaaaccaaaaatctaaagaaaaaaagatggataggagaagtcaatttactttaagtagagaaaaaagaatactgaaaatataaggcaatcaattttaaggaactgacttaaccccaggatgaggttacagcaagtttccttcatttaacacagtccagtccaaacatttttcatgggcacaactgaaaagtgtcactccataaagaaaaaataattggtaattttatacttttataagaagtcagccagatgtatccacacatcaccgtcaccagaaccacaatcaacttttctattcctgtacctaaatttttctgagtgcttaaatatatccaacaacagaattaaggggaagggaaatgttctggattgaattgtgcccactccctaaaaaatgataagttgaagttttaaactccattttctcagactgtaagcttatttgaaaacaggttcttcacaaaggtaagtgggttgaaatgaggtcatcagggtgggctctattgccatataactggtgttcttataaaaatgggaaatttagacacagagaaaacacacttatgcaaaaagaacaccatgagaagatgaaggcagaaattggggtgatgatttacgagacaaagaatatcaaggattgccaaagaccaatggccacttgcagaaactaggaagaggcaaatacagactctggagggagcatggttctgcagaaaccttgattttggactcagattccagaactgttagagaataaatcttgtggttttttttgtttttgtttttgtttttttgagacagagtctcgctctgtcgcccaggctggaatgcagtggtgccatctcgcctcactgcaacctccgcctcccaggttcaagcaattctccttcctcagcctcctgagtagctgggattacaggtgcccaccaccacgcccagctaatttttgtatttttagtagagatggggtttcaccatgttggtcaggctggtctcgaacccctgacctcatgatccacccacctcggcctccctaagtgctgggattacaggcgtcagccaccgcgcctggccaaatcattgtgtttaaaccactcagttgttgatgctttcttagggacgacctagaaatacagaagacagaaggatcgtgagacagttcgttattgtttggcgaactgtagctggactccggctcatataatgaaagaaacttaaaggaatgcctaagaatattactctacgagtgtaagaatttggtttgtcagtttaaactgatatcagcagttacctaaaccaagttttttaataagaacatccaggactgacataatgctattttgttcagctctttgaaaaacagcacaaagctagcatctctgtgacattcattaggttctgtagcacaacatcccagaggatgcttttgggcttcctgcatctcagtcacttagaatgaaccttaaaattcagatttttcaaggctcatcccaaacctaccgaatcaaagtgacttcttctgttgagtaagaatgtctgagggtggagtgttctattgagtcagaatgtctaaagtcatttgtaaactaatctcagatagataatccttgtatacattaagagaaccactgtcctatgtttacttgactgttttcataatgttttccttctgattgtggtaaagttaaaattgttttgagctaaatgtgtaccaatatcagtttctgcagtataaacaaagcttgattatttcaaggtcatgcagtgagaacatttatgctgtgtgggaggaacctctaattccttctaatgaataacacaagcaaaatacaagaaaaacaatgcaaacactggaaggcataagtaagcacatctgtttttaaatgttctcctctcattgattcctctaatcaaggtgcttctttagatagcttacacgttgaattattcatgcatctgtgctttaccaactccatgatactgaagagtctttgggcagtctcctggaggtggtaaaacacaaatgcgtgaaaagggggcagagagcatatctttgctcttgatgtctttttaacctctattgaatcctctacaaaacctattgcatggcttagacacattaaacacccaataaattcctgctgcctaatcagaaggaagaaaatctgatacatgaacactcccaggataaaatggggtgatggcttggacatgctggtaacagaggtaacattttctatttccaaattgcaagttcacccataactgtaatggagatgagtcactgggtcaatggtcatgctgtaaatttgtagctctctgctaacacttgaaaataattcttaaaatgattgtcttcattttattagcatgactgatgacttggaagggaatctataattgattacattctacaaccaacctctgttactcaaatgagtgaaagtgcagttataagtagataaatcttgtctaagaaatgaagataaattcatataaatgcataaaggtgaaattgttatgtaatggctatgcctaatttattaagcatgtcataataagcctgacaaaaagtctaaaaaatattttttgcaagatactgaacagtaacaaaatattttacctgttggatgtacaaaatcttattttaacagctactgaacacattaaaaaaaatacagcttaggctgggcgtggtggctcatgcctgtaatcccagcactttgggagaccgaggcaggcggatcatgaggtcaggagatcgagaccatcctgactaacatggtgaaaccccgtctccactaaaaatacaaaaaattagccaggcgtggtggcaggcgcctgcagtcccagctactcgggaggctgaggcaggagaatggcgtgaacctgggagacggagcttgcagtgagctgagatcgtgccactgcaatccagcctgggcgacagagcgagactccgtctccaaaaaaaaaaaaaaaaacctcaatatcaatatttcctgtattttatacttaagaataccacaattacaaaagtcacagccacaaaagtgtgagatcatacagctgccagactaagtgttcccccacaactcttttaactcacttttcatttgttctgtaatcatgcattccatcaacagccttttttttttttttttttaaatctgggcattgtttgagttgaaaaaagctgggggtttggaagcagggagggtactttaaggaagatgggtttttatcaccaggtcactttccatccacaattccttggtatggacagaagagaagggcatgcctagagcctgaagctagcacagaactcactagttgaaagaaacaaggatggtcagtggaaggggaggtaaggaaaatctggccagtgggctccatgccttggagtcatgcttagatccacctttgtgaaggggtggactgcctaggtcttcataactacctgtgccagcacttagctcatagttgtcacttatcatgggtgggtaagttaccaaataaacaacttcatctggtctggttactggggattgaaggataagaaacggtatagtctaggctgggtgcagtggctcacgcctgtaatcccagcactttgggaggccgaggtgggcggatcacaaggtcaggagatcgagaccatcctggctaacacggtgaatccccgtctctactaaaaataacaaaaaaaaagaaatggtatagtctagtgtttctggctgttagtcattggtaaagccaaaatactcctgcctttgaagtttcctgatgccttctaaacattatatttcaatctggtgaaggaatagggctctaatgagtcatttgtgaaaccctaatcaatagccttgtggtctccctcatttcttattatcattgcacacactacatccacatgactgcttgtaagactatttttcaccgtaaattgaactcaaaatttgcatatttctaccaattttaaattttggcttatgttacattttgtatgaacaagttgctgcctagagtagaaaagtggcatccaattagaaaaaaggaatttttatttgatgaggccctgagttgtgatgactggggtgaaaggagaggttgggtggaggttgctctattgttctagtctacaaaacaccccatatcttgacaatgagtgcctttaaagggcaaaaactgagtgttcatttcttttaagtattcctgccggtagcaaacattcgtaatttatgggtcagaacatttcagatgctttctcttctggccttattgtcatctgccttatagcaatctcttaatctctcttgattgtcttttattttattcaagatgaataatagtgtggcagcttttgctaattcactccattggttatcaagtctgggagaccccacttaaatgtcatattttgaagatgaggggactgaggctcagagaggctgaatatttttcggttctttacagagacaatacacaggagatctagaccttgtatgcagatctttgaactcaaagcctatttttatcttcagtacaacaggaaacatttattcaattcaatttattcccagtatgggtttaaaattaattgcccttatatgcaatacattttattattttcatatggttccttcaaccaaaaacatttttgagattctcttgtaatttgttctgtctagaggatcccctgagtgacttttcaggattgcagattaatcaaatattcagatcctgggatctgcttccgctcagaaaacaataccccaaggcatgcctctttgacatgctgagtacttccaactaaagaagccttagaatcaaggttgctttgactttcttctgtcctgtgtcttttgcccctctgcctctcctaaagcacaggaaggggatttctttggagtctccatgtctgactgtaaggaaagttccaccagaagaaaaaatgcatttgctctaaacgccttccttggaatctaaattaaccagagaaggtgcaggagagcatattaaagacctccccacccaaaacactacatgcagacagacttttcatctattcttctgttttgtctattctgctgcctgagagactttgtctgcataataagaccacttttgttcatagtgcattcactctaccaaccctcccatagcctgtcaccaccaccctccaggagccttgaagcccctatttctctctgtagctcaaaatgatatttaagagtcaaccatctggcccttctctgagtctcatatttttggggactcctatgcatatgcacatagtttatatgctgtttcttctgttaatctctctactatcaagttatcaagtttattacagagatcgaaccttcagaggatgggtggaaagttcccttcaccccaatagatcctagatagataagaaaataacaaaatatagattttatagtttttttgcagtgatgtttccagttacttaataggggatacagaaatttctgtatgcaaaattaagttttaattctgttcagtgtttttaaagctacataacacttctaagtttgaagaacacaagttgtctcagggaaaaagtggggatgggagctcatttattgaatgtatattacataccaggtacataaattatctcttcaaggtctcagcatataactttttttttttttttgaaatgggtctcactctgtcacccaggctgtagtgcagtggcatgttcttggctcactgcaacctccgcctcccaggctcaagcagtcctcccacctcaccttcctgagtagctgggacaataggcaagcaccaccatgcctggctaattttttgtacttttggtaaagataggggtttgccatgtcgtctaggctggtcttgaacttctgagttcaggtgatccacccttttcagcctcccaatatactgggattataggcgtgagccaccacacccagcctcagcatagaaatttgaagtagttattatcactccatttcacagatgagagaaataggacccagagaaataaaccacttgggccacctaggatgtgtcagagttggtatctgactctaagacagtaaaacacgaaagttattttccactataaagttgctgtcccttataaaatcaagttagtaataacacagtgcagccaatacataactgtttgaaatttcacacgtgtattctacatggcagggcctgggccatgttttccaccactgcgcttgccatggagggatccaaatgggagctcaatgctcaggaacacaagtgggcggagacaggagcactgggggaatgacttttaaacatatactgggaatacattgaattaaacaaatgtttctgcccctctaccaatgtgattttaagtttccaccacaatttccagatgaatcagactcagtacaatggcagaggaatgaaagattacatgctttaaataaatgtggtcctgctttccgaggcactctgtgctttagtgaggacagcacgtagctcattcccatcctgtctcacctgcaagcccagtgctgaacgaggttgctggtaccatagcagattctcatgaggcacagtgaatgactacctgactcagggtgtttcaaagcagccaactgaaaacattaaaataaatacaaaggtctcatttttgtagttacgtgagaattggcgcctgatggcatggacaattttgcctgaggctgccatattttggaataaggaaggtagaatctgaaaaacacattgttactgactcatctgcagatattccctgctccaaattttctctaatttcaaaatatttggaattgcaagtggcctaagagatcattgcctccaggtttctctttcctcactttcagaaaaagagaagactctcctttcaccctcatgactcatttcaatcttattgataaattctttcttttaaagttgtattttgtctttttttttctccctttttgtggagaaaggggtctcgctatattgcccaggcaggtctcgaactccccagctcaagctatcctcccgcctctgcctccctgagagctgggattacaggcatgagccaccgtgcccagcttaaagttgtattttattttactttgttcaggtaagccaaagccaataaatttaatgcatagggattttcctttgctgggggagagcttcagatgcaatgagaaagagctgattttatggaaagagataagcttgatgaagaattgacaaacaggaggtctgagatttgtttgcagaaatattgttgacttgctcggtggattggacaaacacccactgagtactatagcctccttcacttaaaaagaagaaaactctcttcacttttctcatagctgtctctagctgacagcacatcataaagtgtgcttcttttttttttttttttttgcctttattgctatgtttaaagttcttgagaatgcattgaaccagctggtttggtacataattggaactgagtagtacacaggaaggtttaaaaaaagttatccccttcctccagaggtcgtagtcatggaaacctgctaatacctttaaataaaatatatccattctttcaaaggaaaacttgaacaccatgtataaagataaatattttatgaaataatgcaggttggcttggagatattctcctttgttacagtaattattttactttcccttttacactggatgaacgtattagtcaatgttctctagagcgacagaactaattgaatatgtatatatatataaaggggagtttattaagaattaactcacacgatcacaaggtcccacaataggctgactgcaggctgaggagcaaggagaggcagtccgagttccaaaactgaagaaattagagtccaatgtttgagggcaggaagcatccagcacgggagaaagatgtaggctgggaggctaggccagtctctcttttcacatttttctgccttcttatattctagccgtgctggcagctgatgagatggtgccctcccagattaagggtgggtctgcctttcccagcccactgactcaaatgttaatctcctttggcaacaccctcacagacacacccaggatcaatactttgtatctttcaatccaatcaagttgacactcagtattaaccatcacaatgaagaaaccccaatttgatggttgatgttattcagtttatttgctagtcactgttatacctgcttccttagatcttcctttaaaggtctgatgtttgttttacttattagaatggaaatatttcatgcaatataattcattgcaatctttgaatgatgtatcattgacaaccctaaaatctggttaataaattatgcatcctatttgttcattttgacttgagttagcctctgctactcagtcaagagagaataagtccatatctagaaatagggaatacagaaataagtcagtccttgtaaagtttgaattgttaccatttgaagatcctctctacagtcacacctttagaactcatctatggttgctaatctttgcatgaactctcagagcttcatagcattttcttcatctttcagatgaggatgctgaggctcagagagattaagtaaaacgttcaaggtcacacagctaataagtggcagacctgggactccccaggaccataactatgcagcaagcctctcatattagtttgtcataaaacacacaaaacatttaaactagctatatgcctagtttatatcaatataaactagctttaatgactgaaaagttcctatactcagtggcaatgcaacataataatattttaaatataattaccctaatacaatgtatccctgctctctgaaacagagctaccacattgcacaactccaggggccactgtccccatcaaatactataggaatgatccctcttgaagtaatgcgctgagcttgcagggctgctctgacagccctggtgatacaaggctttctgataaacaagttaaaaaacaatctcacggacagtggaaaaaaaactagtgaaccacaggtagtacaaaaagaatttttctttggataatacgcaaaatcaaattaccacataatgtaccacacagatatccaacaaattcttgttgaatgaatgtgtgtccaggcccagatcagaaataagagatttctcactgagtgtgatgtgatgggtaaagaagccaaaattcttgaggtagaagctgagaaatacagaagcatctgagaaatacgcctaaagatgaggggctgggagaggcaggggagtggggtgggaagcgtaaaataatcagcaaaaaggacaagagaagatgaagggatgcgttgattgaggtggccctggcttcctggctgccctgtctggctgttcacattccatgacgactgacaccttccctggcactgctcagaaccctcaactacagacagaagcccaaactccagcctcctgtgccccagctgtgtttccagcctcttctcatggtactcttttcacctcctaccttgtgctgtgaccccacagggcccagctgcttccccagggctgtcctccagtgggagccagcactaaccccctcgactcctcacatcagtaccttcagctccaccttcacctggtgaaattcgcttatgcctgaccccccaccatgaacaccaccttctccaaaacacattcccattctcttcactcagaagtcattctgagcgttccttcttgttctcatcaactctcaaaacctccaggacaccatcctcctcttcctgcctcgttatttcatgacattgcaactccctctgttacatggtttacctgcttaaacacagggctgtgtcttaatcatggttttagcttccatgggcttgagcacagatgagttacatcaaaaatatttgtattgacagggttttaaatgtctgtcatctaccacatttcttgcaaagtcgttcccgctgaaacataggccttcttggcctctttttacagcaaagatgctgagattcagagagggaacttactaaaatagaaaaagctggtgttaaaaccagaattctagcacaggtttcataaagcccttgacccttccatcactatatcctgtttttgtgacaggagagaacaaaatccacttggacaaagtagaaaatattagcctaaaatatattcatatcaatagccacacaaagtcacaagagggccgttgggcctaccaaccacggcctggttctgtgggaagcatttggaaccttaagcatttgcctgcattaaagtccagggtgaagattcgtgttcagaacaatgagcctgggttataatgaaaatgtttcatttattaaatttgctctgctttagaaagcagagagttatacaatatgtcattgatttttttttagttcattaatgtgttgacctgattgttcagtgctcaaacagtgaaaggtaattgatcagtcccaaaatagtataatccagtgatttccaaagtttctcaattcatagcgctattaatgtctcagttttttctctataccttatccagtttgtatttcagaaggaatatataacagttacacttattaataagttctgtttaagcaacttaataagcattgatgcgctagcaacttagtagcccattgaaaaaaatgctatgatatttttgttgtattcttcaataaccataattacaaatgggctgtgtgctcctattgggtgctgtaaaacttactttttttgaaaaaaaatcaacttttattttagatacaatgaggtatgtgcaggtttgttacatgggtgtattgtacccaagtagtgagctagcccccaataggttgtttttccactcacacccgccctcttccttccccactctagtagtctgcagtgtctatctgcacaacttcttaaatcttagaatcagattggacactgtgccatcaccctcatttcctgttcctcactgatttttcattcagtacttggttaaatcatagcaattgccaacaatggcaacaacaaaaatatattagtaaagttaggacttcattgaaaggaagatagcattatttcatatgaaagctgtaaactaccccaacttggtagtttatgcaatgatcagcagatatcgcatactgctgtgtttccttcagaattctaaactagctcattgtgtcattatgagtttgctgtggtgccctgtagtgcctcagtgcatagcttgtgaaccttggataatatcattacattccatatatattattgtacacaaataacgttataaactttcctattgtcagttacatttgatatgcagtttctttatagaagcataattaacacagaaaggtatataaatcatgaatagatagaagaatttgcagaaagtgaacacatccacataactaccaatcagatcaaggagtagaacattaacaacacccatgaggatccctcatgcccaggacccaggcactactcccctcctccctaaacttaaccagaatcctgacttgtacttcatatgtgagattcctaaacaggaaagtactgcttatgaatacaccatattttttgaaacatagccatttctgagttgcagtgaaaaaaaaatgattttttcctgatcatcttttctacttctcccccattgtgaagcagctatgaagattggcagattgatcccaaattggtttaaaggctcaaggctggacttcttatctgaacctaaaccaattgtgccatagaatttcctggccatggtagtcaaatggcctaagatgacccagtcagagaaacggcccagcattttcctccctactcctccttcttccttctttgctttctttctttttatgtttttaataggataccatctctgagctggacaagagagcagatgaccccaggaacccttggcagcaatcttgcaaatggaaaccgagtgatccctgggatgcagccaacatcacagacggcagattggcaaaaatgaaaaacaaacaaaaacaaaaaatgttccctggtatcatcttagaaccactgaatcatcattggactctacattaatgtgtgccaataaactcccattttatataagtccatttgaatttgggttttctttaacttacatgcttactaaatcataagatcagctaactatcagctaaatggaaacttcagtaatgtaaaacagccatttctcaatgtaaaaaaaaaaaaaaaactagcatataattttcccaacaggaaagaaaatgctagtgaactaaaatttccatttgagagaaaaatcagccaagccagcttctgcaataattggttcatctttctaggactctgtgattaactccactcatatatcttccaaaacagggagatttaaacaggttaacaaaaattggggtgcttttttgtggttttaaattattctgttaagtgaaaccttccagatgcagcaaatattctcttttaatagagttgcattttcaaagcaaaatttcctagctgtccttgccttgctaatgaagttttccacttatctataatatgtgcagaatggtgatatttgatgtggcattttcttgacatttctaggctactataatcatactctttaattgtctctgcctaatctgcataggagacctgacatctcatcctggtttctgattttaatcataactgcatggagccagaagggtcactaaatagcatccaaaaaacactgttatcaaagacacttttgccaatgcttttaaaaagccaaagcaaatgatatttttctaaaaaatgaggttgtttgttgtggtgaaaacaaagagatagctttaaattaaataccaaatgggttttctaagcattaaaataggataagtataaaaccagactagggatacatctccaatatcactatgctgataacatcacttaaattcgctaggcatttatggaaaacaatgataattccagtaaatgccagttctactttcagagtagctccactgaaatgaatgaattacctcttatcaggccaccaaggggtactgtgattccggaagcatgacagtacctttgatagataagccctccctggaagaggagaattaatttcccccagctctgcaaaggccagctcttgctacatatcacacaccacacctgccacaaagtgacggagactttcctggagaaatggccatggtgtgatggaattccaaagcagagagccaaaggaaaggagtagtagccaagagagcagccatgggcgaatcagacaagaaagcttgtcaccttaaaccctttccctaagcagggaataaagagagtgcaagtcctgcaaggaggggttgtggtatggttggaggcatgagctccagagccagacctcctggctctcatcccacctgggcaactgcacagccttcagcaagatgctgcactgttccgtggttccattttcacaagcataaaaatggagaaatgaataggacctaattattggggtagttatgaaaattaaataggttgatatttgtaaagtgcttagaacaatatcaagtatgatacacatttggtaagtaaacaaataaatgggactgacatttactatggctgtttactgacatttgcccttttcattgctcccacaaaggagaaaggaacagatgttttacttcctttatctcactgaatttcccttaacaaacttcaaaataggccttgttattagccctattttacagaagagaaaaccgaggaacagagagtttaagtaacttcccctgggcaccatgatttacatcaggtccccatcattcccaaacctggtgtgttatttatttgcttgtttttccattgcacaaccttatatctagaagctgggataggatggtaaaggactgaagttgaagtagaaagaaggtattttaaaatgcagcagataaagacaaatactaaataggttgaaggcaaaaggggatgctctttgtcatttctatcatataatcaaagttagtacaccccatggaaaaacaaaaacaaaacagctttacatagaactgattatacgaggaaaagaaaatgacaagaaaaccaggcacaatgtagaaattcactttgatgacaatacagagccatttactataagcaaagggcaaagtagaaccagataaggcatcggaaatgcaaacactagattcccatctaaattgccagtcaacactaaatcgtttgctgcaaggaaaacagctgcccactctcagcagtgaggcaaccaataccatttttaagcactttttactacctagaaatgccaagactcatgctgttattgctactatttataaagaatgaaaggattaattatctacaagtaagccatctcattacttctggcattctgtagtagataaaacaccctgttatttcataaacagataaatgtgcaatgaagtctaatttaattaagtaaaattgcaaaacgatgaggtaacttgttctaataatttaagttacctaaataaaaattatagataaaggctagtctttttatttggactttacagggatttagtggttagttttataatattatttattaccagaaaatgtcaaaaaaaaaaacggggctagaaagcattctaaggttttcgattatgagagtgtttttaaaagtctctgcatatatgtaagagaaataatgtaaaagaagtctactgtaaatgataaaaatgataatatttaaactagagcattataataattttgataaattttccattagagagaagttggttaggacaaaatttcaggatttacatttgtttaaaattttcagggtctttgaagaggcagctgcctgcttgaaaacatctcttatgggttccgcaatattccaatacatttgctacagtggatcaaggcatcttctttagaaaaccatctttctcttaccaagtgccaacaagccatcagggagggttaacacattaaagcataacccctaatattacatctacatttcacagcacaggacagaatgcagaaggaatagatttttggaacaaatctatccaggccaggtattatggtctgagttgtttatgtctaccccaaattcctatgttgaaatcaaatcaccaatgtgatagtattaggaggtagagtcgttaagaggtgattccaccctcctcaacggagtaagtactgttataaaagaggccccaggggctgggtgtggtggctcaagcctgtaatcctaagactttgggaggctgaggtgggtggattgcctgagttcaggagtttcagaccagcctgggcaacatggtgaaacctcgtctctactaaaacacacacacacacacacacacacacacacacacacacacacacacaattagccaggcatggtggcatgcacctgtaatcccagctactcgggaggctgagacagaagaatcccttgagcccgggaggcagaggttccattgagccgagattgcgtcattgcactccagcctgagcaacagagtgagattctgtctcaaaaaaataaaaataaaagaggccccagtaagctgccttgccccttccgccatgtaaggacacagctagaaggtgccatctacgaaccaggaaacaggctttcaccaaataccaaatctgccagcaccttgatcttaaacttcccagccaccagggcagtgagaaataaattgttgtttgcaagctgcccagtctggggtattttgttatagcagcccacatagactaagacaacatgtggcagacatggaaaagttaggtggggcctaaccaacatactagtaaagtaagccatcactgtaagggctataggtttgagaaagatcagaagatgaaacccataggagagaaagtggccataattaaaaaacaacaacaacaacaacaacaaaaaccctcgaaattatactagggtgggaagaaggaatataaaccattgattctcaagcttagttcaaattgggcccttcaggggtctgttgaagattaggaaggctccatgaaagaaaaacactcttcagactcctggtgaaacagaagctgagaaaggcagagatgaaacaaatcagctccacctttagctaaggatgaacagcaagagagaagctagtggaagatattaggccaatgtaggagctcacctgagttccatagacttagctaccatgggcatttacactgcctatggggtggatctcaggggaaaataaatgatgtagcctagttaatgtctagagtagtgattgggtgaaaaatgagtgggaccaatgctgttctctaatttcaccagttagtagggtcaccataaaatttgacaatcaaagagaacgattttaaggagtgatgctagtaataattatggtggaacaacaggtataaaaagactagactaattcttctcattccaatgcttgtttgatataaattgctccatcacagttacagaacatactaaatatatatttctaattaatacatggttttaaattatgcttttctattttatgcagcaggtttagatctaaaagtatttgattgttcacagaaattctttctcaaatgttaaggtttgttgtttcttattttgtttctcaaaatgttaaggtttgacactatgaaaagtctttaaaatgctgcagagtaagaattacaaaagagaatttccagcaaagctttgaatactgccatattctagaataaaggcgtgcacactctgccaccctaacagtgatgaattaaaaggcaacatcttttatgtgaatgtctaacttgtaggatattctttataaaatagatcacaacaattcatctgttatctaagagtgcaaatttgcattttaaatattaggtagctaggcatgctaggcctcacaaaagcttaaggaactgggttataaagacaaaaggccctatcctcgttttgcctgaagtaccctacgaagatagttgacctctctgtcctggagaaagaaaaaccaaacaaaataaaaccttatttattgtctgacttaaatattttatcttgcataaatatgaagaaagctctaaaggctctacatcatttatccaagttaggcttccggcaaacagatgaaaaaactggaaagaatgttttcctatacaaacccatatttttgaagagacaaggtatacatgaaaagcttgggtacattaatgctatacagaagctcctttagggatgaactttctacttagaagttctcatggaaacaatctaccagatgcccaaacaaaagcatatcaattgagtactgccagcagttgatatgaatggctgtttgtgtattgtctctttggagttataaataaatgaactggtaaagaggctttcagaattaacatgttaggctataaataaacatttgtgcagctgcttattacccagatcatttgtacccttgtatctctccaaatcagcactcagtattcctgataaagcattcaggattcctgacaaaggaattaacctatagcatatggcttaattctatattttatatcagaattataaaggggtccaataaatactgaactgtctttgtgacatattctattcgtttactattaaaatacttccaacactgtacaattgaaactcaagtcgttggtcagatctcagccacgtatcaaaagctcattttaaatatttaaagtaaataagatccttgttatgaataggaatgcaataagtcatcaatccaaatccagagaaaaataaaaaaacattttaatgtctttgattgttagccttggatccttccactaaggtagaaatagcaggccagttaaattgcattttgtgtatgcaattcacgttgttttcctggccttacttactatattagttggaatactttatgaaatgaagaacctaccctcatatttttccaccagtgaccttgagttagtattgacagaataaatatttcaaaaaactcaaacccagggccgtgctgaggcatttctgggcagccatagactacctgaaaaataagataaggccttgggtctggataaaaatggatcctgccaacgtctacctggctaacacccatatagaactgccttactagctgggctccccctaggaggagagcttgggggctagtggctatgcaggcaacagtgtttcctaatgatctgggatcactggtcacgctttcccatctatactttggagtcagaattgaattcaaaatccaggttttccacttactatttctgtaacttaaatacattacttagcttctctttcagccttcccattcatataacagagataatatcaccttcctgttgccactgctgtgggaactaaacaagatgatgtaggtaaagtaactgctatggaatatgcgctcgaaaatgtgactatattgatatattgacgtcagaaaaggcctggtaaataaatcccaagattggcattgtgatgctttttcatttggcaccttctccgtatttcacactaaaacatgaaaaaaatgcacatataattggttttagtagtcttaaattttctaagaaccgtttattaattcaaccatcaattgtaaccacgaacattaaacaatattgataaatcaagttttattttttaaactctctttaaaaaatctatctagtacttgattttcaatctgtttaataagatggaggaccccaccaaattactcttctttgaaagttgttcatgtataagtgaataaaatatattttactaaaactcatttccaactgtaatttttaagaatacttaaagaagggatatgttcaattctacattattacatttttatttaaccatttttaaccagcattattttgtaagtccatcacaactatcaatttccataaaatgtggtactgtcctaggtaggagtagcctatttaggaggcaggtaggatctgcattccccaaagacacatacatgaagtgaaaaacaaatcatgacaactaaattacactgaagacaagtgttcataaaattttaagaaaagtgatatttgtggggacacaggcttgagttgtgaaaatattacaattatatgcaggtagcattatagaatctggataatcaacaataagaaaagcataaaaatattcttaaaaatctaattttttgcaagactcacttggactatggttaaaactttgtgattttataagattaggaaagacaagcacctaaaatgtgaaaaaatagctacatcataaaaccatatagattgtcatgagcgtataaagacctggccatgaattcaagggttttttttttgttttttttttttttgccacaacagcaacaaaaaattatctcagaaattagtttcagaaaacagtttttctactcctatagaagcagaccctcaggctacttttatcatcttcaaaaaggagtttaaccctgcatggaagcttaaggtatggagggagctgccaatccactggcaatttctaagttagtttaattaaatgaactgactgaatttccatatgtgtatgtgatttctatttagaaaaagaagagttatacgtatgtgtgtttcattatttatacagaactcattacattatgatgttaaataactactaaaaataaaaaaacatagcacttgtattaaaatgttccatggaccatgtgttaagatgattgcattcctaaaatgcagaaaaatcccattatttcagtatcttgctgtgtttcactgaatcatcagcattaatcatagatgacatattcctcatgcattagtactgtccttcatggtgtgagaacatctactaaggaaatggctttttctttgttgtaaaaaagagtctacggttgtaataaagaaacctgaaaatatgtgtttttcatctttatctctcgctctttttccagctcctagtgtcatcctgtaaaatgctatgcataaatttgtgaacaataattgctattcagtttacaacaaaaattaaccaaactataaactgaataagctgtgggactttgatgcagcttaaatatttaaaagtagaataaaatgatctttcagtttcccatgttcttaaaaaaaagttctcaaaatagcttcttattaggctaagccatatttacccctcctaccaaatctgcaagtgttcagaaaacatccaactgctacctaagataagggtttacatttctgattcttaaagactgatctatgtgcacacagaagacagatgaaaatccaatttcaaggttaggaaattaattttgcctggagaagaaaacactgtaagttcaatttgatacttaaggatgcttatttgtttgttttaatgtcaagttgactattatttaggtctattataagattaataaaccactattacctgggaaaagtacaatcattattgggcattgtttattattttctagcttttcataaggattttccataacaccagtagcgcacaagtttttcaatttgggtttcttttgcttccttttctggaataaaagaaaacctttccggtttgtgatgatccactctacttcctggcaatatctactgaaaagctatgacacaataatagttcaataactttctcatatattgaatctacagcaatcttacactggagttgtgaatatctctccattaacatttcaagtcagcgtatccaagctgtaccccagggaatactgatgtttgattaaatatttataggaaccccaaagaaaaagagtgttctgagtcaaatacaaaagggaaacaatgagtcaaagttgcgtaggtcttgctgttattgtttttattgccaaatttctaagaaccttaaaaatgaggcttagaaaatatttttaataagagcaggccttgctcaggagcaagtagcatctttgagatacttcagaaaacacattacctatccatgtgcacatcacaaaatctccactgaatgtctcatagacgtgtcaaacccttgtctaaaactgaactcttgatatcccccaaccaaaatctattcatgtttaaacctcccccttttcactagattccaataatggcttttcagtttctcaggtcaacaattttagagacactcttgtctgtctctttgtctctgtctttctctatgtatacacacacatgtatgtgcatgcacacacacacacacacacacacacaccagtctgtcatgaatttctatcagctccatcttcataatataacttaatttcttcctaccacttcaactgccaccaccttagtccatgccatgattggactctggcttagattattgtgtaagtctgctaactggttgcccttattccactctttccacctctaatctaatctctacttagtatcttctttttaaaacaaggttcagattatatcacatttctattaaaaatcttccaatactttcccatcccactccaggaaaaaaaggtcatgttctcactatgacagctactgcgccctgctctcctatcagtcttcctatcccaagtctgctgctctctctccctgtactgagaacacactggtgctcctgctcagcagcctgcctttttccagaactctccatttgccatgatgtttgcttctcttctttcatttcctttaagtctctgctcaaatgtcaccttatctgagaggctattcccgacccccatatattgaagtgtttttgtttcatcacttccctgcccttttttctaaaacatagcaagttttagcacttaattttacaaatttatctttttctttttatcacataatttatataagaaagtttatatttttactagtttatttttatgtcactctgttattacctccaagagagcataatttcatttgcttttgttttgcacagttatcttcagtacctagagcaatgttctgcatgtgggcatcctatgaagaatgactgaaataaccaatgtgaacacaatatataatatgtttttttaagaagtcattaattctgttttcattattagtcttaaggaaaattcatagtagacatcacctgagtcattgatcaatgatcatctccctccaccacagcatgagatcctaagtgcagaggtgtatactatgtttatggatatatagtcagtgcccacaactgatcctggcacatttgttaagtgttgagtgaatagctatgatgtattttcattaccactctagaatcacgaatgaaatacatagaaaaataatatttcttgcataagaagccatatgtaaatctcttagagacactgaagtttatacaggaaaatacaataatttagttttagaaaggcgagaaggttcctgatttattagcaaagacacattaagctgggtcttagatagttgtagcagagatggaaacaaatggtgatcaaatccgcagatgttagtcctgatgttaatgaacaaaacatatcaaagtgaaattgcagaaacagatggcaaccactgttggccaagaagccaacaagcagaagcacaggatgatggcaggttcatcaaaatagctcagggagaaggaaaaaggggtaactggctagcaccatggatagcgctaaatgaagcactatgttccgatctattcaacccaacacaaataaatgttttgctattgctattcacaatagcaaacacttggaaccaacccaaatgtccaacaacgatagactggattaagaaaatgtgacacatatacaccatggaatactatgcagccataaaaaaggatgagttcatgttctttgtagggacatggatgaagctggaaaccatcattctcagcaaactattgcaaggacaaaaaaccagacaccacgtgttctcactcataggtgggaattgaacaatgagaacacatggacacaggaaggggaacatcacacactggggcctgttgtggggtgggggggaggggggagggatagcattaggagatatacctaatgttaatgatgagttaatgggtgcagcacacgaacatggcacatgtatacatatgtaacaaacctgtacgttgtgcacatgtaccctaaaacttaaagtataataataaaaaaataaaatatatgttttgttgttgtggggtttcttttatttgtttgtttgtttttttacccacagatggaaaatttgtacctaaagacttcaaccttaagatcaaacataattgcttttaaggatctggaggtgtcacagtgaattttcaggttgcttgagaaatacctatcagataattctcgccagtcttcctcagtttttcaatctttctggcactaaaagtgatttaaaaagaatcttttaataatcacttatttcactgaagatatacttttcaaaacagctgtacaggcctgagagaattaatgggctttgaaataatcaagtaacttactgtcctctctgtttgggatatattgttatttataaattttactttttaaattataaaaagttacaattttgatttgtaattattaaaaactccaattcacaaatataattttaagtggatttttatgcctttcatattcacctcccacatgcaaaacaattatccatgagtttttagttttatgaaagatggagaattctatgttgattataaagaagaataatgtacattttgtttcctacattataacgtgttttctatacctcataaatactgtactattcttagtcaatttcacagtgactatttcctaaatcccttagacagggatttaatgattaatgaaatgctacagcaattcttttaataaataaagttttcatggaccatgccatagagccatgcatatatgtttttgtatatgtagatatataattgttggcttaaagcttacaaatacattaattaggttcatagatttagtagcattttaaattaacaaatatgttttagtcttaaactacttggcaaagaggtaagcaagccttctgattttctccacaataacatttatggggctttaactaggttctctagtacaggatcttttgtaggagttaattagagacttcacttaacttattgtttttaatcctttcgaatgtcatcctgtagttatttcactgagaacttttaactataaattcttgccaagttctctgtattactcattccaagcacacgctggatttattataagattaataaattatccctaaaagaactctgtctcaccgtttcttccaaatatttttgtcaactttttgtttggaaataactttccaaaatcatatgagctgtggtgctcataaaacaatatgagtcaaaactcggaacacacaaacaagaaaaactctaattgaatctctgttcacattttatgattcgtggtctcactttgagtagagctagcaatcacagggcctgagtgctgccactgcctacaccaaacatggcagacatggttcatcagttactgaccacttttggcctcacaattccttacacacaaccacaggcagcaactacagatttattgggttttcacacaaggtgaattctgcttgctcttcctaaactggaactttgaattagaatttagtggcatacgcctatatagttaagaaagggcatgatttttaacaattttaaatactttagaatgggtggttatcaaaatcctttttttatgtttactcaacacttttttttctaattaaatgccaagttatatctatgtccaattacatattaacagttgtacttagtgacggcctcaaagttacttgactttgaaggatgattgtccttgagggaggacttgatcatgaggtttaaaaagatggccatctctagcactgcatcagtatggggctttggggtggctcatgcacaggcctgggcagcaggctctctatgcacaggtctctagggtttttgacttagacaacttgctctgtagaaatgggggagtgataacatccattagctacaaataatattataatcagagaaaaatggcttaaataaattctggcttgttaggagccatgtgatctcaattatgttattcctgaaatctcagtttttcacatatagcattaagataataaaacatactccacaaagttgtcatgagggttgataaaggtaatttaagtaaaatcgacagaacatctagcacaattgaatctaaatttaagtgaaaagaaacagtactaatgtgctcctatttatactaatggagcacattactttttaaccttggagcacaatggagcacaatacttctttaaccctgcagttgaaaaacttgttttgtatctttcacagataatgaatttctcaagattcgttatataaccaatatatgctttaaaatatgatcttattgagatataatttgtatactatgtaaaatttactcatttaaagtgcataattcaatacttttttaaaatactgaattgggtaacaatcaccaccaaatacctaatatattcttgaatttatttttcaatatcaccaaaggatgtctcttccataaggaaacaatctgatgaaatcagtgtaaaacttctataattgaaatggcaatgactttttaaaaaaaagtttgaattcagttggattgttgctagattaaggagaatacagtggaaaaataccaattgaaatgtgtagcctatgattagttcctgggcctcaaacagaaaaattatggacttccagtttctagtctgacgtgcaaaggttttcaaagttgtcactcccattctcgtaacaagaaaaaggctggataagctaaaaatcaacaacactgcttagatctataagggaattgagatcataggaacaactgcttttcccaaaatggagagacaggtgggtacagagaatcacatgtaaatggcagagaaacccagggccaggtcctacagatgaagccagtatcagtaggaacacttaagctgtaatcggtgaatgactgaagactcaatgtggaccaggttgagagtaaaaaatctgaggaaaggggctagtctcggcaagaagcccacactttcttaaattttacctccagcagctttgtgttctcaaagaaaaatcccctcatgtttccttcacgcagggagaaggacaaagtgacctttttgaaatatgtccccaaggccagctattttaccagagtctaactgattagggttttgccaaagcataacccatgtaaagaagaaaaacacccaatgacagcctcctctattcttctcagatagctgagagtacttgtaaaggccacaggccaggagcaaaggctcactaaacactcagacctaaacataagcctacagatgctttcactccttctacacctcaccaccatataaatagggcttccatataaaaacagaggattatagctgaaagaactacaagcctcagatgctattttaaaagtcttttgggaaacccaaagcaattggggggtgggggacaaaaataaggccagtcacagaaattttagccactgacaccatagctagaggaaacagtaaacacagcatgttagccagataaatatcaaacctcatattaaagggccattgactccagttccttttgcccaattcatcatatctgttttcaacaacaacaacaaagtcatgctaaggggcaaaataaaacaaaacaaaaacctcaggctaaattatccaagcaagaatcaggactccattcagacatgacagataatttggagttatcagaccagaaatttaaaacaattttgaacaatatgttaagggatcgaatgaaaaaaagtgaacaagatgtaagagaagatgggaaatgtaagcagaaggacagaaattccaaaaagaatcaaaaggagatgctataaaataagaactttttaaaaagaaactgacagagatgaagaatttatttaatgggcccatcagaaaacttaaaatggccagggaatcattggccttgaaagtaagtcaatagaaatttccaaaattgaaaaccaaaaagagtttgaaaagtaaaacagaatatccaggaattggggaataattaaaaaggtataccttacacatttttggaatagcaaaaggagaagaaagagagaaaagaacagaaatatttgaagtaacactggctaagaatttcccagaattaacgatggatgtcaaactacagacacgaatctaagagaacacaaagaaggataaatagcaaaatatctgcacttaaatatatcatactcaaactgcagaaaaacaaagagaaagagaaaatctcaaaagaagccacagtggggaaaaaccttacatatacagaaatgatgataaggattacaccagacttctctttagaaatcacacactcaaagagaaagtagagtaaaatatttaaagcattgattaaaaaaaaaaaaacccacacaaacaaaaacaactaccaacctggaattctatatcctgaaaaattatccttcaaaaacaaaagtgaaataaagactcttagagtaacaaaacaaggaaatttttttgccagtggagctgccttgcaagacatgttaaacaaaggtcttaagagagaaggaaaacaatattggagagaagcttggatttaaatgaagaaagaaagagcattagataataagtaaacataaaatatgttctttttttgtactttaacagataacagatttttcaaaatatttttagcaacaaatagatgaggtattcatagctagtgaatagtgaaatgtatggcagcagtgtaatagcgatgagcaggagagattggaaatactcgaaggggcttgcactacacaataagcagtattgtgttatttaaaagtggataaacattacttgtaagagtatattgcaaactccttagcaatcactaacacttttttaaaagaagtacaattgataatctcagagaaaagagaaaatgggattatataggatgctcaattagaaccagagaaggcaaaaaaatggaggaaaaaagcagcaaagaaaatctatgaaagatacagtttgtgacgagttaatgggtgcagcacaccaacatggcacatgtacacatatgtaacaaacctgcacattgtgcacatgtaccctaaaacttaaagtataataataataaaataaaaaaaagaaagatacattttgaaaaatggggaaaatataaatataggttggctattagatgagattaagaaattccttcatttcttacatgtgataatagtataatggttacatgggattaagactttattctaaaaggatgcatagtaaataatttagaaatgaaatgttatgatgtctgaaacttaatctcaaatgatttagccagtgtgtatgtacatgtgtttatgtgcaaataaagataaagagaacaaactttccaatgattgttggttctaaatgattgttatatggcatttagtgtacagttcattctagtttcctacatgttcaatacatgataaaattaaaagttagaaaaataaataaatagattaattaatgtcagtatatacctattttatttgttgtagatttggttttacagcaaaggtcttgataaaaatctatattttaacctttaaggtgtcttttgaaaaatctcaaggcttatgggaggacttattgccaatgatcttgataatacctgttcttcaaatttacaaataacaagactttttgtgtgtaatgctgttacttatttttactccaattttcagagtgccgttgtaagttggttttgtcatcgagactaccaaatcatcagctaccagtcaggtaaacccataaattacaaattgtgcaacttttatttcatttcccgagtaatataattgtgtaattatatgtaatttgagatttataggaacttcaggaaataaaattagtagcatgcaaaattaaatatgagctaatataaacacattctgctaaattaacaattatatttcatgctatcccttattaaaaatctaagcccccgagttaatttcctagttattcaaaatatgccttgcattctatagtatattcccaacataatcaaaaggcctgttacagtcctactacaaattttgttatgtaattaggcgttacatatgcatacatataatgcatattacattatacattatatggctaataattatgcaatacattatttggctactaattacaaatatactactgaaactgcaaggccattataaacacctatttttctactttaaattatttcttaaccacaggataaaaataattatagcaatttgaatagagcatattgttaaagtatcataatgtctgttatcaatcgttatatgtaagtgatcataaaaatatctgaagagcagtaattttctaaaattcattgaaagtctcatttttgttgttgttttccctctctctttgaaagaattgtatttgcatgcgtatgttttatgtgtgtgccactcaatataagatggatatgtgagggatttctctacacagcatggccctaaacccaaaaggtcatggcttaaggaaaagataaaagttctcagttaccacaaaatcagaagtatgcacatgatgcaattcaggaaaagcaaaataattgtttttcagctttgatgaaacaggagtgtggcggtgagtcaaatattctgcctaatgtttactttataacatacactatttcaacttctaatacttaattcagtttaacaagcatgtaagtacattatcttaccaattagagtaatataaaaatgattaaaactcatttttaacttcaagacagatcagaatctaatgagggataacgtataagccaacatgtaactgtaatggaaggctgagtactaaagaaaagcgaagctactgtgccacagaagaggagagaagagcaactctcttcagtctcaaatcagggaattctgcctagaagagctggcatttgatttgggccttgaaatgtgaaagggactttgaaaactgcatctaaacattaaaacaattgaactcatgacatagagggtagaagaattgttgtgagaagctgggaagggtagtggggggctgggagttaggaatagttaaagcatacaaaaaataggaaaaatgaagaagacctactactcgatagcacaacagggtgatatagtcaataataacttaattacacattttaaaataatgtaaagagtataactgaattgtttgtaactcaaaggataaatgcttgaggggatggacaccccattctccatgatatgtttatttcacattgtatgcttgtatcaaaacatctcatataccccataaatatatacacatactgtgtacccacaaatattaaaaataaaaataaataaaatcttatattaaaacaagaaagggaaagctttttgtgttttgaataggtacaaattgccagatatgtgaaaaatgagagtgggaaagtagtttgaggcagatcatggcagaccttgatgttggagctcagtagattgtgttgagcattgtgttgatggagaaactttctgaggagggtagtgactaattcccttatttttggaatcagactccagtggcaaaatggatgacttacagaatggagacaaggacagttgtttgggggctgagtaattcaggtgaaaaatgatgaggagaaaaagagaagtggtcatgaaaacaactaggagatgtagctgataaactcggattagatttgggggatggataaagaaaaagatgagataaaatataacttgggttttggcgtggttgaaatcttgtccctgaaatggaactcagagagaggcagatctgagaataaagagctgaccattgggaattcatgtagcagctccctcacaaatctagtttgtaagtaagttaggaattggtggtcagtaaataaaaggcattcctgatacttcaagtgatctcctttaggttttcattgctcttccttccaaacttataagtgacatcaaggaagctggtttacaaaattactgctgcatggaacaattttctctaccttccaaacatagagaggaagcaacagaaaccaatggaatccaccagcaccctaattataaaacaagtgtaggaagggtgctctctgatgcctggcatattcctgcctcaaggcagttgcacctgctgttccctctgctgagggcaccactcactctcactttatttaaatgccatctgatgagaagggcttctgcagccagctgaattagcagtggtcgctcagccgggcactcttttactaggcttcaaagcacttcctagcagttttcaccaccagtcttgatactatacactactccacatgtgtgcatttattgtttattgtctgtctttccccggtagaaaacaaaatgttccatgacagcagggcctttgttttgcttacaaacaatgctacaccatctgcttctagaacagtgcccactatgcactgagtcttaaataaaaattaaatgaatggatgctgctttgattttggacttggagctctcagatatcccagtttcaagagttttcaagttgattggttactacatgtataactctcaatcacaagacaactatgtcctatttactaaattaaataaaattattaatgctaagactcatggagataactgattttacagattttaggcattataacagtggttttaaaatttaagcaaagatcagaatcacttcttgcttaaaatcatgcttaaaagcagattgctggaccccaggtctagaggttctgattcagtaggtctgggccaggtccaaaaatttacttctaacaagcttccaggtgatagagatgttgctagtccggggagcacactgaaaaccactgcattacaagctataacataattgcagcatacacatgagagaagtctacagagtttgggagtttagaagttgcagtattttggtggcaaaatagtaggcccctaatagaagagattactgttcgtctgtccccaaggcttggggtttttcagcccattttttgaagttttctttcttatctttagtttttaaattttttacattaatttaattgtgcatatttaagtacacaacatgatgttatgggatacctatagatagcaaaacagttactacagtgaagcaaatgaatgtatctatcatcacacccctttgtgtgtgtgtgcgtggccagagcagctacaatttactcatttagcaaaaaatcctgaatataatcttttacgatacttggaactcttttgatttgctaattgggttaagatatcatattccatttcattcagtcgcaatacgcttctcaaaaaaaactaaattcatattaaaaaaagcactgatgctctaatggaaaaatgaaagatatccttagaaggagaatgcaccataggacttctgcttactctcaagacaacattaaagaatattggaacatttcttggtacaattatgcagtataaggccctgggaatttcctctttaaatgttttctcttgggcccttttttgatgtatgatttaagaccacaaaaattttaatgactaaacataatataaatagaaggatcatgttatttgtcatacaaaccagaactctttgggagagaatggggtgctattaattacagtgggttaatagctatcaaataggactatccaaagaggtatgatcatcttagataggttagaaaattgtattaggttcaaatcagttcttgaaagattgttgtttattagttggattttgttttgtgattctgaagtatttctgaaatgtatttacagattctgtgcaagaccttcagtcaatgctccagtctaccctcacacattgaaaatcttcacatctgcacataggctggaggctccccgtcggtgtatgcatatgatcatgatgtaatgggaggaactttgtaagtggccaaaatgtagtttgcatgccatctcggctgtgtggctttggatctctctgcacctttgtttccctaggggtgagtggtgaagagtaatacctatcccataaaattacacacatagcacaaaacacctagagtgtctgctctacagtatgtgcttattaaacacccatttttttcttttccaaaatactttctaaaatctctataagccaaaaatttaaccctagtattctaagaggttcacctatttattaaccctataaatgatttcaaactatgcttctcagaatctccaagtgaaaaaccaaatgctaagactagggagaggcagactggggcataatttatttagaaagcaatcaatgagaaaacctcaaccttattatctaattagtcacagtactcattttataatttaacattaaagaagaatgtgcatttttaaatcttcatcaaaggtgatatagattaataagtgataagaaacactgaaagaaattgattaaattatgagttgaatttctagatgagagtcaaaagaaaatggaaaaaatctagcaatgtgtagagactgggttaaagaccagagggccatggtgtggtagtctgggtcgcccacagcatcagctgtttctgcttttcatagtctctttgttctattctcctcttaacacacagatctccaaaagcagcaaactattttgcaaagtagctcttcttggtggaagcatctgcctcctggagataggggtgaaaggctgggaggacagaagaatccatgagtgggtggctgcttcggaaatgggacaattactttattctcatttcaggagctttgacctgaattccacatttctcagcttccactagaattccatgccatgcacttaactattcttcatgcattatcctcagtgactttttaaaatgtcagagctaaaggagctgagaggtaaactaacccaagactcttaattttatagataaagagagactcagaaatgtgaggtaatggatcccatcatatatacgataagtgaagtgccaggcccttatcttctgactcttgaagctatgtttctgttagtggttcacactatttcttctctatttctgccactaaggatccactcaaagggggtttctccataggtcactcaaattccttgagtttcttcaaagctattcttaactctgagatttaacaatagggacttttctaaatacatgatataaaacctatatactgaagctcagtatatccattaaaaaactcatgtttgccgggcgcggtggctcacgcctgtaatcccagcactttgggaggccgaggcgggcggatcacgaggtcaggagatcgagaccatcctggctaacacggtaaaaccccgtctctactaaaaaatacaaaaaaaaattagccgggcctggtggcgggcacctgtaatcccagctactgaggaggctgagacaggagaatggcttgaacctgggaggcggagcttgcagtgagctgagattgtgccactgcactccagcctgggcgacagagcaagactccgtctcaaaaacaaaaacaaaaaaaatctcatgttctagaacatttcacagcatgtgaaaatgcttatattgttttaaaaacagagtacaaaaagtaggtacattatgatgcaaatatctgtaaagaggctgtatggaagaatatacaccaaaatattaatgaccattaactctaggtgataatattgcaggtaaattggcctcatttatagttttgtgattttcacatattcttcacaagtatgtatttttgttactataaaagaaaaaaaggtatctgaatagcagagaaacagtccagcaaggaaatattctgagctggctttatctagtccatactttttgctttctccctttatcgctggctttttggtcaccctcagttttcatccctgactcccattatcactgtgttcccaaatgcaaatgctcatagtgatctcagctcacctgctcactacacctctgatctcaaagggaactaatgctcctttttgtactcttacaatttggctgtgatagaaaatgccaatggaaatgtcctataatcaactgaaactataaatgagaggcttcagctggagatgagatggaaagtcatttatttactgaggacagcaaaagcctggggaacaaaagccaaggaatccttaaagggcagagactagaacaaaagttcaaggctggagtttagggagagggtcatgatttagggttgggatgaagaatagagtcaggaaacagagagcataaatagcaaaaagtgatgtcatggaaaccaagaaggaagatctaaagtattaaatgttatgatataggcagcagcaggagcagaacaattaaagaataaattgaaaatgtttaaaaggattcataggaaaaatattgtattgattatttaagaacaattctgggaaaaggacacactaaaaacattttgatacattgtattttatgactggaaataaggaaaatcatcctaagcataatacctggtttcagaggagggataaaatccaggaacaaaatttttgagtgatggatgctcaccaagaaagccttatgacaggaaaaccagcaagcattaggctcaaagagacttttggatcatgtactttcacacctgggtgcccagaaaatataatatttttactggaataaagggatgagaccctaagttctgccaggtacccttgagggttaggagatcaaatgatccacatgtccactgcccattctaagaacatgggtgtatcccacacccgtaagagtaactctggagctgggaatatagataaagagatatactatttacattacattatatggtagtaccttgcagggacataagtcctatgccagggacatcacaagtgatgtccacttaaaatgaaggcctaatttcatctggagtagattgggaacgactgtcaaggaaataacatctaacttagaaaccaatggatttgtcaacagaataaagaataaagagaagagcactgcaagaaaaccagagaaagagaagagcaaaaagattaattccaagggaggtatgctgtgtcctgtgcccctcatttaggtggcaggtgggaaccagagaccctgaggccaggtcccacatctacacctcctgggaccatccctggctggtgctacaggcactgcagcttacgcttagctcttgggatgatccaatttcatgattaggaatggtttattcccaacacaggaggctataaaatataaaacctgtggatgccagctgtgtgcacacccagcaagagccaaaaaagtgaaataaaacatgcctgggacccttgatcccactgccaatggagaatggctttcagtaattctgtaacgcctcaagattccagaagctgactttaaaagtgtagttaaaaaaaaaatgggcttatttcacagttaatttccaatgatgtttaccaaaatctggccatagaagattggatccacgcccatataaatctaaaagacaagccagttttttccttttggagaaagtctgctgctgttataaatgataggcaccacagtccttggcaggagtgtaacctgaacctgttgagggaaggtataaaactgtccagaagaagtggaggaggagcagcctactgtgatatggatagtatcaagttgactttccttacagctgcaaacaagtatgatacaatggaaaatctgaagttagttgtgagagctctgaatgctgtccaacccaaatggaatgtgcagcctaccaaaatatttgcccttttacttgaagaacagtttaaaatgtcaggaacagcttctaagattagctagatgactgttgatcactttattgcaccttattacgtagcgctaatgggactatcttgtcttctttggtaaagagcccttatcaagtgattaggagcaatataactgctaagataccttacttagctaaaactattttggaaaaggatctcattctggcgtgcaagtactgctgaatgctattgctgcagaatattctgcttatcatcaaattgataatcacattaaattaataaacccaacagatgatatgggtaatatcaagttgactttccttacagctgtgtccttagagttgactttcccacattaaattaataaacccaacactgcttcctgaaattaacagcaaagtcacagaatgacaggcttgggagtggatatatggaaaaactccaaaatttagtatagacagttactttgttatatgaacagtcacgcttggaaaattattcatagatacaaaaaatgagagaattaaaatttataatattaaagcacctaagctttggttatcactggaaatgtataacaaagtaaattcaagtcttattgccagtaagttttacccagttgaaacgactgtgctaacaaatatattgcttagaatatgtccagaagaccatgtactacagaggaaattgaatactccctgtgaataaagagagccatgggattccaggtaagtttcttaatgctgacagtttcaatgagaaaataaaaatttcaaattaaaaaaagattcacttgagggactgaaataaatttgatgaggctgactggattataaatgtgtgtttctgtgcctaatggtgggcagggcagtgtaagacatgagctgtctcaggaaccacgtaactatttctatgggaatacaatgctaagctgagggaccataggccacaagataagcttagtttcttacatcaaagatgttgtgaccaagtatatgtttgagtttttgttgttgttgtctgggtgctttctttttgtttggtttgcttgtttctttattgcaaggggttagctttttttttttttttaatttgggcattgggaacaatttacatagaaaatgcacataatgctaagaaatacctgaagaagcaaggcctgctctttcctttgacagctttcttctggtttcaaaaatggcatcctctagttggaactagtggatattttaaatgcttccaatgcccatatatatagccaaaatgaatagatattgaactttataaggaaatcgaagacaccactcagttagtgatcaaatggagaagaaatcccggcttttcaactccctggtgcttttgttgttttctcaaatgtcccctcttgctttctcatacctccccagagagttatctctatgttattcccactgacaggaaagttgccaagttgattcaagtgctgctgagtaccagatttcatcagggagcttgtatcccatgcttctgcattgactagcattattcaatcaaaataacacaaataaaataaaatagcatttactccatcaggttggaaggtaaagtatacggtgactttaggagagagggaaagggacattcctaataaacttatacttgaaaagggtctagaaataattccagacattttctgctagttcgattacatttgaggagagaaaagagatgagtcacttcagaatgttatgttcaatgcaggagtagacaacagctgtttcatcagaccagactggaatgtactaggttcaccataccatagaccaagggatggcatatgcaaaagtgtgactgggagccttcttttgaaaccagagacacttcagccaaagtattctctgtagcaaaacaacctgatctttactggaatgtgtgaaaactttagtgatgctctctctctataacaacaagcctctctctagttatagtccctcgatgcaccaatgaacctgattactgattggaactggatgtgaggttatcttattcctcagtaattatcttgactgagttgcctttggagaaacaggctgatatggtttggctgtgtccccacccaaatcccattttgaatcccataatccccacaggtcatgggaggcatccgatgggaggtaattgaatcatgggggctgtaacccccatgctgctgttctcatgatagtgagtgaattctcacaatatctgatggttttatatggggctttaccccctttgcttggcacttcttccttccaccatgtgaagaaggatgtgtttgcgtccccttctgatatgactgtaagtttcctgaggcctccccagtcctgtggaactgtgagttaattaaacctctttcctttataaattacccagtcatgggtatttcttcatagcagcatgaaaatgaactaacacacaggcatttatgtggaggcatcaattcctttccaaagaagagattgcattaggaatgtcaggcaatggatgacatttggacatatgatttcatttattactgggatttattctgagaaagtaattcaaactttaatacaaattgtgcaagttttgctttagtacctgttttccacagaaaggactcctttttagttatcatatccattcagtgatgctgttatcaaaatccctacatggatatataatcaaatgcaaataagcccaagaaatgtctattttgctcttgaattacagcattctctatgcaaataagagtttttaaacttgcacagagatttctgtgttcaatgccagcaccatacaaaacatttaatgtgcactaggcttcaaggttttaatgcttttcatctttttctttccacagagcaggaacagtgccagttcacagatctctccaatatgctatgtatgtttttctgactgatgttagaagtttctctgatttttaaagttcagtgcacatcagcacaagcaaatatgatatttacaaagatgactgctgagagttccaaagtcatccgaaaaaggacattagatgacacgtttttaaaggcttctcagcaccaataaaacacggaaaagtccaatgatgtaaattaatcttataaaactagctagtaaaacacataaacctgatataatacatgaaataaatgtcaatctttcctgaaatactattcctgatataatttgtaatctgtttggagaaatggaccaattttgatctctcaagcatttctgagataaattaggcaaagcctttgcataattaaggccatcatgataatcatttggaaaagtcataagaaaaattaaagcaaatgagagcttgttcccaagcttgcaattatgtagggtgtttgtattgtacttgtaataaatacaaccaccactcttacttatctgtaaagtgtacatgagctgaaattacttctccagttgtctatctaccctcaatttattcaaataaaatcagtaagtactaggtacaagttcttagtgctacaaagggctcaagagacaaatgggacatattctgtcattaagaagtttaaaatcttattggggaaaatgttaacaaggggagaacctggggaaatgtatacagaactcattatatttgcaacttcatgtaaatctgaaattatttcaagaaaaattgttacaaaaaacttatttgtgaactaaaatatatccatgtgtaattacaaagcaataaggcataaataaagacagctgatgaagaacagcaggtgttacttgccaatcaacaatactgatggtgaatactgggggccttgggataagccagccagttaaccacaaggtagatctggcaaaccactgcctcagtgtgaggccacctattttcaatctgttgtcattatgtagtgagaccctgaaagcaaacttattttacaaataccacaaaatatcatagaagttttgtagaaactcctgacctttttttaaaaggtaactccttttttgttccacccaagcacacccaaaccaaaagcaaccaaactgaattttgaaagacacaagccttttagtacctacaataagccaaaataaataaccaaaggccttgaaaaataccaaggactgaaatatgagtcacaaaatcttacttcttttttttttttttttttttttttttttgagacggagtctcgctctgtcgcccaggtcggactgcggactgcagtggcgcaatctcggctcactgcaagctccgcttcccgggttcacgccattctcctgcctcagcctcccgagtagctgggactacaggcgcccgccaccgcgcctggctaattttttgtatttttagtagagacggggtttcaccttgttagccaggatggtctcgatctcctgacctcatgatccacccgcctcggcctcccaaagtgctgggattacaggcgtgagccaccgcgcccggccaaaatcttacttcttagagtgtggtcaaatactgataaatcagaaagaaatcaattttctagaaaacaaaggatataacacatttataaataaagttttaaactgtaatccccagtgcagctattttaattagcatggtcctctaaatttgttttagagaaaacaaaaggaaaggaagtagttgttttcatgagtaacaagggtctaaggtataacctcagttgtgatgatctccctctgaatcatgaaatggtctaaactgaatataatgctttatgtatagtgtatgtgttcaagtattaataaatctgaggtatggtcagcaagttgcattttgaggcaaatgtgtctcataatcaaaagccatgaatgcattgcatttattgtatagatgtgggaaatagggcacataaaaacaaaactgggcagagtatagaacaatgagcacgtctctagactcctagttagtgagcaacaaagcatgaatcaagactggctaggtaagagaggtgagtcccacctcgctctgacactgtccaacaggtggtgacattcagggactctgtgactccatctctttgtcaagtgatgttcatcaaactctttatattaattgccaaggagcttatccctgtgagagctcactctgaaaatggaagagctgtgaaaatgcctctgattttcatcaaaataatcacagggggttattaacttttcactctatatttctatatttaaaggacatggttctcccggggatgtcttttagataatataataatgagaaagctataatgagtttcttcagtaccaaggcattttgttatttgttggaataaagtggagcagatgaagaataaagaaatcagggaatgggtgtataatacaagaagctttagattgcattggaatgggtgtataacacaacaagctttagattgcactgagaatcaaggcagggatgagaccaggctacaggtgagaatgaatcatcctatttcactgcatccctatttgtaattcaggtagaaattaccatcctctagagatcctctaattccatcttattagacaacactataatgatcgccaagagaaaaataaaggaaaatcagattaccaactgccatctaattggtgtgtatctattacgtatgcatgggctgctagagactggcacaaatctttactacctgaaagcaatggaatgatcttctgaatatctgtcttgaaaacatattgatccacagctactaaatttcttattatttcccatgtgaggaaagacctctccaagtcactccacctttattaaaagtcatttctgttgactgttcatttgatgaacagacctcagtactcaacagtgctattctgcacttcctaaggcatctgtgtattttgggttctataagtcttcccattaaactgtgatattataggtcaggtgctagaaagacttgacatcttgcactgggaaagtacaaagatagtgacgttcagtcatgtaatgtaatgtaattccattgcctttgggtcacacatttggataattgacagcctttaaataacaagatggttggtatatttctcagttctttccacgtgtttttttttattgctctcttgaactacaaaaatatgaatatggatgtaaatgttcatgttttccaggatgtgagcagctgttctcttgaacttgttacgggaactaatctatttaatataaatcaaacacattttcagtagggacttttaagaacagtgaaactgatgtgtaatcacaacacaatttaatttttgggtgggaaagatcaagaaagtgtcatctgttaattactcctgttatacgatctaattttaccatttctaaatctgtattatatccttaataaaaataaaatatatccattccaatttacagaagactattaaaaaatgtaggtcaacttgaatatttgttggttatgagattataaaaaaaatttctcctttaatataaaagccatacatgtcctttgaagaaaacaaatggagtacagatttaaaaattagggaaaaagccgtatattttacatgtttaacaccttgctgtatattcattcaggctttaccatgtacatttgtccttctgtgtattgtgtgtgtctataagatcatgcttgaaatcatattttgtaacacatttttatttagtaatacactataaacttctttccatgtgaacagtttagatgggtggatggatggatggataaatcggtaatagatatttacaatataatatttgatggctaaatagtagttaactctattggtaaattttccaatcaatctcctattgtcaattggttggaaatagttttttatcagtttgacgtgcatgagtttgtggtttcactgtgcattgtaatcaacatacttgtattgatatctatacacatgttctaaattattttacaatatgattttggaaataaaaagtttagtcaaaatatatgttcttctgaatatttttatgggattaaaaaattgttcttcaaaaagtctacaccaatttaaacatccaccatgaggataccaccttgaaaatttctgaacatcttcacaattactagtcattatctttgaaaaaaaaactagttgtttcttgttttaacatttcattgtgttactaattttaataagagactcaactcatttataagtaggtaaactacagactggttactagatttccaaaggaaataatctaaagaattaaaagtaccgtcacttctcttttcctctccttccccaacacatgttttagaaatatagaggttattagtgaagccttccaaagccatacaaagatgatacaaagaatgatgatattttccaattcttcatagaaaccttgccaaggttgactataaaatttcatgatctaaaagttcttaaatgttgaatgatgaaaataatatacctagagaaaaatggaggaaagaatcaagtccttctaaaattaagcaacagtggagcagaggaaaagaagatggtactgctgctacctctgggccctatttagttattttcacactccaaatgagctattctctttttactaggtgcatggtggaaatggcataactcctcactttagtttagaaacagaacattctctcacagtgggttttatattatataacaggtttgaaacagaaaataaagttgatgtgaaaccatcaacccaaacagttaaaatggcagcatatgtcaccagtgcataaaggctggggctgtttctacggagagaggaagaagcctcgagcacaacattagcctggtttggtccacattttagagcacagagatgtgactatcccacagagataccagaactaataacacaactaatcaactttgcccagaatcggattcctgttctatgatgtaaccactgagaaaaaaaagaaagtgtttattttttataaagacaatgttataagcttttatttgcacaatatgttgttgatgctgaacacaatcctagggaagtgatcatagctgagtttctggaaaaacctaggttttaaagttgaggagacttaagtccaaaacctggcttcatcacttaccggctacaatactgggatatgttaacttcccttgatttcagctttctcgtctgtgaaatgaagatgataataatgctttcctgcccagattactgtattttagataatgcaactggcaaccggcaaatggcagaatggtgaaagataggaaacaatggggcagtatgtcagagtgacagccacttgctcaatttcaatcatctgtgggtagggatgaaggatgagagaacgtggagaaacttacacttaagaaaatcaaagtgagtttttgttctcttaacattgcctacataaatcagaatatgctaaatttaagaactgagtatatttagaataggttttctatttttaataatgccattgttcattttagtgtattattttagtgatgtgccctttatgagaggatgagagtcccatctccatgggaacaagattttgaaaacttgaagacattgtttttgttatattgcattcctctgggaatcatttaggatagcattgttgtaataacattttattaattgccttctttactatattttcctaaacactatatggagaaaagtactgtgattacatactttgaaccttctctcctggagcttccaacaaaatgtacccaatatattaaaaaactgatctacaatccatattccttcccttttcttacttgattatacctgggagaataagacttaagtgtctattcctaacgctgcaggagtatgaagcttattcatagctgagagcatagagagcagctcagacaaacccaggcaggatcacttcagaatgccttttggaagatgctttgccatacgcaggagtatgaagcttatccatagctgagagcatagagagcagctcagacaaacccaggcaggatcgccttttggaagatgctttgccatacgcaggagtatgaagcttatccatagctgagagcatagagagcagctcagacaaacccaggcaggatcacttcagaatgacttttggaagatgctttgccatacagggagtggcagtctttagaagagggtttctggaaggatcacagaaatgcgaccacagaagtgcaaagtctccggtcatcaagctctcagagtgttctctgcaacaatgtgacagggtataatgattctataaatactgatctccagctcacccatctgccaaggaaatattttcccagcatctgaattaagtggagaactgcttaactaaaggacagatgaagcaaatcatccatcttcagcgatcactcatggctttgttcatgaatggtaatttgtggtaataaattcgttcttttatttttgctacccaaatatgtttgtttgttgagatttttctaggtttagcttggagaccaaaatgagggacaggagtaaaatatcactgtcttttatcatgctgccactgagggagatgtcacattcagttttgaacagtccctaaactttaaatataaactaatcaatttgccgatccagtgacctgaaaatgccttgtggaaatggacagaagagaaggaggggctgggggtgaaggggcagagaagaaaagatcatggtctcagctacacaagccatgaatattatgaaaattaaaatttcattataatcataatatttctcactcctgtgcttgagtctggaaagagaaatcaaagtctttaatgctacggtgacaagtagttactctctggtaacaatctagatttcctagcaggcctttgttatgtctgggcctttggagaatttttctctagattattttgtctgtgtctgaaaggttcatacacatgctcctgccaaagcttgtcatttgggggtcattttagtcactggcaggatatagctagacaaacatgaggcagctgataaaggacaggcaatgccaaaaattaaggtctttcacagtagatttctgtttgcagtgaaatgaaatagactcaataccaaacaaagcaaaacaagttaaaagtaaagttgtgtggtcatgtaatatcttgagtttttggagtgtgacaaaatgaagatggtaagagaagaggaacccctcccgcactggggcttgtgaggatagagagcagctctcccgtggcactgcctcactttctattttcagcctttccatccatgcccagtactggctcacatatgaaacccgcctcttctggatgtctgagcccccttattaatctcatctctgtttattctcataaagtgatgccaagtgatcaccaatggagttgatacaagccggggtattcatgactgctaatggggtgatgaattacccattcaaagcatctcctcaccaattttagtaaaaaacatagatactaacacagaatcatgtagtcccagctactcgagaggttgaggcagaaagattgcttgagcccagggggtgaaggatacagtgagatatgaccatgccactgcactccagcctggatgacggagcagaaccctgtcacacacacacaaaagaaacaaacaaaaaacaccagagataaaaagaagtaggacaggggaaagagaagagcaaagaaaaagaaggaaatgatgtaaaaattaaatgcactcagccttctacatgtagtatttcctgctcaggtgtgctaaaatttaatttaaaaattggatcaatcataagcctttctgagaaaaccatgagaataaatgttaaaaatacagatattttaagaaaattactgattgcatgtattacagtttttctaaggattatcttcttggaagaaaacactgtcaaatggtattttaggtttctgtcacaaattttgaggtgctcacaaactaactgctgtctcgctatggagctgtttaagatgttccccactgaaacatgaatttataaataaacagatgaataaacccaaaggaattgtgcaattcttgaataacagaatccattggctgcacaatttgacaatttaaacacaatgagtgatttcctaggcttaatcagccttcctcccaatctcagaagcgtaaggttgcctggaagtgtttatttttcatgtttatttgtttcatattcccctactacctactaggcttgatcatatatgacattttatttcattgttcggacaattgtgtcaaataagcattttatctttattttaaaaccaaggatatctttgggtggagagatgacaggacttgcttagagtctaacagcttgcaagaggcataatcaggtttagagcagacgtcttccaatagaaagagcacaaaggaggtcaaatgctaatgttcaatgagtgatttctatatgtcaggtacttttaatgtactaatgaatttaatctttacaacaaatttaaaaatctataaaagtatcattttaaataagaagataatgtggtatggagtagttaatgaacattaaggtcaaacaggtaaatgatgaggccaagacttaagccacagcagcctggccaagttggaatcactattcatagtacctgaactgaatagtgatgtacacattgtgcacatgtaccctaaaacttaaagtataataataataaaattaaaaaaaaagacttctaaacattttggttgactaacatagctgtaatgcaaaaagcaacttttagttaatttttaaatgaaaattttttccactagtgtaacaactctataatattcagtataatttcacatatgtatagattgaccagaaccaggcatattcctaatagtgcacggaaaaagctaagtataaaagatagccaggaagtgataagattgtgtctatattttaagcatcatcgcaagtgcattgacttggatcccaggtaaactaaagcaaacaaaaatgataagcaatgcagaggaaccaattatcgaaaagtgatttacattcaattaaatcaagagttacattcaactttttcctcagtccacaatagttggaaatttgaatttaaaaagacatataatggcttttgattattcaaaaacacaagtcttccattttctactccacagtcacttatttcgtatgtaaatgattatttcataatacagaacagctaaaaacacaataaataaaatatgacaaacttatttttttatattaatcgccatggttctttgttgcagaaaaaagatggaaagagggcatgagaattaagaacggtcatgtgtgtaaaatatggttgaagtctagattcagtcaaaaagatttttctattctgctaaacattcatttatttatttattcattttgagacagagtttcatgcttgttgcctaggctggagtgcaatggcacaatctcagctcaccgctgagttcaagcggttctcctacctcagcctcccatatagctgggattacaggcctgtgccacaacgcctggctaatttttgtattcttagtagagatggggtttcaccatgttggccaggctggtctcaaactcctgacttcatgtgatccacctgcctcagtctcccaaattgctgagattacaggcgtgagccaccgtgctcagcctgctaaaatttatgagaaacatcagcagaatttatactttgtttacatttctagatacttttatttaccacgcatctgtctaaatagaaaaaagctctgctttcgtatcaccaaaggaatatatatttttaaaatctgttaacttatttcacattgtcacaggctctacacttgaaaatgtttgattgtcaaaagatccatagtagaagaatgaatttaaaaaacagttacctttagactagcaagaaaaatgtatactatcaattatacattaatttttcttatcaaccattgttcttagcaaagaaagactgtaaagtaaattcttttcaagaaaattcatggtaggctgtttctaagtgttcactggataggatatgtggactaatcattacacattcctttctgcccatcaaacatggaggcaatgcatcagtgtcatgtccagactgtaaactccccatggggtcaaggcctggaggatagggtggtaggaacaaaactgtctccttctgtgctatttttccaaagatcctaaagcagccttcccaataaaattaaaagctcaatgcatgctgttacctaaatagaaaaaaaatcgacttaaagacacaatatgcatttctctccctggatatagtcttagttaaacttatattttcagcttcaatagcatttcagcaagttttgtgctatctattaaaaaattgcaaaaaccaatagaaatactctccaaaatttaatgtattagtgctcaaaactaggctgagagattagagcactattatcagtctcttaggaagagaattttatgaatttggtataatatcccttctcaataagagacaataaaattcatgaattttcatgaataacaacttgcatttgagtggccaatatacgccaaagcatcattttaagtattttagttcatttagtcatcaaaatgaccttaggaggtagtttaactgtaatctacataattcccattttacagttgagaaaattgtggtttagggaaattacaaaaacaaactattttctcttcctgcaccacaatatatatgactatatgtattataaattttaactaacctgctatcaggataatttgaaaagatttttaaaattttaaatataatgcaaaataaatattttaaattttaaaaattaaacaaggccacttagaacaaacaaggaataatgtgagacaactgagattagttaattgctatagctgatttttctaaaaatttttattgttgaaccagaattaatacaaatacctagacctaaacataatgtgagctgtattgtacaggtcttagaaccagattacatagtaatatttttcttttattttccaaaggcaaaagatttaatataaagattcaagattcacatcatgacaaatgatacaaatttatgaaatatcctttcttcttcctctttttgtattttttgtagatggtttcaccacactgcccaggatggccttgaactcctgggctcaagtgatccatctgccttggcctcccaaattgctgggattacaggtatgagccaccaagcacagcagtggctttttctattttaactaaccttgccatctttccccctgtgcttctctgttactgccccctcctgttttcctgctacattgactggttatattgacaggtgtgcccctcccccagtagcataggatgtttactcttagacaagctaggacagtataaattctaaaaggactagtcaactgcagtagtgagatgggggcaagaggcaagtagaacaaggaattctatctgtaactgactgtgaacaatcaactgaaataactaactaccttcagaccagcctgttttttttaacatacactttaactttattaacatctaggtaacatctgtaatattccttgctcctcatccccaagtatgctgctagctgtccatccttctgggtagaagtgtattctccagttttacttgttgatttttggatgtgtgctgggggagaaaagcatattgtgtttatagtcaccctagactgctaaagtatattctccagtaattaactcaaagtggccatatgtgaaacataatctctaaattcttcaatatcaaaaaatacctttgttttatccctaaaatcaaatgctagtttggctggatataggaatctaggattaaagcctttttcctgcagaactttaaagatattgctccatttactgctagcatccagtgtgtccagtgataagtctgctgtcaatctgattcttgttccttggtagattatttctcttctctctatagaagtccttattattttctctttatcattagaattccaaaatttcaccaagatgtgtctagggtcagtctcttttcatcaatcttactaggtactcagcaagcactgacaatctcaagacttgaaactttctttagttctgcaaagttttcatcaattatttccttaattatgtcctctgctccattctcattattccgttttcctggaattcctatcaaatgaatgttggagcttctggatctatcctctctatctctttgcctttctttattaattatctttttggtcgtttggactgtattcttagagaattcttcaatttgatcttctagactgttcattctttcttcaagtatgtccattccgctactcagatcatctactgaatttttaatttccaacactcctggatgggaacttttcaaatttccaatctccttttttatctctctgatgctattaatcacactacctctcaagttttcctctatttcctatgttaagtctgcttctttggatgtcagttcttctgtttctagagttctgtgtctctcttcttctgttttcttaaaaagtttggtgactcctgttgaaatactcaaatttgtatgtgaatgttttttatgcttatcataacctatctctagtgactttgagggagaggccaaacataaagttagacagggtgtgccagttccttgacttgtgggcacaactgtttcctcttcctcctgggttttgtacaccacctggtgtttcaccaacattttcttcccagagtccgcaaccaaataactaaagggaatttctttttgtctatgtgagttttcttttttctcagtcagggaggtagctttacctttcctatttcagagccctttccttcctcttcctcctctggctcagaatcctctactgagtcaatgaaaatagtttccatgccatcactggttatctcaactccatgctttgcatctaccaaagtatgaccctgaaaggttgagtcttattccttacagaacactgaagtctgttcctcctccttctctagccctgaggcctcttcttcctcttccttctctggccctgaggtctcttcttcttcttcctcctccagccctgaggcctcctcttccagccctgaggtcacttatccatcgccctccatccctgaggcctcttcatccagctcctctagctcagaaaactcttcctcttaagtctctaagttgttcatctactctggcttagcaactttttacatagtaatatttttcaaatatggcagcttttttaaaatgagctacatctgaatcaatgtggaacttacagattaccagataacattccagacctgctgaatcagaactttcaagtatggggcttgcacatgtacattttacaaatacccacaatgagttgcatgctcaatcaaggctgagaatatgtgtcattataatctaccacattcaaagcacttccttatctatcagtcctctataaataccaatcaccaagtttcaactcattgtagacattttgcaaggcatcatgacaatatgctcagctttgtgatgagccaacctaacagtcatgacaattttgagaatatagtcagttggtcaaaccctatcctcacatcctaaccatcccagatcttcatcttgaggtccaagtgaattggagtccacctaactttcctcagaagagagtatcagtaactcttgccctatcagccagtagggttttaagaatcactttcttctgctctatgtcatgattcacgagggttctgctgacctgtttccaggcagaatcaggacaccctctgtgtctacccacctgcctccctctactagtgaagactttcagggtcctgagtgccccgctcgagagcatctccagtgctagccttgtgcctgacttccctgatttctatgacagataaacatcccatctgtccctggatacccctgaggctgatgttcccacctctcccttggagaagtaataacttgcttaaattcccataagcagtaagtaatggagcaggtattcaaacaggtctctgtttccaaaggtcacactttttctacttttaaagcatactgattaaatgtttctccccaaaatgagatgttctaagcaagcctttggcaagtgctgaatcctgagacatctgtaattaaattctcttcatgttgtacttgtactgaagatatgttccattgcttgtttatgcaagaactgcacactttaaatacagagctgggagaggcagaattgtccttctgttaaaaggatgagaattggactcgtattgttgccaagaaagagggttattctattcaacgcaggtgtgaacattatggatgcctttcataggagataatatttagctcaaaacgaaaaagtaattttatttttgtcaggtgcttgcctacagcaaaaataaaacaaaagcatgaaagactgcattgtgtaacatatttaggaaaaacatacacaatacactcattaatttatataaagcagtcatttgataatcatgatgttgatgataatgaatagtgtaggcatactagagtgaatttctgagaaagggatgggatttggagggagtgtggaggaaatgggcttatttgagggagggacatgagagtggttgcagaaatgtctaagtttataggttcagtagtgaaaagaggagacctaggaggtaagagagtgagagaataggcgggtatggtggctcatgcctgtaatcccagcactttgggaggctgaggcgggcagatcacctaaggtcaggagtttgagaccagcctgaccaacatggtgaaaccctgtctctactaaaaatacaaaattagccaggcgtggtggtgcatgcctgtaatcccagctacttgggagcctgaggcaggagaatcgcttaaatctgggaggcagaagtttcagtgagccgagatcacgcattgcactccagtctgggcaatcagagtgaaactctgtgagaaacaaagaaagagagagagagaaggaaggaaacaaaagagagagagagaagagcagaaatgtcagacaaagagtggaaaagtaagatgattagaagaatggaacaggattttgggtagtgctaagagtacaattgaggttggtcataacaaattaacattttcccagtgtttgtgactttctctagcagcatttagcaactagagtgcaggaactctgaatgtgaacaactaggtcactacacagatgggatgttacctgacaaatacaatgtgtactcagagttaagctagtttagggcagcagcatgatgaccaaattgaaatggcacataagaagggaatgaggaaataagatgtcgatgaacacagagataaaaaaaaaaaggctgaagaatggcctcgcagggaaaagataaacaagaaggttggagggagagtaggttgtggtcagagtacaaggtatttgattagtggttttggaagtgcatagttttgatgacaagctaggggtatgactactgggtgtatgtgccttaagtggagggaagaaaaacactggagataagggcgccaaagaacagaaggccgagagtaaaggagattatgcatcattacagaggaaggagatttagagttaagaagacagcaagtctggtgccaaagtcttggataaaggaagagcataagatggatagtgaataggaggatgaaacaatgatatatttctatgacaacattcttgaaacattctacttagctcattttgagctaagtagaggcttcgtaaaagagagtaagtgcgttgtgctctggtgggagtgaagttcaaggtggatatcgtgaactcctcactccctaatcctggggaaatgtgataagaggagaaagagccctttgggagaactgtagaggaactcagatttcttaactcttactctttcttggtggtgccctttatgagtagctgtgcgttgcctgtcactcagcaacaaccctgagccacaagacagagatgccaggtatctggcataattgaagctaagggaaggacaatcagcaaaagatatggaaaactggtttgctctggaccaagcagagaaaattgttcatcaattaaattcaacatatatttggtgagaaattactttggctaagagtccacagatgagataatttatactcactgccagaaataccaaactgtttccatagcccatcatccttgggacctaatgtgtgtatctgatacaggaggcagcctattctttttagatcatataaaagaaggaagcaggagccatgacttctattcttagttcttctactaatagatcataagcaactacctacaaccccaaaccccagtctcctcacctagaacatgagtgatgattaactagatgatcactaattaccattccagttctcaagatcagtgatgtcatgattcacggggactccccagatagaactgccatatctactctgcgtccacttgggcagacttcctgcctaattctaccttacttcatggattccctcccacaaacttccagaatgctgttaagcagcacccccaccccccttactcaatggccttactaaacagtcaaaaagagcttcctttttaatctgggcaagaaatagccctctattctttaaaggacatagccagttgcctctactggaactccaaaaaaatgacaagcaggtatcatacctttgtattgccagaactcatctctttaaatgaaaatgagaggagagggaacaaattaggggcaattggaagatttcctaatcacaggccttgaaaaagaaagtccacaaagctgttcagtctcttggagtcataagagcaaggaatcattgagatgacaagctaaactcgctcaaagagatggcattatcaacctcccttttttgttgctgttttattttttcctcactccatctgctcagaggaacccaatcttgctgaattggtatgaagatggctggagaattataaattaatgggagggatgccagagaacataaatagatgacaccgtctcacatggccaatacatttattcagtttaatagccaatgaaaggcaaagaaagccactcatttaagatgtttaaaattgcacaaaatgttaaggattgtatcatagtaaaataatactcaaatgaaatatatgccagttccattttaaactataaaaaagagaatatctttgtataaagcctctgtattaataaacattgtattccgtgtaagtgcttaatgtgttagatttcagcatgtacattaaactttaaatgtaacttcccattatgatatcttaagaaaatttctcaatctattaacaaatgagaggaagcaccttgtgtgaagccttgtgctgggctccctaggacaaaggcaaagttcaaggaagggcctctactctaaagaatttacagtcaattaggaaaactgtacaaaagtagtaaaatattttcggacacacacacacacacacacacacacacacacacagccaacagccacacacaaaatacgtaacatatcaccattgctaggtagtgtctaactgattgccagatgtctactaaagaatgttacagtttaaccctaatatcagctgttcaaaactcatttgataggtaagtaaatgaatttagagcacttattcaaggttatatacctagaaagaagcaaaccaatatatgaacttaaagtcaaattttatcctccatttactccactgtgctaccaactaaagtgctacagatttttaataaagggaagaacacgcttgattaaaaatagagattagacatctcatggtatagagctcttaatagagctcttaataaattatttttataacagttttattgacatacaattcatgtaccgtaaaattcaccttttatggtgtacaatttagtgttctttagtatattcttgtggttgtacaacatcaccactctctaattttcaaaattttatcatcacaaaaagaaactacacactcattatcaatcatttcttaatcttccctttccccagcccctgacaacaactaatctatgttctttctctatgaatttgccaatactgggcaattcatatcaatggaatcatacaagatgcagccttttgtctgtcttctttcacttagaaaaaatttttaaggttcgtttatgtcataacagggtgcactgacaggtacagtaaggcctcacttggaaagtttagggcattggcataaggatcattgaaataatgcacaagaggagaataaaataacaaggtgtcaataaacatgggaatctaaatgaggtcccagtgggagaagataaacaagaatgttgaagggagaatagttgtggtcccacaccaagatattttaatgtctttttattgacaagtaatattccattgtgtcgatctaccacattttatttctccatttatcagttaatgaacatttcagttgtctccacttttacactattataaataatgcagctgtaaaatttatgtacaagttttacatgaacatgtgtttttaaaaaattttcttaggtatataaaaattttcctagaaataaaattcctgagttactctgtttcacattttaaagaactgtatgtgttttccaaagtgtctgtaccattttacaattctgccagcaacgcatgaggattctaattcctccacattcttgccaacacttatttctgtctgacttttaattttggttatcctaggagtgggaagaggtatctcattgtagttcgtatttgcatttccataatgactaatgatgttgagcagttttcttgtgtttattggtaattatacaacttttctggagaactgtctattcaaatgcttttcccattttaattgggttatttttctttttaatgtggtctgtgtttttacattctgaaaacaaatctctcataagatacatgacttgtaaatatttccttccataatatgaagcgtttttcactttttgatggtctcctttggaacataagtatttttaattttaatgaagttaaatgtatctattttatcttttgtgacttgtgatttttgtgtcttttctaagaaaactttgcctaatttactatcatgaatatgtacaccaatttttcttctaagagttttatagtttaggtcgatgattcaatttttgtatatggtgtgaggtaaaggtgtaacttcaatctttttcatgtggctgttcagttattccagcaccatttgttaaaatactaccatttcccccactgaatagtcttggtacccttgtcaaaaatcaattgaccatcaatgttaggatgtacttccagaatctcaattcagttttactggtgtatatatatatatacatatgtaaaatggaatttatatatatacacacacacatatataaacacacacagacatgcatatatatatattcatataattatattatatatatgtctactcttatgccatgtatactggcatacttcttgatttggtttgtagtaatttttgagatctgggaatgtgaatcctctaacttcattctttttcaagactgtttcggctataagtcccttcaatgtccatataaactttaggatcaggttgtcaaactctaaaaataaaatgccagctgggattttgatacgaattatgaattgaattgaaactgtagttaagtttggcgagtactgacatattgacatgttaagaatattaagtcttctagtctgtaaacatgggatgtctttctatttatataggcattatataatttattttgatgatgttctgtagctctcagtgaacaagtattgtactttttttcttttttggagacagatccatcacccaggctggagtgcagtggcatgatcttggttcactgcaacttctacctccagggttcaagtgattctcatgcttcagccttctgagtagctgggactacaggtgtgtgccaccatgcctgagtaatttttgtattttcagtagagtcaggatttcctcatgttggccaggctggtcttgaacttctgacctcaagtcatctgcctgtctcagactcccaaagtgctgcgattacaggagtgagccactgcacccagacagtattgtacttcttttgttcaatttatttttaagtgttattcttttgatgatattctaagtgccattttcttaacttcactttcagatttttcattgttagtatatagaaatacaattgattgttctatattgagcttgtagcctgtaatattgtcaaattcatttattagttctaatagttgtgtttgtgtgtgtgtgtgaattcttttgcattatctatatagggggttgtgtcatttgtaaatagagttaattttacttcttcaaatacaatgttaaacagaagtggcaagagcagacatttttgtcttattccttgttctagggggaaatcattcagtctttcctaatttagtctgatgttgatgtgcttttttttggtagatgtctttattgaagttctcttctgttcctagtctgctgagatttcattgtgaaaaggtgttgaattttatcaaatgctttttcttcattgattgagatgagcatgctatattttgttctttattctattaatatggtatattaaattgaagaatgtatgtacgtaacaacaacagtgcattctgggatagatatttccatttggttatggtatatattctttttatatgttgctagattaagatttttatatttcattaaaatttttttcatttatattcataaaggatattgatcaatatacttatttccttgtaatatactttttttgatattagaatattaacttcattgaaagaattgggaagtgtttcttcctattctagttcttcaaagatcttgaacacattaagtagaatttttttataataagcttttaaaaaaatttgctatcttttggtcattttacttttcccagaactgagtttagtgttctgtattatttgtcgtctatattctgtacataagttttatagttcttaacacatttaatccagttaaattagtcaagaatagtgagagcactcaatggctagaaataaaactacttttcactttaatatcactgggtagagcagtacatataaaggttcagactttaattttcccttattttgcatgttttttcttactctgagtcattatttacataagaaattgttttaaaggtcacttttaagtgaggaaaaaagctcctcactatataacacaaccagatttcacttagaattgaacccagtgaaagacttttacaacaaattctattaatagcttgacttagattctgttaataggttgacaatttgagctgtctttctacccattgtagtaaactcataaacctaaaggggctgtctaagaaatgagaataactagaacttgaagagtaaattatgaatatgtttaatgttcaggccaggctatctttcctcctttggcatagtcaattcccaagtcaaggttggatttaaaatcaaactttctagtaagagtaattggcaaaccatctccctaattagcaggggtttaatcaacttgagaaataaaaagaaacacacacacacatacacacagacacacacatacacacacacatatatttataaaatagtataatatgcattatctatattacatataatatagataatgactatatattataattattataattccacagaggatttttttcttttttaagctttaagtcacaaatgttcttctttcagtataaatggagattaaatgagaaagggggatacataagcaaatttcttctaatatatactctttctactatcctaaacggctagcaggaaagataattctaacgatattttacacaccatgttgcaaaggtttaaattatcttgaattcccccaatttacttattccacacataaaagaaatgtcaaaaatggctagtaagttttctcaaatctatgagaaatgtcaaaactttttagaaaattctagcttatggctatcttatttactaagctatccatcctttgcttgactcggtataatcttgtttgctaactatagccttttagagaagagaatagtttaggacattgttggaatctggacgtgggtgcatgtgtgtgtcttcatgcttgactggggctgatgggttatcctgtcacgatttacctgtatttattctaggctaacctgcaggtgtttccatagcaacgtctctcgatgactattattgttgtgacaccaaaggaggtgacaatcttagggagcctttttattatatagagagaaaccaatagaagtttatgttctctgattattcatcaccctttattggcagagtgtggccacctctgggttttgatttggtgtcctttcactccactcacacctaaatctctctgctgtctgttcttgatggtacaacacaactctgccaactgtcactgttagaaaaccccataagaagggaagaaggaaaggaaagcgtgtctttcaaaagacagaagttttgatgccttttctttctttcttcccgaatggtctgcatgcttgtgcttcccccaaatttatattgaaacctagtcactaatgtgctggtatgaagagatggtacctttgggaggtgattaagtcacgagggcagagctgtcacgaatggaattagtattcgcactggactgggcctttacaaaaaagacccaggggagctgatttgcctccttccaccagtggaagtgagaatgcaccatctgtgacccagaaagcaggccttgccaggcatcaaatatgctggcatcttgacatcgaatttttgagccttcagaatgatgagaagcaagtttctgtcatgtataagtacccaggtaatggtatttttgttatagcagcctaagttgactaaagcattgatcaaatgcttactatttatcagatgcttacacttctatagacatttattaagtgcttctaggcacttaagtaaatactccatgtattgaggaagccactgagaaaattaggtattatactgaccccaagttttcatgtcagggaatatggggttttttttgttttgtttttcatctttaaagctttaaatcacagatgcccttctttcagaataattgaggatcaaataaggaaaaactgggaactataaacaaattaactttttgcctagtgaatcattttacctaaaatcttccctgactgttaatcttgtgtatggcattcacgtctctcctgagctttgcaagtctacctgccttgctatccttagaatgtgccttttctctccacaggggaaggagcattcagctaaaaatgaggctcagcagaacacattctctgggcatgctaggaatccacagctcatcggtacagaaataaaacatggctgatttatatacaaacaatggtgacaggattgtcacagcacacatggtaacttcgctggcttggaaatcatcccaaaatcaactaacgagcacttcaaaaaggagggcaaaatgaggctctcatgttgcttgtgtgtgtgtctttcttcaaagtcaagtgccagatctacttagagcagacgttcttatgttttaaaagctgatttggttaatttactgctgctaaatgtagaatcagatattttcccttttataataatataacttaggatgcaagattttttccatctcattctcattaactagatccccatatttataaactgcccctcttatatctactgatcagttacatcacaaatattttatcttacagcagagctagcccaatgaacaaaatattctgaaataaatgcatttgaaaaatgaaacaacttgagccagtatagcatcatgtgtgtagatcaacatgaattgtgtcattacaaacaactcaaagtttaagctacattaaactataagatctctactgcccattacagctcctccaggctatgattttgaagaacttagcccaaagcagaagctacagaaaaatttgactttgagattttataagacaataaattgaaaatctttggaataacataatttatgaaacaaaactgttttttaaccctccactcccatcacttatctatacagaatgcagtccaaaatggaaacagaactgatgttttctttgggagaccagaataaacatttagtaagaatggtgggaaaaggctctggattattcagttcattatttaacacatcttgtgtcttgtgcccctgttatgcattaggctcagtgcaggatgctaagaatataggaggaagcaatagagaaatgattgttcttgtcttcatagagtttataatcttgcatgggggacagtcaacaaacaagttaacaaatacataaactacggactcctctttttaggagagaaaagtattatgtgtcaagtatacaatataatttttagctacactaggtaactgtatgagagatttttcatttataataccattatttattgaacccccaaattcctacaaacaatgacatactttagtaaaagaagcatatttgtctatggataatttgtttttagataatcttattgaaagccaagaaaaactgtactttgtaaagtcttcttgggtggtaaaagttaatatgcttttctaatcagtctgccccaggttccagagatgagtgtcccagggagcacatgcccccacatgccttcaaagatgaggcagggaccccacggggtcagtttgtgtagatatggttttgagtatcattgctgtgaaatagctgcaaccaaccagccaaccttcagcagaaagaaaggacaaccaaggcacaggaaaaggtcaagttcttgagacagtcaccaggcaatgaaagaagactgaaacaaatacattcgggggaaagatttgcataaacatcatggtttcagcacagaaaggggccttaagatgacttctgatcttctttacaaaatcttgaacagtaggagcccatttcaagaagagtccaggcgtacggcttcactgatgtcttgggttgatccctatctcatcaatgtcaggggacagcctgagtcccgcacagggacttcggggaagcctagaggaaaggtggctgtgggagaaggagctacaaacctccctccagctttctccctcagagtaattgtcttacttttgttcccataaaaatctaggctcctgaggttattctcaatggaaaatatggtgtaagcgaatactcggtatgaatttcaatgaaatcatgttgtacttctgatcttacagggaaatattaagatccatgttacatagaaatgcactaggcattgctgtctccccatgaaacatgacttaagcacaggatgtttggcaacagctttataacataagtcaaaataaaattggtttccatgcctcccatatagttacataaaaatcataagtggcagaaatgtccatgttttacatttatgctttatgaagtattttgtgctttgtcctattatgtaacaacccagaaagaatatatgcaccggtcaatttttctccacttctgcatacttattttgtaccctttaaaattagagtcctgatcatgaaaaagatccaagcacagactatttttgttgtaaaaatgaaattaaaattgttctttattataatgaggtgaatgtagtttgcacttagcaacacattacacaccatttattcctcacaacgcgttaggtttccttatgcacttatgatatttgaagctcaaaaatgctaaattatttgcccacattcgtacagctagtgctggggattagaattcagatctgagttactataaagccatgcttttttcactaaaagttcttcctcttatgctcaatttaataacagtttagttaaatttgaaacattccactctcattatcatattagaattgtaaatattcctccagaactaaaagaccaaaaatctatattttcttatttgattgaattatggttaaactcccaatacagatataatgaaaacataaaacagcaaaaaaaaaaaagcataacaatattggcagtcttcattttggacctttgaagagcactgagtccataaatgggtcccctaagacctttagaaatgtatttccttaaggccaaaagggtatgtataacccatgacaggaatctatagtcaaaccttttcatatgaattcttaatcaaacaatttataaagaaatgaaacattaaggaataatggtgatgagatttcttttcatttgttcatccaggttttaagagtaacaacaaaattaacattcattgccgtacttttctaacattacaaatctgttcattagcctcctggcacaggaatcataaaaatgatgaggggatgttgaatttataacatcaagggaaggtgagaaatatgctgctcttgatattcaacatgaagatactgatgactgactccaaaactcctgctggcccacagctccacattctcctcagaccaaacagcctgcagcacaggaccttacccactgggagcttatatccacattggaatcaaaattactgaaatgcaactgctttcagccttttctctccactacccactaaatagggtttctatttggctttcagcctcttccttctcccactctgcaaggagggtcctaatttgtctgactagttcttgtgctctgtggttcagaatcagaaagaaatagacaaagtgggcaacaagagaggcaaagagagctggaggaattgcacaaaaaaataaaacaccttgaaaaaaaggtgcgagaacagccatagtagctgaacatactggatgggagagaaaactaatagggtcttaaggtattttgagtaatgacatagtttttatcttcctatggcatttggaaattccagtatagaatttgacttattttgaggcacattttgttgcatggttgtatttggtttgtgtcctttaatgcttataccccagtagggctgcactatgtgggccacccacatatcagtgtgacacagtttgggggagagccaggcaggggacatacactatcactggctttttgctcctcttcaggaacaacactgacccttgcagatgcactgtcaagctgtactaggatggcaccatacggaggccgtccatgaggaaaagaccatggggaaggcagcagtaatcccagctatgtcctattcatcccttctggatcttcacctctaagcaaccaagattttattcccagagctttcttcatgaagcctacctgagaaggaacaatgacaaggagctcacaggggccaactgtggtccaagactcttcagaggataaacttcatgacaacaatcaaaacttcacttgaccacagctgtgtattcactttctggaattgcctcatacacaagaaaaatgccttgaaataagaaaatccttgaataccctacccataaactttaaaagttggaatccctttccatgaatccatatgccagtatttatagtatcttcatgatcagttacttttccagtacatctcaagcatattctgatttccagaacattttgaatcccatcttactgtaactaaccatggaaaatcatggtgtgacaaacagtaacaaagccatataccagtatacaaataaagtaaaataaaataacaaataaaatacagtagttctacaatagaatcatcatgagaagtggtggttaaaatggggcacatgacaagggaagccttagcttagatcaattcctgggagaaaaagaagcgttctatattttaaaagaacaccaagcttaacagacccattcaaatcaatatttcagcctacgcttgcgtgtgcacgcacacacacacacacacactcatgcacgcatactcaatgacaccataaatttcagagacttaaaaggcttatactcttaggcttgtcacctcagcattactttctcctgatctgtaaagctgttctcaggacaagatctgagctacccatgctgaaacataagcttaagaaaagagaggagagcctggcaccgagttatattaggatgcaatgtctattcagcaagaaagctcactggctctaaagcatttatatcaattttaaagattatttgcaaagaatcgtttggtttcagcaaaacactctgaaacaatttcacaattgcaattcaatgcacttgaaaccaagactccctaccagctcagctcacagcatggagacgtacagtgtggagaggtggggcccatatattgcatggtgtcagaacgctgtctgcctgaaaagccattcattacaaaatgctgcatctcaggagaatgagcctagaaaagtgaggaccgcacagcagaggaaaatgcaagctctgtgtttgccatgatttcaacagctgtgcctctcttctttctgggatcaatgcactattttatctaacagcaggaaaggagaagactgcataatgtggcagcaatacaaaaggagagaatgttaatatagaggctgcaactcaatttccctagagactgtaccctccagaagcccaggactccgggatacaacataatgagagagagctgactcaatggagcacgacaagtcatcacattacaagtcagctggaacacctgatggagtcacaatgttttctcattctgtggagagaacaatgaatgagaaggctcttaagagttagaagcatagctatcaagcaagtgatttgtataaatagatgacttcttcatgatactggctgtttaggccaacagagaggatgacagtggcagcatcggtcgctgccatctaaacattctatctggaaataagaaagacatcttcctcccatctaatcctccgactagagctgcaatgaagttgagtcaagtgaggcactagccttgggcaaaaatgtaatgaggtgccaaaacatcagtcaccaaggtagtattccaacataagagctattttaatgaaaatcaatgcaaaaatatccatgataaaaaagtcacattttaaaattaaaaacagaaaacaatcttacatctgaaccactcagctcaccctcctcaccctagtcctggtcctgcccctcacagggatgttggtggcattagatgatggctatgccacgaaactttaaaaataaaaagcactattacccttgagcacctgctggagtaaatgtatggccccagactctctatgaacagagtctcactttgttcttgtaaaattttgaggcttccattattgttccattttgcaaatgaggcacctgatgttcttaaaagtcaagcatctgggctggaattgaatcctggatgtctaataccatcttctgtgctgtttccaccccatcacgccattatccactaacaatgaaactcatcctaagactggtttaatgtattttaagaacttgaaataatacggagaaatcaagtgaggttgtctgatgcctgagttgatgagtcagacactgctcaccttctaaaaagagccctatgtctcagtataggagcctgttaacaaaattcatatcagaaataaggttctaaggatatgcaagggtgaaatctggggtgagcatagaaagaggcaatagaggagactgtatgactctctttttgtatttacttatatttatttttatattttttgcagccatgtgtttggatgaagatgagtacaaagaagccaggtagctttatttaaatgtgaagtttctaggaagggcctctcaacccttgccctatctgtcctgtcctgcaacacatttcaatactaattagctacttgctcttgggctctagcctgtatatggaagagtcccatgtggccttgtagaaggtgtgactactggtaccactggatgactcaggacagttgatcaatcaacagcttcccctggacctgaagccaacattttcaaatgcattgcattgctaacttttactttttcactgctggagttattattagcttctctctttagtttcatgaggaaggaagctatatttctgtaataacatcttaataacttttagcacttcaaaattatttaaggtttttactacagtatctttctctggagtcagaggataaatacgtccctctccacctgtgtctcaggtaaaaatgcagttgctttaccagacagtcaccaatattccttctagctctaaagtgctgtgttgataagtccaggaaaatgtgctaaagacaaggatcaaagaagcagaatgtgtggagcacataaaggggacacgagtcagaaaggaaggcctggggaaaggaagatcaatgtaagggaaatccctcaggtgttataaattaaggacagaaaggtaaatttttaacaggagcaaaagagtaacagctacaggctgtaagctggagaggggatgtgggagtggggaaatagagagagaaaaacattatcccaggtatttcagacacaggaaatgtgttttcacaagcccttcttataatgactctgaggctcactgaagcctgaaaaccactgggctaaagcacagtgtcaatgcctttgtttaaagatatgtccatcacatttcttatgtcaacatcaaaatgactagtgggaaacaatatgtaaggtgttcttggtaaaagaggatatgctagccagtcttatgtacaccaccaacacagatgtccctacaatgtgctaagcaggatacacctcctgttcacatgacagttagacgcagaactattaatctgtcccatgactgagactctaaccaaaaggagggacaaagtttacctccagccactcgagggtgctcctgaaatgggagagagggaagcagctcaggttcaatctgggttggttgtggtgagcagaaacaattttccaaacaacatcatatgatgtcactaggggcattccatgatgctataccataagttacggtatttatatgaaatttctgaagatataaggaagcaataagaaactaaagtttggatcaaagaggaaacagaaggaggaggagaagaaggagaaggaggaggatgaggaggaggacgaagaagaaaaagaagaacaacaacaacaacaacacatcacaccttgggtcaaagctatgaatttctaccttcagcttctgagaaatgcagaatcctatgtcacagatttgagagcaatgaagaatattaacttagagaaagataaaggaatgctaatatttcctcttatattttaaaattcttggaaagatgaacttgaggaaagaaaggagatttttcctgcttggcaatcacaaatctgaaaatggtcagagcaaaatacacagggagcatattttcagagtggcatcctttccaaattctatctagtcatcaccctaatggataaccatgttcatcagtgcacaattggggaaaattatctcttgagtgtttgagagtttgttggtgactaattactatcatggattaaaagagagactataactcttaactagattttattatgaaggtatatcctatagttctattatattgtattaattttctgttgctgctgtatcaaattatcataaacttagtggttttaatctacagaaatttattgttctgtatgtcaaaattccaacacaggtctcagtggactaaaatcagggttgtgttccttcctggagtctctaaggaacagtctgtttcctgaccttttctggtttgtagaggttgcctgtcttccttggctcatggcctctctcctctattttcaaagccagcaaaattgcatcactctgtgcttttcctccataaactcatctccttcttggaccatagccctaattataatgagctgcttggataatccaggaaaatctccctatatccatattcctaacataatcacatctgcaaaaccctcctgccaataggaggaaataagggaatgggggaaagatcatgaaaaggaccacaactactaacactaaataaatacctagtgggtacctggttctctgttcatcaaacgtcagcagtttgctaaatttgttaataattgtcttgtttcaaaatgactatataaacatttattaaagaaaatcagttgcacattaaccgttgcagaccagtatccaagtggattgagcctagtaatggattcctgtcctcaggcttgatagacaccatgcttgcccaatgcacagcaagtcaactcacttcagtactccctagaaagtataaatttccctttatatcaaatatctcaaactccatgttaattcccccattttatacatccagtgtgaacaagcaagaaaggaaaaacaatgtaaatgagatacgaatatgaataaaatggatctcttgcttggtggaagaggtgaggtacagaaggaaataatgtacagctagagagattgctaaaaagtcaaataaatacatctaggctgggatccaaaggaagattgcattattttgcatgaaatgctttattacccaagtttagaaatgctcatattcaactatatgatcataaatccattctaaagccaaatatgaatgggtttggatcaaccaccattaaaagtatcttaacttcttttattcaaaaatggaaagggaataatatcacccagtgtaacagtttgtcttggaatatatgttattagtgagcatagccattttgaggaactgctaagttccttgaccatagaatgacacacaccacagtagaagagattgactgaagcctgctcctagggtatgcaaaacttgataaatcaacatgaaaaacattttccagggagcacccgggaacagttatattatccatttttctacctctaatttccttgatttctgatttttacaataggaaccatacattttcacattcatcatgaataacttgttttcaacaaatgtattaagcagggagttgggatgttcctaaacctgcaagaaattcttaatttttttattcttatcttactcatctttagttggttgtatttgctatatgcattggatttctaccccccactgtgagacagtcagatccattttatgtcataaaataaagccaacatattttgaaccagtgtgaaagttttaatttttaatattttatatttaaatgattaaatgaaatatacatcctattatattgaaattttatttattaatacttgattttaagaaataaagtttttaaagtattacattagcttctaggaaaaactttcctgtcccataaatactatttctactagtacaaatgctcccatgagtgatcccaattgctgagtatgtactgtaccaggtgctgtactactggtagtgacatggattagctcatttaattcacacagcagccacttgagatatgttctgttatcctcattatgtaataggggaaaatagactcaggtaaatgacacagccaggtcccttagtgggtatagcagggaagcttgaacttgaattcaattcagatttaaagtctatctctcgcccacacattctgatatcttcactctattttgttgctgtcaataattaaagagaagctttctgagccactcatattttcccattcattctcctgtttcaagataactttctttttctttcaccagatggaaaataattgagtttgtggagtggtatgtcatcccaagaggagaaaaagcccacagcttccgagtgggtctcctggggctcctgtaaggaagtactacagaccgcgtggctcagaacagcaggcattcattgtttcatagttctgggcggtagaagccaaaatcaaggggccagcaggttggtcctacagcctctgagggagaatccatcccatggccctctcccagcttcagaggctgacagcaatcctggtgttctttggctcctgcggtgctgactcctgtctctgcctctgtcatcgcgtgctattctagatgtgcctgtgtccaaatgttcttcttataaagataacagtcatattggattatggcccaccctaatgatttcatcttaacttgattacgtctgctaagacccaatttccacatatggtcacattaataggcaccagaggtagggacttcaatatctctctttaggggatgtaattccctgaaaagtatcttatccgctgaaaagaagatgtggtacttttggggttttaatcctttgggtggcttcctcagtcagagaaatccatcctctgtgtaaactctagagttttcttcctgtaattctgcttcgaggctcatcactctgcagcctaaaagctgccattgagacacaaagcaaaaattactttgtgtttacatgttaaaaaaaaaaatcctcttcagcatgcatcacgttccagggctctaaaagtcaaaccaaactacaggcctctctgaaaatgttacctgtgagttgttgtttcaataaacagcaacagcaacaaaaatcctatccgttcttcaagcctctttcaaattgtgatctctgtgaagatcacagagatctcccattactctaaaaatgtctctcttgctcctctgctccctagtgggttgtttcctttgtactgttgagctttttatattctcccctataatcctcatgatcaagtatttcttccttattagctcacattttactagttgtaggcggagcaaataatcatatttgtctttttttctcttacatctccaggtatacaatacctttttacatagagggtgctgattaaatgttcagcaaattgacagctataccgtcaaaaatttcagaaaatcttgcatttccacaatgacagttgctacagaaacagtaacaaagagtcttatgtcactctatatctttgagccctgacttacacatctgtaaactgtagataataaaaactactttgcaatcatgtcacaaaaatacagtgaaacgctaggaaagcttctttgtaggatatattggacatggcaaattggatggatatttgttggctgtcaatgtgttaatttcccaattctgcttccgtgtgttaaagccctgaaagctattgaatcttggtgaaaacacataagtgaaaagctatgacatgcatttttgttactttatctttctgggcaatcaatttgggggtacctgggaaaattgcagtgcctgtctgctgtttctgttgggtccagtggttctctattgattaatttatgctctgactcattttgcaaagagtttaagatgcttggatcctcattaagattgaggtcttagctaccatatttcttattcttggtagtaaaaaatcgcttacctaatcacagattggtgcacctgttgaggcagagccaatgtttacttacccaccctaccatacccagcaggtgctcaacaaataatgaactgaattgaactccactcaagtcggtgatttctaatctagtagctccagtccctccttttacaaacaaatattgtatgttgtacctatttgccaatctgaaaaaaaaatttatataactttctcttcacacatattttttaaaaatttaatgccctataatataaaagagcaagaaaaatataattatttaaaaagaatgtgcatctcaatatataaatgatcaagtttgactatcctagaagaaataatagttaactaccttgtaaactatatgttgtaaagttatagaataaactttagaaaaatgggagtgtaattagtgtgaaattagagtcattatgactatgacagttacaaattcaagctgatacatatatgttttattcctattgctatttgtgataagatttttcaaaatggtgaacttttggtaaaattatcaacaaaaatagtatgaccttcttttgatttaatggtaagtgaattccttaaaaaaaaaaaacagtgtatgttaagccatgcaaaaattactttgtgtttccatgtaaaaaaaaaaaaagagagattttattaaaaaatgtttcctttacttgaactagaacaggaattttgaaagtcagagtgtgcacagcaatgacttcttctgtgtgcagaactgtctttcactgtaaaagacatctggatgggggaaggtccttaacctcataaaagccagaagtgcttccttattttcttctagaagtgtctccttgggagtggggagagagaactacctatctaggtgaaagttctttcagatcctacctttggacatgatttcctcacattccaacagcatccacagtgaagtctctaatttccttcacatttctccttcacaagtctcctaagttccattgcttgagaatgcacatcttaacactgtgaccagccagccaaagttcacttaaaggactcatctcactatccaacacaacaaaatgtttggtaacaaacgaacatactcaaagaagagcaaactttccttccttagtcatttccttatgcctaaattcttttgtaaaagactgaatcaattttcacatctgagttctggttcacctactacctagcacatgataggaactcctatgtggcataaaacatggtaatgaggcagtctgcatctgcatggcagctgacaaggaatgcttatacaaatatggtatcacttagtaaaacaggcactttcatgcatgacactaacctgtgaaatgtacacaaattcatatcattatcaataaattagtacaatctactcagctgtttctcacttctgagacactgcagtctagctcagtgaattgagaaggtcgtaatcattgttcctcagtgaccttgtctattcttgtatttaatattaactctaagaggcacctgtcacagtaagtacttccacctgttggaatgtaatttccaacatgtcttttttattcagtaatatatcctcagaacctagaacagggcctggcatatagtagatgctcaaagccaaaaatgtctagaatgaatgaataaacaagtgaatgctgtgtccaatatgtgtgaatgccatgtaagcacaaaggtaaaaaaaagacaaacacctgcccttgcagatttgcagttaaatggaacataatctctctaatattagtgatgtgccaacacatgtctgtgtatattttaggagaatataaaaaacagagaactcatgtttttagtgagtgagtcaattttattcagatgattttattcaaaaggcaggctgtttcactctcaaaactatggatagttggggctgcacaattctttgttgcagagggctttgcgtattgtagaatatgcagtaccagcaagtgtcagtagcaaacctccagcagtgacaacaaaaatatctcagacatttgtgccaagagaatcactggactaaaaaatacgaatttaccagacggacgaatggataaagagaaaaatatgagcttatgaatgacagggtcaggaccatatttatctttgcattctagcaaatagcattagtgctgatcataaaaagaaataattaatgtcttacattgctcttttaatctgtcatgtccattcatacgcatataatccttaaaacaaccttgcaggaaaatagtgttgatattgactcctttattaaataacacaatccggataagcaaaatgaagcacccaaggtcacctttatattttagtggtctttgttcttctcaggacttttcctcaatcgtacttaaagccactaaccactcagatgacttattcttccaattggaaccaggctgcattaaatcacaattgtttaacaactgtcaaacaacaggtttcatccaacgcttactctaggccagatactttgctaaacactgaggcaaaacctccaaacaatttgcttcttttttagaagggcaagtacttgacagtggatgaaagtggaacatttttcccctagagggatcaaattggggtataactctaaaggcaggtttgagggagaaattaaaaagaggtaaaatgcagtatgggacatgaaaatggaaaaccttctcaaataaggccagtaaagtgcaaaacagggtaaaagcaaatatctgaccgaaacagtgagccatataagaaacatgaaactagattaggaactaggaaatctggcctttccttcccacggttccagcatttatcttgttgatcttgggcaagccatttaacctctctgggtctcactttagatggtctccagcccaaaggccagcttaactggcatgcatgtggactatcagtgcggctaccacatcctacctagcaactggattgttgtcatggctgctgcaccatccttgtacaagtgcagcaatcagaaggatctctgaaattacagtgctcaagttctgttaagctttaactctgggaagctatgagtggaactgcatagaaatgacactggaatgtgaatgccaatgcccaaagtaaggtggctctggccagccatgctaacttgtcttgaagtctatttgcacagaagatacagctggaacatgtgctttcctccacttcatctcacctggggtcaagacccggttggccagctgactggccactgacatcccccttgactccatagggagctgcagttgaggtactttccaaatgaatcctgacttacacaggtactctcctcctcctggtagatgctgtcctaactgctaattacccctaaaagataactgattcctttcctattgtttctcccctaaactgcaaaagatgattgcaatgataaaaaaaaaaactgcttttattaaatgaacttttggaagaggaacatatataaataaattagtagtagtccataaaaacctgtccttcatgttcaacctaatgggcatcctagggcaactatttgccagatcatcgatctgttgagaaaggaataaaagcgaagtctcctctttcgtaaaaaaaaaatgcacaaaattttctataagtttcaggtggcttggagatactctgaagcattaagttaaacacagtttaaaaactgccttaaagtgatcatcattttaattatttccaaacccatgatctctcaaagccatttaattgctgtaaaaggcactttcaggaggaaaacaatctcaaattaccttccaccatcctccaccactcaagaagaagaaagatatacatcgtcagtcccccacaactttccaacatcaaaatttcaagcattttatttggccagatgcatgtagatcatttacagtttaatggaaatattgacatatgtctaccaaaatactctagatctattggagaaattttgccgatgttggtgtactctgacttgctaccatggccagcaaatagaggtgtctactcatcctcattcttatacaaggacagaacagcaatagtggcaaaaacatgtgtctataacctcactgacgttccccatccatgtctgttaagctgacctcagagtctgagagtgtcaattgaattttactcatctaataattttgatattcaatttgtgtagttaaaatatacattatagggtgaagtttcaagagttgtctcagacacttcccatcaagcatctatgtgcacacagaggtagactaagtatgtcacatcagctaaatatacatcctttagggatgactggaaaggaaactgctatgcagatggaaaaaaaaaaagctgtaaccatagatataaatatatgtaaatacacacagaagtttcaattttcacaggatgcctgaaacaggaatgcttgatctctttcacgaatattaggtttttagaatttcataaatggtgaggagaaaatataaaatggcacagaaggctgtggtagaagaactcaggtaacatataaagaaaccatcaggacaactcattgtctgattttgattactgtggagcaactgtgatctctatcatgaaaattccttaacaagctagaaaaaaaattaaaagaccatgcagtggcagaataatggaaatgcagaacatgttacattgtacatagggatctttgaaaaggaaaaagcacaaattgtatgtatctggttcataatcatatttgatccctgatacagtttagagatgtgtaattatctacatctctttcccattcattctggttgtaagttttaagttcagcaaatcaactgtgtgattaaagcaactgaattcagcctgaaaatctttgctctgccatctataggatagtctgtctggtagctacttggaggcactacagcattaagcatgtcattcatgcagaagggcccggggtctgacaagcctgtgaggaatggctagaagagctgaacaagcattctcacaaaaccaatcacttggtaattgctgagttgttatcacagcaattaccaagtgattgatcttgtgagggttagagaagtggtaaatccttggcatgttcttaaggacttttgtcaatgtcaagatctattctaactcccacttcttgcacaagaaaaaagagatgccttttgttcttgcctgggcaggaaacactgactctccagttacccaaccccctaactcctttttcctaagcctctctctagtcaattcctacggggctgatttctggaaagataattccactaaaattattaacatgaaaaccatatatcaatatcatagaattataaacacagatagattgtagttaactgcacctacaaataaacattattaatattaaagcttgtgcataatgatgtgggaaaattaatgcttattgtcagaaaatatttttgagtttattaatataaagaacactaagagaaaagctctcacatgttattactattttaaagaaacatgaattaaatggggaaccacaaaaaacaggagtatgatgttgcgtcaaataggaaaagtgagtatagctacccagggttaaatctggggtcttagtcataaatctttatttgacaatttaatgcaccgttctgttaaactaccattttgctttcattgttcctacctcaaatgacacaattaacaaattgtgagtgctgacggtgatatccaataaaaggtggaatatattaaaaaggtttattgaaattactttatcacatcttcagaaaattgttgaaaagtacaggtggatagatgaaaagccctaacatcttttctaccattagcaagggatgattttaaaaatgtaaataaatgcatttgctatatttgaagcataatttctacattgataatttagtttagaataaatgttgctattccaataatgaatgtctcttcatgggtactgctgtcataattacttaagaaaaaaatattaattggtcaccaaaccatctcagcagatggatctattggggaggtgtcaggttagtgttacattttagcacaaaattgttgtgtgttattttatagtattcaaataatcaaaatcatacaactctggacaggaattggcgaagtatactccaaatggaaaattcacacataaaactgaataaatagtatattttttctgggttgtagcctagataagagaacaaaatatttaaatgagaaaatttagaagtataatacatatggacagcaggaaatgtcatccaaaaaggtcatttttgctttatataaaaaattaaccattttatccccttcctaccatcccacacatacacatacatacatcttggcagcttcgaaattttggtttaagaataataagaataataatgcaaacctaaaagattctaattgtaatcatttctgctcttgagggagatttagctatacctttaaaaaaaaattactggcctgttcaggacaaaataaggattgaaatgttttaaaggattaagaaaatgtggcacatatacaccatggaatactatgcagccataaaaaatgatgagttcacgtcctttgcagggacatggatgaagctggaaaccatcattctcagcaaactatcgcaaggacaaaaaaccaaacaccgcatattctcactcataggtgggaattgaacaacgagaacacatggacacaggaaggggaacatcacacaccggggcctgttgtggggtggtgggaagggggagggatagcattaggagatatacctaatgctaaatgacgagttaatgggtgcagcacaccaacatggcacatgtatacatatgtaacaaacctgcatgttgtgcacatgtaccctaaaacttaaagtataataaaaaaaatcatctttacaaatagtttttctcaacattaaaaaggaaatttaaacccacttttcatgccttctatttagaagcaaaaaatacatttttatgagaaaagagtatgggcccttttagttggtatggtgccagttcctttagaaggagactttctaagcccggtttattatcttagttgtttaaaaaaaaaaaaagcagcagttgatataaacttttcatatttaactgaagtttactctgaagagattaaaagagtttctattccatgaaacgacttgctccaagtttctatgactgggtttcttttggctgaatggcccagttcaagctgtttaatgatgtggtagatgaggaaacagcatggctcttaggtcataaccttgctctgttgttcaaaagctgttgcgatcttaggaaaagtaccaatcttatgttttgtcttctagaaaagggggtgtgagggaataataaatacctgtactgcatggttgctgtgaaaattgtatgggataatggacacatgaagagtttgcagagtgcctgataccttgtggttagtatacggtaactatcattttttgttacatctttcactttggattccatgttttatgcccacaacatttggaggtaaattataatttccatcttagagtcggagtcacttaaggcttagaagttcagtgacttgcccgctgtcgtgtatgacagatctgaaagtcttccagttccaaatccagaattaagtttccactcctcatcctatctgggcaatacttagtgccacgtaagtgttacctgctggggatgatgatgctgcacctgtgtgagaaggagcaggcccatgctatttgaaataactcactgggaagacattcccaggggaagaatgacattgacctttggaaacttatagtagccagagtttgtgcccaattccagaaccgaggctgtcttcactcaggcacattccttatgttatttagcctttgcttccccagctatggagaaaaagaggattctcttattgattactctggattccaactctaattcctcagatactgtcacattaattatttaaatcggaataacttcccttcctaaaacagcagtcttttgatattgctgtatttcagctgataatgggagaaaaaagttagattccaagaaagggcaaaaattatgatacgaaataaaaaactaagacatatgtctcctgagaaaacaatgtaaaaaatcaatagtcaaagaaacttcaatcaaccattttaaaggaaaattttaggaaaaaaaatacaatcaatataaatatgaaaggatattaattttgaacatgccagaaaatccttataggctatatataatttttaaataaaagacacaaactttgatttgcacaattaaatgtcctttcttttacctctacattctgagttttaaccagtcaataaatgtgctctttctagacaaaaataaatctgaaaatcaaatttttattgactttaaaatcattattccaggactgagcacccagtgtcattgggcctcactgtcactgtgaaacccttctttttgttttgaatgggattactgattttgagtcttctaataatatgttcacttcaaaacaacaaaaaaataggagacagaattggatttccaaaagtccaaatcatcattaaataaacattgtttgcttgcctgagcattactgtttgcatcttactctcctcattcatatattaaggttctaaccaccagtaccttagaatgtgactttatttggaaataagattattacaggtataattagttaaattaagatgagctcatactggatgagaatatgcccctaatgcaatatgactagcatccttataaaaaggggaaatttacacacacgcacccccccacacacaaacacacaaacacacaatgtcatgtgaacatgaaggaagagactggagagagctgtccacaatccaaggaacaaaagagattgatggcaaacaaccagaatctaggggagaggcatcaaacatattctatttcatatgactgaaaggtaccaaccccactcatgcctagatctcagacttataacctccacaacagtgagacaatagattccaattgcttaatccaaccagtttgggacactttgttatgacagccctcctagcaaactaatacaatgacgttgtttcagcaacatgctgctgagacttagtgttccatttcttagttataaaagctataaaaatatatggaaagagcaaggcaaagtccaaggtactttatttcctttcaaggctgagtggatgattcaaatgtgttaagaggaaaataaatgagaaatttctaggatgtacttatccttccatctgtatcaggacacagtatagaaaaatagattaataaactcataaaactaaaagctttctgtatcttatacataaaaccaccttgggggatggggaagctcttataagcaaagaaacaaaactatatagttttggagtcacactttatggtcatcatctcttccatcaccataaccacgaacttttacagatcactgtagaacttgtagcaactacaaacgttgaacacctagcaccctgtaaacatccaacaactgatagctttcaagatgcccatatatttcttaggaataagctgatgttctgtctaataatgattgagaaacaaaattaattaataaatctacagattccttaagactcaatgtaaatggtggactacaccaagtcaccaagatgtcaccaagatgatgtcacaaatatggcagagtaagagacaagccttcatcccacacacacaaaaagaaaaagcgcagatagctactcacaaatcagataaacccagggaaagctcaagggctcatgaaaaaattggcagcaatacagtagagagaaaaaaaacatagaatattgatacagaaaggatcactggtgggatcagcatacctgagacaccaggagactgctaggaccaaagaagaaaggtggacctatcaatatcagcccatggtctcatctgcagaggatactggcatatcttgccactgaggtaaccaacagccattcttgatggggaacaccagagacaggtatggctgcacagctgtattaagttgcttcaggaaattagctaccacgtctcccaaaccaccatttatctcagtctcagagctgtggtcaatatgcaagtgcccacattacaggcccaggcttggtggctgcgttaagcccactcatgtctcaggcacatggagtgaggacttagctctggggcccacagtgtgaaacatctcattacatgtgcccatgttccaggcactggctcagctgccatagagagctaggccccaccccaacatttaactctcacccatctgtgatctcatttccagatctctttctgctccacaagtatccatgtctcacactatgttaccagcatggtagtggggagtgcctgtaccctgagtatcattgccattactttcccggatcccagagccacagaaactctgtgcatgcctgtacttcaggcctcagatccacaggcaccacacatcagacaccagtgccactgccacttcaagtgaacccacaagccagacccagtgccccaaaggacctgctgagccataacttccccactgtgagaaaagggatcaggaggactttggcagccatcaccaccaaataccctaccagtgctcactaccactatggatagcacagtgttggctgctgaggatccctgcaacatttgccaactctgaccttagctgatagagctatacaaacactacacagcagcacccttactggtgtcagaactgctgcaccacaaccagcaagcattctcacatcccctctctcccataaaggaaggtctttccacagcaagactagccagtagagtctgaaagtggtgaatactccaccaaatacatacacatcaatgtcaataagaagcttgaaaaaccaaagagacataacaccaccaaaagaccataataatctcttagtagctgacacaaagaaatggagatatattaaatgcttaaaaaaattcacaataattgttttaaggaagctcaatgaacttcaagaaaatagagaaacaattcagttaatcaggaaaacaatgaattaccaacacaaaaagtttaacagattaaaattattttaaaaattaatccaattctggagctgaaaaatacagttaatgaaatgaaaatgaaatagagggcatcaacataagaatttatttgtattcaggagataatatctatatactcaaagacaggttatttgaaaatatataatcagaaaagaaaaacaacaaaaaggaataaaggaagcttacaggattcataggtcaacatcaacagagcaaatgtttgagtcctggcagttaagaaaagagagtgataaaaagctggaaagtttattttaaaaaaatagcaaaaactttccaaatccaggaaaaatataaatatccaggtacgagaaggtcaacagattcaatctaaacaagactataccaagacatattgtaaccgatttttcaaaaattggatttctgaaaatttttgaaaatttgaaaaattgtaaccaatttttcaaagacagagaggatactaaaagtaacaagagaaaaaaaagcaaatcatatattagagaatttcaataaggcagcagtgaatttttcatcagaaaccttataggccaggaaaaagtgaaatgatagatttgaagtggtgaagaaaaaaaaaactgtcaaccaagaataccgtatccagcaaatatgtccttcagaaatgaagagaagcagactttttcagacaaacaaaagttgaggaagttcataatcaccagacctgttttacaagaaatagtaaagggagtttctcaagctgaaagaagaagatgctaatgagtaacacaaaaacatctgaaagtacagaactcataaataaaagtaagcagttaatttggagtactctaatactgtaatagtggtgtgtacatcacttatgtctttagtgtgatgactaaaagacaagtattaaaaataccaagagctacaataatatgttaactgatgtacaatataaaaagatgtaaattgtaacatcaaaaagccttatggtaaccacaaagcaaaaaccaatagtagatgcacaaaagataaacagtaaggaatcttggcaaaacactagagaaaaatcacctaatcacaaaggaagatagcaagaaaggaacaaaggatctataaaacaataagacaataacaaaatagcagtggtatttacatatcaataattaccttaaatataaagagattaaattctccaatcaaaagacgtagagtggctgaagcaataaggaaaacgaaacagaacatgatccaacaatatgctgcctacaagagactaacttcacctttaaggaaacacatggactgaaagttaagggatggaaaaaaggattccttgcaaatggaaaccaaaatagagaaattatttcaaataacaaaagaaaattcagaaaattcacaaacatatggaaattaaacaacatgttcctgaacaaccgatcaattaaagaacaaattaaaagcaaaatttaaaaatgtcttgagataaacaaaaatgtaaacacaacttatgaaaatgtatggggtatagtaaaagcagttttaagaagtaaatgtatagcaataaatgcctacatcaagaaaataagaaagctttctaagtgttagatatttgcttactgctttataaatgtttaagtctcacaagctctggggtagacaaaaattacgtcagtttcccagaggaaaaaccagagaagttaataaacacatataatggcttagaacttgtactttgcacagctgggattttggaatgattatatcattatataaaaagtgaatagaacttaagttctacttcatttatgttctgtttcttttgtttttactgaactgtaagttctggtaaagggtttcatcattttatctttcacatttaacacagttcctggcacatagtactcactcaactagttttaaatcaatgagtgaaggagattttgcttctcaaattcctttatattgcaagcaggtaagcaatatttatttcatggttgatatacatgtcaccatagctatggacatttacttatagattttgcagcatccttaggaacaagacaagacagaatgggataaatttgaggcacagaaaaccaatctgtcatcactgatgtgagagaatactgagtcactttttaaaaatgtaacttaagaaatattatgagaaataatagttaactatgatcttgattaattttttctcacactttttgatgtggcataatgtatcacaaagagtgcttttaaaaaatcaatatatttagaggagttccctcctagaattttatctcctcttttatagtggacataatgtttagactatacatgtaaattacactttactaaagctattttgtaatgtgaggaagatagtcccataccactgtttggccatctcccctataagacaatgaatgaagcatacttagccacagaattactgtcaggattagaaagagtccgttttcttaacctcttctcagtctgttccccattggttagtgttaatgtcaattttaattacagagtcaggtgtttggactttccctgggttttctcagactctttgtggcatcagctactatccaccctctgctgataccaagtattgctacatccttcaactttctactatacatcgcatctggatgtctaaactcaaattcaacttagggtatccaaaacacaagtcattatgtttctctccttttctacctctcctcccaccacagagcaaggtgttactgcttccacattttctaggtagttatcagagttatccctccttttattcatccccaatatgaaaccattcatcaaatctcataagtattattgccaaagaatcctctgaaactatcactcccgctttctgttcccacagccatgccttcatttctgattttcatcacccatctttttgaatcactgtacaaccaggtatccatgtctcacattccagtcctttatccactctccagtcccatggagaaatacagttatttctaactataaataaaatctcaccatacccacttaaagacttagccagttccttaattgtttctcacagttcaatgccccatttgtagcatacaaaaatccaacctagtttttcagccttatttcctgccacatgcctcatgcacatgtttttctagtcaatttgaatttttaaaatcatctccaatacatgctgaggctcttttgattgtctgcttatgcacatactattccctgtgcctgacatgcctttccttgacttaacctttatgactcaaataaatttcatctgctctgtgaaacgtttattgctttcctctagagggattaatctctgtctctttgttgtgctttcatagtactttgtttgttctccaaacataagtcagtgggatctttttaaaacataactaagattatatcatattcctgttgaacaccattcaaaggcttgttatcctacttggaataaaatctaaactctttaccctgttctattaacaaatcatcccttagaactgggcagtcaggcctctgttctgcacctaaacttcagcatagtaataccacacccatgatacatttattaaaggagacatgcgtacttctgccacttgagattcaatgttcagtgggggcatagcacaacacagggggtggcaaaccacacctctttgggccagacccagcctgcctatttttgcaaataaagcttttgtattaatctattttcatactgctgataaatacatacccgagactgggtaattgataaggaaaaagaggtttaatggactcacagtcccatgtggctggggaggcctcacaatcatggcagaaagtgaaaggcacatcatacctgacagcagccaagatagaatgagagccaagggaaaagggaaatcccttataaaaccatcacatcttatgagacttattcactaccacgagaacagtataactgcccctatgattcaattatctcccactgggtccctcccacatgtgggaattatgggagctacaattcaggatgagatttgggtggggacacagacaaatcacatcggctttattgaaacacagctatgctcattcatttatacatagtctacagttgcttttgcactacaatgacagagttgggtatttgttacaaatggcccagaaagacaaagctatttggcccatgacagaaaaatttgccagccattgacacagcctataactcttatctgcccttgagactacctacatttaggctcaaagaaacatagttcaacaatcatttacctttgttttcaaagcaaaggctacattttgtccaattggtgcaagagttttcagttcgtgccactaccaacagcagagattaacatttctgtgcttttggtagaaaaaagacacattaattaacttgtcaaatccttctcagagaatatggatgcagtagatacttacataataaaacataatttctccaaagtgctaagtgcccattttcctacttcatggtctcatttgtggttccataaatactcacaatacagcaaattatatgcaatagttgcacatgacaactaagaaacatttcgtaatattaaaagctgtatttttgtcttaaatttaaatatgaataggtctagaaagaacatgagaatcaggatcctacagtgattcaacaatgaataccagaattatattgtttatatatatgtaaaatataatacagatataaatatattataaaactaaaatgaatatatatttatataaaatataatgaaattcttaaaataatttcaatagaattataactagtattctcccttttattgcaataggtaattttgaattttagaaaagtaatgatttagtatattatataaataatttgtttttcaacttttaaaatttgctttgacatatttttatgacatttaaattttatacaatttgaatccaattacattttatttctgaattctttagatcattgctgccaataaaatatggtttatgtgactttttatattagcttaattagtgattttgctaaaatgaaagcagaaaaagtaaattcaaaggagtaatgatataattgtttataaactatgaattttttaatcatattatgaacacaagataactgacccattaacagaatatgaaaaaaataagcaatgataactagattcagtcacctttagtactttgctaaattttagtcataaaaatcttatagtttaatgaatattttacaaattgttatgatgaatgcttatttgtcagcataggaaagaatacatttcagtcaacagtgagtctgattgataactttagctctttacgtgtatggaatatggtctccatttgcagtcctgcctcaggccccacaattggatggagtaattctgctattaataataatattttcttacaagattaatactttaaagtatctcttccctaaccagaatatagttagtatgagaacaaggaccatacctattttttaatactgtattctcagtgaccattatagtatttgaaacatagggagcatgcaataaatatttgttgagtaaatagctatttatggcatgaatagtgcattgtaatcatctgtggccatgaacttatttttgttgacagtaatttcttaatgcataattcagtgctgactgaaaaatatttcttgaataaaggaatagataaataaatgataaataaagtgactgaatacatttaaccactgtaaggaatttattcccaattcaattaatagaatattttagaccttgggttaattcttgaagtgtcttaatttctccaagtgctgaatgttgggatcactttccatcactaagcatactttgttgttaatttgtggaagcctgtgaaattcctccactgataatcacattactttattattgttgtgtctcaaccaccagctcagaacatgtaatttgctaagaacatgttcaaggcagatggacctgaaacctgtgaagcttttattattttcattagcacttgtaacaaaggacatgagtctctataatcaaacattgctacagagaagctaaggctttgtgacagccacagccaccacaacatgtctcctgcttatatggatgtgatggctactgacataagcagagattgtagtcaaataccgaaaaaaggattattttattaacaatctctttgttttctaaggacttccttgacatatacagaaagtgaataacacggaaataaaatctaaacacattctcccacaaagaaggcatctagtttgattttctcagtaatccaactcattttttatcaggtaaggatcaaaagtttgtcttcatatcttcttccctcttgaggaaaagtaatttcttaactttcatcaaggggttttaccttagcccatgaacttaatgaagtgtataattcctattttaaaaaatgaaactggtattttattattaacaaagttgtatatttgcattgtagagagtagacaaatataaagggtaaaaaataaaacaattatattctccccatcactattacctcttagtgtgtcatccccaataaatactcacattaatatgcattttttcaaaataagataatgcaatacctagtttgtaattttctcttcagttaagatgtccatatctccattttaatgagttttttaatgtaatctaataaccagtcttactcaaatttgccctgaaatttcccctactgcttatttttctgagtccaaatccaatgtggtatcacatgttgtttctagttgccatacctcttaactgctttttactctaaaatagtcaacatttctcatgatatcgaattgctcaacagaccaggaatttcatcagtcttaactaaaaaaaaaaaaaatagagatttatgaaaaaagatgactatgtggtcacaagtatatagctccatctcatcaaatctccagtgaaataacaagttttcccaaattgagactgggggctgtatatggtctagaaaataatgatgaggctacttcacataccagaaccaataaagaatgtgctctagacctagagcagattgaatgagattgaagaaggaaatgtcctctgaaagtctagaatgtctaggaggcaagtggaaggacacattgtcacatcatcaactggagcaagataggggaatagtcctcagaacaatactaccaagtgtggcatctctttcctccctgcaagccaatggcctttagaatgcaccaatcacaatgaaagacagaggactcactctcacaatgagtgaccacaccaaccagcaggcaaggtatgtgtctctaaaaggaaaacactgtggctcacatgctttctcaatagccagcttggagtatagttgtataaaaagcaacacagagcactcaaaaataggcaaggacttagaaaatgcaggaactatgcaagtcttctaaataattcaatgaatgagctaggccagaataataaaagattaaagcagggcacagtgactcacgcctgtaatcccagcactttgggaggccgaggcgggtggatcacgtgaggtcagaagttcgaaaccggcatggccaacgtggtgaaaccacgtctctactaaaaatgcaaaacttagccaggcgtggttctgcacgcctgtagccccagctactcaggaggctgaggcaggagaatcactggaacccgggagatggaggttgcagcgagccgagatcgcaccattgcactccagcctgggtgacagagcgagactccatctcaaaaaaacaaaaacaaaaacaaaaaaaaaagaaaagaaagaaagaaaagaaacaaaacaaacaaacaaacaaaacaaaagattaaaaagaatgaataaattgccaaggactaaaatcagttaaatacagaccggcattcctaatttgaaaagctgaaatccaaaatgttccaaaattccaaactttttgagtgccagcataacattcaaaggtcatgctcaaaggaaatgctgattggagcattttgaattttggatttgtggatcacagatgctcaactggtaagtataatatgatgcaaatattcaaaaaaaaaaaaatcccaaatcctaaacatttctggtcccaggcatttctgataagggacactcaacctgtaaagaaataaatctgggcaggtcgtggtggctcacgcctgtaatcccagcactttgggaggctgaggccgggggatcatgaggtcaagagatcgagaccatcctggctaacacagtgaaaccccgtctatactaaaaatacaaaaaaattagccgggcatggtggcgggcgcctgtagtcccagccacgcgggaggctgaggccagagaatggcatgaacccggggggcagagcttgcagtgagccgagatcgcgccactgcacttcagcctgggcaatagagcgagactctgtctcaaaaaaagaagaaatctaaactaaacacgttttacacagttatatcactgcttcacattttttgatagctatcctcaatgttttttaactggtaaatgtttttatcactttaaattacataaataaaaaaggagaaatttaaaaatcagtaaaaatccttgatattgatacaggagttgggggagcagggaagtgctgggtagataagggcagggtccctggcgagggctccaccctcgggcctgtgcccatggacctaagtgaggacaagcacccctgttttcgtgcccaaatgttgcattttccaagaccactctggcccatcacgctcccattctgtgtctaaaaaaacccaagaccctattgggcacgcacacaagtagccagatgtcaagaagaacacaccagcagaagaacacaccaacagaggccagcaggtcattgatggcggaacaatgcggacgcctaggggagttcggctaagggccatgggaggagagcccggcagctgagcagccggactccaggagaagaacaccttcccattccatccccatgctggctccacatccatcggctgagagctacttccaccactcaataaaaccttgcactcattctccaagcccttatgtgacccgatttttccagtacacaagggcaagaacccaggatacagaaagccctctgtccttgctttaaggcagaaggtctaactgagctgattaagacaaaccacttgcagacagtaaaactgaaagagcgcactgtaacacctgcccactggggctttgggagctgtaaacactggactctagatgccgccgtggggcagagccctgccacctgcccgtccacatgttcctcccagaggtttgcgcgtggggcacagaagaaacgagccacagccccatggcacgccctgagaggggaataagggaaaactcctcccatttcaatattccaaaaagacaaaaatagtgggttttactcacttttatagacaaataatgttatatatttaagtatgtatctgatgagtctttgtaaccactggtaacaatgcttatcatggcagactgtatttcccaaaatgaccacgacattttccatcccacgtgctcttctaaaacctggagagtctttgtgattgcctcatgaatagaaggcagaactgacacatgtggcctccagtgcttggtcacagaaggcaatactgtcgagttctgcctgcctctctcttgaaacatttgttcttggaaccaagcactaagctgttgaaaagcctagggcacacggagagatcacatgtaggtgttctggctgaaaacttcactgctgttcacgtaacatcctccatgacttttctgacatatgaagaggcatctgagaactctctagccacaaccactgtctgactgcaaactcatgaatacccaaagcaagaaaggcctagatgagcctagtcaacacccagaaatatgagatacaatgaaaaaaacatttgcttcactccacaaggtttatggtagtttgttatttagcaataggcaattggataacagttaacaacagcagcaaaaagtctatgcaaaaaataagaatggataaaaaattaaaccacagaaagcataaaatataaataaataaccaagaaattgagttgtgccaataaatgcaaatgatttaaacatggctaccaaccggaaaagatactcagatggagttaaaatagaaaactctacttactagcaaataataaatacccaaaataaaattccaaaaaggccaaaaatcaaagactaaaatgtaatatatgaggcattgaaaacaaaaagaaaaaaataaaataagcctaaccaaaaagaatatttaataaatatagcagcaaaaatacgactagtaaaacagaagctaacagttactaagttgatctgaaaaacttctctacaccatactcaaacccttttgtaagtgtaattttcactgactaaaaaagaatgaaaaacaaaactaacatcaaaatgaagaataaaaccattggtgaatatatagaggccattttcaaattataaacaagcaggtaaatgtaaacatttgaatgaaatgaatcatttgaaacaaatttcaatttctccaatttattcaagcagtagaatgcctgaagagaagaaatgtaaaatatcatgccaacttacacaatctgttccatagccaggctattctttaagttgtgaattctttcagaccattatggaatatactctcaatgataagaaaaaatgtgttcagcaatactaaaaaagtgaaagctatctagttttatgcaaaaatattataattttcactaaaaatttgaccaaggtgttgcttaaaaccaacagcatttcctaaattttaatcaaagcagtttttataaaataacatctgcatgaagtaaaaatatgttctctgctaagaagaatttgggaaatttgcttttaaaggtatttgttgctgttgcactatagaatttctgaatctataataaaataatgagggttatgaatctccaagggtatatagatcagtgcttccaaaccttccttactgtaaaatgctttgtattcacataatattattaatgttctataacatagtgaaatgaatgactgtaggacaaaatttagaaaatggtactataaaccaatttctctttggacatagatacaaaatatgtcaaaatcaagaaagtaatattgatatattcctatttataacatctaaacatactaatataaataggtagttctgtaatataagtagttgtgttataaattggtaatgcccctgtaaactgagcactgtgagaggccaagatgggcagactgcctgagttcaggagtttgagaccagcctgggcaacatggcaaaacctcatgtctactcaaaatacaaaaaattagccaggcgtagtggtgcacacctgtaatctcagctacttgggaggctgaggcatgagaattgcttgaacctgggaggcagaggttgcagtgagccaagatcacgccattgcactccagcctgggcaacagaataagactctgtctcaaaaaaaaaaaagttcgcaatgctaaaacattaacccaataacattaaaatcatgaaaaaaagaatgtcttttatgactagtgttttattcagatctgaagatacaggtaatgcaataacatataaaacatgaataagattttcaaatattataaaaggtggataaactggtcagaatttgcagataatatgcctatgtatttccctaaaagcaagagaatcaactaaaaaaaacacttaatatattatgtcaacaatgaagctgacatgtcatgcgatgaactattatgcagcttactggcaataatgtttttaaagaattttttgagacatttccatttaagtaaaataaaattagtaaaccatacttgctataattaaaaggttttttaaagtacacatttaaaaatgaatgacaataaataaaataatgatttgagcaaggaacatttaatttacccagtcacccagattggccgaaggatgttgaagaattacgttagctaaatgaatgataggtttaggaaagaactgatatttaagatgggtcttagaaaagaactaaggtaccaccaggcataaaacttggacagtattttctgtcccagttttatgcctgctggtactttagttcttcacagaaaaaattactgccttatcagaagtcaaagtaaaagctgaagtagggcataaaaatcaaacatctttaatttgagataaagacagacataatagcctttagatgggttcctagtcagagtacactgagctagctgatgaccaacgtaattgaaaacgtaactaaaaaacataagttgtttaatacaacttggggtccttctccaagacagtttttaaaaagaaaattgtttgacctattaaatggaaatttgaaaaaacaaaataatataagtaaaacaatataaatatatattatacttatgggaaaagcataaaaatgaaaataaaaggtagccttaaaataaaggcattttctatagcacgaaattcaaatttgtgtaagtcttttaatgatatagttggctcttaatattcctgggttctgcatctgcagattcaaccaaacatgaacagaagatactttaaaaaataataaaagtaaaaaacaataaagtataacaataatttacaaagtgtgtatattgtgttaggttttgtaagcaatctagagatgatttaaagtatattgaagaatatgcataggctatatgaaaatactatgccattttgtatgagggacatgagcatccctggattttagcattcatagaagttcctggaacaaatcccccacagatactgagagatgactgtatatgaatcctaaaaagaaaattgaatgctaatcattatcataaatatcagatatataatataatgtcactctcttttccacatgaaaatgtttccattaaagaattccaaaaatttaaacccagttctttgttccaaataatattattattgaaataattaatgtctttcagccagcctccacattcatcatcatctattaagcctggatagatttcatgtcaaggagaaaggaagctgtacttctagaagtaaccataatggatatagtgctttcttccaggattatatattactgtaagtgtttataatgtcaacttgtggctcaaagcaaatcattcatatacgatctactgtgctacattcctaggagctcaatcaaatggagcccaatacacttggctcttccaattccaataacttatttcaatcaacaacaatgtccacagggtctttgagtatacaatgacacagtttaaaacactccaagatatttctggtacattggtatccctagagttatgaaaattgattccagaagtataaggaagataacagaaaataacatggtttattttaaaatacaaaaaagagcaaaaaataggatgcacctcatataagcatacatatagtagccttaaaattaaggcattttctatagcacacattgtaaatttgtataattgagtcttttaataatactgtcaatcctcagtatccctggattctgcatctgcagattcaaccaaacatggacagttaatatataactgtccaaacctagacaattgtccaaatgtataatatgttaatgtatattatatatttgtaaatatttattaatatgtaattgtccaaacatggatagttactatgtatataaaatataaaagtcatttttatttgaccaggaatttaccaagttatcaaataacataatgaataaaccattaatcattttaaaaatcattacctatggatatatattctagtaaaagcatatttagacagttcagttttcaacatattccaatccacttttgtgatgtagattttgaatagtggatgtagctcttggctctattttaccatatttcacatatagctagttaagaatgtcagcacaaaataatacacttaagtaatacattaataataacatttggcttaaaatatatcctggttttaagcaggaggttattaacgtatcatgaatccataccaattattatagtagaatgcccagaatttaaaataggaggataattcatagtggtaatattatttttaaaatgaatcttaattcaatatctaataagtgccttactatgtaagtgaagtcctttatcattgttactgtagcatatgattagagaacacattaaaaagctattgctttcctgacatctaatttgcatcaggttcttaattttcaactggatacaaattaggcactcaaaaataaaagaaccagttaaattaccttatcaataacaatacttttcaccaaagacaattaaaagtaaggacattgacaagcatggatttttcagcatcaaatgtatcttattgtttaaattcatgtttataaagctcccattacatatgttactggacccaaataaataacacaatgtttattccctccaataaccttctgaatttccaaatgatacattcaaacagtgtttccaaagttttaacaaggaagtatttctcttcacatacaactctctccttgttcttaggagttctgacggtctttctctaactaagtgataattattattgaatcctagttgtgcttcaattgaaatatctcttgcatctgcagaatccctgtctcctcttaaaacaagagctcccccctttgtacctaggctgtccatgaacctccaggcctctgctgctctctccagtttctccccatcctcacaacccatgcttgaatcatgaaatgtgcctgctcaaaagctgcacagttctccgtggcttacagaaagtaaaaaattgtatttaaagctttccacagtcaggccttagattaccgtctcaccatgtctcctactgcttaccaaccaaatctcttgtctccacctcacttcttaaaactatgtttctggagcatagcagggcttatgaagtcacattttcccccacatcctcatgaacagtagttcgcacaaaacaagcaacatatatgtgatatttggatttatttcaactgataggatcatcaaaaggccatttgggaattgtcaattatttcattttataactatgcgtatttagttgcatggtaaagtaattaagtcacttgtaaatgaccactcagctacagtgaccactcagcttgacaaatcaaaaccaaaattctgcctcatggaaataacacttttttattatttcatattatgcaaataatttagaaacattgataatagtgatgaataggatgtaatgagatgctttctttgctcaataaaaatatattgagcttcccattttctcaactcctaattgggtgattgcacaaaaaaaaagatccacttagtgtgaaaacaagccagtcaaatagagcacttcagtgaccttcccaagagcacgcttcccaaggaaaatcaaattgaccatttaaaaatgcacagtcaggggagacaaaataacaaagaatacaaaggaataaagcatgcctactagatctacaaaaacctcaaaaaggcaaatctagtacttactggccttaaagaggagagacagagagagagagagattagggtggagagtttatttaaaaggatagttacagagaacatctcaaacctagaaaaagttatcaatactcaagtacaagaaggttatagaataccaaacagatttaacccaaataagactaccttaacacatttaataatcaaactcccaaaggtcaaagacaaagaaagaatcccaatgcagcaaaagaaaaaaataaacacataacatacaatagcactccaatacgtctggcagcagacttctcagtggaaaccttacaggacaggagagtggcatgacgtttaaagtgctgaaggaaaaaaatgttaccctagaatagtatatctagagaaaatatcctctgaacatgaaggaaaaataaagactttgcagacaaacaaaagctgagggatttcatcaatctcagacctgtcctataagaaatgctaaaggtagttcttcaatccaaaagaaaatgacattaacaagcaataagaaaacatctgaaataaacaatctcataaacaatctaatgaagtatcttaaagaagaaaagcaagagcaaaccaggctgggcacgatggtgagaggtgacagcgtgctggcagtcctcacagccctcgctcgctctcggcgcctcctctgcctgggctcccactttggcggcacttgaggagcccttcagcccaccgctgcactgtgggagcccctttctgggctggccaaggccagagtcgtcttcctcagcttgcaggtaggtgtggagggagaggcgcgagcgggaaccagggctgcgtacagtgcttgcgggccagctggagttccgggtgggcatgggcttggcgggcctgcactcggagcagacggccggccctgccagccccgggcagtgagcgacttggcacccgggccagcggctgcagagggtgtactgggtcccccagcagtgccagcccaccggcgctgtgctcgatttctcgccgggccttagctgccttcccgcggggcagggctcgggacctgcagcctgccatgcctgagcctcccacccactccatgggctcctgtgcggcccgagcctccccgacgagcaccacccccctgctccaaggtgcccagtcccatcaaccacccaagggctgaggagtgcgagcacagggcgtgggctggcaggcagctccacctgcagccccagtgcaggatccactaggtgaagccagctgggctcctgatctggtggggacgtggagagtctttatgtctagctcgggattgtaaacacaccaatcagcaccctgtgtttagctcaaggtttgtagtgcaccaatcgacactctgtatctagctgctctggtggggcctccgagaacctttatgtctagctcagggattgtaaatacaccaatcggcactttgtatctagctcaaggttcgtaaacacaccaatcagcaccctgtgtttagctcaaggtttgtgagtgcgccaattgacactctgtatctagctgctctggtggggccttggagaacctgtgtgtcaaaactctgtatctaactaatctgttggggacatggagaacctttgtatctagctcagggattgtaaacgcaccaatcagcgccctgtcaaaaaaggccactcggctctaccaatcagcaggatgtgggtggggccagataagagaataaaaggaggctgcccgagccagcattggcaacccgctcgggtccccttccacactgtgaaagctttgttctttcgctctttgcaataaatcttgctactgctcactctttgggtccacgctgcttttatgagctgtaacgctcaccaggaagatctgcagcttcactcctgagcccagcgagaccacaagcccaccgggaggaacgaacaactccagatgctctgccttaagagctgtaacactgaccacaaaggtctgcagcttcactcctgagccagcgagaccacgaacccaccagaaggaagaaactccgaacacatctgaacatcagaaggaacaaactccagacgcgccaccttaagagctgtaacactcactgcgagggtctgcggcttcattcttgaagtcagtgagaccaagaacccaccaattccagacacaacggctcacgcctataatcccagcactttgggaggctgaggtgggtggatcacctggcgggtggaactcctgacctcaggccctgaaactactaaaagaaaacattggggaaattctccaggacattcacctgcacaaagatttcttgagcaataccttaaaagcacaggtaaccagaacaaaaatgaacaaataggatcacatcaaattaaaatgcttctacacagtaatggaaacaatcaacaaagtgaagagacaacccacagaataggagaaaatatttgcaaatgatccatcttacaaaggattaaccagaagatataaggagctcaaacaactcaataagaaaaatttgaataatctgattacaaaatgggcaaaatatcagaatagacatttctcaaaataagacatacaaatgacaaacaggtatatgtaaaggtggtcaatatcattcattgatcagagaaatgcaaatcaaaactacaatgagatatcatctcactctagttaaaatgactaatatccaaaagacagacaataacaaatgccaccaaagatgtggagaaaagggtacccttgtacactgttggtgggaatgtgaattacaacaaccactgtagagaacagtttggaggttcctcaaaaaactaaaaatagaaatcccatatgatccagtaatcccactgataggcatatacccaaaagaaagcaaaacagtatatcaaagagataccttcatttctatgattattgcagtactgttcacaatacccaagatttgaaagcaacctaagtgtccatcatcagatgaatgaagaaaatatgtatatgtacacatttaaattctaacagcaatattttgacaaaggaattgaactaaaccagtgagttttcatggaaaataagacaaatgtggtatatttgtgttaaataaggcatgttttttaaaacaggatttaaatttttcctctgtagactgtagtacaaagacctattttcatatcctattttcatgaataatgccatgaagccgaaactacaacaaaggttaagtccagttggtaactggttctctaaggactgcaatcttgtttgctagaaaacaaaacaaaacaaaacacacacacacacacacacacacataaaaacatcactgaaaggttttctaagctcatctgagggaacaggctgccatcctataactttagcagtgaaataagtcatagtttacaccagcaacaaaatcagccaaagtactttctctctaaatcataggtaaacatcacagaaggagaaaaagatgtttaacaaataaccaaacaagggttatctgctacccttagaagcaagtgtgtgcacatcgtgggtggaaaagtaacagcacgacaaggcagagagaaccagatccagattgcagggcagatttaaacatcatgtctttgtggataagcaaaggaaaaactaccgaagccattttttcattatacatataaatcacagtaaaatgtgtcacagggaagtttcgcttgatgatctgatgcttcagctatcttctggaggatactcaattttagattgatgacagtcatcaatttgcctccaatttgctttatactgttctccccctgtttactatttgttttacttttcctccctcttggtattttttataatcatcacattaagattaaataacagagcaaaaatctttccttcaaaagcaacagtaaactgagatttatcactgtctttcttgggtccatttgtatgagcagtttttccggatgtaatagaaagtgatccgtttacttcttttctgcatcacttctttttccattgatggtagacaactagatacagacacatcctatctttctctactcttcatttctccataggagatacctactgagtaatgatatagtggcagttgtttctgtttttcatcattcaagatgtaactatatagagatctgggcaatcggaataggaggaagtccaattttagtcctgaaaaattgtaatagacgcaatctgctgtgggagtggtgggaattacactctcacgaacagacttactattggcaaaactatcagggctagaacagccgttcccctccaacccccagcatataaaaaagtaaatggaaaatataaatagcaaggactctatttataccaccgcaaaataaggagggaaatcatgaaaattgagaggcagagctcactgctgtgataaagccttacataaggatgcaagtaaatacggtatttgtgaaagaagaacagaaaatcacaaagcaggaaaaggcaatgtataaaggcattataagaggcagagatagaagggggagagaagatggaatttcaggacacaaaattgccattctcattggagatagcaaaaagtagcattaactcttggggaaaattgggtcattgatttacagaacaatctttagaatctttcccagaagttatttaaaatcaataaaaattgattcgtaaacaataaagcagaaaaggatacataaataaataaataaaggatggagggcaaagtatcactctcagaattatgggattcataaggaatcatcaagaacaaaagtagcaattaatagcccaaagaaagaaatatttaactaatagaaatcatttaatacagggccctacaagttcttaacaaatttaatgatagcccttcccaaaattctaccaacactgtcaactaagtaatacaggataagggagtgttatacactgaattttaaggaaaacttttacaactcattaatcttcccacagccaagttgctttaatgtgtgaggaaaacagaaagactattttacataagaaaggactggcagcatattattcatttacgcttttgtaaaaattacctgaagcctcactcaaatgatagaaaaagaaaaacaaagaagttaggaaatagagaaataagagttgtaaattgaggtctcaaaatcaaatgtcttactggaggagggctagtaatataaatgtgtaaattgggcgaagaatggcaatagaaagtggtgatatttgtggcaaactgaagagttcatgccccacctaaaggcactgaaatgcaaatgctgaaaatatatcttacttcttaccgtatctgttgcctccacctagccagaggctggcagatcacttgaggttaacagttcaagaccagcctggccaacatggtgaaaccccatctctaataaaaatacacacatacacaaaaattagccgggtgtggtggcacatacctgtagacccagctactcagcaggctgaggcaggagaatcatttgaacccaggaggcaggggttgcaatgagctgagatcatgccactgcactccagtctgggtgacagagcaaagctccatctcaaaaaaattaataaataaacaaaaattaaataaattgtaataaaagatgatgggcagcacattgttgcagtggtttctgagtctgtccctccccatgcacgcctattccaacatgcagcaggcagcaggccacagccttcaccatatgcttcctgtggaatttaggagcacctttgatgatggattataataatcacaagatttgttctgttccagtggtgccagctaataaagcccaacatttatgtataattgggatcctgtgccaagaaagttaaatttatccaataaaacatatttccccttttgaagctatatagaaagacattattgccaacttcattgcaaggaaatttttcaaaacatataaaatcagtgactcattcattccttaaacctttcattagttgactaaatctttcatgctaactgggaaaaagcaataacaatcaaatggaagatctctctgtcatgtaatttttatatcaaaggcctatgattatacttgcattaacatgtttaaaactctgtatttatagttgaactgtgtaaaaattaatggaaaaacaaagaccaaggccttgatctgagggagatgggggattccctggagctaaggaaagatcttgatgacagctttttccaacagggaaataatagttgtatcattctcaataccaggcatattattctcattcgctccctctctctctgcccttcccaacaaggtctgagacagtttcataaaagaaggaagagctatcttgtctttttgagacaggatcttgctgtgtcacccaggctggtgtggagtacagtggtgtattcatgctcactgcagcttcaacctcctgggcttgagcattcctaacacctcagcctccaagtaggtgggactacaagtgtgcaccaccatacctggcaattttaaaaaattttttttgtagagatggggtctcactatgttgcccaggctggtctcaaacttctggactcaaatcatcctccttcattggcctccaaagtgctaggattataggcatgagccaccacgcccagcagggctattctttatgagctccaggtttacacatttgttcctgggggaaaaatatcgtattctttcacccaactccctacctggcgagcattcttctgaaccatgactctcagatattgacacctggaaaaatacaactattcattaaacaagttttgaattcctaatgtggcaggtgtcatgttagacactggaaacacaactgtaaacaagatagatttagtttacatcttcacaaaatattgaagtaaagggaatacttctaaacattttatgaggccaacattaccctgatataaaagctagaaaacgacactacaagaaaagaaagttacaggccaatatccctgatgaacacagatgcaaaaatcctcaacaaaatatcaccaaaccaaattccacagcacattaaaaagattattcaccatgattaagtgcaatttatcctagggatgtgaacatagttcaacataaaaacatgatccaccatattagtggaatgaaggataaaaaccgtatgatcatctcaacagatgctgaaaaagtacttgaaaaaattcaacattctcttatgataacaattcttaataaattagatatagagagaatgtctcaaaacaaaaaaggctgtatatggcaagctcacagctaacattatcctcagcagggaaaagttgaaagcttttcttctgagatcaggaacaagacaatgatgcccactcttctcagttctattcaacaaagtactggaagtcctaggcagagcaattaggcaagggaaagaaataaaaggcatccaagacagagatgaaaaaattaaatcagccctgtttgcagatgatacattcttaaacattaaaaactctgaagacttcaccagaaaactgttggaactaataatttggtataattgcaaagtacaaaatcaacattcaaaaatcagtagaatttctatatgctaactatgaactatcagaaaaagaaatcaagaaagcaattctgcttacaatagctacaaaaaacttaaaatacaattacctgctgcacaatgaatttggttaatgacagaaaacatacaagacagtggccctataagattataatcaagctgaaaaattcctatcatcttagcacaatgcatttctcatgtgtttgtggtgattctggtgtaaaaaaacctactgtgctgccagtcatctaaaatatgtaacacatgcaattatgtacagcacataatagttgataattataaaaacaactgttatttggcttatggatttactatttatccaactggcttgtggatttactatacattttatcattattttagagtgtactcctaactataatagacaagttaactgtaaaacagcctcaggggagtccttcaggaggtcttccagaagaaggcattgttatcataggagatgacagttccatgcgtgtgattgctcccgaaaactttccagtgggacaagatgtggaagtggaacacagtgatattgaagatcctgaccctgtatatgcctaggctaatatgtttccatcttagttcttaacaaaaacatttaaaaagtaaaaaaagtaaatgaataaattctagaaaaaaccttacagaataagaatataaggaaaaatatttttatagagctgtgcaatgcgtttgtggtctaagctaagtgttattacagaagagtcaaaaatttaaaaataacaaaaattttatgaagtaaaaaagttatagtaagataaggttaattcgttattaaagaaaaatatttatttttaataaatatagtgcaacctatgtgtacagtgattatgaagtctacagtagtatgtcctaggccttcacatccactcaccactcactgacttacccagaacaacttccagtcttgcaagccccgttcatggtaagtgccctaggcaggtgtatcactttttaatcttttataccatattttaatgtaccttttctatgattagatatgtttagatacacaatcacttaacactgtgttacaattgcccacagtattcagtacaggcatatgttgtacaggtttgtggcctagaagcaataggctatgccacatagcgaaggtgtatggtaggctataccatctaggcttctgtaagtattctctgtgatgtttgtacaaagatgaaattgtgtaatgacacatttctcagaacatatccccattgttaagcaacacacaactgttttggggaaaaaatttaaccaaggaggttaaatatttgtacactgaaaaactgtaaaacattgatgaaaaaaattgaagacacaaataaatggaagacacaaataaattgaagacacaaataaatccatgaacatggattggaaaaattaatattgttaaaatgtccatactttccaaagcaatctctatcaaaatgacatttttcacagaaatatccaaaaaaaatcttaagttttttttatggaaccacaaaagaaccctgaataaccaaagaaatattgagcaaaaggaacaaagctggagccatcacattacctgacttcaaagcataccacagagctatagtgattaaaacagcaaagtactatcacatagagtaatagaacagacacatacatcaatggaacagaatatagagcatagaaataaaaccacatatttatagtcaattgaggacaaagatgtcaataacacacaatggggaatgaacagtattttcatacatagtgttggaacaactggatatccacatgcagaaggataaaattatatgcttatctcatgccatatacaaaaattggctcaaaatggaagacttaacctaataaatcttaaacatttgaatgtatgacacaagttataaaccactagaagaaaacatagaaaaaaagctctgtgacattgctccgggcaataacattttggatataaagccaaaagcacaggcaacaaaaacaaaagaagacaaatgggattatatcaaactaaaaagcttctgcacagtaagggaacaatcaacagagtgaagagacagtctgtgaaatgggagaagatatatgtaaatgcatttgataaggggttaatatctaagatacacaaggaactcatatacctcagtagtaacaaaagaatgaaattcttaaaaacaggtaaaggatatgaatagttatctctcaaaaggagatacacatggctaacaggtatatgaaaaatgttcggcatcactaattatcaggaaaatgcaaactaaaatcacaatgagatatcaccacacacctgttattttggtgatcaaaaagatgaaagataacaaatgttggcaaggatgtagaaaacagaaaactcttccactgtgttggaaggaatgtaaatgaatacagcttttatggaagacaatatggaggttcctcaaaaaattaaaaatagaactatcacatgacccagcaatcccactactgggtctgtatccaaaggaaattaaatcactatgtcaaagagatttctgctcttccatgtttactgcagcattgttcacaatagccaaaatatgaaatctacctaagtacccatgaacaaatgaatggattttttaaatgtggtatatatatacaatggagtattattaagccttaaaaacgaaggaaatcttgtgtttgcaacaacatggatgaacctggaagacatttatagtaagtgaaataagtgaggtttagaaaaacaaatactgcatgtcctcattcctatggggaatcttaaaaaataaaagccacagaggttgagagcataataatagtggtttccaggggtacggggtgggggctcagaagattttggtcaaaggacacaaaatttcaattcaatagaaaaaataaattcaagaaatctattgtccaatatggtaactatagttgataactatgtattatattcttgaaaatttcaaaatattttaagaagttctcaccacaaatataagtacacgaggtgatgcagatattaattagcttgatttaaccattccacaatgtatacatatttcaaaacagcgtgatgtacactataaaaatatacagttttatttgtcaactaaaaacaagtcaaacaatacacacaaaaaataaaaaacttacagtctagaggaaagactgataagtaaaagactaaaaagtgtgattataatactatgaatatgtgcaatctgtatcgtaatgcaggatgctacaggactcttacgaagacatctagcccaatgaagcaggtatcaggggaggcttctcatccaactgcactatggaagatgaacagaggggtaggatttgacgctgcagagggatggaagttcatagagacccagcagttggagacaatgtagcacagctatagagagttaaaagctggaggaatggtgagccatgacgttggaaactctcgacgtgtattaagaactcgaacttcattctctcagattaaatgaggaaagctagcaaagagttttaaggaagaatataacatgatcacattcaccttttagaaagagttctacattcatggtgtagagaaagtggcaaggttgaactctgagaaacgtggtggctagaatctgggtaagaagtcctgtggacaatgggaagtagctgtgagaacagtggaggatatagaaatggtcaggaagaaaacccaacagacttggtggttcttcagacagtgttggatttaggttgcagtcagagctgtctctgtcctcctgttcctcagagctgaagtctttgctgatggtcacccagggagcccttaggtagttaattttagtggccagttctattttcaccatcagtctcttccccagagacacacaggatctctgccactggctcctgtcttaccatgctctcgtttttgttaaattctttcttccttagcaccaacttaatgcccttcaaaaatccatgtttaaaatgtatgctttttctacagaatgaaatacagtttactctgaactttcaggaaatcatggaaaaagagagtttgcacattttctttcccagaggaaatcatattaaagttaaaaaataagttattcattgatctattcaataaatatgtatttatttacttttattatttatttatttatctttagagatagaatctcactctgttgcccaggctatccttgaactctgaacttcaagtgatcctcctgcctcaatctcccaaaattctgggattacaggtgtgagctaccatatctagactcaataaatatttattaagtgtcttttatgcgccatgtaccatacatgatactggggcacagcagtgaacaaaacacagagagtctgtgtccatggagctcgttcttcagggaggaaaccgactctgtacatcacaaatactatacgtacacactgactacatatacacacatacatatagatagatgtgtcaacatatattaagtctgatggtgataagagggaaggcattgttacagtgtgccagggaaaaagcctcattatgaagacgacctttgagcaaagacctaaagaatataaaagaggaaacacagatatctgggagaaaagtagtctgcaagcaggatcaataagtggtgccttgcctggcatgtatgagacatggccagtagactgtaatagctggagcagagtgagcaagaggaagaagctgggagatgcattcatgacgcaccgggcaaggatggggtgggagggaagaagatcatacaaacttgcctcctcttttcattgacttgggaagccactggagtgtctgtgtagaggcctgataccatttgacttgagtattaacaggctcatcctcgtttctacttaaagaaaagattgtaggagggtaaggtagaagcaaaaagaccagttagcaagcttttgcatccagaagacgacgatgacttgggctggagttatgcagtggaggtggtgagcagttgtcatgttctggttatgttttgatgaaatgtctacagattttgctgaaagaaccagggtgggtgccggcgacgtcaaggatgattcccaggtttggtgctgcagtttgcttagagaagtcttagacaagccttttagacgagtctgctggggccatcctcaattcctccaaatacgctttctcaccctttgactgctggctctcctgctagccattttctccttttaagatgaggatatttaataatcactctcttgattctctacccatcttcttccaaaaatcaaccatccagtttccaaatgtgtaaaatgtgtgggaaaatcaagctattttcaaaagtgctgtaagtgattacaacctaaaaggataaatgttggtgttttgtctacacagcctctctttctccctccagaactaattgtcaatgtagacagcagaatgaggattagctgggctccagaagagttcatcatgttctgtgggaataatctaatttacccacatttgtgaaaagtacctttattagatttgtcatattgtgccattgaattaaagaccaactaacatttgactctcagcagaaagctatggagactaagcatcactagactacccaggggaagccactaggcaaccaagaccacagaggacttcctccagcaaaagggcaatgacccattcctttgcatgagggatgttgggatgttctaataaatgtatttggcctgaaaccttcttctcacattcaaggacaattagaaacattttaaagagaaggttgaaatagcaggaggcaaaatagtaagtcatgtaaaaaaacaaaccataaaagatacctgaattaatgtacttgagaatgaggaaggcttctccttctatttggctaaagtgaaattgttgcccttcttggccattcattcagccaaagcataatccttaaaccaagtaaaagagagaattgcatcatcttgcctttgggcacaaatcccttgaaactctgagtagatgcctgaggtgtttaagaatgtatcaaaaccttcaggtaaaggaataacactctgattacagggtgtaggcatcaactagtaaggaagacatgttggaggataccaataaatgttcaggacatttaacattttcctttgcctttactctggttgtgatgttttgctcacggccactgaacattcatcgaccttcccactggctttggtcaaaatatccccaatgatattctctatcatttcctgaatctttcacttaatgaaaagattttcatccctgctctttttaaaaaaaaaattgtggccttattatcaattggaatagatactcatcctctgacattttacgagtttaagattgtcattagttatataattatcttatgtattttaatttatttacattactatgacatgtgtttttgtcctccatgtagaactacaaactctttatatctagggataatatctagttggtaaaatgcgccaaaacttttaggtagtgttatgcagacgtctatattaattgagaacattaattataaaaattgtaaaagcaaaagcggaatgagtttccaagtgtaaaattatgattcagatttagtttctataaatggaatcataccaatacagcaatattttgtttcaactaaaatctcttaagtaacaaacatttaaaattagctataattatttaagcagtcaaaacaaacagggaagccaaaaattccatatcaggatgttatgaatttacccattctgacattactatacaggagctgtatttaaaattacctctaagaaattcatgatgcaatttcaaaatggaaaataaaaaaagactaccacattttgtcaacagcactctaaagaggtcctgatgcagatacctgtgaattattgtgaaattctattatctcatagaaggggcttaaggaaaaaaaaaaaaaaaacagtgtacttcagttggcatttgcaaagctctctaacacaactattccttagcattataaaaaaaactctaagccatgtcttctcttgttagcttgtattcattacagaagagaaagcagtgataacataatatagaactggcattctccaaatgactttaatccatcttcccaaagactagttctcattaatttcaataaccagagtcacaaccagaaaatcaacaaccacaacaaaaatggataaacaagtgacttaaatgatgtgttctgaaccctgtaaaatgcaaaactgaaagatacaaaacatgaaaatggggccaacactcggcatgaaaatagacgcgtacattcccatgccttgacaaagtataatattccaaactcaaattaatgggtcatctctaaagagtactttggggccgggcgcggtggctcacgcctgtaatcccagcactttgggaggccgaggcgggcggatcacgaggtcaggagatcgagaccatcccggctaaaacggtgaaaccccgtctctactaaaaatacaaaaaaaaaattagccgggcgtagtggcgggcgcctgtagtcccagctacttgggaggctgaggcaggagaatggcgtgaacccgggaggcggagcttgcagtgagccgagatcccgccactgcactccagcctgggagacagagtgagactccgtctcaaaaaaaagaaaaaaagagtactttggtaactcatttaataatttgaatgaaccaatttttctacacaatcacttgctttggttctttcatccagcttccacaaccatccgtctaacaaagccaagaaacctggagtgttccttgatatctttctatctctccacttcacaactaattcctcagcacattttgtctactctaccttcaaatattttagagctacttacatgaccaccattgctatcaccttggtccaagcttccgtcatcttttatctggatggctgcaaaagcttcatggtctctctgttccatccttgttttccttcagcctattgtcaactctgcagcctttcaaaatctgaggattgaactctgaccgttttttttcttcttgcccagatttctttctaagagggctggggaattatgtcttacaaaccatagtatctcattaagtgttgggtttttttttaaaattaacccaatataacttggcttactttccaacctgactctggtatagcattaaatgacagatagtagacccccttaccttaaacattcctttctactgatgtctcaagtctttagacaaagcttagctctgacaaccaactgccaacgaaagaagctctaaaacccactgacaacttgtaaggccgtgcttcaacatgctttgcctattcaggctgaaccaatgtatacctttcatgtatcgatttatgattttacctgcatttgcaatctccctagaatgtataaaactaaactgtaagccaactgccgcgggcacactttcttgtgctctcttgaaactgtttccacaggtcacagtcactcattgactcagaataaacttctttaaatattttggcagaatttggagttttcattattaaatctaaggcaattggtcatttatttcttcaaaattatgaaactgaagaaatagtgtcccattttgcttaaagtaaaagccaaaatctctatatccttgaaggccctataagattagtctctcttaatctccgagttcatctcctaattctctacttttctctcttgtaactggcctttttttttctcataaattatatctcatctgaagcctttgctcaaggcacctctcatcctggaatgtgcttttctcatattcagaaggtgaagtccctcataattgctaaatgtttacttaatcctatcttcctactgaggcttgccctatttaaaatggaacttcccacacatttcctaacctctaactctgtttctttatttttcttttgcactcatgattttttaacatactctattgtaattattcttgccctactagaatatcaactccattttggtaagatgttttggtctattttgggtcacagtcatatgccccagcacaaaaaactagttactggtaaatatttgttcaaagaaattcaatgaataacagaataaattactattctttctttcatttagcttccttactaacaagacattttttattccatactttcttttccttttataatagagattcagggagaaaccttgtgtgaactactcattaaaatgattagcgttatctgctaatcatttcaggacagagcacacaattaaggtcggttctggcatggagaaataaatactattataacactaatacaaattatacattgtcaaaggaagcaagttgttgaggcaatcacagaaggaaaagaataaaaaccccagcaacaggacgactttaaagatgtatttccagataacttgtattccctcatgatcagcacaagcgaaatgcactgatggagcagagcctccttgtccaggtgtgaattttctcataaacgtggtagatggagtgctttgttaagtgaaataattgtgatactccttactacaaaaagcaaaactgtcagaaatggctccccaaacccttattaatactgattttcaatgcctcctactatcacaagttttggactttattctttaagtgaaaagttcccccacaactcccagcagttatcatttgactgtccctgaaattatcttaggaaatatcattgaccaaatttgaaacagagcaaagttaaacaacggacattaacaaggagtataattggccttagcatttaccacctttcctctgccccctttgtgcaatacacgctctacatacttttttgatcagtaaaattcacttctatttagactaaagctaagtttttctctttctctttccttttttcccccacctcctatgtgtatgtgctggtgggggagggggaggaaggaagagctgagctacaaaattaatcagctccaggtatgtgccaggcattgtacttaatccaagttcattgaatctgaaaacaatcctaaaatgaagattccctcaccccaaatccctcaactggtaaatgctagagaaataacttggtctaagtttagcaatttaaatttttatattatttttctaaatcaatttattgtccctgttataaacaatgggagtgatgtcaaacaattttctggttaattattaagagaataaacagtggaataaacagtgagtaaggcaatatttaacaatggaagacataggccatttcctaatttgatttccagaacaataaaactgatttcactaatttctctgacaatgtattatcctggggagttaataacttatttttattaaggtgagaataaatgtactcaggtacacaggtggcagaaaaagctcatatatccaattacctgcataatgaaaccaatcacttaacttcttctttggctgttggaaagtcagaggtgctaaaaccaaattttctcagtcccttaagatggactgaaaatcctcaagcaaaaatcactctaccttatatatggaggaaaatctgaagacaaaggaataaggcatcttaagttctactccaggaagtttgtttaagttgctgtcttgaaaaccaagcctctgatattttcttagctgtattaaattgtagctaaaaataaatggctatttagcatgtgtttactatccaaggtccatagagcaagcaaaagggcaggctactgcttttaaaacccatgtagggattaattaacagaagggcactagctagcaagttatgctaaatgacaagtcttgattaaaagctaaaaacaatgcttatttcaaacctaacttcctggtctatagttactctcaactttaaatgcaatttgctaatttcaactccaaatacatatatatgcccttggggttaagaagtgcttcggtcatgcctgtaatcccagcacttttggaggccgaggcgggtggatcacaaggtcaggagatagagaccatcctggctaaccaggatagagacggtgaaaccccgtctctactaaaaatacaaaatattagccgggcgtggtggcgggcgcatgtagtcccagctactcgggaggctgaggcaggagactggcgtgaacccgggaggcggagcttgcagtgagccgagatcgagccactgcactccatcctgggcgacagagagagactccgtctcaaaaaaaaagaagtgcttccgaccttattttatcaaagcctttcattttccaaatgagaatttaaggtattttctcaagaaaatttttatgaaacaacaaaaaacccgatgtttttaatctcagaatctgaagatcacctatgctagaaccgctatacagtagacaaagaattagttttttctttcctcatattctgtatttcaggcccaaataatctacccaatttagaaggggaaagatgttcatttttcttaatgtgtgatggaatttcaatatgtacaatcataacttctttgaagatgggctggcacacatagaactgtgcattaggcttttaaaactttccaggattacgtagagtgagtaaaggcgattgacacaggaggcagtctgatgatgtggagtgaattgggaatcacagcattccccacaaactgctcagctgatctttctgtattacctggaagctcctctatgagcctggcttgtagcatttgaggtcaagaaaccagtcattaggacgtaaatttgtcatttgtcagaggaacacagagatccaaaaataatcctgccataatgtagttcattagattagctggtttgggaaataggtcacaggactgatataagttgatgggactggggttaggaaaggtctttgtgtaattcgcaaaattatatactttgatgatccctaaagtgtgaagatctatgcaacctgaagtagcaggcagactgaagtcaagtcagtgaagcatcagggaaggaagaaaagagaagagctgctacaatttaagggtttcctagcaatgggacctggggcaagattcctcatgtgtaccttgcccagaaatagtaaaaaatagactgtaatttcttttttttttttttttttttttgagacagattcttgctctgtcacccaggctggagtgtagtggcgtgatctcggctcattgcaagctctgcctctctggttcccgtcattctcctgcctcagcctccctagtagctgggactacaggcacctgccaccatgcctggcttttttttttttttttttttttgtatttttagtagagtcgggatttcactgtgttagccaggatggtctcgatctcctgacctcgtgatctatccacctcggcctcccaaagtgctgggattacaggcgtgagccaccgcgcccagcccagactgtaattcttaacacagagcctagcacaaagcaggtgacatgcaaaaatagtattagatgttgtctaaattagctttaccaactctgtgccttctctgtgtcagataatacactttttacatttcaactcatttaatacaacaaccatcttacagttaggaaatgaaaattccagaaataagtatagaagatgatatgtatgcagatgtttgcctgattgtaaagctcatggcttttctacttctctatatgtatgtaaaaataattttgagaatgacttatggtggttacttaactttgcatcagttctgtcatttaatattcatatctatcttatgaatttgaaattattatcttatgtaacaggaactacaaccagaaaggttaagtgccaaaatcatactttttagtaagtgggttagtttcctgttcgggttcgtttctctatgatacacaattgagacataggtactcaactgtcaacctgcaatcagtcagagactaagttgctcctgaaattttgtcactttagaaatgctgtagtttaatgaaggccactttaaaaacaatcactgccaagttgggaaaagtaataaaaatggtaactgtgctaagcagagagaattacttattttatattaatgaaaatgaatcttaaagtgtggcacacatcacatgtaacatgtattttttaaaagttcatgttacaatgtaccatttgcataacttagaaatttaatgtaattaagtacaccaaatgcagtgttattttattcatcaagatatggagtaatatttaggtcaaaaataccacattttcaagctttatggtaaaagatacttcactgcaatattttctaactgagaaatcaaagtcaatccataaggtatttgacatatacaattgaaatatacaaatatgtattaaactggaaaaatatatagatttaaaattctataatctaacatttagacatatatatctaatctaataatttttcaaatttgggtactttatattaaattaaaagagacacatgtttgtgtcatacaaactcatatcatagcaaatattatagaaaatgcttgccgtaggtcagatacaaagatgagtacattatacataaagttcttcatctaatcctgaaagttaccgtataaagtaggtacattcttgatccacatattgtagcttaggaaactaaaacacctaaccagaatttggagccaagctgtcaagatttcaaagattgtgcttctgtaaaaggaaagtcaaatcctttctggttcaactttacctgttgaaaatacttctaaaacccagttttctgccatcatagatacagaattcagaatacaatcttaatttcccactggaatgttccagagtgtagggaaaactaagaaccaaggtaatctattttaaatatttgtttgcattcatttgagtctagcgtatattttatgatcacaacacagccagactgtgttctgttaccaattgtttccattctctgaggtcaaggagaaattgtttagctcctatgtaaaaagggtagaaaatgtctagaaatgtattacattctatccagaagagggcactggcaggtattcaacccaatatctgatatttcaaacagagggaagcaaagctccaatgtaacaagtatcttttcagtaagatgggcttccattcatgccctgcagtgtgactataagaagcactaatatacctggataaaatcatgttttggaaactgatgctagtatttttagcagttagctaattttaacagctggcataagattgcacttttagttgatattactgcctaaacgttccacatttttcctaagttttactttcaaggaagtttacattatttagcattcagttatgaaagttctgtcaaccattacacaatgtacgtaagggggctatgaatcaaatgtgcctcatgatattgactttttgagcacaattctgtttcatcaaaacttacaagacatagaaattgaaaagaatcatggttttgatgtctgatttcctgagtggctgagacaagtggtttatcaatcatataatttctgcagatcattttaattagttttctcttacaagcagttcttttctgcactgtgtagctatgaaagtactctttattttgtgtccaaggtttatacttagaaactctctgggaacaactgtcattgtcaggccttgtctttgttattcttgtgttgtgaaattccatttgccatatctgaagcttaaatggcaacagaccctgttgaataattgtcttctagtgttagatgattagctttatatgtgcaaaatggctttttagaaaaactacctagataaaaaggtcaaaatcaaaatggaccaatttgaaaattatcattgcaacaaaaatttgttgtggacacatactcattgaatatatacaacgtatatttactgagactataatatgtgtcagccatttctattacaggcttattgaatttttcaagtaatcgatggcaattaatttgtcacataattgtactacttgcaaaaataatctcctaaaattaatgactttgtctcctgtgctactattcgaaggcagagtggaaatggcttttaggttatagaaaagaggcagagtgagttctctcactagctgtgtcttaggtaagttccaggtctctgcagtcaatcgccatatctataaaatgaagatgatattactacctggaaatgttgtgtttacaacctttatcagagtagtttactgctgtagaagctcgaccactggtaaccattgtgtttaagtttaattttcactaaaagcccaggctctgactgtaatggtcactcagagttgtgccactgaaagggcacagatggcagtggtcaagtaggccacgtcctctgcgtgcctttttcgctttcagaagtagggctacgaagctgaggacagccagaatgactgctgagattcacatttccattaatgcctgtccattccaaaaaaagatcagtgtatgccaacggcgagatgccttcctcaatgaagtcagaatctaacagcgatgagatcctttgtgtttacaagccttgaagctgagatcagatggcattgccattgagtcggctaggagccagtagtctaaagtctaagtatatattatactgtctgaatcaacttagtggctctcagttctatcatatttgaaactcatttttataataaatatttgttaatgtctcttttgctattccaaaatgaaattgctaactccctctaagaataatcttaaatcaatgtaatatgttaatagtgacataaaagacaatagtaagagattaacacatacaaatagagtactaatagtataatatgcaaatgcttaggtacaattataccagatgatgtggttataatgggtaactctggatttaggaagtgtaaaacaatagccaaatgtgccagttatttactctttgtctctcggttctaaacttgcacttctatgctctgctttatgctgctggggctgagaccctgcaaactacattctgcttgccaagattctctctgttaggatctgccactaggagcaccagagacttcaaagctggatgaggtggaagaaacttgccccttcctgtgtccctctaggggagctccttggctgcttgtggatcttgtgagcatcactctacgatgcttcagtcaccccccaccaacagcagagcctccttgtggcagcagctgaatacagtttgcaattttgttcaacacttggagaaccaggttaattgtctccttcttccctcaaataccagccggccattggtcctcctcagaggtctggattccagcttcatgagtctttcctctgagctcagagatactagcaccagccgagccacgccttgcttacaggtctgagtttgagtttcactagaccttccctcgaagttttttgttttcctttttttccccacaattctgggggtgggaagcagctgcttcctgaagttgctacttccacaataccttagagtttctttttctaccctttaagttaccagctgacaactttttactaattaagaagtgtttgtattaaatcttctctgttcaaatagctggtatcatttctgcctccagagtggactctgaccactacctctactgaatattgtcaacattatttctttcctgagatgaacattttattggacatttgaaataaggcctggtgataagtttatatatatgcataaaatcataataaatgcaacagctactggtactgactgatgtggggatgacacattggtggctgggaagccactagcagcattgccattgctaggttcaaaaatgatgaacaactcttgatctcttgatgatgtactagacagaaactacaatctgccctgatttgtagtgcagttccattcctgggaaagttagcacacactaaaatgggggaaaatacactttgtgtttttatgtaaaatatagccatgccatacaagatatgaaaatattcattgttcaggacagtcttatgcattgctgtttgtctaaaaactctcactcttacccactaagtgccattgcacttatcccaattacgggtgaccaaaactgtgcccacatcatgtcttagagtaatgtcatatctgttcagaataaaataaggcagaggcagaagaggccatttcctttatgaatttagttgaggataagtcatcccatgggtcttccacactgaaagggcatctcctcatgcttctttccacttggcaaaagtctcaaagtctaagttataatgaagatagtttttatgaaaaggataatatcctaaaagaaattcttagcccctataaacacattttacaatcaatatatgttaattttaacatgaaagaaataaaactagtacaggtaataacaatagtaatatttgtgcataatcatattataatacataaatgcctaggcacaactacattagatacacagggtgaacacaattatcagtctagttaccctggagcaccctaacacaagacaccagagcggcctttaaggtttgagaagaaaagggaaaaagacagaaaatgattctaaaaatcaataaaaatgttatacagcaaaggttttatgaagaagaaggcagcatgaagcataaggttaggattagagggccctcaagattaagctgaagttaggggagaaagtacacatgcgtggttgatatacatgtgtatttttattcgggaaacctgttggtgtggacacatatatatacagacaacccttgaacaacacggtttgaactgtacacatctatttctatgtagaatgttttcaataaatgtattagaaaaatttgtggagatttgtgaaaatttgcaaaaacatgcagagaaaccatgtggcttagaaatatattaaaaaaaattcttaggtgtgccatgaatacataaaatatatgtcaatacaagcctatttgatgatttgctaccataaaatttacacaaatctattgtaaaaaggtaaattgtatcaaaatttatgtatatacttactgaccaaacatggcatcactgcagttgagagaattataaacacacataaagatgcagtattaaattataactgcacaaaattaactgtagcacatactatactactataatttcatagccacctcctgttgctattgtagtgagctcaagtgtcaaaagtatccacttaaaatgccatgtaatgctaatcatctctgcatgagcaggtcataaccctggtaaattacatatcacaataaaaagtgatctctcatgtttctggtgtatttttttaaacatgttttaatgcaatagcataaaccttgaataacatatgagacccatacaaactgccactagtgatgctggaaatgctcttaagaagcagagaaaagtcatgacattacaagaaacagttaaattgcttggtatgtattacagattgaggtctgcagctgtggtttcatttcaagataaatgaatcctgtgtaaggatcattgtttaaaaaaaaaaaaaaaggaaggagagaggagaggagataagactcatgaagccactgctgcagctatgccagcaggcatgaacatcttggactttttgcaaaatacctttttatcttgaattgaaaatgcagcttttatgtagatacagaattgctataagaaaggcatatctataaactctaatatgattcaagaaaaagcaaagtcatggtatgacaacttaataaaggaaggtgaaggatctaaagctaaaaaaggaaggagaggagaggagagaagactcatgaagccactgctgcagctatgccagcaggcatgaacatcttggactttttgcaaaatacctttttatcttgaattgaaaatgcagcttttatgtagatacagaattgctataagaaaggcatatttataaactctaatatgattcaagaaaaagcaaagtcatggtatgacaacttaataaaggaaggtgaaggatctaaagctgaagaacttaataccagcaaaggatggtttgataattttaggaagagatttgttttaaaaatatgaagataacaagagaagctgtatctgccaaacaagaagcagcagatgatttcccagacaccattaagaaaatcactgagaaaaaatgggtatctacctgaacaggtttttaatgcagacaaaagtgctctattctggagggggcagggaatccacaaaggacatttcttagtaatgaagataagcaagcactaggatacaaggaaggaagggataggttacccctactgttttgcacaaatgcaattggatttatgattaggactgccctttttatacagctgctaactcccaagccttgaagggaaaaggtaaacagcagctgccagtcttttggctgtacaagaagaagagctggacaatgagaaccctttttctggattgattccatcagtgactttgtccctgaagtcaggaagtacctcatcaataagggactgcctttttaaagttcttttaataccggacaatgctccggccacctagaaccccatagttcaacaatgaacacattgaagcagtctactcacccccaaacacaatgtccctaattcagcctttaagtcagggggtcctaaggatttttcagactcattatgcatggtactttatggaaggggttatcaacactatggaagagagctcaaatagagaaacatcatgaaagcctggaaggatcataccattggagataccgtcattgttatagaaaatgccctgaaagccatcgatccagaaaccataaattcctgccggaggaaactgtgtccagatgttgtgcataacttcacaggaattatgacagaatctatcaaggaaattatttaaaatattgtggatattggggaaaaaaagtcaggatgaagggtttctgaaatggatcttggaaaaattcaagagctaatggaccgccagagtagagaaattaacagaagatgacttgatggagacgactgcttctgaatccgtgccagacagtcatcagtttggcagaagggttccaattatccgagattccttttgacttcttttacgacataggcccctctatgagacaggaggcccatgaaaacaaagcaaatggtgaaagaaggattggtacttacagaaacatttttagagaaatgaaaaagcaaaaagttatacagaaattacaatgtattttcataaagttgcactaaatgtgcctgcctctcctgccttcttttccacttcttccacctctccatctctgtcacctataagacagcaagaccagcccctcctcattctcctcccccttagcctactcaatgtgaagacaccaggatgaagacctttatgatgatccacttccacttaatgaagagcaagtatgttttctattcttataattttcttaatagcattttcttttctctatcttaccttacagtaagactacagtatacaaaacatatacaaaatatgagttaatcaactgttgatattaacagtaagccttctcaatcaacagttagtagttaaggttttggagagtcaaaagttatatatgaattttctactgtgagtgggtcagcaccccaaaccttcatgttgttcatcaatcaactgtacatatttaaatacaatttgtgtgtgtgtgtgtgtgtgtgtgtatatatatatatataatatatttctttatttgacataaagaggacattgttttgtatcttattcaaagttattagagttgggatacattgccttatatatacagtatatcaaagaaaagttattaggttaaaatagaaataatgaccttttagcaaaggtcactcaataaatatctgtacaattaggaatgaacaataagttatagagtgaggagagtgaactaaaaagaaacaaaattataaatgctgatgatgctgatgtccagatgatgagcagaattaactagtggtgaagctctaatctcatttactcattagaattgaggactagtcctccttgaaaaatggtgaccaatgtcctggtatgccaaggacagtctgacttatgcctgttgtcctggtctttattaatactttactctttaattaaaaaaaaaacacaccactaatttggataatggttaagaaaacttaggaaaactgataagaacaagtaacattcactgaaaacttaatatgcgctatgatgatattttcatgtttttatatgtgattgtatttacttattgtaacaaccaagaaaggcgattatatttaccctgttttacatcttaggattcccagagactcagagagggtacttgaatttttcaagcacgtgcagtttccaactgtcagaggcaggatttcaacccacagctatcagatttcaagctgccattaaacatgcctgggatatcccttctgagaggagagtaggcacaaaatacaactaaccaggaaacagattccttatgcagtcaggaagaaaaagaaactgggccatatataagctaggaccttgcttgaacaatgggaaatttaaaaaataagaagaagaaattatccacaagacatgttttcagccagactaatttatgaccactgtcagccactgtaattgcctatttgtacatagtctgtactcatataaattcccatacttgcaatgaaataactgtctgcttcaggcaaatgactggaggacttttttttttttttaagcactgtagtgtggggtcataagaaaacacaaaaacaaaaacctatattcttgaaaaaatccctcccaggtagaactaaaaaatcctaggtggttatcacaagatgcctaagacaaactttcatcacttcacaattttgactatgttaaaactctaattggttagcatgttgctttcaaaatatattcatgtgcctcctattctaaaatgacttaaggcttttagagcagaaagatccagaattcaacattttcccaaatttccagaaagggcagtacttataaaagcatttggtcagagacagcgttagaaatatactatcccttggtgaagctgtctgggacaaatagttttccaatatgcttttagacaaatttatggtttaatgaagtattttgcctacttgatcacagtaacaaatcagacatatttatcaccttcccttttaacaggcagcaattctgtctcccaagtagacttggctgacactttgccatattcttcatggtccaagtgattaaagagtccaaaatcttagactgacgcagtaacactcagacgcacaaaagtaactttggagctgagggccaaactggggacacaaaaaccctctggtgggtataagatgactgaacgagtttgtcatttttccattttcaaattgccaacctcgcccccttcacacacaggaaaattgtatttttcccagagcacatctgtcagacaatactctgaggagtgtttgaagccactctgtgtaaacagagcagagacgatcagaaaataacaactgccacgtgtgtaaagctccctgctgatatctgtgagagcacatgggtgtcaaaaccatgagctaagagccctgctcccattcgtcaccatcagcagtcaacccgagaaaaactgctgagcctcagcccaagtctggagacctgctgctcactggaatgcactagggctcaccatgcagcccaaatggcctcatcacagtcatgtgtggctttccctcttcaggtgtagactgagtcccatctccagcattacctgtacacctgtgattggacctgccctaattctgcacatttgatgaaactgtctcaagacccccaccagccagttctgcatatcaccatcagcaacaagagtttcctttctacctccagcaccctgcatctatgcagaaaacagacaatctgtcagtagtttgcttttttatttagcactccatttctagaaagtcgtgtccctagatatttataatcagaatgatgatttagctgatatacccaggtgtaatacctagacgatctcttaagatttgtatcttacaaaggatctatcatttttttgtgagtaaaatataagtatcaacttttttattattcatatactttttatgtttttatgctaaggcagtgtgtgacagtttaaggaagatgttctatttacagctattaataatttactcttgcaacttttgttaaaatatttatacaaataagttgtgcatgataattgccttgattacatttagatactgagctgtgaaataagcaagcatttgttcagaaagcaggagaggttaaaatgttattagaaatggctgagactagaggaggtcagaactgggatgaactaagtcctgaggtctgtgtgctttgggtgtgcccctactccttcattttggagaggacctatcaggggacattgactagtgcgcttttaggacagaaaaggctcccctgcaaccaggtaacctccaatgggcctgttgcctaaaatgattttaactagaggtaaagtcttttatattaaacttagacttcaaaatgtaaacaccccaagaagagaaaacagattgacttgaatctaccttaagatgtaaaggacagaaaactattttctctcagttttcctagaagtgggaaggaaactatagactgccatatgtgaagcaggcaggaaggaagcctctagaaaaagaaaaggatataacagtgaggggcagggctctggagggggccacctcacagctttgccaagggggagggtcattcccgtttcctcctgctccccatcccttctcagctgagggtcttctccaattgaccatacaccatatttatatgggcctaaaagtcatagtttttcagggagaagaatggacacagagagaagataaatggatggaaaaaggcaagcaatgcatattttacaagggccaaaattagtggaaagaggacagaaataacagagtgcttgcaaaatggggtatttacgtgcagagaaacagcgtgctcttgcaccgctaagcactgttctttaaacgtctctctgcatcccactttctaaaatcctcaaccaactgcctcttaaccacacaagggttcttagagccagattgtcaatgataaaaacaaaataggaccaatttattaagcatccattattgagcagacactgcacaaggaagtttatgcagttatatcacctaattcttataaccatctgctggccccattttttttttcagttcaaaaaaggctcaaagtcatataataagcaactagcaagtaggaatttaaacccaacttgccctggctccaaagcccaagctctctccaattcattataaatacctcaaaaacatctcttatttgttaataagatgcactatttattattaaattatttgttaataaatgcatgtgtatattagtatttatttaataaaattcttaataattatttgtcagtaatattaataaaataataatgactatgatatatagttaggtttagtagggccctagcaatgggatatttgatattcaggtacattcagggtaattcttttccctggaatatttattcacagctatggatttatttaggtgtggaggagtcttctgaagaaagcaaaaattagactcatgtcttaaattgaggcttagacaactatagacatgcttgatgaattgggatgaggctaggagaagataaaagctaggtttttcttattccatgaaagacaattcatcatgagacaaaagtacggtatgatgcctggatgcagttccagggtctaagaatcaaatcaaatgatatattcaggtggaaaatgacaaatgccttgaaaccctcgagacctagccatgaaagcagaatatatattccaagagtcaaagaaaaattatatatgcaaaccaaaaaagctgcctttcaagatctgcagattgggttccaagcaatgctgctgtggaaccctccctacaagagcataccacaaggagagagccatttccttcccaaccttcagcaaaatgccacgccctcctagcaataccagacaaggagttaattgcttgaggctgacctgcaatagcagcagattcctggctttgcagaacagaaggaggtgcttccggaccgcttgtccagccagcatgtcaggtgcacagacaaggcttgtcagtagtaacagtgatatcagtgaccaatgatcagaactatctgtctgagcactagtaacaagctgcttgctacttggggatactttgttgagactgggcaagacacaagttggttcttggaagcagaatgatttagcctcctgttgagagcaagctcatttgtgcatacacagcatgggagccactatactggataccttacacacattcatttgttacattctgcaacaatttgttaagaacagtacattattcatatcttaaagataaataacctgaagcttaaaaaggtaaagtgaggctgggcacggtggctcacgcctgtaatcccaacactttgggaggctgagacgggcagatcacctgaggtcaggagtttgagatcagcctggccaacatggtgaaactctgtctttacaaaaatacaaaaattagccaggcatgatggtgggtgcctgtaatcccagttacttgggaggctgaggcggaagatttgctggaacccgggaggcggaggttgcagtgagctgagatcacaccattgtactccagcctgggtgacagagcgagactccgtctcccgcaaccccaggaaaaaaaaaaaaaaggtaaagtgacttgccccaaatcacacagctttagtgttcacattctttctactatatcctgtgctttttcatgaccctttacttatctcctcatattcctcagactaagtcccagatattctagcaatgaccttttattcagaaaaattgttatttgggaacattatgaaatatttcataaatttaactatttacagttacatacatacctgggccttcccctataattattttgtaattcaacagaatatgatatagtaaccagagaatttcctttgaatgtagagaaacccaaaggtaaagatgagcaagcagataattcatgggtatacctcacaaaaagagatgtcagccaaatttatcatttatgtcctttttaattgtctgctggacataattatggtacaacttttaaaaggcaataaagtgtacccattctttatctcaaatacactttgcattcatcccaaagcaaagtgcagttccaaagagtctaaaaacttgtagagaagagtcaggtgtacaacatatactcttaggagtactaatgaatgctcaacattctatcagttccccccaactttttttttttctttgagatggagtctcactttattgcccaggctggagtacagtggcatgatcttggctcactgcaacatccacctcccaggttcaagcgattcccctgcctcagcttcctgagtagctggaattacagatgcacgccaccacaccattaatttttgcatttttagtagagatggggtttcactatgttggccgggctggtcttgaactcctgacctcaggtgatccacctgtctcggcctcccaaagtgctgggattacaggcgtgagccaccacacccagcctagttttcctttatgaactacaccctgcaagagaaggaagttgcctaatacttatcctactcagcattccttcaaggaacaaaagacaaactctaatgaaaactgatccaatacagttggtatgagtgattaactttgcacaaatgatcatatatgtatcaggcattttccaagtgctctcagctaaaccattttaagagagctctaacccagtagtagcaagaacaaggtgtaagaagaaatggcaatgaaaggcagtttcttgtcgaaagtcaccaagaaatcatgagtttagaagtgggttccttaccattctggatggttcttgacttgatgggtaataaactgcctgtggtagtccaacaagcaatggcaatgtaagtcagaaaaatggaagtgctgtttttggagaattgtattgccagcttaatacagaaagtagaaaagctcatgatgcttatttgttgtaaccagcagagttggggagtaggagcttttgcccaacctcctcatcagggaaaagcttgaggggcagaaggccactattttaccaatgacttgatcagcactgaacatccatcaagactccatggtgccctgccctgccactgaatatcacaataattcagacaagtcagtgggtgacagaatctcccatgtaactcaaataccactactgatagtttgaatatgtattcataaactttcatatgcatttttcatggtatccttctaaccttctgtgtaactaaaacaggtatgattccattttgcagatagggtaactgatggtcaaagagtaacacaaaagcacaaaagtaacttacattcaagtaaaggactctgtctctttaaaatctcaaatacagcaacctttctccccgcagtatactcagggattcttgggccagcttccaagcctgcaaatcctcgttctagtacacggccaggaggaaagaattccagggaaagatctaaattacaagagaatctgtgacatctgcctggcaaaatattatttcttcaaaaagtccattttttcagaaatgacattgaaggtctaacaacttgccatccttcaaaacctgatgaaatttgctgagggagagagagaaaaacaagaggtgaggacagaaagaataagtaaaggttcctgattaaactctgtagaacaaccaagtaggagaatgaataccaatggtaagtcacaggctcacaggctaaaagtaaaagctgcccaggaagaaagagaaagttctggaagcaaagaaatctcaagtttctcagtgggtaatgaaaataactgtgtcattttagatcacacaccttacagaatagaaagaaaaaaacttatcttaagatacactcaagttttttgactattttcctgaaaccaaggcgatggtactctgatactctgctaggatataaataagattttgttttttatgaactgagcccctgattttttttgtctaatggtacagtgcacctcaggttataagtaaaattatattcctattcttttccagatgttattttcctcgtattaacaagccattgatgtttacaggaataaccagcaaaaatgaagcaacatcacatgtaacttgctacaaatgcaaagcatcaaagcccaacaagatctcctcaataataatgtgcattttaacaaggtctccaggcagtctatttgcacactgagtagcactgttttagaggtcctttacctgagcaggttttattttaggtcctggccccaccctgctttggactctttctcccgttctctgccatagagtaatgcagaagtcactgaccatcaagaaatccaggatgataagcgccagagggtccttcttcattatcaaaacctggggacattggccatggtcatccaccaggttagttgcagaggctgaggctcagtcttatttctccaacttcctgcttcagggaccttctcacttcccactgtgtttttgctgtttgccatccctgcaatgccccttccctcacttacgcactccctaaaaaaggatatcgagcaggcgtgacctaagtcaaaactgtcaagtagtacatttatcttcagtaaccccgaggactaaggatccttttggttctgttctttcccctaaaccagccatcagcaccagtactgtcattatactcaccaacttgtactgaagttgcaaagaagttttgataacaataacagtaatagcaaccaacatctattaaacatgcatgacttgccaggcactgtgctaagcaccttgcccattcatttctgacaatatcttcagaacaatgacccaccataacacaaaattctatcattaattcattttgtacataagaacactggaggtagaaaaccacagtataacttgccataggtcacacaattagtggcatttatttacttatcttccgctataaataatcaatgatttaagaactctcactgccaaaggtatttgcattctacaaggcacagtgtctcttgcctgtaatcccaaaaccttggaaggctgagacaggtggatcactggagcccaggagttggagaccagcctgggtaacatggcaaaacctcatctctacaaaaaatacacacacacacacaaattacccaggcatggtggtgcatgcctgtagtcccagctactctggaggctaaggtaggaggatcacttgagccttataggtaaaggctgcagtgagctgtgatcttgccactgcactccagcctggacaacagaacgagaccctatctaaaaacaaaacaaaacaaaaagtcttaggagaagaggagctacctggtaaaatttcagcagccactggcatgaaggttttcctttgcccctgaaatcaccatccttgcagtagtgccctatgtacaaagacataggggtatttagagattaaattaagaataaaacacatttccagaatccagattacgctgtagcaaggactgtgtccagaaaccaaatccaggatacacagcaaaatatgacttatgcaaaggaaaatatcaattttctaatgtaaggaggttctgctccaaccaaacacttgccccactattgtgatggagaggacatttactaaaaaacagaaaaatgaggctagttggctcttttcttaatgtcagtaaactaatgattgtgttctgaaggcagtgtattatgatctgctgatggaggttagagtttcacattgtgactgaaagtatttttccattgtttcaggcaaaaatccttatttttttaagagaaaagaagaaaactgctgccagtattaagtaggtctagagaaataattaggcatttttccctgattatttaattgaccatggttgacctctatcggtgacaattatatttttttcatgaggaaacactgacctattttattccatttgccttccaatatttgaaaaaatgggggaaaaatctagcttgaatgtaaatgtttataaatccctaatcatggaaattcggaggcatctctgggcatttttatcactgataatcattaccttcaatggagagttttctgcattattggagagtagatttctaaaagcgtgaaatattacaatgttaaatatagctaagtgggacatgaaaactgtttcatttattttgttattccaatagggcttagctgacacactgttcttgtaatatagtcagtgattcagaaccagtagcttattaagcggaaaaaattaaataggaactgcctgtcattttgtaaactcaattttcagagcatttcagcacattcaaccaatgagttaggtaatcagaatctcaggagatattggattcaatgcataatgtgtttgttttaaattatcaatggcattatctattaattattatcaattgccaacatacatttcaacatattgcaatcaatattttgcatacttaataaatatttatgaaagatggtggtggattacagactgtaataaatatatcattgattacagggtttccacctatagcatttacattcaaaaagatcaacatatttttacattggaccacagaaaggagatctaagatggttcagctagaaaaaatattattcccagataaacatatttattttataaaataaaatttagtttgaatatttttatgtgcagtaagtcaatgtagtgctgagtgattgctactaaggtatccacactaatttgcatgtactttgctttaaatataaaagatgtaacagtaattcactcttactaactgaaaagccttggccaggcgcagtgcctcacgcctgtaatcccagcattttgggaggccgaggtgggtgaatcacttgaggtcaggagttcgagaccagcctggctaacatggtgaaaccctgcctctactaaaaatacaaaataaattagccaggcacggtggtggatgcctgtaatcccagttatttgggaggctgaggcaggagaattgcttgaacccagggaggcggaggttgcagtgagccaagatcgcaccattgcactccagcctaggtgacaacagtgaaactctgtcgaaaaagagggagggagggagggagggagggagagagaaaaagaaagaaagagagagagagaaagaaagaaaagaaaagaaaaagaactgaaaagcctttacccccaaaggacatgatcacaaggtagacatttgtgtgcaaatatttctgtttgtgtttataaacagtatcttcacatatttctaagaaggctggttaagagaaaatatgcttacatgctttcctgagaacataggggaaatacattatggcttgtagtttataaataaaagttaactgcatactcatttcatctttacttaaactaaataatattccattagagtaaatgtggtttgtgagtgaggaaaattaatcaggtggtccacacctggactgaggcaacagtccgatagctcacggaagcatttcaagaaaaccatttagagtgtggactgtttcagaatgtgaacaacacacattaatgtcctgttgattttctttgatgtttgggcttatttgaacttcagtttgatgactactagccatattttatatgagatgtggtttagagacaacttttataaaaaccagtttgccttgtattcctaaacctatttttttaaaaaaacgaattaaacagagttcagtatagaaatttggcaactgtcttagttgctgaccccttagaaatctggttccaagtactgttgacaggttgttatggaatttaaatgagtgccacagtatttaaagctcaggtcagaagtaataaaaacatattgaagaagcaggctttaattctaaggaaagacagctggaaatctggcaagtctcttttgagtcgattaacccaattgcatcttgacagttgtacttttcatagtgagtaaaatttgattcaactcaatgtacattaggagcatggtgagatattcaaaggtgaaaaaaaagagactggcccctgaggaagtggaggagaataaaaacaagaaaaatgccagtatttattgagctcttactaatccttagacactattccaagcactagtcatgatggaatgcataaagagagatgtaactggtcatgtgtgtttgcatgtagctggtgcagagggagcagcaatgatgtcaaaatgaagtaactggcattggaaaatttcttaagatggcatgattcagaagtcagagaagaaaaggatggcattctgggcagatggaatcgcatgagcaaaggcacacttgcagcagaaactgcaagacatactcagaaaacagaaagtcatatggcttgactctatcataggcgtgctggatacagagggaacttttgccttccttagcaatagagatagtacgttatgtagttttcacaaagatatttaatctcatttggaaattcatactatgtaaaatattctcatggttctaatgaattatgtgaatatattttacagcatttcttcaggacatttataaattatttagactaaataatggcattaaattgaattatatttaataacttatgaaatagtcattaaataggagtttagtaaatatgattacatagtttatgctattttttcatctttgaaaatgatcaaaattatctttgtgctctagattaatttttgatcttatctattgtatcaattttggagaaaatcagtacaatttttaaaattttctttccatgccattaaccctgtgttgcaagtgtaattttgctctttatgaaccacccacattttcctacttattacttctcagtgattttccccagaagactggatcttgcatatgttcgtattcctaacgctatacctgaaagacacagaattacatagtagtagatatcggtcaaacaagcaaagggttagaaatgtctcctacggggagacgtgtttaaaaagtcaaatctagaattagattggatctctgtgaaacatgttaagatattgtgtgagctctttctaaagattcttagcctctgaagacaggttttatgtcttaatctccccaaaggttaggtgtatatttaaacctatgtgtatatacaggtggatatgcatagatgcaagggtgtgtatataagttcatgtatagaaataggtatggataattgcacatttaattgaacagcccttgttcatagatgtgaagtttttccattcttaaagggctaatttaattttactataacctatctggtttaccatataacaaacaggataaaaggattttaaagaaaagcccctcgttggctttaaataatacttatgagactcagaacatgtcacacaataagatgtttcaacttaacacatattgtccttatgttacttcatcttttatacgtataatgtcaaagacctctcaatctgacttatcttttagatcactaacaaggaaaaaaccagaggctttcagctaggtttcatgatggtcatgaatcccttgaaattgtatatatgcatgtacacataaacatataagtaaagtaacatgtgtgtgcatgcatgtgcaaacatatttctagagaggtctttcatcacattttcaaaaatatcacagtccccagaagtttgcttctgagtgtgaccctaaatagctttgattcgaactcaattataattaaagttaaaatcataagattttcaggaaaatctcatggaagcagagtagactggtaattaccagggattggctggggggtggtcctggggaggttttggtcaaaggatatgacatttcaggtagacaggaggaataagttcaacatatccattgtaaagcatgactgtagtaataacaacgttttgtatacttgaaaattgccaagagaatagagtttaagtgttcttaccacacacaaaacactatgtgagttaatgcacatgtaattagtttgattttgccattctataatgtgtatatatatcaaaacaccatgttgtataccataaatatatacaattataatttgtcaataaaaaataatataatcactattttttgtaatttttagcaggaactttaagaatgcttgataagttttttgtttgtttgtttgtttgtttttgagattgagtcttgctctgtcacctaggctggagagcagtggcgcgattttggttcactgcaacatcgcctcccaggttcaagaggttctcctgcctcagcctcctgagtagctgggactacaggcacctgccacaacgcccaggtaatttttgtatttttagtagagatgggctttcaccatgttggccaggctggtctcgaactcccgacctcaggtgatctgcctgcctcggccttccaaagtgctaagattacaggcatgagccaccacagccagatggtaagtattctttagagattgcaaaacactgcattattaattaaagattaagatacatagatactggaaagagacaaatagattaaagataaatcgattcaatggatgtggatcagaatccataatgttctaacttgaactgttgtttttctgtattccgtaatcataaaattgaggttttctcttaagtctacttgctaagataaagatatttcctattaatattaaaatttataatagcttcaaaagacttgttttagagctttaatgtgatgagatttgttataaaaaatgacatttaatggaatgtttctggtagaaagcagtgtttttttccccaaagctgtgcacagtgtttgccatcaggggttgctcttctgtcacactttgtgacactctcctcacaattacctgcttgatctagtgataataaatcccatcaccaaaaaacgatgcacagctacatttatagaaaggaatacatttgcaggatctccagtggtctgcagaccacagaccacaggctgactatggccgcaacttgtttttgtaaggaacgttttactggagtgtaccctcacccattccttcaggatttgtctgtggctgctttgcggctgggatcacagcattgaagagttccaacagaacaacagaaccacatgtttcacagagccacagatattttctaaccagcatttacagaacaagtgtgccaatcctcactctagacattcattgatttctcaatgtctgtcatacacgcctgttacgtgatcctcagctttcagccccctcgccccttagatctcacagtcaccaagccttctagggaaagaatttcaagcgcccctccatcttcttcatttattcgctggctcagttcctctctaccctgcaattgtttccttttttgcctctcctgcctcatttcttcccacttgaaaataataatttacttttctggaaataccattacctgctactcttgctataaactgacaaaggttcccattagccttaagaaaatggttagaatctttatcctgacagaggcggccttgaagaatctgttcctgagaccttcatttacagaatcctcttacagacagccctctgcccaagactgcctcttctaccacctaagtcctgcccacccctgcttcaggttgccccataatgcctcactgtcagtcaggcctttcacagcctcctccacctgcaggcaccactgcttcctccacacccctcagccatcaccacctctcatctatacatgaaacggaatatccccttccattggtggatgctgggtttgagtttccctttctacctcttctactagagttaagctcaccaaagcaagaactcttttatatctcttgacagcctcaaaacttagcctagtgctttgggcagagttaagtttaaaatatattctcatgtgtggttaaggatagctgcaatactagcaattgttgactgtttactacatatcaagattgtctcatgggttaggcatggtggctcatgcctgtaatcccaacactttgggaggccaaggcaggtagattgctagagcacaggagttcgagaacagccagagcaacatggcaaaatcctgtctctacaaaaaaatacaaaaattagccgggtgtagtggcacaagcctggagttccagctactcgggaggctgaggcaggaggattgcttgagtccaggaggtggaggctgcagtgagccaagactgtgccactgtactctagcctgggcaacagagcaagattctgtctaaaaaagaaaaaaaaaaaaagatagtctcatgtacaaagaattttgtaggccaaccatcaaacaaaaaaaaaaaaaaccaaagcaaaacaaaaacaaacaaaataaatccagtccttcaggagcttatggtcatactctgaccttattcttaccaactttgtagtttattgtctcctgtgacatgcaagaactgaaattttctttagaaatagttcctatactttttaaaatttaatttgtattttccccacttaattctcatgttatcctcagtttggtaagttagtctacatatctagcatcatagctcaaataaagtctaacatactttaaacccaattaataattattattagcatttattaagcatttgtttattaaacaccagtattattctagtacttcatacttattatctcacttaatctctcaaaactctgagcgaggtattatttttagagatgaggacacagaggtggtgaggtaatctgacccagagaatagaataggtcaggcttcgagcccaggtagtccatctcataagctcaggctggtcaggactgcaccgtgctaccgcagctagacatgaatctacgcaggtggggcaggggtgagaagctcaggtcccccgccttctccacacctgccaccccccagcccaaagagctgtccaaccagctcagtgtttaaaatccgagtcacttctcacgcatggaattctcacacaccacccgcaagttttgtattgattttttttcctgaagatttttaaatcatttgaaaggtatatttactctctttcaaaacccatgttttgaattaaccatttattcattcattgaatcaacatttaccgaaagtcttctgtgctccaggcatttggaataaataaataaaaccacagctcaaattatcttggggcatgatatgattaaatagttaatggttctgggatatcttaatgaaatccttaatagtaatgacaataaattaatttatcaaattatttgattttaaaacatgtgcagcactttatagtttctgcactctacactttaatttctgagcctcataataactctgcagggtaggtatgtaacattccttacagatgagaatatagtttcatcaagcttgagcaattttctcatggctctctcaagactgaagtcttccaagtttgggttcagtattccaaagattggggacataatgcactctaagacatagttcttgtactcttgaaaaagtaggtcatatttctacagaaaaggtcagatatttagctatacactttactgacatctacttaaatcagaagttgatcttcatggagtacaattagtttggtttttacctgtgaattcaattagcagtatgaacagatctaaagacaaatatttcaccatgtacttactttaagatctaagttctattaacaagcatgcttctctgttgaaagctgtactacagataaactgaattggatttgctggtataacagttaaaagatcagaatcagtttgcaagaggaaccaccttcctgattgatttggattctgtattcattaggatcctagaccagggcttctctcttcatccctttctttttctctgcttcctaacctgtccctctgtggtgtgtgtacatccttcagggataggacatcgatcaaaccatgcagcaatcccagaaggtggcatagcagaatacaacacccttctttaaaccacaaagatccctggggactatttactgtaaaatacaactacatggaaagtatcttaattataacataattcagttgtcaatatatctatattctacattgactccacctaaaactttgagttagaattacttttggagctttttcaaaatgcacacatcaaggactatccccagacccaccagttccaaatctctttacagtatttgttacagcctaatggacggtgctgctgtgtagctacatttgagaaccactggtcaaagggttgggacatgacccttccacccctttaccctcagagtcataaacagaagatgctgatgttaaaattaagatgtgtttacactgaagaaaactattttagtttatatatcttccaatttcacaagtagtaaaaggaataaaattatggggaaaatcattactacttaggctaccacactccaagaaacagaaattcaagaaaaggcatcaaggccaccatgttggggctcacctcactgtggagacggctgattttacctcaaggtgagacaggaacctagtccagtcctaacaagatccaatccttcaaccatcaagaggcaaaagaaaatatcacaagattggattggtcattagatcaaactacaagggaaggagagtggtgcaaataatctagtccaaggaggaaaatgaaactaaaagagtgtcttgtttgcatttcttggatgattagtgacattgggcattttacatatacctattgattactgtatgtctttctgaagaaatatcgagttctttgcctgttttctaagtgggttattcatttttgggtactattgagttgtaggaatttcttatatattttagagatcaaccctttatcagatacatgattagcaaatattttctcccataccgtatgatgccttttcactcagttgactgtgtcctttcctgtgcagaagcttttgagtttgatgtagtcccacggtttatttttgtttttgttacttgagcttttggtgtcaattccaagataattgaaataagaatctggaagagatatctgcattgttatgttcattgcaacattattcacagtagccaagatgtagaaacaacataaatgtccatcaacatttatgttgtcataaacataaatcaacagaggaatggataaagtgtggtgcacatatacaatggaataccattcggctttaagaaaatcctctgatatgtgacaacatggatgagccttgagaacattatggtaagcaatataactcagtcatggaaatacaaacactgcacaactccactcatctgagatatctaaaacagtcaaattcatagaatcagggagtggaatgatggttaccaggggctgagggaagggggagaggagaagttactaatcaagaggcataaagtttcagtcaagatgaatagctccagagattgggggtacaacattgtacctatagtcaataattatatattgaacactcacaaattagttaagagcatattacatgctcttacagtaaaataaaataaacatttcattgtatagccttttaaaaggctgaattggacagatgggaccaatggtaaaggataatatttgagaaatgagagtggagaacccctgcccaccaggtaaatgatttagagggctgcttcttccttgattctcatggtgatgacagcacagttgcttatgcatgaatgggatcaatagaagccttcttgttagaggttaccctgggggaacaggttttgtcacagaggtaacacagaagcacagctgtccccatggttctccttcccttccccgcttgtccccaccctctctgtgcttacaacaggaaggctttatcatatccataccactgcagtcttatcacaatcatcagacacaagaccactgctcaaaaatgagcaattattattttaatggtcattttaatggtagccattctgactggtgtgaaatggtatctcattgtcattttaatttgtatttctctgatgattagtgatgatgagcatttcttcatgtcattgctgaccacatgtagggcttcttttaataagtgtctgttcatgtcctttgcccatttgttaacggggttgttttttgcctgctgatttctttaagtttcctatggattccggacaggagctaaacattgaatccacatggacacaaagatagaaacagcagacactgagaactgcttgagtggagagggtcagggagcatgggttggaaggctacctatcgagtattttgctcaataccttggtgacaagatcacttgtacaccaatcctcagcgacacacgatttacccatgtaacaaatgaaccaaaaataaagtagaaaaaaacagcagggtgtggcggctcatgcctgtaatctcagcactttgggaagccaaggcaggtggatcacctgaggccgggagttcaagaccagctgaccaacatggagaaaccccatctctactaaaaatacaaaattagccgggcttggtgacgcatgcctgtaattccagctaccaaggaggctgaggcaggagaattgcttgaacccaggaggcagaagttgcggtgagccgagatcaagccactagactccagcctgggcaacaagagcgaaattccatctcaaataaacaaacaaacaaacaaacagaataaaacacaatccaccacttcatatcactaggatggctattataataatttaaaaaaggaaaaatagcaagtgctgctgtggatgtggataaattataatccttgtgcattgctggtaggaatgtgaagtgatgtagtcattatggaaaacagtttgagagttcctcaaaatatgaaacatggaattgccatatgatcagtaattttactcctaggggtgtgtgtgtgcgtagtatagtgtgtgtgtgcatgtgtatatatgcacgtataggagtatattctatatacaataaattatattttataatcatatgtataacatatacaatagaatgttattcttccacaaagaaaaaataaatttctgatgttatgtcacaacatagatgggtcttgaaaatattatattaagtaaaataagccaggcaagaaaggacaaatcttgtatgatttgatttatgtgaagtgccagaatgggcaaattaataaagacctaaagtatatcagagggcgccaggaacaggggcatgagggaatggagaattattgcttaatggatacagagtttgtttgagatgataaaaaagttttagaaacacatagtggagatggttgccaaatattccaaatgtaactaatgccactgaattttaaaggtaagagtggttaaaatggtaaatattatgttatacatacaagtattttattacagtaggaaaagaaaagcccagttaagctcctcttaggtccacacggccctaccttacctcccagcaccaacactgaatgatcagcccacttggggtcatggccttcgctgcagaatgcagtctacccctcactccacctgcagacaggctcccactcccctgtccttgggaacctcatgccagccaggtaggggtcactcactttctgagcacctgagcctacgttttgcctccgatccccaggtccttttcagctgttccgagcttcttgtctgcttttctccttacctagcttgcctttttggtttctataatattttttctggtgctggtggttggcccagtctttgcagggactattcagctctctgtatttggcttttccaaatgtcttgtctgtttacttggcttctgccctttatctgtcctcatcctcccacctcacatagcccaactctagtctgctcccgtcctgacttgctcctgtcctgacttgctccatgttctgggcctgtcatacctgaaacacaaacttctttgtggttctaagcacctgacttttaagtgagccaattcacaatcctaagtttattccaggaagcctcaactcggcttcgtagaggaatcacttggagagctttgaaaaatactggtaatcaaggtagaaatttaccctgaagacatatctctagaagtacaaaatactataaggcacaaggaggcattgtttataataggagaagccaggaaacaactcaagggttcatcccgagggtactggtagaataaacagtggcacacccatccactatgcagccagagaagaggatgaacaaagagagcggtgttggaatgatcccaaggataagtcgttttaaaagaaaaaatactgtgtagaatgatatatatggtgtgcaacatttggtaaggacagggaaaaataagaaaaatatgtgtaagtttacgtatgtgtatttgtttattttttcaaaaagaaacagtggcagtataaatcagaagctgacacaaatggttactaagtagaaagaaaaatgggcagagaggctagggaaagaaataattttttgtgtgaacctttttatttaatttcaattttgagccatgtagatattttacctattttaaataaaaaactacaataaatgaatataactgtatgccaaattggtacccaatcacaagagaacataattatttcaagtggctttttaacacagaactctgtgtatatactcaagacaaaggaaaatctaatgtgaaattttgacagtagttttgttagtactaatgttgaaatattaattttgaaattattatattcattgtataggataaataaatatattgtatacgataaataattttgacatcattgtagttatatacgtatgggataaataaatatattgttattaggaaccaagcttgttaatgttaaaaagagagagaaaaataatttaagaaaaccctataatattaaatattaaattttgatttaaaaataatttttttaaactttgacaacggaccaagaaaataataccccagtgacaataaaagcctctatcacccaaatattggttactacagactattttatactcaaaggatcttgcgttgcttagataaatggtggtccatctatgttagaacaatttcaagatgagcctgagacatattgtgccagaaaccaaataactgatcagacattaacagtaggttttcagaataactcatgaatgaacttatggggactcccactttgcaagtttggaaaaaaaattcactatatttccttctttttatgattgaatagtattctatcatatatgtatatatacttcaaaatatcatgtgcatattaaatacatacaattttatgtcacttaaaaaataaatctgaagatatttcatatttgtttacaaagcataaataagtatatgaattcacacttacaccaaaaaattaaattaaatttactagatataattgttatacaattcttactctgaaaaaaatggtggtcaaatgacaatgattatgcctttacctttacgttgctggagtaagagtagttcattcccagctaataaatttagaagaatgatagactcctacaacccctaatgaattcagtaaaactgttgattcagccaaacatcatcactggatgctaggatctttataacagggggatctgtctaacatcaacttgagtatcaataatagtgacctcatgggcctctagtgtgttgcaatatgaagtctacagcatcatctatgaggtatccttgccaaaatgagtaagctgaatctcatcaagcatttacgcttaccttccttattccagagaaaataacacagagaaacaaactagccaatactttgaaaaatcactcagatctatcctgaacacaggtactctacaagacaactggctgagtcttccaaacagactatatcgtggggagagggtaactagggagattgttctagattgggagagactaatgacacacaataaccaatgcaatgcaataaccttgattggatcctggataagaaaattactagggatgacaaaacaggaaatctgaatatgaacagaatactaaacgaggctaagaaagtattttttaatattctaaggagaataatggtatgtgactatgtcagtggaagtccttattcttagaggtgaggtaaaatgatgtctgcagcttcccttcaaatggtttagatggaaataaataatatatatgtatgtctgtgtgcatatatatattctatattcacgcacacataaaagtatgttatatatgtatgtatgtgcacacacgtgtgttcccctgcatttgtgcatgcacaccaaatataacaaactgttaacaatcattgaagctggatagtgaataaggatgtttattgttccagtttttaaatgtttccgtatgtttgaacacttttatcacaaaaatcagaaaaagtacagagagcaggatccacccagagagattcagatgagccaggatggggcttgggcatcagtactcttaataaactcccatgtgatactgatctacagccagtgttgaacattgccctcacccatcatgccccaccatcctgccacccaacctcactagattctggcatctcctggccctacagacacctcctcagagctcttgatgcctcgttgagccccttgagtcaagactcctggggagctctttcttcaactcactatacaggcctttttggacggccaaacaaaatcccaccaggaagacattcatcaaaaagagaggtgtcatggaaaactgcaaaggcagacaaatgtgaaccataggggaagatatgggcctaatatgggaagcagcaacactaaacaaagccgtaaacaactcaatgaaaagacctagggaaaaaagcaaagaaagtggaaagctatactgatgagagtcccaaaagtaccgctaagccatgaggtcatgcttaggatttattcatgtcagcgtcatgagtagtgttaaatgaggagagctatcagagagacctttgtttcagggattcaaaagctgggacccagggacacaggacataagtagataggcctaggccactaccagtgttttcactagaagagaaagtaattttggaagcagcacagatgtgtgtccccagctgctctgcctccccttcccctcacaaagacgtcatccagaaccctggtgaaatgcagctttccaaaaaaatggtccacaacctgtaagagatttgacagtacaacacagcatagccttgcggctcatctaccatagaaaagtgattttttttttttttttttcgagacagagtctccttttgccgcccaggctggagtgcagtgacacgatctcagctcactgcaaccaccaccttccaggctcaagcgattctcctgcctcagcctcccaagtagctgggattataggcgcctgccaccacacccagctaatttttgtatttttagtagagacggggtttcaccgtgttggccaggctgctctcaaactcctgatctcaggtgatccgcctgcctcggcctcccaaagtgctgggattacaggcatgagccaccgcgcccggccgaaaagtgatctttaaattagggactgagtacttccgagcatacacactttccaaggtactcaggccagaatgatttcaggatcagattccaaatcgttagtccctatttttccacaactgacctgcttgagccagcacctgctgtgggggttgcatgcctgtttggaatctgcttgcccacaacttccttccacaaatgggcttctcacttcacaaaggaaagccatacttctcagtggtcaggaatcttactgtggggcattgcctacaggtggaaaatcttatcaaagggaagttcaaaatatttgtgttggcaaaatctcctttgcccaagggaccatactcttcaccattttttatcccatccatctccagaagagatgtgtaccttagaaaattagtttttatagttaacaattactaaatattttgaataaaaaaatctatttgattcatcatttactactaataagcatagtaaaactaaatgcagaagaaaaagtttaaccctgggaaccttatgtcccatgaaaattatttaattaagtttttatttgtaatcatattttgttgccaataactatgtgttatagacttgatccaagtggaaatgtttacttatattaatttatacacccttgtattttgctgtaaaaatagtctaaagtatatatgttgtacatacccaaatgcttccgtaagacttgaaagcgtgtctttgaaattgaggacgggaatgtcagggaacagcttctgctatatcgagtgtgttctgaacaaagttaatggagtgtaaattcatcaggctcctaatcaaaggtttgtctcatctggcttaaaggcaattaaacataaaatccaagatgtctaacataagcaaaaagaacagtttagcttttttggagtagcctaagaaaacggctttctgctgaagaaaccttattctggcatttaaaagttaggtttcaatggaatgaaatcaaacgtaaattgacaaagacaaaataagaaaccatcaatgattgaaatattgtttgtgattacacaaattcatgggatatactagagtcatgagttttgttctcctgggatgtatttgcaattaaaagcaacagattaaaaagcaacttaatttattcacaaactcacccaagaaaaatgccatccaacacactgaagatttctattcattcaggaatttgctaatttccctgtagtatatgaggctggtatttttatactcagcccacatattagtaacaggacttctgatcctagctgaaattctcttttattatccaaaggctcgtcaaactggattatctcgaaatcctaatcacatctcatccctccactccacctctgactttcagcagatatcttgacctttcatctcacagcttcctgctaacaagcccctagcccatatgtgcccacaaatatcatttccccttgcatagatattatgacagcgggagtagctcatcatatagagcgctctccccaaaataaccagtcttcatcttgttgttaaagccagtgagtatctttcagttgttatatgactgccaaatgactctttggcagcattttacacttctgaaaatcaaaatgcaactttttataagcattttgattttaatagaactatttagttacatgccctacatggcattttctctagcaggaaaatgaacagtttggtcttagaaagatttttgatataaatatttcaaaaataaatgatagcaaatacttattgaggatgtaaatattccaatatttattttaaatacttcatatttattaaagcatttgatcccccagataactctgtaagatgggtatttatactctctccattttacagatgctgaagagaaagtgtaaaaaaattgctccaagtcgcagaggtggcaagtgtttgatctcaagttgccttagcctgccctttacctaccaaatgctgccaagttacctgtaaaattcacttgaccagacacatcgagcaatcagattaattgagatttgattttaagatgggcagcattacaaagaatttatagacaggtagtgagatacctagaaagacagacggatggtaagaatgagctgattaagaagacacctccatgtgaagtagctatcagttggtataccaaaaccaaatcacagaaagattaaagaacttggaggttatcaaatcaagcctggaacagaattttctaggtcatatgcagccaacaatgtttcctactagactgagaagaagctacattttcttttaagcactttgctaagtaaaattacaaagatggtagaaagaagaatgcaaggttaatcaataattaagttagaaaatgaagttttgcttaagatattagataaaagcattcaagcaattaattgaaatgcatataatgctgctgctatagaaatttaggtaacaggcagattaagtaaaaattgatttttcttgcaagacactaacacccagaatatcaaggggtggacaaaaaagaaatagtactaaacaaatttttttgaacccaggtgatcaaaatgttatacagttttccaaattcaaacactatgaagctgtccttagataatggccctaccattttcccattactttgcaactttcatattgctctacatcttcaaagtttttctattagagatagcggatatcactagtagctttaaaataagtgattcttgacccccatccggatattaagtgttttgcatgttcagactcatgttaggtttaatttaaagagctagtggttaggcactccatagaataagtgtgaaacaatagtcatttacgtgaattaaatgtttgacattagaagtgttttgagcctagaaacagacacataaatgatcgtagttaatggaaatactgccatgcttaagatcattcagcacttctccagaatgcaaagtatatttagaattagatgcagatttacatgtgaataaaagattttctccagccttactctccaacatccagagtaacaacagaacagcaatgagaaagagaaagtgacatgaaaataatttgaaggcaaaaagcaagaatgagaaatgttcatgctcaggtaaattctgagaacaaggtagtgctataaagaggggaaagaatagaaagaagtattaattaatagtcactaaaaattaaaaagctgtcccacttgaaagtattaactgggttattaagagaaaagaggaaaaattactgtggactgtgcggtgtggatctgggacaaaaggtagtataggaaagcataatttatggaatagaaagctatatggagttttaaaaataagcagtaattttgaccaccaaaatagagatgattatactcttaagaggaaaatgttgagttgtagccatagtggggttctgttacagcaaaagtacaagacaatggaatatgcagctattaaaaattagaagagacaaggccaattttctgtagtactggaaggttttggtattcactaaaattaaagatttaaacaaaaggaaagtcatcaaatgtcttttacccttagaatgcaccagtatggatacagttctggaaatgtactgtacaggcatgagttcaagtcctctgatgggccagatggatttttatctcctcatccaggagcaggagggccagcacatttcttgcttttaatgatctgaggcttccaatgttttccttttgtctttctctagcatctctggcttgttcttgagcctatttactcttgtttcatcttcctgttatttatatatattcatagcaaacattcttctgcattcattttaggaacaaaagcttatgatggtatataaaattcttatctttaccttccttctctctatattgaaaaataattcctttaccttttattcttagaaatactatttcactactctagtattcagaacatacctcaatttctccaggttaagtttctgaagttcagcaaactacatggaattccaataattcaaagtagaataaccatatggtttcacaacacactgttattgttttttgtttatctcttttgaaaaactttaaactgtggattgcttcatcttttggtaagctaaactcacagatattattgtttaatatgtacacttgatcaacttttcccatattgcatttctattgaaaatttattttgctaaggttatcaagctagttctccaatttgttagtcaattatatttttggttttgacaagtaagaaagcttttattgaattttcttattacacatgcatttatattatttaaaaatacatattcatagaaaaaagaaaacatagaaaaccgtaagagtcactcaaaatatctcaacttgcagataaccattgttaacattctgctatgcatcatcatttagaatcatagagccaattctcaaagagtaatagacacaacgcttcacctactgttgtataaaaactggcccatgaattaacatagaaagaaaatgctggttcatgataactattgctgtatgtgtgtctccatcaaccactggatactacctattcttctggggatatgggatgaaatattctctctcaggaagacacctggatagcagggcagaaaagccattttacattcagcctttttgacaaagaagtaagcacttgaaaaattattgactttttctgttttattttctagtatagcattcaattgatttgaactgtttctttttaaaatatattttgcatagtgtgtcatggtgtaaaacacacaaccattatttcaacaaatattcattgtctaactttccttttggcaactgatgctgtggatatagtcgatgaaattttaactttaaataaaagctctgtcatatcttaagaactctaaagctatacaattttaaaattctcaaatttcaggggaaagcttgcatggagattggattatttacttctcacccaaaccagctcttctctctcaattccctgtgtccatggttaccagcatcattcacttgcttatctaagctaaagaggccttggatcttttctctcccttcatcccaaccattataaagtatacagttcagtggcattaattatattcagaacattgtacaaccatcaccactactttttccaaaactttattcatcatcccaaacagaaactaccgcacccattaagcaagaactcccatttcctccctctcctttgctactgatcatctctaatctactttaggtctctatgaatttccctattctaggaacttcacgcatgtggaatcatacaatatgtgtcctattgtgtctggtttatttcactgagcataatgttttcaaggttcattcatgttgtagaacttcactcatgcatcagaacgtcatttctcaaatattctattgtatgtagataccacattttgtttattcattcatctgttgatggacatttagtttctgtccaccatttggctactgtgaataatgctgcaatcaacactggagaacaagtatctgttttcgtccctcctttcagttcctttgggtatatacctcggagtggaattattggtcagtatggtaatttcatatttttttgagaaactgtaaaattgttttaaaacatatttgcaaccatacttcaattttatatcacaatttaatagttaaataccaacagtaatcttttaataaaagtacctaactcttatggatcatttcctgtatgccagcatctcatctaatttttctcaatgattctgtgcagtaattaccatcattagccacattctaccaagaagaaaactgggactaacaaaaatcaagccatttgtcccatctggtggtagacgggattggcaggtaattctgtctgtataaaatacctaaagaagatttaactgttgtcattttacaggtagaatcagggccacaatggctagaacaatttgctttgaggtaacaagctgagtaagtaactgcagggtcactagaactgcagagttacactagaactcacttcttaatgacttgcccagctcttccattgcaccaggatgcctgcctcactcatattatatatatatacatatatgtaaaagataatattgtgatcattgtatagctacacattcatatttactcttaaactgaagtccatttgtctcataagtaaaaagagagaaaaaactggagaccaagattattacaattataataaacctgaagtatttatggaataatgcatttgtactaagcatcacaccaaatgttttacacacattatcttaacttcacaataaatctatgagctaagtgttattatcacttcctctttctgtatgaggtataaagtagatatcagaaaaaccaatgaacttggaaaagtgtacacaaccactaagttgtaacgcaaggcttcaactctcagtgcacccaaagtcaaagcccatgatgttaactcttcttattctgtaagagttatctatcataaggaagaaaatcagatgcaaagaggatttgtataacttttactcacacttaaaaccataagaaaccctaactcagagaatcatgaatgcttatgattttattatttaaaatttttatgtcttaatgttctattctttttgttacaagtgttaaattcataaaatgttggttgatcctagattccttctaggaaaggcaaaatgggagaaattcctcaccactgagcaatgccaatgacttgaatgaagtgactaaaataaattaacacgagtggtgttcacaatgagattgttagaagtgctacatattttttaacaatgattcttttgcatcatgttagctatggagtctcagctggcagctatcagctgtctctagctgtaaatgacagcacaagtgagcagggctcacctacacttgctctgctcccactgatccctccatccccatctcgcagcggtggggaagcacctgccccttccaggaaagagaacacctttctgaacactgcctgccccagctctcacagagaggcagtgggttcagtgtcataatgcggtcttcactccacatcccggatatccaatcctgactacaccccttactaacaagggaaccttggacacgttgcttaacttctctgtgcctcggctttctcatctataaaaaagatgatgatagaagcatttaatccataaggctgttgagagggtggatccttcaaatagtagcccatactaggagctcagtagctgtcggctaatatcattacttttatcattaacactatctcccaggaaaggttagccattcaggaactccagccccagtaagaaggtggacaaatatgcctgtggctgacaagtggattggccaagtagaggtaggaggtccccgcggtgttactgttaacagaaagctgaagttgattctgtaattcccatttggctctgaacccacattctattgaaaggaagtttaaacttgttctagcaaatcaaacttactgggcttttaaccacatgactcaccccaatgtgagtgctaattctgaaaaactccaccctcacttccccatgaacacatgttatcactctagagtcactgaaaacagacaaagggaaatgaagcatgaagctcattctaggtcactggcaaacgtatgtgaaaaagtgctgtcttctgaagagaagtgatttatgttggaaaaggttaatggcattctctttgacataggcaggcttttcagtaatactgagttctcttaaaatttaaaaattaggctgggcaaggtgactcatgcatgtaatcccagcactttgggaggctaaggcaggcggatcacttgaggtcaggagttcgagaccagcctgactaacacggtgaaaccctgtctctaccaaaaatacaaaaattagcctggcattgtggcaggcgcctgtaatctcagatagttgggaggctgaggcaggagaatcgcttgaaccagggaggtggaagttgcagaagttgcactctagcctgggcaacaagagtcaaactgtgtctcaaaataaataaattaattaaaaaatacaaaacttagccgggtgtagtggagtgcacttctggtcccagatactcaggaggctgaggcaggagaatcacttgaactcgggaagcagaagctgtagtgagctgaaagcacaccactgcactccagcctgagtgacagagtgagactccatctcaaaaaaaagaaagaaagaaagaaagaaattaaaacttccctttaaggattttttttcactccatgttgaactgattactgaggacattgactaaactttgaagcagagcagttcattaataaatttgatgtgatacagttttacatgtttagaagaattccacagagtggacgagcgttgaacctggcatcaattctctcctttagcaaaacttggaaaaatattgatattaaaactctgttactattggaagagatttctgtctctatttgacacgaataaagaaatgtatattacatgagtatttcccttcctcaattccttacaatgtgtacacactagttctctttgggaagaaacaagccaagcacaagtttcaaaaaattcttactgataatgcacacaggaaggggaacatcacacaccggggcctattgtgggatgggggtaggggggagggatagcattaggagatatacctaatgtaaatgatgagttaatgggtgcagcacaccaacatggcacatgtatacatatgtaacaaacctgcacattgtacacatgtaccctaaaagtataataataaaaaaaaagaattaagagccaacctggtaaattaaagttctccattgcagatctattctattgggtaataaaatgtgctttccttgggccaaaatcagcaatagagtgttacattagtttcctgttgctcctgtaacaaatcaccacaaatgtagcagcttaaaactacataaatttattatcttacagttctagtatctcatatttaaggttttagagaaagtagaaccttgaatagtagtccatactaggaactcagtagttgttggctaatattattactattgtcattaacattaacacttactatctcacaaaaatggttagccattcaggaactccagcccggggaagaagctgaacaaatatgcccatgtctgacaaaaggactggcaaagtggaggtaaatgagtccaaaatgggtctcactgatcaatagtcaaggcagggctgtgttctttctggtggctccagggaagctgggtctacctgctttttcctgcgtctagaggttgcctgcattctttggctggtggcccctcctccatctttgcccgaaatgatgggttgaacctttcacgtatcacatccctctaagctcctcttctgcctcccttctccaattttaaagacctttgtgattacattgggtccacctggataatgcaggctcatttccctagtttcaagccagcagtctggcaaataaattcaatatgcaaattaataccccctttgtcagataactgaacatatttataggtttctggaattagcctgtggacacattttggcaatgacggttctacctatcacaggtagaaaataaaaaacaagaaaaataaagtaaaaagagagcgtacaagggaaagccaaatgccctaggatgacactttcaaacatcacatccacctgtcttaatctaggttgttgaagtgaacaaacagctgagggcatggtatatttaagcttctgtgagggaaggacaggcctccctcagcccaggactgaaatccactatacccgaaggctataataacagatcaaatgctcagattttactctgaagggctgttcatagtgtaaatgttgcccaagagccattaaatacatttgcccccactttttgcttaaatggaaattccaccaagtgaataaatgcatagcaaaactaggtgcattcttgcattgtggacagtcaacacacctaaagagtgtgactcaaaactaattgaaattaaaagcaaaattctccaattgatgtgtttctggtgtcccctcatagacatgaattccctcctttgcctctcccttatgtttctgcctaaagcagcaggcaatgaaggctaaacctctgaaagtgagcagctgaaaaattgggatatattgctggcgtacttgctacttgtgaaatatctcctgtgccaataatgaaatccatcatgtgaccagctgtctttgcaaaccaaagaggtagagcaagttaaatttctatttcaactgatgctttttataaagaaaccacagcagctctcattgtttatttaaaattagtgcaaatgaaagcttttaattgtctctgtgatgtggcttccttcctgcttaagatgagctcatggtgcctcctccatgatcctctcccctccccagcctggtctgctgtctcagccgtatgcgcaactcattctcatctccatggtgtcactcatgttatctggcctgaaattgtgccttttctctaagccatttcaatagaataaattggaatactattttctatatgaagctttggtcaaatactacaactcagattaatataaaacactccaaaatcctatagtatttaatgccacggagattgctacctaatttgtttatgttttctttttaatcttctaagatgttctaggctttatttgactgcatcccacatcttgtttcgtaattttcttaggatttaaggcagaacctaatgttcaaactcactggtaatcacggaaacacaaattacaacagtaagaaatgatcaaataacgtgagattcatcgaaatagcagaaataggaaagtcaatattaccaactgtgactaaagataggaggaattaagtactcttacgtccttgtaaagttgtgcagccattctggatcagattggaaggacttgggaaaataagttttttttgttttgttttgttttggttttttttgccttaagacacaatacactctctcctgaatatcccagagatattctcacaacatccatcagcagacacaaatgggaatgttttccatggtctcctatgtgggaatggggagttggcgaccaccccagggtccatcaggggagaggaattgtgaaatatactggaaacacactgcagaatagtgtgcggcagagagagacaacacggggagatcttacacacataacattaaaagaagaaagaaaatacaaaatattttctaccacagtactacttttgtaaatttaagacatatacacataaaacattacatattggtacattttaagacataattaactcaatctgaggtccaaactaaagcagctaatgacagacagatgtggacatacagaatctagcaatgtcatgtgaaagtcataggcagttttctgtctcgtctcttaaaaggcatacttttctttctttctttctttttttttttttttgagacagagtgcccaggcctgagtgcagtggcatgatctcagctcactgcaacctctgcctcctgggttcaagcaattctgccacaggtaattcttctgctgcagcctctcaagtagctgggactataggtgtgcatcaccacatcacttggctaattttttgcatttttagtagagacaaggtttcaccatgttggccaggctggcctcgaactcctgacctcaagcaatccacccgcctcagcctcccaaagttctgggattacagctgtgagcccctgcacccggcccttaagtgggtttacttttgactaaagataacattacttatcctttaattaaatccaaaagtgagcaatgaaacagtgagcggagttgttaaaaagattttcaggtgttctgttgaacctgaatgcatttccatttgagcacttgcatttatctctgaaaacatagccaccagggagctttagaacatctgctatcaaaaccatcaaaactgaaagcctttctattccatctcctacaattatattgaaatggattgttgaccattattttctatcttcaacacatttattttcatcagcgatttcccaccagcacagcagtatgacatttaatggaatagctattgtgaaataattatgtttaccattataattctaggtctgcactgattttaatcaaactattccaaatagctttttgatcatagttattatatacaatttagaataatctgatcaggttggaatagcttctcctaattaaacaagtgtgtacataaaaggtgtatatgaatggctgtttacattttaaggaataaaagaaaatcagacttacgaatgtcttattaaaatgaacaataatttggattgtgttaaatcagttctctataacatgtgtgcatttaagtatgtatatatattatagaagtgtgtatatgtatcatagaagactaaatatatggtaaagatttctatagagcataatatgtaaagtaagagacttatatagaaatggaaattcagaaggtaaaatttcccaaggaaaaatattcattctaatatatcaatcatgatttactaagttgcaaatctttttaaaacagtcccaacattttagatcaattgttaaccgacaattggcttacacgaggtggattaattagttactagcttcatttgtgctttccaaaagcatgttttagcttttatttgtcatacaacagagttaagcatgggctaccttgtttagaattccctcgttgctgcatgtggaggttaatactcatgtcatgagcaccaaaagtctggtcagtgtgcatggggaatggactattaacattgtttcttccctgctgtttcttctaggaaaactgacacgcttcacttttcttgatctctttctacaaaacacacaaattaagcaaatatctgaacacaccaacaaacaaaagcaataaacaaacacttcattttgtcatctttatttttatgtagtgtttattacattaaaacacatatgttatatgtatgtcttgaacaaggcactgggctagacactgagtattgaacagacaaataagttatagtccctgcctgtaagaagactaaaatctcttcagaaaagtgcaggtgtcatgcattctaatgaaggacatggtaggaaaaaagcctgtgagagagaagtgtgttcagtcaggctctaggttatttcagtcccgtctttcatggctccttattcttcccattgcttaggaaaaaaaatccctaagcagtgttgcttgaccagacctgtgtgcttgtccccaatatgctcaagagaatgatacaggtacttttctgcccaccttgagataatcaattgtcctgaatggaaaatcagtgctatgattggcagccccatacaggcaagcatgtatgttatacctccacgggaatcagtaatgaaagtaatgatgggcatcaaatattatgtagcctgtcttagcatttgtgcctttgcacacaatagagttaatatgaatcattttggtgtagaaattgtgagaacaaggtcactgtgtaaactgacaaagagctttcctctcaagtgacaagttggactaattgcctggggccccatgctgaaactcaacaatataatgaccagcgtgttccttatagtgactgatatggcatctgagatggaggaattcaaaattgagtatttgttcgttatcattttacaaagtagcttaaattaaggattttttaattaaacaacaaaaatctctgttgatacaaatgtttcctggtcccttctagattcttaaaccaaactttttcaatgtagcctcgggccaaatttctttgaactaaaaatcagccaggttcagtggctcatgcctataatcccagcaatctgggaggccgaagtagagggattgcttgagtctaggagttcaagaccagtctgggtaacatagggagaccccgtgtccacacacacacacacacacacacacacacacacacacacacacaaatccgcgtggtggtgtgcaccaataatactagttacttggaaggcggaggcaagaagatgacttaaacccacgacttcaaggctatagtaagctatgatcgcaccatcgcactccagcctgggtgacagagcaagaccctatctcaaacaaacaaacaaagaaaaagacaggataaaagtcacagaaatggtctacacactaggaaaaaatgtgacaattttttcatgaacacagcattgtctcctcttcaaagccctccatgtgccccagctaacatctggtatcaagtcaattacgtggaacaaagtctgcttgcaccatgagaaagctcagcagcatttagtttctacaagccatacgaacaaatagcacatttacaggaatgcaattacaaaaaagctttatctgagttaaacttggaattctcattaaaatttttttaattggttgtttttattacaaatagtacagagttaaaaatgataagatactaggactttggttaacagctctgtaatggagtttataatatttggaaaactgcctgtaaacagaatttctctacatgtgggatttgaagtgcaattgcaatgaaatattgtttgtttttgggacggagtctcgctctattgctcaggctggagtgcagtggcaccacctcagcttactgcaacctctgcctcccagattcaagtgattctcctacctcagcctcccgagtagctgggactacaagcatgcatcaccacgcccggctaatttttgtattttgagtagagatagggtttcgccatgttggccaggatgctctctaaatcctgacctcaagtgatctactcaccttggcctcccaaagtgttgggattatagacatgagccaccacgcccggcccccgttaaattttaaataagaattttgctctaaatctttttacttaatttacatatcttgatgcatttgcttggagagctatattccctaaaagaagtaagatcttcagcagtaatatatcatattgtgacccagaactctttagcttaatgataatgataggattttaaaatttaatgctccattctatgtcattttacaccttaacaataaaaatattattcatatctagaatgcaaacactgatagttgatatttatcgtgaacttattagatgccaagtactagtttaccaattatatgtgttttaaatcttggaacccttacagcaatcctgtgaagtaagtgttatcatcataattattacctgtgttttagagatgaggaaactgaggcatggaaagtttagagggcatgtccaagatcacacgttaagtggcagagccaccgactggactcaggtagtcttattacacatttgagctcatgcctcccataacaacaacaacaaatcaacagaaaataatcagctccaacacacccacagcattgcttagaaaatgggctccctgattcaaatggctttaattgcaaaaggcactatagcaaccacaatgatcctcttggaagagttagttcttctaggatcaacataggcagcaagcctagctgtaaagcagcccacagattaaataaattctatgggaaaaaaaaaaaaaaaacctgagactgataaagttagtccataggtttgaaccatgaaataatccaaagtaagtatgactgatctgaatatggaaatgtactgtgttcagttagcaaaataaaagtggcatattcttctccatgtttatcttaactagctcatatgtatttgatgtatgccagataaaaagaaaacaatgatccagagctatgccctgcctctctcccatacttggctaatggaccagtcatggagtttttatcaagacggggagaaaacctgggacattagattacttagtcgaacaatatttacgaactttgtgacagtgataagagcctgaaactaggccatactgctctttatattttagaaacagcaatgaggtcacttttaaactatgctaaagtttggctactaatgtggtgtggttgcttcattatgctcttaaacagccacaccagccattccttcagcactgtctattgggcactctataaaaatcccaacttttgtttttccagtgatcacaatatattcatgctgaagcaacctcatttcagacatctatccctcttggcaaccaaaacaagataactgacaaggattaaaagccaaaatttatgactaaatagtgtttattgactttgcacaactaactgcaaacttatctcatagagatatactccggacaagcaaataaaattacttgagcaaaagtatctcgaaactacacatagttgtccaggctgtagattattccataataaaatatatgcaaccaagttgtttggtcatatgcctgatgtgtcccaaataagtctggactctggtaatttttaaacttagatgaggaatccctacaaagaaatggacttaagcttggtgcaacccaaggaacttgttctggactgtcaacaccttgaatttgtaggtgaaacatacatcctagttcttgtttactttccaggcataataattaataactcctcattttactctcaaaatgtctttgtttgaatgaattgtagtcatgacacatcagtacccttcaagtctgataacacaaaccttgtgaaatttatagatcttgtactattgtgttattgtcttttagggccataagttagatcacatccttcaagtgggtaaggctttgtctgaaaagaatgatggtctcattgccaatcaatgaaaaggatgagccttgagataaaacatggtgacacaggaggtgggcctcagtccagggtgatggaggagaaaagcgctcagcctaggactgggatttcaggtggcctcagacactgaagttctgagaagtccttgtgagggaaagtggaccgtcccagctgaaatcccagtcctaggctgagtacttttctcctccatcgccctggcctgaggcccacctcctgtgtcaccatgttttatctcgggactcatccttttcattgattggcaatgagaccatcattcttttcagacaaagccttacccacttgaaggatgtgatctaacttatggccctaagacaataacacaatagtacaatttctatgacagtccagaacaagttgcctgggaaacatggaaaacagtgcagagctggatcctgccatccaaggccagagtggcaacacaggagtggcccacagggagaggcagtgtggtgaggtgtcagtccatccaatgcctcagccaccgaggaggccctcagtgtcctgaacaggctcatccttttcattgattggcaatgagaccatcattcttttcagacaaagccttacccacttgaaggatgtgatctaacttatggccctaagacaataacacaatagtacaatttctatgacagtccagaacaagttgcctgggaaacatggaaaacagtgcagagctggatcctgccatccaaggccagagtggcaacacaggagtggcccacagggagaggcagtgtggtgaggtgtcagtccatccaatgcctcagccaccgaggaggccctcagtgtcctgaacaggacagaggagaggacaccaggtacttcctcctgaacagaaggagctgggcaaattaaagggtgctcatttctagcaataaatgtgccattaagtgaagcaaagttattgtgcaacatgggagttgttcacaaattgttagcagcttacataactgatcacaactggtattgttttcatacagtaaaaccgtgttttagtgtttcagttcttactttataattgctttgggatctatgatcaaatgtaaaagctatgagttttctgagtactgtgtactttttatttatcactatgcacattttaaagcaaaagtggtttgtattgcctaatatgtaaaattccctttgatggtcttgctacaagttccatgtaaacaatgtattccaacatccctgtggtcttttttgaaggcagagatggttgcccttgtcaagatagtataatccctgtgatcaacagatctgagtgtgaatcttgggtcttccacattggagctcggaagagtttgaaagctcataactcatctgagtctcagttttctcatctatgaaatagaaaataccactagccaggcgtggtagcacgtgcctgtaatcccagttaatcgggaggctgaggcacaaaaatcactcgaacccaggaggcagaggttacagtgaggcaaaatcatgctactgcactccagcctgggtggtagagtgagaccctatctcaagaaagaaaaaaaaaatagagaaatggaaaataacatatatcttgcaggattagtataatgattaatgataaaatatgtaaaatgcttagcaaaagagattagctaatgataatattattattaatccaaagaatgtgtccccattcatcgcctcatatgtcctatgagcaatgctccacggatgactgctgtggagggggggatggcatggaagagataatgctagttaaggatggaaggagagggacttagaataggctcttaattcctagaatcagagggcactgggcagaggagtgagaaaatcaaagagtagtcagttatgtgaagaaacgaggaaagaccaagatgtttctatcccaagaagctttcagcagctttcagcagcttgatgctgcaggctggagagctatgggaacaaattcacccactcaacccctcccctgccagcctgctacaaaccaagccagggcaggaacggcatgccttccaggggtgcctgatataccagatattttcattgtcatgtaattgttttgcatgaaacacagtggattgaaaatatcacataaatgtcattacgtacaagccttcgtgtaacatcaagtttatggtggcagctttaggtcaaactcttcaagacccccccccccccttacagcagtaagtcatccgtgtttggtgctttggtggaaaatggtgacagagtagtaagatttggagaatcttattagttgtgtggccttgggcaagccctccatctgtgctcatttataatggggataataatggggtctttgaaaagttgttcaaaaaagttgtaaaagttaaaacttgtactagacataaataaaatgactacccaatacagtatctggtatatagcagatactcaataatgttaactaattttgctattatatttaaccaaaacagactcagtgctttctgtgtactaggcacaatgtttgatgttggatcatttcagatgcaaaagaaatgtgtgcctaagccacccagggattttcatatttttctccccaacttttacttcaaaaagaaacaaagtgtatcattccattattttagagataaaaggctgaaaactacctgtaaaaggtaacagactgctatgaaggaagtccagtgtgcatgtgatttatcattacctatgctgataaggggagtgagaaaataggaaaatccaaggtatttaaagaaagacagctgatacctctaaatagggataaagtagcagaacctgaacttaataaaacctcaagatgaatatgaaagaggtcacaattttttgaggagactccctgaccctttagcagaaactctgcccccagtactcaatctataaactgggttatgagaaaattcaagaatagaaactgacaacatgccttgttgtattgtcgtattacttcggcaaaaagtgatagaaactaaactcaaacccaaattaacctaagcatactaagaatgtattgtgttaccaaatccaaggatgaattaaatgaccaaaaaaagaaaagtggggttataggaagagcagacagctgcatcctcacaacagaaaccagaggcattaatgccaccaaaattttctttcccattcttaactcaccaccaacatttgacagtaaacatggctaccaatagtttttcagaaaatatattgtagggcttcctctactagaaatagacctactctctttatcagcactagtttcagaaatcccaggggaggattctagttggcttggtttggacagggagtctattcctggcccaatcaactttggtcacccaggaaaatggacgtgttgaatgaaggcagtgactgtttcagagacacgaaacagaactggttgtacacccagtagatgttcagtggagccatgagttcaagagccatttctatctgggccttttctatgagggtcagttactgctacgttaaacaagacagttttctctttcatgtagctttctagtgatacttatcagtacaaaaacaagaaacagtttatgaacgaatgcagcaatttagaagagtttttaaaacagatttcaagacgagaaaatgcatttgtggaaaatgtacttactttttctcaaagaataacagcattttgctggacaaaaggaacctgaaaatcatgaggagttatactattgtaatttcagaagtttctctagctagataactgctagggttatttctccaatacataattgtgatgcatttggaaaacatattaagctcaattacataggatttttctttaagtataggtatgagttaacactatttagttatttggatgctgaatcataatgtaccgaaagaaaaaaagaggcagctttctctgacttactgcataaatttatgcatctaccactagagggcacaaataaggctgttttctgggaaaaggttttgaaaatgacaaaattccatattttggaacggtgactgagttaagatatgtagatatgcatgttttctttaaatctgagaagaaaaatcaaaacatactcatacttcaccgtgtaccattttgttctcttccctctttctctcaaaaataaagtacacatgcatgagggaaataagaaatatcaatggttcataagattttagacacaaataataaaaattaaatggctaccaagaaatagactagcacataaaaatactgctacagcaacatggcaaaatgccacaaattagcaaaagtattcatatttgtctacaccacacttacaatctttggagtgattttctcctaaatcatcaagcacaatacagttcacaaaactgatcccaaatcttgcaaatattagatatatattgcatcttttcttaacaaatgtagcactgtggtaaaaataggatatgatttggttgcattttcacacaatactgtgcttgagtcatgctcgcagaatacctccatctgcaacagctgttttactccttaaaaaaaaaaatggaaaaggaaaaaacccaacttctccagaataagcaaacagtccctaatcttgtcaccctggatgtctgacaagtactaataactatgactaggttttgataacttccttgatttgttttcagggttattattattttgctggaaaagggccttgtgagagccaatgattgtattggaaataaagccaaaacaaagttcaaagcttgctgagatgcctctaaggtagaaagggtagcaaggtgaatggcatgatgaggaaagtgaaaatgctgtcgcaaattggataaaagtgatgagttggtagcttccatacctttcacaccttgatgtttcccatcactaattcacagtagcatcaagaatgtatcaaaatgtagcttgtcttcactttattaaaatttctctaaaacacaaattttgaatgttataaacaaggagttaatagatgttcattcaatcactcagcttagtcccttccaatgtttcctttaaaaacaacatacgcttttattctctttttaaaaaatgctctactaaaatctacacaccttctgcaccttctataaacattttgctctagtccaatcctgtttcctttcctgcttcaggttttgtcattttcctcctgatgccaacttgagattccaccatggtttatccccatacatggctgaatccacagaaaatggcaattatgacacagatacccacttatcctcccagtgatggtcatgcatgtagcaataagaatcctttttaagaaacagcacgtctcaatctgagccagagggtagagtttcctctacaaaatactttcaaatgctttgtcctctagaatttcttgattattaatggttttcacaagtatggggggttaggtgggccacaaactgcttccaggtggcaaaataactattaacccttctactcagatttaaaaaaaaatgtgtgtgtgtttatgcatgctatgtgcttatgtaatatattaaatgcaaatatgtattagtacatataaaacttcctaattaacaccaacaaagccttcaagagtaaaactgaggggtatggtgaacattttgaaactaattatgaccctctactaaaatattgccaattcattctccctgaggggaaaaaaatacacacttgtttttcgtcttgtgcattaatagtctaagaaattgacctattgagtagaaatcaaaggaagtttatatctgcccagtaatttctggatttgagaatcagttattcaagctttaacccatgtttctactgacttgatagagtcaaattgacttcaaaattaatttaaccccgaagacactatgtttcagacctctatctaaaatacatatataaagaaatacacaaattaaaaccgttgcttccttttggtggagtggatcttccagagcctgggggatgtttgtacctcctctctcttggctgtcacaccttgagcatttgagtttacagattccatagaatcacttaggtcctctaagttaccaatattattatacagtttcctacaaagtagaagtggtccagattatcatgagaaatgccctcaaattttaaagccaaaatatgacacagcacgcatattattttacttattttagagacagggtttctctctgttgccccggctggaatgcagtggtgcaattatagctcactatagccttaacctcctgggctccagtggtcctcccacctcagcctactgagtagctggaaatacaagtgcacaccactgtacctggctaatatatatctatggcatgagctactgtatctggcccgccatgcatagtaagattaaaaaatttttaaaaatccacaccaagcatatgttacaacctaatctctgaacagttctactgcttccatcttctccatgattttccttcaaaaacttttgattagatcaggatttttacactgaactgcttatccaaaagaaataaatggaagtacataaaaatgattacagtaaaatcaatgatttactttataaatagctatcatatatacatttacatcaaatttatattaaatgtattatagtatatgatagctatttataaagtaaattattgatttaatataagtgtgttatatatgatagttatatataaataaaagagaatagagtccatatttacacaaaactttgaaataattatagtccttctgtcattctcctagcttatttatgtagtacatctgagttgtagagaattggaaaaatcatgaatcattcaaataattgtgaatggtaattgaacagttttccttgcaatattcttgaattgcattgatcccagagtccaagagaagactgacaggagcttgatgccatgcaacacaaagcttaagtcatcaaaagtacatgtatttcaaataattttcatctaaaagaacatcacataaacacaaatgcaacagattctaaaactatgatctaaatcagaaaaggtaaatcattttaaaaatgaatacgtttctatttatctgcccacttatatatttatttttaagcaaaatgaatatataaagactaccaggtaattcttccgtaatatttgaaaaataaatccctaaataaacatccctggattttgttatgctatctgactaatgtgatgggtgatttgggttgccaacagttattattttctttcttcaattttaacagaacctcgatgttgttcaaagtattgtgggtaggcatatgaatcctccatttggaggaggttgagccctccttagcacttctatgtgatttctaattaagttatgacaatcatggcaattgggtttttttggcaatgattgatttagaaatcggcatgagactcaattctagccaatgaactatataagttctactagaaaaggagggtgttttgggcattgttgggtgacgtctggatctgctaaagctgtcttgcacccatagggctgaagccaacatacccatggtggcagagtggtaagatggaaaaaacagaacctagatgaatgtcattatgctgctgaattaaccaacactagaatttcccttcctccaggcttttaatttatatttaagaacattttagctgggttttctggtttctcgtactgacttatgttaaatcatataatccatgcctattttaaatatgcactttccttcagtgtaccagttacacctgttaatgatagtctttatattgcaaaatcactgtagttgttatgctgcatagcaatagcaaaagtgatatatatgccttttccccaacagctatgttaggcccccaaaccaccttaggaaatatcagtagattaataaaattaaccagtgcattggttatctttatgcatttagcacagaaatcctcctacagggagagagagtatttagagaagtatataaacattattttatttgagtgcaagagatatgaaatccatttactatgaaagaaacaaaccagactacatccttgcaaaatcattcctatttatttttcaatagcattctacttaagctccaaagattgtgcattaggagaaaacagtgagtatatcagagaagagcagatccaacctattagcactctgataagcaaagcaaattactgaggacaattacccaggaacttttatattctgcaagccttgttcttgtgattcataaaactcttcctggttgcttgtacaaagtcacttcacaatgactatcagtgtcagttggggaaaaaaagttttgttctattttacccttctcagtgtaacatgtaatttacacgcagtacatgttaccttagattgatgctagtggctcttggtaggaccttgaagaagtcactagctgatgaaggtcagtgttgattttggtggctgacaaattattttgtgggatgagcaacaaagtcacattcattttaaggtaagcattagtatagcatgacaatgtcattagctcatgggtttacagaaataaaagtggcccctttttatgtttgacatgtgcaagagaacttaaatacagcaatatgtcattactttcctaattcgttcaaccaatacttttgaagctgcctttataacaatattacagagtaataaataccgtagctagaagacactcttttccatggtctttgtaagtgggaaaatggaagcccaatgagataaagaaatttacactagtacaggtatttagtgtcagcaacagaactcaattctgaatctcttaacatctaggccaccactctttcaactacatcatgatacttagataatataaaaatcctccaaaaaactgcctgtgtttaattaaaccaagaaaaagcatgagtttcaaacgataaaaatatacattttttccaaccagccctggtaatcagacacattcatgaagaccactaatgagaacgaattgtatgaaacacagggaagacatcacataaaataacagggcccatgagggaaaagaataaagtctgaagtgctgatagaaacttagtgatcaatccttggttccattttagcttctgccagtggctggcagcctatattatgacatcaaaagagttatcagtgatgctcattgatggaagctcttttaataaataaatagcatccactagtagccccacagaatatattatggtacaatttagtggttataaagtattttgttgaattattttaggccacccttggaaaaatatttattgaaaatatttatagaaagaaccttacttgtgtctagtcaagaccctttgctagcagatggggaaagtgagaatcagactgaagtgactgacccagggagcctggaagcaattgataggattcaaattctggttttctgaactctttgtccaaattgattctgtcctgaatttgaccaggtaagattcatgggcttgttacgaaggcagtccaggccttctgaatatgcaggtgtatgtgttcatagtgcaggccatttattcagcatttccatatgcctgacactggtggagaatgcaatgcacagatgaataaagcatgcctactttccaagagcttatgtgacacaaggaaggcagacaaacatatttcattgtcatgtgttaaatattgtgacagtgcagagatacaaaagattactaaaaggacaacttttaaaagccatctctcttgtacatgtcaaaaatgtcatcaaaatgccactttctggtactacctatttagacctttgaaatgcaaatatttcagcacagaagcccagagtccttggggaggaggtggatggtctgcctgcttcactaaaaggggagtggtagaaaaggggctgaaaggactaaaaaagctgaacttgagttaatttaccttcctgtcagtgatctcaagtttgtctcataggaaggttttgcatgccaaaaatggttcttttgtttaatctcaatagggaaaaactgtgcaggttttagtttattctgtatgccaggccatgcatttagagaacttcttatgcacacacacataagtaataattactcttcaaaatttggcaaatgtccaaaatgtagcaatttcccatacctggaaggtatgtaattttttagcaaaatctttttttaataaatctgaattaaaatgttttgccaagcatagagcctccaaggctataagagataatgtgtcaacggtccctgcatcgaaaatgaaagtttcatcctacatgagaagctcatttatcttctgtgcagttactctctaaaatcttatcttatatttaaattcaatgtaacttggggggaaaaaaagtcattttgaaactccaaactaagaaactgattgagcactcagaattattttttgcagaaataattataaaatcactttaattgttgtattgattatatacaagaatttttgagcctgattttttaaaatgatactttcttactatatattttaattgtcttataatttggttcaatattgcccttttaaaaaatgaaaaaatcatcacatcatatagagtgagggatcaagtttgtgttaggaatagagttttaagccaaagtttcctgaggttcaatttactctgtataaaatacattcgatggccaggcgcagtggctcacacctgtaatgccagcactttgggaggtctagccaggcagattgcctgagctcagtagctcgcgaccagcctgggcaacagggtgaaaccccgtctctaccaaaatacaaaaaattagccatgcatggcggcatgcaactgtagtcccagctactcaggagcttgaacccaggaggtggacgttgcagtgagccgagatcgcaccactgcactccagcctgggcaacagggcgagactcagtctcaaaaaaataattaattaatttaatttaatacattccattatttgaaaaaaatccacactcattggttatctggactggattctaaattgggagatagatggtgagcctctttgtgatcactgaccagcgcgtacctggaatatacaatgtgtgctgcagtgccgcacatgtatacacacaaacacacttttatacatattaggatatgcatacatttgtcagggagacatagaaaactgcaactttttattagtaatagcccacatttatctagtacttactatgtgttaagctatatgctaagtgctttacctgcatgggtcaaaacagaaatatctaaggcagcatgtcattaattaaagtaatatgaataattaaaataatatcattattttaaaataactataattgctttttatatttattaaaataattataaataaatgtttggaacactcattgatataaaatggcctctcttatggcgaattctaagaaacactaggttctttgactgcaaacaggtgttacttaaaaaaagaaaggttaagtaagtttaaggaaggataagataaaataagtcaacaggcttctgtaccatagcacttcttaaagcctttattatacaactacacacagtactgtgagagagagacagagactgaagaccctgacatcacactcatgcaaggacacacgacatcttagagcccatctccgacctgatatacacagagtacaccttggaaaacattaatacaaagactcaaagtgcaacctcatggaagagtcaggtaggtggaaaatgctcataaaggagattagatgtgacatttgtttgaaaggagactttccacttgactgattggtggggaggggaagctgaagttggggggagtaatagggacaaaggcacagagcccagacagggcgacgaagtcgagggacatcaggcagcaagagcagcccagggcagagctccggaagccttgtaaggggagttaacgaattgggtaatacagggagccctacttggacatgattgttcctttaaaccatctcttctttcctttactagggagaatagacaatcacaggcccctgttctaaagcctctacttagctatgacagcacagtttttattcaagagaagcttgtcaacaaattcgaagacaaaaatcattatatatttatatatatgtattagaaccatgtataggaaccaggatctttagggcatgtcttagaatgtgagttgaggggaaaatgctaccccagttgaagcggagtaagacagtggaaagagcattgatcagggaactgagaaatttttctggtctcagttccaccagctccatgactgcagtcaagtcccttagcatctttgaatctcgacctcagagattatcagtaaaggcagagatgtggctggacgatctaaaatctatgaagccctaaatgtctacattctctagagtggtttctgtgtatttgtgtttttaggttttttttttttcttaaataacagaagtaaacattgtgacatagagtggggatgataatatcaacctgacagagctgatataagagtttaatataaaagactaacaacataaatgtaaattgttacattatttctctaaggcatggccacttttgcaatgggttcttcatgtgcccaccattctcacttacgttattccaagtcacacctctcactccatgctttgtggtcgttatttgtcctatgattcccgattctatttgcctcctttaaacatgacaagccaaggagtaaaaagataaggaagataaggaccaaagggtgaaggcagaggtttttctcatttgagcatcagcctgctcatctcattctcacactcttgcctggaattcctcaaaacatctttctcttggtgtagaccagtggttctcaaatgcaggtgattttgcctgccagggaatatttggcaatctggagacatttttggttgtcagctaagggtctaggaggtctactggtatgttgtagatagagatctgggtgctgccaatcaccttgcaaagcataggacagcccctacaattaatcatctagccccaaatatcagcagagctgaggctgagaaactggcccaactgaagtagggagtttagcaaagaaaagtatgtgttgggaatgcaaagaaaatggatacactagcagtagataatggggttatgaagattacgcttttttaaagcacttttgcattttaacagttttcaatgaacttaggttacttttaatttttccccagctatctggtggagcagaggaagaaatgctattggaaaacttcattgtgtttgaggttttattatagtacaaagccaagagacaggtcagcagggggctaacttattttaagttcttttattcttttataccataatgaggtatatgccatggagaaattgctaaatcctaatggaagtagcagctgtgtgccatgttgattatgtgatgctgggggtatccagcgtaccccaagtaagacccaaagtacccaaagtaagtgatgcctgttttttctcacctatcctggtaggcttccatcatcttcttacgccttattttaaaagccccctactcccaaaacgagagtacttaacatctatactaatgtcaaatcgtatgctgaggatgagataccttcagttcctttttgtttgtttgttttttgagacagagtttcactcttgttgtccagctggagtgcaatggtgggatcttggctcaatgcaacctcctcctcctgggttcaagtgattgtcctgccttagcctccagagtagctgggattacaggcacctgccaccatgcccggctaattttttgtgtgtttttagtagagacgggatttcaccatgtgggcaaggctggtctcgaactgctgagctcaggtgatccacctcagcctcccaacgtactaggattacaggcatgagccaccatacccgacctccatttttaccttcaagtaaacagtccatgtaaaataatgactcacattagtagataatacttacataatatttatatttatgtaactctatagcttgtaataacctagtatttcataaatgttagctcaattattccccacaacaagattacaatgcattattagcccattttactgctgaggagatttccaggaagttgatgttcacaaggctcacagggtgttcaagcccctgactgccaagtggtggcttttcattctacccaatacgaagcacggatatttatggtatttcatcacaccccacactcaggaacacaaatactggttttctatacctgaaagtgaaaatggtggttttctttatcaaggctaattttttgctactgatgacaacctctcatcatgatttcattagaaatttaagacttggtaaagctcctaaacatcaaagcaaaggcttcactggtcatgttagtttgctagggttcccataacaaagtaccacagattgggttgcttaaagagcagaaattactttctcacaaatgagaagttagagtccaagatcaaggttgaggtcttctgaagcttccctccttggtttgtagacaccattttctccctgggtcttcacatggtcttccctctgtgtgtgtctgtgtcatgatctcttctcataaggatacaagtcagattggattaaagcctacgctggtgacctaattttgacttaatacctatctccgaatacagttgcattttggagtatagggagtgaggacttcaacctatgaattttagggggacgcaattcatcccacaatactggtgtcagggaatttgctagagctcagatctgggatccataagtaactgaaaccacaatgcccaaacagaaagatctttttggagttatgccatgttccgctttacctataatttttacatgttaaaaaatatatctaaacactgcattttattcttagagcttacctttgtgcagtgatgtggaagatgtattgacatgttaatgaactaatgtttcaagttctgctgaacatttaattttaaaagatgtgagggggccgtttaagaggtctgtttttggctgcttgggaaaccactttttgactttctatgtgacttcattctccctcctacaccgtggcaggcccaggtccttgctagcatcaggctgtgcacagcttgggtggagctgctgggagctgcaaggctgctgctctcctcctttccaggtgcattaacctgaattcgcctatagagtgaagcgattaaccgaattcaaaattatctcaaataggacagagcttttgtagacatacctgacatttttatatttcaagggaggctggaggagaaagaacatcatagacaacagaactaactgccaagattagctgctgctctgttgttctgttgagagagaaagaaaaagaactagaatttttatatgtagatgcccctgatacgcatacatatttttctctgaaataaagatgatggcaattgatctagagaataacagcatgtatagaaatagaaagaacttgattcttggctcatgaagtctggcttatatcagcaaatctggtatttgcttcttgcacgcccttgagcaaattgctcccctctgagatttattttccatatgcaataggatgggcatcatctcagtgaagcctatttattttacagttttatatggatcaaatgagatacagtacatgaaatgtaagtaaacaattaccattttgagaattttgtttattttatttttattgaggtaaaaaatgtatacaatttaccctatttatcatttttaaatgtacagttcagtagtagcaagtgcattatattatttttcttcttcagttctccctccctccttgccttcccagcctctggtaaccaccattctactctcagagttagcaatgtatttctattctctctagttggaaatccatctaatctcagagaatgagagagaaggacgaatcacaagtaatcacagatgcaatgaaaataatatttaataacctcttactacacctgggcagtatattaagcaatttataaaggtggtcttatctaattctcacaaaatcctttgagataggcattgttcttctctctattgtagcttcaaggaaatcaatatttaaagaggttaagagtcaaaggcagactttgtctctgggttatccaacttcagtatctctgagtttagctcgtattctatatggtatccacgagaataacaacaatgtaaatatagttaaatctttgaactcccaatctagcaaggcaggccaacattcaaattcaggaaatacagagaatgccacaaagatactccccgagaagagcaactccaagacacataattgtcagattcaccaaagttgaaatgaaggaaaaaatgttaaaagcagccagagagaaaagttgggttacccacaaagggaagcccatcagactaacagcggatctctcggcagaaaccctacaagccagaagagagtgggggccaatattcaacattcttaaagaaaagaattttcaacccagaatttcatatccagccaaactaagcttcataagtgaaggagaaataaaatactttacagacaagtaaatgctgagagattttgtcaccaccaggcctgccctaaaagagctcctgaaggaagtactaaacatggaaaggaacaaccggtaccagccactgcaaaaacatgccaaattgtaaagatcatcgaggctaggaagaaactgcatcaactaacgagcaaaataaccagctaacatcataatgacaggatcaaattcacacataacaatattaaccttaaacgtaaatgggctaaatgctccaattaaaagacacagactggcaaattggataaagagtcaagacccatcagtgtactgtattcaggaaatccatctcacatgcagacacgcataggctcaaaataaagggatggagaaagatctaccaagcaaatggaaaaaaaaaaggcaggggttgcaatcctagtctctgataaaacagactttaaaccaacaaagatcaaaagagacaaagaaggccattacataatggtaaaaggatcaattcaacaagaagagctaactatcctaaatatatatgcaccaaatacaggagcatacagattcataaagccagtccttagagacctataaagagacttagactcccacacaataataatgggagactttaacaccccactgtcaacattagacagatcaatgagacagaaagttaacaaggatatccaggaattgaactcagctctgcaccaagcagacctaatagacaactacagtactctccatcccaaatcaacagaatatacattcttttcagcaccacactacacctattccaaaattgaccacataggtggaagtaaagcactcctcagcaaatgtcaaaggatagaaattataacaaactgtctctcagaccacagtgcaatcaaactagaactcaggattaagaaactcactcagaaccactcaattacatggaaactgaacaacctgctctgaatgactactgggtacataacgaaatgaaggcagaaataaagatgttctttgaaaccaatgagaacaaagacacaacataccagaatctctgggacacattcaaaggagtgtgtagagggaaatttatagcactaaatgcccacaagagaaagcaggaaagatctaaaattgacaccctaacatcacaattaaaagaactagaaaagcaagagcaaacacattcaaaagctagcagaaggcaagaaataactaagatcagagcagaactgaaggagatagagacagaaaaacccttcaaaaaatcaatgaatccaggagctggtttttttaaaagatcaacaaaattgatagaccactagtaagactaatgaagaaaagagagaagaatcaaatagatgcaataaaaaatgataaaggggatatcaccaccgatcccacagaaatacaaactaccatcagagaatactataaacacctctacacaaataaactagaaaatctagaagaaatggatacattcctcgacacatacactctcccaagactaaaccaggaagaagttgaatctctgaatagaccaataataggctctgaaattgaggtaataattaatagcttaccaatcaaaaagagtccaggaccagatggattcacagctgaattctaccagaggtacaaggaggagctggtaccattctttctgaaactattccaatcaacagaaaaagagggaatcctccctaactcattttatgaggccagcatcatcctgataccaaagccgggcagagacacaacaaaaaaaagagaattttagaccaatatccctgatgaacatcaatgcaaaaatcctcaataaaatactggcaaaccgaatccagcagcacatcaaaaagcttatccaccatgatcaagtgggcttcatccctgggatgcaaggctggttcaacacacaaaaatcaataaatgtaatccagcatataaacagaaccaatgacaaaaaccacatgattatctcaacagatgcagaaaaagcctttgacaaaattcaacagcccttcatgctaaaaactctcaataaattaggtattgatgggacatatctcaaaatcataagagctatttatgacaaacccacagccaatatcatactgaatgaacaaaaactggaagcattccctttgaaaactggcacaagacagggaggccctctctcaccactcctattcaacatagtgttggaagttctggccagggcaattaggcaggagaaggaaataaatggtattcaattaggaaaagaggaagtcaaattgtccctgtttgcagacgacatgattgtatatctagaaaaccccattgtctcagcccaaaatctccttaagctgataagcaacttcagcaaagtctcaggatacaaaatcaatgtgcaaaaatcacaagcattcttatacaccaataacagaaaaatagccaaatcatgagtgaactcccattcacaactgcttcaaagagaataaaatacttaggaatccaacttacaagggatgtgaaggacctcttcaaggagaactacaaaccactgctgaatgaaataaaagatgacacaaacaaatggaagaacattccatgctcatgggtaggaagaatcaatatgacgaaaatggccatactgcccaaggtcatttacagattcaatgccatccccatcaagctaccaatgactttcttcacagaattggaaaaaactactttaaagttcatatggaaccaaaaaagagcccacatttccaagtcaatcctaagccaaaagaacaaagctggaggcatcatgctacctgacttcaaactatactacaacgctacagtaaccaaagcagcatggtactggtaccaaaacagagatatagaccaatggaacagaacagaggcctcagaaataatgccacatatttacaactatctgatctttgacaaacctgacaaaaacaagaaatggggagagaattccctatttaataaatggtgctgggaaaactggctagccatatgtagaaagctgaaactggatctcttccttacaccttatacaaaaattaattcaagatgtattaaagacttaaatgttagatctaaaaccataaaaaccctagaagaaaacctaggcaataccattcaggacataggcatgggcaaggacttcatgtctaaaacaccaaaagcaatggcaacaaaagccaaaattgacaaatgggatctaattaaactaaagagcttctgcacagcaaaaaaattaaactaaagagcttctgttcagagtgaataggcaacctacagaaagggagaaagtttttgcaatctactcatctgacaaagggctaatatccagaatctacaaagaactcaaacaaatttacaagaaaagaacaaacaaccccatcaaaaagtgggagaagatatgaacagacacttctccaaagaagacatttatgcagccaaaagacacatgaaaaaatgctcatcatcactggccatcagaaaaatgcaaatcaaaaccataatgagataccatctcacaccagttagaatggcaatcattaaaaagtcaggaaaaagcaggtgctggagaggatgtggagaaataggaatacttttacactgttggtgggactgtaaactagttcaaccattgtggaagtcagtgtggcgattcctcagggatctagaactagaaatgccatttgacccagcaatcccttactgggtatatacccaaaggattataaatcatgctgctgtaaagacacatgcacacgtatgtttattgcggcactattcacaatagcaaagacttggaaccaacccaaatgtccaacaatcatagactggattaagaaaatgtggcacatgtacaccatggaatactatgcagccataaaaaatgatgagttcacgtcctttgcagggacatggatgaagctggaaaccatcattctcagcaaactatcacaaggacaaaaaaccaaacaccatatgttctcactcataggtgggaattgaacaatgagaacacatggacacaggaaggggaacatcacacactggggcctgttgtggggtgggggtagcgggggggggatacattaggagatatacctaatgttaaatgatgagttaatgggtgcagcacaccaacgtggcacatgtatacatacgtaacagacctgcacattgtgcacatgtaccctaaaacttaaagtataataaaaaaaaaaatctttgaactgatccaatggcttcattttgaaaattctaaaattagatctggagatctacaaactggtttataatttttgcactgtgaaatcagagggaatagaccaggaaactactataaattatataacaggaatcacaattgtactattatttgccactattaacaacattcggccaggtgcagtggctcatgcctgtaatctcagcactttgggaggccgaggcaggtggaccacttgaggtcaggagttcgagaccagcctgaccaacatggtgaaacaccgtctctactaaaaatacaaaaattagcctggttatggtggcatgcacctgtaatcccagctactcgggaggccgaggcaggagaatcacttgaacccaggggatggaggttgcagagagccaagatcatgccattgcactccagcatgggtaagagagccagactctgtctcaaaaaaaaaaaaaaaaaagaaaagaaaagaaaattcaaggggttcaccttctgtttttacatgaacatatgaaaaactagctgtaatagaatatggcaaatgtaatcattagtgatatgaacaaatgattataaaggaaaaaggaaggcattaatttaacctgctgccacccagcaaagcttcatagcattgacattttagttgggcctcaaagatgaatcggttttctccaaatggggagatgggatagcaaacacggcatcagtacagagtacaaaagtggaagacagatgatagaattcctcattaattgtagcttacatagttcccaaaggaaaatgccaactcttctccactgttattaaatgggctttcagaaaaccacacctccagtgtggcttttcgaagacatctcaacaagaaagtcggaggcagagctcatcgtgcactcttctgttgtcccacctatcaaactgtagcataattgtgtgcttattgccttatgagatcctatcttatttatttttgtatgccaagcatcctgcatggtacctgacccacagtagaatttaacatgcatttgattaagtgccaaattacaacatacagttagtattggctgaatttctagtgatgctttatttcctctttcaaattttctctgtaagaaatcttacaatttaaagttatctgggtcagatactaagaaaattagcatttgtaaccagtgtatttaagtatctcatctcagtgaggtatgccactgaaaaatagttttattttttccaatcagcactcctaaatatgctatgtcaaatccttttttcctgctgggtagaatatttcattgtgaaaacttagtataggtccatttacagcttcagtctcatctcttattcaaggctgtctcctctctgcacggaatgctctgccctggcacaccttcctccatctcactctcctaggctccaatatggggggctctaagaagggaaggaaataagggtacgtttttggttctttccttgttgttccttgaaggtaatcaaagacagcacatgatgtggaagaccctggtgcctccctagcatcctccacgcttcctcagattctgcctcctgtggcccatccaactgtttctggatgctggtctcttcccccagggacaaccccctagatactgtcatagtaggatggctcaagcccagctatgttctacatcatccagtccaccccccagaaacagcagcctcatcaaaccacctgtggcaggaaagggctgctacgtccactactgtgtcttctctaagcctgatcttctcacacacccggctctctgccccgacccttcgtctcagagaaacttaggaacacatgagcaaatcttagccttatctgatgtccaactaaaaaacaagatataatttccccctcttggcagatatcgtatgcctgacaatagcttctcttggaacaccactcagtcggctttgggaagataaaaacatgttccacagaaaacagagggactgccctttcacaaaaaatgctagaatatcctcaagatcagcaaaccaaaagtccctagaataggataaaggagaattccagagatagtagggcttggagaagaagactgaatgctcacggttggccacatctatttttggtggcaaaaaaaaacagtgcttataaagtggtaaaacaatgaatgaagctcctcatccaacttttccattcagtttcagctcaaaatgtagtgttgaattacaactcaacggaagaactcacaactgaacctcagcacttcagttagtcttcaaagccacttcaagtcatgcgtgcatttctgcttagaggatattaaaagtcatattgatagttcaaatcaatatggaaaaaatagagaggaaaataaacaaagtattcctaagagagagaaagaaacaatggaggaaggcagaatgtaaaggaaaactgtttctcataaaatttacatggatcattaatgtgaaaatatctacaatgtatcaggtactaagtaaacatcttgaagagatgaatgcataagtacaacaaaaaataaattaaggagaaagaaagagaggaaaaaaggaagagcggttgtcagaatttcaggtccatgttctgtggaagattttcctccctctaaacaatgaattattatcattctcaagggaaaaataatcctgccgttccagttgccactggagtaactgtggctgtcttgtcaccactgtatccctagtgtctgctggctaaagagatgagaaaacagaaaatatttctttccagagagcaaatgacagcaatcgtcagtcagtgtaagcttgcctttgcaaatgaaggaaaactcttatcttagttgtaaaatatcaatattctctatgcaaccaactttctgtgaagaaagaaagaagaagaagaagaagaagaagaagaagaagaagaagaagaagaagaagaagaagaagaagaagaagaagaagaagaagaagaagaagaagaagaagaagaagaagaagaagaagaagaagaagaagaagaagaagaagaagaagaagaatagaaatgtgtttaagaattcctcaataagactaagctctatgtgggcaggaactgcttaattcatcattgcgttcccaatatagtgcgcctagaagataattaaaaaaaaaaaaaaacctggagaatgagtgaatgacattgctcactatatggacctaaatttaatctctttatcaaggaaaattataactgttttcttttttttatcctaaaggtaagcagtagggtttcaagaaacacctccatgagcctttctgatgtgttaatattactctataacttagaatataaatggaacaacaaaaatctgacacttgggagacattttgtcagttaacaagcttttttaggagttatctcctgttttttaaaagatgctaagaggagggactagaacaagtttctgaaacttgcagctaactgggaggcggttggcactatgcttccaaatgatgctctctcaatggcaactgaagtctcagcaaactcagaatctctcggtcaaaggctgaacaaagcctgctattttaggcatttggtaataaattataagaatggatcacaggaatacatttactgaaaagcaattgaagagaaagcttttagaaaaacagatttttggcaaaagcggccatgagctattctggtctttggtattatgaagcccacagagcaaatttccaaagcaattaatataaatgaacatcacatttaaaaaatcaattcttttatatgagatgcaaaaagatagagactaatatccaggcttacaaataggcactttgcatcattaaaagtatcacaaaggtttgaaccaaaagggcctaaagtatcaagtttataatattactactatcatatgcattactaggcagacgtcctgatcttaaaaatataacacagtttatggaatgcttcaatgtaacaaaagacttcattatgtgttgagagtgaaatttggtttataaatggaataatagagacagtaagctacacaagaagccatagctgtttctctgggcctctccagtgagttgaatgctgtggaaaatgtaccccagccttgtgttgaaatgagctgccaggttttttctattgtatgtgcagtgaagcctttttgggaggatactagaagtctggtagctctttctctggtcactggcagtggttagcagcgtccccctcatttgtatgtaggttagtagcaccgacactaagggagaaaatgaatgatggttctaattcttggagaaacctatctgattggaaaatgcctctaaacaagcatgctgtaaaaatacatccacatatttcatatagagggattcatacgtttcctcaaagatacaatatatttgattttctgttttaaaaagctccagtgcttccaaacatagccagactctcaataatgtaaatacttgtaaacattttctgtccaattccattaataacctgtcatagatgaattatacctgtggtgacaaataaatgcttactgtatagtttagggctatcatagcccttgtgcctttattttgtaaattatcctctagcacagaggtattagaaaccacatgccatgccttgtgtaatatggtctaccggaagaggggttttcctacttctcttccatagaggaaggatttattaagcaccagctgtgacaggcaccatactaagctccagggttataaaggtgaggaaagcagtgttgaggctctgccatcgaggaagtttagagcaagtggaaggaaggccgtgtaaacccatgaatacgatgaacttaagaaatgctctataacaagagttgtgtaccgtgtcttagagaagcaccaactaggattgaaatctctggggggttctcagaggtcactttgatctgggtggatggttatcagggaccagtattcgaggaggtgatctggctggctgcaaaggcaattgaggaacacaaaagtatagggtgtagggtggggaagtgaccaagggagcctggattgggaagattcgcagggaccatgtttaggagtttaggcatttcatacacagaatgggaagtctctgaaggctttagttcaaggtaaagaaataatcagacttgccccccccagaaaacattctggaggccacttaaagtctggaacaaagtgaagcatggaaagatgggttaatgaagccattccagacatgaaaaagaaatagtgaaaacctaacttaaaaatctgattcccgttgtagattatcacgttttaccaaatgtcctcatgtccttcatgcaggaagaccatgtcctttctccctgttgacctcagcagtgaccaggcatattgctttgtccagtgtaatgtcacttacaggtagaagttttcagaggctgataaatcagccaaggtcctggaataacagagctgtagccaagtcacaatgccataggaccacaggacacgagcaagaaataaatctttctctttgtatgttgctgagatttggggatctttctgttcctagccaagcctgacttctaaaatctccaaagcagtgtgcattttatttttcctgttttcttgtggtgaaaagcactgctgacaatcaatgaatacatatttattaggcctctacttgaatattagacactgtgtttactgatgaccagcttttttctcccttagagaccttgcgaccatgccaggaagagatgacattaaacaaacaatatctttgggaattcagaaagcacagaaatttcttctgcctgaatgggatggatcatggatggtttcccacagggtggaatgagaatagagaaaaatgaaacaggcaggcaattaagaccaggatggggaacaagaagagggtaaagtcatagagacaaaggcaagaaaggagaaattcctacataatctttgggacagaatgagctaactattcttaatcggtagttaatgtctgtgctgtccaatagattagctggttcctcagtttgactagtcacggttcaagtgttcaccagctgtgtacagctagctcagtgcagacagagagcatctcatcattgcagaaagttctattggacagtgctggtctaggaaaagatataaaataagaaaatataaagaaccagagagtttttgaatgttgggatattttcttttacttaaaagttcaaaagttaagatgcatagtgacaatatgaaagtaattgaaaagattagtattagcaagaagggagaattaatgagacatggctggagaggagaatagtgaggggatttttcagcaaccaatgagtgacctagatcaaaatggtgatgggaagaatagaaaggaaggaaaaaatgctcatcactggccatcagagaaatgcaaattaaaaccacaatgagataccatctcacaccagttagaatggcaatcattaaaaagtcaggaaaaaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggattataaatcatgctgctataaaggcacatgcacacgtatgtttattgcagcactattcacaatagcaaagacgtggaaccaacccaaatgtccaacaattatagactgggttaagaaaatgtggcacatatacaccatggaatactatgcagccataaaaaatgatgagttcatgtcctttgcagggacatggatgaagctggaaaccatcattctcagcaaactatcgcaaggacaaaaaaccaaacaccacgaattctcactcataggtgggaattgaacaatgagaacacgtggacacaggaaggggaacatcacatactggggcctgttgtgggtggggggaggggggagggatagcattaggagatatacctaatgctaaatgacgagttaatgggtgcagcacaccaacatggcacatgtatacgtatgtaacctacacgttgtgcacatgtaccctaaaacttaaagtataataataataataataataataaaagaaagtagattcctggttgccagaggctggaggaaagggaaacaggaggaatgaggatacttataagtatggttttcttttcctttaaaaaaaaaatgtgattacaggtaaaatttttcattttaaccattcttaaatgcacagttctgtgggaataagtacattcactttgttgtccagccatcaccatcgtccatctccagaatgttttcatcttcccaaccagaaactctgcatccattgaacactccctattctcccctccccaagctcctggcaaccaccattccactttctgtctctctagatttgactactctaggtatgtaagtaaaagcatacaacatttaaaaaaaaaaagaaaagaaaaaagaaagaatacagtctattctcataatttgtgaagtttgtatttgcaaatttgccattcactttattttattttatatttagttttattactttacgaaatttataaatttcgtaaagtaatctattaaatagatttattttacaatttatattataaccccaaaatcaatacttgcgggactttctccgtcattaacagacaagtgcagcatagaggaaaatgccagtcgtctagcagatgcgtgcattcccagctgaagtccaacatggcaacgctctgccttcttgtttcagctctcataccgtgcacaagtgtcctttttgagttcatttagtgccatattttttgagtttttggagttggtgatgttgctgtttaaaacggcctccaagcatagtgtttaagcgctttctgccatttctaagtgcaacagagccgtgctgtcccttacagggaaaatacgtgggtttgatatgtttcattcagacatgagttacaatgtcgctggtcatgagttcaatgctaatgaatcaacaataggtactaaaataaggcgtcttccaatagaaacacatattaaacaaggttctgtgttgaggggctgaggaaaatgttgtgaccggagattcacaagaacctagccgtgtatttcctcttgaaacagaggttcagtatttgctaattcactgttttcagtgactttatagaacataactaccatgaatatcaagaattggctgtttggggaagaggtattgcaaacagagataaaacagaagctgggcacgaagaggctaataaagacaaagcgaattggcagggtgcagtggttcacctgtaatcccagcactttgggaggccgaggcaggtggatcacctgaggtcaggagttcgagaccagcctggccaacatggtgaaacccaatctctactaaaaatacaaggctttcacaaactaaaaaatttttgtaaaaatacaaaaatttgctggacatggtggcatgcccctataatcccatctactcaggagtctgaggcaggagaatcgtgtgaaccctgaaggcagaggttgcagtgagccgagattgcaccattgcactccatctcaaaaaaaaaaaaaaaaaaaaaaggaaattgttacctcaggttgcgtctattgagacaacatggtaccaagttccagaccagaattttattttaattaaagcataagatttgctcatagtcactggaaagaagccacctctgcctggattttctggcttgcttactcagactatttccttttaatttaatgaaaatccaagcaatacttttaatagtttacttaaaaaaaacccactgggtataggaagtataggagttctaatttctgtgtctctatgtgaatcattccacctagattaattttcactgttttgctacctgaatagttggcaaataggaagtctgaaaagtaagtaataacactgaacctgttgagtcaagaacagtatacaagtgggattttttagtttctgaaagccttgagatttgaaaaatccattagagaatcctcattaagatattagaaactggcatgctagctctttttttttttttttaagaaatatcgtttgaaagatgctaaacatatttaagggggagtcaattcataagagaaaaatataatgtaacctttaggtgatggatcaataaaaacaaataaagagccaggtatacgcacacacaaacatacacacacacatctctaatttaactttctcgccctctatgtcatggctttttatgtagtcgctgactctcctttagtgaaattatagcttcaaaaacctaaaaccacatatttttgtttttctcacacagaccatgggtgaaacaaatcactgacagccattccttaaaccttcactacttttcattaaacatgaaaatttatgtttgcatagtttgcatagtgctgctgattatggcattaatagaaaccacgtgctttgacagtgtaaacatttcctgaagaatgaagaaaaaggtgcgtatgatggggagggcaggcaaagacgtcagatcctcagcgcctaatcaaattgcactcccacatggctgggacaataggcacacaccaccatccctggctaatttttgtagttttttgtagagatggggtttctccatgttgcccaagctggtcttgaactcctgacctcaggtgatctgcccacctcggcctcccagagtgctgagattacaggcatgagccactgcacctagcctaattcttttcttggtactacattaatacaaagactccactgaccctaaacaatgggttttagagcagggctaccctttgattaatgtggtgttaacactctgtaggaactgaaaaatgctttaagaaatagccttgtataaatccaatgcatgtagcagaataatcactggattccttattttgaacttcttataataaaccataggcacaaatgtcacttcttgaaaatacgctaatattttattgctggggaaatctgacataaaactgatttgggcaggaatgtactaccacatatttatttttctcaggccatgataatgttcttcagaggtggaattcctcctcgaactgttttagtcaacaaacacacactgaagatctgccttgtggcaagcaggatagggagcattgtaaaatactgattcctgagtttaagatattacgataatatcatggagaaaataacatggagaattagagcacagttagatgctaaattatatccagaacagggagacagagaagaaaaaaaaagaacactcacagtttactcttccatcctctgagactagagcactgattctgtcattgatcccagatcctaccttaggatatatgaagctttgtaagattcgtaagctttaggcaactagattacactaaagggcctacacttttaagtcagcaaggctgctctcatttataggctcggcttttcacagcctcacctgtggagccctttggccttacttgtgcttccccacattttcctaatatcttcaatccaaaagctctcgatttccacgcggtttccaattccccactcaccccttccacctaacacctggttatcccccgtggttccctagacacctgtacttggtcaggcagccaatttctttcatgcccctgaggacaggacccagactagaacctcagacaaagttttgtgtgtttctgaaccatgtgtaaaagaaataagaaactccagatgagaagtgatcaaaggagaggtaatcattattataattccctaagacattcaagaaaggaaaagtaatacaacaaaagccactctgcaaggaaaaacaaataattcaattatttaaagttacagaaccatatttgcaaatttacaggactgtatgaagatgcgcacatgttaaagaagtggggttttttttgtttcctgttaactgatctaaatctgcttaaaacctccactcaaaagcaatttaattggataacctttattccaattattgaaagttctttcaggaattcagtctccacgtggaagttgctgaccagtaggcttggcaatgatgggcaagttctatagctacaccacccagtccagcagccactgggcacatgtaactattgagcacttgaaatgtggctactgagactgaagggctgaagtttttttcagttttatgttaactgatttaaatttcaatttaaatagccacatttggctagtggctgtggaattgaaacccataactataaatgacagatgctcctatgagtttgtggcagaaacagtgaggaagacaggaaaggggcaaagtccttgtcttcattcatcttatcatagtggctgggttggaggtaaggcctggctttccatcccttctttggggcttacagtcttccagcgtggggcatacaggaaaactctgagatgtggctggctcctggtatgttaaaagaggaggtaagggtatttagatactaatcgttttctgtttcaatagatcctagctttcaagtctattaatctccatgagggcacaaaaatcctattataggaaatatcaactctcctttttgcctcttcttctccctgtcctcctcctcctttttcctcttcttgcacttcttcctcctcttcgtccttctccttctttaatagcaaggctattacttctgccctacacccaagcagatggctgacctggtctaacttagagagaaagtcatttacagacgaatgcaacagaagcacagcgtgacatttctaagtgcatctcccatcacagaagcacgcattttacaatcagttcagtgctgcagtttggtgaaaggccgacaatgaccaaggacacaaggcagcttttgtgctcataaaactataggtgggccgagatgtccctcagcaatgttttgttttaacaacattgaaaaacatgaaaaaacaaaacaaaaaacctccaatgacatttcagctacccagcactatattcttccaaaccatggaaaccaaaggtaaacccttttcatggcagaaggtagggactgtttttcttctatgttcttaatagtgaatttatacctgcatctaataatatatttttcagttctaacttctgggttattttcatctacattttcaaccacttctggtgcaaaatggttcatgtcaatatctcacaaagcatagtgagttacaaaaaacaatgtaaagcattgctttaaaatctttaacaatgaaagcttaaaaatgaaaacaggaatttaaagaagtgattgactttgttaaagttattttagcaaaaatgaaactataggataatatcaatttaaaccgtcctgtaaaaaaagtcaaaaactggagatataaacatataatatttgaggcaatatagacacaaccatgttaaaaaatacttgcacaaagatttaacgtattgatcgatcccgcatttttagaccagtgtttatcatgtgctgtttctatgtcagtcctaaacaaggagtccactgtcagctgtgagaaagacacttacaacttcccaagaacagtaatgagttggtcaacaaatgattgcatgaggaagcattcaggaaatagatttcataataatgtcttcaaaaaatcctgatgcttacatgcttaccatcattagaaatgacaaatgataatgtagcttttaagattagattcttcatctaggtataaaaggaagtctctccctttgggttaatttttttcttatttgggaaatccttcaggaagagacaaaaagcctatctttcttttttagcaaatgaataaatagaagaaaataaaacaacaagacttaatgtctttctcacttaaatcttctggaaaaattattctttgtgtgaaaaataagtaaaatcattgcaagcaacaagttgtttatcaaatgacagtgcattctttttttctgaaaataattatttgttctttaattgaaaaatggtaaagatttatgttgtcagtcagtaaaacatttttaatgccagtatttttatgagagctgttatcctcttaagaaacactacaagataccaagatacactcatgagttggacattgcccaccttccagttattcttcagtaaataaaaacacaaaatctttaaatattctaggtttttttttttttgctgttctgtatatttttaaagacatttcaaaagaaattttgcaaaaaaagatatgcacttaccatgtatttatttatttatttatttatttatttatttatttagtagggacggagtctcactatgttgcttaggctggtcttgaactcctgagctcacgtgatcctcctccctcgacctcccaaagtgctgggattacagatatgaccccctacacctggccctcttcaccttttaaacttaaacctgtatgtttctaggacataccataaaatactgatatcaaatctcagggagaagaaagtaaacattaaatcaattcttaccagtgatttaaaacaactctattccacacaaataagccagcctttccccagtccagtttggaattaccttccttcgacaattttattagcatgccaatgatgacaaacccttagaaagttgtgggggcagaaggaaaggttggggacaagaccaaaaaggcaggacttaacatagacttggggcattttgctgcagaaaagaaggagaatttagagtaacttagtctagtcagtaatgtagtgacatacatttacactccactcatacctgaatctgaatcagaatcattctagaaaaagtgttcagaaacctcctaatatgactgcacttagtcttttggggagactgtactctccccttgaattacctcatctcttaagaatgtgactgtgatcagcatgagctctgtgatgccaccattctcactcagcactctcttcatacctcgttcaaatgttttgagcccacaatgaagagcattagccttaaaggcccttgtctgctcacacaagaaaaatattttctccatcaatacttcttgtatttttcacctggagctggagatcatcttgctaatatgggacagaattagagaggtggggagccccaggtgcacacctggttaacctaccacatgatactgaagtgtcaatggacaagtttcttggactcttgttaagccagctaccaaattaagtgagattctatatgtttaataacagtttgacacagaaaccaaacagtctgtttggctggctgtgaagtatcaggatggccaaatgggcatatcagcttataaactaacagaatgaaaaggtaacatatgaaactggaatatttgcaaaccatatagctgataagaggctaatatccaaaatatattaacaacttctacaattccatagcaaaaataaaaaataataaactgacttaaaaatgggcaaaggactggaatagatatctctctgaagacatacagatagccaacagacacatgaaaaggtgctcaatggttttactattcatgcaaatcaaaagtaatgaggagatatcaccatgcacctgttaagatgactgtcataaaaaaaagataaaaagcattggtgaggacacggagaaattggaactcttatacactgttagtaggaatgtaaaatggtgcagccactgtcgaaaacagcacagagcttcctcaaaaaatcaaaaatagaactgccatgggattgagcagtcccactattgagtattaatccagaggtactgaaatcagtatcttgaagagatatctgcactctcatgttcactgcagcatgattctcaacagccaagatgtggaaacaacccaaatgtccatcaacgggtgaataaagaaaatgtgacatatacatacaatggaatatttttcagctttatgaaagaatgaaattctgtcatttgttagggcatagttaggttggaagacattatgctaagtgaaataaaccaatcaaaggacaaatacagcatgatttcactttgatgagttatctaaaatagtcaaactgatagaagcagagactagaatggtgattatcaaaagctgagggtaggggtaggggggtatgggaagttgttcaatgggtatgaagttttagttacacctggaagaagaaaaggatgctcactctcaccaatgctattcagtatagtactgaaagtcctagccagagcaatcaggcaagagaaagaataaaaggcatccaaattggaaaggaggagaatgtcaaattatctctatatgctgatgacatgatcttatacctaggaaactctaaagattcctccaaaagactcctaaacttgataaacaacttcaatatagtttcaggatacgaaacaaaacatgcaaaagatcagcatttctttttttttttttttttgaaatggagtctcactctgttgcccaggctggaatgcagtggcgcgatctcggctcactgcaacctctgtctcccaggttcaagcaattctcctacctcagtctcccgagtagctgggattacaggagcatgccaacatgcccagctagttttttcttttctttctttctttttttttttatttttgtatttttagtacagacaaggtttcacttgctggccaggctggtctggaactcctgacctcagatgacccacccacctcagcctcccaaagtgctgggattacaggaatgagccaccgtgcccagccagttacatttctatatatcaacaacactcaaactgagaaccaaatcaaaaactcaattccatttacaatagccacacacaaaaataaaatatccaggaatacatttaaccaaggagatataaaatctctacaaggagaactacaaagcactgatgaaagaaatcgtggataatggagatcataattctaagcaaattaacacaggaacagaaaagcaaacaccacatgttcttacttacaagtgggagctaagcattgagcacacatggacataaataggggaacaaaacacactgtggactactagagggtgaggggagggggagtggattaaaaaactacctatcaagtattatgctcactaccagggtggcaggatctgtacttcagacctcagcatcacacaatattctcatgtaataaatctgtgcatgtactgccagtatctaaaataaaagttgaaattaaaaaaaaaagaaattgtaactggcacgaataagtggagaaacattccaagctcatagacaggaagaatcaatattgttaaaatgtccatactgcccaaagcaatctgcagattcaacacgatttttatcaaattaccaatgtcatagaaatagaaaaacaattctaaaattcctgtagaaccaaaaaacagccttgaatagctaaagcaatcctaagcaaaaagaacaaaactggagcatcacattatgtgactttaagttatactacaaggctatagtaaccaaaacagcatggtactggtacaaaatagacacatagatcagtggatcagaatagagaacctagaaacaaagccacctacctacagccaactgatctttggaaaagttgacaaaataaacaacggagaaagacaccctattaaataaatggtgctgggaaaactagctagctatacatagaagaacaaaactggactcctatctcaccatatacaaaaattaactcaaaacagattaaaggtttaaatgttaagacctataaaaactcctggaatgaaacctaggaaaaactcttggcccagcaaagaatttaggactatatcctcaaaagcaaatgttaacaaaaacaaaaatcgacaaatggagtttcattaaatgaaagggcacctgcacagcacaacagaataaacagacagcctgcagaatgggagaaaatgtttgcaaactatgcatccaacaaagaaataagatctataatatgtaaggaactcaaacagataaaagagaaaaaagcccaaataacctcattaaagagttgacaaagaatatgaaagacccttctcaaaagaaaacatacaagtgtccaacaaacatgaaaaaaatgtttaatatcactaatcatcagagaaatgcaaattaaaaccacaatgagataccacctcacaccagtcagaatggctattattaaaaggtcaaaaaataatagatgttggcgaggatgtggagaaaaggaaatgcttatacattgtcggtgggaatgtaaattagtacaacccccacggaaaacagtatagagatttctccaagaactaaaaacagaactaccacttcatccagcaatcccactactggatatctacccaaaggaaaagaaattgttatatcaaaaagacatgtgcactcatatgtttatcgctgcactgttcacaatagcaaagccatgaagtcaacctaaatgtttaccactggtctattgggtaaagaaaatgtggtatttatacatcataaaatactatgcagccacaaagaagaatgaaatcatgtcttttgtagcaacatggatggaactggaggctattatcccaagtgaaataactcagaaacagaaaaccaaataccgtatgtcctcacttataagtgagagctaaacaatgggtacacatgaatagaaagacggaaataattgacactggtaactccaaagctgaggagagtagaagagggttgtagggtgaaaaattgcctattggttacaatgttcactatttgagtggtaggttcgctagaagcacaaacctcaccattacacaatacatccatgcaataaacctacacatatacccacttaatctgtaataaaataacaaataataatagtaataaaatttcagttccacaaaatgagtaagttcatgagatctggggtatctgtggttaacaataatgtattgcacaattaaaaatttgctaaaaggatagatatcatgctaagtgttcctaccataatagaaaaacacaaagaaaaaacaaagaggcacaaggaaattttagaggtgagggacatgtctattaccttgatcatggtgatggtttcatgcgtaaatgcatttggccaaattcattaaattgtaaacattaaacgtgtggtttttttgtatgtcaattacactttaatcaagttgtttaaaaaatacttgcacaaacctgtagtatactagttgtccctcattattagatcagtgcttaccatatgctatgtcagttttaaaaaacaggagtcagctgtagctaagtcctttactacttcataaaaacatcaatcaaccaaacaatggttcagatagtgaaagaacgactgcacagtgaagcatgctcaagtgcttggatctacttcactcaaatacaacacacgttcattgatgcttacagcctgatcccatgtgaaatacgtcttcatagagcttagcattcagtaactaaacaactattaatttggaagatatgaattttctagaaaactgatttttctctcattcattcagagtggagaaaagatagccagagtttgagtctgggtaagccagatccctctggaagctacacagtgtctgctaggaaccaagctaaattcaaagacagtgacttcagatgttttcagccctagtgtcctttaaactgtgtgctggtgtgcctctcacttctttagattgtaaactcctcattttacttatagaaaaacactcagtgcttctttctttctttccaaggaaaatcatcagctttttcaattaatatgtgccacagtgtctgttacttttcagaaataccattccttttctgcattgcctatttccaattttgcatctgctgatgtctgggtgccaaatctatcctataatgttttgtcagcaagttattcccagaaaaataatgcaaaactcttaaagtctgcttgagtgatttctcaggaaccttatggctcatggaaatcctgtattcatccaaagggaagtctattaccaagagctatttaaggcaagtgtgacatggaagaaattataaaggaaaaaaaaaacctccatctcaaaaagtaatcttcattttatgatttttacatgaaagttggtatcactatactcttttaaatgtgttgttagagaaaatatgcaaatcctgaattatatcttcaataagtatatatgaaaatatcacaagccatgatatcaattcatcattcagcacatagcacatgtctctctcagttcatgccccaaacctcccctgaccacagcaccgcagcaactcacagcaacatcccaaacagaaatcctccagcatcacaccctcacctccagcacaaacatagcactaacgtctcttcgaccagctccctcatatcccagtgccctgccccacttcagcagcttgaagagaaaatacaatgaaggttggggaagagaaggagacctaagccactgacaacagtgggaattacagaaacaccattatggctcaggaggttgcaaaaccaaaactttccaaagtgaatcgtaattttcacgtcctggaaaatgtgaccccaatggctactaaaaactgactttgctgacttaggtcaccagtttcactcaaatcacctagatctctaatataactcttgaatattcaccattaattattttattttttatttgcattaatacaaggggtaaaagtatagttttatttcatggatataatgcataagggtgaagtctggacttttaatgtaaccatcgcccaaatagtggacactgtacccattaagtaattttttgtctgtcatccccctcccacccttccaagtttctaatgcctattattctatattctatgtccacgtgtacacgttatttagctcccacttctaagcaagaacgtgtggtattttactatttgtttcggagttatttcacttaagatgatggtctccagttccatccatgttgctgcaaaagccatgatttcattcttttttgtggctgagtagtaatctatcgtatgtgtgtgtgttgtgtataaatacatctcacaaaagttgtgagatatatatatgtgtgtgtgtatatatataccaaaaattttaaattttaaattgtacttaccactgtactttaaactcaaatgcaaatattttatctattcacttttgtaatcatggagctatatacatccattggggaacctgatattgtacaaacagtaagcagtgatgaggaagagatactgaggaaatcagggaataaggacattaaaaaagtaaaaagagaaatgaaggaatgaaaactaaaagtaatgtcaagtgtcgtctgcagaacgggattcagtcatgcagcccatggcagtagcatagccacagaccaaacagcagagaagcgagtcgtaacaggaagtctccactttttcttgggcttcctgcagcaagtggtaaagaaataggtgagtaccatgaaaaatcacccagtttttcccaagaatcatggctatcccagtgtcagcagagcatggccctgtctctgcctctaccaccacctcacatgcttcatcccagaaatggtcccagacctgaacccctcttcagtcacttcgttcactcctggttcaagtttttccactgtaaactggagtctctcagctacttaatcacttgcttaatggtttggggaccacacaatcttctgtgagccctaggcctgcacattccttaacagatacgtgcaggaacacagggtaccttttaacaccaccaccatcaccaatactcataataaacaaacagatgaataacacttatataatgcttattatgcaccaggcactctccaaaacactttatacttaggtactacttttatacacatttcagggaagtaaattgagacttacagtggttaagtgatctgttgtgaagtagcagatcccaaatttaaacacctgtatgttggttccaaagaccacattctttatcactattctatgctaaagctcacaagtgaagacttaataataaatctttaaaactccaaatatataactaaaatttgaagtatataattcttccatcaagaaagccttgtgaataggattacgtggaccctagctcttccatcccttttcaaaaaatctttatggttggtcagcttctttatattatatgaattctaaaatatatttgccagagaaattcaatcatacctataaatatgattactcctcatctctaccaaaccacttaaccatcccaactagccctactaacttcatgttttactgctaatgcaaaaaaaaatctaatgcatttctggcaaacagggagtttctgtggaagtcaatggagagaaaggttaacattgacttctaaggcaagactatatagactggccagttaaatgtcacagatataatttccttatttgaaagacacatcatataaaattgctgatgctattctgttgacagtatgaatgttaatcattaggactatttactgtcatttccatgctataattctgctcaaatattgaaatttgtaataccaagtaagagaagctattttcattactttttacttttttttgagacagagtctcactctgtcacccaggctggattacagtggcacaatctcagctcactgcaacctttgcctcctgggttcaagcgattctcctccctcagcctcccgagtagctgggattacaggcacctgccaccatgcccagctaagttttgtatttttagtagagatggggtttcaccatgttggccaggctggttttgaactcctgacctccagtgatcctcctgcttagcctcccaaagtgcctggattacaggcgtgagccacctcacccggccaagagaagctattttggattttaaaaatatgcttttaccaattaactggtgttttcctaagcgagaagcctagtaatattattctgttattagtaattgcctgggaagaatgtatatgctatatgaaactctgtggctaggctgtacatattaccctggagaaatatacacaggtagttggatactagcatttctttgaaataaatcaaggatatagatcatgagtcctaaatctggcaaaccttgttcacattacccaaaaagatctgttttatcatgtggttcactcctacgtgtgtattccagcccaactgggattaatttctaatatattttaaaaatcatgtttatattatagtaaatggtatttctggtaacactctaataggttttggcctcagtaagattttgcttagaggaagagtcagccagctacagcctgcaggccaaatctagctctctacctgttgttcttcgacccatcattgagaataatttctccagatttgcaatcagtttgatgataaagaaagctaattttgaatctcaattaaacagaatgttattttttaaaaaagtttaaaagattttcagtgttcttattattaaatgcagtaggcagaataacgatctccgaagacgtccatgcccgaatccccagagcccatgattatgttacctgacatggtaaaaggaattccatgacatggtaaaaggtaaaaggcagatgtgattaaggttatggactattatgggttggaccatgtcccctacaaagatatattgaagtcctaatccctgatacccatgaatgtgcctttatttggaaaaaggggttttgtagatgttatcaagttaagatgaggtcatcaaggtaagccctaatccaatataactgatgccttataagaagaggagaagagacagaggcacaggaggagaggaggcgttgtgctgatggaagcagagattgaggcaatgcagctgcaaatcagaaaatgctaaggattgatgggcatagctcttccatcccttttcaaaaaagtctttatggttggtcagcttctttatattatacagattctaaattatatttgcatctgtgctatatgaaactctgttgctaggttgtacatattacgctggatccatagtagtgcataaccttaatcacatctgccaaatcccttttaccatgtcaggtaatgtattcacaggttctggggattacggcatggacgtctttggagaccattattctgccaactgcatctgtggaagaaagaacaagaaaaggaaggatcctactcagaacctcacagggagcgcggccctgctgaaaccttgatttctgatttttagactccagaactgtgaaaacgtttttaaataattgccgttgttttcagccacccattttgtggtactttgttatggcagccctagaaaactaactcctggaccctgcattgtgaaatttatcctgagttatccaggtgggcccagtgtaatcacatggatccttaaaactagagagactttccaggctgcagtagagagagaaatgtggcaatagaagcaggtttacagagacgctacattcccggccttgaatatgaatatgattcctggtattgaatatgaaggaaagagccatatgccaaagaatgcaggtaacctctgacaactggcaaggcaagacagcagactctacctcagagcctctggaggggcagagccctgccgacgccttgattttagcccagtgagaactgtgttggacttttgacctctggaactgtaccataatatcatcaatattttgtgtgtaagctaccaagtttctgataatacgttatggctgcaacagaaaactaatacaatagatttgtattacaaaaactgttccttattattattaatattattttttactttaattttgttgaactttgtgaaaatttgttttctctcttgtaaggtaagtacctacataatgtatttgattttgcatcttggcccataaagtctaaaatatttactatttggttctttacaaaatttgttgacctctggttttgagtgttagcaaatttcaagtttgttaaaaggaaaatacttaatgtggctcttccatttagaaatactacatttcttgcccaatggtttattgaagttcagattacagaagtagatggattataaagatttgtatagttgtacttctcaaaaagaattaaaagaaacatatccattcttcctatgactgtactcctgcatctaaaaacttgatttgtgaagcttgtgatgtgccaccatagtatagtgtagttgggacagcaagtgcatgttaagtatggggtcagaatgagatattagataacctggaacaaaggggagtgctgacttaaatttctggaatacaagcaagcccactcatcccagagagatggacaggacattgcctggctgcaggcaggtagcttcatagcactgtcactatggagcgctatataaaaaacatatttgataggaatgtgcaaaattaaaaataaaaaatagaaaaataaatatttgcctataaaaaaaagactcacctataatatgttcagaatttattcccctaaggatttttttagaattcaaaatttctattatattttcagtaaagttaaattaatcatgttttctacgagttcaaaacatattcatcttaatcacaacacttgcagtttggtagcctcattttgaagaatggaaagttaagagagcataaatcaattgctaaagaaagacaaagtcattataaagcaggataagtactgccagatcgtccctgccatatagactagttaaccctacttttacatgagagaaacatgtagcttaatgaaaagcatctttcattcagtaataacaaatagttgtcaagtgtctaccatacgctgggaataagaaccccagacttgcccctgttcctcaatgaactcagtcatttgctgtcagaatggaaggtgcacttaacctttgctcccaccccatgtgagtcagtctgtgggtcacattagcatagaaaaggcacaagctgagatttccctacccactgccagattggcaaagaaatatagcagagaggccatgccagacttgggaatcggacagacctagattcaagccctctctccttattagctatgtaatggtgggaaaatagtctaagatgtgggacacagttccctagggctcagatgtaaaataagaaccatcgcatatcctttgcagtgttgctgtgaggactgaccaggaaccacacagatgctcacccagttggctcatcatacagggtgctgggtacattttaaccatgaatgtccttctaggaggttaagtaaatatcaagaaatacaacaaatagaacacttagccttctttgcacattctgcaggagtcttgtgaaatcactgagttccagtcactcaggggacttggtaatggagcccctgctgtactcgtagacacacagctgtgggtaagagaaggtggggatgggacatcagacaacctggaataaaggccagtactgacttccgtttctagattcacaggcaagcctactaatcccaggatactacaaagatgtcaaaacgttgacactgaggagagaacatcatcacaaggaagggtgcatggaagaaaggtgggggagggcagtaaaaagaaggaggaggagacaataaagacaggcagaaggcttagagacacatattactcagtcactcagcatcccagggatgggctcgtggtccagtccctgaatctatctagactcacatgtatagtgagagattgatcatgctgattgcagctgtaaatgtctttaatttttgtgattctattttcctgaagtaaagtggtgatgaatgatagtggagagttaagaagattagttggacaattttcaaaagaagaatagaaatgactagtaaatacgagcagtaatagttcagttttttaaataatgcgaattaaatcaatgtgatgcagcatttgcctatcaaatgaaagaaattaacaagaacatccgtgtagatgagggcacagtgaaatacacgcactctgatgttgtggataggggtatgggttggtatgagagttcagaaagaaatttggtaatgttcatcaaaataatttagaatattcatctcttttggcctattaattcttcttagaaactaccatatgccaaaatgcccacaaaagttatgcacagacgtgcatcatttataataacagtgagaaattggacatcactcaagtattcaatattaggtacatgcttaaataagacagaatatatcaatatggtagaatattttgtggccattaaacataaaagctttttaataatatagggaaatttaataacattaaaaatgtcaagtaaagaaagcatatgttctcaggtaaattaaaaatttatttttaaaaatacactaagaaattactattgctggaataatgaacacatttcctgattcttcatatttttccaaattctctacaaagcacatgcctcatctttaagctcagaaagaacataaagctaacataatcatcataataagaaaaaaacaaaagataaaaaggaattgttctcatccattttctttcatagttctgaggccttatgttcatgagaagaaaggtaacaggaaaacgatatttttatttatactgtattgattttggaaaggccacaacacagtggaaagagaaattaagagatggtggcataaattcttgaagacggagccttattttcttcctctattacttgactttcacattttaatccatgttaaaggacctgttttatattctcgtgttttatctaaatcttttctggcagtcagcagaaatatatgcatattctatactcacaataataaactatatcagatacaggatgagaaatgtatctcttaaagatctccatatgagttaatattacaccttctctagataaatttatctatcaggaaattagtttaaatttaatttagagaagccacatgatatagtgaaaggagcccaaagcttgaagttggaacacctgtatttggagatggatccaccagatttatgattggcacaattcactcagtcccttggctcacaaatctgtcatgtgtggagctgagatgacatcatcttcacagcattactgcgatgatatgagataatacatgtggaagtgactgcgacgttgtgaagtcactgtttaaccctttcataccaaaagaaggaaaaagtctttgatagggcctcttcatgctattaacatgctgtatttatccaaatgaaaataataataataaaagtatatttaatagatctggtgacccagtctggacaaagttcattgcctgggcacatttccttgagtgcagctcaaaaatttaccagcattaacatgatgtgatttttttccaggttaaaaaaatatatatatatgattcaataactaaagctgatagtttacaaaacagaaagcagctactctaataataaatggaatattgccacttataagcgcagcatttccctaggtaacagaaatattttctcttaagatggcttattggggtcaacagattagaacttatatgtacttcgaaatcaaatggtatagttttctttttgttttcaaacttagtaaagatctcttttaaaggaaaaagatctcactgactgccaatgttgacaacttatttttacaacaatattaatatatgccactaggtataatctgcctgccctatcctcatggtccttttacaacaactacaaaactaaaaattaatttatacattaaaagcaataaaaatctttaaagtagtgtaaaaatcaataacattgatgtgaataaacacattatttcactgaaagtaagttataattctcaatgtgaatatgatagtatacatgcacacgtaaagtttgacatgtctatacatataattttctcaacatttttgtctattccaacttttgtaaaatcagtggtatgatacatgtttaagttatatatttagtgcacatagggggaacataagagcgatgcctgagttacatgtttagtgcacacaggaaacacatgcacacgtacatctgagttatacatgcagtgcacatataaaacatgtacacacacttgagttacataaatagtgcacatatgcaagcaatgcaggcacacaccggagttatacatgtagtgcacatacaggctcacacataagttacatacacagcacacacaggaaacacagacacacatcagagttacatacataatccatggaaaacatacagacacacacctgagttatacatgtggtgcacatatggagcacaaataggcacatgcctgagttatttaggtagagtacatatgggggacacacaagcaacgcctcggttacatatggaggacaaatctagccttttcccattaactcaagataaataaatagcactgcctccgtctaatcagattattaattcatcaaaagtgtgctacaaaaattgcatgattaaactgcattaggaggcccagataacccagacatgcatagattacttttttagggctataatcaaagtataattacaaaattgattattttcttggataacacacaggcacagggaaaatgttcatatactcttgtttgagaaactctgctattgataacatgacctatgtccaaacattttaaaaagttttttataaaacagaatcctagaattcctgatttgaatagaacttgtggggcaccagagttcagccggatctgacttattgatttatgttgctaactcagtgcaacagcatccgcaacagcctctaagggttgggagctctggcatttaatttaatctagtccccatcattgcccttcatcttctcctcattgctgctgcttctcctctcttttccaccttcgtgccctgtccttgctgttcttaagtaccacgcacatttgaggacagacaaaacagacataccatgaaacagatttgttttcagtctgaaagcccacaaaacagcacctctgtggaagaaaagccatagttacagttggttgtgtggctggaaattctgaattcccctggaaacatttaagactaggcccttttccgctatcaattacagaacaaatagacccccaggtctgctcacctgcacaatccacacagaaagtaatgggtattccacatataatgggtaaatgatttgacattttgctattacatatatagttatggtctgcataaggacagttgaaagataagtagacacctaagaagctgatttattgaattcagcaattcattaaatttaacaaatatttatagagtgcttattttctggaaaatactgaacaatttttatttttctctttacagcaattgtgaaatgcaagaaccagatacctaggctccaacttaaatatccatctcctttatttaaaacatatattggctatctatcatgaagtaccaggtgttctgttggggtcagtgagatattagaggccaaaaaaaatgtttctgggttaaaagactagaacacatgttatgaataacataaaaatttagactgggaaaaaaacaatttcaacagataatgacagagagagacaacaaagacaagtaaggtgaaagcaatatagcattgtgactaagaacaaaaatatgaacaagtggaaagatctgagtttgagtttcaggttatttcaattatctgtgtgaccttgggatattatttaacctctccaagctgtaatttcctcttatgtgccagcaggctaaatagaagtacctaacacattctttcttcttgtttttgttttgagaattaaatgagataaagcacagtatctggcagagggctagtgctaagtaaaggctatgtatttttattataattactacttttaatatattggtgccagaaatagcataagaaaatgaacagaggtcaggtgcagtggctacactcctggaatcccagcactttgggaggctgaggcaggtggatcacttgaggccagaagttcgagaccagcctggccaacatggtgaaacccccttctcaaccaaaaatacaaaaattacctgggcatggtggcacatggctgtaatcccagatactggggaggctgaggcaggacaatcgcttgaacctgggaggcagaggttgcagtgagctgagactgcaccactgcactccagcctgagtgacagagtgagaaaaaaaagaaaggagagaaagaaagaaagaaagaaagaaagaaagaaagaaagaaagaaagaaagaaagaaagaaagagaaagaatgaaagaagaaaagaaagaaagaaagagaaagaatgaaagaagaaaagaaagaaagaaagaaaaagagaaagagagaaaggagggagagagagatagagagagagagagaacagagacaagaaacataggaccttactctggaaactgtgagaatgctcatttggttaaaagactagatcatagaagaaaagtagaggttgataggtttgaaaagttggttttagtcaaattgaaaaacaggctgagatatagggtttaattggtagatagtaaagaaatcattgaaacattttgaacagagcagtgataaaatcagaggtgcactttaggaaaataactaaggatggcaggataaggtggagagaggaaaaatcagagcattttatgaaaagaattccacttaaccaattaagaattaagaagtaaaatgggaattagagtgttgatatgaaaaagaagaactaaacttgaaagaggtattatggaggtagaatcccttacaacatttaggagcacctttaagttcaaagagtttgaataaaataggtctcataggaagagtaaaggtcatgccataagcccaatcagtgctataacaatgacccttaatatctactcagtgccagacacattgtattaccacactttgcattactatagtggaatacctgagactgggtaatgtataaccaagagttttatttggctcatggttctgcaggttatgcaagcatggcaccagcatctgcttggcttctggtgaggcctcaggaagcttacaatcatggttgaaggcataggaggagcccacagatcacatggcaagagggagcaagagagcagggaggaggtgccaggctcttttaaacaaccagctcttgagtgaactaatagagtgagaactcactcaacaccaaaaagatggtaccaagccattcatgaggaatctgctcctatgactcaaacacctcccactagacacctccaactttggaggtcacatttcaacgagatgttgaggggacacacatccaaaacatatcacatgttatgtgtcatttttagattccttttaaggctggtcatccaatggatttcacatcctcacacaacccaaacaaaaaacagaaaaaaagaaacttcctctagttgtttccagcaaccttccctcatacctccctggcttgaattggttacatttccattcctgaactaataactgtgatcaggggattgacatacgctttaggacataagttttgtttacctgaatcaatttttgtgtttataataatgaaactatattaatgtggttagaacagtgattctcagtctgaggcaattttgtccagcaggggacatctggtaatgtctggaaaatttttgattgtcacaactgcaacagtgttactggcctctagttggtagagtccagggatattgttaaggatcctacaatgcccagaacagccccctacaacacagaagtattggacccaaaatttcaatagtgttcagagtgagaatgttggctttgaacaattaggggtcatccttggatctgggtgtgagatcagctccaaatcccaccttacattaatagataaggataaaaccaatgttaggaagacaacgaaaagtcaattaaattaatatactcaacaaaaattaattgagttggggtgtggggacattgcaagaatgctgcagtgaaaggcttccaaatatctgctcctccacaatggcaatgaaaacactaaatcaacattttaagaactctgtcaactaaccaacagagaaattcaaagattctttattaaagaaaaaacagctgaatctcaatgagaacagtgacctttctggtgttttaacttgccctactcccatcctctcttctcagctccacaatagctttgaaaaccaacagcttggtaaatatgatagcagtgacaagcatagccataaaaaaaacagcagcctaccaaccaaaggagagggaaaaacagttttgaagctcctcaaaagtgcccttaccagttgttattatttgatctggctggtagtttcctggaaacctctactagtagggcttgtctttacttgaccggactcagagataactccttgtaaacaacctttccccaggacatcggtcaaaaaccatccatggtaattgcttaatatcagctacctgaggcatctataaaatttgggcaaacaagaagctgaccaaaaccttacatggaaaatgtggtgaatgaattgtccatagggtctgtgtgcttgggctgccacaacaaaataccagagactgatcatttgaacaacataaatttattttctcacagtcctggaggctagaatggtccagcatggtgaagtttttgtaaagcctctttttcaggcttctttctcactgtgagctcctttggttaacatgcagagacagagcaacatctctggtatctcttcttttaagggcactaatcccatcatgagttcccattcacatgatctcatctaaccttatttatccacccgaaagcctcatctctgaatatcatcatattaacatataactttgagtggcacacatatattcagttcatacattctgccctagacccccaagatgtccttctcacatgcaaaatacattaattttatcccaaaagcctcaaaagtcttaacagattccagcatcaattctaaagtacaaagtctcatttaaatagtatctaaatcaaatataagtaagccttatccccaaaatcaaaattattctccagctgtaaacctgtaaaaccatacaagttatgtgcttccaaattacaacagatagtggaataggcatgagatagccattcccattccaaaaggaaaaattaagaaagaaggaaggagagacaggccacaagaatgtctaaaaccaaccaaggcaaattccattagctcttaagtctcaagatatctctttttcatttaatgccatttattctagacctacagggatagtggatcctgcctccaggcttttacacagccctgtctccaaggccccacccccaggctttagtcagaggccatatggcctattgaaactgaggcaatggtcccaccctttgccacaaaggacactgacctgatgatctctgaattgcctttggggtcactacttcattttcttgaaaagcacaaagttagagccaaatagctctctggtctggtcttgcaagatctaaaagtctggcagcctttatttcatctcatttgtttctgaccccttagttcaaattgacagtgtttttgcttgtataattgatctctattcctggcctcttctgagatggctgattcagtccatgagtcattaccacgatctctttatcaaataattgttcaaccacacccttcctgttgtcttcaccacaggcttttttatttatttgcaatagagataggctgaaaactttccaaatcttcaactctggttcctttatgcttaacaatttcttcttcaacttctctctctcctttcacattttaccataaacaggaggaaccaagccactccttcaacaatttgattaggtatctccttagctaattatctaattttatcacttgcaaaatccaaagtcttatctaaatattatctaagtttgtttgtcaaaaatatcaatttcacaaaacactagaacatggttaatccaagtgctatgtcactttataaaaggatcacctttcttccattttccagtaatgtttttcctcattttcatctgggaactcaacagaatggcctttaacatccatattgatatcaacattctcttcacgattatttattatattattatatctctagaaagatagataattccccttagctattctcttttctttctgcgccctcactccaactgccttaaatacttcactgcaattttggctttttctagcatacacctcaaaacttttccatcccctatccattgcccacttctaaagccacttacgcatgtttaggtatttgttgcatcagcaccccacttcctggtaccaaaattagtgtgagtcttcttgggcttccataataaattaccatagactaggtggtttaagcaacagaaacttattttctcacagtcctggagggcagaattatgagacaagcatgccagcagcacactttgccaggttctggtgggagctctccttctctctgtgctctgccatggcctttctttggagcatgcgtgtggaatgagaagcaagctctctggtgtcttcttttgggggcactcatctcatcatgagggatccagtcacatgatctcatctaactgtaattacaacatagacattttgagaacacaataaggactttgaaaagctccaacatgtttctgagaatctagaaggcaacacacatgtgcaggaagttgagacacctgaaaaggtcctaattttttaacttttgctgaccttgagtatctgagcaagcaggacattaatggtaacagagttttcaactgcctaccagtaaattgaaggcatgcacctaacacacatggaactattcaggaaagactgggagagttgctcgttcaagatactaaggaaatgcatgtctagtcattagctgacaattatgttaaccagttactacacatgagaaactatagagttcttacaggaaagtcatgaaacaaagaacaacaataacaaacaggaacaatagcaaactgtgaagaatgggatctggtttccagagttgctacatcatattatctaaaatattcagtttcaaaaaaatcatgatacatgtaaacaaacaggggaatatggccccaaaacaaggggataaaatcagtcatgaatttttttattataatttttgtccctgaaaaagtccatgaattagaattcctagtcaaaaatttgaaataactttaaattataatttaaagccattacaattattttcaaagaccaaaagtaaaccatgaatacacatttaaagaaaaacatgagaatgatatatcagcaaatagataacatcaacttaacatataaattatttaaaaaatcgaaattctagagctctaagatacaataactgaaataaaaaatttgctagggagactttttctatgttacaaaattagccaacttttattgagagcttaaaacatattaaaatacatattaaatacacattaaaatgtattgtaaatgctttatttttctctttttttaatttaattttaatttctgggatacatgtacaggacgtgcaggtttgttacacaggtaaatgtgtgccatggtggtctgctgcacatatcaacccgtcacctaggtattaagccccacatgcattagctatttatcctgatactctccctcccactgcccccctgacaggccccattgtgtgttgttcccctgctagggagacttaattggaaattttacttggcagaataaataatcagtgaacttgaagacaggtcaattgagactatctagtctgtggaatataaagaaaaaataatgaagaaaaatgaacaaagtctccaatgtccctgtgatgctatcaagtgtaccaacatccacataatgaaaactttagaagaagaagtaaaagagaaaaagtagaaaaaatatttgaggaaacagtaaccaaattttcaaaatttcatttgaaaatcattaaactatacatattaaaagaaactcagaatgtatgtaagatcaactaaaattatccatgcccagacatatcataatcgaattgttgtcaacagtaaaagataaagagagaatcttgaacacagtaatagagaagtggctcatcacatacaggggtccttgataagaggaacaattgatttcttatcagaaactatggtttccagaaggcaacgggatgacatactccaagtactgaaagaaaaatactgtcaaataagaattctataattttcagaactattcttcaaaaatgaaaaaaaaagtgaagacattgccatataaacaaatggaaataatttgtcacttataaatctactctataagaaatgctaaacggagttgttcagtctgaaaataaaggacaatagacaataaatagaatccacatgaagaaatattaacagcaccagtagacgtaacaatataaataagcataaaaaatagtatgaatatacccttggtttgtaattttttccctgtttatttaaaaggtaactatacaaatcaacaactataaaatggtgctgatggacttataatctgtaaatatttattcttatataagagcacaaagaaagggggaaaagtagagctatgtagcagcaaaattttatataccactgacattaaattggtattgatccaaactaaattgttaagatactagttataatcctcagagcaaccattaagaaaagaatgtaaaaatacaattaaagaaatattaatattaatggaattaaaatgttatactagaaaacatctatttagcataaaagaagaaaataatggaaaaagagagaaacaaacaaacaaaaaaagacatatagaacacatgtgcctggacaacatggtgaaaccccatctgtacaaaaaatacaaaaattagttgagcatggtggccaattggaggctgaggctggtggatcacttaagcccaggaagcagaggttgcagtgagccaagatcacaccactgcatacaagcctgggtgacgcagtgagacccagtctcaaaaaaaaaaaaaaaaaactcaaatcaaaacaacagtaaaaaaaacccacatgtggcaaaatggcagatgtaaagcttactttatcagtaattatactaacacagaacattacatttggataatgatttttctgattaaatttgttgtagacagacagaaaacagaattagatcagtattgagattacaaagtggcattagcaacaagcaaggaattgaatccacaaatgtctctttggagagaggaagcaggatgtatgtgtcacctcttaatagattcatcaggataaactaaacagcatgttcaaaaagtttataggattggcaaataatgttttggtaaagtcattagaaaccatacaatagctattatgatgataatttacagccgtgacaatcgtctagacaagagaattaagacattactggttccaattttaatttgaaacaaagctaaccgtatcatattaagtgccctagtcttgtggcctccagccactgggtgaaaatgttaaattcatttgctatttttcccagaagagctgacagaagtaggcaggggtaggagaaatgaatgagtcaattgtaaagaaatttggattcaagcaaaaaagcctcaggaaagaaaaaaaaatccttcctgctgcagcaatgttatccaaacagtggggttctcagtttgcctagtactgaaggacatctgataaacagcctctggtaaagaaaaaggtagtggtttatctttttaaaatttttattttatttttcattgaccaataataattgtatttatttatagcatacaaggtgatgttttgatatatgttcacaatgttgaatgattaaatcagactaattaacaaattcatcacctcacatataattttttgtggcaaaaacatgtcaaatctacccttttagcaattttgaaatatgtaatgcaatcgtatttattataatcaccattttgtgtgaaagatcactaaaggttactattcctgtctaccagaaactttgtaccgtttgatcaacatctaccccctttccatccatccccctttgtcaggcccttttcagagataaatcactggtggagactagaatgactgttaccagtggtttatctttgaagagtccacacctgagtccagattttgtttttttggtttttttttttctgctcttacaatgtaaacttaaagcaagatggactctagtggtctcaatgataaggagagaaaatagaaaggaaagacctatttctgtgagtagtatctgctaggatgggttctcaggacacagttatagacattccattgtaagaacaggtattcatttacatttgatgaatgtacaaatcaaccacatttagttttcctattgaggttttatcgtactctctccaagccaatgacttcttcacattctccttttggcccttctaaagtggatatcaagtcaaagtatgaggtagtgcatttcagaatcatgagtaggaaacaatttcaagacccagagcctaacccctttaccagcaccaagtactactgccctagacccaggggtacactggaaggtatcctggcctggaaagtacaaattgagctctaggtggggctcttgcttttcctgagaccttggccaagtcactcaactttcctgactctctcagtttctttacctaaaaaaggaggaagatgaactggttgagctctcttgcatctttagaatttggcggttttagatgcccctatcatataaaataaatctctcaattcctttaaaataaatatatttatgcataaataattatatatttatacataataaagccataaatacaaatatcaatatatttacacatatatagatacatattgatatcttttatatgtaattatatatacatacgtagcataacacacgtatagatatacatatgctatataaacaaaatatattatgataaaagtgttttgaaacagtctcccaacagcccatccaaaatagttttagatcattacaaaattatttcagggtctcagaatcaaaacacagaaaagcctcacggtacacagtagcccactcctgatttgagatggcattaatcaatgagaaacctctaaatagagggcaaccaatattgtgaaacatgctgtctgagtagaaatagcctcagaaatcatggcgaagcaacacttttcttttttcactctctagccatggtcctcttctaactgggcaccgactctttcctcctctcccagctttatccttcccctacccgccctggcgcagagttgtcatcttatgactctggaacccccttgcaatgtgctgtttctgtacctcacctcttggaggtagatgttgcagtggcagcctcaaacagggatgcttttttaggcaccatcggaagccacagcacagtgctaggcaagaatcagaggaataaaacacaatctcctggagctgatggtccagttgtcccaactggaaaacgaagttagaccacagtggtatgcaaagtgtcttctgactgtagaattctcagacaaatgaatgcacaccagtgccaaatataacacattaattttaattgtagccctctagagaggatgacctagccactgagtgaagatttcaggcaggtgggcctttctgtttccaccgaaattatattatattggcagccacctagtcttaaaattgcctttaggaaggcgtaggagactgaattggaaaatgcagccaggcaatttatgggaaaattgaacggagcgtccctctgagtaaggagacagggcgtggtaatgtcagtcctccttctaaagaccagagaaaatttctgttccacctgataaactctgtatccttttggactttgtaaatattgcacttggaattgactgtcatttaaatattgagaggaaatctgccaaagttatttgattagtcaaatgctttaaagattcattaaaataccaaccctgtgggatgaggggaggtattttattcaatgccttcctcatgtggtatctctgacatggcttatggacatcctcagtagttccaaagggattaaatgtttaagttcctggaacaaatggaaagtgcttactcctcactctttgtcaaactctaaaactacgactgcctcagtgaaacccccaatatccttatgtctaaatgtcacaatgatgatgcaggtcttgaaatatacaaagaactggcttaagctgatataaatcagaacctgaaacactattatttcactactacaaatagtttaaagtttgtaaagatgtgtaggtggttcttagttttattatctttgctgtgagtcactaatattgcttcatagtggaaactgtccatttaaactaaaataaatcttgtccacagagaaagctggtattggttgctttttagttaaaacagtgtaaagccttggtttaatagagagttcgtctttcttctgaggaattaaaacatgttcatacaatagattatctttttatatctttccttctaccactttacctctaatactaggataactagctaacatttaatgaatgatttctaaatgctaggtggtgagttggtgagttaaagtggctttctatggattatttgtcttcagaacaacccaatgagccaggtacttttgtgacttgatgaagataaacaacttgattaggtagcaaacctagttagtcatggagccagaaacccaatctttgacactagactagatgaattcattacaaagtctttccaaagggtccgtctatccagcctcttctttttcatattttcccttaggcattttctgtttggagagtacaaaagacctctaacccacctctctgatcccatgctgtaacccactccacagccagtctacactctaatctcacgcactgcaatatattcactcatgtaatccaatccttcagaaaaatccaaactcacacatccttcgcattcacaattttcttctttctcagtgtgccacatgccagactttagagcgtgtttctctccctatctgagaccccatcttcttctgcacctcaaacccacttcctccaagcaagctttccacagcacttactaggcacattacactttggggatgcacccttgtcctggattaagaaaataatgtatgctgcaatagaaagatcacagggcttagcatccagagacaggtgttaaaatcctgtttcacttgcaattttacttaatatcatgtggcctcagtgttgtcatctgtgatggggagtcattactatctgccgcatagagttgctaatagggattaaatgaaattgtgaacacacacacacatatatgcacacacacaaatatatgtatatatttatatgcatatactttcacatatgtagaatttcatttaatccttgttatatttatgcatgaatatatgtgcatttatatatatataattttgtatacccacatataataactttgaaaactataaaatgctctaaagaggtaaacaatcattactgttgctaaactgatttattatgtatgtatattttgcttcctcaactacattttttattcctaaaggacagcaattcttttcatttatatctttctctttctcagattctagcacagtgctatacaccataaaaaatgctccccaaatacttgagtaagaatattcccaagacctctagggagaaatcatgattcccatattatatgttagaaaaacgtcaaggcaagaaagtggccagccaactagccattgggaaatgcaggtcttctcattcccatttgattgttttttttttttttcaaccaggctgttctgtcagctttttccttaataaatcggacttcatttttactaatgacagtcagagactctacttactatttgtgggcagcaccaagtaggtggagtgtcgacttcatttggagggtgtcattgcaatgaaaaaacaccctgacaacttgaagatgtgggcagatataaacaacagcattgaggcggtagctcatgcctgtaatcccagcacattgggaggacaaggcgggcggatcatgaggtcgggagatcgagaccatcttggctaacatggtgaaaccccgtctctactaaaaacacaaaaaattagccaggcgtggtggggggcgcctgtagtcccagctactggggaggctgaggcaggagaatggcgtgaacccgggaggcggagcttgcttgagctgagatcgcgccactgcactccagcttgggcgacagagcgagactccgtctctcaaaaaaaaaaaaaaaaaaaaaaaaaaaaaaaaagactaatgtcttctttatcaaaagtctcctcaggaacagtttgaaatgagaatgctaaaatttaagatctagtgggcgatctcctcaagctagttcatattacttagtttcctttgaatccatctctactttaggattctccaacatgacaagtaaagacaacatggagagagctgcgagagaataacaaaggtgccaagggatttgtaaaatctatccgtgaacatgtagagttcacaggaaaagagaaagagaaatgcccttagtgtacaaaggaaagcagctaccatcatttttcaaaaccctccaaaatgattataaattccctaagaatagggattggctgaaaaaattctctgaggtgtgattcacaaatttaattcttctgttgtttcactgaaaatcgtctccagggcagataatgaaatctcttttgaacacatgcatttgattctttaccaagatgttagaggatgcaaaaccttagatggtccagaaactgaatgatgagctactgagcatgatgtataagacaaggtgaagaagatagcagagggaaatgtttggaaagaatattaatctggcactgttgtgatcctgaagctgaagagaatgctgagggacaaatttcctctggagagaggcagggattgaaaactaaagaataatgtttccctatttctgttactgggggacggacagtacgaccagaaagacaatgtacctccctgatgtggtttggatctgtgtcccttcccaaatctcccgttggattataatccccagtgttggatgtggggcctggtgggaggtgatgggatcatgaatggtttagcaccatcttcccttggtactgtgtagtgagtgagctcccatgagatctggttgtttaaaagtgtgtggcacctcccccaatctcttttcctcctgctcctgccatgtgaagtgctgcctcccccttcgccttcaccgcgactgtaagttccctgaggcctccccagaagcagatgctgccatgcttcctatacagcctgcgaaaccatgagccagttaaacctcttttctttataagttacccagtctccagtgtttctttatagcaaaacaagaatggactaatatactcccataagccagggccccaagaaagattatcatggtcgggaaacagttagtgccaagggcctataaggatgcggtcattgatgagaagaagtggtatggaagttggtaacactagttctcattcccccacacaaaaaggagacccatgagcaggaagcaagtttatgatactacagagagagaaggtgataagtgagggtgatggccagggcagaaggaggaattacagaacattttgaatcaccactagtctgttcatattacacagaaaacattcagtttacgccagatgatatcctgctgcattgggggaaaaagtcctttgcagttgtttcacagaattaaactttctcatcttagcagtatggctgttgctaccttttgaagcctcataatgagagccttctcatcttagaaaaggtctgacctagtgtgcttagagttattgtttttcactttttattccagaacttcaaaagcatttgcagagaagtgctatccttacgtagtagacaatttggtaaaatgtccttttctgagttccatggcattattctgaccaccagcaagaaaagggctcagacttagaatactgcagtgctgctgtgcttttaatgccccgtccaaaactctcaaagaaatggagaatgggcaaaggagcccacaggcctcgatactggtgctcaggaggcagtgctgtccaaaccttcagtcttaatgtagataactaataaccagatcaggatttaccaaagtccctccaaggcagagacaggcatggaagacaggaaaccctattccagcagcattatgaagagccacagccaccatcatttaaagcacagggcaaattctactccagttcgatgttttattacagcatgtgttttcctttgttttgatagcagtatatttgtcttcttaattatgttttatgtaaatactgtaataaattagtttgcatctcccaagtgcatatcaacaactaattaaatgtcagcccctcaaaagacaaaagagaatctgctttgtaaatacatagtcataaatctcttgaactacgtgatgtatgtgaagacttttgttataatttttataagaaagaataaaatcctgaataaccctagaaagatattagcgcaactatagaactattgcctctggggagaggcactgggtggcccaagaacaagcatgcacagagccctttccctaggatcctttagttataattttgtacaatgcatctatgacctctttgaaagtaaattacataatttcttgattttaatacaaaatgagaccaataagaggatattagtgaaatttaattatgttttattatttttaaaatctagaatattcatatctggaaaacttttattaaggaaaaataaaattttattgaaacagtgaattttaaacattgttccactttgcttttaagtgtacttcatgaagtctaattttttattatggaataaagttacaatcttcatttttttcttccaattaacacaggttttgacaccaatttgcattaggacaaatacaatttaatgtgatgagaccatgcaccacatcccccattaaagttggactgtatgattggaaacaactgctaattaaagcctaattgttaccttctgtgcactgttcacttaattagataagtggcttctgacagaacaactggtttatgctcagtgggaaagactacatgaccaggtactatagatggccaaggtctccagtcttgcagaacaacatggattttgagtttctgctccaattaaaactttcagttaccacagtggaaactgaattcatggcaacaatatccaaaattgtgatttgactcagcttcagattcgggcaggttttacaggacccagataaacttaggaggtaggtagtgtttgtgtttcgcacattgctgtctggcccacttcagccaagcttgtctgagcctccaccatatgtgatggttgctcaaaaactgcttctcctgagtccacttagttcaattttcccaggaagaaacaaacacacacacacactcatactcctcccatctcagatatctaagctacgatttgggctggataaactggacaacctcatctcccacccactgtaaccacacctctctgtgccaaacctcagtttagtggccaggaaagcagagacagcagggcagagtgagttgggcatggcccatatatatggttggtgcaggttcaaacatttttatttaatttggggcaagcatcttttattttattttattttattttattttttgagacagagtcttcctctgtcacccaggctggggtgcagtggtgcggtcgtggctcactgcaaactccacctcccaggttcaagcaattctcctgcctcagcctcccgagtagctgggattacaggcatgcaccaccacgcctggctaatttttatattattagtagagatggggtttcaccatgttggccacgctagtctcgaactcctgaccaagtgatgctcccacctcggcctcccaaagtgctaggattggtgcaaggatctttatgataaaacttaaggcaggaaaaggacaaatggccaagatgattatatcacaaggtataagattaaagccatggcaacacaaggagataaagtagacaatgtgggggcattctacaaaaagagataaaatgtcttggtacaagttaggttgattttgtacttcaggggaaaactggcaatcagagtatatgtattttccttctctgcacacctccacttggccccatcttgagacagctttcttctctactgcttattctgagaatagctttcttctcccttgcttacagagccagcagaaactgagagaagaagggctttggtacatggcattaggtgtgtatgtgtgtgtgtgcatgtgaatgcacatgtgttaacctgggaattatttaacttctatgagctttggtttttccatttataaaatggagaatatttctaatattgaccttacaaaactgatataaagtctaaatgagatgatgcacatggaatgcttaacataaaacaaggcgcacacactcaaaaaaaacccaatggtaattattgctattattatagtcaatatataataattggacttggttggaatggaaacaaagcatttaactaaagtactgtaggtattgtgtgtgggcattagacattacacatgtcatagatattgtgctatgggagatgcaaagtataacatatggtccctgacctcaatttgccttcaagggtcagagggggaggaattaataaaccacaggaagaaattgatagcctggtatatattctccaaagggaaagagttctccaaatgggagatgctagactggaggggtataaactgccttcagaaagggaaagaaacatgaaagcattttgccatctctcccccgagaaaggttgagagacaaaaaaaaaaaacctccataaataaactgtttaaacttccctcataattcagtgtgtctacaaacaaaaaagtaggagcccctatgcaaaatgggaagtggaaagtgggtcaggcaagcagcaactcacacactcctagtggaagccatgaggagcatcacacactagactatccagttggggtgacgtggaccagtcactgggacttggcttccacgagaaggtagctcaagaagctccctgtggtaaaaaaaaaaaaaaaaaaaaaaaaaaaaaaaaaaaaaaaaaaaaaaaaaagcattagattccagctactaggattacaggtaaattcattaggggttggaatggaaacaaagcatttaactaattcacactagtcaaccttcaaacacacacacacacacacacacgggctacatgctatttgttttttcagaggaccttttcagagcaagttgggtgtacggtaaaaatctcattcctcgatgcataggaatacagatgcagtgaattctgtgaagctcccacatcctctccggtttcctagggtcctactctgaccaattcagatgaaaattttgtgagctaataaataaataaataagccacagcactttaaatgaaaaaaagaatctttcttaaaattatattaatatcaggcccggcgcagtggctcacgcctgtaatcccagcactttgggaggctgaggcgggcagatcactggaggtcaggagttcaagaccagcctagccaacatgatgaaaacctgtctccaccaaaaaatacaaaattagccaggcatggtgatgtgcgcctgtactcccagctactcagtaagttgaggtgggaggatcacttgaatccaggaggtggaggttacagtgagcccagatggcaccactgcactccagcctgggcaacagagtgagtccctgtctcaaagaatatatatattattatcaaattgaagtgttttgaaggtgtttgcagaaacaacagatgaaagaactgagtgtgaaaatatcacgtgaatcaataggaatttgaattatcttgaatcctttaggcttttcatgccattgcacacaacaagctaaatattctaatcaggtgaaaattagggcatcattttatcaggtataaagccaaatatttggggcactatctcatcttaaatcacaccactgactacctaaatgtcaataattcgtaaaagcctgtattggataaaaaggtcagaaacaagttttcccctcctggtcgggtacaatggctcatacctgtaatcccaacactttgggaggctgaggtaggcagatcgtgaggccaagagtttgagaccagtctggccaacatggtgaaaccccatctctactaaaaatacaaaaattagccaggcatggtggcacatgcctgtaataccaactactccagaggctcaggcaggaaaatcgcttgaacccaggaggcagaggttgcagtgagccgagatcatgccactgcactccagcctgggagatacagtgagactccatctcgaaaaaataaataaataaataaaagaaagaaaaaaagaaaaaaactcccctccaaaccttagatttaatattttctcaattcagttaatgcaaggacccatgagaagccattttacacctcaaagtttctaaactcagggaaattgacaaaaaatggtcatcaaagaaagccatatttataaacaagcaaaacaacttagtaaattttttcaaaaaacaaatgagggggagagtcaaagtatctgaaaagcatttgaaaaatgctggtcttgaaaaaaaaataacaatgacattttaacacgttttgcaacatctgtccttgagaaaaaagggtcagttttcattaaaaaaaaaaaaaaaaaaaaaagacagtgtttatagacctagaaggtctttcaaacataatggcctaaaatgaatgttttgaaggtgaaaataaagtgcatataggattttccaaaatgtctgtgctgaatgtttgacatcacctagcccaaacattgcatttttctaattacaatagttcaaaaaggttaaatgatctgttcatagctgcacagtgaaccagtgatttttcttacccaatgatagaagaagccagttcctccatctacactacattccactaaatcacatcagctcataaatctacagagttcacaaaaatgtttagtgggattgtgcctttgatttacagaggaaaaaaatgtgtttttctgtaattttctctagggactctcacttcattaaaactttaatttccaagataagttatccaagatcatttccaaggttaatatagcatttgaaaaacataagtcacctctcttcattcaactaaggcaacacatagccagcaaaaagcagtgacggtgagagattcgcaaggggaaaggcagaatcgctccactcaaatctgttctcttttttcatttaatctgtaatcagaaagcaatgctgacaagccctttgaggtcctggagtgtgctaagacacacatcaagtatcactcatttaaaaataaaaggcttgttgttcaggagcatttgtgttggttgtgttgctattttattttctaattttcatctccctggagtcaaagtacacagcatcatgcttccataaaaacagtaattaaagcttttaaaatatacatattagcagatcacacactcctatcagtttatcttgtgaatatcataaataccatgcacacaacagatagaaattgcataaacagaaaaattctgcattattcatgaactgtagtttgcttttcccttggctccatgctactaaggaatatgtgtgcttgtgtacatattccctgttaaaaaccacatctttaactacaacatagtttatgttgaggtattttaaatgtgaggattattacattttaaaatgtgagtatattgcagttgagtttatcctacctcacacttgggaatgaaaggagatcatccaagacataaccaaaatattattgactcattagtaaaaatccaaagagagtatttatcaagggtgggtcatattttcaacagctgtccccctgttgaatatagatatttcgtaacacaaacaatataaaaagacactagcaaaaataaccacaatatatgaaataggctcgttgtattatttctacccaaatttaaatgattcttttcactccctccagcagaatcacactccaaaagtgaaatttcttgaatggagaatttacaatgagtttcttgggaacagactcagagatgaaaacagctatgagaggtactcccaagaatacacttgcgaggacgcgaggaaggcaggactgggtggaggggaaagctcaatggttccaacagaagccttaggccaattctacaaggagctctagagctgagctgacccttcagctttgtttccagttgggtatgaggttccttatctgggtgacagtttcaatcaaagcccaaaccttggggtatttgtaatgaaccaaatcctccacttttgtgaaatcatgaatccagaaggagacatcctaggcatattatttagaattttgcaagttagtatcagaataaatataaacagaaacagtcaaaaactgttggtgtctgaagctgagtatgttcttcatgaattttgcattttccgcactatacaataaattaatgtacttttaaaaaagaaagaagatttgttccagttgaagccaggcatttgtacccctgcaccagctagacagggctgtacaccagcatgttaatctagggccaggcaggtccctttggctgagagcatgagagcaattctccagtgagaggcagctataagctatcagttgtccattttctcagcatctgggaatcatgcttctgacttgaagcagggagctaggaagagtaccatagtatccctacaaaggggattttaaattgtagcaagcaccaccaattgcaatttcaagctagagcaatcttgattcaaacttttaacatctacaatagattaagggttcctagccaatgaaaggcaagcacctattaaacaaaagagagaataaacaaatttttaattaaaaactgggaagagaggaaagacaaatatatctttttctcatcaattcatttataaaaacaattgttctcagcacttaaaactataaaaataaaaaattaaaatacaattaatattgagccttttctcattctagtaataagtaatgtcaccccagatgaataaactaattaaaatatttaaagcccatctgtttcattaacagatgcattttaaaacaaatatagttatttttattggttacctaaatctaaaattattttgatcaatgatactaatgaaaatctaattcagaaaaaaaaatttttaatttatataaatattttcattatagagaggtatgaaagagtgatcaataaaagcctttaaagtatagatatattactttaagttctgtgaagaaagttaaatggaaataacagttcatggaggaaaggaaaggatagaaaaatttccatatgttaaagaagagattatttatgtattttaaatgaatagcagtagtgaacaaatcacggtagtttccagatataatcatatattcttaaaagagagatgtaccatttttgttctaaaatggaaacatttacattaaaaactacataatttgggactgtagtatttaaatttgtgatataaattttaggcttcatttaaaaatgtgcaaggggacagatagatttccaaaattattttgggggtgggtagtgcaaaagcaaaacagctgacagagtacctgtttttaaagtccctcccaactcttagctacttattgttataaatggtgtgtttcccatggccctgaaactattgcctatccagaaccttaggactaccaacagaaacatgtttaattaaatgtcaagaaagcattttaagaaccctacccagcacagtaaaggaacaaaaactgatcacattaaaaccacgtaggacagagaatattggaaaatgagggggtttcaaggtagagaaaaatccaactcaccaaactccagaagggcaaaatagtgcatggtatggagtcaaaataatcatagtctcaattgtagcgtaagccgaatgcagtattgtttttattgtcatgaggtaactcttgtcttaggcggtgaacaacctcttgggacgaaagacccctgggttctctcttttttgcaacaactatgaccacctttgtttatttctctgactgccctcctccctttattctcattttttatctttctatctctctgcttaaagaccccatcttagtaaaaaagaaaatattatagttataatgcaaaagggaacaacataaaaatcactcattattttaccaagaacaagagacagattggccaaaataactttacaggaaggaagagttaattaacaacacactctggtcagtctcttaaatccctatatctattttcattccaaaaaaatacatattaataataatatgtgtgtgatttaccccactcttatctaagaaaacattttaaagaacattttaaacaacagcatttaaagaatgccttgctctgttgtaaatttgcttactcccctcatcttagtcagaattgatgtgttcatatgatcactttactactttcaaagattatttttgcatctttcattttagctcaaaattaatcagatctttggttcaattacttccaaaactttttgaagttagagttaaggggggaaaaagccaacagacaatttttccctgcttagtacatcttttgctacttggctacaacaaacacacactggacccttgtgtgccaggaagctggtgggcccagagaaagggctggctctcaaacctacttcacattttaattttgttcaatatattttcaatgaaatttggttgctcttttaaaccctaactcaaaaagagttcaagatcagcaaagttacaaacagctttattcataaccagaataatttgccaaacagagcagaggagctgggcaagcactctagatcgcttttcatacataggacttcaattctgagactgccttttgttactaaagcttcttggttcaatttgacatgcatataattttgctcaatttttctcgtatcaatcctaaatgtccattccattaagtcaagctccctgagtttgcttaaatttccctttcacagttactcagttgttttccgaaagagcacttagggctccttcgtttccaggttttctctcattagaggacgttagggaataaacagatgaccctgattccaattccccaaccagttccacaactggtctgcccaaataggtgatctttgtgcatcttattccatactagttcccactgacttccttctctgccgtctcaggcctccttcaaaacttttcatttgtttgttggtttaatatgacatgtttttttaaagaactaaggtaggtcaacctgtttcccaggctataagcaaatggaaggagagtatcaaccttgagcatcacacaaattcatcgaacacagtaaagtctaacatgcaatagtcccagaaacttaccaaagggatctcaaagcatctctgaacctgaatccccctgacctccacccttcacctcccacaggagagctctgagggcacagtgctccctgggcagccctgtccccctgctattctgttcatttcagaatctgcctttctctgcctccatctttaagcttctgaaggtgaggaaccatatctctcttctccttctccttctcttgacaacttcagagctacaaataacatactctgggcacagctttggaaatatgcattgaatgaagaaaacagggaattatgattctaacattattatcagattaacaaggactaattacaagtctgacaattgaggagggcaaataactctctacctcttcaaaatttacagatatcctgacattacagccatctcaacacatattatgagttgaattatgatgggcttctaccagcactgccaagcatagcttacaaaaagctttgctccgtaggagtctattgtcaccaggctgcatgttgcaactaaatccaaataaagtctgtgactccacttccccaccccccacagtgcaaaacacttagctttctgcaagagggacagaaaagtaagctgaatgctgccagttgtcagccttttttacatactgtggcaactgccacttttaaaattatacaacaccttgaaagaaataacaaagatggagatttcttcgaaaacagctctaaagcagcctgctaagcaggagattcacgcctgcagccaacatttaccccgtctgccttgcaatttcaggatcagtatacatcaaatcaagtgaacaacccagggaattctgccgttaccttttagaaacagaataaatattaacagagctttacttctttccaccaaggaggactatatgttaatacagtaatttacactggaaaaaatataaatgaaagggtttagaacctcataactttaaaaataacataattcctcctagaacattcctttcacttgtgattctcaaagcactttgcatttcccagctattggcagggctggaattaggatcaaagtatcactaaatggtaggtgaaataaatgtgaagctgattttcaggagtacaggaatggagtcatcaggcgactttaaagttaagaatctgttggagcagctgccaataaatcaaggcccaaaggagaaagttctttggaaaccttgaaatattgtatacatttagataattattgttgttgtcaatgttaacgaaaaaagcaataaatcagggagatggcactgatgagtgaggagaaatagactcaacaatttaaatggaatcattccttatcctccttccccaacaagcagcctcaacagtgtttgcttctgcctgccaacagccaagccaagtgagaaaacactatataccctccctatatgtcccagccatcagttaccagcctctttagatggcactaatgaaaaacaacctgtaggtcttcctgtctcctttaactaggagacagctcagtctatggtactaataggtattactcagatgctccagcctcaagaatgaggaagactgatgatacctttggcctgagaaagcctctgggtgagaattcagatcatcactcaggagtcaggtcttacagacaaggtggcccctctcctgaaatgactgaccagttgaaaagcaagcatcgagtccctccgctgcagcacattatttggccttagcctaaccttttcctttactgtcttgagttgcactccataacttgtaatacttgagttggctgcacttgcaaaattaacaatattggtccatcgctgttgctcaggaagatcctttcactctctggacttgctcattaattcccttcctttgccattaattactttcaaccaaatgatgaaatgttgtcattttttaaagttctgtttattttgaagctatcacgcagtgtcatttttattgtctccttctattcttactttgaggctctaaaccatcatttaagattcagaagcttaaaaaaatatatacaaatgtatataggttttccttcctcaggatacatcattgggtggctccaagaaggatccacagccttttatgaaactatttgagcaacttggtcatcacacaataaacacaacaaaaatactcattaagtgtgttaaattcatcctttaagtcataatccctggaatgccatttagtttcaacactcaccactccctacagaagctaggcaaccatctggaatgatctcctctcactgtgttgttaagttcattatgtataatttatatttctagatcaggggatctcaaccggaagagatatttggctactgctggagacatttttcattgtcacaacttgggggctgccactggcatcatgtgggtaggggtcagagatgcagctaagcatctgataatgcataggacagccccgcagataaaaaattatccagcccaaaatgtcagtgatgtcaaggttgagaaatcttgttctagacgttctatcttgcctaagttgctcatatttggtatggaaaggccatttactcatcagcctgaagagttcccataaaacctgaaagaacaactcacctatgaagaaaggagtgggaaacagattcttttttggtgggaactgaatgtcaccacccacatgctgtgaaggagaaacatatcactattcactcttctaggaaaattaagtttaaaatttcacaatttacctcttcttttggttcatatgcaaattataaggtactaaaaatgggagacactgacaggttaattgctcccactcttctggtccagctgcacagagctgaggcagagggagcacagagaagtgagagaacctccaaggtcagcatgctccagcactggatacatcagcatatcatgggttttgagttagaataactgataacataacacatgtacttgaagttcactgatttgattccagctttttaaaaataatcttttaagcagaagctggcactgctttttactcctttatttttttctctgtacctcttaaaaataaagtataaatctgacatatgtttcaggcaaattggctcagaactcagaaaaggtaaaaagaactctcctagacagcctatgttcccaaataaaaattatctctagttcctatgcctgcatcaagcctttctaattaagtgatatttggtcctaacagccaggttaaaccaacctacctttatgtcagatctgagccccttccccacagcccacaaccatatttaccatccacactactgtgtgtgtatgtttaggctatttatataattctgattagaacattttgtatccttcctgagataatatgcttttcaaaagtagactgtgagtttttgaatcatctgaaactcttcttttatttttgagtgaaaaagggaatagggacgacgctatgtacattattttaggcacacgtttcctcttcttaaagcactcttctcattcactgatgagtagcggttgactttgtaattttcaagtggccaaagcagatggagtgagagaaagaaaagtcagagacagaggtgcagctagatccagaaatgtgaaatggatccacaggagaagatgtgcagactgagaaggtcagtatttacagaagaggcaagagactaaagggtgcatacagttaggcagtggtagaaagaaaaacaaaaaaccctatgaaagcatggtaaaagaagaaaggggattcgcatcgctgggatgtgaatagaatttgcaggtgctatgcctgcctctcaatccagagcccaaatctatttgcctcattctatacctctgagtagctctgagataacacaggatgaggtttgggaaagccacatcattctaccagatagaatgcctggcttcaccatctactagccagatgatcttaaccaagtcgctcaactctccccaaactccatttcctcaaagtggggacaatcatttattcacagcaggattgaggtaacataggtaaagaatcaagggcactagagaatgttacatggaaggctctatgatcacatcacgcggtattctaagtaatggagataaaacattttaacaatagtaaaagcaaaattgaattataaacattgctttttttaagattggcacatcataattttacatatatgtggggtacaacatgatgttttgatacatgtgtaaattgtataatgattgaattagggtgattagcatatccttaaacacttattgtttgtgatcagaacattctaaaacctttccgatagctattttcaaacatacaacatatcattgttaactagtcatccaactatgcaatagaccaccagaacttattcctcctatctaaccatagcttagtacccattgaccaatttttcaccatcctcttcctcccctgaccctccctagcctctagcaatcacaattctattttctaagtcaatgagaacaacttcttagattccacatatgaatgaggtcatattgtatttgctttcctaaacctggctgatttcacttaacataatgtcctccaaggttcattcatgttgccacgaatgacaggatttcattctttcttatgactgaaaaatactccactgtgtagatgtacattttctctttccattcatccactgatggacacaggttggttctatatcttggctatttgtgaatagggctacaataaacacaggagtgcaggtatctttttgacatattgttttcatttcctttacatacatacccagtagtgaacattcttaatacaatggcaatttaaaactttatgagctaaccactaattcccagaaaagaaaacttgatattctctaaagaagactttaaagcaatgcaattctaagatactctgggagtaaaaaaataaactacatgcacacacagttttattgctatcttcttccatggagaagaataagccactatcaaaacgctcatagagacatttctgttctaaagaaaacagtagtcaagaatttaacagacccaatctcagtgttacaacaactgtgcagaaaatacctcaatttactattagctaaaaaatcatttttatattttaaaagatcatttgccacaaatgagatgaataggcatttcaatgctcaagacattacatttcataattattaatggggatcaaataaaagcccactctgtgtaattaaattggaatttaatttcccggaatagtggcaaacatgagaatcagagaaagaagatgttgactcagaaaaagaaaagtaattaataaggatgtcagaagtcacccctgtttcacacaactccgcaggcagagcaacatgcaaccaacgcagcaaatgtgaggtccaccggtgaagcgctacagctgagatggccccagctgaagtgctgccttgatgaggggagcactctgctgcagaactgtgccaaccagagtaagctgagaaagcccggaacactggtggctgggttcaggaccagcccaactccatcatggctgtgcagatcaagcccatattgcacagtaaaaaaaatatgcacatatatttacaaattagtattttaaattgtttagaaaattcccctcagaagccaaattctgcccgtttcaagagaggactctctcttgtattcgtgtgctccattttttactagcacaatctgccttgggaccttcatcaattttgctttgcccaactctgcaaatgcagtattgattccaagaggaaatcaatctcagcttgaaagaagatctttcatcaaatccgtattttctcctcaatgccagagctctgcttgaataaaaagccctgaccacaaagcagaagtttccttccatctgatttgttcagcaaatattactgagagctagagctttgaccacatcagaatagaccttgactccacaagaaaagggtctaccaggcccacgctggacctgcagcacgtgggagagcacagctggccatgggaaattagaatttgaggggagagagcagttttttgtttggaaactgtaacagaaataggtagaattcctagttgaattgtggagaactcggaatcttctgggtggttgcaagaaaacttagaaggaagaaaatatcaaatattagaggaaaaatcccatcattcaggttggtggtcaatgatggggttcccatcattgaatcccatcatatttatttctatgttaaagggccaccaaattaagctagggtgccataactctcaccctttttaatctttttcttttcgcctgcatctatggcacatccacttaatgtcaccaccttggggtgtttttatcctcatttttatgcttactcataaaacgatacactcatatatatgcatttatatgaatatgtagtaatataaacctgtacactcttttcattttataaacctaagattataaattgctctcttaagagcaaattcatttttaactcatcaattttcatgtctgcataatattcaaattgtcctttttatttttaattttaatttttatgggtacatagtaggtgtatatatttatgcagtacatgatgtatttggataccggcatacaatgcataataatcacatatcacatcagggaaaatggggtatccaacacctcaagcttttatcatttctttgtgttacaaatattccaattatactcttagttattttgaaatctacaataaattactgttgactctagtcaccctgttgtgctaactcaaattgtcctctttttcttttgacattttctcttgcttcaaagcagctacactggttggataaaagacattttctgtttcctgtgtgggcctttgggtgttgcgtccactcccagcatctctggagtctcccattgcctgcttacatggaggtgcattttcttgccctacctcctggggctgctacctccatgcaatggttaccccagagacagaagaaggacttcttcacccaggacttgacatcaacccctgctccctagatttctactgctgagtgaaattcttccatttcatatcttgctaaagttagttgtagaattgaaccttctgagcttgtggaaattggtttggaatttggatatatgatacttccaaccatgaaagaaaaagtaatatgcttcaggcagaaatttacaatgtttactttttaacttcctcctgaaattggaaggctggattaccattttggtggggttcagctgttgaaattgatactaaaatatactcagtttatatatctcaagccccaattcacaattcacagttctgaattctattaaatgatcaaagtgaagccaataatgacaattgaaaggcaaaagattttcttttagttaagcctgagacatgttcagagcttctcaagaaatatgtatttgtgaaacctaacccagggacattacttgtattttatagtgcggttatggttgaatttaatcttgttaacagtagcatttatactaataattatcattggaagactacatttgtataagactaagtataatacaacataagtgtaagtgatgtaatagtaagtgatgtaataattccatataatgtagttttcatatgataattattaatatgaataataatattccagtaagtgaccttagatttctggatttccattttcccttccataaaagctaaaagttggatgaaaattgaatttctaaaatgtcttctgtatttagtctttttgaattctaaacttttctgctcatacgtcccaaccctgtaagagaaaagtgcttttacttgagaagaggcatctaatttttaatcttattttagtaattctcttaacaaaaatatgtgattatatttttcatttaagaatggaaatgaaaatgtcatataagcaattcactaagaagatagattccaaagaaaaaatttctaaataagtctcacttctagtcatcaacatgataaactctagatctacacataaaatccaaaatgtgtattttatgtagacattccttttaaaacacagaaatttaagaaggacagctacatatcttgaagtttcaagacattagatatatttttacttattgtactcgccaacatacaattcaaaacactgcagacggttgaaatactgccattattctccttagttagtcttccctgtctaatgcacaaaagtaaaatatttgatcacgttcttgctttaaaataacagagtttttcaaggcattatatacatttttcaaaagcacattttctaggttgctgtaccttctcttggcatcaagagtcacttcacatgatgtctgcaagttgcatttactaatgtgctccttattggattcgtggcacgcacaccttccagagcataagattatacaagttaacatcagcccggctggctcttactcatgctcatgagacaggcctgttggtctcagctcagcctctctttagcggtataatcttggacaaatcacttaatctccttgacattcctcttcctgtctgtaaaataaggaaatgcactacacaggggtattgagataacaggtataaaagtgaatgacagtttaagagtactctgtaaataggttatggtagcattaacattcttcatgttagaaggagagcggacatacaacagattctgtgaaagaatgtttcccaagagcccttgcttgcttttcaatgttcaactaactctaggtactctagcaatgcaaataattaaataacagaatatttacaaacatatctatgtgattttaggcaaactgcattatggagacaactcttatcaaaagagaactaaatttggggattaagtgattttttttcagatggaaatttaatgaaataaatttgaagccacagttatctaatgaacacaaacccaccaataccaaaggacggaaggttaaattttagaaaatttaggtcttttaagaaaactgagtgaaagaagaaactaatttgataagatgataaatctaaacccattttctatctctgctccacagaaagggatccgaaaaacaagctagaatcctgtccttaaggagctgagtacttgagagggagaaatttcttttaaaaggagaccgcatataatagaaacatgcacagccatttcagcctttcagaatatatgtttgagggctgggttgatatgaatgacatcacacaaacacacaaacacacacacacacacacacacagattttaagtgaaaatgtgatcacaagctctttgaactaacagataatttacaaagaggtgagatgaaagtcatgttgaagttcaattgcaaatgtagaattacagtgcaataaacatttgtcaaatttttaaattattaattattttatgtcattgcttaatttcctaactagactacaagttccttgaaggtaaaattcttgtcttttgtatttacatttccaatactaactaaaacaaacttggcatctaataaataagtgtccactgattgtctgaaaccacttaattctgtagacactagaaattctatcacagattagaaaatgattaggagtcagaaattgtttatctttagcaacaatactttttgattctcaaaaactggtactattatgaaacttattatacacctccaaatcctccttaccccatacagtcttcagagactatgaagctcagtctcactctgaacacagaatatagcaaaatgcctgtctatagcatcgtaagtatgtagtaagtatttgctgaattcatccactgctattcctagggtttttcgaggactttgtttacactgttattatagcacttacacttatgtgtattatacttagtcttatacatgccatttcccctaatttgattgctagatcttctggcagggttcattttatattcagccttgcactagcacagtgtttggcagacatctggtcaaccattatttgtttgacaacgtatgtaattttgaaagttgaaggcattattaaagacatgcactgcagccttatatcaaattaagaaaccttgaccaatggtttgccatcgccagcttaaatacctccagtagtcataagctcctaaggcagtcctagttattacagagaagggcatccctagctgttaaagaattctcttttgagctgaaataatcttccttgtacctccttcccactggttgtaactgttaagaaaaatgcagaatagcttgttctactacttctagaggatactcttttaagatacaggtcagcaatcctgtctcactcaggatgtttcttccccagggtaagcatcccattctccttgagtagtctttgtggttatcctgctcattcttcatgaacacacactcctctaatcaatgtccttctcgaaatacagcatcagaaatgaacatagtcctctaagggaatctgtccagcccgaagtgctgattacataccaaaatccaggtcaaggcctccattaacgcagcccaagaccctacttaggagaaaatggaggaaatataatgaaatcatattttaagagactatgtagaaataagctctcaatagaagtctttcatcatctatcgggatgctatctgggtcagttaaactatcctggaatatgctagctttcactttgtttaaaacctcattttctacagttccaaatataggtttcaaattacctagagaaaaatcaccccagaaaaatgctaaagtcacaagttcacacttttaccaaaatttagtatgagtgggggcaagggtgtatgtaagaccactttactaaaaaatatggctggtgactctgaagcaacatcagtgactagctagacatagagacaggtatctggtttggggaagagggcaatgcacagaaactgggagcttgtcagttcaagagtgaaaactgtcctggctactggagatccaaaaggcaccaaaattatttatttgtaaatcctcccaattaattccattttcagtgctgcccctgggatcactgcaagtactcttgtcagctttgtggtttaaatattatttaagaaggactagaattttgttaggctccctcttatttagatttgatatgatagttttattctgcttttttcctctgcatggtgacagttatttacgatggcctacggctttcagaaggacttttggtctatggctttcagaaggactttactccacttttgaaacacttaaaaatcaacagggtctttgcctatattttctatctactgtcataattcacatttatcctatctgtttcaatctctgtaaatatctatcccaaacgttgctaccacagtttaccagcataacttataaaatgttctgccctagagcccaggagtttgaggctgcagtgagctattgtcatgccactgcactccagcctggatgacagagcaagacgctgtctcaaaacaaaacatcctaatttagaatattattatattaatcttttttagttttcattctgatataaatgacagaataacataatggtaataagaacttgaattgagttacagattaatcaggatggtgagagatacgtctctacagcctctgaaatggcattatttttctatcatttggcttctcttttcatacataaacacgtataaacatattgtaactaataaagatatttggttgtgaaaaagtagaaagattattttcatcatataactttttcctatcattattaatagtaaaaattaaataaagaaaacatatctccaaaaggctctctcacattactatgcattccaacagcccttggatgaaagtagctctcccccgtattacatcggcagggtctttgcagggcttgcaaagaaacaccagattaaaggaatttttagtgtaaaaattagtaataaaaatgtcatttcagtatcagatctgtggtggagaagtgatcttttcctaagaaagaagatatttcattgtactgtgtaaaaccgtgtgctcagggttataggggtgtcaactttttggtgcaccatcatgttatagattcgaatgtcgctatgctgaattaatagatcccatttatcattaccacaagttgtcctaggacaaaaagagggcaacattcagggtcctatccaactgaaattgacaaaaaaaataattttaaaaagaaccaaggattgctgaagacagtatttctagatggtaacttgtgtcatgtataccaaatagattttaaactattcaatatgctgctaagtatcctcatgtctctgagcctaaagaaactatactacataatgtatttccatcaaatataagacattatataattactcaaacattagctttagttttatccctttgagcaaataccttgatgaacaataatcatggctgtcttaaaagatgcctcgaggaggaaatgtttaacacactgtaatctaagttggtgcactgaactgcaacctcgtcctcaatgctgagccataaacattttactctctgcttcccttccttcacagaaatgttctaaatatcttccctatgccaagcccccaattcccagcagaattccctgaagaggagcccttctgagggtcacagtcgcagcctctccccaaaacagcacatgcttccccacgtctcagccctgtcttacctcttgatttagaaagctctcctcctccacgagagctcctcctcctgtgagttttgtcccccaggccttcagagctctgaaacctgcttccttctttgcagctcctctttcaatccctctctctccctcctctcttcactggcctttccccttagcccatggacaaggccttgaaccccaaaaaaatctttcttcaaccctgactttcccctaaatctccagtacttcaacatccacctcttcaaggtgacattgctagacagagtaactatacctccacttttaactacccgctcattcagggctagaccaggctagccctccggacaggctaattatttcaagccctttcaaaccattattttatcttcctttattttatgctgcactagagaagacaatttttatgaatgcaaattgtatgtctctccatcagttcaataagggatttatttcatgaactaaacctatgctgttaactgatttagaattgtccttgattttgctcatttccagtcacctctaactgataatattaggtccctgagtatacattaaaggcagaagaaaattacagattagaaggctgattcaaaaatgtttataaaaactgttttgactctcagctctgcaaaatatatcttctttttggttttctattgcaatattacaaaccagactacttcttggagacatattaaagcaattaacatttaggtaatgaagtaaattatattttccttgaaaacaagattctgccatgcatcttttcagttacaggatgtacatattgtaactgaccacttgcagaaactgtcattgagatagtccctgagctgaggtcgtggccgcatatttattcattgtttcaatttgtgaaagcatccttggaagagtttttacctgtccacttaaagttcttggcaacttcagttgacatcgacattgacattgaattgacattgggttaattatactttggttcacgcgtgttgcaatttcctccaaatgatagtgcaccaggaagtctgccagctggcccgtcccttacagcacacttcctaagatgctatatgtggtggttacaaaggtgggctcttcagccagatggcctgggtttgaatcagaacttggtcatttattggctctatgatcctaaggtagccatctgacttttccatgcctcagtttcctccactgaaaaatgaactaatgctgaaacctatctcactagagtgttgtgaggattctagctaatagaccaggaacaaagaaagagctccataaataatagctagctatgctaattttaaagttatcccatttatctcctaaaactattcttactgctgtctgtataatgcctatttcaatattcttattttcttattctattcaatttttcacaatagataatattttggaatgtaatatttttgagatgttcttcaacatttcagcttcaatacttcagcaacaatgcttcctcctggctttcctcttatttttctgaatattattcagtctccttttgtaagttctgtcttcatctctgaaatctgcttattcttccagtttttggccttttagttctcattgtacctgatctctttagggaacatcatctactctcttacaattaccactttgattatgatggttctcaaatctatgtctgcagcccacttaagccaaatctttatttctaacactgtcagcacattttctcatgaacagccaccagaattcaatttatcagtttaaccacacattctaccttccttcctctacccccttttcaaacctctcttctttctgtattttctacagaaaatggttaatggtaccaatttttaaacttgacatcctagccgggaacattaagatcatatttaactccatttcctcccccaatatacatttaagagccacttttcctatattctatcaaattcctggagcttattttcaaacatgactgcctgtctagtcctggccatttttcttcccagtttaatatttaatggattcttatttttctcaaaataaagcctatattattattataacactcaagccctatctctttctgcctcccattccatccaactagggaatcctataggctactcctttagggctgttacatactctcttgcttcatggaatttttttcttgctttttctcagtttggaatgtcctagcctatccacctgccaagggagatctacttcttttttcctccatgcaatgcttaaatgtctcatctttcctaagcctctcttccagtcaaaattaatgacaaagatttggggcacttgcctttattctattttttaatactgggtcttcctctcctactatgtaatctctctgagagcagacacaaaattgtgtacatttttgtcccctatgcatccccaccctgatgtctatcacaaagacctgtagtaggtattcatgtttcgcaaacataattatgatgtgtacaccatgaatattactctacatcacacaactctatgcaacgtcagtcatacatcttctaatgcaaagttttactaatacttatctattaataaaactacattatttatactctgccttcccaaaaggacttcttgccacgtagaataatagatacaggtaatataaaaatactaagtatgaaagaaggagagtcctcagtaaaggggatgaggaaatgtaggattctgttcctcccattgtgttcgcagaataacaggtgggtactttcaatcaagcatacataccatctggcgtcttgtctgctgagctacgtaaaccacccgcctttgttttacatcatatattgcatgcaccacatttttgactctcagacacttccagatttatttattttaaatatgtttaccaagggaaactctgcatatgatactcttcattcctcattgaataacagccaagttttcttattgaacgtttatgttgaccaacattttctttcatgtttgctaactgtgaaatggcaaaacggaaacatgctcttttgatttcttcctcatggcagttttccctgtttcaaagatttgttttcatccaaaatgaacgatgttaactttatcccactatatttatcctcaggtatgttggacagtttttcttctccaccaacacaaaatgtagtttctagtttctcaacggtagctttaaaaaattaagatacattcctatgtggtagggggtgccatttaggaaatggtgaaaacgaaacaaacagaacactaaagtcaatcaaaatctcattatcttcctctctaacactgaaggtgccctctgccccttaaacttactcagaggtattaattgaatagcatatgattaaagaagcttgaaactaaaattgcctaatgaatacttaatatccttttccttgagattgaaaacaatgttctcctatccattcattcatctatcatattcaattatactaacattatctgtactcactgatcctttcttaggcaccaaaccctttgctaagttttttgttaacattatctagtttcatattgaaagtaccccgaggagttggctataataattcccattttacagataagaaagcagaggcttagggaagtcaagaatcctcctgttattgcacactaaataaatgctagtatcagaatttttgtttcagtgattctaaaagtgtgctcttaacagttctgctatactgtcttctaaacatagcacacctctgtcctatgcaagctgaatattaaaatataaaacctcctcttccattgttaggtatattttaagcacagtctcgaatatattttgggttgatttaaacatacagttctcaagactactgaatgttgtcttctctcctcctaacatcattttattttaatgttcctttatttcatattctcacttccttctgtattgaggaagcagaatatctgtttttcttggctgcatcttgaatggttatgcaccccagggaagatgtcagagtccaaccttgccctaacacgtagaagacctagaaggagccagtgctgcctgggagttctcactcacagcagactttgtgagttttgtggataccctacgtttgctagactccaaaatcttacatgattacattaagctctgttgtcctaatttcatttaaatcatgcaaccaacaagagtattaataactaatgtttacttagtacttaagacatgcaggactccatgcagaaaatctcacatgacttttacaacttcatccccacaacaagcttacagcttagaacgactattatcaccgtttcacagatgatgtgtggcgcagagacatggtgatgaataggagaaatgaacttatattttgtgggcactgtccattattctttccactatttcttgctactggtaagggtaggtataaaagatcctaaagttgtgactaatgaggattttcatggcagacaactgcctctacctcaacatgggctgctctcttggcttggaagacaccactctcctggctgtcctcttccctctctagtccctcctcagcctcctcttgtggattctccttctttattctacctcaaggcttctcaggccttggtcatggttaataaaataagtgttgcatttccaacagctaagtgtgtacttaccaatggctataattggagatttaggatttaatgaagactaaaggagttttaattccaaattttccagattaactctgaattgtgacagtggacagatcagaggtgaacttagggtgaattatttgagcatgctgtggaaggcttcctcaaactgaacagccttctgttattcaattcattaaatgacgattctattccaggcattgtactagtcactgatatactgctgtggtctgaatgtttacattcctccaaaatttacgtattgcaatcctcacccccaaggtgatggtattaggaggtgggaatttggggaggagattgggtcaagagggcagagccctcataattggaattagtgctcttataagaaggtccgagggagcttgtttgttccttgcaccatgtgagaacacagctagaagtcactgtctatgaggagtgggccctcatcacacagcactgaatctgccagtgcttttatcttggacttcccagtctctagaactgtgagaattaaatgcttgttgtttataaaccactgagtttatgatatttctttatagctgcctgaaagaacagactaagacagataccaaagttaagaagataacctttgtccttaaggagctccctgtctaccagggaatagaaaggtataaacaaacactgcaattacaaagtaaaataaaagggtcctatatttagagctccataaaaggtatactgggagtacaaaggaaaaagtggttcatttataccagctcccccttcctagcccaattccagtgttggggagtgggcctcatgagggatgtgactccaggggactttgcaggcggtagcaggtggaaagggtaaagaacagtccagaaaaaggaggtgtgtgtgcactttgctaatatgtctattagtgtgctagtcattctggaaagaacttgtgtcatttattcctcaaagaccctaatccatctcagttataagatcgagtagatggaaaccctctgagcatttatttgtaatttgccataatacctgtaaagagcattggaaaaaaatgcaataatattactgaaacttttattaaatgaatgtataattatagatggataaagccatattttataggtatcattaacattcaaactaattgggggagaagttatctctattcacctggtaaagaaacgatttaaagagttaaaatgacatactcaaggtctcagaggtagtaagtggagaagatggaatctgacgtggggtatcttgattcaaaatgtattatttccactgaattatttcccttttcttttttgtctataatgtcatactttgatatctgtcaatctggtgagccaagttgccactaaaaatatttgtctcagtttctctgtctctcagatacaaatttaatatgttgtgaaatatatggatcattttttaagtcctgaattttaaattaatggtgaaagagctgtttacacggaacagcaggttgcaaatcaacagcttatcaaggtcacataaaataagtactctgctttgcattttgatccgtttatgtctttaaaaagtaatctccttcaccttttggtgtcctatgaatctggaaaaatattctttgtgaacagcagtgacaggaggtgagttggctacaagaataggctagaaatgtttagaaatgagaaaaatcatttaaagcaagagcagaaggcagggtctgtggggtaaaacagcttcatcgatagaattaaagaactgtaagccacaattcttgagatttataacagaaatatactaattatgctattttagaattatgttacttcttcagcattcagtaactgacaaaccagccaaatatagcatatgttatgtcctccctcctgtgacctgtccaatggctatctcgttactcatgagaacctgctagagaaagagcacagagaagtcagatctcatcaatccagtgatatcaagaggacagtctgaattcagataactgactccacctctttctggctgaaacacattggcaaattacctaagctctctaaaactctgtttctccacctgcaagatagtcagtatggcagtaattcccaactcacagggtcattataagggctaaacaaaagaatgaatgcaaaaattctgacacataaaaaatgctcaattaactgatactattattagctgttgctgattgtgatagagaaaatagcctgagactaaagtgcaaactatattagagtgtgctgtggtttatgtagggattttatttttattttttctaatccttattcccacttgttttgctaatcaatagaaagaggcagactactataaacatgaaattaaataaatgaatccctcaataatttacacctaagtatccaaagtcatgtattacacatacattgaacaaacctaactacagttaacattaaatgtttaacatgtttttattttagctattaggtgattaaaagtagaaaaaaaatcacagtcatatggagctacaagctgaagaaaagaataaaactaaaaataactttcacatccacatcaacaacaactttacctaaacagtaagttgcaatgctatatatcctatcaagctatcacaagaaatttaaataagaaataactctaggcaaacattcagtgacaattatattctgttaggttttttatttattgctaataaaactaccacatctacaatgttttattttcagagaagcatttgcaaatatcagtctgaacccttctcttttattttgacatatagaaataaaacataaaattatgaataattaacaagttgattttaggtgaaaatgtaagaattctaaatcccaagtcataagagcaattatgatcttctcttgattcccttagtatagctaatgtatattttaacatatattttgacacaaaaataaacacgatgtaaatcgttgtagacttatttcttcaggcttttcttttacaattgctttaagttaaacaccctgtaacacatgccatgtgggaaagaaatgcctttatagatgagtattagaaaaccctgaataaaaaattacttttatatttgatgacaataaagtagtagttttatcttgaaatgtgcttatatattaggtgaaacaggagaggctttaaccaaattatatgctggtccaaaaggagtgtcccccaccttttccggtgctgcctgctctgcctgagacatccgtgcagccctcccttcttcccctgaggtcttgcccctctcactttctcagtgcagcctcctctggtcccacctcacaccattcccttatgactcatttttctaccaaagcattcctcagcgtctaatatgccatttttgttgttgttgttgttgttttgagacagagtctcactcttgttgcccaggctagagtgcagtagcatgatctcggctcactgcaacctccgcctcctgggttcaagcgattctcatgcctcagcctcccaagtagctgggattataggcgcccaccacacccggctaatttttgtatttttagtagagatggatttcaccatgttggccaggctgttttcgaactcctgacctcaggcgatccacccaccttgaccttccaaagtgctgggattccaggcctgagccactgcatccagcctcatttttttatttaacttgcttttttttgtctagcttcccccactggaatgcaagttccaccagggcagggacttttacctgttttgttcacagctgtacccccagcacctataacagagcctgctactaggaagagcttgaattaaattgttaagcaaatgagtgaacttgggagatcatctctggtgcaactccctaattctgtagatgaaacacgtgactccccatagctgaagatggagtcagataagagaatcttctatgacatcatactgcctatataaattagtagaaaacccagccactgttccaggaagcttactcttgtcgacacacaacccagacacttttccaggaagcttactgttgttgacacacaaaacaatgaggtcagtgagtaactgaagcctctatttgcatcatgctgacttttaatgtgcttctaattggtttctcgtcaagtttttaaacatctatcttcaactgttaaataaactatgctcttccatatttgactactatatggtagacaactgtccaccttacatgaggtatctagattagtcaaaatcagagacagaaagtagaaaggtggttgccagggactggggaaagtggagaatgtggagtggtttaacaggcagagtttgggttttgcaagatggaaagagctctagagatggaaggtggtgatggttgtacacatcaccaccatcaatgtgaaggtacttcataccacagaaacatacacttaaatgtgaaggtacttaataccatggaaatatacgcttaaatgtgaaggtacttaataccatggaaatatacacttaaatgtgaaggtacttaataccatggaaatatacacttaaatgtgaaggtacttaataccatggaaatatacacctaaatgtgaaggtacttagtaccatggaaacatacacttaaatgtgaaggtacctagtaccatggaagcatacacttaaatgtgaagatacttaataccatgaaaacatacacttaaatgtgaaggtacttaataccatggaaatatacacttaaatgtgaaggtacttagtaccatggaaatatacacttaaaaatggttaagatggcacattttatgttatgtgcattttactataattaaaaataaaataaaataattttttaaataataggcaattttcaacatttttttctgaaatgttgagagattacattactatcttcacagtgttcagaattattctctcaagttctgtacatacttcattaatatatatacatatatatgtcagacacattgaatgcatattagtcataaattacatctgagcttatgaaacatacacgtttgtcatctccccagcgatgtgtatgagttatgacattggaacctggaattccatttactttctgtgtatggagaagccatgtgtagaaaagactgtatggatgagtgatactttaaagcactgtttgggtaggagaagtaaagtcttgttattatcagaggaacatgaactctgcttcatgtgcagctatatctcaggtttccacatagaatacagtatctgtcatactgagagctcccacagaacaagattattttgtctggccaaaccaatgtatcatttgaaaattatctgatttataaatttggtttactcacaaagtctactgcatatatgcccagtgaatttctgaaacaaaaaacacaaaatcatttggcagcatttattcctttggaagctatattttgggatctatttatatttttctgtaatgtttaatcatgccaaacaatatgatccattaatcatgtaggataatattaaaattccagtgtgtcattaaagttttacaaatgaatcaattaaagttatgaataattcagagatctaatatccacttagctgtcaatataaccaaatacaatcattcactgaaaattttttgctttgttctttgctgctcaaagtttggtctgtgagccataagtgccctggtcacctgggaacttgtttgaggtagaaaaccccaggcaccacctacatctcatgtaacaaaatccttagctgattcgtgcgcaccttaacatttgagaagggcttcctagggatatataaagatataccatacaaatgttgcaaatttatggtcaaaaaggatcaggatcagggaagaaaatttgtttattttttaatcccttatttcttagcttgtaaaacatattttctagagaaaaatgtgtctcttcaaggcaactggatattttgatgcaagatccctgactttaaaactttgggattgtcagaggcactgaaaccagagtgactctatcttgaataggtgctgggtaaaatgaggctgagacctgctgggctgcattcccaggtgaggcatttttaggcacaggatgtttacaattcagggaacagattcgtaatatttacccaatagacccaggacttgtaacagacccagcaaaagtcctgatgtcccaatatcttaacagtaaaagcattcatagtttaagaattagttttgctttaaagatagtaacataaattcttgtggaagataatagttacacaaagcttggcaatcctttgtcaggaacctttgtagtagagcacaccttccccatgactttttgctctgttgtcttatacgtaaacaagcttcaaacctaaggtgagtgcgtccctcctcttgctttggggaatgccctgctctgtctattctttcatctcttaactttctaataaacttctttcactttactttgtggacttgcccgaattattcgttgcacaagatctaagaaccctctcttggggtctggatcaggacccctttctggtaacaggatcagcagatcagggatgagaacaggaaaaaatgattaagaatggcctaaaattacaggcctttgcagaaggaaaatccttcaacagactcaggaagacttttgcttgcagtaaatagcccatcaatgcctgctgaccctttgacagactgagaactctcaccggacgcaaacaggaagcctgaacctatttgaagagcaaacgactggtggcacaaatagaacgaggtgcactgtcccgggaagccaaacagtacaagtgagtggagttttccaggctgtggaaagaagagcctgatctcgggctagtgcctggtttccctcccccaggactgtgcattgtccaccctctaaaggacctctggaataggagttagaaatgtgcctggggtcaaacaattcacactgagcaaagaaagctaacaagtaagcgtgttttcttgcagcctcttagtaaagtgggtgtctagtaagtccacatggacataggatgcggaaccctcatttgcatcatcagcctagagcaggtgcagggtgattcccttcactcatgccgaagtgagaaaggcccagagaagccaggctggagagtgctgagctctcagagggcctcccagcaggaggggactggaaaggcgctggagtgctgagagttggttgcgcaggactgcaaaggaccacagagggggccgcactaggtcccaagaatgccattctcctgtgtgatcacgcctcacaggtattgctggcaagccaggcctagaggaggctgccaggaacaccgcaggctgaaggactcccatcttctctgttgtttgctcagcttagtgttgtccaccacaaggaagactttctgatagagcgttatctcaacactcccactcacctgagaccttcccacacacatttgccgacattcaaaaaccctagagactcacatgtctgcagagtggggcattctttctctgagaacatctgaaaaacgtgaggtgggttccctgcatccgagcagcaggaggccctctgcacagagtaggggattgagccgggtatgtctttctccagccccagcaaaagccccggagaggctctggaagagaataaatccctgggaatagaggctgtccctcatccctgcgaggggcgcatgcccagccccttgaggagtggtgaatgtcacagctcacaattgaacatctgttactttggtgcaaaccctgtttcagcagaaggagtatttgcaccagatttctaaactgcttggggttttttacacttcagaaaaaaaaaaaaaaagaattacaaacctggttcaaatcaagctaaaaattttttgatattaccagaatttttaagtcatctaagccataaattaaatacatttctaaaaaactgtcttcagcctttcaaggaaaaatatgtaagtgtagaactgacccctgaacactcaatcttctgtaaattaacaaataataattatgagtttaaaatgacaaatctaaaacatcttttaaaagtgaggtgttgatttcaataaagaagtgatttgacttacaactatatacatatgcagatttttggaccacatctattgaggaaatctgtcttggcattcactctaaactggtattaaggacacatattacctaaatagtcatgtttttaagatctacttaagtttcaattatgcagctatttatactcccctaaatctagttagttaccatttatgtacctgggatgtgcttcatgggcaacgttttctttattatcattgaatttgtgtcttaattgaattgcatgcttactaaatgaaataattggaacataagaaatttgtattgtaaaggctgcactcagtcaaaatattctaaaatatattaaagaaaggatttaacaagaatatacaaagtgatggctttaagagatgagataaaggttaatccaaggattaacaaatgccacaattcaaaataaaacaggttgcaactacttttccagagatgatttaaaatgtgtagaatataaagaatgtttccatcttctgtcctgtcttgtatatcctttcaacatgctcttttattgcagcgatatttgttttccggactgttactctaaactgtagaagatacacatttcatcagcatgcttgacactgtttctttccattaaaagccatttatatatctcacatctcaatcagatgatatttcagagagaaactgaacttccctctttaagatgtattttatgaacacagtttataataatgtacatatttataagttgtcaatgagtgagagcattatattttcacgagaagtatttccatgttgttatagccaagaaggcagattcaaagtatagacagtgatatggcagacagccaggatcattgattcatttttagagcaaattagctggagacttattaatgtaattagttagagatttattaatgctatttaaactattaaaataacctcacagtgcttttacacaggtctccccttattttcccttacctcttgctcatttatgtgacttatgtgtctggttcatgtgtctgtccttagaaaggtagtacatataaaataaaatgcacattgctgaaaagaatagcaggactgaatacagttctgtacacctatgacctatgttgcctatctgcttaatggagtggaaagcatggtggactcaaaagacgatggaactcagaggcagaacacttcactgcagctgaggaagagaaaagttcagtaactcgctggttaaaaaaaaacaaaaaacaaaaaacaaaaaacggtaaatgacaaccccaagatcccagcccacatctgtcagactccaaagccctgaagtagcaattgcattgtagaaatgtctattacccagttactgtacagatttttctgtttcatcatactgtggccaaactggtttttttggggtttatattgcttgtttgttttctgttcaaagaaatgtctagtgtacttatcagacgaactaaagatgatagaaattaaaagccaaattatatttgttccattagtgctacagaaaagtgtttctcaaacattaatcttgtaagaaatgcagattctgactcaatacttctgggttgggcattcctagccagctcccaagagatgctgatgcttctggtgtgaggaccacactgagtagcaaggcttacggaagactcctaccaattttctgctttggaatttgaatgaggctggtgaaactgctaaatggggaacatgcatttatagcattagctgcacatgtgactaacaagtaaaaaataaagattatgaaataatgcccctaaccaaaagtggtccctttgatttctggagctctgcaaatgaatggagccactaaatgaccaagaaaacctggacacagttttcctgggttttatgactcagtatttacttttcttactgcaacccttctgatattgtcttaattatttctgattccctccttcacaacaggtcatcttccaaaaagaggaccagaatgtccttttttaaacacaaagtttaagaaaatacacctttaacaaatgtcactggaagcagaaaaatcatccaaagtatgtaattaggatcaagaaatctagaatgtaattttacaagataaatgcaaaggatatattagcattttgttctgattggggaaaggctctctttaaaaggcacacttataaaatgtgttattttacaatggaaattttaacacaatgcttttaccacttcatagcatagtctatctcaagaatattaccagaaatgctggctgtctccttgcacctgcattgttattttttatcagcatcatagggagaaaatgcttcttacagataacatatataactctcagcaagattatgaacaggagtttagaaggtacagataaaatatctctatatatagcgatcttaattcaaaacagaatataaagcatatggccaaccaaatgcagtcattctgttatctttgctactccctgctctataaaataatgctttccccggctcacacattatataataaagacatgtcttcactctgcaaagcatgctttccttgcctacctctactgttaacattgctcaactaaaataaacatttcccggcaaattcaagagctgatatttgcatctttcaaaataatagaccaattttctgcttcccaccatatctggtttatagtctccctctttcatagaaaaacaccctttcttggaaaacacacaacttgtaaggacaactactgcagtgccagttctcctcagctatgaactactcagtaagtattgctggaagaaacagctacaggagaggaaagataaatacctaccatttaaaaatgactaaaagagtataattggaatgtttgtaacacataaaattttttaaaacatttttttgaaatacctaccacagaataacatgtaaattccagaaggattgaagatgcaaactttaatggaataaacaaaattaggagaaacaatacaagagaataatttttaccctcttatttaaaaaaattatcaaaatacataataggaaatgtttaaggtccataacatgaaaagtgcttcttcaaatcattaggagaaaaggcaaagggcaaaatgtaaaaataggcaagggttctgaaaagataattctcagggtggcagagggtggggggaatatgcaaatgtcaaattaacatgaataaagatgtttggctttaccagaaatcaggaaaacacaaattaaaagaattcgagtctttatatcccaccagactgataatgaacagtggacgctttgatcattgtagagaaaggggcactcatacagaaaggggcactcttgtagattctagctagaagactctgtcgcaatagcaatccaattcctggtgatttttttcccctttgcatagataggacagattacatgcatgtatgagaaaacttataacaaaaaaaggagcataatttcaagtcccatatccctttaccctagtataaacaagaaatggtaagggtcacttgttgccttcacattcccaagtcgttctgcaattgtaccccatacaatccatgtggccaaacacaacagccctgttctttccccatcgtaaaaagactctttagaagaaacagcaataaagttataagatgaagatttctttgttgaatatcagtcaaaagaaactaggacaactaacaaagacagctcagaatcctcctggagttatgctatagaaaaaaatatgatctgtccacctgctttgctaatttgagctcaagaacttgagcatcaagacagtttatttttttccattattaaaaaaccctttccatgagtagcagccagcctatccttccattacctacagagccatccacttaatgaagaaagagtttgtttagagtacaatgaagatagacaaaccactggggacaaggttttgccaatgagaagccctaaagctctgatacagcaaatagctcctgccaggaagtcttatttttagttaggaaataattttctacaagccatgcaagttctgcttgctttgtatttaagattcaaagaatctttattcttggcaacctgaaaataaaaaatcaactaaatgctctcttttggctttaagaccccaaaatgagggtaatgaaaggtacagtggcttttgatttgaagttaaacccctgttccttcaagtcattgtctgaatttcaagtacaaagcattgtataatgagcctcatcagagtaacctagtttgggaggctaaaataaaatgaaatacatgtaaaatatttgtaaactgtatgaataagttattagctcacagaggttctactcttaactccctctttcttgaatattcctcaggcaatacagaaaatattacatttaagttgcacttaaggtgtaaatatgacaaaaagagtctgacaggcaggaagagccaagccctgaccatactgtgaagtgacatgatgtctttgtccatttcagctgctgtaacaaaattcctgagattgggtaatttataatgaacagaaattaattggctcctggctctggaggctggcaagtccaagatcagggtcagcatctggcaagggctttcttgctgtatcatcttatagcagaaagtggaaggccaaagagagagcaagagagatagagagagaaaaggggcccaaatttgttattttataaggaatccattccacgaatatgagcccactctcatgataacagcattgatccattcctgaggcatcagagccctcatgccctaatcacctctcattaggccccaccacttaacacagctgcattggggattcagtttccaacatatgcttttgggggaacacattcaaaccacagcacatgcattatctcctctgggcatatccacttcatgtacagtctttgtccttttcacagtattttgcttggaaatccatttgtttaaccaatcctgtctttttagaatactactccctccagtgtgcaacagacaagctttccctcaaaatcagttctctactcttgccctaggcattgggctgcacagctagaaactatatttccaggcctcctttgcttttaggtttagtcatgtgactaggttcttatcaatggaagtgagtaaaaacagtgtgttctacttccaaagcttggccataaaacctcagttatgtactccaccattccttttttctcatttcctcataagctaaaacagggacataatggtggtcagctacaataaagccctaaaggatagcagagcagcaacatggaaatatgctgggtctctgaataacataacaaagccaagctactctgtcagaataaattggttgaactacaataggagaaaaataactttctatcttctttaagtgacggtctctttgtcatagcagcttagcttttaccatcacaaatacagaagaaattgacttgttcaaccaaattctgccttttaatgccacctttcccagaaggaactccatttgaatatggaatcctgataattcaaaaatgttttaaagtccaaaatagattatgtaactgtataaacccaagtcactggtgataaatatctaagcccgacatttatttataacaacacataattgaattgttcaattgaaacaattaacaacaaaaaaactaattttcaagtactgatataaaataagttggggtatcagtgtgataaaaagtatggtaacatggaaaggaggcaggaagaccaaggtttcaattcaaggtctcacaattaagagctgtgtgactttgggcatgttttttttttttttttacatttctctggccctcgatgaaatgtatataataagagagtatgacaatccaccacatgatgttaaaataagtgtttagcctggtaactggcaaataggtggtcagcaagagtgaagctactagcagtagtgctttaattaatgaacatatatacagaaaacagctataaaggacaattcctctcactgaaacactattaaaaatcctttggcaactatgttgatgagaactctttcaagtcccgctcaggtttctcttcttgggttgtctagactaagcagatgctctgaagcatctcttactattctcatcccatcctgttctgcactgggatgcttttcctaatgtagaagcccctcatcattatatttagtaagcgctaattccttacctatgtgattccttcaaagcttcccctaaattctaagttttaaatgagagtactacaaacgcggtctgtattctccatgtgtcctgtaaaatttaaactggtacttattactctgagactgaatcttcttggaatttgaggagtactgtagatctgtgctgggtctgaattatgcatttttgagttctgtatttgtcttgagttcttttgttgaaaagtgtaacttgcaagttgggtgtgcagtagaaatctcatccctgatacacagaaatagggatgccatggtttttgtgcagctcccacatcctctctggtttcctagggttctactttttgaccaattcacacacaaaattgcatgagctaataaataaataaataagcacagcactttaaatgaaaaaaaaaaaacttccttaaaattatattattatcaaattaaagaaatttgaaggcttttggggaaacaatggatgagagccgagtgtacaattgtcatgtgaatctatatgaattatctcaagtcctttaggtttttcatgtcattgcatacaatgagctgaatattttaatcaggtgaagatcagggtgccattttaatcacacaactggttttgtgaggcaaatatatcttcttctcaagtaaagaatattgaaaatgccagtgaaatgtgcctgacccagcacagagaaagaaactgtgctccatcccagcagaggccatgtggatggcctcttgtatcctaggatacctttccaaggaagaaccacatgtttctgttaacacacataaatacacagaggaaaacagatttaatgtgtttaaacccggaaatgatataatttcacaatagtagcctttcaataaggtagtagaaaaaacatcaatttattcttataacatgaaatatggaaactactaactacctctaatcaacatcaaaagataagaaaagcagttgctctccatttagggaatgcctgcagagatatttatcacatcttcttttcagaaatcccaaccagtggacaaatcagctccgtatgtgtgctctttctttaaatgatcccaaatgccatctacagcctacctgagcttgagtgagtcatgcagtcatatctatacaaagacaaggtacacagacagcctctccgaagagttacttgtaataattcagatccaaaagaataatgtagttgtgtgtctccctatgcttatagcagtttgtaaatataaacacttctattagaagctggtagttagaaaacgttagagaacaattactgaaatgtctttaaagtatttacgatgagtcttttaaaaatgtagactaagttttaccaggaaaggctcatgttggccttatttttattttcatgactggggctcatcaaagtgcctagcatataggagagattcaatagaaaggtttctaaatgaaggagtaaatttatgaaataagtaatggtaacttagaagtagaaaaaaattatccataaactcaaattcagctaacattaatatttctatataatttcctttagattgttaattttataaggatttaatgaaaaataattttaataggatggtagcatttcctgaacacacactatcctctggactaaataaacacctctcagcattacctgatttaataagcacactgcgtgtgttgagggcttctattaccctcaaaaaacagttatgagaattgagatatgtttttaaagtgtcatttgatatttaaaatttaaatttttgcttaatattcaggaacaaatctgcgtgcaagacagatcaagtgcatacaattttaaagtatagtaagaaaaacacaaacttagcagcttacagtctggtaaaaaccggatgccttcatttttcctacttaccacttgaaaaacttgcaattgatcacgatacataaaacattaccaatgttttgtttcattcctttctttctaaaacagattatgtgataggtggacattttcattttcttttgtcttagaaaagaagtgaagcacagaaagttcaagtaatttagccaagatatctgataagccactgcgagatacattcacagaattcatctctcctttacagctagactactgcttttgctatatgtattctcaaaaaatttaagaatgatcatactcaatatgagaattgataaagcaaatgaccatcagtatcaacgttgttacaccccttggcagtcattataatgttaagattttcaaatagccaatcagccttcaaatgttgaattaacaaaggagagcaagcaatgctacacagatgtaactatctaggctaccttttgaaaatcaaggtgagttggtttgaaagtgtaatggcaaaccctcaacttatatcccaacgccatgcaaaagcacttaaaacagatggagctggcactgacagagaaggcaaagcaaatttcaacacagagaaacacaaatccttgttattcattggggaaaatgaggaaattttatatccaggtttgttaggcagttaatgattgactctattatgtttcaatgaatcaacatcaagttagtttaaaatggccatattccacaaagcaatttatagattcaatgctgttcctatcaaactaccaatgacattctttacagaagtagacaaaactactttaaattttatatggaacatatatatatatatatatatcccaaatagccaaggcaattctgagcaaaaagaacaaaactggaggcttcacgtaacccttcaaactatactacagtgctgcagtaaccaaaacatcatggtactagtacaaaaacagacacatagaccaatggaatggaatacagagcccagaaataaggttgcactcctacaaccatctgatcttcaacaaagctgacaaaagtaaccaatggggaaatgactctctattcaataaatggtgctgggaaaacttgttagccatatgcagaagactgaaactggaccacttccttacaccatatgcaaagttcaagacggattaagaatttaaatataaaatcaaaaactataataaccctggaagacaacctaggcaatatcactttggacataggaactagcaaagatttcatgatgaagatgccaaaaacaatctcaacaaaagcaaaccttgacaaacggtatttcattaaacttaagagcttctacacagcaaaagaaaatatcaacagagtgaacagacaacctacaggatgggagaaaatatttgcaaattatgcatctgaggtctaatatccagcatctataaagaacttaaagaaatttacaagaaaaaaaaatcaaacaaccccattaaaaacaagtgggcaaagaacatgaacaggcacttttctaaagaagacatacatgaggccaacaagcctatgaaaaaaaccctcaatatcactgatcattagaaaaatgtaaatcaaaaccacaatgagataccatttcacaccaatcaaaatgactattattaaaaattcagaaaataatagatgctggcaaggttgcagataaaaaggaatgcttatacactgttggaggaagtataaattagttcaaccattgtggaaagcagtgtggtgattcctcaaagagctaagaacagaactatcattcaactcagcaatctcattactgggtatatacccaaaggaaaatacatcgctctaccataatggcacatgcacacatatgttaattgcggcactattcataacagcaaagacatggactcaacctaaatgctcatcaatggtaggctgcatgaagaaaatgtggtatatatatcctatgggatactacacagccataaaataaaaggagatcatgtcctttgcaggaatgtggatggagctggaggcccttatccttagcaaactaacataggaatggaaagccaaatagtgcatgttctcacttagaagtgggaactaaatgacgagaacacatgaacacaaagagaaacaacagacactggggcctatttgagggtggagtgtgggaggagggagaggaacagtaaaaaagcaactattaggtactaggcttagtagctggtgtgacaaaataatctgtgcaacaaacccccacaacacgagtttatctatttaacaaacctgcacatgtacccttgaacctaaaataaaagtttttttaaaagtatatactttgcttgtaaggcatggttttcagcattttggaatatataaagaagtagaaaatattgtccctttctttttgactcttagaaattattaatgtatacttctttaccaactaaaataaaatgaggaaacagataaaatgagacaatgctgcagacatgcattttacacaggtttagagtacatatatcttatttgagatattcaagattccagtaagagcagaggggtgggaagtagatttgatgtgttcagtataaaaatgtggataccagtctgactcaagcatagtgtttgtataaaaggaaaagtggagtacagagtgggagagggagatgggggccagattaccaagaggtttggattctgggctaagtttggattaaattcaccaggaaattgtgagccgtgtattttgcaccaggaattaacagaatgaaagccatgttttaggacggcttcaggtgaaatacacaaaacatattacatgcagaaagaaaaagtgaagagagaaaaaatgtccacaccatctttcgtgatgtgaaaaataaatgaacaagacaggcagtagaacgaaagctgaaaaaagcattaaaagaaaagaatgattgagacttgatgtctgattacatataaagcaagggagcaggaggagtccaaaccccaaaatttcaagtctagatggtcaagagaataacagtgccattgatagactaaggaagtgcaggaagtaatgtcctgggaaagaaagaattgagtttgagatacatgggttctaggtatggtggggcatctatgtagagccacggaatgctcattgcagacataaacccggaaacgtgaatggaggctagatggaagtcacggcctgaagatgaagatttaagagcatttactacaatggatgagatttccaaaaatgatagaaagatttaccaaggagtgggagtttatccctgttactcccttacttgagaacaagcaaaaggagacacacggagcaagaacttgttaaaaaagtagacagaacttggatagcaaaatgttgttcaaatcagaagggatattcctaaagtggtcagagagcacaagtgctaaaaaaacaaacaaacaaaaaatgtaaattgaccacaatcagaaagaaaaggttggccttgaagacagcagttttgcagaacaatgggagctgtcgttgagggtcatggacagagcagacagtgcggaatgcagactgtgtgtgagagtgaccaacagctcagagaattatggtatggtactgagaggggtgtgtgtgtgtgtgtgtgtgtgtgtgtacgcgcacacatgggcgcatgcacatttgagggtatcttctgttatcttctgtgttgaaatatgtaacgctgaatgttgacataggactacacctgtgtctatttcaaccgagtcaccaatctggtggtcctcagatatctgagtgaaagacagcacttccttcttgttccccaattcctaagcaacagtcttgggaaactctttcacatctcttgaattatttggtgcaattcaaagatacataaaggatttcttcagttagagtgcagagcattttcttcctcctcctcatgagaaatctctcatggactctagaaccaattaccatgggctgggagggagaaggactggctatgctctctgacagtggactaagggggaggcatgagtactcctccctggaccaggcccagccacaaaagaaagggagatggtcttgatcctgcctatgtaagaagaccacccccagggtaaaaagacacatgtgttccctatcaatggaactgttggagaggacacccctcaaagcaccatcatggaaggagtaagctttaacatcagccaagctgacagaaagaaacagagctaggtcacaactgtctttctgcctagcctcttacctacactgtgccctatcaaggagttaaacgcagttaccaaagggaggaagtgcacaaggagaggacagccacaatttccctgggacacaggcttccaatgtgaacctcctctgacctgggagaagtccaaggttaatgcacttctttggaatcttaatttttgcacagtatattgtgcatatgcttttggaattaagtctgtttttatagcaagaggaatttcattatctgaaagtgatcaaatatcatagcctcatccaagcctcctccaaaggaaaagcagaccacccccaccaatgtggaaaggaacagggtaggcaaagtggagttgatttttaatgagttcagacataagtgtgactggcattgaatattatgttccccttctgggaaaccacggtgcattttgctatattaaaagccctgagaaatcctgcaataaagaagcctgttcactttgttaaccctggtatttcccaaatttatttaaagagacatatttgtttcagagaatgctgattaatatgctgataaactaagattaatatttcattaaacagagtttgaaaagcattgttctagacatttggcatattactaaatctctatcccgtaaaacatatttaggaatgcctacatacaaaatgacttactccaaagaaggacctatttagtgttattcctttatttataaattttgtaataaaatatctttagagtaatttttctgcaaatctttgcttagctaacctcattgagaaattaagcatcttacatacacgaattttctggataaccagaactttctcctataaactttaacacttaaaaatatcaaccattgaaaataaaacctctgaattcagatttttattacacgaagttttcattataaacatgaatgtttcattataaacatgaatgctatattcattatatttgatgaattcattatatttgatgaatgctacatcaaatcactactcattggtatggtatctttgtctctgggaactacggagatagaggtacaaggttccctcctggctgctgacttcttaaggcctggatgtctgtttgaaaattccttttatttcctgtcttgcaatccacctgtctgctgctgcacccagtcagaaggctctgagtgagggctggagcttttatggcactctaagcctctggactttgtaaaaactgttggttccccaagaaccttttctgttggcttgttggattttgttttattcacttccaaattcaatcttttaaaacatcaagaaacaggatctcatgatgaaacagcatttccttcatcctgaggactgctgcagacagtaaagtttgtacactgcataaaggacaaaaacaaggggcgaggagggctagagtccagtagagatgccagccatcgagttctgagcctatgggatttgggttttctctactagctatgctctgcacaatcagaggagacaccttttccaaattcacgttggggcaattggaacccagtatccctcgtgcttcagtggaaatcagatgccacaccctttacatgactctttttagacttcccttcctgcatcctccaaatgatgttaccaaatctctccttccaccaagcctcatccaatccccaaacaattttccctttatttgcaaaagcacacccttatctaaatatcactgataaatttgaaatgaaatttatgaatccagagaactcattttctttgttcctctgcatctcagcctacagaggctatgacccacaaatggataaaattaattatgagcataatgctgtaccagtccagtcacaatgttttactgatcccagacacctgtatatcgatgcggctaatctaatctatctggaccatgttaggaaggaagatagctgggaaaggcattatgcacattttgcaaccaaatagaaaaagaaaatgagccacttgcgaaatgtaggttgcatgggaagaactggagcaggacacatcctaagggttgacatgcacttttttacatggctgaggccactgaggcaagacccagccctgctagagtgggaaactcactggtttcatggggcaaaagcagtattcaggttttgattctcccacttaactgctgtacaactttgctaagcttcaattccctcatcaataaaatggaatcagtaataataacttgcttaacaaggcgaggatttcatgaaatatagccgtaccttggtatccgaggggactggttccaggacctcccagagatgcccaaatctgcaaatactcaagtccctattataaaatggcatagtatttgcatataaccttggcacatcttcccatatactttcaatcatctccagatgagttagaatacctaatatgatgcaaatgctatgtaaatagctgttatactccattgtttcttatatgtatttttattgttgtattcttattcttttttttttaattatactttaagttttggttaaatgggtacatgctcagaacgtgcaggtttgttacacaggaatacacgtgccatggtggtttgctgcacccattaacccaacatctacattaggtatttctcctaatgctatccctcccttagctccccaccccacaacaggtcactgtgtgtaatgttcccttccctgtgtccatgtgttctcattgttcaactcccacttatgagtgagaacaagtgatgtttggttttctgttcttgtattagtttgctgagaatgatggtttccagctccatccatgtccctgcaaaggacaagaactcatcattttttatggctgcatagtattccatggtgtatatgtgccacatattctttatccagtctataattgatgggcatttgggttggttccaattctttactattgtgaacagtgccacaataaacatacgtgtgcatgtaactttacagtagaatgacttataatcctttgggtatatacgcagtaatgggattgctggatcaaatggtatttctagttctagatccttgaggaatcgccacactgacttccacaatggttgaactagtttacactcccaccaacactgtaaaagtgttcctatttctccacatcctctccagcatctgttgtttcctgactttttaatgatcaccattctaactggcatgaaatggtatctcactgtggttttgatttgcatttctctaataaccagtgatgatgagctttttttcatatgtcttttggctgcataaatgtcttcttttgagaagtgtccgttcatatccttcgcccactttttgatggggttgtttttttcctgtaaatttgtttaagttctttgtagattctggatattagcactctgtcagatggatagattgcaaaaatttcccccattctgtaggttgcctgttcactctgatgatagtttattttgctgtgcagaagctctttagtttaataagatcccatgtgtctattttggcttttgctgtactcttactctttatgggtttttttcccccacatattttcgatctgtggttagttgaattgggatgtggaatcagatacagaaggctggctggaggtgaaagaactgtaaactgtaaattgtactgtataaacaaataaactttaaatgctatataagcctcttaattaaggaacccttgtgattagaagtaaactgggataggaaaatttccatttcattgacacaagtctctttcttgtccctcctctcaataaagatgaagattttattccctcacctcatgtgattttgaactaatacaggtcaagtgaaggtaaacaatgaacacagtacacggtaacaccacccaagggtagtaaggtttccaccccagcaagagagggaaagactggttggtgatggtgaatttctccattatttggaaaaactgctcattaagttaacaaccttaaacaatcccaaaacttccaaaaatataacatggatagcagcctttataaagttaacttggttaatatttttgttaatctcacggtgagtgcttatggcacaaactcacaatgcaggttgtctgtgagggttcggccattgtcccaaaatgttagagatgggtaaagtcagcctgggggatctactggagctctggatcagatctgaggtcatagttgaaaatacgttacaggtggagctcaggggctgaaccaagatcctcatagttgggtttacaggagcttccaggcgagtccaggagcctctttgtcactccaaataaccctggactcagaagcaattttatactttattaagattcctaagaattctgatggccagaagcccctagaagacctccatttgaggctatctgtaaggaagacctaccacgtggtcctcgtcgttggtacagatgagggtttctcaacagcagaacttttgacatttggggggctaaagaattctgtgatggggagctgtcatgtccatggtaggaaattcaacagcatccctggcctctacccactaaatgcacgtagcatcatccctcagttataacaactaaaaatgtactagacattgccaaatgtcccctgaggagcaaaatggctcccagttgggaaccactgacatagctgaagtcctggagacctggagaaaatatagagattgcaggctatggactcttctcaccaacttgcttcatgttttaattaactgttaatagactattttaggaaacagctaggtgaagtctctaaatcactgatcatctgcgacagtttaatgtaaagttaccattcctgctttggaagaaaatgttaaatttgaaaccccttttattctggtcattgttcacagtgctgtttccatgaatcaaaactgaatcatttagacctcatcaaccagaaagataatgcagaccacctcaaaatttctctctttcatcactgagttccagagatagtaaattattcttctatattctattactcctttggccacttattctgattaaatttgagcacgatttgattttgaaagggagaggaaaggccagaagggaaatccaaatgtccaaccatctttcggtatcaagtacagtgataggaaaactactcagtcagccacaaaacatgaaccaaaaattgttgaaaaataaatagcatttttacccaaagaaataacatccatttgcctttgctttttacatgagattatcacacaataaagaaaaaagaaataaagcagatgagagggggaagccatccatttaaaggaataaataagatttataaatcaggaaagaaaagaggctgtcatgtacaatcagttgtcttattaacccacaggcagagatacagtcagaaaggtcctatgatggaagatttacccttgcttataaatgaggcaagattacaaagtaatgtaatttcctgggtaagctgtgagtaagtaattatctcatcaaggaattctgcttctggggggcaagtagatgaagaaaaacagcctttcttctgtctaagacacttatgctggcagaaaaaaaggttactattgcctgattttgtacatgtctagctgagttaaaaccataggtctgcaaagacacccaccatcacctaacttctaaagggctaatattgtgagtgagcatgctgctttaggactgtaaccttggtacttcaatgcatcttcctctaaacttaatgtcaggaaacctttacaaggcatgcttgatggtgggactggttctggtggagaaacgggttttagaaaataaacttgaatttgataataattaaaaacaaaaaaaactcattgattggaaaagtacccaagaccactcagtttctacttggggacaggtgaggcacagcaattactcaaactctaaatcaggatggagcagtgttttgatttggaaatataaagggatggtatgagttgatggaagagagggagaaatgaaaagattgagaacaggtcacatacattctatgaagtctttcaaaagtagctaacatgccaggcatggtggttcatgcctgtaatcccagcattttggaagaccgagagcttagcggttcaagaccaacctgggcaacacaggtagaccccatctctacaaaaaaaaattaaaaaaaaattagccaagcatggtgggacacattgtagtcccaggtactcagcacggtgaggtgggaagatcacttgagcccgggaggtcgaagttgcagtgagctgtgatcacgccactgcactccagcctgggtgacagagcgagaccctgtctcaaaaaaaaggaagaaaaaagtagctaatgtacaagttaaaacagaggcgcctagcaacttgtcaaattttgttggaacatttctcaaacttcccttgggaactactgaatcagacgctctaaagagttaacacatcttctggaatttcccacattttaagcagaacttacttcctccacaagatctgtcctaaattattatataacttactagtaattgctcatgctagaacataagggaagcttaacaaatgggtgacattgcttgatttaaaattaagagtcgatgctgataatacaataaaattagtccatgtagaacagtttgactttaagttatatgttatgcaatatcaggtttataaattaaatctaagtagtttgagttaaaataattggtcatgaattgaaaatatgttgaaaaaataaatcatatttttgctcaatgaaataacatccattttccttcacttttcacatggaattaacacgtttctatctgaatttggtggcttgtattgaacttgatctggtatataaggaaaaaggagaattggcttgcataataattggcataataaaggcagtgagattattacaaaattaagcatcagctaacttaaaattggcatttctctcacaacaatagtatcagagtatataatggtaggtatacacagtttacctattagaaaaacaaaaagcatacctgccaacagatagaaatgcattacctccaataatagggacattttctggaagtgaattctttcaatagtttgctgatggttttaatttgacatcttttttttcctttttgcatgcatgtccatttcctttcttttcttttttttttttttttttttttttttcgagacggagtttcactctatcacccaggctggagcacagtggcatgatctcggctcaccgcaacctccacctaccaggttcaagtgattcttctgccccaggagcctgagtagttgggactataggcatacatcacaacgcccagctaatttttgtagttttagtagaagccaggctggtctcaaactcctgacctgaagtgatccacctgccttggcctcccaaagtgctaggattagaggtgtgagccaccacgcccagccgtttgcatgtgcatttctaaccaatagagtccccaactacccatcttctgccaatgtatattttttccatcaatacttccatttttcatacttgctgccactaagccacaaggaaaagggagcgcttcatgcaagaacccaagcatttgacaaggctgacagtctgcagtgtttctggaggggccaccttcagtcttctcctttcttttcttcttcctagctcttcaagctgaactaacccatgtccctttatggcccagttcatcagccacttctacctatagctgtgtattagtctgttctcatgctactgatgaagacatacttaaagagactgggtaatttacaaagaaaaatgtttaatggactcacagttccacgtggctggagaggcctgacaatcatggtggaaggtgaaaggcatgtcttacatggcagcagacaagagagaatgagagccaaacgaaaggggtttcctcatataaaaccatcagatcttgtaagacttcttcactaccatgagaagagtatggggaagctgcccccatgactcaattatctcccaccaggtccctcccataacacgtgggaattatgggaactacaattcaagatgagatttgggtggggatacagccaaaccatatcaagctgggagcacagcagcagcttcagcccacatgtgagggacatttgtactgtgccccacccaccagtgtggccaggaggccaagcgaccatggaggtcgcttgcctccacccctcttgcttgcccaggctgctgtgtcctttcctctgccaccattggctgaggtcctctgtctttgttcccttttgggactgcctcaccctagacactggcctgcctaggactctgggagcttgggcattgatggccaaacccctacatgagtgtttatttattgcccccataccttcagtctggggacgggagcccatgagaagaatatggcagcagatggcagcagatgggtcgctccaccatccctgagcccaagctccctggaatgatagctgtctcaatgaatcactgattccacctgttgtgctgtgggtaatgtcagaggggctgcacatgagctttgtgagagatgtgctcttggtttcattaagtgaatggaggaacatgcaaacaataatgtaaaaaaatgtcaggatctcttaagtaggtttgggacaaatactattcaagtaaaactaatgtgaaaagtaaacacagaccattacaattgggagttgattaacctgtgatccatggttggacttcaggggctctttatgcctcccaggaagttaatagatagatagttttacctgtatgtgtattttttctagagaaaaaattaatattctcaaaaaagaacatgatctgaaaaagttagaaatcatctcctcattcatctgctcattttgtgatgggcgctaccaaggcacaaagaggctgtcctgaaatgcaaataacatgatcttactcctctgttgaaagacttcagtggctcctgccactctccagatgagatacaaagcatgacatgctaggctgcatggggctctggcctcagctcatccctccaggtccatgcccaccactcatcaacccagctgccctgtggacacaaactgagcccctcacagctcctcaacagaccacactccctttgtgagcacatccccaccccctgccatctctcctaaataattttatttgactggttttttgttttgttttgttttgttttttgaaacagagtctcattctatgttgtccatccaacatctcttcccttataaaaacttccctgactgcaaccttggttctccagtccctgttaggagacactcctccttgtttttgtagatactcacgtcctcctgtctcatagcatatatatcatcccactatcatagtaaatttgcttatctctggatttatcgaccctgtgggagccctcccccccatccactctttgctctatcaaggtaggatgtttttaccttcacattccccagaagccagcatagcacctagaacagtctaggttcgccacatatgttttttatatgaatgaacgaatgaagcagagttatagataaagataaagcactgaacatcccatactagcccaagatgccacatagctagtctgtgatagagcccgaagtaggaatctgtctctgattccagtactgtttctatgacacccattgctttatgtctttgctctggaaaaaagcaggagcatgtttttctgcatcttttaaaaacataagtataaatactacttcttcagtcctcaccggacagagggagctgtttcccacgttcccgacaccctttcaggagattcataatgtacatgttggttaagggtgagcacatcactagcgaagcccttgatcttcaggcaagaaagagcggggaggaggaggagtcagagaacaagaaaaagagaagggggaggaagaggaagagagaagaaaaaaagaagcgggaggaggggaggagagagtaagtttatgtaacctttccttgggtcacagttgaaatctagttatcttttgaatgggttaactggtactcaaattctcagatatttatatctaaagttaaaactaaatctcaagttacctcaagtaaaatatagatcagttcgccactgatcttggaaacccaaccacgcttttttttactgaaagtttgtttcagtgtcaaatgaagattgagaatcaaatgcagtggagagcaaagtaatgccctccaggcactggcgtggcagcatttcagcctgctgggctccctagagcctctctgtgctgagctttcatgatggttccatggggagtatcggaaatggctctgttttgatttcctctgcaaacctgcagctgcttctcttctccaattcactacaacatgctaatagggtgactaaagagacagctttgctatcgctatcacattgactcctgttcatttgctgtaacgtgccaagaggcaaaacgggcatcaggatcaagagaaaactaactctccatattttaagacattctgtaaatggactgagtgtgcctttagaaccttcatcctacccagcaacttgcagtacacacccagtgtagcctgttcactctcacctccctcttgtgagacatcctgtttccgtgcttaaagtgttcttccttgccctatccccttctctgaatgacgcctgttataccaagtgtctcaacagagaagttacttgccagcgcctttcctaactcctccagagaggtactcccattgtgcccgctattgtgactgcctctttccctgtccctgtccccaaaaattgtcagctacttaggggcagaaactgtgtccataggagacactcagatacctgaaaagtgaataactgaaattgtttcatctgaacagattcatgtcattttattttagatcagtgtctacaaaaaatgacatcaggccccagcaagggcaaaaagaccatgggatcctaataagatccacttggactgaatgataattaggataaaacaaggcaccaaaaacaaaggaaaagttttgtaagaagcaattagataattttggaaaatatttaaggagctttacctttagcttcttggctgttacaataagttttaattcagcttggttggatgttgtagaagaaaatcgttgagatatttaaacctatagcaatgctaccagttttaaagaaatgggaaaaaaatgaaagtaaatgaaaaaccaatgtgaatgtagcatctttaaagaattataaattagctggaagcagcatccaaatagcagttcccaagatgtcactatgtaattatagctcatcagcacatgtcttgcatattccaaaataacccgttatactaccctctctttcccaaaccggggaaggaaagatgacagcaggcctcagaaataatgactaaatagttcctttctaacaagggtggctatcagcttttagtgtccaatatcttctataaaaatacatcacacataaggaaatatgtaagcacattcctagaattcaaattaaacagtctaattttcaaagactttcataagtttttaaagacaaaatgatttttcctattgaattttaaataaagaagaaaatattaccctaaaaataaaatagggggtacccagtaggttttgttgagctggggatatgtaggagtctttttgtccatggcctctttggtgtgatcacctaaaatgcttgacagatgggatgcatggcttcattagcaactgtatcaggacgcatggagaaagggggcccacttaaattgggtgtttggctaagtgactcttcctggaagcagtagccttgtggattcactcagtactagctgtggctgagggcagggtaaattccactgagcaaacagatgtgaatgttataaagcagatgctgatctttagtatcacactattgggaaaacctttttttcatggatacagcaagaaatacttgtacatttttactctaatagatgttaaaaataaagcatgttaaggttatgacacttaaaataaacattttaagtgcttaagatgaaatatttaggtattcaggttaaatactctaaagcttttcagaagtaaacgtttgctatctacaatggaaataaaaattcagaatcattatttcctacctactattgcttggacctccctttcaaccaatcaaacttaaaaagaaaaatcactttttatttcatgctcactctgtccctgtgaggaactttataaagaaaaactggtgctacaattcctatcactgacacccttctaaccttgtgtttcttggtgggtaattgtttattttaaaaagtctttctaaaattcctagcaggagtaattattttgatagatttttaagtgtaaatgtagctctaaaaaaatccatgcacatatctgttaaattatataataatgatccaatatagccaagtaaagccaaaatttagcacccactaacaggtaagcattatgttaggcagtggattctcaatggttgaataacacactttcactgatatttggactttttatgaagcccatagtagttcatgtttaccttattttattgcttttattttgatgcttttattttatatcatctcagaagtcagtgattgattgattgatttttaagtgaacgaaaggtctcacgtatttattactgaacccagcaaaccaatgcgttcataacagattcagagagaaaaaaatatatattcccaacaaaacatgtccaactctccagatagtggtgacattttcagcttgatatggtaacatgattgtgaccttcagacagcataaatatgtgtgccatctcatgtgcaattcctcatagacccagcttggttcttttccaatgtctccttttggagtttcacctgactttattaccagttttcgtctaaatccactggggaatgggatgattttgcttttgtttcttggccaggaatcctaaaagtcttttaaccctaaaagtcttgtgagaagacatggcgagaagcgcagtcaagcacacaccacgatggcagagaaaggacgatttattttaaaaagcagattttataggatatttctttgagctttagtaaggtggacttactcattttaaagatggagaaatggagtagtgagcagtgaaaaattatgtagtatcataatttgatgaataggacaaaaatttagtctcaagtgctaagggtttacataataccacattttcttcttcattccttaaacacatgaaaggcacccccaatagagacagtacctaatatgtatgaagattagagagagattatgaagtaattcaataccaatattctcattttatgccaacttttataaaaacatatacttagttcactttttacaatatcagaattactaatttaggctctacgtattttcatggactctaatataattttgttttaaataataaatgttagcacagataaaaatatttctagtacagtatttctggacataattcatattgcttttaattcatgcagaattgctaaaattcagaatttgtttaagaagtgacctatagggaaaatcagaataaacactcttagacagtgaaataattcactctctggtatatggctctgtttaacgtatttgaaaggccaaatgtaagaaccaggggaaaaaagttgagtgtcatttaggggcagaatcaattcgaaactttattctttccaaactggctgcatatcagaatcaccaagtgaggggtgaaggcttatataagctttccaaatcgagaacccctagaggttttctctttcctttttttttttttagcatatctgagatagtcctaataatctgtatttttaaaagaattcctatgtacttctgaggtataataaattcggggaaccaattttagatggattgagatcaaagctgtttgaatcatagctctgtcatttgccagttttgagagttggtgaaacaatttaagactcatgatactcatctgtaaaatgaagcaaaatagacctttctcatgagattcatactaggattgcatagggacaatgcagtgctgaacactgacaccaacgcaaagttgaggctcaaaaaaagtttgcattctttgctccttctccataaaattagcatctactattgacatggaaagcatgaaatatataaagcacgaaaactggccaaaattaaaagttctgaccacttcagctgattgagttatatggctattagatcgtctgtgttttttctagtacaataccagacacttaaagcatatttctacaaaccaaataagtctaagggcctcatttggtcctatacgatttggggttctatagcagaaaataacacacttcttgttgtttgagtagggattttataaaggaattatttacgagtctttacaggttgtacagaaaccacaaaggatagtaacactatctgggagctaaagatggtgggggactaaaacacctgagtcaaaaagggcaagaggggagtggttatttaaacctggagtcagagaagtttccctcagaggaaccatgacctgttgtcaagggacacagctggtacacagtgactgtcaggaggagggtattaggacaaaatccccaatctcactcttctcctgctagttgtttgatcatgcagcccattggccaaaggtcaaggtcagtctcccagggcacagcacgggatggagaagagctgagagtagataggaggaggaaattggaggcatatcatgtaagtcctatgtcattctgtatcataaagaaacacagtccttcaccccaaagtaattaaaaatacttctaatacttacttgtatcttttgaaaacattaaaagaaattcaattcataaccaaaaaacaatttaaaatgccttttctctctctttaacttggcctctctcttcctttctcattctcatcctccatcaaaacttccctccaaaacaaggtctccactaccctttatttctccattatgtttttgtgtaagtaaattttggcgctttctggtataaactccttaactctccatacccatttctgctttgcaaatgctcagaaacagaactgccaggttcattatctcttttagcaaacatggcgggaggtgaggataagggaagtaattgcaagcatggacacactgatatgcactgttgtcgatctccatcagacttggtgaaaaataatagcgcatctgaatataattcaagcaaaaggcagaatccattatggtcttctataagccatgacttgggttttcttccatatggaaaaatggaagtgtttttccatatgtaaaatgtaaatattgactgtacctgatagttgcattagaattggtaacattccagattttcatgtcttattctgtttgattctcacaaaatagccttgtgaggtaagtaggaatttttatacccttaagactgagaaaaatttaatgactaaatagaagaatcacagctggtaagtgaagaaatcaaaattagaattccagaatacatttttccctgagaactgaaaacactttacctaagaactgaaaacactgaaaagtgcttctttttcaaaatcaataaaaatattttttaaattgatgcaaatgcttactttgattactctattttgaagcatactaatggagatttcctgtaaaatataagaagaaaaaaaaatttgtttacttcctgcattgtcatttaaaaaattgattaaaataattaagaattagataaaattacaattgcaatgaaattgggaagctatgacagccccacaaaaaaagactaagaagactattgcaaaataccaatacaaaatgagagaaaaaataagggacaactcatctctctagatcttaaccaagacgcagatttcttaaaagtaactggtaaattcaaaaaggtctaattagtgatcctttacttggggtgagaaaatataggctcaacttctacttcccagaacagtagaagaggctgactaaaggtgaatgacaaatattggccatttttgtttttgttttcccattaaaactcctgacaccaaaaaactgccaaagatggagttagatggagttagaagagctgaagagagaggaacctccctctttgtaattgcataccgaggtcaccatatcagtgataagcaaactctaaattacaaaataaaaacctgtaatttaaacatccaattacaacaaggctaatcctctttgtgggtgatctgctcatctcaaagagagaatacaggagggagagaaagagaaagagagagaaagaagcaaagatcagataaataccgcattttataaaagaattgctcccaataaacagaagcaaatttatatcaaatgatattcttaaagaatataaagaaaacatgcaacatggaccatggattctgggtaaagaattttaaaaagatattaaacatataaaagagggatcaaagaaaacagagataaaacatgaactcaccaatttcagaaaataaattgaaaatatcagtatagtcatttttcagatgaaaactacacttgagaaagaaaagagtggaatatatactgctgaaatcagtaagaaaggtaaaacacaagcttgaaaagcaaattacacaaaagtaaaggaataaacatataaactcactggagacagaaaacaatagttacagaagacaaaaagtaaccaaatggtcaaaattgatattcttgaagaaaacaaacaaaaacaaagaaacagacaaaatttcaatagtttaacaaaagaagtctttcttgaaataaaagacgatgaagttaaggaatcacactgtatttacaaagaaatgatgtggaaagttaactgaagattctagtgaagttactggaccttaagacaaaagataaactttcttttttttgtaattttattttattattattatactttaagttattcacaactattgggttagaattatgtccatgaggcagatgaatgatttggggctcaaccacaccctagtcggggagcttctcaatgaagggacctgagacttctccatctttgtgcctccagcactgaacactgtgcttagaacagtgtggtggagaaaaagcaaattgggagcatttcagacatcaacttccaatgaccaatgcagtggagaaatgctggcaaaattctaacagaaaaaatacatgactcatacattgtatactcagccaagatttttcagtcaagtgtatagacaaaaataataatttttggaacattgaaggacatatgaaatgtattggccatttttaaagttatgtatcatacatgtaaaggatatatgtatcatatctatggttatatatatggctatgtgtagagagagagaaagatatcttcaagcaagagataaatttaaataatgtgttctctataaaggatgactgctagtgctagatcaatataaatgaaaaattagatttaaataaacaagataattatggttacagaaccaaatgtaaatgttataatccttggtattttacaatcatgtaaagtactaaaatttgggggtaaaagaaaatacaaacatagtaatttctaagtttcaaagcagacagaaattgtatacagttaatcaaaaaatagttattcaaatgtattatctaaggatattgagaaaactactaaaagaagctggttaggtgagctgatgtttttcatgcctcaaaaaatacaaaaaaaaagagtacattcaatttagctataaatagataagaaggaaacaataaatcatgaaatacaatcttctaagacatcagaataggaccacacacatttatgaaatcaataaatgtaaatggaataaaatttattctgaatagaaaagctgccataatagtgaaaaacatccttaaggacacaaaaatgtgagcactttgaggacaaaatcttggtctttgttcgccactgtctccatgacatccaacataagtccaagcacattgcagacactcggtgtcattgactaactcactaagggttagtgaaatagttcataataatccacacaaaggaataatgtgtagttaaaaaaaactttttccttattgtaaaaaacaataaggaagatctaaaaatgactgatgtgaacatttttgcatgataattttggtgaaaacgctgcagaataatgttatactatgatatcatttgagtaaaaccaaaatatgtagacattatataaaagttatgtaagttataatacattatatacatatataatgttgtggatacaggaaaatgtctagaataatatatgcaaatacatgtgaaaatctcaatagagtttctaataaaggaaactagggatgatgggagaaagagaatttcacttctcatttctgacctgttatattttaattttatatgatgatggtgtttttataatttaaatcatataaatcaaaacttaataaagactacagatgttacctggaaatttctagtcaaaaatttaatcctttaagttaaatcactaaaatacatgaggggaaaacatgttatattattcaaatagaaataaattaacaaaaaatatttccatcaaaagactgactaatcttttgataagtttaatgataaactcaccatggcaaccaattttatctgcctctataacaagaagatcattcaataggttactgagaagatagagatgttatttatgctggcaaaataatatttagcttgtgtaccatatcacctaacaattagcaatctggagagatacaactttcttactaaatggtgaagtaacattcaactgagaaaaacataattcaagcttaatgtttgggtgatacagaaaaatgtggtctgaaacaggcagtgaatgacttgtttggcacaaatattggaaaagtgaaaaacagttcatcaggaaaaccaaaagccactaagtcctaggtggagaccaactggacatatgcaaattcaacagtcaaggcaatttctgctaatatatcacaaatttcacaatcagcaatagactacaattgtaaaacaaagttcttcgtgttaactctgaaagtgtctgtcagcatggatagcacaggcagattggggaagaccataaaaagcataattctgcttttaattttaggtgagctattatataaagaatggtgataactgtttgtcatctcttataaaaacagtattaagaaaaattatatgacagaattttattcagatgtaagtagggatgtggtgaatttctgaggcattaaattatcagcctggcaatctttattttattttgtattttattttattatattttattgtattttagggatggagtctcaatatgttgctcaagcttgccttgaactcctgggttccagtgatcttcctgtctccgcctcctgagtagctaggactgccaggcatgtgccatcacacccagctccaccctggcaatctttaacacaagttgatggaagtcagatgtggtggcacatacctgtaatccccgctactcgggagaatgaggcagggggattgcttgagcctaggagttcaaggccagcctgggcaacacaatgagactcaccctttcaaaaaaaaaaatcagaaactagtgcatagataccatctgtttggaaggcctggttaagatggtgtccacaagctagaggcctgaccaggagctttgcatctcaccacgcccgagtggagttgctgttcaaaggcagggaccagtttttttccattatttcaccagtacctagtactgtgcctgagcaagtttaaaaaaattctctggtcttaaatgtttacaatttaaaatagaattaatctgttatctgacaataaagttgtaaaattttaagtaaaatgatgttataaaagtattacatgctgcttcaagaaaatatgaaacattcagggaaaaaaaaataaaagaaccatattccttcacttagaaacatccatatagtaaatgtctttcatctctctctctctctctctgtgtgtctctaaggtatttcatatattttaagcataaacataatttttactctgatttttattttatgctgtattggaagcatttcctatgttactacacaattttaataaatcatatttcaaaatctgtatcatattacatgaaatgactttaccactgaatctcaaaacatttctctatagatagaaatttcagctgttttcattactgtaacactttgcctacttaggtttgttttcttaggatagattctcagaaacagaattacttaccaaatatataaaagcttttaaggatctttacacatattgtcaacctgcttgccaagaatttacttctgtaaacaatataagttgaatttcacttacatgctttgaactgtaagtgagcataaatatatagacatatagacatatatattgtacattgcattgtattttatgtctgggtatttgtttttccttcttgctgaattgtctgttcaagctgtttgtcatttatttgtttgtcttaatgtttttcttattgattattatgaattcatgatagagtaaatatattagtcctttgtcatgtttgtagcaactggtgtttgggtatatattctgtgtaaagtgctttcaaaatttgttgtcagataaatttgatttaatgcaagtatcattgttaccactgaataaatgcattaaagtattatttccttgcttatgctgtttgctgaaagaaatgaatgcatgaacatttatacaataagcagttaacatggttttaaaaggacacagtttctgtattcatattagctagttactccacatgctctacagagatattattagtttcatcttgctatgtgaaggagtgatttagtcaattacccttggttttgtggtaaatacttatcagaattaatattacgatatacagtttttggttaatttggtgtctagtgaaatttttcttgaaattaaattctgaatctttgccaaatttttaacaatttttatatctcatattggtttgccagttccccagcacgccttcctgcaaaataaaactccatcatactcattcttctcttcaccattctgtctcgtccatttgccgtgttccagtcacagccattcatgtaattttctctaaatactccatgaacatttataactctgagccacgcacctccattttctgtccagagtgcatttcttcccatttctcaacataccaaactccaacccatcatcaatggaagctaaaatcaaatattatttctcccacgaattcttttggaaagccccagatgagtgagctcctttgagtactcgttccatctatttaggttcactggagttaatatcacgttgtgtttcattaattttcatatgtccattttccctacaaaactataagtttaaattccaaataactagtacagtgtctgggtctgcaataaatgttatgaatgacaatcgctatcatcgagcacttttggatgtctgtctgatgtgtggtcaagtagacagcatggcacaaaaataattccaaaaatttaatctgaatctttcctcttctttccaccctggctcccacctctgtagaccaggtcaccgtcgtttctcacatgggccacgttggtagcctcctaacctaagtctctgcttcttcctttgccccaacccaatagtctattctctagtgaggactcagaagaatctttttgaaacatacatgtgatctgtctctcctctgcaatggcttccagttgcaaaaaaagtaatactcagactccttagcctgtccagctgctctccacacaccaaccctggccgaattttttgattccctccactttgccaacagtctccagccactctgacattttttcttttcctcaaacaccccttaggttttcagtgctgtagcctttttaccgacagttccctccccattttccctctttcactttcttggcttgctttttattatcatgaaatttgagtttaaatatcacaaacgcagagaagctttcccggacaactcattctaataaacccctttgtcttttaatcatttcactctatgttacttcatgcatttcttactctttgtttatttgacttttttgcttaaaaattatgattacttgtatctcaccattgaatgtaagctttaggatagaagataccttgtccataatttatttcacccttgtaagtccagtacttggcacaaagcaggtgcaaagtaaatattcctaaatgtggatatggtgatggcaggaacggtagtaataatatctaacatttattaaatgactacggcacacaaggtcctgtcctaaatactgcatatgtgttaatttatttattttaaataaaaatgcatacccagatgaaactctgcagtagaaatggtagtcattgtcattatcccaattttacagataggaaaactgagacacaaagctgtgaaataactagcccaagatcgtatagatattgagtgatatatctatatatatctatatatcactcaatatagatattgagggccagagtttgaattatgtcacactgacaggagacccaactgtcttaaccactgtactatgtacatctcattttaaaataaggaaagaaattcattgataagacttttaaagatagcttcaaacgtagtttaatttaataaacaaatatatctcatgagttcacagaagattttttaaaaataaagcaggttaggctgtcattgttgatatcatatcctatgacctgtcacgaaataaataaaaactagttatgtgagagctaattccaatgtctgtccttagaaaaaggcaaagacttttcctctagttgaagggaatataagggacatcactacattgcattattttgaaaaaaaggtagcaacgctggacatatggtgtggttcaagcccgtgctgagtaacttttggacagggacactaaaaaatagacctaacctagttaataatagcaaaccactgatccgtcgactaatcgtgtttataggaaatagaattcatgacaaaaagaaatagcagcatgggacagaattaatccacaacatgtaatttccttcctgtgcatagccttcaccaaaaggaaatctgaagactcgccacctgttcagaggtttgcttttcagaagatttggaatggcctcccctcaaaacgactcaaggcattcatttatgccacatgataaaaataagcactgtgcttgctgaaaagtgaattttgtgatctaaagaagaatgaagtaaaaaatagttacattttcaaacttaattttagtaacagattgtgtgtgtactaatatagaacacctgaaatgtcataagcagaaattagtgatttttattattttttaactgatcaagctgttttcctaatttatagtaaatgcttttccacctcttaaaaatctttaatttcttttctctttctacaggtccaggagtttaggaccagcctggcaacatagtgagactccagctaataatacaaaaattagcagggcatggtggtgagtgcctgtagtctcaactacttaaaaggctgaggtgggagaattgcttgagccctggagttcaaggctgcagtgaaccgtgattgcaccactctactccaacctgggagacagagcaagagcaagaccctgtctcaaaaaaaaaaaaaaggaagaaagaagtctcaaaaatgaaagagagagagaaaagagaaagggaaggaagggaaggggaaaagaaaagaaaaaagaaactgacagcaatagtagtcaccttgaggggtttgttgagagctgtagatatcatgtggaaaactgctggcacgtagcaaatgttctatcgtggatctgccattgccactatcccttgcctgtgcctggctagctacacatggggctcccaccgcattctgcaattccctgtatcattcattctcttcaaacatgctttttggatacttaatacaataacatcactgaatcccacagtgaatcccaccttggggcacctatacctctgagtgtcggaaagattttgatttttttaagttccataaggaatgctgcatgtatctgtggcaacattgtacaaactaaaatgtcaagttgctttctaatggatctggaattttattagttatttatttgtcccctacccccacccacacaaacccatattttaatattcatgaaagcaaggatgctgtctctttggattttgaatgctgtgtccagcaaaatgcaggttgcaggtgatgaataaacaagaagaatgaaatgccaattttataaaatgttgctcagaagttctgattaacactcatatatataatatattttttaaagaatgcagcttgtttagaatgttaaaagcctgtcaaacaaggggttcaaacccacacatacacacatacacatacatactaaaagaagccattggcccttggtggaagaaatattgaaaaccaatgatttaacccatattctggttatgtctgacttggagtattctgtctttgatcctcagatatggaatgtagaaaccatgcccatatatcttgtaaccaatgtagagttttagttttgtttttactcgtcattatttaataaataataaataattatttattaaataatgacgagtaaaatagcattttactcgtaatagcattcaacatggtaacagcattcaactcataagtatctataaaatccaaaataattaaatgtatcttgattttctgtgaacacatcaggattgtattttgcctaggacagaatcttagcacatatttgaagcattttctcctgtatgcattaaattatgtcctatcttcatagcaaatgacagagattaactattttctctgcattttgaccttgtgggtaatacttcctgtaatgtcctgcagaagctgctaatctgccaactgagattaggcagatttctctctctctctctctctctctctctttctctctctctctctctctctctctgccactctaaaattccaaaggggtcatatttgttttggtatttttataaattaaaaaatatgccaaaaatattatctaatgaagaatttaaatcataacatctggacaaggggctattatatttttttacaacctctgaaaatttgtatttaaaatagaatggatttctctcctaatctttacatcaaacataacatttgaaatatttgaaaagatgataaaaatgaatttgaaagtaaagatccaagtattcagccataaaggcattccattgggaaattacttgccaataatctcaacagctgaaatggatccttgcaaagaacattagatatagaatcgggatctcagacttttatgcctaataaactagatttcggaacacaaataggacttctaaagttctgtcctgtgagtagtgtgagtccaaaggattctggatcctccaagaaaatacttctttccaattgtcacctctgcttagcttagacaactcaggctccaatttaactccctctacaatcttcccaagagtagcaaaaaggaacagttatttaaaatgaaacatatatacaagacagaatgagaccactgactgatctcagcaacataataataaaataattgtaatcttaaattgagtttaagagcaatgaacagtaaaaaaacaaacaaaacaagcttccttcatacctacttcttgagctacttctctactactgtaaagattaaagtggaattttacttttaggaagcattgtagaatatgaaatgactataaaagttagtaattccctatgaaatgttttcagcaaattgttcagtctgagacgtagtttttccattagttaagtagagactcaaagttggcctgagaattgcataattctgagataatgtaagtgaaaaccattgcacagatgaaatctcagtcaacagtgcttttgccttaactactgaataatactaactagaggcttctggaaatctctgtcttcctaacttggaaatacacacacacacacacacacacacacacacgtacgtgtgtgtgtgtgtgtgtgtgtatatatatatatatatatatatatatacacattattggttcatcatttctgaaatcagaagcacttcagcaaagatctcttgaaatctccaaactactgacatatttagagtatggaaactttcttaatgttcattgcatctgacacagaccatcaaacagaaattctccagctctgaaaagattgtttgttcactgtcagttcaaagaattatttttccttttaagaagtttgaaagcctttggtgcattattcaacttgcctacaaaacatgtaagtgtcacggtatgcagtcttctttctgaaacagtataaacaaactacaaagagatgtgtgtttgagccctaatgttttcagagaattttttatttaagcaacatcttatgtaagcaaccagaaacacaggaatgatatgtttagttactataacagcatgacattttaaaattgacagtaaattatgcaaagagttagagattatgaggcctcagtgttgcaaacaataataggataaagttactttgactaacttggtagtatgttcacaggtatctgtgctgatggtcacctatctaaaattaatggaggccaagaagcaaaagttatgaagctaagggtgcttgctaaaagcatgtcaacctacaaagatgatggaaggattaatatgttgcctaactttcatcattttaaattgtaattcctttatctgttcaaatattttgtagattaattttatcaactgccacattactagaatatggccaattttacccaccttatttttaaacagatgccagagattgtggttgacgaaaattgtttttagaatgactatcaagaagatctattttagaaatcactattcactttatattcctatttaaaacaactgcagtgtctctttgttttaaatttgcacattcctcattaattctaaagttgagcttaagctgaaagttattcaaaacttggaaaaccatgactcactgtcctaaaggagagaatgtccccctctcagctatctctgggaagtgtgcagggcactcaatgccctccctcccaggcaagagcagcatgctggccccaccgcgtgcccactggtgttatgtagatgattcctcatcagcttgacttaccagcccaacctgcagcctttagacactattccctttcccaggggagggacctggaggagctccaggcagatcgggaggccagccctgggctctgctctgctgcctcccattaccccgctggacagcatcccaagcaggggaggatcccaggagagggaagacttttcataagctcaaccatttaccagatcttcttgagaaacaggaagaaagccaactactgaactctgcttttcacactaattttacagccattcaaacccttctctgccacatgttgacatccattacagtgaacccacaaaagtgctcctgcattcactgagttcttagcctacttttgtaactgacctaatttaatgtgtatttgtttatttacatccttaatatcaccatccaagtcattattacctgtattggactgcaaattttgcacaaatgggatcatatctgctcaattcactttgcaaaatgattgccccagaatcaaatacaagccttagagtacatgcttttctcttgggctgactgtggtctttgaagagcctcattaaagctgcattcaaggtgggagcccacctactattcaacggaagtggctctgctaccagcttccataattgaattctaatgaaataacacaaaatgtagctaaaatcctttagatgatcccactcatatccatagcccattaaaagaggcaatgagtcacaggctaagggttctgaagagtgcctttcttcacatatgacaaaacaatggaggcccagtgaggtaaaacggtttgtgcagaattagagctgactggcatccatctcctgaggctcagggttgcccttcacagaggaagcagcggacaagttgaaaactggaaaggtggcttcaagctaagcgcaaacaatacagtggtatgtactgacatcagccatagccattcctgaagttggtcttttataaactcatgcatttcaccatctgatgaggtagatgaaacaggggtgattgaacataggttcaaaatgcatcattccttctggaaacaaaatcaagttgctctaaaactcaggcttttagatgtgtgaccccaaaatgcaagtgtaagcaatgtaagtgtcactctacatacattttatgtaatatatatatatatatatacatacacacacatacacacacacatacacacttcattaagctccagtgtatgcattactctgaaaaatccctctctgctatcataacgctcatttgttacattttaagataaatgactgaaagcaaacagcaattgtgagacaggaaatcaaattccatcagatacagaagtctggtaccatctgccgagggtgcaatgatgaagtataaacacagagcgcattttgagccctccatagtgaccttgtacaaaagtgcccaggaaacaaagatgatgtgacacattttgcgacttatatataccagctggatataaaagtcataaaaagcaaaggtgatattatatatatttgacatatatgaactggattgttttgttttaatttatttaaatgttattttatgactatgaaagtactgagaactagtggaagaaaactggacaaattaaaaatttaaattccccataatccctccatcaagagattattttgaacatacagctatattttcttccaaacctctctatacttatgtatgtttgtatagatagatagataaatagatgatagatttaataaggtttatacaatgttttcattcttctcccaagtaatatatttacatggaaacatgttttatggaaaacatggtattttggtaggtaccatcatacataagcttatctgttaactatttcttattgttgaaggttcaggttatttctaccttttggctattaaactaacactacaactagcaaaattttaacaaaatgcacattacatttaatcaatttagttgccagggtttgcttcttcacgttccaaatttgagttatatattatgtgattgtttttaatatattatttgtgtctattactttgttcctcattttgtatattgttgatcactaatttgtaatactaattctagtaaacgtatgccaggcaccgttctaagcactttccatatatttgcacatagtacaaaataatgggcacagtgcccaatgcatactcaattatattttttctttcctcagctttactccccttaaaaaaagtaagttaaaaaaaaattgaacccttcttggaaacaacacagtctaaaagtctaagctttataaactaaccattaacatcttgttcagaataaaaccctttgggaactctatttgaaatacatctaggctcccctggaaaatgcctggccatcagttctccctgctgaatgcacagatgccttccaagtcttctccctaatattatacagattctttcctgcatttacatctattggaaacagactgacttggagacatgctgcccagagaccaggcctaaagttatattctgtgtatgatttaatatattagggaggaagttgtatacatagtaaataataattacaaatatcatttaagtataatgtggatgcagtgctgtagatattaaatacaaattatttttccttttttcactcagttcaaataacagtaccttctcagaccacatgctgcaggaaaataggcaattatttcagcattatccagacatgtcagctactaaagaataaatagcatatttatctttttaaaattatgtagcaggttggaaacaaatgtcattttaacagctggtaccagagtttcccaaagagagagaactgcctttgtttaggaaaatacctggagagactgttttaagtgggggagtatgacccaaggaaatgttttatgtgaaaaactgcacaaccaactgatgctgactgctccatgagatgctcatagaatctggagggtggagaagatatcaagaaaggagagagggcaagccatcagtgagagtggagggggcagtggtcagcaatggaacaggatgtttgatcatgtggaaaaggaggtcaatttaaaaaattccagtgtcaggaatgcaggacagcagctgaatgagtgtttggttctgcaaggtaaactgccttagtcactgcaaaccttcagtgaagccattatacacaccaatgccttctttgaatggtggtttttgttttattttggagtatgcatgagataaagaaataagaacagctccaagagctaagatttaacaaacaaacaaacaagatctagagtttaataggaatatgaaaacagatctagagtgaacatgagaacaggtgcccctgggaaacaccagaaatcatgggaaggacattgagcttcctacagaatataaagttgagagtttgggtcaactctgtgtacatttcaagggaacctaacatcatagttccatgaagggatagatacaatctctagaggaggagtataaaataaacaggataaaaaggtgctttccaacgtgcttggagaactggacttagatttcatctatttctgctattactttcttttattcctttttttccccaagtgcttgagtttcagtagtaatattttcacaaggccaaacataaaataattttaaggaattctaaatgaaatcaagccattgttctgatgaaaagtaagattttctttttactggttataaaatagagtagcatcaaaactgagttacctgtatgcaggctctgagtaagctcaggaggtagtaagggctgtccctgagcctgtgctgccattggtccttgaatgcttttctggatttagaaatgtccagtaaagaagaagcaagagtggccctctccctgaaaactctattcatcagcccagcaaagagagggtatgtctcatcaatgttctagcatgttttggtcccacctcatctccctcctcacagttatccactcttcaaagcagaggaaacaagcccctaccgctgtcagtgctttgacctgactctactccaccatggtcaccaacaacctcctaatgatcaaaaccagcaatcttctcttcatttccatgtctccacacttgctcctgaagtgtagtcttgtcataaaaactactcacctcaccttggaatctttgactctgtttatcttacgtattccactattgctctgatcctaacttcttttttttttttttttttaagttcagaggtacaagttcaggggtactgaaatgacttccaaaaacatttctccagatttctcatctctcccagcttcaagcctctatttccaaaagcatacactacatgtccatctagatatcttactaaataactcactatctatgtgtcccaaacagtggtggcaacaagggatgaccaggtcaagattgatcatttctctactaggcacctctcacaactataccaaagaaagaaaatcatatgtccgtactgcaaatgcagcaacttcttctaccatcttaggccccacacatataaattcagaagatgccacagaggctgaccttgccgcttctcctaaccctgcttcttttttttttttcttcctttgagatggagtcttgctcttgttgcccaggctggagtaaaatggcacgatctcggctcaccgcaacctctgcctcctaagttcaagagattctcctgcctcagcctcccgagtagctaggattacaggcatgcactaccatgccaagctaattttgtatttttagtagagatggggtttctccatgttggtcaggctggtctcgaactcccaacctcaggtgatccgcccaccttggcctcccaaagtgctgggagccaccacgcccagcctcctatccctacttcttacaggttatcacataaggaatctgagccacttcttattttgaaattatttcatctgtcttaatgtcagtttagtatctgtaacaataacttatttcattttctttccaatgaaatatatctttatctccataatacttagtgttccataatgatatgtggaattgaagggctctctacaacacaatctcctcatgcccacacctaccttcaacatttatcttaagctaagccactaagagctttctcaagttgtgcttcctaaagctgcagttctcaaaatccaccccacatacctatgaagcccatataggaagccccattttaaaaataatttttgtaatcgaataaatattagaaacacttcacacctcctcttggagattcattccaaccactattaggtcacactattttcactcatattccattggccaaggctgatcacatagctatccaataaaagttctgagaagtcatgcaattaaaaaaaaaaaaaaacctctctagcttctttatgtcaatgttttccaaaccttttattaagttatgtttattaatatctgaaaaacgttaggattcagattatctatgttgaaaactagtagtggtttagataaggtaggcatttatctctttctctgagagagcacaatcagcccaaagcttgtatggtggtttcaaggctccttctatcttgttgctctgtggtcctgcaaaagcaacttttcatccatgactgccccagctcctgccatcacgctcatgttccactcaatggagacaagaaaagaaggggacatattgcactcttttgagcaaatgacctgggaattggttacactattttcactgaaattccattggctatggcttgatcacatgatcacaactagctacaagggaggctgggaaatgtagcctttagcgacatgatcttatgctcagctgaaacctcttttattactttaaaaagaagaagaagagaacagaaaatggagaagaatttgtagtctctgctataacaggtccagaaccccttctggtacatgctgggctaaagacctgatgaatgagaataagattatggaggatgcatattaagtgatctagaaggaagtgttttaccagcaatatctaacatcttcaaacgttcacattgaaaaacagtcctttgccatcaattttatttcaccatttcttcaaatttagtgtaaattccaaccattcttagaaaattcctttattaaatatttttaaatattttcaaagatttacagtaaacaatttctctgaacctactgtccactgtaaccatacttcattgaaaaaatgcaatcaaaatttcttttctctaacggtgtgtatacaaaagggaaacattcaattacattaaataatttgtttcactccctaatccttaaattcaggtctgccactcactagctttgtaaccataagcaggtcagttgatttttccaagtatcaatttctgagtctcatttcctctgtaaaatgaaaataatgcatactgcagtattgttgtggggtttaaatggaataatgcatatatatgtcagtacgtagtaggtagtcaatcatcgttggcacttacttttgcaggcaaaaagtaggtattataactagatgatccttaatattctacatttctgtgatttaaaaaatagtaaagggtgggtaatgcagaagtgctggcactggaacttcaggcaacactgtagtaaattggtgctttttcccccgcaagagagagcagctttcttgatgtcatctcaaagtctaggaaacaggtcttgcatacacaaaagcatatttcagatggcatagccagaatgtctccaaatcgcaactctgacaaaatcaattataaaacttcataagattatcttgatcttataaaggactgcccctcatgaaggactctatgaagtcctcaataaaatttgttgatgacgggaatgacttagggttgctgggtaaataaggcagaacctaatgataaatgtagcaaagtcttaatgaaaaaattcattagtaaagtttactttggataaagtttaacctttgcataatatgagcaataaaggaataaacagtgcaatgacctctcacattaaaaaatgaaaaaaatattatttaaaaataatgaaattggtctagatgctctctagatttttttactctaaaattttaagaaatttacaatattaatttcagtgtgaatttttttagattaaatacaattctatgcattaagtacaagtacagaaagccatctgagttcgacagtcagctataaaataatagaaacacaaaactaaagcattccagcaggaatatcaaacataaatgcttactcatggttttgatgcagacaatcctacttttaaaaaattaaatggtattttttaccgaggagtaaagaagaccctaaataattaatataatcattggttcttattgcaaatagtcaatgtttaagtcttagctctctctcaccctgtcattcttccttttctatttctctctctctctccccctccgtctctctctccctccctctttctctttctcaccactttgagctgtatacattacatttttcaaaaagaaggaaaagaagagtcaccaaagacacaaaaagtacagaaaaaagaatgaaccttggaggactccatgactgaacatatttattcatttagaaattgcagccacaagaacacatctacttatactttcctaatgtcagaggaaattttttacagagcaaaggataatactcatgagtccataataaatccctctggtgatctgattaatgttcttggtacctggattaatacaatttttttggttatacattctgcttcgaagtgaagacttattttattaagaagaatttctggaatgtgtgatgttatataaatgtatttctggtagctatttttctggagataataagaattatagaaaactcactttcttggaatggtttacatccgtgaatttcaggaattagactgaactgacagttggtggggtaaatgctagttaagacttatatcaacaataaactcggttcttcaataacctggaaggttacactaagagttaataccacacaatctctgccctgaattcttctgtattttgatattaaactgtttgagagtacactacattccaacatttctaatgatttttcttcacaaactctctacatttttagacctgtgtttattcagcaaatggataagataaatctctgtgaactagccaaataatatcttgatgccttttaatacattgatagcatttaatcagtacccagcactgttctaaatattttaaatacttacaacttacaatagggtaggtattatttttattcccattttccaaatgaaaaaatggaagcaaagagaaagaaagtaatttgcctaaggttacaacagcttgtaacacatgaagtcaaggctgatacttcaaggcaaagggttgcagagttgcagagatcgtagtacaagatagaggattggtgaggaagactaaggagggggtacccctcatggaacaggattcaatagcaaagcagcatcaagaaggaaggaaaactcactggaatttatatccagaaccattggtctgagactcctaaaacatcctcagagagcaaaataggtctcattgttcacaacaggctccaacttggtagagggaggtaagtagtctcgttcatgaatgtttttatttaggggccagcgttcctaagcaatcattgccatattctcaccaggtttgtccacaagctctctcctgcatgcattatgagcactaactatttagcaccaacttccctgaccacgttctcccccgcccaccagtctgccccctcccgctgcccagaaagaaaccccctgctgcccaaagctcacccatcacataggaactggtcaagttccacctcttccacaaaatgccccctttcctcttaaatacctaaatagctacagcatttgtcatctgtactttacactcagtcacatatttcattgaaatgtttttgcttctctgcatgagtaactaacctgggaattctctgaggccaatgaccatgtagtattacttctctctatgtataagtattgcttaactcatagtgctcatcatggtgtttgctcacacaaattgcctaatgggtacttgttaaataaatgtatccgtgaatgtcataacttccatcaacccactatttgtggtgcataagaaaatgctcaataagtccatactgactaatgaattatttcactgttgagtcagtaattgtttgcagtattacaacaaaagactgtgatcctaatccagtactagttatttaaaataaataacatttaatatgtgtcaaaggcactttgtataattctacaggagccacactatggactaatccctgggattcatttctaaagaaggcaaacattttccttattctctcaagcctagtgagaatacattgcatccctggtcattccctccctatctttgacacatacttgacaatggttgtgatatttgagctttaatagtcatgggggagggggagggggagggatagcattaggagatatacctaatgtaaatgacgagttaatggatgcagcacaccaacatggcacatgtatacatatgtaacgaacctgcacgttgtgcacatgtaccctagaacttaaagtacaataaaaaaaaagaacaaacagaaaacaaaacagtatttcagagaaaaaaatagtgatagcgattaggaagaaggctagtaactcaaggctacagtccctggctttgattttgctttgaccgttctgtaaatgtgcatgtacacagcatgcttgcatgtactgcgtctggtgtaatactaagacaatgaaattaaatgtgactggaggttaaatagcaaagccaccttagtttatgacattatttggatataatcactataatcactatgaacatatctgtttcctagtaactacttaaaaggtagacatgcaatttaggggataattctttctgaaaacatctctattaaggccatgcctttttttcttctcctctgcaaaatgttttcgacttgtgttttatttaaatttcagaccagaatagtacagcagattacatagtaacttatatctccacaatgagaaaataccttagttgatcaaatttctaatactgaatgtttaatttttaaatgttcttgtttttaatctgaaaggctgaagaagagctaataaaatatatcacatgaaattttaaaagtgagagataaaatgtatgcagacaatattattccatttacttccatgctaaaccccttactttattacagacaactttggggggataatcctctggccactggagtccaactttttacctttgtcttcccactacctaagcacagcagaaactctctaatcgtcttcttattccaaacatcagatgcagtgcctggcacacagtaggcattcagtagttgtttgttcaataaataaatgagaatcttttgaagccacacaaatgaactaataatatcttttgaggatgaatgataaaaagcatttgcatcagagaataaagtagtctttgaagttgaatctctctaagagtctaaaaattcaaaggctcttctacatgaccatgacagtttattttatttcaatactactttgaaacaatgacttcattttctccagcttttttattttcctcaatcataattagaaaaggctaataaagtggtcatgtttatgtaatattgccaactaaaatctactgcaaactggtgaaaacaacttgtcacaactaacaaataatgtgagccttattctcacatatcctgttattcacaataattaacagaaaaactggttcaaagatctaactttgtattaattctaagtgcagcataagagatttacttttttactattccataataatattcatagaattaaaacaaaacaagtactttgactctctcagaagaaaaatattattcccataaattttaaatagtcctttcatgacacaaaagtatccactttttgcttatttgtggagtaaaatacatttcctatatttttatatatctatacagctgatgtcttttctcatttttttaaatttatttaaaatttttttatttttatttttgagatggcgtctcactctgtcacccaggctggagtacagtggcaagatctcagctcactgcaacctctacctcctggattcaagcaattcttctgcctcagcctcccaagtagctgaggttacaggcgcctgccacaatgtacagctaagttttatatttttagtagagatggggtttcaccatgttggccaggctggtctcaaactcctaacctcaagtgatccgcctgccttggcctcccaacatgctgggattacaggcatgagccaccactcctcaccctcttttctcatttttaaaagcttgtatccttcaacatttttctctatattctgtgaatttgtcaggtttctttttttttttcaattggagtaccaataaatgccaaggttagccaatgaaagcctgggcattataggatgtcactaaattgatttattgaccctttgccttacaacaccttcaacatcagagaagtagggattcagtcagaaactcctcaacacttagtattactagaattatgttaccaattaaaatttgttcatcactccttgagtgtggtctcttgtgagccctgtaaagaattaaacaaaaagtgatgaaggttttaattccaccatgggtctgcttgccatcactatatttctagatctcattgtacacattcatacattgatacaccattcattcccagcatttcccacatgcttacttttaatggtgtgataatctgattaatggctttctagaccattagaaaacccattgaaactcttttggtaaagagctaaaattaaatattttaggctttgtgcaccaaaagttatttgatgtaactactcaagttggacattataacatgaaaaacatcataggcaatatgtaaaagaataaggatggctatgttatgataaaattttatttcagtgtctgtacccctaaattaaattcacataattgtttacatgacacaaaatactagtcttcttttagtgtttttcagtcttagcttgagggttgtacgaaaaccagtaggaggtaggttcagcttgcagatcgtagtttgctgacccctgcattagactttcagacccataagaagagattctgtgtcatatcttaatttgccaacataggtacaggccttagacaatgctctatacattgtacatgctcaacacatgcttagaggatgaatcactgctaaataatttatggttctcttaataccatggttaccttgttcgtgtgtgaatgatttttttggtctctctctctctctctttccctccctctctctctctctgcctttctctctctctttctttctaagattctagtgaagtcagaacgtggtagcctgagagggttattctattcttaaagggtaattcttactttaaaaggtaagttatttctattaagttcaggatatttagaaagagacttagttttcaaagaagagctcagttgagtaactcaaatggtacaatgaactgaatgattatgtcccttcaaaattcacatgttgacagtctaatccccaaggtaatgggattacgaagtgagatttttgggaggtgcttaggtcataagactgaagccctcacaaatgggattagtgcctttataaaggaaacagacagctctcttgtcccttctaccacctgaggaagcaaggaaaaggcactgtctaagagccagagtatgagccctcaccagacacctaccctgacagtgcctggatattggacatcccagcttccagaactggacaataaacttctgtttagcttataagctacccatcttagggtatgttttatagcagcctgagcagactaagacaaatggtaataagccacacagcacatcatcaaaattgtcactgctaccttcctggagcagcctgagtgcaacagttaacagtctcctaagattgagagaaacatatctttggctctctggacccgatctactttgttctggtgccaactaccaacttttccattaaattctagtgctgtgcctgagcccagcaccaatgtagtattgtgtccttctgcatatgcaagacttggctgtggtcttcagctttattctggagtaagtgatagggtacagccccgagctaggtccagggctactgtcactcctaccagagcagatttattgctgcgtccctccacaatccttaaaatcatatagtcattttcaccctacgcagttgtcaccagcccttgccacagctaccatgcctacaaaatgacataccagcagcaaaggataactctgtctttgtgagacctactctgtggatctatgcaaacctatatagtttgaattgttctttaggggagcataagatgttgcagaaaccaagtacaaattctataaccaataatattttgaaaaataaaaagaaaaaatcaaaacaaagagagagttaaaatggagcaatagtattttatagctagtaagctgcatgttttcttgtgcatgactctaaaagcagtaaaaagatgctttgctaaaaagcatgactgatagaaattttctaacttttcagccacacgctgttgaaaatatttctaccaacgaaatcaaaccagtcttataaattatctacattccttcatgaaccatcatttacaagttacaattaagccttttcttcttttgaaactgtctttacaaatattactctggtaattttatatatggggtttggtcctaccttcagattagagaaactgtattttgagttctgagtagaaggcagagaggaactcgctaacatgttcataggatttgggaggaaaaaaagtctagaagttttcacagtggtgctaggagaagcttaaaggagtgtattccttccccgtgtcaagaatgtgttctctattcaccagagtaaataaataactgcataggtgtaaattaaaatagatagatcaataaataacattttttagaaccagaaaaatcagcatccatcaagctgagagtccccacacaataccatactgtggggtgtgctatactgaagaaaccaaggaaagaatgttaaagacttgattggaataaaatcagaccctaagaataaggctgggaaaaaaatacagagctcagagcccagcagctacgtacacctgaaaggattcaacaggtcccaggaaggtgtctgcacctctgccctgactcctccaatgctctggtttttaccacctcaaaagggaggtggtatcacttattgtaggaccccaggccgaccctcctgcttgtccacatggtgcctgtggtgcctacttggacttaaagtataaaacttggaagcatttaaagggtaagagaaatgcttgagagtcgctgcagtgagtcagcacattaatgctgactccacagttatctggattagagccggccttgtctgtgacctggactctcactttgcccaatcccaagcgcttgcagaatggctggctggccggagcccccgccaatttgtttttctggcttgcatttcattatttaacataaaccaggagtcagtactaaaccagccttctagttctcatatctttcatcatcccagaaattgacaaaaactgacagagttgagaggatgtctcattttacctgccaaatatttcctaccttatactctatagcaaaaaaaaaaaaaaaaaaaaaaaaaaactgacaatttcaaagcattttcaaagcagaagattttaatgtattgttattcttgaggataaatctttcaggatattaccttccagaatttctgatgtaacaggaaagagtaagatcagtatctgaagcagtttccacagataagactagatcattatattttttaaagatatgtacatggacatcagcttgttctgggctctcgcatatatctactacagtgtcagacacctaccaagtgcttaataagtatgaattcttagcttttccttcagggttttgggtaagcctttgcaattcccaagtcgaaagtcagcaaaacgttatatatcaaacaaaagaaaccacctcacctacaacaatgggcctgagactcagcaggatgagaaatatctttttatgaatacagtttttaaaatatggagccaccccacataataaacagcaggacaggtcaagtattagacacaatgaatgacaatgggtggcttgggcgtgtcttctgaacacagtgggccatagccatggtcctcatttctttctaattggcacatgtgacatctggacctctctattagcctgaagtcacagcactttgtgcaggaaccacagatttaaagagaccttggtatgtattcataaggctgaaatgaagatcacatctgcgcaactccaccagccctttcctcaaagtctctccaggatcgatgattaaggaaagcaagatgattgacaggtagtactacaaggattagcaaattgcagctcccttctcaccaccccactgtctgtccatctctggtatccattcctgcctctcacctcccaactaccaggctccgtgtttcttcccctagacaagatgatgaaagcaagagatcaggtattcaaaattgccatgaaggctctctcttccttgccatgccatccctggcatcttgtcagttggcttccaagtttcagcattcactctgtaaaatgaattaatttatgtgaaatttgctgatagatgcaggatcagcactctcaaaaaatgacaaatcttcctgatggaatttgtcttttaattgtcttcccttggagaatacatattttcactctccctattgctaccataggtactgcatttgtcctgatcagcacagtaacataaagaggccgtagagaaggcatatggccggctgcacttttcatttcctggttctctgttgacagtattgcttatttccagatggataaatagtttgcaccttaatgtaatcaaagactgaaaaaaagatgccacttgaaaaacatttgagaaaagagaaaagaaggggaaaataggcctctgaggtggtatctataatgtggtactgaatttcactctatcttcacaaacaataaacctcatgttttataacattttactgaagcattattttctaataaatccccttttgttttgattcttgttgctgtataataagcaaagaagaaaagaacaatggctggaaattctgtctgtgtgatttgaagtgctctcacttgcatgctgagaagtgttataacgaatatttttggcatcagctgatgatagcagcttggtactagcagcacttgattcagaatgtcatatgatacaataatacacaaattgagtgcacagagggggaaaaatcatgcaacctgtcataggtacagcgatattccatgagtattcagggctggagatgtagaagtagaaacctgaaatctgaaatatgaaaaaaatgaacaaacacttaacatccacaaataccaagcaaaaattaacaaatgaaacatagcagttgttatgcaatcataatacaagaggcttctctagtcaaaatcttatggcataaatctatgaatgatctgctacaactaaagtactcaagtcaatgggaaaacatatttattcaaataaaatgtcttttctatgactttttaacaactaattttcttaaaataacaggccttttctccattgcttaatcttcatcttccactgactttttaacaactaattttcttaaaataacaggccttttctccattgcttaatcttcatcttccactgcttttttctagaagactgtttggtccaaaaaaaaaaaacaaacacatcctgaatgattaggaaaactactaggactgctttatttaaaaatttatttaatatcagcagggaatttatttcatgttatctctaaaaataaacacattctaaatattaactccaggggcattcttttaaccccgtggcatccacttggcttgaactctgtcacttgtgtttgaatatttgagtggttgctgggaactagattgtcaatttctgtttgccctcccctcctttcttatttccactatttctccagtggtcaaaatagctgtttccttctgataatattagtgaaatttttctagtttcacttttccctagtctatatagttagactgccattgtccaagttctggctccctcagaaccatctgtgtgacctctatcaaaagacggctctctcagtgcctcagtttcctgatctacctcctgaggttaccgtgaggactaaatgagttacaatagcacttagaacaatgtctggcacagagtaagctctgtgttaatgttctcaacttgaaaattgaagtgatttcattgtgaatgctattattcaaaatattttaaaatacctactttgatttgtttttctcccatcagtttgtggattactttactttaagtagttggtatgattattttaagttggccacccataggagtttaaaaccagaaagaaccataaaaatcatgttgtccaacttctacaggaggttcttcatcattatgattatcaccaggcatttgttcctcagttagttatacttcttatcgattctggtgccactggagcgcatttttatctaagctcggggcatggagatgttctcaaccgtatctacaaattcactttcgtctctgtccctctcatcaacatcttctgaacagtaaagatcatcactccaccatgcactgtgatatctaatggttcgtggtgtaggcaaagaggattcctagttactctagacttttccttgccccttagcagccttaagtttttttcttgtcctttgacttgtacggtactgtgtggtttgtgatacctttgcactgtgtggtttgtgatacctttgcacaattattacacaatggatcctaaaaccaactttctaaaggtcggcgaagcaggcataattattccctcattctccctcagggcactgaaaatcaaaggctaggatcttgcctgagattacagaattagaagtaccagagagaaacataaagtccaagtcttaggattttctctccaaaggttttttcacagcaccacattgcttttacccaaaacacattgcttcatacaaccatattagcagaagcaaatacctccgcaatgggcagcgaccaagaaaatgacagaaacgataaaataatgtctgaatgggcagtaaaatatttacaccattcagcagctctgggtcaagttcacactgaggccatccagatgatgcagagattgcgaaaatagattcctgagttccctatccatccaaaatggagttgaaaaataaagtccctttgaactatagaagaaaaaaaacagaagaattgacctcagtcgtgttgctccttaatgttggttatgtagaactgagtttgcattgtcaggaccactgtttctgttccttttggaaggttagaaaaccattgttatttgtatatttcaactctacaattaaaagttttgcatccccttcagatatttaggtaaaatgaagttggtgtgacatttctcatcatgtctcccaggcccacaaagaaaacagatggtctctgagttctagagatctctttgtgttctatattaaaatgttttccaatagattgacatagtgtaggagtctggctcttcattaaaaaattgtttcttaggatttctgcaacttcttctgaaaagtataagattttgagttatcgtggtttgcagcttggtgcacaaaacccctctgcacaccgtattggaatcactttgcatttttggggtggtctgcagaatagggcaatggacttatggacacttcattggccttgataatccctgatgtactgcaaggcaattagcaactaaatttttgctaagtgcacttaagagtaataagaaaaattaaaatgtcatcaaaatgctaaccacagattcaactaaaactgaaccaaagaatggcatatttagtcttgagcttgaagacctaaatcacacaactatagaagcacaattgtgcatccatagttctccatttctccttccaaaccacttcccccagaaaagcagctttggagactgtctttacttcagttagatgctaaagctcaagaaatgtgaaacaacccagggaaactagaattcagcagcagtgctaagacaaaattaagtgcactcctttcagctattcatgaaatcctcataaagaggccaaactattgcattctatcatggagataacatagctgaaataatttacatgtttccattttagtgtagtaaatcaccccagcataaaaatcacacaaatatagcagaagttatcttacccatgatctacctactagaatcatttaatcaacaacaacaacaacaaaaaaagtaattttacagtggaataacatgactatgctagctcagacaggtgctcaaagtcaacatcaatggtgataagtcatactgatagtattggtagataaccttcaagtgatgggaaaaggtggcattttacctcggattttcctccccccagaacccataatactcttctaaacatgaagaaaatatcagacaaattcaaattgaagaacattctacaaaatacttgaaccaaagctcttcaaaactgttcaggccatcaaaaacagggaaagtttgcaaagctgtcacagtctagaggacccctaaaaagacagacgactcaatgtaacatggtatcttatatggaaaactggaacaggaaaaggacattaggtagaaactaatgaaatcctagtaaattgtgggctttagttagtaataatgtatcaatattgattcattagtagttatgacaaatgtaacatacttacataagaggctatgtaagaggaagctgggtgtgggatataatgagaactctgtactctctctgcaacttttctgtaaatctaaaactattctgaaataaaaggtttattacaaataaaaaagggcataggggttcatgcttataatcccagcactttgggaggctgaggcaggaggattgctttagcccaggagtttgagaccagtctgggcaatacagcaagatcctacctctataaaaaaaaaaaaacaatcaaaaaattagcagggcatggtggtgtgcatctgcagtcccagctacttgggaagctgaggtgggaggatggcttgatcccaggaagtcattaatgactgcattattaaatgaaccaaaactattttttatctcttctgttttacagttcaatgtgatggtgcccgtggaaagctggccacagtggctgggatgccctcacagaatgtgcatgcagggaagttctcgtctcaacaacacatggccgtaattttgtttatacacattgtactgttgcagtgtaagaatttttgaaatcacaagtataattgcaaaagacagagttatttctatgaaaaatggattggatgatttggcaaaacccggtagaggcaaatgtctaagagtatttatttaagtacatgtgttctcatgccataaacgactgggggaaaaaaactcatgaaaatcaagaaggatgctgcactcagcttgcttatgttcttcaagttctgctccacttaaaaacaccaaaattagaaatcatagatcgtgggtgtgatttctgcaggaactcagatcagttcaaccctaatcaaagaacacagggtggagctatctcaaagtactgatgaatgagcatttatatatttaatataaaataaaatgttcaaggcatgtgtgtatcatttttaataattgtcctgttttactctctatttttgtgaatttatcttttcaattaaccagttgctcctgatcccaattgactaacgaagacattctattgaaggtgatttttcattttaccttttatgtgttagtattttacagtatgtcttttaccatatgtcctttatttggtaagttccggtttttattttacactgttttataataaatgcgttgtgcacttctgtcacctttttttccctggtggactctagacacaagggtgattgcctaattatactgtgctgcttataagaagcagattagttaagtggcttcttagatgaacagtgcaaagtgccacatgaaagctggaggaaaaatatccccaagaacaaaagagctttaaaatgttgttttattttttaaaattccggtgtctgagaaaacatcatttcttcaaaattaagtgactctattttctaagaactcttaagtaggagcgaagatgagaactgaataaatgtgatgtgcttctctcttggcctctaggtaataaattctgcactatacagattacactagacgtgaatctgtttcttgttttatgctgagagcaagatcactaagacatactttaccttccttaacagaatctatctttctcaatgatggtgataaagcagatttttctacattggtagaaaactcattctaatcgaagttgaatagttccaagctgttagaattttctaagcaaaagaatagcaagatgctccaaggatacaacaaatgaaattcaacggttatttacaaattcagctgttcaccgaaaacgaaaagcttcttaaaaaattagggtggttgagtctgaagtatggtttggagaagtgatttttttaaatagggtatttataaaaatatacttgagaaaccaatccaggggagtcaaaatggatgcaaccaaaccttaagaatataaagcagtgcaaacaatccaaaagcagtgcttcttaggattaagccatgtgcacatttaaaggttaggagaatttcagcgtgtggcttggctggaccttttctgtttccattacgatcatactattgtcagaaatcccagctagcaagcaggcaagagatcatgaggaaaatcaaacaggagtagaaccactggggctgcctgaatttctacctgcacctttcccgatttaggcaaggagacttggctggacagcgggaggtggagagggaaagggatggtgacagaaggaaggaggaggccccggaagcgaggtctcaggatagcataggctccctgtttcttttcctttctttgcttcctacaagcattaaccttgagcctaaaagcacaatatgaggaaataagcaaacaagatgaggggcagcaccaaagaaatgctctaggccctaggaaggttagatttttgagaacacatcaacttgggtaacacaaaatatgagtaaaaacaaatatgagagaaaaacatatatgtaaactgaacacaaaaattgaattgaaccattaaaagttcgctgatcttatccctaaacaaacttctgggatatgtgtatttcatcattcgtgtgtttgaaattaaattttatttaactggtatttttaagctaactgttctaccaccaaaatcagttttaaaatacacttctagtttctgctacattctcatataatttaaaatcagccgtgtgaagaaaatacaaaccttagattcaaagcctagaatcaactatatacctaaaatataccagaactgattgttttataaatgagcaacagtgagcattcttctctttagaacctggctcataactcatctctcccaccaaccttcttgttgcttcctcaaatcttcccttctctccagctgaaaactacagcatcatcatacatatctgccttcttctcatgttaaatgtaatctatgcctcgagaatctcacctaatacctgctggacatttctaaacaaatgtccatatgtacccccctcagcaaattattcaacagctgaaaagtgtctttctccagatttgacagtcttgttgtattccctaaagaagttaatgccaacctcatcctctcagttgctcaagagcaaaacttctacataatcttctataaccctttctccctggcccctcatctctaatcagttaccaaagtgtgcccaatctatctccgtacggactataatttacaaccccatcagattttaagctctatcatagtaagaatattagatttgtttgaaatactgtacccattacccagtaccatatctggcacaagaagatacacagtgcatatttgttgactaaagttatatattactatatctaaaggcaattattttagttgttagcctttatatttcacataatcacacatgagaggattttcagggatcttttgcccatcacagaacactgatctaaatttgcttatattccctgttttcctgacgccccaaagtccttaccaatatgcacacagacacacacacacacacatacacacacacacacacacacacacacgtttaaccttaacaacatttcaaattgataatcactatatagaaattatttttaaaagaaaaaggctattaggctattatctttttttcatcttctaggctttcctcaaaataaagtggaaaattggcaagcaatgagtcaatttgataaaatgtaaacagtcaaatgaaatagatcaggccaaatgctttattgaaatatttagtttcatccatctacttaattgacaaaattggccatattgttaaaagtttaatttatctcagccttgctgatatatctataatcaaaagcagcattttggaatggaatagttccttatacatatttatatggagttgactttttaaaaagagttttcaacaaaatttcacataatgtagctgatgtataatgactaagaaaaataggaaaacacaattcaattgacagttatgaatttcctactttgcagacaataaaacctgctaagagtatgttggaaacaccaaataaaacatgggctcctcagctattggggtaggtagataaaaatgtaaattaataaaggaggtggattatagtccatgacaaagtggaaaaacagaaagctttgacttctgagcttctgtcctctccctcttgccctctcatcttgctttacccattccctcttgaacttggacttaccagtcaggactcactccacctctgcatgcatgcagatgagcacacctgaggggaaacaggcagctccacaagcacacttttcttcaatctatgacgactaacctcaagtgcgcctttagtgctggaaggcaatcttacagtattccctggagatcattctatacctcctttcttctcaaatcttcctgtacttcacacacacacacacacacacacacacacacacacacacactttactctcagataatggttttacttctgccttcactgagaaagaaaggaagtgtcatcggaagaacacatgcccaccaccatatctgacagccacctgcctctgtgtccagacactctgtcttcctttctgctacttttgtcaaaatgtccacacttttagatagggcctcctcctccacctgtatcccagatccttcctcacactgcttgttcaagagcattaccacagcagtttttctccttgagtattctttgctttcttaccagattaaggagaattcaaaaggtttttaaaatactatatctagcatattgaattgttttctgcagagcattgaatggagtgccagttaaccatgttggagatatattagtggttaatcctcagttacatctcacttgatccatcagcagcgttttatacaattaatctcccctctttattaaaacactcttccatgtggcttcaggaatcatgcttgctcattcctcccatcagatgtttttccaggttcttcctcaaatccctgtgctgtaaagatcagcctgcccaacagtccagctccaaaccaggccttgtcactatctatactgatttccaggtggagccatggactcagttactaacaactcccaaatttacatccccaatcctcaccctgtgccccaaattccagactcagaaatccaactctctgctcaccacctccacttagacatctcttaaaagcttcttaaatgttgcatgtctgaacccagacatttgctcccaactgccagatatcttcccacaaactcccaaactcagtgataactctctctgcccagttgctcaagccaaaataactcgaatgatctttgactcctgtcaagtctacttccagcatatgtccagaatctgacctctctctactctctccaccaaaaccacccttgtccacccaaccattatcttgtgcctgcacaatctctagtatttcattctaaatctggcccctgccatctattcctacacaatagccagagtggtccttataaaacataagtcagatcctgccactccttcactcaaaacccttcagtgttttcctgtcccctaggagttaaaggcaaacccctcactatgtcctacaaagtcctaaatgagctgcccccagaagaacatcctgcttctctgacatcatctcctaccactttctccccgactcactctgctccacccaaagtggacttcttgatgttgcccaagccaggaatgctcccacctcggcatctctgcgctggctgctccctttgcctagactgtctgtgttccccagacacctgtatgctctttctgccactctttctgtcctctgggcaaatgtcagtgaggatttccttaaccatcctacacaaaacagcatctgctccacagtgaaagcacttgctctcctccttttctgttttattttctttatagaattgatcaccatcttaaacactttgtattgttgtgcttactttatggttataaacacaccatgaggatggggatttgatcatttttttcagttctgtttcacagatttcaaaactataaataaaaggaaatcaataaagaattgccaaatgaataattgagtggaaattttaaaaagatatttatatgaataatcaaatctaacatttattgggtgtttgccatctatcaggttcattcagtattttgcaggtactgtaaactccaattttacaaataagaaagttagggctaacagaaatcaaataactcaccaaatgtcccacagctatagctagtatgtggtggacttgagacagacactcaagcctgcttcacttcacatcccaacccattgtttttctaaattgattccatgtatcttatggttgtgtcactgccacgaacctagataatgaccttagtgtacattaaacacttaataagcatctgcaattagtgtctttaaaattcaaactgcacacagtaggtaaagcactgaatgataacttatcagattcaaaaagctgtgtagcttgctaagcaacaaatttaccaacagcgattttagacaattagtatatctttattcattgctaaatgaatgctgtgactttggaattagcatatcttcaatttagccctcaaaagttggttggtgtttattgatgcaaatgttcaagttattaaaatcagtttgccaagtcactactgaacccaaatcatcatcatcatcatcatcatcatatgcacaaacaagaaaaatctattacattattttctctaatgataaatagcaaggtatacaccttgctttcttctctgaaacccagtccctagagtcctgtcttcctactgaaccccacgaacttcttgcttaaaggaagcagctaccctgagatgctacttggttcaatacctactctgttttggaattgtcttcctgcctcagattcctgttgctactctgatcctaaattcagccctactatgtccaatactgtcaactctacattctaccagctcctgattcttccctaacacgggttctctattcaaccctaaatacattgaaattgtactttcaaattttgcagaatcaccattactcagtcagataggcttaagaagtaagaaaaaggaatcggtggtcctaaccagccttcaagagggactccagtgattctcacttctggatattcacattcttctatgggcccctctcatatcaaataagataacctgtgtagctgagattaggccatagaagacactgggctatctgccttgcacttagattattctctctggaggaagccagtgatcatgtcatgaggacacaaaagcagccctatgaagtctacttagtgaagaactgaggcctcctgccaacaaccagcaccaacttgctatccaaatgctggcaccatcttagaagagggtgctccagcttcagtcaaccttcaggtgactgtgccttcagccagcactctaaccacaacctcacaaaagactctgagcctgaaccatccagctaagacactcctgaattcctgacccacagaaattgtgtgaaatgatgaatgtctattcctgtttgaaactactgagttttggggaaatttattatgcagcaaaaaataactaaaacagtgtgcatacaaaatccatttgtaaggaaagtaaacctgaaaagtcatgagtcctatgacaaagaaaattgtgtagaaattcaactcagcactgaaaatgtattggatatataaaacagataaaacaatgattttgtctttttacaaagcttagagtttttattatgagtctttatgaaaagcttttagctgactttttcttctgtcagtagagccctaaatatcagtatttcaataagtttgtaaaatagcacaaatagcctaactaatttaaaaaaacagagctccaatgactttaaactttaaactctgaactttaaaaaaaaattaagaagcataattttctgctgttaatgcagtagccctgctttaaaatataataataaccaatcaaatgtggattgcctacgatagaaacagatgcacaatacagaagcttaaagacaatgtcagggtgtgattatgaaagaaaatatcaagaccaggactaaaacagaaatatttgccttaaggatgaaagtttggtgttaatatcagaatagcattgtaattacatcagtattttacttccttatataaatacaagtttgctaaaccaactagaaatttgaacataaatcattccacatatgagttcagtcattctaaactaatttttcttcttcctgatttatgacatcctccttggagtgatattacagagagtgaactcagccaagtgaacccacattgtcaactgcagtcaattttcagatattgaagtaaacagatgaaatagggtatacccaacttatagatgcacctaaggttgccaatatttactctggtcttgttatatcacacattacagagaagaactgctgtaaatctaaaattgaagacaacagacatgaggataatatttggcttctcttttgaagccctggggaagcatttaggagataaatgctaaataatttcaatgccctgccctgcccacaaataaagcatttagcattcatcccctaatgaggaatatacaactcattttgtcggagaggtaccactttgatgcttccctagaaattgggctgtaaacccctaggttaccagaactgtgtctatttatggctctgcctctggccccaagttttgcatcctggttttggccaatagatcactactgagtgacagattagacaaatactcttcttctaatcagtacactggaatacagccaacacacattgcatcttatcttctaccaggcactgtatttggtgctaaggatacaaagaagatgaagagccattcctggctgtggagcagctcatgatcagtgggagattcaagcatacgcatagacattgcagggcagggaagacatatcatgcttgagagaaggcagatgatggaggggaagacaaagagaagaatcaggccttctggaaaaaataggtactaaacaggctgaacagagcattacagaaaaaggatgtcatgaaaatcatgaccttggagtttggtctttaggcagaagctcatcaatggacagctggctttgacaaggtaagaggggaccctatgccacaaagctggagcttctgcaaagtaagactgtgtgcccaaaacattgcttaaaaaataataatcacataagtatttctcaagggcccataaggccaaaagaatgaagaaagaaattagcatacctactctcaaagtgttcaggccttttaaccttttgaacaatgaaatttgcagtgcacagtatacttaattagaactatccaccatctatcagaaaaaggccagagtcatatattttcacattctaacttgtatgcacaataaagaccaccccctgcaaatacgtccacgtcctaatttcagaatctgtgcccatattatcatacatggcaaagagggtgctgcagaagtgattaagggtaaggacctcgagatggaaagagtatcctgaatgacccagggcatttctctgggtccaatctaatcctataaagtgggcccagttcaatcataggaggccttaaaagtggagatttcccagctgtggtcaaagagatggcagcgtgacatgaattcgatgtagcagagcacaagcaaggatggcagagaggcttctagaacataagagaggcctccagctgacagccaacaaggaagtggagagctcaatcccatgaccatatggaacctaacttttccaacatccaagtgagcaataaatgaactctgtctgagaacctccggaaaggaacgcaggcccctgatgccttcattttagccaggtgagatccacaggagacttctgacctgcagaactgtttgatcataaatttgtactgctttatgccaccaaatctgtgggaatttgttacagcagcattaaaaaaactaatacaccaataaattctgtttgtcacttaaaaatggagtcacaagaactggcttataatttgagtttataaaactaaattctgtacaatatccagaaatgttggtaccacttatttttatgaacttttaagactaataagtggtaccatttattgaggacacaccatgtacttgttattgtactaagtgcttcacatagcaataataatcactaatatttttagtatatgtacatgtatgttaggatgtgataggcactgtaccaatcattttcatgtattaattcatttaatcttcacaacattcttataaagcaacttctattacgattcccattttacagatgagggaattgagacagaaaggatatccataaggtgccacggccactcaacccccattgcagctctctaacaggagcaagcatttattaggaatatactgtgttctaggtaataggccaagtacctcccattcactagtgcactaatgccccaatagcaccccattttcagataagaaacctggggcctagaaaattttaataactttcaaggtgtctcacaatgaacaaatagtgctgctaaagccagaactgacctcagaacaggccctctcagacatccagggtgtcctcgagacaccagaaggctgggctggcatcaacaatgtgtggctacctgaagatgtcctttccctaagaaccttcagaagactatttcagttaacagatttccagacgttggatcaagccagatatctccctaagatactcaagatcctctccattggcagagggtgggctgcacatccaccaagtggacaactgaggatatttgtgtttaacaataaaaagtttcaatcacgttcccactttttacattcaatcctgattacaaaagtgactcaacatgtattggatgtccactatgagcagatcaatataatgagcatcaacgaacatccaaacaggtataatttctccaggggtactgatttatactttataactttcaagagaagttaaaagggcttcagtaacacatttgggtaacaccacggccctaaagaaacttacaggatgtataaagggggaagtctgatcaacttcttataatgttctagtaaaattcaatgcaattatgtcaggaaaaaaagaattggactaaaaggtagcagacctagtttctagccccagctctgcctgagtgatctgaacaagtcattttacatgtctgcctccatttcttcatctgtaaaataaaaggatcagtctacaatatatcaaatatcttctgagttctgagttctgcgattctgctctttgaaatctgccaatctgccctcacacaagagagtggttacagtcaggcaatgtgctaaacaataagactggagtgggacctggtacctggggtgttattgggggcagaagatggcaaacatccagacttcggagccactttgtatatgaactaggagggtttcttatacaaaaaaaaaaaaaaaaaacacaaaaaaaacagaccctagaaaaagagcactccaaagtatctgcagaaatgtagtgagttttccaagacctgaataaaaatgggacaccagaaatagtaaccttgctatgttagtaatggctgatgtacttgatacttggttaatgggattaaatgaaaagtaaacatgcacccacacaaatgcatacatgcataacatacacacacacacacacacacacacacacacacatctcgcacagtaatgcgttgagtgcctcccagtccttcaagtggagcactgagccgatcaacatggtgctattacacaagcttgctgcactgcaccaaactcgctgagcgcacagcatgcctggaaacgctaccacgttctcctacaagcataaaggagtttctggaacttctccaaagccccatgctttcatcagctaggtaaaggcattcacttcaccggctgaaatgacggggctatcagcctgcactaaccagccctgggaagtgcagttttatagtttctggtactgcagagtaccacagagcaaatgggattctgcctagatctgctaggaaagaatcaaagagatgagaaagttgcattttactgcccacaagtgatttctcttgcacaaaaggaccatacaatttgggtaaaaagaactgaatcatgaaaaagtcaattcaataatcaaatgcaaaaatcggatgagcactgaaatgtttaataaacaatatgctaaaattagtgctgcctattataaaattgcaaaggatgaagcagccacatatttatccatcaaagggattatataaatgaaaattctcagaatttaaaatcttcttagagcacatatcctggctcttttcccctccttcttcatatatgatggcagggacctctctgaatcttcatcctgcatttgctttagcctttgaatctcagcaactcttggacaagtttcatttgaacctagcaatctcatctggatagaaacctctgataaggtctccatgacctttaattgttttttacccatgcacagatatctcttaaaaatatataaggcatccacttccacaaacatctctgtgtgactctaagctgtcacttcaccagtttagaactccttttcttaccctataaaatgaaaaggtttgcttccttctataatagctctgtcattctggcatcagtttatctttaaatggcttggctttgaattgggaaaactttggaaaggctttaattctaacaagcccagaaggtgagaagaaggaaaaacaagaggatagttttactcttgccctctttggtcttggttaaaatgaaacacacgtgtgtgtgcatacacaaacacacatccttccccctttcctcacttagagtatatttttactgtttgtttgtttggatcaccaactatttaaagtgagaaatcctaacaggcagaattcccgaattttaaaaatagaagtgaccttgaggagcacaaggaatgaatggaactaataagtattaaaggagaagagaacttactttttgaaattagaatgaagtctttttgctttaagtatgagctgagcttccatatgcatctttgttgtatctgtcttcagagtttgtgcccacaagggactgaaaagtgtctttctgggccaggagatagagggaggcaaggaataaaaccttctttcctttctgtctctctcttcccgtttctctctctctctctctctctctctctctctctctgtgtgtgtgtgggggggggggggtgggggttgtttaactgctagaaaactcccctttcctttttctataaggtagccagccccaaggtctaggtaaaggaagcttggcctccagcaggtctgaagtccctggtctcaggagttaactaatcatttggggccagattccagaccagattgttctcccttgggggtgggaagtcactgccagggtctcattttcaggagctaagaactgcatccagggcgtgacctaattcaagcctgtgtccttctaccacaccagcatcgcctctgttaatatgatcagctgtgtcccatatggcccacttgcatcaaaatttacacacacatacacacacacacacacaatttaaaaaggattcggtcagccattaactaggctagactgctccgttgcaccctcattcagtgttcttccattcattacattcagcatggtccaagggaagaggttatttcttaagggtgtgaagaaagatgcatttggacatgcattccttagggagaacaaggatgttcttttctaagagggtcatgaacagatcacactgcattaggagtttctcttggcctggtttctgggccctggggagttgagctttatgacatactaggggcagctatctgatcagtcttgaagaaaatatcttttctatgtgagctctttaaagtaaaactaagttttgtcaatgattctccccaagaaataatggtgtctttaattctagctacaatgcccctgctggcaagagtccatccttccccacagctgaatcgggccgatttaaaagtcacctcatgcatttgggacaggttggaggtgtggaaaaacactcccattacaattcagaagtgctgtcatactaccagaaccaaaaataaagctgtagaaaaggagagaggaggagaaagtaagcagaagagattaagggtcaggcaaagcaaagggcttaaaaagacagcgtgtaacacaggatatttgaaacgaacaaagaactgagctattttaaagcacaactacaaacacttctcgaatatctgtgatcatagatgagagctgaacaagttatcccccatccctttatggttcttagaaatacagaaggcataacacaacatttgccagaagaataaataagacaacttaccgatgtgctaaaaagtctctttcaaatattgaggtaagccaaagggaaatgagtatctcaatgttactagggtctcatattttccaacatttgttcaatttggcccacacattttaatgtttcatatttatgggttaataacattttaatttgggaaccaagtgacctgagttttagtttagctgggccgctaagaactgcttgacgtttggtatgttacctactctgagtttcagttccctatctgctaaagtattccattctctttaaggttgtctacgatttatgaaaccattattgtcctctcttttgtactctctgactttccattttattacataatgaacaagtacaagacctaaaccaaaaaaaaaaaaaaaaaggcaaactctgcttgctcatttaaatgaaagcagaaaaaaaaaacttaagtgggagagagcttatattagcaacctacttctggacaataccaattttcaaaaatactattttcaaggaggtttcatttacagcgttgtctttcattcttacaacaaactttggaagctaatatttattactgtttaccaaggagaaattcagatccaagatcaccaaactaatgccaattaaaagaataaataggactgatacttgggccaagggtttaaaatgtctgtatgttttataaaaaatcaaatccactagaaattgtattccccacaaacacttatgaatggcattataccactgcactattaatcctagtgctgttaggaattccaactacccccctggatggcttaaagggatagagacatcagtgatagccctaggaaaaatataagaattagaacttataggagaaggaagtgtattgttttgttttgttttgtttttcagggcatggatttgaaagcttctgatagcagaaatttcttgctgattgttttctgctatcaacaacatcctcagagacatatgaagaataaagaaacatttagctcttccatcgaagccctacttctggactccgtccacagccccagatatccctttcagtccagagctcggcaggtacatcactcaggggctgtgtgaaaagtcaagtggggtagagaggagacacaaccctgacaaaagcaagtgagttctcctcctcctgtagcggaccaacctactccttcctgagccacagccataggagcagacatttagttcaaggacaacagagcaccttccaagcactgatagccttacagttctccagggaaaaaggcagggccaagcaaggcccctctgcaaggttcacattcagctatccaacaatcaattcaacagtgtcttccacctcactgtgggcagggcactgctcctggaaggcaccaggcaatgtcaaacccaatcctgagcctggaagcactcacacacagggaaagcagccgtggaaatagctcaattacaattatgtgcctagtctcttcatcaattacaacagaagtggagaactcagaaactgagtctcacgaggtaacatttaaagtcaatcttgaaagataagcaggagttgtttgttggagccagggaagggcactctcgtctcagggaaaggcataaaagaatgcagatcatcactgatgaaacagtcccgattttacaggaaatggtgagaaagtgaaagtcaaaattgtagttggtggtccaaacaagatactctttgggaattctctcagaaatactccatttaccttttaaggcgttgggcaggggaggggggtaagagctcaaaacagttcacattgttggttttaatagatttttaaactaataacataatgaaattaaaatgtctattttcagccccaaccccaaaagaaatatattcttgtttgcattaaagaaggttttcaccaaaactgttcaggttcatttctatggaaaatcattcaggcatcaaccctcatgacttcttcaacagtccaaatggaaagcaacaacatcacgtcacaaattcctccacaaagtagtactagacgttcaagacagagaaattaaaataccaattattttctctaaaactaccaaacgtgttttccatcactcaggcagaaaatgcagccattacgaaacaactctgccaggctgaggccggagaacacagccagcacacagacgaccaagatgttcagtccacttaagaaaatgcacctcactacttcaggggccacgcaagccatcttcatgaggcattacgtattgaaaaaaaatggctaattttctgagaggtcagttgaaatataagagacagaaatttctttctgctgcttgtacagtcaaaatttattgaagtcagttagcaacaatgtaatttgcctgacctgatcatcttacaaattgaagtcatcaataaagtgtattcacttgtgtatcatcatgttttattcagctggaactgtctctctccaccgatggccccaaacatatattacatgcacaaattaagcagcacccattctatattgactacttactagttccttctgaatatgtcctcaatcgcgctatacatatttcctgaactgaagggaccattccaagtgtcttcacggtatatgttacttcaacaaaccgaacatattaatactatatggaatgtctgcattttccagatactgtactagatacaaggatccaatgattaataaaaaagctttcctgccctcagagagctgaaagtatagttttattatcacagaaactcacaattattcatagtaaacactcagaaaatatttggtgaataaacaggtagacgtacatgcaaataaacaaatgccaatcactctttcaaagttgtttacaacaagagttactgtttttattctgaaagttaatttctgctatcaggaaaaaaagtcgtcttgtgtattaattcaggaatttcctgcaaagctctgaaagcaagtacttgctcacacctgccagaagggtttggtatttctcgacatgggagtaaatataatgttttattgatctcacttctattagctttggctaaaaatttatatataaaaatacataataaatgtacaaaattatacatattatattaatatattatataacatatacattattataaataacatattaatgtataataaaagattcacataatgttacacacacatacaaacatgtatacatatatgcatatatacataggatatacaaacatatatgtacaaacatgtatatatgtttgtggtaatgtggtaatatatatgtatattgtgtgaatattatatcacacacacacacatgccttccctaataaatcggtcaaagaaatgagtagcaaggaaaaaatattataaaatctggcattcctcctttctgtaaaggggatctttttgaaaagaaacacatattgctctaagagtcagtcacactttcacagacagaagatactgcttccaaagtgcctcccagcctgcaccccttcaggggacagtagagcagttccctgaagccctacctcaagttcaaaaactatcacttctctcaaccctcccctgtaggcaatgcctgtaacatttcactgcattttttgcgggcctcttttacttgactaagttctctgagagccagcattatgaaccatttgtgtttaaatgccttgtatttggcacagtttgggtcataacccaatactgcaaaaagggaactcaatggcatgggttagtttattaaattaattttaaaatcattttccttttagctgtcttgtaatccttcttgaaatagttgaggatcccctagcatttcacaaaacaagagttggaattttctgtcccaaatattattgcatctaaaatatatcagcttgggtcctgtgtaccttagggagaaccccaagcttgaaataaactaggtaagacctcaaatacagcaaggcagtgagcctaacacagatttattgaagctttaattccctcttcttacctttctagcaaattactcctttttacaatatcccaagatattttaaaaaaaacctgttgtatattacattacactctttcatgaatataccagcactgcaaaaaagcagaaactaggacatgactacttgggtgcataatgagccctatgcaatcccacagctacactgtgcagagaagaataaagcatttggccagtgctgtctcattaggggaaaatatgtcctgccaggaggcaagggtctaaactaggagcccccttggagtcccatattaaacccagcagactgcaaaataacagaaattaacagaaggataagctttgtgactggagaaaaatttaactttctcaaatcctaaaatcctgacctttctgccacagtactcaaccaagttttcatggcatactatcatgttacatacaatcagttgtgggacatgtcaaaagcaatgttaccaacaatagtctctcaacatgcacatcaagggttgaacattcaacaaaaatgtggtaagttgatggggtgacagatatgttaattcgctcgcctgaatatttctacatagaccaaaatatcacactgtaccccatacatatatacaattattatcaattaaaaataaatgaataatttttaaaagggaggatatcttgcacatagaaatcccacacatcatgcaagttgactatgaaactaaacatgttaaaacattgagaaccacttaggacaacttaaacaaaatacatttacaaattgccttgaatcactctcttgaactatctctgtatatgtgtgtgtgtatatatatatgcatataaaatattacaaatattggcgtgtagtttttcagccatggtattattgtaggctttaacctttttgttcagatgtcctgaaacagaccactttaaaaatcagaatttttgaaaatattaactcctttttgcacggttaatcatacaacctctgaaacacctgagaaattatagtaaaaataatgtaatccattctcagggttatcatcatgattactgatattaaatgctggcatctttcaggatgattgagatgtggaaagagtagctctgacatgcagtaaattcacctcatgatactcatgatacttcttttgattgtatggcttttttaggccattttccatctttttttgggccattttccattcattaattcatttcattccatcacgtaccttctcagacatgtgatatagacaggcaccgatgtcagtatgcctgcctctagcacagatgcatttctcctacactaactacttgctacatttattctgcaagaagccattaatttacactatacagtcactagctttgtgagaaaataagagtataaaggttctgagtaagattcttaagaccttttctagaagtaaataatttgaaccatacataaacatttgcaagatcgattcagtaatttatattctttcgttattcctttattcccacctgcattctgtatagtggtaataagtattagaaaaaaaaagatccccaaaaacaagaggaattaaatatatatatagatattatgaaccaactgatatgttccttcctcatttacacacattgaaggagttaagaatgtttcatcctttctcctggttttctgcttctgtctctgttataaattatatcacttaaatataaatgaatgaatttttactctatagctttgagacattctggtttttaaacctttgttttttttctaaacactttccaaaatataggaccaaatttttaacatacttgagaggcttgagtaagctgagaaccaaggagagcagcagatccctcagtcctggacaggacccgcccctcccttcactactggggaggaaacatcccaccccttctggcttctaccaaatgtgacaacttgcctgcttggccttctgttaagagctggatttcctgtccccctcccacacactgggcagcagccagactgcaaaagtccagtttgaccatgtggaaacctttgcttggttcctgccagagcctttcagtaagctgccctatttagagtccagctcagataaatcctccccttccacaatctggcctactacaacaattgcaagaccatagacatcggccccagtcatgcttgatttttaatttttgtttgcttagactagggtttattcatcatgttaccatcatgtctgaaaaaactgataatggtatctggcattttcagtaaatggagggagttggaggccccagccacctgggtctttcccaagtatcttgaaagctgagaggatcaacacctcagcacacctgcagacatttagggccaagcagtgggaagatctaaacccctggaaggagccagaattcagtttgaaatctactcacatagggagtgccctgggtgccataggagctgctggcagcagggggtcccaactgcgtatcctcagccttagagcacccaccctacccaaactgggcactcagatgtatttgtgtcctaggctgctgtaacaaggcaccatcagctgcgtggcctaaacaacagacatgtattgtctcacagctctggaggctggaagtctgagatcaaggtattggcagagtggactctttctgagaactgggagggagactctggtccacgccttttccaagctgctagtggtttttctgcctgtcttcagctttccttggcttgtagaagtatcaccctgatctgtgtcttcttcttcgactggcattctccgagtccctatctgtgtataaatttcccctttgtgtaaggacacagtcatattcaacgaagggtctgccctactctagcatgaccttatcatgactaattacatctgcaacaacagaatttccaagtaaggtcatattctgaggttctggggattaggacttcagcacataaatttgaggggggcacgtttcaacccataactccaggaatgacattgatggctacctgtagatcatctgagacagggtttggcacacagtaggttggtactcaatacacatgtgagttaaataaacgaatgcatgagtgaatcatcctttctgagtgccagtgaagaagtctttaacttggggtgtcgtgattttcatgatcaccattgagcattgaagactattgaggagagaagccgttgctgcgagctttctgaggctgcttgctgaaagacgaaggcactccttgctgtctgatcacagcagaaggctctgaatttgaagttggagtgctataaatagcagttagtcttatccttcaaaatgtcatgtgtactttttaaaaagattttagtgtcatatgagagtccctgagtaattcaatttataggaaagggagatcagaaagaactaaccatattataattaattacatatgcaaatgatggactacatctagatgcatgaatccatgtctaatcatagttggcaaaggttggcaactgcacacctggactggggaacacaccccctgctctgcttagatacagacgccatcaacaacctctgaaaatttcccagaaaacctggaaattcagtcctgtaagtgccaagcctcctgccttcccccatccctctctggggcttgcccccaccagcacacagcagtgcagacaccatacagcatggctgcgctatggtgaggcatggccagtgggaggaaggccaccaattgcatacaataacaactttgttgtcactgctaggagccgaaccagctgcgatgccttacaattgctacttaaatgtaagcagtgtcaggaaagtctgaatgtaaagaagtttctcagttcttgagccaaatgaccggttgcttgtgttcttctattaactctaaaacaattaactctatcagcttatgctgatagccactgtgcattttttggagcacctgggcactagctaaggatagtgactgatatgtggatgatgaaatatataatagagatgatatagacatagatgtgccaaatgctatatatacatgtatgtatgtatatattcatatatatgcacatgcatactgatgaaagccactttgctgatatccccaaataaccactgaactacagattccagatttatagagcatattgttggtgttgtttctgagagtacctaccatagtattcctgtggaaagatacacacctatatagtttccattttcaaaatgcatgcatgtgcctctgtgtgcgtgtgtgtgctcccaaagcagcagttgtaggggactgcacagaataatcgttcgggagataatcaggagtcctagatttgagtcccagtcttgccactgatcaaaaatggaaagaatgagttctatcacccaaagtatgagcatgcaattaaagagattatgtgaaagaaccttgaaaactccaaaaaaaaaaaaaaatgaccctcatgagacttcacaagtcaacaaaggtaaaaatcaatggcaaaagtttcaggcaaccttgtgttcatccaggtggagacatgcttaatctctcctgaccctgcaaacacttctgggcacctccctggcatgcattcagttggtgctgcactggagttgccatatgactgcatcctgagtctctgctgtgggactggagttatcctagggaaaatggtgactaaaccaatttcctcttcagtgttctttttcattcccatttcctcctgttttggagacttattttgtcatacagtcttaaaggaaagggatctggtttgctggttcacaattagaggtaggaggcaaggtagctcctcccctaggagtttgtgctctttgaaagccaatgtgggaggacctccctagaagcacatggagatatagctgagcagcatctatctactcacctacatattcccttgaatggggctaaagatgtgcatgttatgccaaaagctgaaaaaatagcaacatgagataggagaatggatagtgaatgttcattgtgaactctttaaggagcaatacctcatttcctatttccttcatccctcccattcacctttcacactgaattcttagccaactctacataaaatagactcccaataggaccagtatggctatactcaaaatagcctctctctaatatgggctcaatttataacctgggtagctggtacagttcatacgtagaaaagttttggccattcaaaaatattggaatgtctgattcctgcttgatattctgtagaagtaagggcaccaatttgcaagtcaggaggccagaccacagtgtctccttaactgccaaatgtctatatatccttggacagaccccttcattgcaatagagcacattttttctcaataaaatgactgaattgaaagctatagctctaaaaagctttcaattcagtgctggaaattcaagttatatggactgttttaatttccatggtagtcgataaataatatggtatggcattttggttaacttgaaattaccatgtaactccatatatggagttactatataatttgcaattctcaaagaatcataatgcaaaaaataagtatttaacaatgcaacatatagaatacaatttttaaatgaatttgaaacataatgcttcccagggtcattataaacacaaattttcatttatccatatattttaaattgctaattattggaaatttttgataaattcttgttagtggcttttccatactctattgtttaaagtacgtttgtgtgcatgtgagattattacaagcaaaggtaactgaatagggacctactgccaaaatctgcttacatttcactaattttgattaggccttaatgtgttttctaaacttgggtagggcataccaaatacaacaaaactagattccacatctagttcataatcaggagcattaagtatatgatgactctatcaattctcagtagtttggattccataactaataaagaatcatgttttatcctgattaattggttcagattaatttagcaccccctgccaatgtcccattttaactgtcttcaaacccaaaggtagaaagtggcatttaaatgtttttcaactctgtactgggagcagaccaaatttcctaagtcagatccaagccagagtggtttgacccagacaggattagattgagcctaggaagggtgagattggagagaggcacccaaaccctggaacacaaggagggtggctgacaagcccttttccttccagcattcactgtaatgaaaaactaatgggctggagatttgccttctaggaagagcttaagcattgctttactaaacacacctacatattgtctctaaatgtcatgctaagatgtacagggtattgccatgaacttcttgagcagttaactcagtggcttaatgcttgccgtgaagcatctttaaacggaaacatcctttactactaagactgaggcttcaccatggtatcaaaggaagtcagtaaaatgtaccttggcatagagtgcaggaacatatttattactggtgggaaagacctattaggcctgtctgtcacaatgccaatgtataatttatccctgaggcttttggggatcctataactgccatgattttaatggctggtggtgagtcatgggcatttatgaagatagagcacttcaccgactactgattggactcctaagatgcacataatccttaaaaaattatccaaaactttgtcttaaatttgaagtcttctcatacttataaataaagttgtggttcaatagctctttctctgtcttctgcatgatttccttttggtacaattatcatcattgacttggcaaaaacaatgtaaaacacagggctgcatggaacttctagaatttcagaggatgaatacatttgtagcttcatactaaaatgtgtctaaattattcctaaaacatgcattataatatgtgttctaattccacatccctattatagaaacaaatacacatacattcccgtactgtcccatctctacctcttccagtctatcaccaaacttaacattaaaaaaaaaaagttgccatgtgatattgaaaacaaaacaaagtataagctaaagaaatatcctactttaacctctttgatccttgcttttctcacaaattgatccttacgctagcatttcttaaactggcaaacagcttaaaggtgaaacagaagccctgtggtttctgctcataaagtaaatttggttagtattgactccaaaggcttttgtttccatttttgcccaagtgtaaggttaaaaaagttgctgcaatgtcaatttataaattattgttaatctgtgtcagcatttgacacatcgcagtatatgagaaacactgagaaaaattgttccatgtcagtttgagaccttttaagctgcattagtcacagatttctctaagaatacctggaattctgagtcctcaaattaaatcaggattatatgtagttataaaggatttataagttcatattttctgtagttcattaacttgcttctttttatttcatttcctgtctttgttattgatgaagtaagctaactgaatttcattaaagtctgttttataattttcatataagttgtctaaccaataaatacataaaagactggtttcaccatttgaaaggcattgatatgacattggtaaagatcaaaagcttatctcagagacaaattgaaatcatatcatttgtgtagtaatcaagattaaatttaccaagagtcctttctttttaaaaactgtattggctcctttgtgaatatagcagtaagattttaccagacgtccctctatattttttgacctttgagccttgaaaagataaatgacctacaataatcaatattctatcaatcattaagaacaaattggaattaagttaacctcctagtagcaataaaatctcatactcataggagatttgaattcaggttctgagattaatttgctgctctcccacttgtaatgtacaactaaaggaaacaaatttagttcaggtcagtgattatttcattaagccttcaaaccactgcttaacagaatgttatatatcagatgactctttaaaggatcccaacgtgcagtatgtgtgtgtgtgtgtgtgtgtgtgtgtgtgtgtgtgtgtgtgtgtgtgttgctgtacatgtgctgttgtatgtgagcacaggcacacatctggaggcattatcatatatatccttgtctgattttatgggaaaaagaaagctatgataatatttttacactcaaggacaataatcatagctataaaattcagtgtgcctaatgccatatcctaactctaagataaaagtggaaagaagcggctgtgggcttaaggaatggagggagagaaccctctttctagtgccctccctacaacactaataagagcctcatatgtgttgtgatgaagagcttgggctctagggttagactgactgggttcaaattctgtttctaccatttactaagtatgtcctttgagtcatttatctaatctcaccaagcctcagtttcttcatctgtaaaatggggcatttatttttactcattcaacaaaaaaaggtcttcaatgtctgatacatgctgggcgctatgcatcctgagatgcaatcataaacaatacctagctttcttcccaccccttgtggagctttaatgctagtggtccttgtcagggttagatcagctcatgcatcaaagtctttgacacagtggctagaacagagcaggccctcaaaaaacgtcagttcatgggaggataattatcaccgggtgtcaggtgacatgatctccaatccccacaacaatagggtaactgttattaactttgttttacatattaggaaactaaggctaataagataagatgtctggcccatttatagtttgtttttctctattaaagacagatattgcatttttatatgagaagatctgtgtgttcaaaacgtgttacaaatgtgaatacacttaaataataactccttaaaactcacccccttttcactgtaccatatcgcctgctaaccattaattgatatttgtttttttttgataattttgcaaatgttaaaggtgaatttttaaaaactttactgtgattctcaattcaatatcataagcacacacatacatatgcacacacagcaccatcaaaagatttttttaaaaaaagaggaaaagatccttgcaatcatagcacatcaaagagaaaatgctcaaaggaaatggaagaaacctgaaaataaaagatgggaccagacttctacaaacagctgtcaaatagcctacagaaacaaggcataaaggatcccaaaggaaagatgaaaaaattatactgggtttttaattaaacctggaattttttttttccaaagaattttgaaaagaaatggagagcatcctgttagatcaaggttatgaacagaagaaaaaaattttagaaaaacgttgtgaaattatttttctctttttattaagaaaaaacaataccaacagtctttacaatattgcttggggccattcaaagactgtacttccttttcatgatcattttctgtctgatcttgggtcttaccacaccctcttgtgcaccccactcagccattgtgggcaccgtggtattatttgaatgtgcaaagaggcatactaacaggctgtttcctctgcctggaattctatcgtctggagtgtatcatgggtaaggcccttccttccttcaagaggcctgcactgtccttacaatttaaaatttcaatttgcaacctcacccgtattttagtaatcctgatcccagttacctaagctttatttttcttctaacactaccatcctcggtcacactatgtgctctacttatctaccatgtttatcttttattttgtctgtttcctcctgcctagtccaaaatgaatataagctcaacgaaggcacagaattttgccttcatttgtgtttgttttcattcatctgttcactggtgtactctggtgaatataaactgtgactaatgtgaacaaacaaaaagtgtttgttcaataaatcctaaatacctataatttttttcatacttgctccaatggacataggtgatgcttaaaagcaaaaccaaacaaaatagcctagcacttctgattgggcatctttaagagtaaaggaaaactaatcatctctgttacttgtagaattgaaatgtgagatgaattcagatcactatgagtattgttcaattcaaattttaaagcataacctcaaataataactaaatgaaatttgtaaataagcccagaagcccaggaataacaatcaaagcatcaaatgcaagcatcaaatgaaaatgcaataaatttcttgactgaaaacatgtcagccaaaatactgtattgaaaaatgccattaaatatgctaaagtgacaaactgcacaatgcaaataaaactatcagtataattaagccgaacttatatagaattattatatagcctaagttcaatttaaataaatcaaacccaaaagaagaatactgacctcttgcttatgattttcttggcccagtaaactcttttcttgggacatattagtgattggtaaataaataatgaatggtataaatatttagcactacttcctcatcgctgaaggaagaaaaaagtacttatctatttataagttggctatgaaatggggtttgggggatagaagaaacatgcacacaagaaaatagctcaaaaaggaaggaaggagggaaggagggaaagggagggaaagggaggagaagggaggggaagggaggggaagggaagggaagggaagggaagggaaggaaggaaggaaggaaggaaggaaggaaggaaggaaggaaggaaggaaggaaggaaagagggagggaaggaaggaagaaaaaaaaggaaggaaggaaggaaggaaatatatatgagcaaaccaatgtttcagatatgggaaattgtgactaaaaaagagggatcatgaaaactaaaatatatgaactagtagaatatgattttgaaacagtcaagataaccccaattattccccacggaaactgaacctgaagggaaagttctgttcagctcatgtgttaaaccataataatagttcaacccagcataagataaacacagaaaaaatccaaaagcccaaattgaaacaagttaaataaatagaatttcccagcaactatgatcacagttcaaggtgtcttcatcaaaataaagttcaaaaatgccaagtaatggtctaccagcctacctggtgtagatttctggtcctccaaattgcataaactatttaagtccctatttctttactttcagtaacattaatgttaatataaaattataaacacagcttctcacatttggctggtttgcaacacatctgttaggatccaaggtgacttggcagggagcagtgggtcaagtcaacacaccacaacataaaaccacttaaaagtcaccactaattattattgttatctcgcataagcttacaccaatatacaatgcaagggcaagtatccattgaattactaacagatgcctccaactccaaacaattaccttaattcaaataaatagatttggccaaatcacttatataaatctcttttatctaacagagggcgactgtactacgatcatgaaaacagaggagatcagctgggtgtggtggttcacaccaataattccagcactttgggatgctaaggcaggaagatcactcaaagccagaaattcgagaccagcctgggtaacatagtgagaccctgcctctacaaaaacaaatttaaaaacttagttaggcatggtagtgcatgcccgtggccccagctacttgggaggctgaggcaagaggatcacttgagcctgggaggtcgagactgcagtgagccatggtggtgccactgcaccccaatctgacagagtgagaccatgtctccaaaaaaacagaacaaaaaacaaacaaaaaaaaaggatatcaagaattgactcatttccaaaaaaaaataaaaataaaaataaataaaaaataaataaatggtttataagcaaaaggcaggataaaagaacctggaaggatcaaaaaaaaaaaaaacagaataaatgctggaatgtgaattagcagaaattcttcactgctatgaaaagaaaaatgaaagtggcctaaaactcataagtctccctattatctcaaaccagagcacgaatggtcttctccattctcccttctggaatgaaaggcagtgaagtctcactgttttattttgtacttgaattttaacataaacaaacatttgcaacttattcaagttaaccatcttgaaggttgaagttcttcataagtacatttattatttaatcgcttatttatcaaaaattttgaccattaactatgtataaacctgtgccaagcactaactgggcagaaatcaaattctttgcaagtggctataaaattctgtgagtggtctggctaaaataggtgaatttgtcttccagatagactattttatcttccatatttctagaaaaactgacatctaaacatgtctctacctcctctattttcccacataaagcacaggtttctatcctccttgtagttatttgctagaatattagtctgcccctctagactgtgaactcctcaaagcaagaattctgtccattcatggagctcccacctactcccacacttaaagctctagagcactgcctggtacattgtggatgcttagaatagctgtatcgtgtgatacacgaaggaggagcaataacgtagagtggtaaaggggaaaatgagttccttagtataaatatcttgtataaattaagatacattatacatgtataaattaagatggagccctaacaaataaatggagccctaacactgctcatattccaggagttataagagtattccagatattctggtgttccggtgaaactgatgccattatttgtaggaataggaaaatcctgaagccctacatgctcttggcaaaccctccattctcctctccccttatcacaccaagcctcaccaccataatgtccctaggcctcctacagcctaagtttattttccatttttaagaagcctaggagttccagttcgttcctgacctctcagactgtcaccccatatggttctgtacatcctcctctctggccctatccactatgacctaactgctgaagttctttcactttcaactttcagttgagcaaatagagggttgcattaatacccatgagcttacatcaaagctcatggctactagtacaaaagctcatggttattagtacaacccactatttgatcaacttctctgactctacccttcagcttcttgctccaaggctgagagctggctctcctctgaagatttggcttcttattagccctgtgagtgaaggctgctttttttccacatgaccccaacagtagtgtcaaaagcctccttgttctttgccagatctctctccattccccctcccgaaagacctatagctcttctgcactgcctgtgagcaggactcaatgtgagcagacctttgtcattcccttaaaacccatcaaccacttgctctgtattgcaaccacctgctgaccactcccttccctgttggagttcttcaacttttagttcatcatcaatctacccaagagtattcaaaataatccttggtgatttccctttccagttcatggtggcctttcagttccttgcatctttcctccaaccttgtgctctgttcaacttcagctgctcagacctgtggatgtatccaagaagactgaatctcctgaatgacctcattactaagcacccctgctcagatcaacacctcctgttttccaccttactcctttaatcttaaccctaccatgttgtacaatccattcatctcctcaccctttccatggcccttacgcacccccaccttatgccctcacttctcagcttatatttcataattattagctctttattacactcttctggcaaaactctgatcacatttaaacctaaattttcaccaactaatctgtgaatcctgaacctgacttgagcatcatgttcacttccccaaagttaaacccgcaatcgtgccagttattctcactctgatcacacaaccgctaaccccaagtggacccttaatgctgacaggcagggagccagcagagacgtgtttctgtcactctaaccctcttctagaggacaattcagtattgttctccactccaaatttcagcagagcctccctgtctgcactcagctcaagatctgattttgccttcacaatgagaaaatagaagtaaacagaagagaatgccctcaactcccacaagttcatctcttcacctaccagcatctgtgctcctatccgctgccttccttcctattattgtgaaccaattttctctgttcttatctatgatcaagtcctacacttttgtactggatcccatcccatctcacctattcaagaacattgctatagcaattctcaactctctctcctgcatcatctatttttcttttaccaattaatcatactataatatctcaagtcttacaaaattaaaaaaatcccatactctcttgacacaggaataattttgggacacctaactccaaaacactgcctatattcttgctccttccagttcttcctccagtttctctttagctatctacaataaagtttcaatcccgccccactcccatttcaagtatacctctgttcatgcctttgctgcaaggtgactttcttggcaaggccttcctgaccaccctactcaaaactgcaagctccacacccctgatcatcactccctcctcccttcatggcctcattgtcctctaaagcttccgttaccatgtgacgttccatgcatgtatttatttcttcactatctgtctcccctctacaagtaggaaagtgccatgaaatcaggattctttgtctactttattttctgcaatttttctggcatctaaaatagcaatatgccaataaatatgtgttaaataaattaatgaatggatgtgagagaattatagcatagtgcttaattaacaccagagctttggaatcagaccgtcctccatttgaacagcaactttggtgcttggacgtgtcattgaacctcactgcaattcagttttcttcactgtaaaatgtggataataaagtatgtcataaaattattaaagtaaataaaatgttatatataaagcagtcagaaaattccttgggacacagaaaacaaccaacaaatgaatggccacttttacattgtcccagatcaaaaggtacaaagccgttttaatgattaaattctgaactgctccattttctcatattttaatatcccaaggcccctaaagacatagtttcagcttatgcaatttaacatggatattggtataatcccaatagcttggacccatattggaaatgctgttctactccatcacatgtgtgcatcatcagcttgcatgtattggttaaacatttgacttcattattgtacattcacactgtagttcacaatgctcctaatgtgtgggtgcacataccacccagaaaagcacagaaaaccacccacaatgatgtgaagagacctaaagcaaaatgtcaacatctgattaaaataacttcactcttcctttgaacaatgcatctccaaggggattgatttatagcattatttctcatgccatctttaagaacaaggtgaaataaaataactgaaacacagtataatgaacacaagctacatgaaacgcacaatgaaggattttagggttcaaatgcatttttcatacataattggtggacaagagaatcataaaagtttcgaattggtagtatagcatccttacaatataaatgagaaaagtgaggcgatccactgagtttatgtgaagagaatgggcattaagaaaatccttccccatggaagggaaaaacttccacagagtaaattccccatagcagagacagacaggcagcttaatggaatagaaagggcacagaaatagcaatcagcgcagcacccaacacaataaatatttgtgcaagaactgaattaagggtatgatgacctgaattctggttgtggctctgcccaaattctccttgaataagtaactttacttcttggtgtcctttttctcctctttgtactaaacggcagagtcagtagggttaagagcatgttaagtgactgattgtaatttgtagagataggaaaagatgggaaactttttaaagtttttttaaagactcccagagctgtggtaggacagtggatcctaaagatcacattctatttcaataaatagaaaaattaaaacatttgaaaaaagagtaagtatgaaaaagagttgactgtccatttccccaaagaaaatgcataaatgatgcagtagaagtaaaacactcattattctgagatgccattgtatgttaatattttaaaaatatatcttaaatctaaaatcacatttttaatcatcagagattttattaactctgtgtgtgtatgaaacattaatgagaatccaaaaatgcaagagtgaggatcccttctgccatgtttgtaaaactaggaaaattccattttcccagaatttaaggctgcaacccatgatttctccagaaagagctttaccaacatttttttttataaattcaacttctgtgcatcatgtcctcaaatacatcatccacagatgatgactaactcacagcagacctgtctcctctcaagtgctggttgaaatgttaccatccttcttgacaggtctaagtatgtcagttattaataataatttttacttataagtttcttaacacttataaaagaagaccccccaaaagctttgcaagttagacagctctagtttgcatatatattttaagcatcagtgaaaagacatgataagtgatacttctcaataaatagctcagttacaaacaaatcagaactaagaccagaagtcccattttttattccttgatgtgactgtcccataattcttctagctaactaatgagaattaacttaaaggagatcacaacatagaactcttatgaagatatttctatatgcggtatttctagaaacattacaaattctatgtgttaagctatgtaaaatttgggaactagattatcatactgcactaagtaaatcttgggatatccaacatgccacccacgggccatatgaaacttccaaaattgaaaagcctcttgattatatatatgtaattcatgccaaaaagtaaaacttcccttctaccttaacccaacgtggctctcacatatgcgaagtgttcattgtttgaaaacacatcaaatgtccatgatttataactagaaaatcagtgtgtgtctgtgagaatatgagtcatagatctgcaagcaaggtaggaaggtctttattccaaataaaagaaagctggcccataaaacagtctagcccagggtcaacttgttatttgaagatcaagcaagatttaaagcttatgtcattggttctaaactgagtcccctgctataccgtttcctatggactcactgaagagtcaaaaccatggatgttacgcaagaagaggcccctgggctttcggtaaagtaggaacacaaaggcaatgtcagagatattcagcatggttcttgtttatgatttcttgtgttctgatgatggaacatgtaaacagctgtcaaccaattaccaaaaatactgaactcattcagaaaggacgtaaagtgtctaggagtgaataaacaatgctcactccaaaccagctgctgccacttagggccaacatttgatccaggacaaagaaaaaagaggtatttggtcatttgttatggtaatcaccagcgtgtaaagggctcttcccatcagagaaatcacccaacagccaccacaggatgtttcttattttgacgactgaagggtgcatgctgggtctggaggagggagccattgatttattttcaccacttttccctggctgacagcaatctaaaagagaaggaacaagccagatcactcatctgcctgcttggcatgcctggtagtcatgggagcccatatagaggccatctgttcaggtcccagtctctccaaacatgcacagaaagatgacgtcaaaaggggtgtgcttcagccccattaatgagccacccaaagtaaaccggaagactcagcctgagtagcccacccatttatctcctctgttagcagccaagttcaatcaagtcatggattggggcaggcacaattatttttaagtttatttccctaggcaaatgttaagttgatttgaacatctgtggtttagtcctatctgatagacatataggtgggtagattccgtgagtcaagaaaaatgcacgttgcttacaacctactaaatgaaacccacctcagaagacatgatgttcagcattagcctgatggtttggtagtgcaccttcaaactcagctttcaaatgcccctaaattactgcagccagaaaaattctctgcagcaagccatgcagatgatggccactcttcagaaacagcagtgtcatgtagctctactcagtgaaataaaacaaatgagatgttctcttttgcctcaagatgatcctcccattgcaccaagatttatgatctattacaaagaaatgccaatcactacagattagttgggataaaaaaagtgttcgtataaggcttctgtgatcagaattctaacttcatgttatatgcacagtatttatgaactcaaatagaaataatttggctttctaagatgttttgaatttttgctttttgtaccctaaaacgtgtcttgcatttttagttatccttgagatgatcatgtgaaggatgtcctagatttttcaaaataacccattatgataacaagagaacttctgggatctaggaccatttcagcagttatgttggtagaggcacccctccatcctcaagaaaggacctgttttcaatccacagtaagaccccaagtgaccaagcagaccgtcactgactagaagccacatcttagagtcattgtcacatcttctgcttttttcccgtctataccctcttccatcaaaccctactttcctataattgcatatccatattccttcagggccctccctgtgtctctgtacgatgaaggtagctcatggtgacttgttaatacatcacatctcagtttatatctctgcattccaagctagactccctgttttacttggcccaatctctgaagctactggaaagagagacaacaacatcttcaccaatgcacaaacatgccacactagccttcatttcattattctttgatcatttcaatactattattttgtttggtctttcctgctgaaacccctgttagattttggacctcatggattttctaaattatctctaattgctatctatgcatctacatctatgcactggcctattccataaataaccataagggttctcaataagagtagtcttttgttaagattaagtaattttagcagacacaacccaaaccccattccaccaagaaataaaatatagtgaaaacacttcacagaaaagaggaaagaaaagcccgaatgcctatgaaagaaagagaccaagaaggtgcactccattttaccctgaagaacccacaaaaagcctaggagttggaagtaccagatacaatgcaagggaggagtacaggcatgactcatttgactgtgcctctctttaatgcgcttcacggatgctgtgctttgttacaaattgaaggtttgtggactctgtgttgcaccagtctatcagtgccatttttccaagacaccctgtgtctctgtgtcacattccagtaattcttgcaatatttcaaacttttcattattgttatatctgttatagtaatttgtagccagtgatctttgatgttactattgtaattgttttggggtgccccaaactgtgcccatgtaagaccgtgaacttcattgataaatgtgataggttctgactgctccagcaattggctgttcccccatctctttccctctccccagccctctctattccctgaaacacaagaatattgagatgaggccaattaagaaccctacatggcctctaagtgttcaagtaaaaagaagagctgcatgtctctcgctttaaataaaaagctagaaatgattaagcttagtgaggaaggtaggttgaaagccaagatggctgaagctagtcctcttgcaccagtttgccaagtgtaaatgtgaaggaaaagttcttaaaggaaattaaaagtgctactccagcgaacacatgaatgataagaaagtgagaccgccttattgctggtatggagaaagttttagtggtctggagagaagatcaaaccagtcacaacattcccgtaagccaaagcctaatccagggcaaggtcctaactctcttcagttctattaagtctgagagaggtgaagaagccacagaattaaaaatggaagctaaaagaggttgattcataaggtttagggaaaaaaaagccatctctctagcatccaagtgcaacgtgaaacagcaagtgctgatgcagaagctgtagcaagttatccaggagatctagctaagatcattgatgaacgtgtctacactaaacaacagatttttaatgtatatgaaacagccagctattggaaggaaatgccatctaggactttcatagtgagagaagataagtcaatgcctggcttcaaagcttcaaactcagccaagaggggctgactctgttgttagggactaatgcagctggcgatatgaagttgaagccaatactaattcatcattctgaaaatcctagagccctcaagaattatgtacctgtcctctataaatagaacaataaagcctgaatgacagcaaaactgtttatagcacagtttactgaatattttaaactccctgttaagacctactgttcagaacaaaagcttcctttcaaaatactactgctcattgacaatgcacctagtcactcaaaagccttgatggagattgtacaggagattaatgttgttttcatgcctgttaacacaacatgcattctgcagcccatcagtcagggaatcatttcaaatttgaagtcttatcctttaagacctacattttgtaaagctattgccaccatagatagtaattcctctgatgggcctgtgtaaaatacattaaaaacatctggaaaggatccactgttccagatgtcattaagaatatgcctgattcatgggaggaagtcaagatgtccacattaactgcaatttggaagaagttggttccaatccttatggatgactttgaggggttcagaacttcagtgaaggaagtaactactgattgggttgaaaaagcaagagaattagaattagaagtggagcctgaaaatgtgactgaattgttacaatctcatgataaaacttgaacaaatgagaaagcatttcttatggatgagcaaagaaagtgtttttttgagatggaatctactcctgatggaagatgctgtgagtgttgttgaaacaacaatacagaatgtagcatatcccataaacttacttgataaagcagaagaagggtttgagagaattgagtcaaattctgaaagttctatggtgggtaaaatactatcaaacagcatcatgtgctacagagaaatttctagtgaaaggaagagtccattgatgaagcaaactttattgttgtcttattttaagaaattgccacagccaccccaaacttgagcaacgaccaccctgaccagtcagcagccatcaacataaaggcgagactctccaccagcaaaaagattacggctcatggtaggctcagatgattgtcggcattttttttaactaataaagtatttttaaattaatatgtgtacattgcttttttagacaaaatgcttttgcgcatttgactgaatacagtatagtgtatatataactcttatgtgcactggaaaaccaaaaaattcacatgactcactttatttctacatttaatttactgtgctcgtctgcaatatctccaaggtatgcctgtacattcaagggaaagggttgaaaaacatggtaatattttgtctggttttttttttcttgttgttttttcaaaatcagatgacatatgcatacaagggaatattttgaaagtctccataaggaacatttaatttcttgcatccctacttccaacacaatctattacatgattacccattgttccttccctcaggaatgttgagaaatattaggtggagaaattgagtctgagattcttaggaacattggagggtgacagtgagaaacactgacatccatgcccccccttctgcccagcttaggatgtaaacagttaagtttctgcttccttaaaaggagactggagaatcctgctctggagagagtgggggaaaatgtggacatactgactgacatttggggacccccaaccaaaaatgatctggctggttatagaaaagctgatcaatgaactaatgtaactttctcacaaagcttcccatccatgtttaatgaacataagtagaaaaacaaagattaccacgtttgagaaagcctccaatttaaaatagagaataaaataggaaacaaaagtgagaaacaaaactgaaaaattcaaataatctatcattgatatcatcaaagatgtgatgttgtgcccatgaattaaaaacaagatatcataaaaaggaataacaaaaaaataagaaaagggccaggtgccatggcttatgcctgtaatcccaacactttgggaggctgaggcgggtggattacttgagactaggagctcgagaccagcctagccaacatggtgaaaccccgtctttaaaatacaaaaaattagccaggcatggtggtgcgcacctgtaatcccagatactcgggagtctgaggcagcagaatcccttgaacccgggaggtggaggctgcagtcagccaaattgtgctactgctctccagcctgggcaacagagtaagactctgtctcaaaaaaaaaaaaaaaagaaagaaaagaaaagttccctgaaaataaaaatataaatatgtaattttttaatccaataaggggattagaagattaaaaacaaggaattcttgagggtgtgaacaccccgttttccatgatgtgcaaatttcacaccgcatgcctgtatcagaacatctcacgtaccccataaatatatatacctactatttaaacacaaaaattgaaaataaaaaaatgtaaaaattaaaaaagatagattcaaggaaatttgttccaaaaaagaataaaaagacaaaggactcataaacaaacaaacataaagaaattatttagaaaagccatgagttccaaaatcttacaggagtttcagtagaaaagaccaaacaaaagaatttgtatggaaatgatcaaagacataattttaaaaacaaaattttataactgaaagatgtaaatctctaaaattgaaaatgtctaacaaaatcagtaaaaatctacatcatatgcttaaaaattccaaggggtgaggtgagagcaaaggtcccatacaaaggatttttttaagtggcatcatagttctcaacattattgaaagttagaatcgaatgcagtgatatcctcaaaattccaaggaaaaacaattttcattctataagtctgcacctagcaaaattatcaatccaaaaggaggatagaaaaagacatttttagacatgtaatatcacatattattttcctttatcaagaagtcatcatggtgagagataataggaaatccaagagatagaaggtcccacataaaaagggttaaagaagtttgaacaatgatagcatgggctacgtaaactcacagtaaaaaagaataaaaaaggaccacaccatctaaagtgagttaagcactcaccacaattcattttccattttccatttttactagcttgctaggaggcaactggaggcaaaattgaggttaacgacacacggaataagaaaggagcctactagtgtttggataagagattaacagaatttcaaaggcacttggacttgtttagtttatttttgaaaagaaagaaaaaaaacacagtaattagtatcttcagattcctactagactaatggaaacgcaaccaaattcagctcatttacaattctgtctagtagtgcccagccctgaatttctttccagttgcaatgttttcagattcaaattgcccatccccacatcttttgccattttggcgaatcccttagaggggagccatgtagtttagaatcagaagcaattgcgtttcacatcaaaaaatatttttatttcagagaaactaagacagaaaagcatagccataataatcttgcttctcttttgagttacatctaggattgctagctattctttgcccgcacatccttgccacagtacaaacacatacacacacacacacacacacacgccaaaaaaagagtgttcatcagttccagaaggttcacaaaatatacaagccttttaccctaaaaccttgtgatacatcccaaaatatcttttaccatcagagattagctcatcagtccttttgtctaactatcatatttcctgattctgaaacaatagctcacaactagaatgacctttaaatatgaaaagaaatagagaaagtgtccaacaaacaaaacttaaaatctatatgtggatcaagaaggcagtcataaaatgcaaagggcttcttattacagtagctaaaggcaaggtaatcagttaaattaccatgatgaatgtactttcgtgggctttcagagtttgtaataaaatggcaatcagatttacccaagaaagcaagaatatcccatgcatgtgtaatagtttactcaatcaagaaggatttgctaatcagctactatctgctcatcactgaatttgatgctgagatttttattaagtaaaatatgtgctattacacttgttgccggtgtaattatggtaagaaaactaaatatgtgttaaatagaaatggagtaaggtagaataaccaatgagaagcttcaaggaggaggtgccactttcactgtaccttcagggcaaaattaacaaaagtaaaaggggggaaaaaagactcccctagcctgggaaaaaacccaacttttgtttctgacaattttataacaaaaaaaagaagtaggatgggatttaatccagaataaaagtgaatagctttacagagtagagaaaatgcttttatatgagactagagaagagtaagaggacaattatttatgcaaataaaaaagaaagaaaaatcattccattatgaggagacaaatttgttttgggttcctgcttcattccaaataacagaaagtacatatacaatatccatcatccattcatctacccattcattcattcagcagacacttcatagtgcagattgtgtgttgaagacaatagcaggctttgaagaatacaaaaaacatatagttccttccctgaaagtgctgctgatgtataattaaaggctgttcttttccccttccccaacctacctaccatccctattgtgagctcaaagcaggaaggctgacaaagctgttatttgaaatatttgtatgattgagaaggcgaccacctttcaaggtttccaagacacggcatttttcaagaactgtttatgtccttcttcctatgaataagacagaaagctgacatacagctatggtattactcttctttttacttgaaattgcaaaatgattaaagccatcaagcaacaatagttgacctactgagggaaaataccagataggtgccctggagagattgatgagtgaatatatttagaaaggattcccaagactatttgcatttgtctctgagactgctttctctcctttgcctctgtggttagcttctccatagctccatgttgtcatccaaactgaacctacttgatatggagcctcctaagctacagggaaacaagcccactcatcaacacaagtaataacagactgggaatcttcactcacgcaatcaaagtttctgttgatttcagtagaaaatcagtgttttctgatacttttaaggcaacacctacaagtttaaagccatttagataaagccataagttacgagggagttatgtgtctcaatctctccattcattgaggacttatcgttcctggggcacttttctgcaggggaacaatgaagagcaatggaaagtaagcggtggcataactcccagctccaagcctgatgtctcctgaatagtccctacattaacgtgctactggaatgattctcaaatacaaaaggggaggaaggcattttggaaatgctttgcatggactcagggcttcatttttaatttgccatgaaatcctacataagttacttaagattctgggcctcagctttctaaactttaaaaaaaaatatgaaagaaaaatggacaaaattaacattctctgattcaacctacattccagtgatggtgtctactttggtaattacttttaagcctgcagcaatggcaatgactaattctattactacatataatactgaacatactaatatatgactttatattatttcagtaactcagaaataacaataatccagtaatcaagatcagtgatagctcaaggaacaaaataacagaaccaatcttaatagtcacaggaagccaaacaggagtctagctaaaaaatgttgatgtcattttcctctatatgcttcctacaaaattctaaacccatctcagaacaccagtggagggcaaaatgggtcaataggcacatttccatagataaaatgtggggtgggtggggctcaaaattgagaattttagcaacaatgctgtttttcttagcctaaagtattttcttctgtaggaatataagtatttgagtaagaactgaaattagaaacccaagcaactagtctccaatgttttcaactacaacattaatacaaaatcagtaagagtaagatgaagactattttggaattgcaggcaaaacttccacgaaggatacagtttttgagagtaggcacagtcaatagttttgactctgaggtatcagtgaatctatttataaatcaactcaactaattgtcatgcagggcctatccacgcagagataataagagcttagagtcaaagagggaagggtaatgaccacgcagagataataagagcttagggtctaagagagaagggtaattgaatacaaaaattgttaagagtggcttgaaagaactgtgatgtaaaggcagattattggtgcaaaggagggattggtcaatccctggggaggatgaacagagaccatgcatttcaggtagacagggatgactgcagtaagtagccactggctgaggaattctaggcactgtgagctgctcccttatagctcaaacatggatttctagggcagttgttgcaaggcctgctcaagcaggacctagtctgccaagctaaggcatctagatttcaccactaaagggctttacacagatgaatcacataatcagattttcttttagaatgataactctaccagctgcatagagaatggattagaagggtgtgatattacagacagtcatatgcgagactgttggcttccaaactaaatttaagtgacccctttctacgaattctatgggtcaaaacttctactaaacatagctctcacattcatattgcctctttagaagcatagcagaatctaaacatattttgaaggttaatatgttttttaatatcctgttagattcccttagcaggaaaaagaaaagccattcaaggctgacattaagatacatttttcaagcggctgttatgatcattctaaccccatctttccctgactatactactaaatacaacatagttaagcttttgcaggaaaacattctcataaccatattctctgccttgtgtttttcgtactctgtcacagaaagaatatggagtgcttttaaagctgcttatgtaattcacagcaagatctgttccattcttagttatcagtaaagttattaagttagcagcaatccacgtacttttttctacttctaccagaaaagaaggcatgaaactcaatcacttacgaaatgatcctccatgaataaattatcctgcggctatgatatttttaaaattacctcacacctattaaaaactaaattaatcaaatcacttagatgtcagaatattttttaaaagagagatactgtcaaaatgctacgatttctggtaaagatcctccaacttcttaaggaatctgaattaaaatagaactgcttctctaaagaaccctacaaaacctattagctattgagattataatacgtgttgcttctgggtaaagaatacctatgtttgcccacttgggcaaaacactaattagatgtgtaacaacacaacatctattaccagagcatttgaaaaatgtatttttaaaaatcaaactaaatttccttctaagtagaatgtagtccaagagtattatctgttggttgattgagatttgctctcatatcctgtttgatataagacaacctgtcagtttaagccactttcatagtatttgagctctcactgcctgtcagtctctggatgtacaaaggatctgcagtaaggaagaagagaggcacataagagatcattgccctctcaaggacaaggtccagggctagcatagtcatgcacatgaggttcaaagaaggtttcctggagaagaagacttagagtttgacacagagtagtgtgtccaggtaaagaaaggtgcaaagagcattttatatagatgaatctacgtggcctaaaatatcatacaaaggtatggagcagcattggtgcagggaacaactactggtagcttgatgtacctagaatgagaagctgtgggaaaccacgctgttgaagcagggaaggcctggaacctggatgttcttctagaacatgaggctggctcactctcctaagacaggatgaggaaaaattttactgaatttcaagtgaggggccatgtaatacaacctctggtttatggtcttaattccagcactaacttgctataaacatctggggaaaatcacttaggttttctacatccctcttccctttcaagagatactctacctacttactcaggtatattgaagaagtaaaaaggatttggagaacataaccacaatattacttaagaatattgtcattttaataataagtattatgcatcacatgaactacccaaggcaaacaagaaatagcaagcacatacatcttacagcatgtgtggatagcacctatttctataaagcaaatgcgatgatgagtttattaaacatggcactactttggcatgtcctcccattctttttttaaaaaacagtgctgtcccaagggaaaacaaataaagcaaataaaaattctctccatcctctctcaacctatctttttttccattctttcctttttccctacaaagcatgccttttcccccatccctttctaaagtaaaaagctggagcatgcttgtctcatatgtatatgttggtatagatctgttgccgtgggttgttcttttctagaagagttagcatcttcacccatgtggccatggctcctacgttattaagaaagctgtgaacatttcagggaggcagtatgagtttactaaacatgtattagactaacctaactttatttacttttatgaaactcttcttggagaggtaaaatgtaagaatgcaacaaagattatatattctatttcttcagggctccaggcaggatttctcttgctctccttttggactggaaaagggtgttaatcaggagcagaccaatcagttggatagattcaatagccaattaataacattaatcaaagtgtactggttattagtgtattcatatccctaggacaacaatggggagagttactataatggtaacaatgatggaatatatagttctctactacatttaacatttttgtctatcatttggattaaatttctgattatcaaatgtgtagtaacacacagattcaaaagataaagattgaaaagtatctttaaattatcccaaatcctgaagtattttggttgaaatcaataaaataaaatttaacaagcacaaaaataaaaaattcagcttcaggattcaaaaattgaatggtaggataaagtagacctaatttaaagacattgtaaataggtatattcataaaatgaaatactatatagctaaataaaccatatggctattataaatatgttctataactacataattccatatactatataaatgtataactaactataaataactatataattgaagtttagaaaagattagtaacccatcccaggtcatataattagtaagcaatgggatgtacagcctagggccatctgaattcaaaccctagattgttatccactatgtcacattgcttctcaaggcagaatggaactctgtttactgacataaagagactatgtcatatatggcagcgtacagagccatatatatttatatatatagagagagagaacatataagctcagaatatatacacatacatatacatacacacattacacataacatatgcatatatatcaataaagatggctcatgggaaaagtcttcaaggttataaaatttcaacactggatgtttctcggtagtggcattaattgctgattttaaattattatttttcatctgaattttctagtttttatagtgatcatgtattgcttgtatagttaaaatgcatcatgtgactagcgaggcattgcagtgatcagaattttagtattagtcaacaatatgacacaggtgctacaatcattaaagcagttctgttgtgtatttaagaacagccatattctaatggagtggaaaaccactttcacgtgtcttgcactgatgcccagaacaccgtgttcaatagaacatccaaaagtggatagccagcatggtaggaggtctggagcccatgtcctatcaagaaaagctaaggaaccgagcagagcccaaaaataaaggggaaatacatggtgagatgcatgaccatggccagttaaaatggcaaagttcagaagctgggttcgttagtgttattccagaagtggacaggagaagcagacctgccagtcagtcaatattgaggtccttctaggtaccaggccctatgctcgacatcagggatttacaatgactcaagagacaatcactgccctcagagaactcatgggtgagtaactcatcacagtattgctaataattaaataattctaccgtagaaagtgtcctaaaggagatatgcaggtgctgaaggagcacccagtgtggcagcttgtcatcggtgtcacagaagacccccctgagatggtgaggtggatgtgtacaagctgacacctgacacatcatcaggagttgacatggccaggagggggctgagtttgtaaaggtggaaggaggctttaggaagtgtgcagagtgggagggagtaaggcctgctgcggaaatcaatgaagccctctcgcacttttgcataagaagcaatgactcctaacagcgctggcaatcccaactgccctggccatgaaacacacctaacaggaacatgttgcaagatccagagtgacagaactgtcagctttacagtgggtcactggggtcagccactgaagcggaatcaggcctcggaacactaggtgatgctagagaggaaacagtctacttttaacccgaaattcgaatggaatcatatgattctgttttgtcatggatagggagtcatttagcaacatgcagcaaagggaatgtttataaaaatataaacagtgatgatctcccaggaggcaatctctatttataacaaaaaatctttaataactaagaaaaaatagatacagcaatatctctaagaatgcatacgaccctaagtaagattttctgggtaaaaaaaaaaaaaaagcaatctgataagcacatctcatgaggatgtgtgagtgggcaagaaattcgcagataagctttgatgtgggcaagtgtaaaattattcatttatgcaaaataattcaaatgtcccctgtagaaagatgagttccaagaaatcagttacagctcagaaaaggatctaaaagtcagatattccctaaaaatgtgttactatagtcgaaatagcatataaaatgttaagaactctacattattgacaaccatggtatatgtaacctagccttaaggaaccagtttcctaaaagatcagcagccttgggagatgttacgggatacagcatgagggaaactgagtctcctgtagtttgaagcaaagaaaaaacagacaaccagtgagagatgaaaaagaaagaagaggcatttctccctccatccatagtgcagaatgtgaattaaggaagacaattaaggactacaggaagtgagcaatgccaagatgaaacagaagcagccaacataagaaaaactaagggtagcaagcctgggcatagagaaaatcacaaagataatcgagaaaagtctaacaccagatagcagcaaaggtggttattccagagcagtggttctcaaaatgtgacgtctttgcaatgcatcagcatcacctagaaaccacagtttgaaatataaaatccctctcagccccacctgggatcaaatgaatcagagagatcaagaaaccaggaaactgaagaagaatcctccccgagcccaggctgagcaatttagccgggtgttgggtttgtaggaggccacatcagacacgggaccacttttctttaccaatcctttttctctctaacctcgtttgcatgcctttagcaaaaaggtacttcttactcagcaatcttctcttcctggaaactgatgcccagatttctatcccagtgctgccctctggttttatctagaccactggttctccactctggccattttgcccctcgagaacatatcacaaagtgggagacctttttggttgtcaaaactgtgagagtggggtaatgatactagcacctattgggtagagggcagagatgctgctaaacattcggcaattcacaggaaagctccccacaacaaagaattctccagaccaaaatgtcactagtgctgctgttcagaaaccatgatccagatcagttgccccggaaactacattcacaccaagcatcatctctttgctcctccactcctccagctcaaactagttccactagcactgtgaaatcctggttgtgctgacatagtcaacttccctttatacccaaacttctccatgtctgctctccataggctcaatttaattacatgtggcttttctcaggcgacacaaccctctcagctacattctccatgtcaatgatgaatataatattcattctattgcttacaaaccccaaaagagaattgatgtcatgttattagcagtcatgttttctgatttgaacgtgttgaacaagcatattaagagagtttccataataatgccacttatcaggagtcataaaaatctgcaaactttagctccagaaagataataaaaatgcatctctccagaaacagttttgactttctttttatcaatagaaacttaaaagtcagaaggctgagaagtgaatttttctagaaagaaagttaaaaaccctgagcatgtttgattccttggttttacctaaatataacatattatgaacccatgggtttaggttaaagtaggacaaattctgggaatatgtactttcactatatgggaaattgtggtgcaacaaatctataaatatttttcaaatattactttcactaatcagtagtcccatggaaatgatgaacctcatttttctcctcagaataaagctgatactaaggggggaaaattataattacacatgtgcgtgcacactgaattatgctgcactgttttcaaatacaaacctgagaagaaaatggagaagagacaagagtgaatatggactatggtgacctgttaaaaacacacacttgtgaaaacattcattaataataaattaacacacatttaccagatccttatatgacagcatacagcaggtaatttaacctcaaaaattcagccaggagtttgacatcaatctgagcaacatagtaagacctccgtctctacaaaaaaattaaaaaattagccagtgtggtggcacatgcctgtagtcccagctactcaggatgctgaggcaggaggatcccttgagcccaagagtttgaggttgttgtgagctataattgtgccatcgcactgcactccagcctaggtgacagagtgaaaccctctttaattaaaaaaaaaaaaaaaaatcatctccccaacaggcttaaagaaagaatccatcagcttcacagaaatgtcctttgagctcatgtggagcaaaggcagacgccttgttatacttcctgcccatgtggaaactctgatgggtcttgttttcccatctctcttcctatcttgtgtagttaacttgcacaccctccttagcaaactgcacaactttttaggataaataaaagtcctctttgtacttggcaaaagtcaagctgcctgccatagcctttgtatagaacacaggaaggggatgaccagtcagccgacaagcactgtacttcttgacaactgtccacgtattcaggtgtaaaatgatgatatggaaattcaaaggacgctatgtgggaataacagagcttccactgaagtaaggagtggcgtaagatgcagccatattcatacaagtttctctcgaatgtctattcatctcctgcaagctttctacataagcgtggtcactggacacggcctccctctcaccaaactccaggtcattccaacctaacttgcttcagggagcaacagattctcctcttatgggggtggaggtatccaccacaacacccacgttgctcctcctcagacctgcaggccagcactgggtactcccttctgcttctcaccactaactgctaagggcctcctctcctttctcaggcctcgtggaaatctctccccatctccctttctacctctcttctaactcttgcctcaggaaaattattcttcctccttctgaatctctcattatatttctttcctatgtgaatcaaaaagactaaaattttgtaaaaagtacagttacaagtataataaaattatacccagttaaaaacccaggatttccctttggaacctaaatcataacagaaaaaaaaaacgatcttcttcctcatctttctctaattaaatgtgctttctttcccctcgaacatgtcttcaaattacattctttattcaggtttacagtgtctcctttgcctgaaattatattttaatagtttttcattggaaatcttcagagagtatttaaattgaattaaacagggttttgtgggtgtattagttatgggtaactagttcctgcaaaattcagtggcttaagacaacaaagatgtattatctgacagttgctgtgggtcagaaatgcagagcgtcttagctgggtggttctaggcagtgaggctatcagcaggcctgcagtcttctcaaggcttcacagggactggcaggtccacttctaagctggcgtcttcacatggcatttggtcagagacctccgttcctcaccatgggggcctttccacaggccgcctgagcatcctcaggatgtgacagctggctggccccagggtgagggatccaggagaaagggagaaaagagagccaaggtggcttttgtcatctagtctctgaagccacattcagttgcctctgcttttttcttttttttctattcgttagaagtaagtcactaaatccagcccatgctgaagggagaggaattagctctaccatttgaaggttttgtcaaagaatttctgaacatatttcaaacaaccacagtaagcaggacttgaatgcaagtcccacttatgacattatttccactggggaaaaagtgttctgcaacctaactacaagcaaatgtttaaaacgcagcttttttggtaaaggagatacacctcatattatataaatatggctgggacgttgtcaaacattatggtgtattactgagcctttgaaatgtactgaaagctgcaagtttatagatttcatcattataaaatacccaaacaaccacaatatctgtacctttatacacacacacacacacacacacacacacacacacacacacacacacacctgcaacattcatttgaaaattgaaatacctacagaatagctatagggttccatagagaataacaggattggatgactccttgaggaaaacatggggggaattttagctactaaggagacaagttgttttaataaatggctcataaaccttatttacatttactcaaacaccaggacaagtccatcattagccatcagcaattacataaactagggattcttttaagatgttaagatattggccgggcgcggtggctcacgcctgtaatcccagcacgttgggaggccgaggcgggcggatcacgaggtcaggagatcgagaccattctggctaacacgatgaaaccccgtctgtactaaaaatacaaaaaattagccgggggcggtggtgggcgcctgtagtcccagctactcgggaggctgaggcaggagaatggcgtgaacccaggaggcggagcttgcagtgagccgagatcgcgccactgcactccagcctgggcgacagagcgagactctgtctcaaaaaaaaaaaaaaaaaaagatgttaagatatagttagccagaaaacaatttgtctttaggagagaaaagttttcctctcaaaatatcctctcttataatagactgctctaattctcactcctcttccccttcccattgcgcacctctgctatcctgaaagagtcttgaatcaagagtttagatttactttcatcttctataaacactatgtgaatggatatagtttaaattccaaaatgccttgtctataataattggagtccagtgtcaagtcacaaggaattgaaaaccattatatctaaaaataaaagcaatatacctagtaaaaatgtatattggactcatggaaaaatattagacatagtcacgagagcagtgaggcataaagaaaatacagtttgctaataaacttcttgtttttctgtcttgctgtgcattctctctcaatctctttgccatctccccttcaccatccaagtcttcactgttggtgtcattcaaagttctgtgtatcatttcttgtcttctcatctaaaatacttggtgatctcatcaacccctgtagcttcaataccagttcaatgtgatcaccccaaagctgtgcctccaacctaggcccctcttctaagcttctgacatagatacccaactgccttctgaaaagctttaccacaatgtcctaagctgaaagcattatcttctccacggaagttcctcctcaggtgcctcctggtacaatcacgctgtaattcaagcttccttttcacacctccagtcctctcaaattgaatcagtccccagtactcccacactctgccttcttgcaaagtagatggatcacttcaatccatcctcacttcctggacctcgctacctcccacttagactactgattgcaacagtctcttcattcactcttcccatcctacactctcgacccctcaaatctattctccaccctgcagagtgtttttcctaactgtattagtctcctatttaaaatccttctgtggcttccacttcaaccatcaggctcttctaagttcattttgatagctatgggaagcctactttgacttcattctcatttcttctctaggttcccttctggtagcttcccaccctgagcctacattcaccatgtctgttgtatagactttttgaaaggcaaatgaatctcaggaccccaaaatcactaagccaaagggaaatgtcaagctgggaacttgctcaggcaaagctgcctcccattttattcctaaataagataactacaaagattaaaaaagctacatacctccctcacaatttgcccactaggaaattccttttgggactcaagatctttatcttaaaggagttcagttggatttcaccttggcaatgtaaattgatagcttatcttcacagctgcgggacaaaggacagaactcaaagtcatccctctgctcatctgaggcaaatgcatatctgattgcttcttctcacctattgtttatacaaaaatgtacattcactgagccagactaagacaaaagtgactcttcctctaccccctctctcacatgtaaattctgtattcagtgaaaggctgatcaaagactcaaaagaatgccactgtttgtctcttaccaatctatgacctgaaagcctcctacccactgcaagttgtctcacctttccagaccaaaccaatctacatcttacacatattgattgatgtctcatgtctccctaaaatataaaaaaccaagctgtaccccagccacattgggcacgtgtcatcatcttgaggcccacaaagaatttccttgtaggcaaattgtgaggaaggtatgtagcttttttatctcctgaggctgtgtcatgggtgtgtctttaaccttggcaaaataaacttctaaattgattgagtcctatctcagatacttttggttcacaacttcatcaatattgttgaaagaatcatttgcacttccctttatataatgtgttaaatacacacctctgttcttattctctctttggagagaaagtgttttccttcctatatatttggtaaaatctgttcatccctcaagacctagtttgagttaccttatttgtaaaaacttccttgacctcccctcacatctcagctgcagctggtcatacccttctttgtgcgatcaagacccatattcttacatattttgtagcccatttcacactgtcatggaactatttgcctttgtgacagtcttcagggaaaaaggtacgtctttttcacctctgtattttctgtatctactacctattacttaaaaggtacccaatgaatgtttgttgagggatgaatgatggaagtagcaaaatgcagtaacaataatggaataatagactgacatgttttctaacacagattccaacaaagcatggacttacgtagatcctgacaaaaaacaaatgcattaggctttgtaggtcacattaacgactgttcaatgaaatttgcacaaccattatatttcacaggtatccctgcactcacaatactgaagtcctccatctatagttggttggatgctggtgacacattccgaagaatgagtcagtgagatatgtccagactaacaaggtgttgctgtattactgaggcctcccccagatggtgattccttggaaagttaagtatgtgctgctggctggaagtttgcagctttgacacagtaggaatgtttgccttaggacagtggaaactccccatctcgtatgacacaaggtgtgtgaaattgttaccccaaataacacaatctgcccttcccatgaattcatacaagcatgaggtattctgtagaaggaacagaattttgagtaactctactcaaattgttaaaaaattacaatttattaataacagtatagtctccaccgtagtttgtgtcttcatactctgaaaaccttgtgcagaatattttgaacataacgtatgtgaatatatttaaaataattcttccttcgattaatttttctaaaaattacagaaagtactcatataaattcaacaaaataatgcaattatagattatcttaggactaattcaagcctaagatttttttccatctcaggtaacaacctatgctattaaaacctcatgtgactttgcacagagagaatagcagttgagttagcacaatgtccccgtctctcccagacatcaatttaattgccatttagaagtcacttgctcaggattattatttttagaacttttcacaaaatagtttcactacctaacattaggtcataacatttttaagtggagaattggagaaaaataaagagatgaacattttaacaaaggtcaaagaaaggagacttaaatgattacttgctgataagcacttaaaacatctcagctgaatgtaaagctagacccagaaaacatcacttcttccttaatacaattctttgctccttactaagagcaaaactttttaaaacgcaaccatgcaactttaaacaacactgaagagttcttcgcaagagaaggataactctgaagcaattagacataaatctagaacttcaggtgtgaaagagttgtaattgctttaaaaatataggattcagaaagttaatgcctacctcttgcctgacaaaacatagtgaaggttcatatgtcagtcaaccacatagagtacattaagcttccccaccaaaaagttatatgttacctaaaacctgtcattattattaatgaaaaaccttgaaaatttgctaaagatctgatggtctaagaggcaggaatgcaccaatgcctgagggcaagattgtgcctctctatcctcaatgtccaagtcccactgtttactgtcccattgaatcacacaactgggacacaacccaatttccaatagcagggcattggttacataaattatttgattacttttaatagcattattatttatattaaaaagatttatattctggaatacccagcagctgtttttaaaatgagctaattcccaatatactgacatggacttctgagactggaagataattataacttattaagtaaaaaaaaaaatgccagaacatgtaaagtatgattttaatctataaaatgcatatatatatatatatatatacacacaaacagatattcatatctgtagatacttcttaaatatctagaaagttccatttcacactgttaaaagagactattgctaggaagtggtggaggagcagggactagtgtacattctaaatcataaaatctgagctgtttaattctaacacaggctacttccattataatgtttttttttttttaatgaaagcatctgagctcttaatcatggtaaactcctcacattccaacaaggacaccaggttgcacacctcgagggtgtaggatgtacattatacatcttacgtccctcatggtccttcacagtgtactatgtaagatctccaggaggaaggagccacacctgcatgcacactccagggctttctgaagtggggcccagaggtctcctctgggagagtgtgcgagggcactgacaatatgtctgtcaggatacacggaagttctaccaatagcagtagccaaggtccagaaataacagaataagaactccagaattaaatattttaatatttatttgttaaatatttgtttgttaaaatgcaactcaatgtagctgttaaaacagtatgttctgcagtcagactgtctaaatttgaatcctgaatccatcagctattagctaggggactttgagcaaattaaataatttctctatgtttcaattccatagcctataaaatgtggacagaaataatagggacattgtggagtttcaatgagttagtatagatgaagtgtttagaacggtgcctggacaatcatgtgttcaataaatgtcactttttgctagtgttcttgtctggtaggcaaggtgttattattgaaaatgggttcactgattatactcactttataaatgtctcaagaatagccacattcacagagaaacacacacactagccctcaaggtctagcttaccgtcctctagagcaaaatgtacatatctgtagatacacaggaattataccagcagttacacaccaaacagttgtatgggcagagatatcagaagggaaagatttttcaccaacagcaatcagattatttctattttgaccagagttatttccaatttgacctcacatcaggaaaatcttatttttaatgggcaaaattttgaactttatatttaaaactcttgaactttatattaaaattatttacctttaaaaattatattagaacataattttttaaacccttggtgtcctctaaataatgattgcatattaacagttgaaatatgaatcattaacaaaaatgtgtttcatgtatatattttcaggaatacattaattatatgaaacaagtaatttatcatcactgtctatgaccttcactgagggccatttttaattagtgtttgtacttagtagacattgacaccataacagttataaagattttatattccaatacatcccagtgaacttaagaggtttcctaacttacaggcttgtaactacatactgttttgctaggaggactgaaaacagtttggtgccaataaaccagcaaaggtcgagagtgcagtgaagactgcacaagctgttaaggcccagttcactttatgatttgaggtcatcagttaatctacaagtagtatcgtgtacatctgtgtgtgtgcgtatgttctgatctgtactccacctgaaaacacaatatagtgtgtgtttgtttttacttccctaacacaaaaccattctctgcatggaccacaaaatacgtctcttaacaaaaattaaagataatgaagatattggaaaggttgcagattataaaattttctttttcaaatgttttaaatgctcatctgagattaactctataatgaatggagttaaaccctagaaaaatcttcattagtcagattcagataagatttataatctgatacgtgccagccacaaggaaaatgtgcatcaccactattcataatagtgaatacatggaatctacccaaatgtccatcagtgataaactggataaagaaaatgtggtacatatataccatggaatactatgcagccataaaaggaatgagatcatgtcctttgcaggaacatggatggagctggaagccattatcctcagcaaactaacgcagaaacagaaaaccaaacacagcatgttctcacttgtaagtgggaactgaacaatgagaacacattggcacagggaagggaacaacacacattgggacctgtcagtgggggtggggggaaggagatcatcaagataaatagctaatgcatcctgggcttaatacttaggtgatgggttgatagatgcagcaaaccaccatggcacacatttacctacgcaataaagctgcacatcctgcacatgtatccaagaacttaaaattacattaaattaaaaagaatatgtgcttcacatacaacagacaagaatataaactattgttgcaccttaatatttctttccatattatcataatttttagtatataaatttctggccacattttgatgatgtaatcaaaataccacagaaatctgaattcccatacatcttgctagttttcacttttgcatttctttctgcgtaacaccagctaaaaggcagctcttccactattcagtttccctaaggaaaaataatatgatcaatttgaaaattggtaacagtacatgtgaagatgtacagtggtttagttaaagttataagctgctgttccaaattaaaacttcatttttagccctttatatctcagtgaaattctcttattaagtgaaactttgcattaagtagagtaggaaaaagagaattcacttcctttatatgttaactttctgaaaatctcaacataattccattgggaaactactatggtggtttagaagagaaataaaccaaaatcaactttatgttaaaaaaaaaaaaaacagtccaaggggaaaataatttgctgtgtttacaatttttttctaagccctaaaaataacagaaggaaatcttatagtatacagaataacatagaatgagtagactggattttgaataaaaatataatttcaaccaaaaaacacgatgatgtctttaaaacaaagctaaagagctataaatatcagaagtagctataacacataaaaatatggattcattactcatttgccccttcagccattctaacttcactcttattaagcaataattaatactacttaaagccactatcttggcatacacacaaaaaggatatgctatgtgcaaaatcctcatttgaagaaggatcaagatcatccctttcgtcagcttgtggtgattttaaaactatggcatagcatacaatttccagatgatcttgttgggaacagtctacatatttgaaaattagcctacaaaataattaaattacttgccccaaaatgtgtgctacttatatctgctcaaaggtaaataaacccaagcatgttgatctagatggcagcatcgtgactgaaaattttccctgtcatggatgaggtagagcaggttaaaaagaaatgacagagcttgactgtgtccattaaaaattaaggaaataattatgagacaaataaaatagtatcccatgcagtactagctacttggtaaaatgattacccttaagagatagtacaagatgaaaatataaactctcaattagagtttacataaatcacaggtaatacctccacagtaagttgagaaaaattagcgagaagaatacaaacaccttttgaagtcaatttcaaggagcaaaattatcagactgtccagtcaaccattcacacctgtctgagaacacttcttagatggacttttaccctcagtcaaaatacaattcttatgtcctcgtgtcttaaccaagccagttcccactgtatactccattctaaacactggacagtacacatacttgtgcgtgcacacacacacacatacacacacacacgagccacaaattgcaaagcaaagaaggccataaattacaaagcaaagaagggattagattgctgtatcatttgaaggtaattctaaaatatctcccagtgaaattatatccctgtctaaattggagaactttaaaaaaaaagagtgcatgttaagatctccaggtaaaaattactaagcaaatggtatctcagtgtcttgattgtaaattaaaaagttatataatacagcaatattaattgatatgctcttttttgagcatctcatttcaagacagaccatcaaatcagagcggtttcaaagaaaagcaaatgtcatcatcaacagaaagtcagaggctcagcactcttcacctggacttgtctgtggtccaggagaggaggtgagccaagaacaggcagaatattattcacctgaaggacatcaagttggaaaagacagcatggagaagaacggaagttaacctggcttcaaagcctgatgcccaaaatgttcaaaacattcaggtgccaaaatgtcttaggaaatggtgcttaagatgtagactggccatggggattttaggtctcagactccagccaagctgtgttggttgtgaattttctttcatagcacacgtacaggccagtactataggaatttgtaacagaatccacttccagaaatgctgctctgttttccctgaatgttttctgcaccgtttgccactccctccttatttgccttccctgcaaatgctgttgttcttcagttccatggtttcagctatgaattcatgtgggattcgtttccaaacttttgtctttacctttgaacactattttgaattctagacccttaaaacaacttcagatttcacatcttccaaactgaaccaattggatgtgttccttgtattcattaggttatgattttaactgatataacagagaacctaatagcatttgcttgaacaagataggattttttttttaatctctcaaataacagtgtggacatgaaaagcagtccagggctgacatggtggtttcacggtgtcagtagcccagtctccttcagtcttcattgtctcttggtatcatgtcctcttctcaatttccatggccactgccttggttcaggacttcatcttcttatttgaagtattgtcgtgcccttcttcctggggccactgctgctggcagtgtcctcactactgccagaaactgatgtgatctgtttgttccagaagactctaaattcattgccatgatagtccaggcccttataattatggcctgggtttaaccgtttcatctccatttctagccactcctaacactaggtcacccttttacaaatactttacaagctttcattccctcgtgattttgctgggactgtactttcctcctcacccctattttatcctttttctggctcattattattcaagcctatgtcaagtattatctcatttgctgaatgttatctcctctatggactcttccaacttctctccaccaaactgaattcagtaaatgtttaatgagcataattcaaggtaaggaatagagatattgagataaataaaagtgcttctgctctaagaggttaaatatttagcagaggagatggaaactttactcattataatatcttatcaacaggataactgcaatatgaacagaatgatatggggtaagttaatcttgcctgcaggcaaaatcagctgttacctctatgtacaatagcactttgttgacttagcacttgtatgttcaataaatctgtgtctctctttctcataaaattatgagtttagtgagaacagaacccacggtccccacaccactattttatccaatgccaaaagaagaaagaaaagaattttattttggtattcatttctaaagtccatacaagtatagaaaaaaaaatcaaattttaaataacgattttgcagggtaaaattttcaaaatcagattaaaataataactatctttatctaatcatatcatgaagggaaaaacttacatgttaattaaatccacatggaaaaggttactttattgaagtgttgaaaaagagaatgatttactttctataggaaaaaaactcatgaaaaatagtgagcatgttaagaatattaaaccattaaggcataaaaactgacttgactttaataatatttcattgtggtaacatgaaatacaataaaattcaatgttttaagcgatatacacatctgaaagaaaaatgtttaagtaacaaagaaatcgaaatgtaattttgcaccaatcacaattaaaattaatatactctgaaattcaaattgaatggctaatcgacttaacatttagatcagttgtgacctccagttattagagttgctaatttatttatagagaaaacatactcttattcactgatttagaaagaaaatattcatttgggatggcattaatttcctcattttgcaaggaaaagaaagtgattctgagagaggttgagcaagtttctgtatttcacatggtcaactgggaaatcagaaataggactccagcctatttggatgagataagaagtattaagagctttgtaaactgtaaagtgctctaaaaatgtaggcatggtacatgctcaattagaacactatgtgttccagtacaccaccactgcattccgttagaaaaggctctttttcccatagcaggattctgccattaagattaatgtttattattatcatgcaagaaggaaaaacaaaaggcatttcttgaaccagagaaaatatattattctttatttctctaatgtgatgtctccatcatctgcctgtgaccgctgttgggagctctttatttgtcctgttgccactctgaatagtttgattgatttcttctctatctgtcttccacaaatgtatagccaagattctttaccttcatgtctaacatttaacagggaggtatttccatttttcaggggaatggaactcagtgccctgcaggatccggtcaagcatctttcaatggatcttttcctgaagaaagatcttgactaccattttgttgcatttgaatatcttagcccccaaacacactttcagcttccttgtttgcacctgagatggaggcagaactaagctaacaattttagatcatttgggtacccaggtacgtggttgtggatctgaaggaaattgtgttattgctacttttttattataaggaagatgccgtaagtgccactggattttacactaaactttttaagtcaatttcaacaggacaaatgtgcacatctgtaataatgcaatgcaatgatttccttagtgaacactcaaatgatcaaaagcacttgtgctgtaaaatatgtttccaggcaccacgcttgaggtttaagagcaaccaggatgctttagcatgacactactttcattccaatttgttttcatggttttgaaatgtgtataacaggccacaacttcatggtggactcaattcagccttagaaggttgctcacatattcacagtaactccaacagtagtggggttcttctacagactgagtttgttcaggcagtttcaaattccagccctcccactttagctcttcactatttcatgcttaagagtatttcctatttactactcctgagaaaaaaggaattatggcaattgaaggacttctcaatagacatttctatatattgccaattaaatccaacaatacttacgaagtataaacagatctgactttagattatacaatggcagagacagaccttgatgacaaagtctaagcgagttttcaacaaaaggcatccacccttcactggaaccatccacagcaccgcagccagtggtcagaaaccacggtctctccgaacttctccattcagttcctctgcagttgagcatcagcacacaacacagcgcaaaaacaactgtctatgggagaaatgtccaaaaaactggaaaccgcacacatatgggcgagatgcaaaactgttgcttagtcataacatccatgtggcctaaactgttcagtctgacctgtttccctaagtgggatgcagagttagcccagtcccaagtaagatttttcccttaaaaatttacctaacttccaacgctcttgctattttttgtctttacaccactaggtttctccattgtgggaatgtaattttccatgatctaattattaagcaggaccatccctctaatttcggcatccttttggtcccttgagccaggcagtcaccagggagaaacaaagttcttaagctctatcgagtcacagcccctttgagaatctcaaagtctgggtcctctaatcgggaaagtccacacacacacacagcctaggcatgacaggatagcacagcatggatcctagagggccatgcctggacagccagtagaggaatccatggaaatggaaagatctgaagtcaacacccccagattccaattttggctttatcctcgactaactatgaaaccttaaaaaaatcaattagaattctttgagccggtttcttcatttacaaaacggcgataataattcctgctgcagccacccctctggattctactcataaaaattattatgtatatcaaaattttgtaattatatttccccatgcttgttaaagtatgacttttcattagaaacttttgcgttatctttgattccttgttttgctttgtccactaaaatctgttagatgttccttcacggaatctctcatcagttctctgtctcactcaccttgctaaggtcctcatgtctgaatttcagtctccacttccttggggatctcctacttccaacctgtttatgtatatatgtgtgtgtgtgtgtatagttataattatagttatatatagtttatatatagttatatgtggaaatgtatatgtgtctgtattttttgtatatgtagacctacaaaatttgtatatgtgaatataatatatagtcactatttccctgacttggctatatttctatgagacagccatatttccaacaataatatgttgtttgatctaaacaatgttctctccactgtcatttgcccaactgtcaaaaagtaagctaagatagaaagtttagagtgcatatataggaagtgtttgttaatgggggtagggagcaaatgggcatcaatggttagtgaaaaggttttcattaagaaaattttatctcacccaacacaaggttattaaaacagcgatattaagagaatgttaaatcaaatagaaattgtatcctgctgcctttcactggagttcatagactactgactcgtacccagtcttcccctcctggtaccctgggaaacacaagattgcccagcttagagacaatctcagaaacattgtacaacattaaagagtaaatcatgagtgactgaaatacttaaaagcacagtatattataacatgtcgtaccagtaccagtggtcaagatgctgaattataatattccttaaaaccattatatttgtaaacataacctgttctttgatgaatgatctaagattactcacataaaatgctaaggcatggtattcaggacatgatgaagcctgcgacctgcacgtggatgtggtgctcacatggtggcttcctgtcctgcactgcgggagccccctctttacacaattattctctcctgcctcagcagcaagcactggctgaaacactgaccacattctccttgcaaaaaaaaaaaaaaaaaaaaaaaagcggttacttctagattctgtcttcctcctgacagtaaactcttaataaaaatgtacttggcttgttctttctcaaaacttcacaatgtaatttaaactataaaataatctcaagcaggtaatatcttaaaacagaaaaatacacatctgatggaaagtaaatttcaaaacttctctcttctgaactagcagagtatatcattttttagtatagaccttcatacagagcttgcctagaactacaagattaaagtaaataataagatgtatttaactaaaatttaataacattgtgtggcaattactttctcatttagctaacttaaaaactcaccgttaaaagcaggaattgtcccagagttgagggaaaaacacagagaaaggaaataatccaaaaaggtttgtactgttatctattaccacataataaattaccccaaaacttagcttcttaaaatggcagtaagcatttatcatttcacacaatttctgtgggtcaagaattatttgggagcagcttagtggagtggttctggcccagggtctctcatgagtttgctgttaagatgttggcctgggctcagccatctgaaggctgacctgggttgactcacccactttcgagacggcccactctcatggatggcaaattggtcctgggtgttggcagcaggtctcagttccttgccatatgggagctccctggggctcctctagtgtccccacctgatggcagctggctttccccagagcaagtgatccaacagagagcactgacacatgaaaacaccactgtcttttatgacctagtcccagaagtcacactttgtcccttctgcaataccacactggttacacaggtcagctctattcactgacagagggaacaacaagggcatgaaccccaagaggcaaggatgacaggagccatcttgaaggctggcgaccacagatccacacctaactccaaaccaccaaattactcggagtgtgtgtcgggtaagatggagtagagggcaaaaaaacagattctttggactgagagagatctagtttcaagaactaagtctacagatcaccaaggaagtgatcaaggatacatgatctaacctctctgaacttcagtcttctcatttttaaaatgggggtgacagtgccatggcagacccagttggggtcactgctatccatcttctctctcgcaattcccagcctgcccacggtgcggtgagcccatgtgactagaccccggacgatggactaagagggaagaggacgtgcctaagttccgggctgaggccttaagaacccatgcactcttctcctgttacttttccctgcggcaacaagcaaggagtcctcattccagggagtgtgaccgcatcgtggtgctaattcccttcccttggcctcgactgccaaggaaccacaggaggaactggcttgggaagtcccctggcatcagagtaaactttgtgtgagcgaaaaataaacctttatattactaggccactgagattcggggtctatttgttaacaaagtataatctagcctattttaattcacgtacataaaataatacttattttgataattaaatgagaaaatacatcttaacttcctacacagtacctacatgataggggttttaatatgtcagtttctgttcaccttgtctgagcttgttttctcattagcaaaaaaatcgaaataatattcaactcacagaattgctttcaaaattaaagggaatgaaatacattaaaaatcttaacagccagtaaggagttaataaatatttaagtttcttctccttctttccctggaattatgaccacggggggttcagaaggtctttttcccctcatcggaccttctcctcctctatattcaaagctccagagtccctgagaagctaacatactgagtttatttgataattcctgtgaaaatatcacattgcctacttaagacattgaatgcagctgcatgacagaaatgataatagcttaaaagatttaccaatcctgacaataatgccatgatttcatttcagaattactctaaattagtcattattttcttacatataaagaaaatgcaattccccttcttttgtaatgttgatattaaaggcccataaatgccaccttattctatcaggtcttttgtcccatgaaaggaactatgtaagatgtgtcctgacttgtgtcatctctaaatttaatagcatataaagctgaagtataatggatcctttggacctaaataaacatgaataataataattttttaaagcgaatccagccatcctgtgccaagtcattacactgtttcacaggacttgctccagagagatttcatcatgagtatattataacctctcagtcaacagattagtaaaacttgtctacttcctcactgaaaaactaatcatgtgtcttttccatgcaaaactggaatcattggcccatttacatgcccaagtcacagcctaacactagaacactggctgatgtcctttgaatgtggtttttcagccacatggaagctcctgacactttttggtgttctgtcactgtccttcattgaagggctcccagcaatgaccaatatgcccactgcagcacagaaaaagtggaacagcatgcattctgctgctctccctctcctcaacaaaagtaagacaataaattgcccagatccattctgctttcctctgtggtagccaaagatatgggggaatgagatgtgctgtgggaatacaggtgtggtgtctcaaactaattgccatgtgacagaccagctttgcctcctgtgtgctccttatgctgtgcaatcaatgtctgttcgatgctgagtcatggtgacacaggatctggctgcagacattatccaaagggatgttacaatgtcgcactttctccctaccctaaggccacctgctccttacctgttcaaggttatccattgctgccttagagtctgggtgtgtttaaagacctcacacaagacctcatcaactggtgtgcctcccttaatacacccatgtaaaactcgactcacaaatagcatttgtgaatataaaaatatacatgaacagaaaaataatgcataggaatatataatttatgttacatttaaatagtacattgtgttgtatataaggtgatacatttcttggaacaagaaagtccttacatataaagcattactgcttgttgcttctttgtctcaggttttatgattttaatgctgagcgacaaagctaaaactacgaattcaaagtccacaatttggtctgcctcagaattacccagcattgaattctttaactatcaaatagaataaatcttttttttttttgagacaaggtcttgctttgttgcctaagctggagtgcagtgttgcaaccacaactcactgcaccctcaactacccaggctcaaataatgctcctacctcagcctcctgagtagctggaatgacaggcatatgccaccatgcccagctaattttttaaattttttgtagagacagggtttcactatgttgctaaggctgctcttgaactcctggcctcaagtgatccctgccttggcctcccaaagtgctgggattacaattgtgggccaccatgcctggcatcaaagaacaattctattgacacattaaaaaatgaaaagaactatacattattatatttttattttttaaatttttagtgattatgggtacataatagatacatacatatatttatggggtacatgtgatgttttgatacaaatatttttgtttgtttgttatgagatggggtctcactatgttgccaggttggtcttgatcctcccacctcggcctcctgagtagctgggattatatgcatacaccaccacacctggccatgattatattttaaagtaaatgataacaatcacagggcagaagttatcaaagacaaaggttaattttgataaaatcattatgtgtcagacaactggattattttatttaactaagtgagataaaaaatgggtttgccaatgtgcatcctgttattcttataataccgactagatttgtcaaaataataatgaagtacagacacacaaatgcacccatcttaaacattttgtgtttcttcttaaattgaacaagaatgtattgagtactgtttgttaggagagaaaccctgcctctaatgaccttaaggccttaaggaaataacacacatagttcacatacatgaactatccctattttttatcctcataccttcttccgcataccaaaaaaaaaaaaaaccaacagaaaaattgttcaaatcctaataattctaacttagaaatgtcttgcattcaagatctctccacttctagtgcaactacactattcctattgtcctcatgtatcccatgaactattgcaataatttctggccacgtgttatttcatattccaggtatattcctgaaacaaacaattaggtcttaccgacttaaggcctcagtcttatttaaaaccctgttgactatacaataaaaacaaaatttataacctgatacaaaatgttcttcatgggctcctcttgcctgtctttaaatcgaatcaccaactctgtacattctaccctgtttccaggatgcccctccccatgccatcttctcactggttccaagtcacaacaggttatttcacaggatggggtgctgggtttgagggtttttttattcttttttactcattatctctctctctcctctgcctaaaatagccttattcccttcttagccagcaaacttctattcatcctagaaaatccagtctaaatgtcccttctccagtgaaacctccatcagactactttttctggatctcagaagcaattcatttcattgttatagctcttgtcacgttgcattataatgtcaatattgtatctgtttccagagctgtatgatgagctccacatggacagagatttgctcttatttttatacccttagcactaagcacaattcttggcacatagaagatcgatgtgccaagaatattaaataagatgcttacttaatatgaataaatgaataacaaagtaaatgctttacaagtttacagaaaggagaattcagtgtgttatggagtaattaggaattgctacactaacatatatgtaaaatatatgtaaataaaatgtacataacaagctttaaacaaagaataatcaaacttcaaccctgtttaatttcagactttctttaaaaaggatatacttatactatcacacattctctttaatatgccttaagtatgtagttggaagatgcttaggttcaagattccctgaagttcttgggatcagataagtaggaagatgttcttctatctggatcatcgtctacttttctttattgatattaatttgtaacaatcatatttgtagtattttaaccaatgaatccattttaatgctataatttagtcttttcacttactaagaagtatttctctctacttcattcaaaaatagtaatgtattagtctaggataaaacctgcccaacatctaaccccaaaattcctacatagcacgtaggtaggggttgtcagatttagaaaaaataagaaacctacaggatgctcagttaaattttaatttcaggtaaataatgaataaatataaaagtcccttgcaacatctgaggcctatttatactaacagaaatctagttattcatccgaaattcaaatttaaatggctgtcctttatctggcaactctacaaagcagcagacgagaagactagcgatgaagacatgccaggaaagtcttggttgacgtatgccactagaaaggctagctttcctggttccccagagaaaatctaagggcgtcaaccatcccctatcctctatattcttaaagagacccatgtttacccatgtgctgtggcattaggacttccaacaggaaactcattttggtaaaggaacaatctaagatcatgtctcagaatagttttttttttataaaggagcatacagatgatgttctctacagaactagtctcaggactttttcctaccactgtcaggaaaaacaagaaaatgtatcgtcattgtagtctgcccagcaatgctggtattccaatgtatcacaaaatttaagtccacgagccctttctacaacgcaggggctactgtgaagctttatatgcattactactataaatcttcataacattcctacaagatatatggcattctttctactgtaaaaatagggaaactaaggctgaaaataataatttacccaaggctacaccatgagtaggaagggaggtgaaactcaaacacagctcttaagaccttagaactacttaaatatttatcagtgatgttatatattgacttttcgtacccaggtcctactaaagaaccaaaaatgtaaaggtactcaaaagagctgtcatacaggtggatggtctcaggacagataagttcctaagcaagaatacaggcttgcgtgtttgtgtgtgtggtcacatggcgcttcctctgaaaattcttctctaaaatcaaagagctttacaaaatccaagccttcactattccactcaattttttcagtatatttgaaattttctacatggtaaattaccttcctgtgaagctagcacatttctgaaagtgcctaacttttaactataaacactgtaaggtaaatatgtaaggtacatgtaaaaacaagtctgctcatcccttctctgtttccccaggttgcagaaaatgaaatgaccataataactccaagacagagcagaaggttcatctgagtcataccaaataacttcattgctgctaaagtaaaatttgaaaatgattgaagtgatttttatgatcagccttttggaagtcattcaaaagtgctgcaatgctacttcaaagaagataattcaaatttaaatgtcactcttcagtgttgtttatcaacagctgagtattaaaattggtgagcttgatttgtgttatttcacttcaccagcttataatttaaacactcttatacttattatttgaataaatggaataaacacaagtcaaactttggtagtgaggtgctcatcttcagaggagttcaattagattggaaaaacattttgtagagatcttgtagaacaacagctctctaccttgaatgcacactggaatcacctatggggttctaaaaaaatatcaatgcttaggtctcacccctggaaattctcatataattgggctgaggtgggacctgagcactgagatttttaaaacttgccaactcattctaatatacagcaaaagttgagaacaactgctacagaaggaactcaagcattggatggaaagctggaataatgacatttcaggatcctttcaactctgaaagtctatgtctaattgtacatgtgaccctactatgacatcgtactaaagcagacctgaaatgtctttggatatacaaattaggaatacatcgttacagtcattctttctagatgtagtttcaaagtacaaagaagatgctgctattatttacacttctctttcaagttctgattatctattgaagagaccttaaaataaacaatttaatcaattcaattattaaaaatatactgagcatctactgtcagcaaaacacagtacccacaaaaatgtgggtactgaacatttattaatgagtaagccagagtcagatttttttggaacttacaattcaatgggcacaaatggttgtactacaaaagtaaggggagtatgtttgcagtctaagtgcatgatggttcatttaagtgattatgttcagctgtgaagtagaaaggctggcagaagtattctttttatcactgcaaaagtccataccttattcactttattgaagaataataaatgtaaaagtaaattttaaagtttcaggtgatatttcacatattttttaatacatatcttacatattttatatatatatatatatatatatatatatatatatatatatatatatatatatgtcagtaagcagacgtgtcagattctttagccttactaaacattcaccaaaaggaattacgttatacaaaaccaaatcaatttcttctggtggtttttcaattaagggctaaagtaaatttttaagtgattcaagagatataggtagtttatgcaattttaactaaatttccagtaacctgaaacaatttcattaaaatacaggcttgctagtgaattatgctgattctgcaagataaagaatatgtgagatgtgagagaattttgattaataaatacacatttgctaaattctgctttggttgactaaactttttgtttgtttgaactaaacaaaacagagttcaaaaaggcagagtaatgtaacacaactagttaaagggagactttagaaaaatgagccataacatctggccaatcatttcagctcactgtacccaaatggaactggaaacacacagtgataggaaaggtcactcatgctggtaaaaagtaatacctctgctgccacagttacaccccacaaatgaaatctacatccatattgtcttaatcttcactactaggcaggatcgatccaggggcaggtgctcagctagagccaagattaagtattttgtgctcctgtatcctgatttctagcacagtgtacaagacacagcggtgatcaaatcagccagtatatagtgtaatacaaataataaaatgttttaactgaaagcataagactttgtagtaaattaatgactggaaatcaactctttgactcaatttatcgttatttaataacgttgtagaagactaggcaaggctttacaaataaaaaatttaaaatcatacatataaaacccaccttctgagtgaaataaaataaatactcgaaattcaataaataagactgcttatatgggaggctacaattttaaatataaactttagttcctattttaggttatatcttccaaattccagtaaggaaaaatattcatgagagtttcttttcatgcaagaaaaaacaattctagtctcaagagaacccaaacccaaatcagcaattaaagtatcaataaaagctatctgccttgtttgtttttccaatcttgttccttaaaaagatcaacaacaaatttaaaactgcacatgtaaaatcaaaaatcgtaaccaaaagaataggatgtactaatatatattttctttgaatgtatcttcttgaattcaaacctaattgaaatgaaaaaactgttaattttgaagctgtagtatctagagtacatctccacattgacatcgaaattttaaggaataaatctgctggttctactgtcaataaaaatgcgtggctgggcctattatttcattaactattggaatctgtaagcacccttgatatggtttggctgtgtccctacccaaatttcaccttgaattgtaataatccgcatgtgtcaagggcagaaccaggtggacataattgaatctgggggcagttttccccatactgttctcatggtagtgaataagtctcacgagatctgacggtttatacatggcagtttccctacacaagctctcttgcctgtcaccatgtaagatgtgactttgctccacattcacctctgccatgattatgaggcctccccagccatgtggaactgtgagtcaattaaacctctttcctttataaattacccagtctcagatatgtctttattagcagtataagaacagactaatacaaccctgttctgtgctcttttccttccactgtctgcctctcctccatgccctcattcattcccaggttttcaattagcagtcagacactgatgatgtcatcatggcttttatagcccaggcctcctttgtgagtagtatacacaatggtctggtctacagctctctaaaagacatttcctttcacccattgcctctcctggaaaaagaaaaccctcgctataattctgtaacattctaaataataaaatatccaaggaagtatgaagtaactttaaatgaagtttaattgctgctgggatattaaatattcaataggaaatcaattatttaattagttgattgacattttgaatcaggtcatcttcacttgcaagtttctctaaaccatattctctgagcacattggaattccatgttttccaatgatattcccaagaaagggagaagtttgttgtttgctgtcactggcacaagcccatgggcaccaagtgtgaggaacagccccagtgacctgaagcctgcagtgagaaatgcgcttattgggcccaacttctctaccacccaagacaggatgcttattgacggagcagagagtttcctacaaggtccttgaaaaaggcaaattcaagctagtcttcaaatatctaggtcaccttttttttttttcctaagaaaaagaagtgaatgacagagcacaaagtagtcaggtaggaataaaggaaaggctacaatttgcatgaatataaaaaattgacaggacaggctatttatagtgttcaggtgtgagcagaatcaccaatagcaaagctaaggcttaaatacttagtttgctttaatatgtgctttgttcatttataactagagtaaaaagcatcagagaatgggaatgaccataaaattcacctcaaagtttttgagatatttatttttaggtgtaaataattagggaagagaatagtaaaaatgaagtgaaatacatacattataaaagtctagaaaatattttaaaatatccattttggcatatacacatgactaatattagagtacatacaagaaaagcaggtatcttaatattctagcacagataaagggccaggcgcagtggctcacgcctgtaatcccagcactttgggaggttgaggcaggcagatcacctgaggttgggaattcaagaccagcctgaccaacatggagaaaccccatctctactaaaaatacaaaattagctgggtgtggtggcacatgtctataatcccagctactcaggaggctgaggcaggagaatcacttgaacccaggaggcagaggttgcagtgagctgaaatcgtgccattgcattccagcctgggcaacaagggcaaaactctgtctcaacaacaacaaaaaaattctagcacagataacttgacaattttctttacaattcaagaacaatataagacttcagaactgtctgtctatagccagtctcactgtaggcaaaacacaaactgttctaggcttctttaggtcctaaaggcttgcaaatcaagaactcgttaggcctacaaggtacaaaagaagactcagtgacagaacaaggctcttactaggcctctaatatgtctaccttcaagcttaacttggatacttttaaaaagcacaaggatttttagggcagtgaagatactctgcatgatactataatggtgaatacattatatatttgtctaaacccatggagcacacaacaccaggagtgaaccctaatgtaaactatgaactctgagtgatgatgtgtcagtgtagactcatcaggtgtaacaaatgcaccactccggtgtggtatattggtaatggagaggtgatggatctgtgggggcaaagggtataagggaaatctctatgtcttcctttcagtttcactgtaaaccaaaaactgctccaaaaatataaagtctttaaaaattaaaaacttcattgatttataagccctatgctactagctataggtaaaagctttaaaatactatacaaataaaaatattaatttcagcatagatcatttaccagagaacgaaggaaagaaactaacattgtttctgacaaggaaatggacaggcaagaataaataaatatctacattctaggttttacattaagtatgttatatatatctatatctatctatctatctatctatctatctatctatctatatatatatatatcttctcttttaatcactacatatttaaaggcggtattctccctctactaccaaaaacaaaacaaaaaaacaaaaagaatcctgaggcacagagaaattacagctagaattttcatctttaactccaaagttcatatagtgctgtctttatcaataaaaaaaagcaacaaaaatgatttttaaaacagacgactatctaacaataattgcaaagtaagacaatgaaaacacagaggcatttagtggcctttacacagggttacataaaactggcccatcgatatcaacaggattgggcacactttgaccagtacaagccaaaagaaggtacgatcatctgtctaggagttgtaccaaaagctctgtccagcctatgaaggaggacataaaagattgagctttttcattcattctggaggacactgtctattaaagggaaatacccaggcaaatcgaaattccaatttttaaacactgtattatttaacattataataacatcatcaaaaatctctataaagtggttatttgtactgaaagagctctactttcaagtttgggctagagatatctaaattaaaggcattagaaacataccactattattttcaaggaaatcaatattactctaactacattcattcagcaaacccacaaggcatcaagcagtatgtcttgacactaaaagtaaagaaacagcaaaggtacatatgttttattctctacatttgatttacctgtacacttaggtaacatagatatacacatacacacacacacacacatatttatatatatgtgtatgtatatatatatatacctttatatatgggtgtgtgtatatatatttttaaactttcagtttaaagtatatatatatatacatacacacaaacacacatatacacatccaatatgcaaagagagaaagagagatagttcagtggtcaaacatttactatgtttctgaatgtaacacgtgcatatagattaaggcaaaagaacacctacatcctaacaggttcatgttaacaagtctacctcttctaaaaggccaactttgtttacttatctaacgagtaaacaagttagaaaggtaaagcaactcatctcacataattgtacttttctctggcaatgtaactgaaaagaaaatattttttgctatcataaaacaaaaggtttatcttttaagagaaaaactgccatattccttaagaaaataaaccaagagcctccaaagttttcactggaaagccagctaggtctctgaaagccttattcaagcctccagagactcatcttcccctttagatagctcactaatgatggcttcaaaagagagaatagtgagtgaggctctgagtttaatactctctgaatttaacactctggtttaagcaaaggtaaatgtcccttttcttaatttctcagagcacagccaaggcaaggctgaaatcttaaatgcaagataaccaaatatttagatataatacaaaggaagtaaacatagaatgtcatggaactgacattccatggaactgacattacatggaatgtcatgaaactgacattccatggaactgacatacatggaactgacattccaagtaaacagaatgtcatggaacaggcatatagtttacctgttttcagtttaaagttcagcacgagtgcctccctattcagctctaacctgccccaaatgcccaattatatctagcaacttaaatatccaaacccaagaaatgtatgaaacagagcatgaagtcccttttgctatctagttaactcccagtttcagggttcaagttcatggctgcaactttcctcagatgattgaccctgagaatgtctagctacttcaggagaggctctacctacttatgatgacagggctttaatctactcaatcgggtattttcctaacaaagcacagagagctgcagcaggagaggctggtctgttacaactttagattacattcaaatcaaggaatgtttacgttttgcaagagacatttaataaagaaaccaggataaatttaaatacaagaagtgtaatttacatctcacagtgaatcctgactttcattacatttaactttaaaactaagtagacaaattaaaagtaaatatagcaccatattgtcagtgtattaatgaaatgcctatgctttgaaaaataaacacagataaagagtcagaaccatttttaatcaaagataaatatagctgctcctcaacttataatggggttatgtcccaataaacctattgtaaactgaaaatactgtaagtcaaaaatccatttaatacacctaacctactaatcatctttaccttagcccagtctaccttaaacatgttcagaacacatattagcctacagttgggcaaaatcatctaacacaaagcctattttataatgaagtgttgaataccttatgcaatttattgaatattgtacttaaagtaaaaaacaggatggttgtatgggcagtctgaatgcatattgctttcataccactgtaaagttgagtaatagtaagtcaaaccattctaagtcagcaaccatctgtacataaaaattgctcactccattatctacaaatagtctagtgtttgctgtggtctaaatgtctgcgttcccccaaaattaatatgttgaaacctaatcttcaatgcaattaatattaagaggtggagcctctaggaaatgattaggtcatgagggctctcccctcaggaatgggattggtgcctttgtaagagaggctcacggaagattgttcttcccttctgccatgtgaggatgcaggaagtaggcaccatctttgaagcagagagcaagccctcaccagacactgaatttgctggtgcattgatcttggacttttcagcctccagaaacatgagaaattaataaatacccagtctaaggaattttgttatagcagccggaatgggctaaaacatgttctagtttcaagaggatattaatttcttgaaagtgcttatatgtttcacaagagtattaattttttaaaagttctaagtaaagctatagtaaaagtaggcatgcattgttagaaaaaatgtttacagtatccctattatcatttcatgtaatatacaataatttatttctttgaaacaccaggacatttttagagtgttctttggtaaaacaaattaagaatggtaaaaaggtattttggttatatgtcaattcaaaatgagatttacatgtcccatgagattatcaacaaatgttccttgaaaaattagatgtctacaggcacaagaatgaagttggacccctacctcacagcatctactaaattaagtcaaaacagatcacagacctatataagggctaaaactctctaagaaaaacttaggacaaaatctttatgatcttgggttaggagatcatttcttaggtatgataccaactatgtaagtgacaaagaataaacacataaactagacttcaacgaaattaagaactttgtgctttagaggacaccattaagaaagtgaaaagaaaatccacagaatgggataaaatacttctaaatcatatacctgataagaaacttgtatctagaatacaaaaagagctcttacaactcaaaaatagaaagacaaccctattaaaaatgggcaaataatttgagtagacatttctccaaagatatacaattggtcagtaagcaactaaaagatgctcaacatcattagtcattagagaaatgcaaatcaaatacacaatgacatacttcacagccaccaaaattactactatcaaaaaaacagatcataacaagtgttgacaaagatatggagaaattagaaccctcatacattgctagagtgaatgtaaaatgtgcagctgttttgataaacatttggtagtcactcaaaatgttaaacatagattatcatcttacctagtaattccattgctagttacatacccaaaagaattgaaacatatgtccatgtaaaaatgtatacataaatgttcatagctgcattatttatagtagtaaaataatgaaaacaacccaaatgtccatcaactgaagaatgaattttaaaaaggggtatatccacacagtggaatactatacaataatgaaacaaaatgaaatatagattcatgcttgaatcttgaaaacattactctaaataaaagaagccagatattgaatgattccattcttatgaaatatctagaataagcaaattcataagacatagaaagcatatcagtggttgccaggggatagggaatggggaaatagagagttactgctaataggtatgggatttcttttttaagttgatgaaaatattctagaattggatagtggtaatggttgcacaactatgtgaatatactaaaaactattgaattgtatactttaaaagggtaaattttatggtatatgaattatatttcaataaagctgttacaaaagtgagatttataactcaatctgggcttaagaaatgcaattacaactagaattgtgatcaattataccaattattttagatttcttacataaaaatatgttataaaaataattgttatatcaattattttagatttcttaaataacaaaaaagttctttgaagttgtgttagtattcattagacaaatatgtttatttgtggtgaagtaagcatatttaaaagaaaaaatgcacaaaggccctaaaagcattgtcaatcagctttgttggacaataaaccaatttccagtcataacctactttgtagaagtaatagctattactattttcaacatattactatcttttcaacttaaaaatgtacccaacttatcaaatgctatctaaggacagccatgtactcttcattctgtttggaaatattccagtccaaatctattcctaatctggtccaatgagtagaatctcctgtcatgactggcagtgacaaggagagaaagggaatgggagaaaaaaggggaatgaggatagatccgtttattcctccacctctatcaatcactgctttagctccaggattgaccatccccagcaattcttcatttttatccaactttccagtgccctctaatccccttgggaagattaagaccctgtctgattcatgtatcacccatggggccaagcgcactctccttcatgtagaaggaattcaggaagggttgggtgtgaaatcaactatctgaaatggggtatcacacattaaaaatgttacaaaaaattttaatatcttttttaaaaggagaccaactctcatatgttaaaatgtaatatcagttctcagtcatggtgttccaattactcacatgccatgatcagacgcaagatgttattcaagtaacttgttaataataaaaaagttccagtgtttttcaatgtttgttttttctataatcaaaatgtattcaaaactatttttctagtagcatttctgttacatgatttataatttttttttgagatgtagcaaaaaagggaagttaaaacttgtgggtaggaaaaaatatttataaaattgcattagacatgagaatattatctatcatgtgtggcaaattaaaaaatggctgcaaatctgtctcttgtattacacgacaaagaactactagaggtatatttgggaggtacaaaggataaatattcttgataaggtaaaactctcagatttcacatatcattatgtctactggaaggcaaatcaactcaaattcctacccctcatttatgtatacttgtcattcttggtactcaccacactctctcatgcccctaaaaatatttaaggtttactgttttctctttcttgaacaattaccttgtgcctttcctacccgactaatcctcaatcattctttgtgagtcagtcagaattttatgccctgcaggaagcctgccatgccctcctcttgagccctatagcatcagagccacaaaaatgaaagattactctatgatattactgtaccctacaatactaatcagaaaaaaaactgttaaatgttacccttacagatacatgccacagtctacatattttatttactgttttattaaaccatcgcttctgatcaacttggagatcagctctcaaagtcatcacaagttgattaatttttaaggaagtcttggaatcaaaacctttgaatctcctccctgcttacaaagtatctaaaggaaaactaaaaacaaacaaacaaaataaacaaaaaataatgcaggacagcacctacaccagagattttcaccttttgttcttttacataaaagattaataaggagatatgaaagagtcatagcagtccttaggagactataaggtaaaagtattggcaactattgtcaagtatgtctaaccacatacaatagaaatcaatgatatacgatatgttaaaactcctgcaatgaccatatggagacagcagccaacagaattattcagaacatttttcgtttcctccctgtgaagttttgaatagcctaaagacttactgactacatattttttcttttgcatcttattttctgcctttcttctaatacctgctagtatacagaaaaatcatggtatcagacaaccctgaacctatagaagaacctataatgtaacttaaatataccacacatttggagattccaacacttacttctaagttatctatgtggcttacttacttatgagaagaagtgagtaatagctggttatactgtaccaatgaataaataccaataaccaagatgcctgactagtaaacctgatacaggaaacagacatacttaaaaatgtcttgttcttcaattacatcctattctgtagatctcagcatctaaattttaatttaaaataatctcaacaaaagctacttgaaagccatgaaatgaactgatgtggatatgaaatatcattttttattttcaaaatcacaaatttaaaacacaaaaagttatttttgtactgaacccacttctaagctatttatttctgtcttcaaattactattaatatcaatcctttctgagtagctctcttgggtgaaagattctaatggccaacagatggggtaagtgcacaaacacttaaaattttgtcccaagctaaatgtctggcatacatacacacccataaatacattcaacttgctttgtatttgcctttcaaattgggaaaactcaaacaaaaatttaacctgtgaagtactgtgttaaagcagtatttcactatttagcagcttaaaatacagcaattttgccataatgtaatatagcgtttaggaaataaatatgatgtgttttacccgaacgtcacttttacacaatttttgaagttccttgaacttacactggcatatttattaacagtactaactcttattattttccttaattttcttgtaattctaaaggggagggagataagaatagctcccaacaaaatatacagtaatttttttttttttttttttgaaacggagtcttgctgtctcccaggctggagtgcagtggagcaatctcagctcacggcaacctctgcctcctgggtccaagtgattctcctgcctcagcttcccaagtggctgggattataggcatgtgccaccaagccaggctaagttttatatctttagtagagatggggtttgccatgtctgccaggctggtctcgaacccctgacctcaagtgatctgcccgcctcagcctcccaaagtgctgggattacaggtgtcagccatcgcgcctggcccctacaaaaatatttaaaagtatttctaccaattataaatttgaaaggatacataaaaaatggtcaaagatttgtcttacattaaaactgtaacactaaaaggaaaaagcatagtcaggcaaaaactgttatcaagatacgctgacataatgcctccttctgctttcaataacaaaagcgagagtaaagttgtaagacacagagtgaactgaatgaccctgacttcctttcctcaggctctcacaaatacaagttagttggcaccagagaggctgggtaggaaactgtgcacatttccatatgacacagatttgttcgtgactccgaagtggcacctctacatggaaagggtgtacattttactttttcattcaaagttatgttcatacaaaattcaaaccgtttatttaatgctgcaggatttagtactgtgcagctgtctattgcattcgcactcatttgcgaaaagtttgattaaatcactactcactcacccactaaaatgacagaattcaggtttgtgctgccaatttgctcccaccacagtatgtctactactgctatcaccacctaaaatggacccttccccttcttgtatgaatcatgcttgtggccctataaataccagtcttataaaccacgatttccaataaggatcctagttttaaatcaaagaaattgcaactgctgagaataaggcattattagttacatttttataaaatttgaatagccattgagaatttagttgctctcattttcacaaaagttaccttccttaaaatatcactttataaattttgtgtcattcttaagcattcaaacatccaggagccagatactgaccccttgaaacacaattcaaattttataacagaaaagagtaaggaaagcaaaaattatttctaaaagttgtgcttttagccaactgttccttaatgtgtatctcctctaagcaatgatcataaaggttactaaaacatatgatcaacactagagccacagcagcatgctggaattcttacagaaaaaataatggtccaaactggttaaaaaaaaaaagtccttatatccaaatagcctatgacattttcagtccttcttagttgcagggctttactagaaaacatcatcatttatttttatatttttaaacttttcttttaggttcaggggtgcatgtgcaggtttgttatgtaggtaaatagtgtatcacaggggtttggtgtacagattattttctcatccaagtaataagcatagtacccactaggcagttttttttttgtttggttttttgagagtttttgggtttttttgagatggactctcgctctgtcgccaggctggagtgcagtggcacaatctcggctcactgcaacctctgcctcccaggttcaagcgattctcctgcctcagcctcctgtagctgggactacaggcgcatactaccacgcccggctaatttttgtatttttagtaaagacggggtttcaccacgttggccaggatggtctcgatctcttgacctcatgatccacacgcctcagcctctcaaagtgctgggattacaggcacgagccaccgtgcccaggccataggtagttttttgatcctcaactcctcatcctcctctctttctccactctcaagtagtccctggggtctgttgttcccttctttgtgtccatgtgtactcaatgtagaaaacatcattttgcagggaaataaaatgctgctaagaagagtatgtcaatactacaaagttgttcagtgtatcttgaagaaagtagtcaaagccattctccccttatttagaaagccagtaacgtcatcagggctagcaaagtgactccaaattgcataagaaaattaaaactacaaagtaggctcaaattgtatagaaagatgtataatgtatgctcagacaactatcaactacatgtaacaacaacataaatgtacctgctaactagatttcctatctcacattctcaacaaaccatctatgacttccaaaagtcgatggaggccactttcccatgaggcaccacagtccacagttgactcccatgtctctcatttacaccttctgtttcacgcatccttccaggttccaagaaagcaatgcccttcctggcccacaatttctcaacgtatgccttcgattcatcccttcctaattactgagcaatttctctcctgctcatattacatacccagaaccatcccttcatccaagctcctgtttcccatttcgaactaacagaaggacattttcattttattgctttcttagtacaaaaatccctccttcctcctagtactgcccctccccacaatcagttatacaacccaattataattgagccattctcaatcatgtcgtttctctttttggaaaagttctctagttcactaattttcaccacatcccagctaattcctctacaaggcttttggaccccaaaatatgatttcactaagccgctaaaatatgattccattaacttcccataactcccaatcatgtacctttcactctatccataaataatcccagcctttgactttcattcacattactcctcttgccaagaatatgcttatctctcctaccaatagaaacacacattcaagagtcaacttaggtcatgcttctctaaaagatttccccttcttccccttcttcccctttcatcctcgatgagttttctagcagaattctttctcatatctagtattctccatacatttagttttattacttgtgggtcaaagaccaaacctttatagaatgttttaaatctcccccagtaactaacatgtaatgttaacatatcacatattagttacttaataaatgcagataagtttatcatataggatgtatactaccttctcaaaacttcatgatcgattttaagataatttccaaataacagttatttttctaaagagtaaatacatcaacagagcagtaagcatggcagtgccaagagaaatagaaaaggaagaaagagttaccttgcagaaatagatttaaatgagaattttctcatggcattactgcacatcttctaacagcttttgtaccagactgtccttgcaaaaatatttgcataacaaaccaccttgtcatctagagatggtgcctccctccaggttagaggacagatttgtttcctgaccaggataataaagataacacctccctgcagagaaagattaggcagctttgctagaagccccttaaaagattgggaatttcctgatatggctgcattacagaccactgagcaatgacacaaatccgctgtgagcaagcatccacctgagacactcagcattgcccctgaaaggattttgggacatacagggaactgacaaccacatgaagctcatgctgtcttctatgctctgagtgataaaatcccctgtctctgacccaggagtcccctgtcttctgccagcatcatgtaactgcagcagactagcaagctgggtaaactgtgagacccttggtagttcctgaaatttttagatgttaggagtttccggtttaaaaaataaaacagaagctaccatgttgaattctccacgtctaacatgcaatgtcatatcccggaaacaatatgttgagtgaaaaaggcaaactcaaaagtgtgaagacttcatgatttaatgatatgaagttctactataggtcaaactaaggggagagaaatcagaatggcggttgcttctcagagtggggatgggtaggaacagaatggaaataagaaaaattttgggggcgggtgataggaatattccatatcttaactagggtagtggttacaatgatgcacacaactgttagaatacatcaagctataaagttaagactgtgcattttaatgtatataaattatatctcactaagaaagcattaaaaattctagatagctaaacagtgaatatatcacagtcccttttagtttcaggacagaataattcacaaaaacattaggagaaatactgatcactttcacaagcattctgttcaacatcctttctagagcggtagctgcaatttagggatttaagagtatgtattctggagtcagattacttggttttggttttatactcagatctttcagttactagctaggtactctccagtaacttccttaatcttttcatgcttgggcttcataatttttaacagaagtataaaagattttcctgtgattttaaagatgaaattagatagtataggtagagtgcctagtatatagaagcattctctaaagattagttgttatcaactaataataacacaggattcaaaataattcagaacatttctgttaaagcaaaagagtaatataattttaaaaatctagtaagtgtaatatacattcgttaacgggaaaactaggtgagagatttaccatgccctaaaagtcatttaattatataatcaaataatgcagtagatccacatcaccgttcttttacatgttaatttgaagtacagaaagaaaaaacttaagccgaataaatatcattttgggtaaatgtttcaagttcagacagatgtttctcatttactctcagacaactattttattattttgggtctattttcctaatgtaatgaatgtaaaagaggtaaatccaattgaatactaatcctgatcttgcctgaagagtaagttgatgacaaaatttttgaaaaacatgactaaaaaatatgtaaaaggacaaaatctagaatcggatagtacaaatacagggagaaggagacaaagggatgaaatatcagtactggaaaagcactttgctacaacaaagggcaagcggtctgacaaagctgggcggactttatggctgcatatcagaccacatactaactatagcattcatgtcacagttagtatcccccatacagagtcacatctgccacacatgtaccagaatggcctcagtactgtgttgtttaaaattattcccaacattttaaaagaaaactagaaaagagataataataagcaataatgatgtaaaatttttatcctatatcaaatttcttaactgcatcattaaaatatctctaacatttggtactgatctcattaaaagtatttccaatatttaacagtcattattatttgtctgagatgtgaggtattttatgttacttgtcatgtgagttgaaaaaatttttaaaggtacaagaaaaaataatcaagttaatggaaaacatcacttctcaggaaacaaatcaactcatttagcaatgaaggaggaaagagcatattgtgttactgctttcaatttgtcccaacaataaaatgctaaggccaaatgatggttactactgagtgcttacgtagaaaactgactcagttctcctagcagacagggtcctttctttgcttaaaagttacaacacctggtatacagcagcaatacaactaaagaagatgagtttcagactacaaataagtggctgttgaaacaaaaaggactacaattatgagatatgatttctcttttagtctttaagccttcttatgttcatatttcttaaagtacaatattataccatgtgctccacacaggaagtggaaagaacagatattacaatccctcccaagctacacctttaagatgcagcattacagataaggttaccacacacttcagtgatccactataattgtgcagacaacaaaatgctacaggaggaaaaaaaggcattttaactacattcattcctatctaaaaaagcacgtgtgcaaacttacatatgtaaattcaataaagttcatacttccttctcttttcttgccagacctgaatagtaaatctgaaaacttggcttttaattgcactacttgactcctcaaactgaacaaagtattgtgtccataaaaacatctgctattgacaaagaattgtacataatcgtttaaaaaaatcattttggcatatctttattgtaaagcattttttcccagtcctaaggattttcgggtttgaaatcaagatgaactttttatcccacagcaactctcccagaactgtccatttaaattttaatctagaaagagaagcttgtctaagtctcctacttgctgttaaaagctacctcggcccctcaatataaacagtcagaagacagccaaccatgtctcaagaagatggaagtgttctgttggcaaatggccagaagactagctcaccagaactgtccaaatcaaaaacctgtaatcagaaaattccagactcctccttcaacttccttcccaaattcaaactggccactaagatggatggacttcacttcctctctagtgcctgtcactgccttattctggaccgctcaccactgctcactgctcttcctccctggtctttccaccttcaaccttgcccaacccagagctgttttccacgctgtagtcataatggttgtctaaagggtagatatgatcatgacacagaagagagctcacgatctgtgcctcactaccttgcaaccccactcactacctgccactccctagaaacaccctctatttctcagttgtacttgatattctcggtctgcaccacaatctttgacgcccccaaagcttaaagtatgcttctttctcttccttgacagcctaaccagtgcctttaccacgtggctaactcttagtcattcttcatgactcagtctgagttttattccctccagaaacctttccatgcccctcttccttggccctatagcaccttggtccacctacacagaattgttcaccacatcataattgatcctgtcttttgtctttcctgctaattccttgaaggaagaactcttcttcacccctgtatctccagcatcaacagttcaaacacagcagcactttttaagtgtttactaagttttgttttttgtttttttgagattgtagttactgaaaaagtgataaaaagcacgtggacctaaaagaaataattcataaatttcagagttgtaataaactctgaaaataatctttttcaacttcttaatttacaaatgaggtttataaaaaagatttaagaaagatttttcccaatagcatggatatgagagaaggaaaaataaactagtgaagataccctcccctaccccgaaaatcttaaaactgtctaaggaaaaggtatctggggaatataatggataaatggaatgccatctatttcagcaccaaccacacaattctatgaagcgcatgaggagctcttcctagtgtcaccagtaaaatacgcgtttcttcacccaaggctcaaagcttctacctgtgtttgtgcctacaattccaaaactggctcttggaacagtcgcttcctccactgggaaggagttgccacacctgtaaaaggaacaggttgtttgtgatcgctaaggtcaacctcttatctctgatggtctctgaatttagagtacaatttaaatatatagttaacatagtccgggagagatacagggaaggggtgagggaagtttacttacaatcaggactgggtgtgaacgttatgggaacctagaatattagagctggggctgatctgggattactctaatcaatatccttcttgtagtagccgaggggactgaagcccagaaaacttcaggacccgcccagggtctcccagtagctagtgtgtaagctgagaccagaacttggctcgttctctcccagtcctgagcttgggcagaatcaccagcaacgccagctcccttccctttccttcagatgggtctcgggtccagagctggcgcccgctagcgggaggccagaccgggagggccaaggcagccacctgtggctttcccatccctcaggtccagcagtgcacatggggtgcccccgcgtcaacgccggaggagtgaccttgcaaacccgcgccccgcgggcggcagagccggccgctcactgcccggtccccggccaccacggaagagcgaagatctctgccagggcaggagccctagccccgacccgcgccccaagtctctcccgcgcggcggcttccggccgccatggtttccatagcaacaacagcacaagctgccgggtcccagagacgccctagggtcagaggtcatctccgtggcaacggaaacttcccgcgctacggcggctccaacgggccgcttccgccgcattgcgtagcgaagcccccggcgagccgaggctgggagcgcggtgatggccggtccccgtgagcagagggcagcggcggcgggaccggggactctgggccaatgggtaaagccaggaggaagcccgtgcctggcccgttgggctccctcctcctcagagccgaagcagtccacactcggaacccagcttcacccggattaccgaggggttccacgcctggaggcagagctgcagcgtgggcccgctcgcggctttgcagaaaacaaataatgacacacttctctggaagcccggggcctgggcccagagccgtggcttctgccaaactttctggtcccggacaccaactccccgcctctcagcccgaggccacagcggcccagcaccctgcaccttttaaagtggctccaaaaaggagaaagccaaatagatcagggtggtaggcgcgagtgcagggagctgcgaagttggaagattactgcttttcaaactgccaaagagcaaaatactaagcgagaaactccgtccaaagcaactggaactcgaggttctttactaatgagagttccagttaccatcttcagagaaaggagctcaaaagagggagtttattttttgcggaatgtcttccttgttaagaagaaaattaaagattaaaaaagaaaatgaagggtctggcaactatgaacctaatggtgccctaacgtttgctattctaaggccgagaatgccagatggggagaacgccatgagcttttgagcttgtgtattttgcgagaggctcgagtgtgaacagtagactacaggccttgagactgagaaggaagctataaaatgtgggccaagggaatgtctgcaggaccgggtttcagagcaccctatcgtggcggataaagagccactaacagcttttttctttatttagtagccaaattcttggttggcgctttgagaaaggagtaagcattaagcgaatttaaccaagtaaaatgtatcgtcctgccctttgtagtcccatagttcactatcctagagatacctatttttcactattttattaaagtgtattgaaaacctaccatgtgtcgtgaacagagtttttgtcaagagacagtgacaaaggcagtggtgcccagcagttgttgggtgactttcttacatgatgttaccagactaatcaaacaagaacttcactgttccctataaaacatgtctgcgacattcatcctttttgccttcaagtttaggaagtccctaagaatccctccttttgttcccttctcttcatcatcctaccttttacattctgaccaaagtaaaaaaaatagtggcagctagagaactacacagggaaaacatcaggacatagttggtcttgatacaaaagagctattgcatctctagaggtatacggggagctgagaagtctccctcagaaaactccatgcccttcagtacccgggttcaacacataactaaaccttgtacctggtacacaagtcctaaggaacaccacacagactatggcagtgagcaggcagatgtgtaaataggtgtttccctgtccctatttacaggaggtaaatagtattacctccacagtccctcctggaggtaatactgagttgggctcaaaggttttattaaaaataggcacagtgcaatgacttgtttaacactgaagagaagagctcctgttagactgttcaaacagcccaactgtttccccttaaggcaaaagacactattttgaataaatgcttccattttgagacatctacgtggtatttatagaaggcgtatgagtcaatttgagtgaggtatgatgccaaaatgtgcaaaggagtgaaaacattggttgttgtccttgttaccatatgtataaaaacacttcacaaaagtctccaatgtttgtgttgctaaaacatggaagactgggttcgaacattttaaaggaatggttcattgtaggaaacgtgaagtatagtatagaattagctttagcactttcagaaagtactgcatcatttgaacaaattttctcagttatggatgctgtctaagatgagaacaagttgtacagccaaagtcatcttcattgttaaaactaagtttagattatcatgcattgaattttacacttattaactgggatatacatttcaaaaaagaaaaatctactctcccaacaaggcagtactccgaagcctacctaaaatgccatcctttggttcatggagtggcactgctctacaaaacccattttgttacctcagtaaataagcttcctggatggagtctaaggccaactaatactacattgaatcccactctacagccaagcatgttagaagaagcagcttacatctgtttgctgttccagacgtgcagtctgaatttgatgttttcatttgaaatatactcagtgtttagacttgcagaggttgtggcccatttgtggctcacccagctctactggaacctaggatgagtcggtaggctgagaaggaggggagtaaaaagtgctcactcttcttccctctcttcctattttctcacttccaaacaccatgacagccctagatgtaaagcaagtagctttttaaaaaaacgtatatttaaatgagtaacagtggcataccaggtgttttggcacctaaaacagcttagtgaaaggcaaaagcagagctgaaaggcagccagacaagtaggaaatagaaagtgatcatgggtcctaccaagccctgcatgttccacctcaaagttacacgacagagcgggagactgagttcagaaaaagagaattgatggaatgttctcagtgtgctgtgcagaactaggtctagggcgtctgcttcgtactaacactgggcactgacatttgtactcaataaaatcctcttagattatgatttatcttaaaatctgtgttttccaaaatcctaccaagccatggaagtttggggatatcctgtgtgtggttgagtgggtatatctatttgagggtctgtggcttcctttgcttgttttacattatgtgcctgaagagacagcaatgacatgaccttagtatttatgtttattgtggattttcttttttcaaccacacttctttccttagtacccttggcttaaagtgcagtgacctagattatttccagaacgggcctattatatacattggtcaatccaaactatcatactggtttaaagaaacctatgaagcctccttcaagcaaaataaatgccttggacttagtattccctatttaatgatttgcctaaaataaagtcaccttgcatgactcctacagtgaaagttgaagcaggtaacatttattctaaatgcatagctgttgctctgctaggaaagtaggacatttaagagtgtgtgtgtgtgtgtgtgtgtgtgtgtgtgtgtgtgttctctgataatagttgttagactgggtgttttaatgaagatagcaaatttactttatatccaggacttttaagctattggaatttattttaaaaagcatatattgtgcaaacacatttttcatgttctcttccagttaaattttacataaaacaagcccaaaacactatttaatgaagacctcttatataagtattaataatgagctaatcaataacttttgggtagatgaataactttgtccttaaattcgtaactctattttctgcttattttcacaccaacttgattatatagcggtgctctgaaattccacgaatgcttgaaccacctacacttgttgacagtttagcgaattggaaataatcagtaaattatttcataacttccaaagatataggaaggaaaattaacctattatttatctctgaaataagaataggtgctttacaccaaattcactggtatttggcagtattctcccaagtttcttagtttgaaaccagttaattgttctctttttaaatttaagataacataataggtagtagtcaatctgttccttttggctgtaacagttaaaagaattttagtgtttgtttcattttaattacccaattaactttttagttctactgctattttgggatcaaaaacctgcaaaagattttaggctttatgttactagcaggagaatggaactcacgaagtacaatagtgaaagggaatggcttggcatgggttcgattcaagcttaacaggctaaaacttttagaaggtaagataaataatgtgacacattaatgtcccatttaaatatatatattatatatatgtataatatataatatatatatatactaaatgctccaactccctggttggaactcatatccctggttatctaacactaaattatcctattagaatagttggtaatgttcttagatacactttgagttagcccatcaattcatacccaaatactttagcattcataagctgcaaaatgaattgttctaaaaataaattgtcatttgttccacagtttccaaaaatgccttggaaggggggaaaaactattccagagagatgaaagtgggtgggatggaggaagtgtaataagattgtgactcgtgtatagggagaaatttagtgtttccggtaaaattgtttacaaaaaaaattataaaggcctacaaagaaacttactgttctgtgctaaattatttcccactctccagtactatggaaggactgacttcaaggtccctaagacaaatggtcacatctaaataaaaaatgtttttgcactattcctttctcagaagagagttaaatcttttcacagaaagacacaagaagggttcaaaagaccaccatttttgcagtgtaaagcagtcacccctgcccttcccactgcagcccttggcctttctcactttgagaagtcttgcaaaaagggtcttcatattaggctgtgagatagtgttgcagatgtaagttggttttgtatgaaccaagcgtcagcaagttttaggtttgatgtcggggacttggagtacatcttggggtacacttcatagctgaattagacatgcgggtggaaaggtgacaacactgttttccccttgggcaattctcaggttggtgtgtcgtttcagagttgctaaacgctgaggagttaagaagagaggagggtaaaaggacggaggaggaggaaacagatggggtgaatagaaacggtgtaagaactagaacacagggaggaggactcagggcagagcccagagcccactgcagcaccgagtccacggagcagccagaggctactaccagagcctcaattgccaccccaaagtaccagctgggggcaatcttctccgccccagcataggagcctctgcccttttagactgtctaacaactcgcagtttctcctttgctgcaggaatggtggccgcaaacggtctcagcctccgcacccaccgcctccgtccccgcccacccgcacctcctcctcctctgcctcgcgctgcacccgcaggcggcagacccctcggagcgcgccaccccagctacgttgcattggcaaggttcggaggctggagggcagcagccacttgctgccccagtcgctggggctctgggtgccagtgcggcccccggcagagcccagggcgtcagggaggccgtggagagccatgatctactgcaccgcagtgccagcgtcaggagcttccagagcccgggctgccactgcgggacggccgatctgcccgctccctccttcagacacaaccccagacaaaaacagccggccccgggtccctctccaccctgaacggagctaggggacgccacacactcccggctgccagcgtgagcggttccgggaaaggctgcgcccagcctcctcgccagcgccgccgccaccaccatgcagccctccagcctgcctcccctgggttgctcgcccacagctccgcggccgcccccaatcgcctcggactgagacgcggggacgggaacccctgggatccgactccccaaatcagatgcatttgcatttcttatgtaatgtactgcaagttcccttgttggagccctttggaatcggggcgcatgatcaccagtaggcttaaaagcaggaactcacggcctggctcatccccacccctggccctgtgggaccccgacgcagggctttgacaccgctttctaaagggggggacttcaattacaaatattagaggggctgggcttgtcctctcagtctggggttccctcccggcgcaagccttgctcaagtattcccggtggcaggatgtgtcagaggcagacagggggaatgagttaatgctcgggcacccggagctggacgggggagggacgcgggggctgacggaggagcggggccgcgagggagggggcctcttttactttggtaaaggtgatcgtggtggcgaatattgtgcaagctaatcagaaagtctagagcaggttctcggaacccagctacgtccctcgaacctgctgcagaagtaaggggagctcgcggttctttttcctggcaactaccgaagcttcagctgcctggggcacaaccttaagccatagcccttcactattccaccaaacataggcaaccaaatacattaaaaaaaaaaaaaaagtttcctcctccctcctagtgatggattgtgtcacagccaagggatgccaataatggttttggggttcgtagacgccgatccagctgttacttgtttattcatgcaacacctctatatgcaacactgtcctggttcctggtatgtttcccctgccttcctgcatagcagaactgcagatctagctcgatgagcaacagacaggttattatgaggaaaaacataacatgatgcatgtttcgcttaccagttgggttcttgtttttcttaagactcttgccacaaagacactgcagcatatgcgttcctttgctgaaaatgttccaaagaaaccacattgatttgggcgaaaagcaatccagcagcttagacaccctgagaaagaagagatccttgtggttgcataataataatttgaaatcagttctcctgaagaggggcaccggttttaccataggaaaaacgataatattccggatcttctcccagttttttcccctcacgtggtatatttctttgagacttctcagtgattgtttgttttcggccag

SEQ ID NO: 1271 - DNA, 18874 bp, Homo sapiens
tcccacccccagcctggggcctctgggagccttggtcctgagcagccaacacaccagcccagacagctgcaagtcaccatggacgctgaaggtaaagggacactctctctgccatgtccctgcacccatccccccactgcctacccctgcccccaccctggcttgtctcagccccttgttgcctcctctggagtcatctctcctctggtcccgccatcgactcccttacctaccccatgtccctgcagccttgctcaacccccagaggccccttctcactcttctttctcctgtgttgagtccccaaggagctctggggaaggaaggggcttaagccctagaaaagggcagggtggcctggaggaggtggcgtctcctgggggcagtgggggccggaagtgggaggctggttgggggagcagcatggacttctgctctcgctggtagctcgggagaagcagagacaaagtcctgtcccttctgcagctgggtgggggagggggcttgagtcccgtgattccctgcctggagggagctgtatgcaaactgttggggtgatcagtcccaacccccaaccatgaagtccggtggcaacaaaggaatgagaaaagacaagttaagatttaaagcagccccagggggccagttgctaaagtgaaggctgcagagccctggttgcctgataatttattgagtacaatcttttgatctaagaagcagatggtacggggtgaaacggtgaaggtgggggtgtgcgcgtcatttgaaagatgtatagccgtggtggtttatgtgaatttcctttaagctcaaagcatatgtctaactactaagataatcttttttttttttttttttgagacggagtctcgctttcccccaggctggagtgcagtggcgtgatctcggctcactgcaagctccgcctcccgggttcatgccattctcctgcctcagcctcccgagtagctgggactacaggcgcccgccgccacgcctggctaattttttgtatttttagtagagacggggtttcaccatgttagccaggatggtctcatttcccaacctcgtgatccgcccgtctctgcctcccaaagtgctgggattacaggtgttagccaccgtgcccggccaactaagataatctttaacttattgggctgcagctggtgggagtgggttttacaaggagccaggatgtctggtcacattccaacgcttcaaggaagtgtttcagcccagagcattctgtgtaaagccgcagagcaggtcatgttcactggcctggggacacaatggcaataaggaggtgattctcctcagaggccccctatggtgttccataggtgtcctacacaggggtggctgactaaactggcgccccgtaaacccttccaccagcacaaacccaggggtccatgctctacgctcagaaggctccaccagggatggggctgtgtgaccatgggtgggtcctggcttctcagagtcccgttttcttccatctgtaaaatgacaataatagttccctgctctggcccgccacggtggctcacgcctgtaatcccagcactttgggaggctgaggtgggtggagcacttgaggtcaggtgtttgagaccagcctggccaacatggtgaaaccccgtctctactaaaagtacaaaaattagccgagtgtggtggtgcgcacctgtaatcccagctacatgggaggctgaggcaggagaattgcttgaaccccagtggcggaggttgcagtgagctgagaccaggcctcagcactccagcctgggcgacagagcgagactccatctcaaaaaaaaaggaaaataaatagttccctgctcagaaggttgtggggaggacagaggatgggaggcacaggtgcttagaccctcctccatgtttgaggtgcctgctggccccatacacccggtccctctggctccactgtggaaccagctctcaggggtcccatgcaggatgccacgccaaacacctttcaatctccattgtgtctttctcttttgaaacaacgccgacctggatgtgaatcctgactgccactcagcagcagtggaaaccctggcaagttttgtaacctgtagaagcccgtttccacatctggacaatggagttggtggcactggtctcacggggttgtaatgaagattaaataccttagcagatgtcaaggggtctcgacctgattccttcagagccaggattctttactgagggatcagggatgggctctgggggagttcatgaaccccagaatttgcaggtgaaattgtgtgtctttgtgagaacacggttacgcatttttctgggaaggagatccataattttcatcagatccagattctttttttttttttttttttttgagacagagtctcgccctgttgtccaggctggagtgcagtggcatgatcttggctcgctgcaacctctgcctcccgggttcaagcgattctcctgcctcagcctcacgagtagctgggactacaggcataaaccaccatgcccggctaatttttgtatttttagtagagatggggtgtcaccatgttggccaggctagcagatccagattctttttttttttttttcgagatggagtctgactctgtcaccaggctggagtgcagtggcaggatctcggctcactgcaaccttcacctcccaggttcaagtgattatcttgcctcagcctcacgagtagctgggactacacgtgcttcaggcacttgctgccatgtccagctaattttgtagttttagtagagacagggtttcaccatgttggccaggatggtctcgatctcttgaccttgtgatctgcctcctcggcctcccaaagtgctgggattacaggtgtgagccaccgcacccggcctcttttgttttttagacggggtcttgttctgtcacccaggctggttggtgtgcagtaacataatcatagctcactgtttgtagcctccaacttctgggctcaagtggtcctcctgcctcagcctgtggagtagctgggactgcaggcgtgtgccaccacacctggctaattaaaataaattttttttttttttagagatgggttcttgctgtgttgcccaggctggtctcaaactcccagcctcaagcgatcctccaacctcagcctcccaaaagtgttgggattacaggcatgagccaccgtgcctggctcaaatcttttcatatgtgaacatctcagcatgttttctttctttcttttttgagatggagtttcgctcttgttgcccagactggagtataatggcgtgatcttggctcactgcaacctctgcctcccaggttcaagtgattctcctgcctcactctcccaagtagctggggatacaggtgcccaccaccatgcccagctaatttttttgcatttttttttttagtagagatgggttttgccgtgctggccaggctggtcttgaactcctcacctcaggtgatccacccaccttggcctcccaaagtgctgggattacaggcgcaagtcactgcgcccagcctcatcatgtttttttcttaaaagataaagacttttctttttactacaaccacaatactattgtcaaaactaaactttaaaaatttccttggtgttatcaaacattcaatgtccagattccagtggtttcataaatagcctaatttgcttttagtttgtttgaattaggatctaagtaaaatctacactttgtgattggttagtatgttttaagagtctttgaaactttatttttttgattaaaaaatgtttaatttagagataggggtctcactatattgcacaggctggtctcaaatgccccaaagtgctgggattacaggtatgagccaccacacctgactgattctttttttttttttttgagatggaatctcactctgttgcccaggctggagtgcagtggcgcaacctcggctcactgcaacctccgcctcccagattcaagcgattctctcaccccagtctcccgagtagctgggattacaggcgtgcaccaccacacatggataaattttgtatttttttagtagagacagcgcttcaccatgttgtccaggctggtctcgaactcctgacctaaggtgatcttaggcccaccttggcctcccaaagtgctgggattacaggtgtgaccaccacgcccagccaatatgtggtcttatgagagcattggttcttttttttttttccctgaggcagggtctcaccctgttgcctaggccagagtgcagtagctccatcatagctcactgcagcctccaactcctggactcaagggatcctcccacttcagccttctgaatagctaggactacaggcgtgtgtcaccatgcccagctaatttttaaaattgtttttgtagagatgggttctcactatgctgcccaggctggtctcaaactcctggcctcaagcgatccttctgcctcggcctcccaaagtgttgggattacaggcatgagccaccgcccctggccgagcattgattcttgatcctcatgtgcatctgagtcacagagcagggtgggggctggctcttccccaacctggatccctggaaactacccccagagattctggttcactgggttggaatgggcctgagcatctgaaagtttgaaaagctccctgtgattctggtgtgcagcccaggcagaggccccactgtgtccacttctcttgaaaggagtggttcacaccaacacccccacttccctacctcccgtgcgctcctcgagcatgacaatgtggcttctgcccccgacacatggcacaaaaaccgctctggcacaggcctcacagttgctaagtgcagagccccatcctcagtcttccttctatttacttctgctcacctcccaaaaccctcttctccttcccaggtacccactcctgatgatgcttctctttttgttggacatgccctgtgggttctttatcttattattttattttagagaccgtggcttgctctgtcacccaggctggagtgcagtggtgcaatcacaggtcactgcagcctccaactcctggactcaagccgcagcctcccgagtagctggcgagtagctgggactacaggcgtgcacccccatgcccagctaactttttctttttttcttttgttttttgagacggagttttgctcttgttgcccaggctggagagcaatggcactatctcggcttactgcaacctctgcctcccaggttcaagcgattctcctgcctcagcctcctgagtagctgggatcacaggcgcccaccaccacgcctggctaatttttgtatttttagtagagacggggttttgctatgttggccccggagttcaatttttgtatttttagtagagacggggtttcaccgttttcaccaggatggtcttgatctcctgacctcgtgatcctcccgcctcggcctcccaaagcgctgggattacaggcgtgagccaccgcgcctggccacggcagcatctcttctgaactccagagccattccctaccaccctctgggcaccaccatccacatctcctgctgccgcctcagccttaacctctgcaaaaccaaatccgttctttctctcgagctctgcagaagctaagctgtttcaccaggccacgattcaggaaacgctttgggattcagcttctgttcttgtgaaatgggaagaatccctgtggtgagctccagatgagagcacaaaggggaacaggggtgcccgcggctggcacgccatggctggcacgccatggcactcagtggggtcaccgccccctcctgctgtcccacctccaccctgcctgctcttctcctggaatgactccttctgccagctctcagctacccaggccagaggcccaaggctcccacatctctttagctactaattctggtagatccccttttggaaatagccctcaaatctaccccagagctactgtcaaagttcagggctccatctcttttggtttttttgaaaatattttttcaaattaattatttgttggccgggcgcagtggctcacacctgtaatcccagcactttggaaggccgaggcaggtggatcacctgaggtcaagagttcaagaaccagcctgaccaacatggtgaaaccccatctctacaaaaatacaaaaattagccagggatgatgctgcatgcctgtaatcccagctactcgggaggctgaggcgggagaaccacttgaacccgggaggcagaggttgcagtgagttgagatcacaccattgcactccagcccaggcgacagtgagactccgtctcaaacaaaaaaaaattatttgtggaggcagggtcccactatgttgcccaggcctcaagtggccctcctgccttggcctcccatagcactgggattacaggtgacagccaccgcgcccagcctactttttgtctggccaagactacctcagccttcttttgcctcccaatctgtctccagttggtggctgaagtgacccttctggagcaaaaccataatcatatcactccctcttttaaaattctgtgatgggtcaggcatggtggatcacacttgtaatcccagcactttgggaggccgaggtgggaggactgcttgagcccaggagttcaagaccagcctgggcaacatagcgagaccccccgtctctacttaaaaataataaaataaaatgaaaagaaaattttttttgagatggagtttcgctcttgttgcctaggctggaatacaatggtgggatctcagctcacggcaacctccacctcccgggttcaaccgattctcctgcctcagcctcctgagtagttgggattacaggcatgtgccaccatgcccggctaattttgtatttttagtagagacggggtttcaccatgttggtcaggctggactcgaactcctgacctcaggtgatcggcccacctcggcctcccaaagtgctggaattacaggtgtgagccactgtgtccggccaataaaatgaaattttatgatggcttctgcgatctggccaaattcctcagctaaatagtttagttctttctccctgtggcctctcctcccaccatgtcacctgtgaatcccacactgcccccaccccgacactgtctgcaggtgaacagatcagttttctcagccccaaatgtcagccccaccccacacctctgcctggcaaacatcactcaccggtcctcagagacacctagtcatttattccatgagtccaccacacttgagaaacgcttcttttcttcgcgagcacgcctaccctgtgctagacagtgttcctaagggctttcaaacataaagtcttttgttttttgtttttgagacgcagtcttgctctgtcgcccaggctggagtgcggtggcacaatcttggctcactgcaacctccgcctcccaagttcaagcaattctctgcctcagcctcccgagtagctgggattacaggcgctcggctttttatttttttaattttttttattttttgtatttttagtagagacggggtttcaccatcttggccaggctggtcttgaactcctgacttcaagtggtccacttgcctcggcctcccaaagttctgggattataggcgtgagccactgtgcccagcctccaactcctggccttgtcttcctcccaccctggcttcccagagtgctgggattaacagacatgagcctccacacctggcaacttctttccatttttcactgattctctgacacatcctcattgagcacctgcactgtgtggggtgttaataattgctaggcatggaggcaacagcgtgggcagctctttctcttacttgtcaggctttagcctatgctgttgcaggactgtgccttggcctggaagccccttcccttatcctcatccccaatctcccccttcagctcttgttcctcttgcaggtcttcccttaaacatcacttcctcagcaggggcctcacagacacgcccggaggttagatcctggtccctctgtgcttcctgttcttcccccatcatcacagtctacggctgtttcctctcgatgggcaaagactgtgtctggccattgagttttctgctatatccaagtgcttcgtatactgaaccatataaatgtgctgcttttattggtcaaaacggccaaatattggcaattttatattggttagcttcatagtatgtgagctaggatacttatcccatcagagaggttgcgtagcacagtgaatcagagcccaggctctggggccgcacacctgaggtccagccctggctctgccacttgtcactaagtgattgtggactggagacaaccctcaggggccttgggttcctaatctgtgacagggatgacaataatgacctcctcgtgctgttataaaatacagaaatgtactaaaatacaaaaattggccaggcatggtggcacatgcctgtaatcccagctactcaggaggctgaggcaggagaactcaggaggcagaggctgcagtgagtctacttttattgccaaagctcgggggtccatcccttttccattgcatgccactgcactccagcctgggcaacaaagtgagactgtctcagaaaaaagaaaaagaaaaaaatgtttaaaagccaggagtttgagaccctgtctctattaaaaaaaaaaaaaattaccttggcatggtggagcagctactcaggaggctgaggtgagaggaccacatgagcccgggagttcaaggctgcagtgagccatgattgcaccactgcattccactctgtctcaaaaagaaagaaagaaaaaagtcaagagaactggagctgaaaccatgaaaggtcagttttcagcaggagagtgatcaaagaaaaccagaactagacagtcgttaaaatagcaaaaacatattgcattccagactattgctgtaggggaagagtgaccttagatcagaactgggctgaactctacaccatgggggttatagccaacgagcagagttgggggcagtggatgggacattaccatgagaaagcactgggggttgggggtattctgacaagaccaacctaaagggattcttgctgagggcaggccaaggtggtcagacagcgcctgggggagagtggagaatgaggacccccatcagggatcgggggcaatcagatgtggaggatgagggactggctaagctgacttagcagtattcttgctaaaattggacgatgcagaggtgaacacggaagtccaaggcctaactggaaaagagctgagggaacctgagtgaggtttggctatagacagaacctctgagtgagcccatcaaagttactttatttatttgtttgtttattaatttatttaagacagagtctcactctgtcgcccaggctggagtacagtggtgctatctcggctcactgcaaactctgcctcctaggttcaagcaattctcgtgcctcagcctcccgaggagctgggattacaggcacatgccaccacacccagctaagttttgtgtttttagtagggacagggttttgccatgttggacaggctggtcttgaactcctgacctcaggctaattttttgtttgtttttattctctttttttttttttttgagactgagtttcgctcttgttggccaggctggagtgcaatggcgcgatattgactcactgcaacctctgcctcctgggttcaagcgattctcctgcctcagcctcccgagtagctgggactacaggcgcacaccaccatgcccggctaatttttgtatttttaggagagacggggtttcataatattggtcaggctggtctcaaactcctgatctcaggtgattcgcctgcctcagcctcccaaagtgctgggattacaggcgtgagccaccgcgcccagccttttgtttgtttttaaatttaactttttttttgagaccgaattgcactctgtcacccaggatggattgcaatggcgcaatctcagctcattgcaacctctgcctcctgggttcaagagattctcctgcctcagcctcccaagtagctgggattacaggcgcctgccaccacagctggttaatttttgtgtttttagtagagatgaggttttgccatgttggacaggctggtcttgaactcctgacctcaggtgatcaacccaccttggcctcccaaagtgctgggattacgggcatgagccaccatgcccggccttaacttttatcttaagttcaggggtacatgtgcaggtttattatataggtaaacttgtgtcatgggggttgtacacattatttagtcacccaggtattaagtttagtacccattagttatttttcctgatcctcttgagggaagagagagaccctctcatattgtttcatactcagaaaaggaaagagaagcgaaactaaaggcaggtagcctggtgcctaggaaccagaccggaaaccaaggaaccagacccgaaatcaggcctgggcgtgcctgacctaagcctggtagttaaaattcgacccctgacctagcaactgttgttatctatagattccagacattgtatggaaggacattgtgaaacctcccgttaggttctgtttcactctgaccaccggtgctcgcagcccctgtcacgtaccccctggcttgctcaatcacgaccctctcacgcggacccccttagagttgtgagccgttaaaaaggacagaagttgagcacctgaagagctcggattttaagacgctagcctgccaatgctcccagctgattaaagccactcccttcactatcttggtgtctgaggggttttgtccacagctcgtcttgctacacttgccctcctccaaacttccgccctccaataggctccagtatgtgttattcccctctatgtgtccatgtgttctcatcatttagctcccacttataagtgagaacacgcggtatttggttttctgttcctgcgtttgtttgctaaggataatggcctccagcgccatccatgtccctgcaaagaacgtaatctcattcttttttgtggctgcatagtattccacggtgtatgtgtaccacactttctttgtccagtctagcattgatgggcatttaggttgaatcatgtctttcctatggtgaatagtgctgtgatgtgtctttataacagaatggtttacattcctttgggtatatacccagtaatgggattgctgggtggaatggtatttctggtttttggtctttgagaaattgctgcactgtcctccacgatggtttaactaatttacactcccaccaacagtgtataagtgatcctttttctttgcaacctcgccagatctcggtggtcaactcctcccactccccaggcaatgctgatttgctctgtgcctatagttttgcctttcccaggatgctgcgggaatgggatcatacggccttttggatctggctccttttagttagactgatacatttgagacaggtccctattgttgtgtgtatcagtagttggtttcttctttttttgagatggattctcagtctgtggtccaggctggagtgcagcggcatgacctcagctcactgcaaactccgcctccctggttcaagtgattatcctgcctcagcctcccaagtagctgggattacaggcacatgccaccacgcccggctagtttttgtattttttcgtagagatgggatttcaccatgttggagaggctggtcttgaactcctgacctcgtgatctgcccaccttggcctcccaaagtgctggaattacggcgtgagccatggtgcccagcctgcatcacaggttgtttacccaatactcaccagttgcagaattcaaatccattttttaaaaaatcagcctgaaaaaaaaagaaaaaaatcagtctggccaggcacggtggctcacgcctgtaatcccagcactttgggaggccaaggcgggaggatcacctgaggtcaggagtttgagagcagcctggccaaaatggcaaaaccctgtctctactaaaaatacaaaaattagctgggcgtggtggcgggcacctgtaatcccagctacttgggaggctgaggcagaagaatccctggaacccgcgggacggaggttgcagtgaggtgacatcaggccacttcactccagcctgggcaaaagagtgaagctctgcatcaaaaaaaaaaaaaaaaaaaaaaaaaaaaaatcagggtgggcacagtggctcactcctgtaatcccaggactttgagaggctgaggtgcgaggattgcttaagcctgggagttcaagacgaggctggggaatatagtgagacccccatctctacaacaaaaaatatacaaaaattagccgggcatggttggtgtgcgcctgtagtcccagttccttgggaagctgaggcgagaggattgcttaagcctgggcagttgaggctgcagtgagccatgatcgtgccactgcactgcacctagtttgaatggagtgggagtgggggattaggctctcctccctgccgtttgctcccaggccttttccgtagctggatgtgaccaacagagacagtgcccagcctcagtatagctagctcttagtggagggacaggagccatctggggcagatgtgggagagaatgtggcgaaggagagccgggtgcagtcaaggaggcttgtggctcggaggggaggtggggtgagtgagtggagactcagcagcttggctttggggaagtagacaagagagggccctctttggagagcggagcaagccaggatgtctggccttcacttccacttggaacagaagtgtgctgtgtgcgcgtgcttgtgcgtgtgcgtgcacgtgtgtgcgcgctaaatcaaacaccctcgctggctctgtgttcccctcaaggggaagccaactccacggatggcgggggtccattaggctgcaggtcttctccctgccgatagatggcgctgttgcaccgcgcctgggtttgcctctgcccgcagccatgcagggcccatcacgggctatgcctaccgcgcgaggggccttcaccatgtccactatccttatttatttatttatttatttatttatttattttttaagtgtgggtactggccgggcgcggtggctcacgcctgtaatcccagcactttgggaggccgaggcgggcggatcacgaagtcaggagattgagaccatcccagctaacacggtgaaaccccgtctctactaaaaacacaaaaaaattagccaggcgtggtggtgggcgcctgtagtcccagctactcgggaggctggggcaggagaatggcgtgaacccgggaggcggagcttgccgtgagccgagatcgcgccactgcaacagaacgagactatctccaaaaaaaaaaaaaaagtgtgggtatatagtaggtgtatatatttatggggtgcacattgataaaggcatgcaatgcataataatcacatcatgggctagatgcggtggctgacgccgagatcgcgcctctgcagtcgccaggccactgcaggcgccacagtggcgacagagcgagactccgtctcaaaaaaacaaataaataaataaatcaggttaggccgggcgcagtggctcacgcctgtaatcccagcacttgggaggcggaggcgggcgaatcacgaggtcaggagttccagaccagcctggccaacatggtgaaaccccgtctatactaaaaatacaaaatttagccgggtatggtggcaggcgcctgtaaccccagccactcgggaggctgaggcaggcgaatcgcttgaatccggaaggcggaggttgaagcgagccgagatcactccattgcactccagcctgggcaacaagagtgagattctgtctcaaaaaaaaaaaaaaaaaattacatcatagagaatggggtgtccatcccctcaagcatttatcctttctgttacaatccaattgcattcttttagttatttcgaaatgtacagttattattgactgtagtcaccctgttgtgctagcaaatagtaggtcttattcattctttctattttttttgtacccattaaccttccccacctccccatcatccttttttttgttttgagacggagtcttgctctgtcacccaggctggagtgcagtggcacgatctcagctcacttcaacctctgcctcctgggttcaagcgattctcctgcttcagcctcccgagtggctaggattacaggcctgcgccactatacttggctcatttttttcggggttttgccatgttggccaggctggtcttgaactcctgacctcaggtgatccacctgcctcagcctcccaaagtgctgggattacaagcatgagccactgtacccagccccatcatcctcattttatttattttttatttttattactatttttttaggtggagtcttgctctgtcacccaggctggagtgcagtggcgtgacctcggctcactgcaacctctgcttcccgggttcaagcaattctcttgcctcagcctcccgagtagctgggattgcaggcgcctgccaccacgcccggctaatttttgtatttttagtagagacaggagggttttaccattttggctaggctggtctcaaactcctgacctcaggtgatcctcccgccttggcctcccaaagtgctgggattacaggcgtgagccaccgcgcctggccagactgattttttttttaagtgaatttgaaagctgcaactggtgagtattggataaacaaactgtgatgggattgcaggtgtccacccccaagcctggctaatttttgtatttttagtagagaccatgttggccaggctggccttgaacccctgacctcaagtgatctgcctgccccagcctcccaaagtgtttgggattacagtcgtgagccaccgcacccggtcagaagtttaatttttttttttgagacggagtcttactctgtcaccccggctggagtgcagtggcctgatctcggctcactgcaagctccacctcccaggttcacgccattctcctgcctcagcctctggagtcgctgggactacaggcgcccgccaccaagcctggctaattttttcgtatttttagtagagacggggtttcaccatattagccagaatggtctcgatctcctgacctcgtgatccgcccgcctcggcctctcaaagtactgggattacaggcgtgagccaccgcgcccggcccagaagtttaaatttaactaggtgcccagtgatctcatcaagcccacagcactccctcaccctcgcccccacaacctcccttccccccacgccccccttcctcaccgcagtcccccccctgggacccctagatcttgaggctgatgggccagttcccagtttcactggttgttaaatattttgacagtgacccctgacagcaggagaggcagccaaactcaacagctgttctctcttccccccaggcctggcgctgctgctgccgcccgtcaccctggcagccctggtggacagctggctccgagaggactgcccagggctcaactacgcagccttggtcagcggggcaggcccctcgcaggcggcgctgtgggccaaatcccctggggtactggcagggcagcctttcttcgatgccatatttacccaactcaactgccaagtctcctggttcctccccgagggatcgaagctggtgccggtggccagagtggccgaggtccggggccctgcccactgcctgctgctgggggaacgggtggccctcaacacgctggcccgctgcagtggcattgccagtgctgccgccgctgcagtggaggccgccaggggggccggctggactgggcacgtggcaggcacgaggaagaccacgccaggcttccggctggtggagaagtatgggctcctggtgggcggggccgcctcgcaccgctacgacctgggagggctggtgatggtgaaggataaccatgtggtggccgccggtggcgtggagaaggtgctggtcctgcctgtccctggtccaaccccaccctcagcacacccctcccctcccctcccctctccagagcctccagccatgaccgggtgaacagccatggcctggagtcagcaacacaagactcttcccacctcagctcctccatctgagctgggctcagttgagctcatccagctaagctaaaggggagctgggcctgcttttctttttctggagatggggcctcagtctctccagtagctggatatacaggcatgctccaccccactggctaatttttgctttttttttttttttttttttttgagatggagtctcactctttcacccaggctggagtgaagtgatgcaatctcggctcactggaacctctgcctcctgggttcaagcaattctcctgcctccgcctcccgagtagctgggattacaggcgccagccaccatgcccggctaatttttgtattttttagtagagacagggattcaccatgttggccagactggtctcaaactcctgacctcaggtgatccacccacctcggcctcccaaagtgctgggattacaggagtgagccactgcacccagctgccttttttttttttttttttttttttgagatggggtctcactatgttgcccaggctggtctcaaacttctggactcaagtgatcctcccaccttggccacccaaagtgctgggattataggcataagccaccatgcctggttttggaattggttctttatctttgttctgctgctgcgtggcgtgatgttcaagagcaaaggacaacacaggggaagccagtgtcactggcaccacagccttgagcccatctctctagccctctgcaccttatttcccatctgtgaaatgcccttaaacaccccttctaattttaatattctgagtcaaattgagctcaggtccaaatgccaaatattgctgatattcatccactttttgacccacaaaagtggtcattttaacctacaataaaacatcctggctcagtggctcatacctgtaatcccagcactttgggaggcccagttggggggattacttaagtccaggagtctgagaccagcctgggccatatagcaagattctgtctctacaaaaaattaaaaaattagccatgcttgtgggcaagcccctgtagtcccagccacttgggaggctgaggtgggaggatcacttgatcccaggaggtggaggctgcagtgaactatgactgcactgaactccagcctgggcgacagagcgggaccctgactcaaaaacaaaacagtggccaggtgcggtggctcacgcctgtaatcccagcactttgggaggctgagatgggtggatcacgaggtcatgagttagagaccatcctggccaccatggtgaaacgtcgtctctattaaaaatacaaaaattagctgggcatggtggcacgcacctgtagtcccagctactcgggagactgaggtgggagaatcacttgatcccaggaggtagaggctgcagtgagctatcattgcaccactgcactccagcctgggcgacaggttgagaccctgtctcaaaaacaaaacaaagcaaaaacaaccccaaagtctggtttccttattaaccccaagttcatggtccacccgaagcttttcaaatgtcagtcccggctccccgcgccccagctgcagtgctgggccctatcgtcaccctcgccctcccggctccctgcgccccagtgccaggtgctgggcccagtcctcacccttgtcctcccggctgcccagcaggcggtgcgggcggccagacaggcggctgacttcactctgaaggtggaagtggaatgcagcagcctgcaggaggccgtgcaggcagctgaggctggtgccgaccttgtcctgctggacaacttcaagccagaggtaaggtgggctctgcctccggggagggatctgtggtgggctcttacctccccttggcttgtgtcccgcaggagctgcaccccacggccaccgtgctgaaggcccagttcccgagtgtggctgtggaagccagtgggggcatcaccctggacaacctcccccagttctgcgggccgcacatagacgtcatctccatggggatgctgacccaggcggccccagcccttgatttctccctcaagctgtttgccaaagaggtggctccagtgcccaaaatccactagtcctaaaccggaagaggatgacaccggccatgggttaacgtggctcctcaggaccctctgggtcacacatctttagggtcagtggccaatggggcacatttggcactagcttgagcccaactctggctctgccacctgctgctcctgtgacctgtcagggctgacttcacctctgctcatctcagtttcctaatctgtaaaatgggtctaataaaggatcaaccacatggggttctgcggtgataatgagcacatagtgaggggtcagcaaatgtcagaagttacctgggacagccgggcacgatggctcacacctgtaatcccagcactttgggaggctgaggcgggaagatcacttgagttcaggagtttgagaccagcctggccaacatggtgaaaccccatctctaccaaaaatagaagaattagctgggtgtggtggcacgcgcctgtaatcccagctacttaggaggctgaggcaggagaatcgcttgaacccaggaagtggaggttgcagtgagctgatggtgccactgcactccagcctgggtgatagagcgagactctgtctccaaagaagaa

SEQ ID NO: 1272 - DNA, 7524 bp, Homo sapiens
cctctgagcccagccctccctagcatcaccacttccatcccattcctcagccaagagccaggaatcctgattccagatcccacgcttccctgcctccctcaggtgagccccagacccccaggcaccccgctggcccctgaaggagcaggtgatggtgctgtcttcgcccagcagctgtgggagcaggcgggtggggcaggatggaggggtgggtggggtgggtggagccagggcccacttcctttccccttggggccctgtccttcccagtcttgccccagcctcgggaggtggtggagtgacctggccccagtgctgcgtccttatcagccgagccggtaagagggtgagacttggtggggtaggggcctcagtgggcctgggaatgtgcctgtggcttgaaaagactctgacaggttatgatgggaagagattgggagccattgggctgcacagggtcagggaaggccaggaggggctggtcactgctggaatctaagctgctgaggctggagggagcctcaggatggggctgatgggggagctgccagcatctgttcctctgtcatttctgataacagtaaaagccagcatggaaaaaaccgttaaaccgcaggttgggcctggccgttggcagggaagtgggcagaggggaggcccggccaggtcctccggcaactcccgcgtgttctgcttctccggctgcccacctgcaggtcccagctcttgctcctgcctgtttgcctggaaatggccacgcttctccttctccttggggtgctggtggtaagcccagacgctctggggagcacaacagcagtgcagacacccacctccggagagcctttggtctctactagcgagcccctgagctcaaagatgtacaccacttcaataacaagtgaccctaaggccgacagcactggggaccagacctcagccctacctccctcaacttccatcaatgagggatcccctctttggacttccattggtgccagcactggttcccctttacctgagccaacaacctaccaggaagtttccatcaagatgtcatcagtgccccaggaaacccctcatgcaaccagtcatcctgctgttcccataacagcaaactctctaggatcccacaccgtgacaggtggaaccataacaacgaactctccagaaacctccagtaggaccagtggagcccctgttaccacggcagctagctctctggagacctccagaggcacctctggaccccctcttaccatggcaactgtctctctggagacttccaaaggcacctctggaccccctgttaccatggcaactgactctctggagacctccactgggaccactggaccccctgttaccatgacaactggctctctggagccctccagcggggccagtggaccccaggtctctagcgtaaaactatctacaatgatgtctccaacgacctccaccaacgcaagcactgtgcccttccggaacccagatgagaactcacgaggcatgctgccagtggctgtgcttgtggccctgctggcggtcatagtcctcgtggctctgctcctgctgtggcgccggcggcagaagcggcggactggggccctcgtgctgagcagaggcggcaagcgtaacggggtggtggacgcctgggctgggccagcccaggtccctgaggagggggccgtgacagtgaccgtgggagggtccgggggcgacaagggctctgggttccccgatggggaggggtctagccgtcggcccacgctcaccactttctttggcagacggaagtctcgccagggctccctggcgatggaggagctgaagtctgggtcaggccccagcctcaaaggggaggaggagccactggtggccagtgaggatggggctgtggacgccccagctcctgatgagcccgaagggggagacggggctgccccttaagtgtcggtgaatagtgaggctggaggccggaatctcagccagcctccagcaccttccctctcaccatcccactgccccctcgctcccatgtttccacccggcaccctgatcctcacccgaatctcctttttttttttcttttgagacagagtttcgctttgtcgcccaggctggagtgcaatgcacgatctcagttcactgcaacctctgcctcctaagttcaggcgattctcctgcctcagcttcccgagtaactgagattacaggcacccaccaccatgcccagctgcttttttgtatttttggtagagatggggtttcaccatgttggctaggctggtctcaaactcctgacctcaggtgatctacctgcctcagcctcccaaagtgctgagattacagacatgagcctccgcgccttgcctcctcacccacctcttcactctgaatcctcatgaggcttctcagccctggatttcctgctgccatcctcacccagcacccacaactagcgcctgggcagggcagggctggcacctctcaacgtctgtggactgaatgaataaaccctcctcatccacccctatttatctccatcaccatttccccctctttcttgttcctggaaacggctgctgagtctccatcggccaaacttatctgccctgtgatttctttgacaattctccttttcccccagaacccaccctgggttgaccagagtctgggaagaaggacaagagaacccggcaaactccctcctaggattaactttgtaaagcacccttgccctgtagctgcaagggctgtggaacctgggcagcccgcaaccacctttagctctgggccccccaggccagcctggagcatggctgggtggggccaccagcccatgctctcaggcgggcctgtgatctttcccagggcacatggactgtaggctggccctggcccacaccaccacactctccccagccatggacagaggcagccagaggcctcacggtttctcctccgagtttctggctgggtgtagttctcagaaaccccagtgcctgcgtgtgtccactcgtgggtgtggtttgtgtgcaagagctgaggatttggcgatgcttgggaggggtagttgtgggtacagacggtgtgggggtgggaagtggtgcagagactgaagagggtcaacctgggcatgggggacacagggactgctgagaacgtgcgtgtcatctttgctctgatggggtggacatagcagaaaatctaactctgtctgtagccccatacagaatgccagggtgagcacagtggctggtgcctttaatcccagcactttggaaagttgaggcaggaggatcgcttgagcccaggagttcgagtctgaagtgagctgtgattgcaccactgcacttcagcctgggcaacagagtgagcccctgtctcaaaaaagaaaagaaaaagaaagccaggcttcatggaaagatcgtatgtgtgacccaaatatgagttcttcagctcagccatggtaatcccttccttgaagtctccatttctgcagtacacatgcatgtgcgctctctctctctctctctctctcacacacacacacacacacacacacacacgcgcgcgcgcgcgcgctctcctgcgaacagaggcagggggagaggggtttgccctggtctcggggactggtctggctggcgcttccccactgcacgtttccaggtttagtttgtctgtgtctcctcttccatcccaggggctgagccccttccatcctccaagaggaaccagtgagagtgagtgaaggaggggcctggagccagggacttcccctgtggggcctgggtggagaggggagaactcaatggtgctgcctttgagaccagcccaggctacagcccaggagcacacatgggccagggcagttggtatttcccgaggacaaagaggaaattttcaaagaggaagttgttgagttagagcttgcggtggctgagagcagacaggttgacctgcaaaaaaagacaggggaggcatgtgagtgtgacagccctgctctgtggcctgggcaggagatgggggaaagggtcaggtgggggatgggctcgtgcagtgggagaggagacggagggagggagcgggaaggggcttgcttagtgggtgggaagagctgagctcggatggaaccagcttctaccagccaggctgggcacccactgggctgcatctggtggccttttctgattgctatttggactcactgcagctgcagaatgacagaggccatgtccaaaatcccttagagacactgttgtcttagagttgttaaaataagagcccccatatcaggtttagaaaatactgtcaccgaacgaacgtcgctgtcctcagctccacctccctttcctttgacagatatggttgttttctaagccaggactggttttagtcaggtcctgggcgaatcctgaaaaaaagaggtagtacgggtaaggaaggcacccaacagggctttcacaatccagaaaatatcaaaatataagtgttaaaagagaggcacaggccgggtgcggtggctcacgcctgtaatctcagcactttgggaggccaaggtgggcagatcatgaggtcaggagtttgagaccagcctggccaatatgatgaaaccccgtttctactaaaaatacaaaagttagccaggcatggtggtgtgctcctgtaatcccagctacttaggaggctgaggccagagaattgcttgaaccctggagtcagaggttgcagtgagccgggatcatgccactgtactccaggctgggtgacaaagtgagactgtctcaaaaaataaaaataaataaaataaataaaagagaggcacaaacagtgttatgaatgcaccaaggaaaatggtgcattcataactctcaggtgaagcctaccaagccatgcgtgtgtgcacatatgtgtgtacgtgtgcatgtgcgtgcgtgcatgtgcgtgcgtgcatgtgcctgtgtgtgtatgtgtgcacatgtgtgtgcgcatgtgtgtgtgtgcgcgcatgtgtgtgtgcatgcatgttctcccatgcatgtgtactgtggcaagggagactttgaggaagagattccagtggctgagcagaagggctcgcattgccctggcgaaaggttggaaggcttcacctgagagtgtgtcgtggcctttgtcatatccactgcttgattcctttctttaaaaattatttttattgttttctacatatgagaaccaccacacctggctaatttttgtattttttgtagagatggggtttcaccatgttgtcccggctggtctcaaactcccgggcacaagagatccacctgcctcagcctcccaaaatgctgggactataggcatgagccactgcacccagccactgcttcattcctggtggctgctgtgcctggcatgttgcagatcctccatgaatatgcatttgaatgaatgaatgaatgaatgaatgaatgaatggagatgacgcctcagagattctttcttttgagatgaggtctcattctgtcacccagactagagggcagtggtgcaatcacagctcaccacagcctcaacctcctgggcctcccaagtagctgcgatcacaggtgtgcaccaacatgcccagctaatttttttttttaatttttaatttgtacagacagggtcttgctgtgttgcccaggctggtctcaaactcctgggctcaagtggtcctcccacctaagcttccccaaatactgggattataggtgtgagccactgtgcccaggcttgcctcagatatttgaaggctgggaaggattttgcaaagctgggaaaaggaaaaggcattcccagcagaggggatagcaggtggaaatacataattaaaaaaaaaaaacgtggagcagatccagcgcagtggctcatgcctgtaatcccagcactttgggaggcagagcagggaggattgcttgagtctaggagttcaagaccagcctgggtaacatagaaagaccctgtctctacaaaaacacaaaaaattagccaggcgtggtggtgcatgcctgtagtaccagctacttgagaagctgaggcaggaggactgcttgaagccaggagtttgagaccagcctgggcaacatagtgagaccccgtgtctacaaaaagtaaacatttatatatatattttttaaagtggagcagttcaatatagagtcttttttgaacaaacgtgaaatagatgtcttttttttttttttgagatggagttttcactcttgttacccaggctggagtgcaatggcgtgatcttggctcaccagaacctccgcctcctgggttcaaacaattctcctgcctcagcctcccaggtagctgggattacaggcatgcaccaccaaacccggataattttgtatttttagtagagatggggtttcaccatgttggtcaagctggtcttgaactcccgacctctgctgatccgtatgcctcggcctcccaaagtgctgggattacatgcgtgagccaccgtgcccgacaatagatgtcttttaattttctggaggaaaaagcaaagcaaaagaagcagtggatattttaagactaaaaaggaaaacaaaaaaaggagatagagcaggccagacgtggtggctcaacgtctgtaatcccagcactttgggaggccgaggcaggtggatcacctgaggtcaggagttcaagaccagcctgaccaacatggtgaaaccctgtttcaaaatacaaaaaattagctgggcgtggtggcgggcacctgtaatcccagctacttgggaggctgaggcaggagaatcccttgaacccaggaggtggaggttgcagtgagccgagatcacgccattgcactccagcctgggcgacaagtaaaaaactccatctcaaaaaaaaaaaaggagatagagcaaggaacagtaagaaaatagttgggtgcagtggctatgcggtggcactataggaggctgaggcgggcagatcacctgaggtcaggagttggagaccagcctgggcaacatagacccctatctctacaaaaaatttgaaatatgaaaaattagccaggtgtagtggtgtgcgcctgtggtaccagctactcaagaggcgaaggcagggaagattgcttgagcccaggagtttgaggctatagtgagctgtgatcatgccactgcactccagcctgggcaatagtgtgagactctgtctcaaaagaaagaacatggccaggcgtggtggctcacacctgtaatcccagcactttgggaggccgaggcagtcagatcatgaggccagtttgaaaccagcctggccaacatggtgaaaccctgtctctactaaaaatacaaaaattagccaggcgtggtggcatgcccccgtaatcccagctacttgggggtctgaggcagaagaattgcttgaaaccgggaggcagaggttgcagtgagccgagatcgtgtcattgcactctagtctgggcgacagagcaagactccgtcttggaaaaaaatttaa

SEQ ID NO: 1273 - DNA, 7244 bp, Homo sapiens
gcctcgggaggtggtggagtgacctggccccagtgctgcgtccttatcagccgagccggtaagagggtgagacttggtggggtaggggcctcagtgggcctgggaatgtgcctgtggcttgaaaagactctgacaggttatgatgggaagagattgggagccattgggctgcacagggtcagggaaggccaggaggggctggtcactgctggaatctaagctgctgaggctggagggagcctcaggatggggctgatgggggagctgccagcatctgttcctctgtcatttctgataacagtaaaagccagcatggaaaaaaccgttaaaccgcaggttgggcctggccgttggcagggaagtgggcagaggggaggcccggccaggtcctccggcaactcccgcgtgttctgcttctccggctgcccacctgcaggtcccagctcttgctcctgcctgtttgcctggaaatggccacgcttctccttctccttggggtgctggtggtaagcccagacgctctggggagcacaacagcagtgcagacacccacctccggagagcctttggtctctactagcgagcccctgagctcaaagatgtacaccacttcaataacaagtgaccctaaggccgacagcactggggaccagacctcagccctacctccctcaacttccatcaatgagggatcccctctttggacttccattggtgccagcactggttcccctttacctgagccaacaacctaccaggaagtttccatcaagatgtcatcagtgccccaggaaacccctcatgcaaccagtcatcctgctgttcccataacagcaaactctctaggatcccacaccgtgacaggtggaaccataacaacgaactctccagaaacctccagtaggaccagtggagcccctgttaccacggcagctagctctctggagacctccagaggcacctctggaccccctcttaccatggcaactgtctctctggagacttccaaaggcacctctggaccccctgttaccatggcaactgactctctggagacctccactgggaccactggaccccctgttaccatgacaactggctctctggagccctccagcggggccagtggaccccaggtctctagcgtaaaactatctacaatgatgtctccaacgacctccaccaacgcaagcactgtgcccttccggaacccagatgagaactcacgaggcatgctgccagtggctgtgcttgtggccctgctggcggtcatagtcctcgtggctctgctcctgctgtggcgccggcggcagaagcggcggactggggccctcgtgctgagcagaggcggcaagcgtaacggggtggtggacgcctgggctgggccagcccaggtccctgaggagggggccgtgacagtgaccgtgggagggtccgggggcgacaagggctctgggttccccgatggggaggggtctagccgtcggcccacgctcaccactttctttggcagacggaagtctcgccagggctccctggcgatggaggagctgaagtctgggtcaggccccagcctcaaaggggaggaggagccactggtggccagtgaggatggggctgtggacgccccagctcctgatgagcccgaagggggagacggggctgccccttaagtgtcggtgaatagtgaggctggaggccggaatctcagccagcctccagcaccttccctctcaccatcccactgccccctcgctcccatgtttccacccggcaccctgatcctcacccgaatctcctttttttttttcttttgagacagagtttcgctttgtcgcccaggctggagtgcaatgcacgatctcagttcactgcaacctctgcctcctaagttcaggcgattctcctgcctcagcttcccgagtaactgagattacaggcacccaccaccatgcccagctgcttttttgtatttttggtagagatggggtttcaccatgttggctaggctggtctcaaactcctgacctcaggtgatctacctgcctcagcctcccaaagtgctgagattacagacatgagcctccgcgccttgcctcctcacccacctcttcactctgaatcctcatgaggcttctcagccctggatttcctgctgccatcctcacccagcacccacaactagcgcctgggcagggcagggctggcacctctcaacgtctgtggactgaatgaataaaccctcctcatccacccctatttatctccatcaccatttccccctctttcttgttcctggaaacggctgctgagtctccatcggccaaacttatctgccctgtgatttctttgacaattctccttttcccccagaacccaccctgggttgaccagagtctgggaagaaggacaagagaacccggcaaactccctcctaggattaactttgtaaagcacccttgccctgtagctgcaagggctgtggaacctgggcagcccgcaaccacctttagctctgggccccccaggccagcctggagcatggctgggtggggccaccagcccatgctctcaggcgggcctgtgatctttcccagggcacatggactgtaggctggccctggcccacaccaccacactctccccagccatggacagaggcagccagaggcctcacggtttctcctccgagtttctggctgggtgtagttctcagaaaccccagtgcctgcgtgtgtccactcgtgggtgtggtttgtgtgcaagagctgaggatttggcgatgcttgggaggggtagttgtgggtacagacggtgtgggggtgggaagtggtgcagagactgaagagggtcaacctgggcatgggggacacagggactgctgagaacgtgcgtgtcatctttgctctgatggggtggacatagcagaaaatctaactctgtctgtagccccatacagaatgccagggtgagcacagtggctggtgcctttaatcccagcactttggaaagttgaggcaggaggatcgcttgagcccaggagttcgagtctgaagtgagctgtgattgcaccactgcacttcagcctgggcaacagagtgagcccctgtctcaaaaaagaaaagaaaaagaaagccaggcttcatggaaagatcgtatgtgtgacccaaatatgagttcttcagctcagccatggtaatcccttccttgaagtctccatttctgcagtacacatgcatgtgcgctctctctctctctctctctctcacacacacacacacacacacacacacacgcgcgcgcgcgcgcgctctcctgcgaacagaggcagggggagaggggtttgccctggtctcggggactggtctggctggcgcttccccactgcacgtttccaggtttagtttgtctgtgtctcctcttccatcccaggggctgagccccttccatcctccaagaggaaccagtgagagtgagtgaaggaggggcctggagccagggacttcccctgtggggcctgggtggagaggggagaactcaatggtgctgcctttgagaccagcccaggctacagcccaggagcacacatgggccagggcagttggtatttcccgaggacaaagaggaaattttcaaagaggaagttgttgagttagagcttgcggtggctgagagcagacaggttgacctgcaaaaaaagacaggggaggcatgtgagtgtgacagccctgctctgtggcctgggcaggagatgggggaaagggtcaggtgggggatgggctcgtgcagtgggagaggagacggagggagggagcgggaaggggcttgcttagtgggtgggaagagctgagctcggatggaaccagcttctaccagccaggctgggcacccactgggctgcatctggtggccttttctgattgctatttggactcactgcagctgcagaatgacagaggccatgtccaaaatcccttagagacactgttgtcttagagttgttaaaataagagcccccatatcaggtttagaaaatactgtcaccgaacgaacgtcgctgtcctcagctccacctccctttcctttgacagatatggttgttttctaagccaggactggttttagtcaggtcctgggcgaatcctgaaaaaaagaggtagtacgggtaaggaaggcacccaacagggctttcacaatccagaaaatatcaaaatataagtgttaaaagagaggcacaggccgggtgcggtggctcacgcctgtaatctcagcactttgggaggccaaggtgggcagatcatgaggtcaggagtttgagaccagcctggccaatatgatgaaaccccgtttctactaaaaatacaaaagttagccaggcatggtggtgtgctcctgtaatcccagctacttaggaggctgaggccagagaattgcttgaaccctggagtcagaggttgcagtgagccgggatcatgccactgtactccaggctgggtgacaaagtgagactgtctcaaaaaataaaaataaataaaataaataaaagagaggcacaaacagtgttatgaatgcaccaaggaaaatggtgcattcataactctcaggtgaagcctaccaagccatgcgtgtgtgcacatatgtgtgtacgtgtgcatgtgcgtgcgtgcatgtgcgtgcgtgcatgtgcctgtgtgtgtatgtgtgcacatgtgtgtgcgcatgtgtgtgtgtgcgcgcatgtgtgtgtgcatgcatgttctcccatgcatgtgtactgtggcaagggagactttgaggaagagattccagtggctgagcagaagggctcgcattgccctggcgaaaggttggaaggcttcacctgagagtgtgtcgtggcctttgtcatatccactgcttgattcctttctttaaaaattatttttattgttttctacatatgagaaccaccacacctggctaatttttgtattttttgtagagatggggtttcaccatgttgtcccggctggtctcaaactcccgggcacaagagatccacctgcctcagcctcccaaaatgctgggactataggcatgagccactgcacccagccactgcttcattcctggtggctgctgtgcctggcatgttgcagatcctccatgaatatgcatttgaatgaatgaatgaatgaatgaatgaatgaatggagatgacgcctcagagattctttcttttgagatgaggtctcattctgtcacccagactagagggcagtggtgcaatcacagctcaccacagcctcaacctcctgggcctcccaagtagctgcgatcacaggtgtgcaccaacatgcccagctaatttttttttttaatttttaatttgtacagacagggtcttgctgtgttgcccaggctggtctcaaactcctgggctcaagtggtcctcccacctaagcttccccaaatactgggattataggtgtgagccactgtgcccaggcttgcctcagatatttgaaggctgggaaggattttgcaaagctgggaaaaggaaaaggcattcccagcagaggggatagcaggtggaaatacataattaaaaaaaaaaaacgtggagcagatccagcgcagtggctcatgcctgtaatcccagcactttgggaggcagagcagggaggattgcttgagtctaggagttcaagaccagcctgggtaacatagaaagaccctgtctctacaaaaacacaaaaaattagccaggcgtggtggtgcatgcctgtagtaccagctacttgagaagctgaggcaggaggactgcttgaagccaggagtttgagaccagcctgggcaacatagtgagaccccgtgtctacaaaaagtaaacatttatatatatattttttaaagtggagcagttcaatatagagtcttttttgaacaaacgtgaaatagatgtcttttttttttttttgagatggagttttcactcttgttacccaggctggagtgcaatggcgtgatcttggctcaccagaacctccgcctcctgggttcaaacaattctcctgcctcagcctcccaggtagctgggattacaggcatgcaccaccaaacccggataattttgtatttttagtagagatggggtttcaccatgttggtcaagctggtcttgaactcccgacctctgctgatccgtatgcctcggcctcccaaagtgctgggattacatgcgtgagccaccgtgcccgacaatagatgtcttttaattttctggaggaaaaagcaaagcaaaagaagcagtggatattttaagactaaaaaggaaaacaaaaaaaggagatagagcaggccagacgtggtggctcaacgtctgtaatcccagcactttgggaggccgaggcaggtggatcacctgaggtcaggagttcaagaccagcctgaccaacatggtgaaaccctgtttcaaaatacaaaaaattagctgggcgtggtggcgggcacctgtaatcccagctacttgggaggctgaggcaggagaatcccttgaacccaggaggtggaggttgcagtgagccgagatcacgccattgcactccagcctgggcgacaagtaaaaaactccatctcaaaaaaaaaaaaggagatagagcaaggaacagtaagaaaatagttgggtgcagtggctatgcggtggcactataggaggctgaggcgggcagatcacctgaggtcaggagttggagaccagcctgggcaacatagacccctatctctacaaaaaatttgaaatatgaaaaattagccaggtgtagtggtgtgcgcctgtggtaccagctactcaagaggcgaaggcagggaagattgcttgagcccaggagtttgaggctatagtgagctgtgatcatgccactgcactccagcctgggcaatagtgtgagactctgtctcaaaagaaagaacatggccaggcgtggtggctcacacctgtaatcccagcactttgggaggccgaggcagtcagatcatgaggccagtttgaaaccagcctggccaacatggtgaaaccctgtctctactaaaaatacaaaaattagccaggcgtggtggcatgcccccgtaatcccagctacttgggggtctgaggcagaagaattgcttgaaaccgggaggcagaggttgcagtgagccgagatcgtgtcattgcactctagtctgggcgacagagcaagactccgtcttggaaaaaaatttaa

SEQ ID NO: 1274 - DNA, 17245 bp, Homo sapiens
cctagcttggcgcggaatccgtgaattgcccgcggcccgagggtgcaggtgatgggtgctgaccgactggggaagcccggagtgtggggactgaggaggggagtggcctggggcgcgctggagcctgcgaggaaggcgccgcctcggatcccccgccccccattccccttcccgaattccaccctccggcccagccatggcctcagtttccccaaacaggaaagggaaggagggtgggcaccccggtctaacggtgcctctcagcctctgagacccagaaccttccttctgcagctcccggactgactggctctgcccttccccatggacgtaagtccgggccccttcccctctctgggccccctcagcgccctctcctaaccccgaatgggcctgtcttccagcacggactggggagggggcttctacccaacagagactacaacctgccagctcaggacgagagctgtcaggaagagtccaggaatggacttcccacgggagggcacatttctggtattcctggcaagataaggagttgactaagtaatccacgagaaaaggcatttccggcagaggaaacagtctgggggtgagagggaggctgcagcatttggggaactgctagggctatcgtgtgtttggaagagggggagggagagaggtaggcagggctaaattgggaattttgtcactgacataaattttaagtgccaggcgtggtggctgtcgcctgtaattccagctactgaggagactgaggtgggaggatcgtttaagcccaggagctcgaggctgcagcgagccatgatcatgccgctgcactccagcctgggtgacagagtgagacactgtctctaaaaaaattgaccaggtgcggtggctcatgcctggaatcccagcactttgggaggccgaggcgggcggatcacctgagatcaggagttcaagaccagcctggccaacatggcaaaaccccctctgtactaaaaatacaaacattagctgggcgtcgtggcgcgcacctgtaatcccagctactagggaggctgaagtaggagaatcgcttgaacccgggtggcagaggttgcatgaaccaagcttgccccactgctccagcctgggtgacagtgatactccgtctcaataagaataataataataaaataaataatagaaaaagttttaagtgagttactgggagccattgacggattgtaagggagggagggatactacacaaggacatctggtgtggaaaggggcaaaattgcaggttggatgacaggagccggtaatgtgggctgagggatggtaaaggagtggcaagggagtcagagacaagagatctctttggagaggcattccagaaggaaaatcagccctagaagactctagaatgctgaagtgcttgatgttgctgaactgggaatgatagggaaaaaggcaggctcagggcacaagataatgagtcagggtgtagtcctgttgacgctctccccaccatctggtggccgttcctctcccagccacctcctcgtccctcatggtattcccgtgttcctgcagcccctctccatctccttgtcaccccttcctcctgtactcgtccaggcctcctctagcccgtggaatccaaccccggctcctgtcagcagccctcccctgctgctccccatccctgccatcgtcttcatcgctgtgggcatctatttgttgctgctgggtctagtcctgctgactaggaactgcctgctggtgaggggtctggtcggggataaagggtgggctctggggaagaggaatcccggtaacctgtcccttcatctgcaggctcttaccctgagacacttgacatttagcccttgcatctatccgttttgtggtaccagggggtccctcctctcctgtccccagccaaaccttttcctttcccctcgggaaagctgccttggctgtcactacctgctgcctattccacatcctgaaccctgtgacctaggcccagggctgctgcgcggacggtagctccccctgcaggaagcaaggttcctccgggcccccagactgctgctggacctgtgcagaagcctgcaactttcctctgcctagcccggcccacttcctggatgcttgctgcccccagcccaccagagctgtgagttccattcctaccccctgccccactgagccctgatctaggtatgatcggtgcattcatttttttgctcaacaacatttattactgagcaccttctcaaggccaggcacggttccagggcatgaatcatgtgcagccaggtaaaaacaacctatcagataatgcctggtgatgaaagctacttgaagaaaataaaatagggtgccagctggagaaaggtgatgtgggtaacatgtagagtacatagccagcacttctaaatgaaagtgagctaaatgaaagttagctaaatgaaaaaacagctcacacagctcctttccgttcaccgaatgaactgtgttctaggtatagggcctctttacggacctttgtttttcccaacaaccctgagaactgagaactaagttgtttttttttctttcctccctccagagctgggtcctcccgtctcctcccctcccctcttcttttctttttgttgttgtttgagacagggtttcactctctcgcccaggctggagtgcagtggtgcgatctaggctcactgcaacctccacctcccaggctcaagtgattctcctgcctcagcctcctgaatagctgggattataggctcacacaactaccatatggctaatttttatatttttagtaaagacggggtttcatcatgttggccaggctggtctcgaactcctgacctcaaatgatccacccgccttggctgcccaacgtgctgggattacaggcgtgagccaccatggcccagccatggttttttttttttttttttttttgagacggagtctcgctctgttgcctaggctagagtacagtggtgtaatctcagctcactgcaatgtccacctcctgggttcaagcaattctcctgcctcagcctcctgagtagtaggaatacaggcgtgtgccaccacgcccagctaatttttgtatttttagtagagacggggtttcaccatgttggccaggctggtctcgaactcctgacctcaggtgatccagagctgggtattttttaaaacctatatgttttttctgattacaaaaagtattatttacaaagtatacatatagaaatacatggaaagtaccaatcactttacaaacccgctctctatcccaaagttgctgtgttttacatgtatctctcatatactaatacagtactatcactgctgtattttaccattatttggcaaaaatggggtggtatcatgtaggttatttcatcatacctgctactgtccccctatcccccgccttttttgagacacgatcttgctctgtcacccaggctggagtctggtggtgcaatcatagctcactgcagcctctacctcctggactgaagcaatcctcccacctcagcctcctgagtagctgagactataggtgcatgccaccacacccagctaatgtttatatctttcacacagatggggtttcatgttgttgcccaggctggtgttgaactcctgggctcaagcgatctgccatcctcagcctcccaaagtgctgggattacaggagtgagccaccatgcccagcctctacttgccctttttttttttttttttgagacgagtcttgctcttgtcacccaggctggagtgcaatggtgcaatctcggctcaccgcaatctctgcctactgggttcaagctattctcctgcctcagcctcccaagtagctgggattacagggatgcgccaccacactaggctaattttgtatttttagtagagacagggtttctccatgttggtcagggtggtctcgaactcccgacctcaggttatctgcctgcctcggcctcctaaagtgctggaattacagatgtgagccaccgggctcagcctctacttgccctttttaacctgacatcacacttcgccacctatccatgcctgtatgtgtagacacataagggttactgtcctcctcctgaagtggggagtaagctggcttagggaagtttagtggcttctccagagtgttacgcaggagagccttgcatcgcaaatagctccacagcgttagctgaggtagaatcctcaggggagaagcctggcttggagaagacaacctgtttctatttgtgggtttaaagatgttaaatgtaatcgaccaccgtcctgaggaatgattattttgagctcagcgattcagacagcaaagcccctgcccttggagtggtgacattccttccctaggatggaaggggaggataaaagcaaattcataacttgggcatatggtgattggtgctaatccctggcatgttttcagttttgaagtaaattgtggggcaaggagcgctttttcagataatcaccttctggtttgccaggggcagtcagcagaggggtctcaggtttggggctgaggggcagaagggcaaaaggaggagaccttgggttctgaaaactcctgtcttggcgtggtggcactcgcctgtaatcccagctactggaaaggctgaggcaggagaatagcttgaacccagtaggcagagattgcggtgagctgagatcatgccactgcactccagcctgggtgacagagtgagactctgtctcaaaaaaaaaaaaccaaagcaaaaaaacctcttgccttagaggagatgctccattagaaaatgatttctggccccctgtcctggggatgccgccccctaccccttctgtctatttgaagtgaatagccagggactcatcacctccttgggagagaggatgggtgaggtgcattgtaaggatagactgggccttcccaccttccccacagagggctgcaagaactttcaaacctggagacatcaggccctgatcctctctggtttctgctggagctaggaagggatttaacagggtggaggacagggcaggttctttctgtccttgagctgtctttccacaaagtatatttaagtccctccctcttcagtttccttgtaataacagcccagaaggttacaaatgtcttgccacttggcagctgtagacactgaggcttacggaggttggagtgacttggaggttatatggctggatcagctggaatagaaacccaggtttctcttccttactgagggagaaacatgcctgctcgcctgctctgcttcttttttttttcttttttcttttttttttgagacggagtcttgttctgtcacccatgctggagtgcagtggtgcaatcttggctcacttcaacctccgcctctcgggttcaagcgattctcctgcctcagcctcctgagtagctgggattacaggtgcccgccaccacacctggctaattttttgtatttttagtagagatggggtttcgtgttagccaggatggtcttgatctcctgacctcgtgatccgcccgccttggcctcccaaagtgctgggattacaggcgtgagccaccacgcctggcctgctctgcttctttcatgtgcatgttgcaaggttctcattcattcattcattcattcattgactcactcaccaaagatttatggagttactgttgaggcactgtctagggccttggggactcagcagaaacaagatggagaaggtccccagcctcgcagggcttccattctggtgatggagagagagaaataaccaggccattacaacagagggtgagaaatgacgtgctatggagcagcggttgctcagccctgcatgcgatcagaagcaggtataggacttaaaaggaaagccaggcatctaggccccacactgaggtctgggctggggctagagtttgtgaatcttttacaagttctcatatgattctgatgcacacaggttaagaaccactgctgagggaagaagctatgataagaatagctctctttcaggccgggtgcggtggctcatgcctgtaatcccagcactttgggaggccaaggcgggcagatcacaaggtcaggagttcgagaccatcctggctaacacggtaaaaccccgtctctactaaaatacaaaaaaaattagccgggcgtggtggcgggcgcctgtagtcccagctactcgggaggctgaggcaggagaatgctgtaaaacccgggaggcggaccttgcagtgagccgagatcgtgccactgcactccagcctgggagacagagcaagattccgtctcaaaaaataataataataataataatatctctctttcttttttttttttttcccaggcagggtctctcttgtcacccaggctggagtgcagtgctccctctgttgcccaggctggaatgcggtggcgtaatctcggctcactgcaacctccgtcccccaggttcgagtgattctcctgcctcagactcccaagtagctgagattacaggcacctgccaccatgcccggctaaagtttgtatttttagtagagacaggttttcaccatgttggccaggctggtcttgaattcctgacctcaggtgatccacctgccttggcctcccaaagtgctgcgattacatacaggcgtgagtcgccatgcccggccaagaacagctctctttcgtccagcactcattacttaccaggcatcgtgcttagttccttccaccgattcccgacaatggccttatgaactaggtcttatattttttcattttattttattttattcttttgagatggagtctcactctgttgcccaggctagagtgcagtaaaacaatctcggctcactgcaatctccatctcctgggtttaagcaagtctcccacctcagcctcccaagtagctgggaccacaggcgtgcgccaccatgcccagctaattttcgtatttttaatagagatgatgtttcaccatgttggccaggctagtcttgaactcctgatctcagatggtgcgcccaccttggcctcccaaagtgctgggattacaggtgtgagccaccacacctggccttaggtgttatattcctataaatgaggaaactgaggctgaaaaaatgaattagccaagctgaggttcaaacccaggccttactgactctagggcctgagctttaaccatctatacgatgatggctggctctcacagagacaacaggaaaaattcaagtgaaaaactctcctgagagccaggagagacacaagggttaacagtcttgcggagtccttgtttaatgtacttaaacagcagattccttccagaagccacatggctgcttgtaacggttgagaaatccattagccagttattaatgacaagatctaaacccttccaagggagagagccaagaaatgcttttaataccctcttttctgaggtaatggcagcagagcctctctcagccatgggttctgtgcacagaatgatggtgtggtccttcaaaagcccgcagaagtgatttcatccccagactgagactccctagagacaccccaaatcacaccctcatcaaacacaagaaaatcacttctctctcccccttccaccatgacggttctagcctcccccaaggaggcagttctgttgacagtagcacagcccaattcagacccctgtccctgcaggtggcaggtcccctcccctcactgcagcccctagtgatatctgatctcaccagccatctgacaccacaccctgaaacctcagctgttggaaaggtcattcccctattcctggcttggccaagtttctgattgaactgtacaactgtgactgtcactacctctgcctctggcctcaaggagccaatcttctgtcacacagccatcctgggccacttcagccatttggcctgactccagcccatgcctaaggcagttgcgggtcatccctgtcccaggggaggacagcagtgcactggatagaccagttctcccttcttgtctctaaggacacgctgctcctattccccaaagagacagacattgtttcctccaggagctgagaagccctcttctttcttctttgcctaaagaaggcaaatgatatgcttagattcatccattcattcagcattcatttatatctcagacacctgctgagcatgagtccagtgctagctcagtggagaatatgggatgagctgcccctgccctggcagacccagagagaggctgatgctcctggcactgggaggcagagggctcaagagggattgcaggcaggactgtacatcccagctccattcccatcacttgcctctctgtctatgcctccatttcctttttttttttttttttttttttttttttgaggcagagtcttgttctgttgcccaggctggagtgcagtgggtcgatctcggcttactgcaacctctgcctcccaggctcaagcgattctcctgcttcaggcttctgagtagctaggattacaggtgcaccccaccacgcccagctaatttttgtgtttttagtagagaagaggtttcgccatgttggcccagctggtcctgaattcctgaccttaagtgatccgcccaccttggcctcccaagttgttgggattacaggcatgagccaccatgtctaaccatccattttctcttttgtaaagaagcccattactcaggattctggtaattaaaaaatataaggctgggcgcggtggctcacacctgtaatcccagcactttgggaggccgaggtgggcggatcacctgaggtcaggagttcgagaccagcctgactaacatggtgaaaccctgtctctactaaaaatacaaaaattagctgggtgtagtggcgggcgcctgtaatcccagctactcaggaggctgagacaggagaatcacttgaacccgggaggcagaggttgccccaagctgagatcccaccattgcactccagcctgggtgacagagcaagactccgtttgaaaaaacaaacaaacaaatagatctaattcttttgaaaacattaaaattgattgggcgcagtggcgcatgcctgtaatcccagcactttgggagaccaaggtgggtttagcccaggagtttgagactagcctgggcaacatgatgaaaccctgtctctacaaaaaaatacaaaaaatgaattagccaggcgtggtggcacgtgcctgtaatcccagctacttgggaggctgaggcaggagaatcgcttgaacccaggaggcggaggttgcagtgagccgagaccgcgccatggcactccagcctggcaacagagcgagactccgtctcaaaaaaaaaaaaaaaaaagtacaaaaaatgagccgagcacggtggttcatgcctgtaatcccagcactttgggaggccaaggcgggcagatacctgaggtcaggaattcaagaccagcctggtcaacatagcgaaaccctgtctctactaaaaatacaaaattagccaagtgtggtggcacatgcctgtaatcccacctacttgggaggctgaggcaggagaaccgcttgaatccagaggtggaagttgcagtgagtggagatcacgccattgtgctccagcctgggcaacaggagtgaaactccatctcggaaaaaaaaaaaaaaaaatggccgggcacagttgctcactcctttaatcttagcactttgggaggctgaggcaggtggatcatctgaggccaggagttccgagaccagcctgaccaacatggtgaaacccccatctctactacaaatacaaaaattagctgggtgtggtggctcacgcctgtagttcagctactcagaaggctgaggcagaactacttgaacccaggaggtggaggttgcagtgagccaagatcgcaccattgcactccaccctgggcaacagagtgagaccctgtctcaaaaaaaaaaaaaaaattaaaaataggtaaattgccattttcaaagatacctgtaaagatttttaaaatcattcatgaatgcggtctgttcgttgcacagagtagatgctcaaaaatggtgaatgagaccctctattttggtctcatgctgaagaagtccataaagcccacaagtcattttcatgatggacagaaaaatgtgtgtgctttctctgtctactgcctcaactgcacagaccccgggactgtagcagaaccatcttttgagcttgacaccgggaggcccaaattctagcacgggacccagggccagttgctctctggtcctcagtctcctcacccataaaatgggaaggagagaaccctgaatcattgcttctagcttctgaactcagttgttcagaacaaggactcactgctgatttttcaacagcacagggaattgcactgttcctgggaatgatggacagtaccctctgttccactgggcaagtgagatttcccaggcctctctgttcccttctccccttagagagcaacagacgtggccccatcccacctccctcaaccctctctctcctccctcaggactgggcacctcgctgcccccgctgctgcccactctgcgactgtgcctgtacgtgccagctccccgactgccagagcctcaactgtctctgcttcgagatcaagctccgatgaggacccagggcccctgccctctggggagcggccagcccccagggcccatgtgccctcctccctgaagagcctttccccacgccactggaaccacagatggcctgccgagcacccaggcctgggaactggaagtggcagcgcagggcctggctccctgcagggcaggactcttggccggctggacggcagctcctctggagggccagaaaagagaggggctagtgctcgggcaggtgccctggcttcccttcccctccacacgtcaacgattctatttgaagttgggcaggggggtggcgctgctcaccacacacaagtgttataggaggagtctggcccttgagtaccgggtacgcaggggtgcctcaaccacactccgtccacggactctccgttattttaggaggtgagtgtagtgccagtatctactctccttcttaaaaaaaaccagggctccagagaatcagaacagccaccatcaccgcagggagtcaagggaggagggagattagagaaggagccagggagggtggcagggaggccacgtgatccgagtcccctcacccctttccttcccacaggtccctggccaaagatttatttctcttgacaaccaagggcctccgtctggatttccaaggaagaatttcctctgaagcaccggtgagtgggcaggggctccctccccatcaatagggccgacccaagtcttcctcccccttcccccatgccgggccccacgatagtgtgaatgtcaggggcttcaggtttccctaaatataggtccctgccagaggatccgtggcgggaaaagggcaggggtcattagagaagatcggggacacatgtggggcgggcaggagctgccttataaccagcccgggaacccctagctcactcgctgctgaccaggctctgccggctccttcggcctcgccgcaggtgggccccttgcaggaccgggccggggtggggatggggttggggttgggccaacagggtccagatggggtccaggtgaggaggggagatttggacgataggagcagggggctcagcatctgggaggcagatcagttcggggacggattttcttttggagaaggaagtcaggctcaaggaagacgtttggcaggaactgtgaccccgcatgccagaggccgagcagcggccggtgcatagccgcgcattctggttttctgtggcgcagaggactaccagcctggctgcggcggcccggcggagagcgcgcacgcatgcgcgacccagcccggcctgccagcctggaactcggatggggaggtctcgcctccgcgcgccgctagttccgccgccttctcgcgctccctgcgtgtcctctcgatgccctttcctccgcctcccttacgcctgggccagtgacagggtgtcggctccgcgccgattcagcccgcgggcgaggcaggctaacgcacgactgcgcgatgtggcccctatggtgacacgcgctgcagccgcgaagaccggaagctggggcggccccgggccgcgcgcgctgggcctgggaggcgaaactcagcttccttcgtttccgacttttccatccgcgtcctccacttccccgttccgccctcccccattgccaacattctggctgagtcacggcgccccagagcgcgccaggctgggggaaaggagcagaagggagggccctagcgacccgcgggatgtggtccgagtcacgtccgaggggggtggggagggatcgtgttctcggcgcccgccccttcctagcgcggcctctgggctgcgcctctcgggggcggcccgtagcccagtccgtcgcctgccattggacgccgcccgctcctcgtaaaggaaaaagctcggcggagggcggagtggtgcctttaaaaggccgggcgccgccttccgcctgcccgcctcctgcgccgccccttccgaggctaaatcggctgcgttcctctcggaacgcgccgcagaaggggtcctggtgacgagtcccgcgttctctccttgaatccactcgccagcccgccgccctctgccgccgcaccctgcacacccgcccctctcctgtgccaggtgagcgcccctcttcacgtgcggggaccagggaccgtggagagggatcttgggggcagtggcgggttgggcgtccgcgtggaggcctcccccatcccatgccagcgtctccccactaccaggcacacacaggctccccggcccctccagcctgaggtcctctaactgcgcaatgcagcggctgcgcgcgctgagtcatggcgggggaggaagccggacgagatgaaggaccattctcccccttttcttgcagggacccctgtggcaaaggattagggccccttagccctggcggggatcctaagaggcagtgaggggtgggggccggcccatgtacagccccagggttctcgcaagtgggagcttggtttctgtcctgggaaacggggcgcccttcgcgaggagggaaacccctccgcggtgcttgatgcccccttaacactttccctgtctctccttatcgggcgaccttgattctgagcccggaacagctgcagccatgcgaagcgacgggagcatttttcaggggaaggcgcttgctcctccacgttcttgccccgtaggaacagtgacgatggcaaagcttaccgctttcctcgcctcgggctagggcttgttccgccgccctttcctgggcttctccttgctctcttatatttttcctaatgcccctttcctaccacccgccccctcccttgtggggaaaagcctgaccttgggatgtccttgaagccttggagcccgggccagccctgggatcttgaggggattggaaggaacaccccagtggcagtcagaagagctgggttctaatctcagatctggctccggggttgctgtgtggcttgaagcacagacctttcccatatctgggccctttcccacgagggtgttgggccctctgcttgattcacgatctttacattctaaaatactccggttcggttttgttttcaggcaaggtgaccccatggcaaggcgcaagccagaagggtccagcttcaacatgacccacctgtccatggctatggccttttcctttcccccagttgccagtgggcaactccaccctcagctgggcaacacccagcaccagacagagttaggaaaggtacaggggcaggcctagcaaagggaagttgggcgtaagagagagctggggaccagaagtgccccagggcctgctgggtgtggggcaggggaggtagggaacatttccctgacctccaggagaggggccctggtcatcgggagatgatgggaaaccctagctaactagtccttcccctctgtttcctgtatccaggaacttgctactaccagcaccatgccctaccaatatccagcactgaccccggagcagaagaaggagctgtctgacatcgctcaccgcatcgtggcacctggcaagggcatcctggctgcagatgagtccactggtgcgggcaggagacagaatgggtggagggtgcagggttgggagtggcaggctgatcccctaattcccatgtgacactcccagggagcattgccaagcggctgcagtccattggcaccgagaacaccgaggagaaccggcgcttctaccgccagctgctgctgacagctgacgaccgcgtgaacccctgcattgggggtgtcatcctcttccatgagacactctaccagaaggcggatgatgggcgtcccttcccccaagttatcaaatccaagggcggtgttgtgggcatcaaggtaaggggagggcctccggacgtgaggtttgagatggaagtggaggaaggaaatccaggttagtgaggcagggaatgaatgctggattggtggcctagagacttgcatggagcctgcttcaggcttagggcatttactcgacatttttaatcctcacaattctgagagaacagtatcattcccactttacacatgaaaatctcagaagctcagggaagtgaagtgttttgctcagagtaagtggcagagccccagtctgacacccaattcactcaacatttctgttgtcaaataacatcccagtgtatcctgtctcagaggattgttactaagtgaactaagtgaaaatattttaatttaattgtaactaagtatttgagtaactaaacattttaagtaaattttttttttttttttttttgagatggagtctcgctgtctcccaggctggagtgcagtggtgcgatctcttggctcactgcaagttccgcctcccaggttcacgccattctcctgcctcagcctcccgagtagctgggactacaggcgcccgccaccacccggctaattttttttgtatttttagtagacactgggtttcaccatgttagccaggatggtctcgatctcctgatctcgtgatctgcccacctcggcctcccaaagtgctgggattacaggcgtgagccaccatgcccggcttaagtaactaaatattttaattgtaactaagtgaaaatatttgccagccctgagatgcagtttaagggattaagtaaatgtgggggaagactggggctaaagaagaggaaagaggggcacgcccagctacctaggaggctgaggcgggaggatcacttgagtccaggaagtggaggcttcagtgagctgagattccaccactgtactccagccggggcgacagtggaaagggtgctagaggtcatttcctgtgtcttaatgttgttaccctgaccccaacaggtagacaagggcgtggtccccctggcagggacaaatggcgagactaccacccaaggtgagaactgtttgattctctgccctacgaacccaaccagagcaggtttgggtgctgggaggagtggaaaccacatgcccctccccaccgtgctctgaccccttcctcttctcttagggttggatgggctgtctgagcgctgtgcccagtacaagaaggacggagctgacttcgccaagtggcgttgtgtgctgaagattggggaacacaccccctcagccctcgccatcatggaaaatgccaatgttctggcccgttatgccagtatctgccagcaggtgggcctgcaggtcctcaataggcaacctcctacctcatttggttccagtgttgttaatttgcctattacctgccatgatgcctacctccccaaaagcaagcattagctttggcccgtggaggacactcaagggctgttgaaggcagaggggccaaggagggatggtgggtggatctgaggcggctcttgtctcctgtaatctgagggctttgaagcctgagtccctggcatcatcaagatacggtcttgaccagtggctgtggagagatgtaggtgggactctgggttaggaggcctcacagtgaccctgtccctcgccctgcagaatggcattgtgcccatcgtggagcctgagatcctccctgatggggaccatgacttgaagcgctgccagtatgtgaccgagaaggtaaatggctacctgcctgaccagtgcaaggtggctggccggggaccctggggctaacccctatcctctcctccaccccactacccaccgtgcgcctgctctgctccaggtgctggctgctgtctacaaggctctgagtgaccaccacatctacctggaaggcaccttgctgaagcccaacatggtcaccccaggccatgcttgcactcagaagttttctcatgaggagattgccatggcgaccgtcacagcgctgcgccgcacagtgccccccgctgtcactggtgaggcccacactcatcttgatctctatgcagtagataagctccacccacaaccctatgcccatttggacggatttccatggcaacttccaccagctcctgccagcttcctgggtctctgaccacagcccctctcgcctcacccctgctctacagggatcaccttcctgtctggaggccagagtgaggaggaggcgtccatcaacctcaatgccattaacaagtgccccctgctgaagccctgggccctgaccttctcctacggccgagccctgcaggcctctgccctgaaggcctggggcgggaagaaggagaacctgaaggctgcgcaggaggagtatgtcaagcgagccctggtaaggataggcaggaggtgggcagggtgcctgggtggatgggactcggagaagagcccttctcactccacccctctccctgcttaggccaacagccttgcctgtcaaggaaagtacactccgagcggtcaggctggggctgctgccagcgagtccctcttcgtctctaaccacgcctattaagcggaggtgttcccaggctgcccccaacactccaggccctgccccctcccactcttgaagaggaggccgcctcctcggggctccaggctggcttgcccgcgctctttcttccctcgtgacagtggtgtgtggtgtcgtctgtgaatgctaagtccatcaccctttccggcacactgccaaataaacagctatttaaggggga

SEQ ID NO: 1275 - DNA, 5763 bp, Homo sapiens
aaaagggcaggggtcattagagaagatcggggacacatgtggggcgggcaggagctgccttataaccagcccgggaacccctagctcactcgctgctgaccaggctctgccggctccttcggcctcgccgcaggtgggccccttgcaggaccgggccggggtggggatggggttggggttgggccaacagggtccagatggggtccaggtgaggaggggagatttggacgataggagcagggggctcagcatctgggaggcagatcagttcggggacggattttcttttggagaaggaagtcaggctcaaggaagacgtttggcaggaactgtgaccccgcatgccagaggccgagcagcggccggtgcatagccgcgcattctggttttctgtggcgcagaggactaccagcctggctgcggcggcccggcggagagcgcgcacgcatgcgcgacccagcccggcctgccagcctggaactcggatggggaggtctcgcctccgcgcgccgctagttccgccgccttctcgcgctccctgcgtgtcctctcgatgccctttcctccgcctcccttacgcctgggccagtgacagggtgtcggctccgcgccgattcagcccgcgggcgaggcaggctaacgcacgactgcgcgatgtggcccctatggtgacacgcgctgcagccgcgaagaccggaagctggggcggccccgggccgcgcgcgctgggcctgggaggcgaaactcagcttccttcgtttccgacttttccatccgcgtcctccacttccccgttccgccctcccccattgccaacattctggctgagtcacggcgccccagagcgcgccaggctgggggaaaggagcagaagggagggccctagcgacccgcgggatgtggtccgagtcacgtccgaggggggtggggagggatcgtgttctcggcgcccgccccttcctagcgcggcctctgggctgcgcctctcgggggcggcccgtagcccagtccgtcgcctgccattggacgccgcccgctcctcgtaaaggaaaaagctcggcggagggcggagtggtgcctttaaaaggccgggcgccgccttccgcctgcccgcctcctgcgccgccccttccgaggctaaatcggctgcgttcctctcggaacgcgccgcagaaggggtcctggtgacgagtcccgcgttctctccttgaatccactcgccagcccgccgccctctgccgccgcaccctgcacacccgcccctctcctgtgccaggtgagcgcccctcttcacgtgcggggaccagggaccgtggagagggatcttgggggcagtggcgggttgggcgtccgcgtggaggcctcccccatcccatgccagcgtctccccactaccaggcacacacaggctccccggcccctccagcctgaggtcctctaactgcgcaatgcagcggctgcgcgcgctgagtcatggcgggggaggaagccggacgagatgaaggaccattctcccccttttcttgcagggacccctgtggcaaaggattagggccccttagccctggcggggatcctaagaggcagtgaggggtgggggccggcccatgtacagccccagggttctcgcaagtgggagcttggtttctgtcctgggaaacggggcgcccttcgcgaggagggaaacccctccgcggtgcttgatgcccccttaacactttccctgtctctccttatcgggcgaccttgattctgagcccggaacagctgcagccatgcgaagcgacgggagcatttttcaggggaaggcgcttgctcctccacgttcttgccccgtaggaacagtgacgatggcaaagcttaccgctttcctcgcctcgggctagggcttgttccgccgccctttcctgggcttctccttgctctcttatatttttcctaatgcccctttcctaccacccgccccctcccttgtggggaaaagcctgaccttgggatgtccttgaagccttggagcccgggccagccctgggatcttgaggggattggaaggaacaccccagtggcagtcagaagagctgggttctaatctcagatctggctccggggttgctgtgtggcttgaagcacagacctttcccatatctgggccctttcccacgagggtgttgggccctctgcttgattcacgatctttacattctaaaatactccggttcggttttgttttcaggcaaggtgaccccatggcaaggcgcaagccagaagggtccagcttcaacatgacccacctgtccatggctatggccttttcctttcccccagttgccagtgggcaactccaccctcagctgggcaacacccagcaccagacagagttaggaaaggtacaggggcaggcctagcaaagggaagttgggcgtaagagagagctggggaccagaagtgccccagggcctgctgggtgtggggcaggggaggtagggaacatttccctgacctccaggagaggggccctggtcatcgggagatgatgggaaaccctagctaactagtccttcccctctgtttcctgtatccaggaacttgctactaccagcaccatgccctaccaatatccagcactgaccccggagcagaagaaggagctgtctgacatcgctcaccgcatcgtggcacctggcaagggcatcctggctgcagatgagtccactggtgcgggcaggagacagaatgggtggagggtgcagggttgggagtggcaggctgatcccctaattcccatgtgacactcccagggagcattgccaagcggctgcagtccattggcaccgagaacaccgaggagaaccggcgcttctaccgccagctgctgctgacagctgacgaccgcgtgaacccctgcattgggggtgtcatcctcttccatgagacactctaccagaaggcggatgatgggcgtcccttcccccaagttatcaaatccaagggcggtgttgtgggcatcaaggtaaggggagggcctccggacgtgaggtttgagatggaagtggaggaaggaaatccaggttagtgaggcagggaatgaatgctggattggtggcctagagacttgcatggagcctgcttcaggcttagggcatttactcgacatttttaatcctcacaattctgagagaacagtatcattcccactttacacatgaaaatctcagaagctcagggaagtgaagtgttttgctcagagtaagtggcagagccccagtctgacacccaattcactcaacatttctgttgtcaaataacatcccagtgtatcctgtctcagaggattgttactaagtgaactaagtgaaaatattttaatttaattgtaactaagtatttgagtaactaaacattttaagtaaattttttttttttttttttttgagatggagtctcgctgtctcccaggctggagtgcagtggtgcgatctcttggctcactgcaagttccgcctcccaggttcacgccattctcctgcctcagcctcccgagtagctgggactacaggcgcccgccaccacccggctaattttttttgtatttttagtagacactgggtttcaccatgttagccaggatggtctcgatctcctgatctcgtgatctgcccacctcggcctcccaaagtgctgggattacaggcgtgagccaccatgcccggcttaagtaactaaatattttaattgtaactaagtgaaaatatttgccagccctgagatgcagtttaagggattaagtaaatgtgggggaagactggggctaaagaagaggaaagaggggcacgcccagctacctaggaggctgaggcgggaggatcacttgagtccaggaagtggaggcttcagtgagctgagattccaccactgtactccagccggggcgacagtggaaagggtgctagaggtcatttcctgtgtcttaatgttgttaccctgaccccaacaggtagacaagggcgtggtccccctggcagggacaaatggcgagactaccacccaaggtgagaactgtttgattctctgccctacgaacccaaccagagcaggtttgggtgctgggaggagtggaaaccacatgcccctccccaccgtgctctgaccccttcctcttctcttagggttggatgggctgtctgagcgctgtgcccagtacaagaaggacggagctgacttcgccaagtggcgttgtgtgctgaagattggggaacacaccccctcagccctcgccatcatggaaaatgccaatgttctggcccgttatgccagtatctgccagcaggtgggcctgcaggtcctcaataggcaacctcctacctcatttggttccagtgttgttaatttgcctattacctgccatgatgcctacctccccaaaagcaagcattagctttggcccgtggaggacactcaagggctgttgaaggcagaggggccaaggagggatggtgggtggatctgaggcggctcttgtctcctgtaatctgagggctttgaagcctgagtccctggcatcatcaagatacggtcttgaccagtggctgtggagagatgtaggtgggactctgggttaggaggcctcacagtgaccctgtccctcgccctgcagaatggcattgtgcccatcgtggagcctgagatcctccctgatggggaccatgacttgaagcgctgccagtatgtgaccgagaaggtaaatggctacctgcctgaccagtgcaaggtggctggccggggaccctggggctaacccctatcctctcctccaccccactacccaccgtgcgcctgctctgctccaggtgctggctgctgtctacaaggctctgagtgaccaccacatctacctggaaggcaccttgctgaagcccaacatggtcaccccaggccatgcttgcactcagaagttttctcatgaggagattgccatggcgaccgtcacagcgctgcgccgcacagtgccccccgctgtcactggtgaggcccacactcatcttgatctctatgcagtagataagctccacccacaaccctatgcccatttggacggatttccatggcaacttccaccagctcctgccagcttcctgggtctctgaccacagcccctctcgcctcacccctgctctacagggatcaccttcctgtctggaggccagagtgaggaggaggcgtccatcaacctcaatgccattaacaagtgccccctgctgaagccctgggccctgaccttctcctacggccgagccctgcaggcctctgccctgaaggcctggggcgggaagaaggagaacctgaaggctgcgcaggaggagtatgtcaagcgagccctggtaaggataggcaggaggtgggcagggtgcctgggtggatgggactcggagaagagcccttctcactccacccctctccctgcttaggccaacagccttgcctgtcaaggaaagtacactccgagcggtcaggctggggctgctgccagcgagtccctcttcgtctctaaccacgcctattaagcggaggtgttcccaggctgcccccaacactccaggccctgccccctcccactcttgaagaggaggccgcctcctcggggctccaggctggcttgcccgcgctctttcttccctcgtgacagtggtgtgtggtgtcgtctgtgaatgctaagtccatcaccctttccggcacactgccaaataaacagctatttaaggggga

SEQ ID NO: 1276 - DNA, 4749 bp, Homo sapiens
cattggacgccgcccgctcctcgtaaaggaaaaagctcggcggagggcggagtggtgcctttaaaaggccgggcgccgccttccgcctgcccgcctcctgcgccgccccttccgaggctaaatcggctgcgttcctctcggaacgcgccgcagaaggggtcctggtgacgagtcccgcgttctctccttgaatccactcgccagcccgccgccctctgccgccgcaccctgcacacccgcccctctcctgtgccaggtgagcgcccctcttcacgtgcggggaccagggaccgtggagagggatcttgggggcagtggcgggttgggcgtccgcgtggaggcctcccccatcccatgccagcgtctccccactaccaggcacacacaggctccccggcccctccagcctgaggtcctctaactgcgcaatgcagcggctgcgcgcgctgagtcatggcgggggaggaagccggacgagatgaaggaccattctcccccttttcttgcagggacccctgtggcaaaggattagggccccttagccctggcggggatcctaagaggcagtgaggggtgggggccggcccatgtacagccccagggttctcgcaagtgggagcttggtttctgtcctgggaaacggggcgcccttcgcgaggagggaaacccctccgcggtgcttgatgcccccttaacactttccctgtctctccttatcgggcgaccttgattctgagcccggaacagctgcagccatgcgaagcgacgggagcatttttcaggggaaggcgcttgctcctccacgttcttgccccgtaggaacagtgacgatggcaaagcttaccgctttcctcgcctcgggctagggcttgttccgccgccctttcctgggcttctccttgctctcttatatttttcctaatgcccctttcctaccacccgccccctcccttgtggggaaaagcctgaccttgggatgtccttgaagccttggagcccgggccagccctgggatcttgaggggattggaaggaacaccccagtggcagtcagaagagctgggttctaatctcagatctggctccggggttgctgtgtggcttgaagcacagacctttcccatatctgggccctttcccacgagggtgttgggccctctgcttgattcacgatctttacattctaaaatactccggttcggttttgttttcaggcaaggtgaccccatggcaaggcgcaagccagaagggtccagcttcaacatgacccacctgtccatggctatggccttttcctttcccccagttgccagtgggcaactccaccctcagctgggcaacacccagcaccagacagagttaggaaaggtacaggggcaggcctagcaaagggaagttgggcgtaagagagagctggggaccagaagtgccccagggcctgctgggtgtggggcaggggaggtagggaacatttccctgacctccaggagaggggccctggtcatcgggagatgatgggaaaccctagctaactagtccttcccctctgtttcctgtatccaggaacttgctactaccagcaccatgccctaccaatatccagcactgaccccggagcagaagaaggagctgtctgacatcgctcaccgcatcgtggcacctggcaagggcatcctggctgcagatgagtccactggtgcgggcaggagacagaatgggtggagggtgcagggttgggagtggcaggctgatcccctaattcccatgtgacactcccagggagcattgccaagcggctgcagtccattggcaccgagaacaccgaggagaaccggcgcttctaccgccagctgctgctgacagctgacgaccgcgtgaacccctgcattgggggtgtcatcctcttccatgagacactctaccagaaggcggatgatgggcgtcccttcccccaagttatcaaatccaagggcggtgttgtgggcatcaaggtaaggggagggcctccggacgtgaggtttgagatggaagtggaggaaggaaatccaggttagtgaggcagggaatgaatgctggattggtggcctagagacttgcatggagcctgcttcaggcttagggcatttactcgacatttttaatcctcacaattctgagagaacagtatcattcccactttacacatgaaaatctcagaagctcagggaagtgaagtgttttgctcagagtaagtggcagagccccagtctgacacccaattcactcaacatttctgttgtcaaataacatcccagtgtatcctgtctcagaggattgttactaagtgaactaagtgaaaatattttaatttaattgtaactaagtatttgagtaactaaacattttaagtaaattttttttttttttttttttgagatggagtctcgctgtctcccaggctggagtgcagtggtgcgatctcttggctcactgcaagttccgcctcccaggttcacgccattctcctgcctcagcctcccgagtagctgggactacaggcgcccgccaccacccggctaattttttttgtatttttagtagacactgggtttcaccatgttagccaggatggtctcgatctcctgatctcgtgatctgcccacctcggcctcccaaagtgctgggattacaggcgtgagccaccatgcccggcttaagtaactaaatattttaattgtaactaagtgaaaatatttgccagccctgagatgcagtttaagggattaagtaaatgtgggggaagactggggctaaagaagaggaaagaggggcacgcccagctacctaggaggctgaggcgggaggatcacttgagtccaggaagtggaggcttcagtgagctgagattccaccactgtactccagccggggcgacagtggaaagggtgctagaggtcatttcctgtgtcttaatgttgttaccctgaccccaacaggtagacaagggcgtggtccccctggcagggacaaatggcgagactaccacccaaggtgagaactgtttgattctctgccctacgaacccaaccagagcaggtttgggtgctgggaggagtggaaaccacatgcccctccccaccgtgctctgaccccttcctcttctcttagggttggatgggctgtctgagcgctgtgcccagtacaagaaggacggagctgacttcgccaagtggcgttgtgtgctgaagattggggaacacaccccctcagccctcgccatcatggaaaatgccaatgttctggcccgttatgccagtatctgccagcaggtgggcctgcaggtcctcaataggcaacctcctacctcatttggttccagtgttgttaatttgcctattacctgccatgatgcctacctccccaaaagcaagcattagctttggcccgtggaggacactcaagggctgttgaaggcagaggggccaaggagggatggtgggtggatctgaggcggctcttgtctcctgtaatctgagggctttgaagcctgagtccctggcatcatcaagatacggtcttgaccagtggctgtggagagatgtaggtgggactctgggttaggaggcctcacagtgaccctgtccctcgccctgcagaatggcattgtgcccatcgtggagcctgagatcctccctgatggggaccatgacttgaagcgctgccagtatgtgaccgagaaggtaaatggctacctgcctgaccagtgcaaggtggctggccggggaccctggggctaacccctatcctctcctccaccccactacccaccgtgcgcctgctctgctccaggtgctggctgctgtctacaaggctctgagtgaccaccacatctacctggaaggcaccttgctgaagcccaacatggtcaccccaggccatgcttgcactcagaagttttctcatgaggagattgccatggcgaccgtcacagcgctgcgccgcacagtgccccccgctgtcactggtgaggcccacactcatcttgatctctatgcagtagataagctccacccacaaccctatgcccatttggacggatttccatggcaacttccaccagctcctgccagcttcctgggtctctgaccacagcccctctcgcctcacccctgctctacagggatcaccttcctgtctggaggccagagtgaggaggaggcgtccatcaacctcaatgccattaacaagtgccccctgctgaagccctgggccctgaccttctcctacggccgagccctgcaggcctctgccctgaaggcctggggcgggaagaaggagaacctgaaggctgcgcaggaggagtatgtcaagcgagccctggtaaggataggcaggaggtgggcagggtgcctgggtggatgggactcggagaagagcccttctcactccacccctctccctgcttaggccaacagccttgcctgtcaaggaaagtacactccgagcggtcaggctggggctgctgccagcgagtccctcttcgtctctaaccacgcctattaagcggaggtgttcccaggctgcccccaacactccaggccctgccccctcccactcttgaagaggaggccgcctcctcggggctccaggctggcttgcccgcgctctttcttccctcgtgacagtggtgtgtggtgtcgtctgtgaatgctaagtccatcaccctttccggcacactgccaaataaacagctatttaagggggagtcggc

SEQ ID NO: 1277 - DNA, 4692 bp, Homo sapiens
gtggtgcctttaaaaggccgggcgccgccttccgcctgcccgcctcctgcgccgccccttccgaggctaaatcggctgcgttcctctcggaacgcgccgcagaaggggtcctggtgacgagtcccgcgttctctccttgaatccactcgccagcccgccgccctctgccgccgcaccctgcacacccgcccctctcctgtgccaggtgagcgcccctcttcacgtgcggggaccagggaccgtggagagggatcttgggggcagtggcgggttgggcgtccgcgtggaggcctcccccatcccatgccagcgtctccccactaccaggcacacacaggctccccggcccctccagcctgaggtcctctaactgcgcaatgcagcggctgcgcgcgctgagtcatggcgggggaggaagccggacgagatgaaggaccattctcccccttttcttgcagggacccctgtggcaaaggattagggccccttagccctggcggggatcctaagaggcagtgaggggtgggggccggcccatgtacagccccagggttctcgcaagtgggagcttggtttctgtcctgggaaacggggcgcccttcgcgaggagggaaacccctccgcggtgcttgatgcccccttaacactttccctgtctctccttatcgggcgaccttgattctgagcccggaacagctgcagccatgcgaagcgacgggagcatttttcaggggaaggcgcttgctcctccacgttcttgccccgtaggaacagtgacgatggcaaagcttaccgctttcctcgcctcgggctagggcttgttccgccgccctttcctgggcttctccttgctctcttatatttttcctaatgcccctttcctaccacccgccccctcccttgtggggaaaagcctgaccttgggatgtccttgaagccttggagcccgggccagccctgggatcttgaggggattggaaggaacaccccagtggcagtcagaagagctgggttctaatctcagatctggctccggggttgctgtgtggcttgaagcacagacctttcccatatctgggccctttcccacgagggtgttgggccctctgcttgattcacgatctttacattctaaaatactccggttcggttttgttttcaggcaaggtgaccccatggcaaggcgcaagccagaagggtccagcttcaacatgacccacctgtccatggctatggccttttcctttcccccagttgccagtgggcaactccaccctcagctgggcaacacccagcaccagacagagttaggaaaggtacaggggcaggcctagcaaagggaagttgggcgtaagagagagctggggaccagaagtgccccagggcctgctgggtgtggggcaggggaggtagggaacatttccctgacctccaggagaggggccctggtcatcgggagatgatgggaaaccctagctaactagtccttcccctctgtttcctgtatccaggaacttgctactaccagcaccatgccctaccaatatccagcactgaccccggagcagaagaaggagctgtctgacatcgctcaccgcatcgtggcacctggcaagggcatcctggctgcagatgagtccactggtgcgggcaggagacagaatgggtggagggtgcagggttgggagtggcaggctgatcccctaattcccatgtgacactcccagggagcattgccaagcggctgcagtccattggcaccgagaacaccgaggagaaccggcgcttctaccgccagctgctgctgacagctgacgaccgcgtgaacccctgcattgggggtgtcatcctcttccatgagacactctaccagaaggcggatgatgggcgtcccttcccccaagttatcaaatccaagggcggtgttgtgggcatcaaggtaaggggagggcctccggacgtgaggtttgagatggaagtggaggaaggaaatccaggttagtgaggcagggaatgaatgctggattggtggcctagagacttgcatggagcctgcttcaggcttagggcatttactcgacatttttaatcctcacaattctgagagaacagtatcattcccactttacacatgaaaatctcagaagctcagggaagtgaagtgttttgctcagagtaagtggcagagccccagtctgacacccaattcactcaacatttctgttgtcaaataacatcccagtgtatcctgtctcagaggattgttactaagtgaactaagtgaaaatattttaatttaattgtaactaagtatttgagtaactaaacattttaagtaaattttttttttttttttttttgagatggagtctcgctgtctcccaggctggagtgcagtggtgcgatctcttggctcactgcaagttccgcctcccaggttcacgccattctcctgcctcagcctcccgagtagctgggactacaggcgcccgccaccacccggctaattttttttgtatttttagtagacactgggtttcaccatgttagccaggatggtctcgatctcctgatctcgtgatctgcccacctcggcctcccaaagtgctgggattacaggcgtgagccaccatgcccggcttaagtaactaaatattttaattgtaactaagtgaaaatatttgccagccctgagatgcagtttaagggattaagtaaatgtgggggaagactggggctaaagaagaggaaagaggggcacgcccagctacctaggaggctgaggcgggaggatcacttgagtccaggaagtggaggcttcagtgagctgagattccaccactgtactccagccggggcgacagtggaaagggtgctagaggtcatttcctgtgtcttaatgttgttaccctgaccccaacaggtagacaagggcgtggtccccctggcagggacaaatggcgagactaccacccaaggtgagaactgtttgattctctgccctacgaacccaaccagagcaggtttgggtgctgggaggagtggaaaccacatgcccctccccaccgtgctctgaccccttcctcttctcttagggttggatgggctgtctgagcgctgtgcccagtacaagaaggacggagctgacttcgccaagtggcgttgtgtgctgaagattggggaacacaccccctcagccctcgccatcatggaaaatgccaatgttctggcccgttatgccagtatctgccagcaggtgggcctgcaggtcctcaataggcaacctcctacctcatttggttccagtgttgttaatttgcctattacctgccatgatgcctacctccccaaaagcaagcattagctttggcccgtggaggacactcaagggctgttgaaggcagaggggccaaggagggatggtgggtggatctgaggcggctcttgtctcctgtaatctgagggctttgaagcctgagtccctggcatcatcaagatacggtcttgaccagtggctgtggagagatgtaggtgggactctgggttaggaggcctcacagtgaccctgtccctcgccctgcagaatggcattgtgcccatcgtggagcctgagatcctccctgatggggaccatgacttgaagcgctgccagtatgtgaccgagaaggtaaatggctacctgcctgaccagtgcaaggtggctggccggggaccctggggctaacccctatcctctcctccaccccactacccaccgtgcgcctgctctgctccaggtgctggctgctgtctacaaggctctgagtgaccaccacatctacctggaaggcaccttgctgaagcccaacatggtcaccccaggccatgcttgcactcagaagttttctcatgaggagattgccatggcgaccgtcacagcgctgcgccgcacagtgccccccgctgtcactggtgaggcccacactcatcttgatctctatgcagtagataagctccacccacaaccctatgcccatttggacggatttccatggcaacttccaccagctcctgccagcttcctgggtctctgaccacagcccctctcgcctcacccctgctctacagggatcaccttcctgtctggaggccagagtgaggaggaggcgtccatcaacctcaatgccattaacaagtgccccctgctgaagccctgggccctgaccttctcctacggccgagccctgcaggcctctgccctgaaggcctggggcgggaagaaggagaacctgaaggctgcgcaggaggagtatgtcaagcgagccctggtaaggataggcaggaggtgggcagggtgcctgggtggatgggactcggagaagagcccttctcactccacccctctccctgcttaggccaacagccttgcctgtcaaggaaagtacactccgagcggtcaggctggggctgctgccagcgagtccctcttcgtctctaaccacgcctattaagcggaggtgttcccaggctgcccccaacactccaggccctgccccctcccactcttgaagaggaggccgcctcctcggggctccaggctggcttgcccgcgctctttcttccctcgtgacagtggtgtgtggtgtcgtctgtgaatgctaagtccatcaccctttccggcacactgccaaataaacagctatttaaggggga

SEQ ID NO: 1278 - DNA, 6136 bp, Homo sapiens
cttaaaaaaaaccagggctccagagaatcagaacagccaccatcaccgcagggagtcaagggaggagggagattagagaaggagccagggagggtggcagggaggccacgtgatccgagtcccctcacccctttccttcccacaggtccctggccaaagatttatttctcttgacaaccaagggcctccgtctggatttccaaggaagaatttcctctgaagcaccggtgagtgggcaggggctccctccccatcaatagggccgacccaagtcttcctcccccttcccccatgccgggccccacgatagtgtgaatgtcaggggcttcaggtttccctaaatataggtccctgccagaggatccgtggcgggaaaagggcaggggtcattagagaagatcggggacacatgtggggcgggcaggagctgccttataaccagcccgggaacccctagctcactcgctgctgaccaggctctgccggctccttcggcctcgccgcaggtgggccccttgcaggaccgggccggggtggggatggggttggggttgggccaacagggtccagatggggtccaggtgaggaggggagatttggacgataggagcagggggctcagcatctgggaggcagatcagttcggggacggattttcttttggagaaggaagtcaggctcaaggaagacgtttggcaggaactgtgaccccgcatgccagaggccgagcagcggccggtgcatagccgcgcattctggttttctgtggcgcagaggactaccagcctggctgcggcggcccggcggagagcgcgcacgcatgcgcgacccagcccggcctgccagcctggaactcggatggggaggtctcgcctccgcgcgccgctagttccgccgccttctcgcgctccctgcgtgtcctctcgatgccctttcctccgcctcccttacgcctgggccagtgacagggtgtcggctccgcgccgattcagcccgcgggcgaggcaggctaacgcacgactgcgcgatgtggcccctatggtgacacgcgctgcagccgcgaagaccggaagctggggcggccccgggccgcgcgcgctgggcctgggaggcgaaactcagcttccttcgtttccgacttttccatccgcgtcctccacttccccgttccgccctcccccattgccaacattctggctgagtcacggcgccccagagcgcgccaggctgggggaaaggagcagaagggagggccctagcgacccgcgggatgtggtccgagtcacgtccgaggggggtggggagggatcgtgttctcggcgcccgccccttcctagcgcggcctctgggctgcgcctctcgggggcggcccgtagcccagtccgtcgcctgccattggacgccgcccgctcctcgtaaaggaaaaagctcggcggagggcggagtggtgcctttaaaaggccgggcgccgccttccgcctgcccgcctcctgcgccgccccttccgaggctaaatcggctgcgttcctctcggaacgcgccgcagaaggggtcctggtgacgagtcccgcgttctctccttgaatccactcgccagcccgccgccctctgccgccgcaccctgcacacccgcccctctcctgtgccaggtgagcgcccctcttcacgtgcggggaccagggaccgtggagagggatcttgggggcagtggcgggttgggcgtccgcgtggaggcctcccccatcccatgccagcgtctccccactaccaggcacacacaggctccccggcccctccagcctgaggtcctctaactgcgcaatgcagcggctgcgcgcgctgagtcatggcgggggaggaagccggacgagatgaaggaccattctcccccttttcttgcagggacccctgtggcaaaggattagggccccttagccctggcggggatcctaagaggcagtgaggggtgggggccggcccatgtacagccccagggttctcgcaagtgggagcttggtttctgtcctgggaaacggggcgcccttcgcgaggagggaaacccctccgcggtgcttgatgcccccttaacactttccctgtctctccttatcgggcgaccttgattctgagcccggaacagctgcagccatgcgaagcgacgggagcatttttcaggggaaggcgcttgctcctccacgttcttgccccgtaggaacagtgacgatggcaaagcttaccgctttcctcgcctcgggctagggcttgttccgccgccctttcctgggcttctccttgctctcttatatttttcctaatgcccctttcctaccacccgccccctcccttgtggggaaaagcctgaccttgggatgtccttgaagccttggagcccgggccagccctgggatcttgaggggattggaaggaacaccccagtggcagtcagaagagctgggttctaatctcagatctggctccggggttgctgtgtggcttgaagcacagacctttcccatatctgggccctttcccacgagggtgttgggccctctgcttgattcacgatctttacattctaaaatactccggttcggttttgttttcaggcaaggtgaccccatggcaaggcgcaagccagaagggtccagcttcaacatgacccacctgtccatggctatggccttttcctttcccccagttgccagtgggcaactccaccctcagctgggcaacacccagcaccagacagagttaggaaaggtacaggggcaggcctagcaaagggaagttgggcgtaagagagagctggggaccagaagtgccccagggcctgctgggtgtggggcaggggaggtagggaacatttccctgacctccaggagaggggccctggtcatcgggagatgatgggaaaccctagctaactagtccttcccctctgtttcctgtatccaggaacttgctactaccagcaccatgccctaccaatatccagcactgaccccggagcagaagaaggagctgtctgacatcgctcaccgcatcgtggcacctggcaagggcatcctggctgcagatgagtccactggtgcgggcaggagacagaatgggtggagggtgcagggttgggagtggcaggctgatcccctaattcccatgtgacactcccagggagcattgccaagcggctgcagtccattggcaccgagaacaccgaggagaaccggcgcttctaccgccagctgctgctgacagctgacgaccgcgtgaacccctgcattgggggtgtcatcctcttccatgagacactctaccagaaggcggatgatgggcgtcccttcccccaagttatcaaatccaagggcggtgttgtgggcatcaaggtaaggggagggcctccggacgtgaggtttgagatggaagtggaggaaggaaatccaggttagtgaggcagggaatgaatgctggattggtggcctagagacttgcatggagcctgcttcaggcttagggcatttactcgacatttttaatcctcacaattctgagagaacagtatcattcccactttacacatgaaaatctcagaagctcagggaagtgaagtgttttgctcagagtaagtggcagagccccagtctgacacccaattcactcaacatttctgttgtcaaataacatcccagtgtatcctgtctcagaggattgttactaagtgaactaagtgaaaatattttaatttaattgtaactaagtatttgagtaactaaacattttaagtaaattttttttttttttttttttgagatggagtctcgctgtctcccaggctggagtgcagtggtgcgatctcttggctcactgcaagttccgcctcccaggttcacgccattctcctgcctcagcctcccgagtagctgggactacaggcgcccgccaccacccggctaattttttttgtatttttagtagacactgggtttcaccatgttagccaggatggtctcgatctcctgatctcgtgatctgcccacctcggcctcccaaagtgctgggattacaggcgtgagccaccatgcccggcttaagtaactaaatattttaattgtaactaagtgaaaatatttgccagccctgagatgcagtttaagggattaagtaaatgtgggggaagactggggctaaagaagaggaaagaggggcacgcccagctacctaggaggctgaggcgggaggatcacttgagtccaggaagtggaggcttcagtgagctgagattccaccactgtactccagccggggcgacagtggaaagggtgctagaggtcatttcctgtgtcttaatgttgttaccctgaccccaacaggtagacaagggcgtggtccccctggcagggacaaatggcgagactaccacccaaggtgagaactgtttgattctctgccctacgaacccaaccagagcaggtttgggtgctgggaggagtggaaaccacatgcccctccccaccgtgctctgaccccttcctcttctcttagggttggatgggctgtctgagcgctgtgcccagtacaagaaggacggagctgacttcgccaagtggcgttgtgtgctgaagattggggaacacaccccctcagccctcgccatcatggaaaatgccaatgttctggcccgttatgccagtatctgccagcaggtgggcctgcaggtcctcaataggcaacctcctacctcatttggttccagtgttgttaatttgcctattacctgccatgatgcctacctccccaaaagcaagcattagctttggcccgtggaggacactcaagggctgttgaaggcagaggggccaaggagggatggtgggtggatctgaggcggctcttgtctcctgtaatctgagggctttgaagcctgagtccctggcatcatcaagatacggtcttgaccagtggctgtggagagatgtaggtgggactctgggttaggaggcctcacagtgaccctgtccctcgccctgcagaatggcattgtgcccatcgtggagcctgagatcctccctgatggggaccatgacttgaagcgctgccagtatgtgaccgagaaggtaaatggctacctgcctgaccagtgcaaggtggctggccggggaccctggggctaacccctatcctctcctccaccccactacccaccgtgcgcctgctctgctccaggtgctggctgctgtctacaaggctctgagtgaccaccacatctacctggaaggcaccttgctgaagcccaacatggtcaccccaggccatgcttgcactcagaagttttctcatgaggagattgccatggcgaccgtcacagcgctgcgccgcacagtgccccccgctgtcactggtgaggcccacactcatcttgatctctatgcagtagataagctccacccacaaccctatgcccatttggacggatttccatggcaacttccaccagctcctgccagcttcctgggtctctgaccacagcccctctcgcctcacccctgctctacagggatcaccttcctgtctggaggccagagtgaggaggaggcgtccatcaacctcaatgccattaacaagtgccccctgctgaagccctgggccctgaccttctcctacggccgagccctgcaggcctctgccctgaaggcctggggcgggaagaaggagaacctgaaggctgcgcaggaggagtatgtcaagcgagccctggtaaggataggcaggaggtgggcagggtgcctgggtggatgggactcggagaagagcccttctcactccacccctctccctgcttaggccaacagccttgcctgtcaaggaaagtacactccgagcggtcaggctggggctgctgccagcgagtccctcttcgtctctaaccacgcctattaagcggaggtgttcccaggctgcccccaacactccaggccctgccccctcccactcttgaagaggaggccgcctcctcggggctccaggctggcttgcccgcgctctttcttccctcgtgacagtggtgtgtggtgtcgtctgtgaatgctaagtccatcaccctttccggcacactgccaaataaacagctatttaaggggga

SEQ ID NO: 1279 - DNA, 5231 bp, Homo sapiens
tgaggtgggagagagaagcagagcgagagagaggaggctgctggaaggagaaagaagagggtgaggaggcgacagagggagaggaggaagaagaggtagaaggagagagaaaggggagagaaaggagagaggagggttggaggtgcatgaaggaggggagagggagcttcagcgtggagagaggaccgcggaaggagagagagacagcccagagtggaatgtggaagggaaacagtccagcggggagccagggggcagccatggaagggacaggtggggagctggggggacaggggaactggggtccggaggacgccccaggcctcttggccagggcctccctgatcatgctcccgtggccactacccctggcctcctcggccctcaccttgctcttcggggccctcacttccctgttcctctggtactgctaccgcctgggctcccaagacatgcaggccctaggggctgggagccgagctgggggtgttcgtggtgggcctgtgggatgctcggaggccggcgggccaagcccagggggtcctggggatcccggggaaggacctaggacggaaggcctagtgagccggcggcttcgggcctacgcaaggcgctactcctgggctgggatgggtagagtgaggcgggcagctcagggtggcccaggccctgggagagggccaggggtcctaggtattcagcgcccaggcctgcttttcctaccagacctgccttcagccccctttgtgccgcgggacgcccagcggcacgacgtggagctcctggagagcagcttccctgccattttgcgggacttcggggctgtgagctgggacttctcagggactacccctccgcctcggggctggtccccacctctggcccccgggtgctaccagctcctgctgtaccaagcaggccggtgccaacccagcaactgccgccggtgcccgggggcctatcgggcactgagggggcttcgaagctttatgagtgccaacaccttcggcaatgccggcttttccgttctcctgcctggggcccggctcgagggccgctgtgggcccaccaatgcccgggtcagatgccatctgggtaagtagctgccgcctactgacaacctccttgcctcgatgatttcccccccagacccttctctccgccagagccgtctgctgtctggttctcattgtgcctctcttcttccatggctccctgttgccacccacagcagcatttcctcagcctcggttatctgcacaccaccttcataagctttgccgtggtcattcccatctgtactgcgtttcttcaccttggctctccccccgaccttttgttctacgtatttaaaagaaatatttatagcactatcagtattacttgccctaaatagtactcataaaaagcctggacaacacagtgagaccttgtctctacaaataataaaacaattagccgggcgcggtggcccatgcctatggtcccagctactggagagggtgaggtgggaggttcactggagctcagcagtttgaggctgcagtgagctgagattgtgctactgcactccagcctgggtgacaagaaagtactcataaacacaagctgaaatttaaaaaagaaagctttcaacagtctagaacattctagttaagtgctctagtctctctgatcctgaagcctacacttttttcttttttgaggagtctcgctctgtcgcccaggcgagagtgcagtggcacgatcttggctcactgcaagctccacctcccgggttcataccattctcctgcctcagcctcccgagtatctgggactacaggcacctgccactacacctggctaatttttttttattttgtatttttagtgaagacagggtttcaccatgttagccaggatggtctccatctcctgacctcgtgatcaatccgcctcggcctcccaaagtgctgggattacaggcatgagccaccgtgcctagccctacaccttcttttttaaaagggttggtggggtgtcaaagttacagtagcaccaaactgagattttttctttttcttttttttttttttttgagacagggtctcactctgtcacccaggctggagtgcagtggcacaaacatggctcactacagccttaacctcctgagatcaaaggatcctctcacctcagcctcctgagtagctgggaccacaggtgcccaccaccatgcttggctgattttttaaaaatttacgtaggccaggcgcggtggctcacgcctgtaatcccagcactttgggaggctgaggcaggcggatcacctgaggctgggagttcgagaccagctgaccaacatggagaaatcctgtctctactaaaattacagaaaattagctgggtgtggtgtcgcatgcctgtaatcccagctactcgggaggccgaggcaggagaatcacttgaactcgggaggcggaggttgcagtgagccgagatcacaacattgcactccagcctgggcaacaagagcgaaacttcatctcaaaaacaagaaaaaaaaattgtgtaaagacaggctggacctgaactcctgaactcaagtgatcctcctgccttggcctcccaaagtgctgagattacaggcgtgagccaccgcacctggcactttttgatgtcttaaagactggaagaaaatggaaaaggaaataattttctgttattccatgccatgaccttgttttgcccccaatcatctcctgtgctgccagctggatgtgtcctacacttcagggcacactagcctcaggatcagttcccaatccttcctctcttccctctctctgtgctctaaatcatgaaaaccttctggccaatcctgacagatgccacatgtgctgttcttttcaacctagaatccccttcccccgtaccacctcctgaaaaactcctactcagccttcagtactcaagttttcaagtgccacacttcctctgggttggcttcctgttcccccatcagttgagttggctgctcactttcctcacagcactcagccatgtggtccttgggccaggaacgtctttaatcttatacctctcagtgagacagcgcctatcacacagtaagctcttgagtcaaactgtcgaaagcccaggaggaaaagccatttcctccaggaagccttctcttttctcgaaatgagaggttgctgccaggtgccgtggctcatccctgaaataccagcactttgggaggccaaagcaggaggattgcttgaggccaggagttcaagaccagcactgtctgtataagaataaaataaaataaaataaaataaaataacgggtctggccaggtgcagtggctcacacctgtaatcccagcattttgggaggctgaggtaggcagatcacttgagctcaggggttcgagaccagcctggccaacatggcgaaaccccatctctactaaaaatacaaaaattagccaggcgtggtggcaggcagctgtaatcctagctactcgggaggctgaggcaggagaattgcttgaacctgggaggcggaggttgcagtgagccaagatcatgccactgcactccaacctggcgacagagcaagactacatctcaaaaaaaaaaacaaaacaaaaaattaaccctgcattgtagcacatgcctgtaatcccagcagctactcaggaggctgagacacgagaatcacttgaacctgggaagcagagtgagctgagatcacaccactccactccagcctgggtgagagagtgagactttgtctcaaaaaaaaaaaaaaaaaaaagatgggtcacactacccacagcagcgtttccctaatctcctagcacttccctcctccaggactgtattgtaattatactgtggccactttctggaaagaaaggaggatgaccacaaaacctggcatttaagacacttagagctagttgctaattgactggccaggatgggcccctgggatggaggcaggagtgctggatgcccgcgtctcttcttacaggcctaaagatccctcctggctgtgagctggtggtcggcggtgagccccagtgctgggctgaggggcactgtctactggtggacgactcttttctacacacagtggctcacaatggtaacggggtgcccattctgcaggggggatgagggactcaggagcaaaggagcgttgactagaaggcagcagaatcaggcccaacggacttcctgtcctaccaccaccatcttccagctgcatgaccttgaacaagccgcataacttctccaatgccctaggaccaccaccttcttcatcaagtaactgcaaggattaaatgagataatattacgtacacagaaaagcggttaccagcacaggactctgggttcctgtcctacctcttgcacttgggcaaaggacttaacctccttatgcctctgttgctttgtataaaatagggataattatggtaataccacagtttgttttgatgattaagagttgatacatatcggccgggcatggtggctcacgcctgtaatcccagcactttgggaggctgaggtgggcggatcacctgaggccaggagttcgagaccagcctggccaacatggtgaaaccccgtctctattaaacatacaaagaaattacccaggtgtggtgatgagcacctgaaatcccagctactagggagactgaggcaggagaattgcttgaacctgggaggccaaggttgcagtgagccgaaattgcgccactgcactccagcctggtgacagagcaagactccatctcaggaaaaaaaaaaaaaaaaaaaaaaaagatttgatacatttaaagggttagaacaaggcctgccacttatttactgtttgcttttatggtgtttggtgagtgctctggtgtgcaagtacctaatgtcagtggctctgctgttcctgtcccatgtgccctaggctcccccgaagatgggcctcgagtggtcttcatcgtggacctctggcaccccaacgtggcaggggctgagcgccaggccctcgactttgtcttcgccccagacccttgaaggaaggtgctcccttcacacacccaggctggagagacactgcgctcagggacggcttgatggtagccaggacctcctctctactgcgggggtgggcgggggcggaggatgggaactggctagtgagcactgaaatataaattctgaatcctctcctaa

SEQ ID NO: 1280 - DNA, 6289 bp, Homo sapiens
ggcgccgtgtccgggtgtggagaggggcgtcgtggaagcgagaagagtggcccgtccctctcctccccctttccctctttcggaaagtggtttctgcggggcccgggagcctcggagtaccgaacctcgatctccggggcggggtccttggtggggactgagcgccccctcccggggacgggcggtctggccgcggagtcccctgcgggagcgtgattggctggaaacggtcccgaacccccaggggagcccgatccctgggggaccctggcttcggactccagtatctgtcgtcgcagggtccctgccctagtggcctatgtcccttgctcggggccatggagacactgcggccagtacggcggcgcctctgtctgaagaaggggaagtgacctccggcctccaggctctggccgtggaggataccggaggcccctctgcctcggccggtaaggccgaggacgagggggaaggaggccgagaggagaccgagcgtgaggggtccgggggcgaggaggcgcagggagaagtccccagcgctgggggagaagagcctgccgaggaggactccgaggactggtgcgtgccctgcagcgacgaggaggtggagctgcctgcggatgggcagccctggatgcccccgccctccgaaatccagcggctctatgaactgctggctgcccacggtactctggagctgcaagccgagatcctgccccgccggcctcccacgccggaggcccagagcgaagaggagagatccgatgaggagccggaggccaaagaagaggaagaggaaaagtaaaggcacacccttacaccttgtcccggggctgctcccctgatggcgggaggaaatagggaggggaaaatgtgggacgctggaacctttgaaagtggagggagggaagccagcgggggaggaggaacgggcaggggagaagcacacgtgtgggtgggagggaggaccgccctcacccttaactatgttcacctgtcccagaccacacatgcccacggaatttgattttgatgatgagccagtgacaccaaaggactccctgattgaccggagacgcaccccaggtacaaacgaagaggaaacagttgggggaggtgaagggcctcggctcagttacccaagatcggctcccctagaggcctttgcttgctgcctcagctcccacacaacttacagctgcaggagagagtattcacccagtagcaccatctttatgacttagattactaccttgtcttccttttttttttttttttttttttgagatggagtcttgcccttgtcccccaggctggagtgcaatggcacgatctcaactcactgcaacctccgcctcctgggttcaagcaattctcctgcctcagcctcccaagtagctgggattacagacgcatgccaccactctgggccaatttttgtatttttagtagagacaggctttcaccatgttggccaggctggtcttgaattcctgaccttgtgatccgcccacctcagcctcccaaagtgctaggattgcaggcatgagccaatgcgcctggccccttgtcttcctttaagagacaattataatacaaaaaattagccgggcatagtggcgggcacctgtagtcccagctactcaggaggctgaggcaggagaatcgcttgagcctgggaggtggaggttgcagtgacctgagatcacaccactgcactccagcctgggcgagagagtgagactccgtctcaaaaaacacaattacagataattctttttttaaaaaaacaactagtcattgattctggaaaattacagataattctatcatgtttcccattcccagaagtccaagtcctggcctttcaatattatctagatctgcatccctctactaccatgtacattctttaatcacaccgctggccccatttcccaccccacatgccttcctagaatttaccctcagagtcatgcctttccttttttcttttttttgaggggtggagagacagagtcttgctgtgttgcccagactggttggtctcgaactcttgagctcaagtgatccatccgcctcggttctcaaagtgctgagattacaggcatgagtcactgcacccagcctagagccattcttgatttctctctcttttacctgaacattcacaccagcagcaagtcttggtagctataagatgtacatttccaagtacctctgctagtctccactttcaataccacatccccatccaagccactgtctttcttgcctggatagttgtagtagctcctaactgggctctctgcttccagcttctgcaattcagatgaaccttttaaaacataaatcatatcactttttttttctttgagacgaagtctttctcttgctcaggctggagtgcagtggcatgatcttggctcactgcaatctccacctcctgggttgaagcgattctcctacctcagtctcctgagtagctgggattacaaggacacgtcaccacgcctagctaatttttgtattttctagtagagagggggtttcgccatgttggcgaggctggtcttgaactcctgacctaaagcttcccaaagtgcctgcctcagcttcccaaagtgctggaattacaggcgtgagctgctgcactcagccataaatcgtgtcacttttccacttaaaattttccaagggattccatcttgccagggaagagcatgtcaaaggagaatccaagcgcttttcccgccacctccagttctctgcactcttttttttgtttttgtttttggcgagtaggggagacggagtgtagctgtgtcaccgaggctggagtgcagtagtgcgatcttggctcattgcaacctccacctcccgggttcaagcgattcttctgcctcagcctcccaagtagctgggattacaggcgcccaccaccacgcccagctaattttttgtgttggccaggctggtctcaaactcctgacctcgtgagttgcccacctcagcctcccaaagtgctggcattacaagcgtgaaccaccatgcccggcctgcactcttctttgaacagaactctgttcttgtcctggggcctctacccttgccattcccctgcccagtatgttcctccctgttcttcacattacctgtgccttcctgtcaatcaagatctttgcttctcaccctctctgaggtccaaccctgaacctcaggtcctccaagacagaggcctggggacctgcatgtttaaccagctccccaagtgatgagtgaggtccaggcaggtatggtgtacaccacctccatcccttccatgtatcttaccttcctcttctccaggaagctcagcccggagccagaaacgggaggcccgcctggacaaggtgctgtcggacatgaagagacacaagaagctggaggagcagatccttcgtaccgggagggacctcttcagcctggactcggaggaccccagccccgccagccccccactccgatcctccgggagtagtctcttccctcggcagcggaaatactgattcccactgctcctgcctctagggtgcagtgtccgtacctgctggagcctgggccctccttccccagcccagacattgagaaacttgggaagaagagagaaacctcaagctcccaaacagcacgttgcgggaaagaggaagagagagtgtgagtgtgtgtgtgtgttttttctattgaacacctgtagagtgtgtgtgtgtgttttctattgaacacctatagagagagtgtgtgtgttttctattgaacatctatatagagagagtgtgtgagtgtgtgttttctattgaacacctattcagagacctggactgaattttctgagtctgaaataaaagatgcagagctatcatctcttaaaaggaggggctgtagctgtagctcaacagttaggccccacttgaagggagaggcagaattgtactcacccagattggaaaatgaaagccagatgggtagaggtgccctcagttagcacctgtcccatctcgggccctccaactcctcccagtcccactccagtgcagccagctggctccaaggtagaaacccatgagcactcagggagcagtgtgccttcagctgcagcagaagcagcccggaggataaaatgagaaccagctgcacacgggccctttaactcccaagccccacccctgggcttggcctgccttgccctgccgggaagtgatccccaaggcagggtgagagttccccatctgaggcgtttgttgcagctacctgcacttctagatgtgagtacattgtactagccccccaaaccccaaatcaggggcagatctttgtatcccttgaggctctctttagtcctgtcttgctttgaagggccttgcttctgctggggcagggaaaacatgtctgaatcagagtggggaaggaggatgggtggtggctttgcttttggaggtttcactttccaatagttgggagtcttctgggttttgaagtaaaggcagattaacaccaacaccggtcccccacccccctgcaactctcaggcctctctctgacttcagggtcccacctgggaaatcaggtggggaaccttacagggtcattcagaccccatcttagccctagatcggtgcttgctctactcacctgcactgtcctggggacctgggctctggcctgtcaccttgagctccaagaatgtgacctgtacccattcaggccccttaactctgacagatgagggtttcttactcctccatgcagggctgggccagctgttggtctcagtcgatcattcaggaagtcattagcagagtgatttccagaaggcgtagaatttagtgaccaaggttctttcctttttgggaggagaaagtgaaaactaggatgctcagctggacccaccagcctgagattctggggattttagagctgtcccttggggagccaagcacttgggggtggaggtgatagcgaggctgatggcccctgtgttctcagctctctgcctgggtagcccctgggtgatgggggagaggccagctgtcacgtggggtatcaggtggctctgccagaaactcccttggcacacagagcactgggtcggccctcgggtgtggctgtttgggcaggacagccctctgtatgtagccttgagcaggtaggggggccaccttgagtgggtggcccagagacagcctcagggctccaaggtaacggggtgctcaggttatcttgggtgctgccctcccaggttctgggggagcagaggctgggcgctggcccaacttacaggaaacactcacctttgaactgccattagcaccatctgggcagtacacagccccacccaggtcctctagttcttgttctcggcttagaatctttgtgtttctgcctgagaagccactgcctcctagtttgtggtctctacagttatagccaggttggacttccggctccgtcctttgataactgtgtgctcttgggcaaatttcttaacttgcaggttcttgtgaggataacatgagttaattgagggcacttaacactacctggcacagattaagctcatctgaagtgggagctgttacttaggggcgtttgcctagaacacagggtccagaggctctctcccggaaacttagacccagtgagtcagaagtgaggcctgcaaaaagcagcaggagtggggttaagaattccagcctagggctggatgcggtggctcaggcctgtaatcccagtactttgggaggcccgaatgggaggatggcttgaggccaggagttccagaccagcctgagcaacatagcgagaccctgtctctgtttgtgtgtgtgtggttggggttttgttttttttttttttttaaagaattatagctcagtcctatgattaggcaagttgagaaaatattgatgaagatcaggggtgctgaagcctggttcctggggtcgcttctgatctaggcggttcttgcctctggtgactggtgttaattggcaggagtgggaggagggaggacaagtggaagtctaggctggctgagctgttctgtctcgaaaagttcctaaaactgtgctgctttaaaaaaaaaaaaagtaatttatgagacacattctcaatttccattaatcatctcctaaagggggtaaaccaggaagccgctgggtgaaaacaggctgttggcaattcctgagtcatgtgacccattctctaaagactagaatatttaacttaaatcagtgagaaactctgtgaa

SEQ ID NO: 1281 - DNA, 3555 bp, Homo sapiens
ttgtttacattgtatttattttcatgttttaccttctattgatggcaaatgagactggttttccatttacagaagtgatacaaaagattcctgttgcaataatttcattaagtgaataatgagccaatttaaagaaaaatataaagcaaataattgtacagatggtaaactaatatggcaaaatcactaatattcaaggctgaagtttggccgggcatggtggctcatggctgtaatcccaacactctgagagatggggatgagtggctctctcgagcccaggaattaaagaccagcctgggcaacatagcaagaccctgtctctaaaaaaaaaaaatagccaggtgtggtggtacatgcctgtagttccacctactagggagactgaggtgggaggatcacttaagcccaggagttcaaggccgcagtgagctgagattgtgccactgtagtccagcctgggcaacagagtgagaccctgtttcaaaaacaaaaaaaagtggccgggtgcagtgctcatacctgtaatcccagcattttgggaggctaaggctgctggatcacttgagcccaggagttggaaacctgcccaggcagtatggtgagaccgtgtctctacaaaaaaaatacaaaaattagctgggcgtggtggtatgcacctgcagtcccagctattctagaggttgaggtgggaggatcgcttgagcctaggagttcgaggctgtagtgagttgagattgtgccactgcactccagtctgggtgacagagttgagattctgtctcaaaaaaaaaaaaaaaaaaaaaaaaaagacaaagtttggaaaattaaacccccagggaaatggaaactacatctgctgctcacccacctgcctgcctctcctaaagggaagattgggtacttggggtcccatttctgtagggtggagcattataagtaagcctagcttgtggcaaatctgtctctctggacactccagcaagctggaagggacgatgatcagaggtcacagtttgggagttgccctgctctaggacaacgctcctctccacattggatgaaactcagtttcccctggccatggccttcctcaccatggagtggtgagggtccgaggctgagacgtgtgcagatggaggagaatgggcagaggagcctgtgggttttctctgactctaggtccccactccagcaagacagcgccgctgcagcttggcccagcaagttcctccttgcagtttgggggtcaaagccacagttcatatgaaacaaaatgttcctctgcctggtctggtcctctctttgtgtattttcctagaggacctcacagtgggtgagtggccaaggagaacaggatttgtggctctgggaaactggattcctgtcatctcctgccagctgtcatcgccacaccgaggctgttcagcaccgcaggacccgttctctttggtattggtggcttcggtaaacactgaaagaaggtggaggtggctggtcgatgccatttcctgactatctagtaccttgggttcttcatctggatgcgatcttgaaggcttctggcctggcattggctccacccccaggtctctgagccacagcccaggtagctgagcagaggcactgctgggcttcccctagtccacatagcctggccaccacccagacccggggagggggactccaggtggaaggagcctgggaagggcatcttcgctggggcagtctcaatcctaatgctggatcctggggtccccggtcccactgaggcaaggcctgcctcggggatctctggggaaccctggggattcagaaccccacactggtccggccttcacgcttccagaaagctgagatctgctccaaggtgacccgtggctggaggccccactcaggatccgggctccctggccgctgcctcctggcctgggggctcccaaactggacgctggcctctggcctctgctcgggttcagcccagctcaccaggcctgtggcggggggcctcccctcccagggctggggcccccagaaggtgctccgggctgggacctccagtacggtctgggggcccaagttgctgggagcagaatttggggctgagggggcaggtggggctgttgctcgggcctccaaagtgcccacctgggtgggaggctcaggggcccgatctgtcagcagggggaccgcagagccataccagtcctcagagcgctctcgggcggtgcccatgggctcaatccacagctctcctcctgggcgccacaccagggtgggtgcacggtggctggggtctgggcggagagcacggcggaacaggcgttcagccaacacagcggtggtgaggatgaagagcgcagccagggtggccaggaccagcatgatggggatgcagggcccacagggcagtgagggccatggggctgcttcccatgcggggggcccctccacgcgcccagagggcggctctggagtcaacggcatctgagagacacaggggtgagaagaggaagtaaatgaggcagagggggcacaaccaagatgagagagaggcagcaggtgtccaggaaagcctgggagaagggctgggcatgggggctcatgcctggaatcccagcactttgagaggtcgaggcgggaggatcacttgagcccaggagttcaagaccagcctggacacacagtgaaacctcatctctaaaaataatttaaaaactagctgggtgtggtggctcacacctgtagtcccagctacacaggaagctgaggtgggaggattacttgagcccaggagtttgaagctgcagtgaccccagattgcaccactgtcctccagcctgggcaatagagcaagaccctttctcaaaaatgaaaaagaacattctggagagacagagaagcaagagggaccagaaagggtaagcgtgagccaggtggggtgggaggacaggcagcctacctcggggcacagccaggccctcctgcctggctctccaggcctttccagaatccccatttccctcccagaccccagggtgcctcagacaagaaaggtctcaagggcttctttcctccccactcggccccctcaagtcttgctcagacctagagaggaagtggtgggtgaagaaatgagaacctcccctcccactggctcccctgcgtgtgtctcccccaccgcctgccgccagcacctccgctggccccttgaggctccttcgcccctcaccattctcctcggacttgatcttgctctcataggctccacggaatctgctgccgggccgggccgggccaggcctccggaggcgcctctgcacccctcctgggctccccagctttgcccaggctctggcctgtctctatctctcgtttgtctctgcacacctctctgtcccccacatcctccatctgcagggggcctcctgcacccctcaactcaccttgggtcagtccctgggctcctctccctcctagagccactcttcctggtgctggactaagaggtgcaggcttggagggtgcagggcggtccgcctctcagacgtagag

SEQ ID NO: 1282 - DNA, 1369 bp, Homo sapiens
aggagtcatgaggctgtggccatgggtgctggtgtgggtgtggctggctgcactaggggccatagaaactggtaagaagctgtcttgggagcagcaggaaggcaggcagctctgggagcataaagtgtgatgcccacttagggactcggaagccaaccctgcaccctctcattttctctccactcttctctcccatcctgctggtcccacctaccccccaacaaccgcgagccttgtcgtggtgcacccagctgaccctgagggaaatcaagaccctccacagcctctgcaataaggctgggtggtctcacagggtcccaagtcagcttccgcctcgagagataaaggcaggggtcagcttggctgttgtcacagagtttgcttgggtcctagcacccagacccaagcgtgccacggcgtcagccctggggacagagtctccgcgcttcttagacagacctgacttcttcgattatccggactcagaccaagccaggctgctggctgtggcccagtttattggagagaaacccatcgtgttcattaactcaggtatgaaccagcttgagaagggacctccctccccgccagggtctggaggagagcagccccagacccttcattgggccatcagaggggagttaagggtcctgtttgtctagcaggttccagccccgggctcttccatcacatcctggtgggcttgctggtggtggcgttcttctttctccttttccagttctgcacccacatgtaaggcctgccccctttctccaaccccacccaccaccaccttccttgggagcggctgaagaccccagttctagcggggcaggctgtgacctctcccctctgatctccatgccccacagaaacttccagaaaggggcctaaagagccggacaagggctctggactcaacctgagcacccacacccacctcctctcctgttgatgagcaaaagttccctgctttcctcctccctgactgcccagcgagcagctggggatcctgtcccctctgtttcccatggcccaagccccccacctcctcccttcccagccccaaagaacttggtggcaagggccttggtggcgttcacgcagatcgtcttttattagcggtctgtaaagcacctcccagggtcccccgaccccagattggaggaagccttgagaggtcagtagcaccagggacatggcagggcccgagggcgcgatgtgcagccgatggtgagggactgggcgccctcgcctgcccccggggttgtcagcactgggaaggcttgggggtagcagccacctccttcccccaacccaacagactagttcaaatttgggtaaataaataaaataaataagattcctc

SEQ ID NO: 1283 - DNA, 1369 bp, Homo sapiens; identical to SEQ ID NO: 1282

SEQ ID NO: 1284 - DNA, 4901 bp, Homo sapiens
tcattgacagacgagtatttattaagcagctactatatgccaggttcaagttggtcttactctagggatagagaagagaacaagaaaagtctgtgccttcatggagtttacattctagtgagggtagaaaatatcaagaatataaatacatgtagacagtcagtgacatcaaacaagtgggcggtggggacaccacatgagcatgggtggcaggagggcctctctgtgaggtcactgtgggtagacggagaagccagccagcaaactggaggaaaagcacccagacggacgtccttccctaagctccctcaacccaggccctgagccaagaatatctgaaaggaaaccaagtcaaatagtgaagtcccgccaggaccagggtaggcaggacagaggagccggtgacagggaaggctgtggatggcttcttccctcctgggcatggtgccccaagcttgctctggctgggggcggaggtctgactcccgcctttcaggaaacctggccctcacaccacctccctcactcaagcgtccctagcatctcggaccccaggactgagcaggcagggtgtgacactgcccggtcccggcaccccaggagcaccgcctggatggagggggcctcccgcgtatcctccctgatttgaggcccgggtcctcaggatcccagagaacgtgacgtcaccaaagagaggctgacccccatcccagcaggtagaacaacacatgaggaaggcgtgagactgggacctcctagcagggggtggggagctgtgtggcacagcaagactcccagggcaggtgggcagccaggacccggggctccagcgtcacttcttcttggcgcggtctgctgcgtccagggcagccatgttgcgggcggccgtgatcaggtggatgacgctgatgagcgacttcagcaaggcgatgggggcagtgacccagaggcccatccggaacagtcccacagagccaactgcaggaaggcagcaggggagtttggggcccgaaggagggggcctccatctccctgggcaggccagatccccctcccatcctcctgcccagcccctcatctcctacctaaaggtccctcagagaaatggaacaggtagaggaggcagtagaagagctcattcccagcacacaaggtgaacagagcaggctgcacacacagcaaacaggccacgttagcaagaggcaggcgtgtgccaccccctgcccccccagcactaatgaaggcacaatctcggcatattacttctcttatttttttttcttttttacagacagggtctcgctctctcatccaggttggaatgcagtagtatgatcatagcactgcagcctcaaaactcctggtctcagccaggcgtgtggctcatgcctggagtcccagcactttgggaggctgagacaggcggatcacctgaggtcaggagtttgggaccagcctggccaacgtggcgaaacccctctctactaacaatacaaaaattagccgagtgtggtggcacgtgccggtagtcccagccactcaggaggctgaggcacaagaatcgcttgaacccagcaggcagaggttgcagtgagccgataacccgccactgaactccagcctgggtgacagagcaggactctgtctcaaaaaaataaataaataaataaataaacccttggtctcacgcaatccttccaccttagcctcctaagtagagactacaggcgtgtaccactgtgcctggctaagctaattcaagattttgtgtgtgtgtggaaacagagtctcactttgttgcccaggctggtctcaaactcctggcctcaagcaatcctcccacctcagcctcccaaagcgctgggattacaggcatgagccaccatgcccagccattatctttttaaaaatccttccagaggctgcctgtgttcctggaatcaagtccacactccagccctgcagacctctctggcttatctcccttcccgctttcagtcccttctctttgcaggcctcattcccacttgttccctggagtaattcacacaggccttccccaccaatcctcctcctccacgcctcagcttacgggccctcctcctggagtgactgggcaggccctgctctgcgccctcgccttctcctaggctaggaccaggattcagcccagggcttcccacagccaagagcctgaggggtggggtgtgcaggaaatgcttaccctcgaggtgtagtagatccgaagcaccggattcccggacaagtcgatcatcttgtgactctcactgcctcggaccacagaacttggggagaaaacaggggaacccacaaggtttcatgaccactaccatgcatccaatcctcatgttaacacctattgtacagatggaaaactgggcacggctaaggaccagtatcctgccgaaagccacagttacctatttgggggcagagtcaggattcaaatgccacatttgaaagctcccatgccccttcctataagctgtcacctatatggaatcctagaatacccagccagaagagtcctaagaattgcttaatgcaactgtaaacatgactgaagctttaaagagaggcaggtttgcctggggtctttctacaaagcagagctaaaaaggagcccttccaggatgcctagtgccatcccagacacccttccgtctaggctcagcccaccccactgtaatgtctccaagtggcccaggcccccagaatcgcagcagacctgtggaggtgcagccagtgactggccacatccaaactcatgctgatttggaagaacagcgtggctccagggtacagcagggccaggttgaccaacaggcacatggtggagcagcggtccgtcagcatgtccagcatggccccaaaccgggttcctggaagattaggtgggcaagggctgttatggcacagtggatgcaggacaggtgcccatatttggtttatcactctgacgcagggtgtaaacgaagactggaagtgtccgcctgcctggggaggaacgcaggctagaaaacaggctgtgtgtgaggtcagtgggcaaaggtcaccatggcatgaactgagaaaggcatgagagtggagggaacagggtaggaggagaggaaagctatgtctgcaactcatcaaccccagaaccaagactccagggctagatagagacttgatgcctcaggggaagccttacagttgggtctggagaacagattaaaaaattagtcaaccctccagaagccatcacccttccctctccatcctccctctaagcatgccttctggaaccccaactgcttatgcagggcacacagtaggcctccagtaaacacctgttgaatacactgttttttgttttttgtttttttttttccgagacagagtcttgctctgtcgcccaggctggagtgcaatggcgcaatcttggctcactgcaacctccgcctcccgggttcaagcaattctcctgccttagcctcccgagtagctgggattacaggcacgcgtcaccaagcccgctaatttttgtatttttagtagagacagggtttcaccatgttggccaggctggtctcgaactcctgaactcgtgatccacccacctcggcctcccaaagtgctgggattacaggcgtgagccaccgcccctggcctgaatggacttgtattcagagagacctccagcagcgccaccgccatgtcatgtcttgctaatccacacctctcacaagcagtgagttctcaagagctagcttaaattccttttgctacaaaatcagtccattcttgctgggcgcggcactttgggagcaaggcaggaggatcgcttgaggctaggagctggggaccaatctgggcgacactgcaagacccagtctctacaaaaatttaaaaattagccgggtgtggtggcacgctcctgtagtcccagctagtcaggaggctgaggtgggaggattacttgagcccagaagatgggggctgcagtgagccatgatcgcgccactgcactccagcctaagtgacagagcgagaccctgtctcaaaaacaaaaaaacaaaacacaaaacaaaaagccccaggccatcctgttctgctttttccagagatgggaatgacagccctctgactctgaggtcccgaggaggcaggggaagggaggaggggattgttgaaccccaaggctggctgagaggggtgtctgtcaccttgattaagagcgcgagcagcgtgtccatcgaaagcgtccagcaggccgctgagcaggtagaaggaggaggccgtgagggggcagcagggcatgaagtagaaagaaatgatggcgaagacaatccgggcataaccttggaacgggacgcggggagacagggcaggatcagggagcccgccaaggcccctcgccctctcgttcggcccggggccgtgggcagcactcaccgatgaggttgggcacgaacaggaagatattttcgtctggcatcgcggcgcctcccttgctgccccgggcctgctctggagatgccagtgctgtcccagccccgcagcgcggcctcagcctccggcccggcgcatcggccgcaccacctgcgccctggaccccgccgccccaacctggccccagatgctgaagcccgcagccgtcgggagcatggaccggccccgaggtgcgcgggacgcagggggcgcgcgcagtccgcccttcctacccgcaacctccctcgcctctgccagccccgcaggcgctccgggcctccagctgcggtcgccgctgctccagctgcgcgtggcttccgggaacctcctcctccgcgcccgtcgttgcaaaattggagagaggaaaaagtggcttaaaaaaatagttgcggcccctttaaggcctg

SEQ ID NO: 1285 - DNA, 5667 bp, Homo sapiens
aaaaagaagtttagattcgcttcccggagccgggatggcagcctgcgctatggttggggaccaacgtggtgcacgggcaggggccggggagagaggcggccgcagcgggagcccgggagcgcagggcgggcctggaagagctccgccccaaggggcgcggccaccccggaggcgggcgcacggctgcttctcattcattgtcttgacaagagcatcttcagcgggcgagtccccggctcctccagctccttcctcctcttcctcctcctcctccacctccggcttttgggggatcactgtcctctctcggcagcaggtgaggctgggcctgggaggcgcgggtgggccggggcgagggccacctgtggggcggcgcgcgcgtgggagccgcgggctgcgggggcgcgcggctgtcaccgcgacccagccagcgccggggccaggtagcgggcgcagcagcccgtggggggacgctgcttggagtgggggccgccggggccccagagcgctctgcggaggcgagggctagggaccaccgcggccaagatggaggtgggtggccgggggtcagcacagtgtcgagggcccgactccccacggaattgagtctcggggagggtggggacgagggcagggtggggtgagcggggcagctgccctgggcttggagacaggaaggggttgagagcaaaacaagaaaagaccaagttcccctttccgtggtttccgggcctggtacctgtggtgggggaggaggcagggtggggcgatggcttcctgtcccccacctctggtccggggctcccctctctccagatacaggctgctcctcaagactggggctcttcacatacgctcctcaccgctctttgggcaggccgacctagcagcctcttcgggagtcctggggtggccgggggtgctggagcccccagtgagtaggcgaggctgaggctaggggcagaggctctgggcatggcaccctccaagcggcagcacaggccccttccctgagcaggaaggtgatgcggtggcacaaggtcgcccctggagttccttgctccccacccagacactgggggaaaccatcctacctggacctcagagcagtcggagtggcctctcccttcctgtgtgcagtttacatgggggtggagatggctcttaagggcacctgcttttctgagcggaggcgagaggcagaggtatggggaggaggagatacctggacctgagccagagacctgctggggaagctatcctgccgcctcactcccctcaggcagcccccacgccacttcctcctgtgtccagccccatgccagcaggcgagggaggccagctcctgtccctgcctttaggaagcgctgtgtgggtgtgagggaggtgggctctggacacggtaactaagagagaacccaccctcggagccatctgggctgatgacgcctgagtctgaaccattaggaaggacgggctctgcatccatcagccagtcagtcaacaaacatgcagtggggcaacaccacgccaggctctgttgcagaggctgagggtacagattgagagggtggctcagagtggcctggggccagggagaagggggcttgcaggttagagggaaggagaggctggggaaggcaagcaggcatcagccacagagggaagaatagggagcccctggagatgatgctgggaccttaaaagccagactgaggggtgtcctgggggaggtggggaccactggaagatcagagttgacctgaagggagaaatgctcttatgctgtgtgcccccagaatgagccggcaggtggtccgctccagcaagttccgccacgtgtttggacagccggccaaggccgaccagtgctatgaagatgtgcgcgtctcacagaccacctgggacagtggcttctgtgctgtcaaccctaagtttgtggccctgatctgtgaggccagcgggggaggggccttcctggtgctgcccctgggcaaggtgagcccctggggccctggggggagcagctcctccaccggacccatggctctgtgcaggtcctgattaggtgacggtcaccaggccttccagggcctgtgttgccatctggaaaactgagctgggccccatgagccttacacttcctccagctcctctgtgctgtggctgtgtggaaactgacgctcagaaggagccaacacaagatgggtcacaccagtgaccaggactacagacagtcctgcagacccatgatcagccctcctgagcctcagcctggggctttctccccatggaaacacagagggggttgggatggggtctgggggccctggcagcgttctcagggttgggagggactctggctctgggcctgtctgaggacctagcaactctgtcccccagctcgcaggcagggatgatgcaagaggtgctctcccccacccgcagccctgccctcccctggagcctgctgccccctccgctggctggctgctgccccgcacccccagcacactcctgtgctctttggggggtaagacaggaaggggagatgggccccaagttgttaccttaaaagggctgatggaagcaaagagaagaggaagtggttgtcggggtgagagctgggcccgcgccccacatggctgtcacacaggaagccctgctgaagcagctgtccccggaagaagccatttccaaacctctgctcctgcctggggccagttgggacaggctccctggcccctctccttttgggaggacccacccctgcagccccaccactcacactcgctctctggggagctgcctccacccccccagcccccatacacctgtcctggctccagggccagttgtgcccatggaagcctcactcggggaagctggggtgggggtgccaaccctaagggcagagacagactgagacagagaccggcgggaactctgccagggtcttgcacggcccccaacctctgccatgcgtggccagccctcctggggtttgcccaggccattttgggactggaacaagagaagaacaacccgcccccgtccccaccccaggccctggtccagctcccagggacaccacagctttcctctctgggcctctctgaaggaggtgtggggaggttggattgggtttgggaggcaaaagcacctccaaggccctgctgtgcctttagactggacgtgtggacaagaatgcgcccacggtctgtggccacacagcccctgtgctagacatcgcctggtgcccgcacaatgacaacgtcattgccagtggctccgaggactgcacagtcatggtgagtggtggtggggacccaggggctgggagaggggctctaggatgggatctgacatttggagtcctgaagactcactggcccctcctctgcaggtgtgggagatcccagatgggggcctgatgctgcccctgcgggagcccgtcgtcaccctggagggccacaccaagcgtgtgggcattgtggcctggcacaccacagcccagaacgtgctgctcagtgcaggtgctgcgggaggaggggcttgggggtggctcgtggcctgcagtggatgagggcaggaggctcatggcttctgacactgtggggaacgtgcaggttgtgacaacgtgatcatggtgtgggacgtgggcactggggcggccatgctgacactgggcccagaggtgcacccagacacgatctacagtgtggactggagccgagatggaggcctcatttgtacctcctgccgtgacaagcgcgtgcgcatcatcgagccccgcaaaggcactgtcgtagctgtgagtcgccatctaccctgacctttgaccctacagcctttatccttcttatccaccatcagccaggcccttggatgctgccctccctcgcctccacctgggactggccccgtagggtatgtacgggtgcctgacctaccacctccctttccttgcaggagaaggaccgtccccacgaggggacccggcccgtgcgtgcagtgttcgtgtcggaggggaagatcctgaccacgggcttcagccgcatgagtgagcggcaggtggcgctgtgggacacagtgagtgctggggcaggaagccgagggcccccaggctgggaaccaagactggaggtttcgtccctgctctgccactcacctggcaggatggccatgggcctcagtttacccaggcgtgagatggttgttcccactggttggtcgggagggccctcacaggtcactgcccagggaagaccaccatcccagggcctgggatgttacctctcacctgtgtctacagaagcacctggaggagccgctgtccctgcaggagctggacaccagcagcggtgtcctgctgcccttctttgaccctgacaccaacatcgtctacctctgtggcaaggtggcctcgtcgggcggggtgggggtgggaggtgggcaggatgggcctggagagggccagggcagtgggcatccgctggtattgaccctccctccacacctgccacctacagggtgacagctcaatccggtactttgagatcacttccgaggcccctttcctgcactatctctccatgttcagttccaaggagtcccagcggggcatgggctacatgcccaaacgtggcctggaggtgaacaagtgtgagatcgccaggtgactgacccccggccctgaccgcagcatgctccttgggcagtgggcagtcccaagcccacccaaccagactgtgggccccgctcaccttccccttcccacaggttctacaagctgcacgagcggaggtgtgagcccattgccatgacagtgcctcgaaaggtgatgctcccccgccccaccctgggctccaggctgggcactgactttgcggtcttgtggggggtgtcctggcataagcgctttcctcactatccctggccttgcccacagtcggacctgttccaggaggacctgtacccacccaccgcagggcccgaccctgccctcacggctgaggagtggctggggggtcgggatgctgggcccctcctcatctccctcaaggatggctacgtacccccaaagagccgggagctgagggtcaaccggggcctggacaccgggcgcaggagggcagcaccagaggccagtggcactcccagctcggtgagagggctgggaagccagggaataaaactgggagggtggggtggggctggtgtttggggcacctcaaactcacaacattgggaatctttgtgggtccgggaatggtaatcctgaggcctcagaacacaggtttcagattgataggcctgcaggtctccaggcagcaaccagctgagcgactaaagggcccaaggccagggctctagggatggggctcagcagaggctggggtaaggggagccagggaggagctgggcctaatgcagcaccgggtccccaggatgccgtgtctcggctggaggaggagatgcggaagctccaggccacggtgcaggagctccagaagcgcttggacaggctggaggagacagtccaggccaagtagagccccgcagggcctccagcagggtcagccattcacacccatccactcacctcccattcccagccacatggcagagaaaaaaatcataataaaatggctttattttctggta

SEQ ID NO: 1286 - DNA, 5667 bp, Homo sapiens; identical to SEQ ID NO: 1285

SEQ ID NO: 1287 - DNA, 5567 bp, Homo sapiens
ttcctcggaggtgtttattgatgcccagctgccatgctccggccactgacacaaccagaaaaggcgtaaacatgcacgggtgtcccccaggagggtggcaggggccctgccttcaaaccccggccccctccaggggacagttatttaaacgagtggccgggagcatctgccacctgctggggaggcagagaccctgcaatggccacctctttaaaagggcagctgtacagggctaggttttttcaatgaagtttctgtattaaaggagtggctctgggtttgttttttgtcctttttttttgagacattctcctcctctgaacctcccctaatccgacctcctccctgttgggggagagggacggggcagcgtggagaggcaggagtgaggagcgcgggggcctggggccgggctctgagcactgcccgggtgtgcagatgatggggggtttgcatatttgcagggactagcgagtcaggcaggaggtttgcatatgtgaatatagaactccgcagcccctcatgagcagacagacccgggtcacggagactcacaaaaataggtagtgcagggtgggggcagcccaccctgtgtaaacgtgcaacacactcgtgcgaaggttgggtactggacccggctcgatgggcctgtgccgggacactgctgtccactcaggctgaggacagagccccggccgcagggggcagctcactggtcagggtgtgccagcgctccagggctgcgtccggctgctgcaggcagtcactccagtgcttccgagcctcgcctcgggcacctggccccagggacacgccacctggggagcaggtgggcagggtcagggccacctccctgccacttgcccgccctcaacacccgcagccagctcctccctcaccaatgaagtcattggatttgccaatgtcatagtcccagacggtgacttccagggtcttggtggccagagtggagagctctatctcgtagaaaaactcctagggacaaggccggccacccgttcgtgagccagctccccagcccctccctggcctccctccatgtcccgtcccctcctgggtacctcgttaaattctgggttgagagtcttcttcttcacacacgtcttatgcttggatttcttgtccacatcgggcctcaggtacctgggggtggggtggagggagacgaactgaggggtgagggacaggccaggcccaactcaggccagggcaggctccctggggaggagagggtcagagcaagggctcacgtcttgacgtaggggtccgagtaaccgttgacgtccatggcagccagatgggcgcagcgcaagatgcctaccagcagtccccggcgccgcgagctgtagctgagactcagcaggatgcggccacgctcctccagcagcccctgcccctgctccgcctgctccaactgcggggcacagactcagggtcagcctgggcccctgcagcctcccacccacatgcatccccatccccatgaggtgcctcacctccttcagataacaggagatgcccctcagcgccgctgacatggaagagggggacgccagctgagggggcaaagagaaggttctggaagcctggcctccccagggccccctcccctggcgcccctgcagcccccacacagaccgggacctggcgctcgaggcagatgttaaaatgcttcttctgcgaaggcttgaggcggcggaggggcacgcggatctccccaataaactcattgtgactcagcttgtcctcatcacagacggcgatcctggtcgggaactgcagtgtcagggcccctggggtacctgagccccgttccggggtgtaggaagggccttggaccagcccagctctgccctaaacactacgtctcatctggaagacaggctggcacttgagaaggacaagcagatttgcccattcctctgtccctccctctgcagccacccggctgtccctggtccatcaggacatgctcagccattgtgggaagccctcagaaatcttggagcacgctgctcactgcctccattcagggcctgggggcaggagccgaacaccacggtggatgtggccatagacacaggccgtgagagctagaagggccttggagccttgggcagccagaccagtaccccacgcctcctcgggaacccccgtccttttcctgcatgcagcagagagccagccccgcagggactcactaagaaatgattgctttccagccacctgtcctcctgcagtccctgccctgcctccgcagtgacccactaccaggctgggcatctgtggcatggaggatgggcagatcccagccctgccacttctgagccacctgtgtgaccttgggcaagtcacttgatcaccctatgcctcaattcccatctgtaaatggagatagtcaagggaaagaaagaaatgtgaaaatgctaagcctgggctgggccctggtgagcgctcattttttggtctcattctggttttggcctctggcctcccctccattccacccgaatagctgaaaccaaggtggcctctctgctgcacagccctgaccatcagggaaggtcccagctgcaaatccaagcacaaaggcagaggtctctccagagcctgggtttcgctgcccgccacctgacttgagggagtactctccctacatctccatctcctaggatgacggagcaagttccctgtccctgaagacttcactccttaagagattttaggggaactcaaggcacggaaggggcagaccaaagctgcagaggtctggcttaagccaagggctctgagaaggggtctcggcaacccaggaacgtttttgggagggggcagagcttggactgaacctcagatgagcggaatttaggctggcaggaaggagctttccagatagaaaacaacaggaaaagttcaggagttgtggaactggccagttggaagaagggagtcctctgtttgaggggcagaagatacttttgttttgtttttgagatggagtctccatcacccaggctggagtgcagtggtgcgatctcggctcactgcaacctctgcctcccgggttcaagtgatcctcctgcctcagcctctcgagtagctgggatttacaggtacatgccaccacgcccggctaatttttgtatttttagtagagacgggggtttcaccaagttggccaggctggtcttgaactcctgacctcaagtgatccgcccacctcggcctcccaaagtgctgggattacaggtgtgagccaccacacctggcaggcaggagatattgaggggcaggaatggcagggaagaattttggcctgctgccaaaggggctagggagccgctgatggttcttgagcatcagagaggtacgggcttaatgggacatagatcaaccaaccagcggttacaatgtcagctgtccccgagctgctgctgggtggtggggaggggggccctcacctgagcaccttgtgcgtgatgtcgtcatctgtgatcccgctgtaagtcaggtcctcattccacacgggattcagtgtgttcctctgagtcttcgtttttagcttattggcctgggatgtggggatgaaaggttctcaatacctgtcctccagccccacaggctggagtcatgggctgggccgggcggggcgagaggaggctgttaccttacaggctccaggcagcaagtgcagcttgacgtaggggtcggcgaggccattgaaatccatgggcttgaggccctggagaggagggcaggggagagggctagaggctcccggcacctctctccatccctcttgtagagctggaccctggaggagcccagaaggagggggcaagggcaggacgaaggagcaggcctgggaagggaaggaggaatgggccccctctgggggctgcacgcaaaccgggcccgggcttgggtggcagggagtgcccaccttggccctgaggatgctacagtgcagagtgcaggaggcccggtcgtagagaaggtcaaactccagcgtgcctagggcggctggagagagaggaaaggcagcatgggtcggtatggagacaggtgtgtgcgagaggccagcaggtgggcactggctctgtgtgtctctctctcttgccagcccgcgagtgtgagtgcaagaggctgagtgggcccatgcgtgtgtgcgtctgggtccctggctcggccgcaactggggctgtgtgggtggtggagtgtctcagcagaaatactgaatattgagccttgctgaagctgtaatctccacgctgactgcagctgtggtggccgtccctgccacccccccactgccctcctcccctacctacatgcacagccagcagggcccatccccctctccccccaccacggcaagcctggagacccccaccagcacatggggcctccaagcccccagactcactggcatcatccgagtcatagctgtccacctccgcaccatcctcaggcgtggtggccccaaggagggctgcagggggggccagagccagggggaccagatgggcgggggcctccccgccgcccccgccgcccccttcaggtcctggtccccgggggaagtagtcagagatctggcggatgggccggatgggcccggggcacacgttgatggccatgtgctcctggatgttgatggtcatgcgatcgcccctgcggcccctcatgcagcacccctggctaggagagggcgtgtgagccagtgagcccatcatacctagccatcctggctgagggccaggcgacggcctcctcggtctgtggggccctcactggcctcccttcctaggtgtcgagggagagggtggtgtgtgccagccggtggcaggtgggaggcctgggccctgcagaccccaagctgactccacaggggctgggctgccaacccactccttgcagaagtcgaggttgcaccaccccgtcctcacccacccacttctaggttgtccctgtatcatcttgccagctccttcctctcctccggggctcccctctgctcctgagcctgcctgtcccccaaggggccctgcagggccccgcctctgtttctcggaggctctgtcctcctctgcaccaggcgctggtctagtcagggtgtcacccacccctctaggctccaactgcccactgtcccctcattcagccccaggacctgtctgcctgcctggttcccccgctcgctcaccacagcccacggtggagaccccagcctcagatgccacctctggctcctcaggggagccagaaattgcagccgcaggagagccgaacacccccgtagcgcacacaggctggcacgcttccccgcaccctcacgcccccggcctgcccagccccctgcacctgcctctgcctccaacaggtgcccaggcactggggggacggcgggcgcaggctgggcggcggcggccggcgaggagagcgcggagtcgagctgtgcgagccgagagggagggagcgccgagaaagtgcggggaggagggggtgagcgaggtggaggcgaggatgcagccggcgcggcggcg

SEQ ID NO: 1288 - DNA, 6439 bp, Homo sapiens
tggcgttcacgcagatcgtcttttattagcggtctgtaaagcacctcccagggtcccccgaccccagattggaggaagccttgagaggtcagtagcaccagggacatggcagggcccgagggcgcgatgtgcagccgatggtgagggactgggcgccctcgcctgcccccggggttgtcagcactgggaaggcttgggggtagcagccacctccttcccccaacccaacagactagttcaaatttgggtaaataaataaaataaataagattcctcaagctggcctaccctggagaggagccgtggttgcagccggccactcgggaggcccgagggccagcgggggttagttggggcgtcctctcctctcgggtgatggggagccctgggggatggcagcataggggctgggatggccttggcagaggcgtctccccacattctgactcctggtccccttgaaaccctgttggtgtccctccccacaagccctcctgccctcagtgggtgggaggcggtgccccctcccctcctccagcgcaagggtgtgcaggaagggggcagagtagggggaagaggtcccctctctccaccccctcagtccccgagagatggggcctcttccctttcggggtcatcgtcagtcctggggttgtccgggcaagaggaccctggctcccaaccccagccatcagccccagagccctgtctccacgggggtgggggtggggagggggagggtcccggcccccggcctcagtcctgggcctggcaggccgggggcggccgggagcggggccagaagaggcggcaggccccacggcagatgaggaagaaccagtagagctgaggggccaggagcagcgcagcgcccaggttgacgtgggcagggatggccaggggcacggccagcaggggcaggccggcatggcgcccgtaggcccagtacaggtagggaaagagcagcacccggcagcagaggaagctgagcagcatcagggccccgttcaccttgtgcagcagtgtgtgctgctgcttgtactgaggagacacagacacagtggccacggcagcagaagggctcggccccccttggccctctccctgcctccctgcgaccctagcaggcagctcctcccaaaccagacactttgccaggacacaagcaccaggtgctcaaaatgcacggggtgagggggggatgacgaaggggctagagcccttggcagcaaccttgaaggtccctccccttcctgtgacctccccattgggctcctgcaccctcccatgctcactcacctggatgaggatcttgccaaggcagacgaagggcgtgctgacctctgccatcaacatgcaacccagaaagaagtctcccttaccctgtcgccacacctgggcacagaggcaggaaggtgaggagctggggctctccctgggttcttgggcagcccccgcccttcctctttcccctctgtcactttgggagatgcttgactctgaacatcagaacacctgggtgcagggctgggtgcagtggctcacgccggtaatcccagcactttgggaggctgaggcaggtggatcacgaggtcaggagtttgagaccagcctggccaacatggtgaaaccccgtctgtactaaaaataccaaaaaaattagccaggcgtgttggtgggcacctgtaatcccagctactggggaggctgagatgggagaatcacttgaactcaggaggcggaggtttcagtgagccgagatcacaccactgcactccagcctgagtgacagagagagactccgtcttggaaagaaaaaaaagagaaagaacacctgggtgcaggagcaggtgcatgacttggctgcatccctctcacggtcctgcagaaagactgtgtcccttatgtaacaggtgaggaaactgaggctcagagacgtgcaaccacaaatccaaagagccacagccgggcatcgtccagcccagggccaggctgcccccacaccctggtgccctgggctggtgctcagtgaaccctgcctgtccacagctttccctgggaatacgctgggtctgcttggttgtcagtacgcagacccggggcttcccaggctcctgccagcaccagcaggaccaaggagcaggccacccgcaccccgcccgcccagctccccgggactcaccactgagagtgggaagcacaccagcaccatggcggcatggtggagcaccatgaggaactccttgtgcaggtagccacgcgctatggcccacgtgctgcccggggctctggccgctccgtcgtcccctccatgccctttgacctggtgcttgtgccagtgacagaggaacatggcgtagatgtcgtagatgaagtagggcacagcaaattgcgtgtaggcagaggacagccagtgtctgttgggcagagagacggggtgggggagcaaggaggaaaggggacaccagtgattggggtcagatctcaggggtcagcacagcagccctggacaggagcggagtcttgggtacagatgagggatccagagggtagagggtgagaaacttgcccaaggtcacacagtcatgcagctagtaagagatggtgctgggattcaaacctgtggtctcagaactcacccatgttcctctctctctgcagtatagtcgggggaaaagaaaagaccagaagatgcccacagaccaaaaggcacagatacagtgccaaaataagcccaggacaggcaggtgggaccttgccatggttatttgtcctaaccttaccatgaggttaggaccagcaacagctgaaggggcgagagtgctggagagagaggtcacaggggtggacgcccattcctgcctcctgggacaggcgatcttccaaacttcccatgcatagccttatttacccctcccaaaaccctgtaaaaggtaggtgtggccatcatccccactgtacaggtgaagaagtgagtcacagaggggctaggtaacctggccaaggaagggacatgggcggtgtggctccacagccctcactgtcatccccaccatccccagaagatccgagaggcatcagagacagaccctgttggcaagtgagaggtcttgtcagcgctgttcgccctgccccaaagtcacccaatctcttgtctattttgtgttgtttttcagggacagccaagcgttaaggggaaaatgcagagcaaaaggagccaaggacaaagaaagttccatgtacttggagagtaaacaaaaacgagaaatggatgaatagacaagacagcatttttcttctggagtcagcacattggcagtttctcttaaatcctgtagtcccaagactggcctggggtgggggcaggaggtcagagaggcaggacctggggtgctcgccccacaaggggtggagggatgaaagcagagtcagccagaagccatcaccaaacatgaggcacgtggaggaggctgtggagaagttggggctgaggcctctgaggatggggagcctgaggcaggcggcctgtgagtggagccaacccattctccagcagggacggtaccagggaaaagggaacctgagactggtgcagtggtgtggagctgcggcccagaggcagggaaagatgagaggggaggggcagctgtagagaacgcgaagcgggaacacagggagagaggtcccaagtggcctggaggagtcagggcaggaagctgcccagaatgcaggcccagcagaggtgatgggagatgggacagctgggctggtgcaggagaccaggaggggccaccaggccctgggctgtcatgtgaggtgttagatcccatccccaccctcttggcaattaggtgctcagaagtaggaacagctgctgccctggattaacccggatcctccccacctacctgaggattaaagcagggaagacggacaggaacagacacaggggggcctggggagcagggggtacagaagctaaacggtgacctctgcatgtgaaggctggggaggaagtgctggatcccaggctcagcttggagcaggggagggaaggggtgggcagaggccaagaagcagccaagtccctgggcggggtctgaagaaagagttaagccaagaactgtcctctgcagctgccacttaactcaattcctctcgctgaagcccttccaggaagggccgctgcctcaccacagaagaggcaactcatcttcgggaaaagaggaggcaaacagaaacagggcaccccccatcaggggcgtccaaatgttccctgggactcagtggctgccacagaagggaagcggtgctgaaagctacaaagggggcgttgtgggcacctctaaggcaacttgcaacgggccacccgtgggtcacctagggcggccgtcagcaccacggacagggcccctctcctccccgtccccccgcctcctgcctgcacacctctgggcctttttggcaaccaccagacactgcagcagctgcctggccacattttggcctcttcaccctcatcccctcccgcactgcctggccgtgtgtggccttgtgcgtgtcatctctcccttgtcctctccctcaggcatggagtggatgccggatgcctggattatgggaagggctgaggggtgagcctggcatgaggagggggcaccccatctgggtgctggctggaaatggggtctgcctcctggggtggaaggcagggaggaggtggggaaccacgacaacacgggagacctggaagccgactagaaagcgctttgaggatcctctctgatccccgctccttctccccctggttctgacctttaaggacaggacaggataaatttatccctgggtgttgagttgcggttattgcagttaacttgctcaggcccaagttaagggcttggggaccacagacagagttccctccaagatgtggggtcttccgggattacccgtacacgccaaccactggcacctgggcaggggggtgtctcgcagcacttactggtcatcaatgatgtgcttgcaggaggtggagacgatgtagccggcagtggaggccatgatggcctggacagaggacaccagcctgggggagagagggaggcgtgctagaaaggcagaagggaagaggcgtgtgccttgatttctcctcgttgctagtctaacgactgcgctttgcgttcagccacttctcgggccagtccttgcctgccttcgcccaaggctgggctgcctgaggtgtgccccaccacaggtacctcacggctctccggcccgctcggctgctgttcctcagtccaccccactccttgccaccttcttccttccccatttgtggaaactgagtctccctcttctcaagcccgcagggtgtctgtcctgaggtgagactgagagtgaactgctggcctggacctctccccacgaggggagcctgggccggttcttgccccgcttagctgtccagtcatgacgcaggcctcactctggaccctttgtgaccccgagttccccagtcactttcccactgtctcctgactgccaccagcctccactctgcactctggccctgttctaggggtgtagagttgtaccatccactcctccatccctggcccccaaacactcaccctgaatgacacctagctgtctggccctggcctcagtccctaatgtcttataggaatgtcttcgccgcatgctggccctgttttggagggtgggagggtgtacggggaagaagagagaggcgggctgaacactagtagaccagatggccgggctggatgaggtctcccagaacagtgagcaaggcaggcagtgaggagagaggaagcctgggggtaaagccccggacccccacaggagctcccagtcccccaccgctgagggtccagagaagtgccaggtcccttccattccctgagaagcccaagaagcagacaggggctgaggggaaagaaagtggtttacctggctgagacaatgactgcgtcggcctcctcccagcgtagctggggcagccgctggagcgtgttcttggagaggaggaagagtccggggaacaccacccccccggccaccatcggggtcagcatggtggctcaggacttgggcagggaggcaggcgggccgtgaaggggcagggaggccgagtggaaggagttaggggtggagaagggacgccaagcccgggaaggagggagaaaacgatgagaaggggcacaaaggggccagggcggggacgggatggggccagggagtccgatgaaactggggagtcgggagggggctggctgggcagagacgggggaggggaggatgggagaaggggagcaggagcaggccagcgagggatggggagaggcaaagaggggatggcttggtgagggacagagaggaagaggggacaggaggaggaggatgcggatggggg

SEQ ID NO: 1289 - DNA, 8748 bp, Homo sapiens
tgatcgaaaggcaaatatttatttttcaggaagagaaacaggagacctcgaggcttctggacttaggaggtccgggcagctggtccatggttgtccaggtagtgccgcagggctgtgggataatccgttatgacgccagtggctcccacgctgaaggctgcttcaaaatccgactcttcattaaggcaccaaaagaccacctgagcagggagggagggggcctgtagattctgaacaattttacatctggagagtggggacccacctcctcctctatggagactccccagcagcagtaggctggagctgattgttaaattctcaggaattttgcaaagtggttattaaacccagccattattaaaaattaaatcatagcctgggtgcagtggctcacgcctgtaatatcaacactttgggacgccgaggcaggagttgaggccaggtgtttaagatcgagtgagacctcatctctacaaaaaactttgtaaaaattaattagcccggtgtggtggtatgcgcctgtgctcccagctacttggaagactgaggtgaaagaattgcttgagcccaggactctaaggctgcagtgagctatggttgcaccactgtactccagcctgggcgatacaacaagacctcgtctcaaaaaaaaaaaaaaaattatatatactgacaattaaattatttatttatttatttatttattttttgagatggagtcttggtttgtcacccgggctggagtacagtggcatgaactcggctcactgcaagctctgcctcccgggttcacaccattctcctgtctcagcctcctgagtagctgggactacagatgtccgccaccacgcccagctaatttttctgtttttagtagagatggggtttcaccatgttagccaggatggtctcgatctcctaacctcgtgatccacccgcctcggcctcccaaagtgctgggattacaggtgtgagccaccgcgcccggccctaaataaattattaaaacaacaagtggccaggcgtagtggctcacgcctgtaatcccagcactttgggaggccgaggcaggcagatcaactaaggtcaggagttcgagaccagcctggccaacatggtgaaatcccatctctactaaaaacagaaaaattagctgggcgtggtggcgggcgactgtaatcccagctactcagaaggctgaggcaggagaatcgcttgaacccaggaggtggaggttgcagtgagctgagatcacgccattgcactctagcctgggcaacagagcaagactctgtctcaaaaaacaaaacaaaacaaaaaacaaaacccaaaacaaacaaaaatccagtaataaatattcaaagcatatctcttgctaatcagtttcctattactgtgttcttgaagtgattaagtctgttgaggctgcaagatggaaatactacatgatggggtgccaccatgcatctcttcccattctgcatttagtggcttcatgtcggcagcctgaaactggccaagatgggagtatttaaaccaggaaaattaatcctcaaatcagggctttcatttgttcctctctgagagctagttgttgaccacttaacagcaccaccctcccccaaacccccattccactgccacctgccccagctcctgcagctctgccccttccctgcccgttgagtgggcactgaggtaggcggagatgggaattttttatttaaaaatacagatgagacgaggtctctctgtattgccaacactggagtgcagtggtgtaatcacagcccactgtagccttgacctcctgggctcaagtgatcctcccacctcagcctcctaactagctgggactacaggcatgcactaccatgcccagttaatattttatttatttatttatttatttttgagacagtcttgctctgtcgcccaggctggagtgcagtggcgtgatctcggctcactatagcctccagctcctgggttcaagtgattctcgtgcttgagcctcccaagtagagctgggattacaggcatgcgccaccatacccggataatgtttacatttttagtagagatggggtttcacaatgttggccaggctggtctcgaactcctgaccttagttgatccgctggccttggcctcccaaagtgctgggattgcaggcatgagccactgcaccctgcctctgcatttttcttttctttcccttttcctttcctttttcctgtttccctccctctcctccctctccctgtctctggctctcacgctctttcctctctctcttttgagacagtctggctatctctcccaggctggagtgtggagtgcagtggcgtgattctgattatagctcactgcaccctcgaaaccccgtgctcaggtgatcctcccatctcagcctcctgagtggctgggactacaggtgtaaaccactgcgcttggctaatttttaaattttttgtagagacgagggtctcagtatgttgcccaggctggtcttaaactcctgggctcaagtgatcctcccaccttggcctctcaaagggctgggattacaggtgggagccgtgcccagcctctgcctatggcatttcttccctgtacccttgatgggaagctcccacccctagtaccatagtgcctggaacattctcaaggatcgtttactaattaaatgatctggtggaagccaatgctcaggggagaggggggtgggctgggcctggtttctcccatctctcatctttccccagccccctctcatcagggatcatgatacatcattgttgtcatcataatggctaacatttatcaagcccttaataagtactagttacatatccatatgttggcaatgtcaggttaagaaaatatgtgcgtggccaggcgtggtggctcacacctgtaatcccagcactttgggaggctgaggcaggtggatcacttgaggccaggagttcgagaccagcctggccaacatggtgcaaccccgtctctactaaaaacacaaaaattagccaagcatggtggcaggcacctgtagtcccagctactggggaggctgaagcaggagaatcgcttgaacccgggaggtggaggttgcagtgagccgagattgcaccactgcactccagcctgggtgacagagtgagactcttgacacacacacacacacacacacacacacacagaagaagaaaattgtgtgtgttcgtgtgtgtgtgtgtgtgtatccagagagttaaatataccattttcccattttagggacgaagaaactgaggtgaggtcacctgcccgagtgatgcagctagttggcagcagagtgggaccggaaccctgctgccaggtctgtgtgcggtggaagtggtggtcacggcctcacctgcacccctcgctcctccaagtgtcggatcagactcttcctcatgatcagcctgggggtggggtggggacgtgggaggtgatgatgagaggggacctgggagaagggcagcagtaggtctctatggggacacgccacccagccatcttgcccacctcaccatttcgaaaccacagccaataactggttcaggcaagagcaggaaaatgggaaataggtcctgcagagagaaggaagtgggggttagctcctagggtctcccctgtcccagaggtggggtgggctggtagtgcccccgccaactagggtagcgctgccctcccaccccccagaatcccccagaataacctttgtagttgccccagtgaacaattcacccattgttcagagagcctactctgaccaccacgcttcaagggtgtggccctccagtcaccattcaccagataaggaatctgggccttagagaacgaaagggacttgccagacccaaagcagagtggtggtggggctgggccagggcctcgcttggttccaaagctggacatccaggctgcaggccctcctggttgggcctggccagcttcttatttatctatttatcttattattaatttaaattaatttttttttttttgagacagagtcttgctctgtcgcccaggctggagtgccgtggtgcgatcacagctcactgcaagctccgcctcctgggttcacaccattctcctgcctcagcctcttgagtagctgggactacaggtgcccgccaccacgcctgctaattttttgtatttttagtagagacagggtttcaccctgttagccaggatggtctcgatctcctgactttgtgatccgcccgccttggcctcccaaagtgctgggattacaggcgtgagccaccgtgcccggccattaaaaaatttttgtagagacatgtctcactatgttgcccaggctggtcttgaactcctggactcaagcaatcctcccgcttcagcctcccaaaagtgccaggataataagcacgagccagccaagtgtggtggctcacacctgtaatcgcagcactttgaaagtctgaggtgggaggagaccagcgtggccaacatggcgaaacgccgtctctactaaaaatacaaaaattagccgggcgtggtggcagaccctgtagtcccagccacttgggaggctgaggcaggagaattgcttgaacccaggaggcggaggtttcagtgagccaagatcgcactactgcactccagcctgggccacagagtgagactccttctcaaaaacaaaaaacaatggccgggcgcggtggttcacgcctgtaatcccaacactttgggaggccgaggcgggtggatcacctgaggtccggagttcaagaccaccctgaccaacatggagaaaccctgtgtctactaaaaatacaaaattagccaggatggtggtgcatgcctgtaatgccagctacttgggaggctgaagcaggagaatcgcttgaatctgggaggcggaggttgcggtgagccaagatggcaccattgcactccagcctgggcaaaaagagcaaaactccgtctcaaaaacaaacaaacaaacaaaaaacccacaaaaaacctcgtgagccactgtgcccattggccagcttcttgagaccagacagcacttagtgggacgacccctaattatcccactccaggggtgactttagagacccttgacagtgtcctagggcaggctctggagtcagacccagggaaaacctaagctctggatttccagctgtgtgtccttgggcaaattacagaacctctctgggcctcagattctctagggtaccatgggagtcatgattcttatacctcctgggggtgctgcaaggtaaaagtcaacccaaaatatgttaaaacactttataaatcttgtataaggccgggcgcagtgggtcacgcctgtaatcccagcactttgggaggccgaggcaggcggatcatgaggtcagattaccatcctggctaatacggtgaaaccccatctctactaaaaacacaaaaaaattagccgggtgtggtggcgggcgcctgtagtcccagctactcgggaggctgaagcaggagaatggcgtgaaccagggaggcagagcttgcagtgagccgagatcacgccactgcactgcagcctgggcaacaggggaagactcctcaaaaaacacaaaaaaaatccggtataaaaaggtggtacacaaatatcattgatctctttgtagcaaggtattgtgggggctgagtgggacttccttctggacaacagaggggagcagagagctctgggactaccacagagaagctgtcagaaagcaaagggagaccgggcccaggggctcaggtatgtaatcccagcactttgggagaccaaggtgggaggctcgcttgagctgaggagttcaagagcagcctggtcaacatagtgagaccttgtctctacaaataatttaacaattagccaggtgcagtgttgcacgcctatactcccagctacttaggaggctgaggcaggaggatctcctgagcccaggaggtcgaggcgcagtgagtcatgatctggccactgcattccagcccgagcaagactgtctcaaaaaaaaaaaaaaaattgtaaagcaaagggagggactaggcttaagtgccagcgaagtatccaaattcctgatcctttccccagctgttactttgttaacccctgccttcctgcagaacactgacttggccttttcctgctgagggtctgagacagccgtgctataattaatgaacgaatgtctccccagccagactgtaagctcaccaaggacctctccccaccctcactggtctcatttacacattataactgcacctgggacagagtagacattcaataaaatatgctagatggcctgagatggataaattacctctctatcctaaaactccacatatgcacagaatttcagggtgttcacagttcccttagtattcatgaatgctgggtaagaaccactgtccttaaaagaccttgggggttatctctgaggggagctggggagctgggaagatctgggctccttctccacggagaccctaagcagtggggagtttttctgaggtccgccccccactggtacctgttgatgatgttgggcaggaagcagaagaagaacttctcagggattgggatgaagggcagcagccccaggtagtaggaaagcagcacccagaatcctcggcttattgtgaaggacaggggcatctcggggttctggggaggcaaggagaggcatgagaatctgtctgctctggggaagcagagaggaggcatgagctgcaggggagccgtggtgggcattccagaggccctactacctgcaggatccaagtcacatcttggggctgggtgtggtggctcacgcctgtaacctcagcagtttgggaggctgaggcaggtggatcacctgagatcaggagttcaagaccagcctggctaacatggtaaaaccccatctctactaaaaatacaaaaattagctgggcgtggtggcgtgcacctgtaatcccagctactcgggaggctgaagcatgagaatcgcttgaacccaggaggcagaggttgcagtgagccgaggtcgcaccaccgcactccagcctgggcgacagagagagactgtgtttcaaaaaagaaaaaaaacaaaagtcacatcttggctctgtgttcgaggcctgagttcacacccttttcattgccaccgccacgccactgggaactctcccagacccctctagctcgggtccccatgctgggtgggctccagctctggggaggaggggcccctggaggaggaagaggacgggggaggggtggggggactcacggcagccttgcatttcttcatgaccgagctcttctccgaggcccagatggtgatttcattacggtcatagcgtctcaccaagcctgctatctgggaggaggagaaggaggtgaagggagagccaggcctctctcacgcccccggtggccgccctagccctgcctgcagcaccacctcacggatgagctcttcgttcttccctttgatctctacgctcatgggtgtccttggaaacctctggaacaggtcctccagacgaaccatgcgccggtctgacccgtgagcaaagtggcctgggggtggtgtgggaaaaggggtcagagggaagccaaggcggaggtccaaggaaggcaggcatggcccaggcagggctcgaagcccttgctctcacctggagagaagtaaacctccagcttctccttgtagaggggcaggtcctggggaggacaggaaggatgtcactagaggcccgcattgggcatggtgactctcagggtgggggttggggtgtcagggcagggcccacctcgaagtccaggctgcccacatccctgtttaggcccgactggcggcacaggttctcatcatgtgacaccaccaccactctgtcccgtgtcagctgacagtcgagctccaggaggtccgagcgctgggccatggagctgtgggggtgaaggtcagcggggggcaggggcaggggactgggatgaggggcatggtggctgggaggtggccgggaatgtgagagcggagttcgtggcgggatgtgcaggccacctccagggggcgccagtcacccagctaggaagtgaatggcgtcccttgctgtgatgcagtccacgacctgcacaccctcacatggcagcctgggcaggggcagatacactcacttctccatggcctccatggtgttctccagcagctctccagatcctgtggggggcactggagtgggcctctggggcttggggtctaggggcctggcccaacctcatcacccacattccctctctgggctccatcctccctctggcctcacctccccagccagcccaggctgcgccagcatcttcttcctcgtccacaccctgccctgccacttcgctctccttctctcttggtccctgccccgtttctagcatgcccccttggacctacccctctgtgctgtccactttggcacctgttctcacccctacccggctcacctcctcggtgggcccccaggcggatgcggaaggtgggagccctgggcgtgtgcagcagatgaggccggcgcaggaagaagatggagagcatggcatagctgcccagggcagggagggcatagtacagcaaaaggctcatgaccgtactcccacagaagctcctgcagccacacgctcagccgtccgcgggactgtgctgcctgcctagccagtgtggg

SEQ ID NO: 1290 - DNA, 3777 bp, Homo sapiens
atagtactgcttgtgttttataaagagaatttattgggctgtgtatctaaacatttcagtgattttaatgactttaggtgtgaccagatctcggatctcaaaggtggtcttcaaccccttgacctctaattcgttttctttgctttgacttcaaagattcttaggtttgcctcccacacagaccccaggcagctccatgctcacgaatcttcccgcaagcctcagcagccagagttcagtggagacctcatgtgactgcagaggctgggcctgtagccagaggcctagagggctaggactggcccaggaggtatgggcttttccccacccctttgaggctaacagcccatggacaaagtggctgtttgcataagggagaaggcttaagcactggctgccctcaagtcattctatccctctcccaagtgggcattaggttatcagactaggctaaaagcagaggggccacggggtaggcgggcagcacaggagccacacacccttctccaaaagggtctggtggctgttggatgacagggtctggaggcagggacttcttccaggaacccgggggaaattaaagggaaccaggccaggggaggaggtggaggcagtgactactgctcagtttcctggcccaaaatacaggaggtgagaatgggggaccaaatttgatgaggtgattaaaaacactcctttattgagtcttaaaaaataaacaccttaaagggacagcgtgaagctgagaagtagcatcccaacagcttgtgtccttgggagctgcagtcttctctgaaggaagctgcttctgttccacagacacagggcaaggggtgctatgtatgctttgtacatgtatcaagggtccctcctgggggtggcagagctcagttactctcgccatcactgctgatgatgccacgcatatgtgaccagtctgggggtgcgggacggggccgctcttcatctgagtccagggtccgtcggtacagctcccctgggggtgctgcttctcctaaagggttccaggctgtacgtctgcgtggccggcctaggggaaaggggaaacgagagatcagatgtctgagaaggtccaaccccacctatctgctcctgggcagtgagaggaaaccccttacccgagccactgatgatgttcgcaacatccaaggaggccacctcagctgcctcctccctctgctccttcagggcccgacacttccctagggaaggggtacctggggcagaagaagctggtgattctctcctccccagcaggaaggccctctcctgcagcccccagggcacgccgggcctcacccttcatgcctagcgcttccagttctgcccggaggatactcaggcgctccttgtgtgagcaacaggagcccaacagcttcttgtagtttcgatgggcaccacaggcccgaatgtagcgcttcagcctcatcacagccgggtggtcctctccacggcgacctgagccagcctagcaaggaaagagcagctgaaggccaagcctgctgggcctgaggcagggtctccctcttccctaatagtggcctcccacccctcctcaccctcaccttccctcctttggcctctggacttccatctgaggaggaagaggagcttcgtgtcctgcctttcctggagctcttcttggaagagcggttcttcctctccccctgggggcctccccctgcctcgctgtcacttacctccctctccaagtcactttcctcaccactggtgctgcccagtctggccatctttctagagcctttagctgtgggttcccccttcccactgtcttcctcgtcctcgctgcttccactcaacctcttcccacccttaagctgggtcctgtcctcactcttcctctgcactgggggttctctatctctcccactgtcatccccactgctggctgcctctttctgctcttcctcgctgtctgagtctcccaagagcctctttgcctggcttttctgcttacagctcctctcctccctagctgactttctccggccattgctcctggttctgggtttccaatcccccttttcctcatcctcttctttctcttcctcctccacttcctcctctctctgctctttcttctgggctaggatctcctcttcactctcctgttcactttccttcaggcttttagttcctttatttccctccaccttctttgctgtcctctgaacgggttctgcctcgctctcctcactttcttccctggcctgcttcctactgactgaggccttgcctggtgcctgcttctttaccacaggtttcttcctagtcttccccttgtaccccttttcctcctcctcactgctctcctctcccctctgtgcgggcaggtccctctgccgttcctcatcactgctctcctcaactgcctttgaggctcgccttggattctcctctttggctgggctgacttctgctgccaccccattctttgctgggggtccaaagtagtctgggctggaggcttcagagccggactctggaatatggagaggagagagggttgagacaggctcctcctgtcccttctcccttcacttcggataggttgcctcgagccctgccctgacagttggaggggcagcaggaaacagctatctgtacttgctgttcccggttcctgactcactagccttgctccctcatctaacgcctggggacataagagatgcgcagtgaatgcttcttgagtgaaccaacgatgcagaaggcccccacagcagggaggaagcactaacccgactctgaattgaagcggaacctttttctctccgggtcgctacaaggggtgggaggcctcttgcccttcttggtaaggtccagtttgtcttccctggaagcggcttcatccacctgtgtgtgcgccaagagggcaaactatgcaccaaggctgcgctcaccgcgccccgtcaggcccctcctcctcagcagcaagccccgcctccgcctcccgcggcccaggctccggcccggcacacctgcatcttcagcagctcctcctccaccagccgcttcagtgcctgcttctcctcgggctccaggtggctgcggcccgagtgagctaagtacctccgccgcacgatggaatgcgtaagcgtgctgcagggacatggtgtcaggacggagtcccgacccacccgcgccctttccaaccccatctccaaccccctgggcacctgaggtccgggcggcctcggaagaagctacgggtgaactcctgcatctccttctcccgcgccattttgctcaacccgggattgacggctcccgcctttttttcttctcggcctccgtcagcgcgtttgacagcggctcgcgcacgcgcagtgctgcggcaacgtggggcgagggaccgttggcccttggccgcggaccgcgtgggccgagaactttgccagacgagacttgttttctctgggcagttggagggtctcgcggctcctacccttttttggaacggatcattttaaaagttctcgttagaaaccaattcggcgccggcaccctttgggtgaaacctaatcagcccgcgacgctgcctttctcactggtcacgggcaacagctaggctgctgttatttcgcaaggcagaagagaaaaggcatcctcgcgagcagatgaggaacctcggggataaatccttttgtggcttcaagtgtctaagtacattagagtcaggaacggcgctttccagcgtccgccatttttgtggcgtcaccgcgtcgctgctac

SEQ ID NO: 1291 - DNA, 3101 bp, Homo sapiens
ttgatgaggtgattaaaaacactcctttattgagtcttaaaaaataaacaccttaaagggacagcgtgaagctgagaagtagcatcccaacagcttgtgtccttgggagctgcagtcttctctgaaggaagctgcttctgttccacagacacagggcaaggggtgctatgtatgctttgtacatgtatcaagggtccctcctgggggtggcagagctcagttactctcgccatcactgctgatgatgccacgcatatgtgaccagtctgggggtgcgggacggggccgctcttcatctgagtccagggtccgtcggtacagctcccctgggggtgctgcttctcctaaagggttccaggctgtacgtctgcgtggccggcctaggggaaaggggaaacgagagatcagatgtctgagaaggtccaaccccacctatctgctcctgggcagtgagaggaaaccccttacccgagccactgatgatgttcgcaacatccaaggaggccacctcagctgcctcctccctctgctccttcagggcccgacacttccctagggaaggggtacctggggcagaagaagctggtgattctctcctccccagcaggaaggccctctcctgcagcccccagggcacgccgggcctcacccttcatgcctagcgcttccagttctgcccggaggatactcaggcgctccttgtgtgagcaacaggagcccaacagcttcttgtagtttcgatgggcaccacaggcccgaatgtagcgcttcagcctcatcacagccgggtggtcctctccacggcgacctgagccagcctagcaaggaaagagcagctgaaggccaagcctgctgggcctgaggcagggtctccctcttccctaatagtggcctcccacccctcctcaccctcaccttccctcctttggcctctggacttccatctgaggaggaagaggagcttcgtgtcctgcctttcctggagctcttcttggaagagcggttcttcctctccccctgggggcctccccctgcctcgctgtcacttacctccctctccaagtcactttcctcaccactggtgctgcccagtctggccatctttctagagcctttagctgtgggttcccccttcccactgtcttcctcgtcctcgctgcttccactcaacctcttcccacccttaagctgggtcctgtcctcactcttcctctgcactgggggttctctatctctcccactgtcatccccactgctggctgcctctttctgctcttcctcgctgtctgagtctcccaagagcctctttgcctggcttttctgcttacagctcctctcctccctagctgactttctccggccattgctcctggttctgggtttccaatcccccttttcctcatcctcttctttctcttcctcctccacttcctcctctctctgctctttcttctgggctaggatctcctcttcactctcctgttcactttccttcaggcttttagttcctttatttccctccaccttctttgctgtcctctgaacgggttctgcctcgctctcctcactttcttccctggcctgcttcctactgactgaggccttgcctggtgcctgcttctttaccacaggtttcttcctagtcttccccttgtaccccttttcctcctcctcactgctctcctctcccctctgtgcgggcaggtccctctgccgttcctcatcactgctctcctcaactgcctttgaggctcgccttggattctcctctttggctgggctgacttctgctgccaccccattctttgctgggggtccaaagtagtctgggctggaggcttcagagccggactctggaatatggagaggagagagggttgagacaggctcctcctgtcccttctcccttcacttcggataggttgcctcgagccctgccctgacagttggaggggcagcaggaaacagctatctgtacttgctgttcccggttcctgactcactagccttgctccctcatctaacgcctggggacataagagatgcgcagtgaatgcttcttgagtgaaccaacgatgcagaaggcccccacagcagggaggaagcactaacccgactctgaattgaagcggaacctttttctctccgggtcgctacaaggggtgggaggcctcttgcccttcttggtaaggtccagtttgtcttccctggaagcggcttcatccacctgtgtgtgcgccaagagggcaaactatgcaccaaggctgcgctcaccgcgccccgtcaggcccctcctcctcagcagcaagccccgcctccgcctcccgcggcccaggctccggcccggcacacctgcatcttcagcagctcctcctccaccagccgcttcagtgcctgcttctcctcgggctccaggtggctgcggcccgagtgagctaagtacctccgccgcacgatggaatgcgtaagcgtgctgcagggacatggtgtcaggacggagtcccgacccacccgcgccctttccaaccccatctccaaccccctgggcacctgaggtccgggcggcctcggaagaagctacgggtgaactcctgcatctccttctcccgcgccattttgctcaacccgggattgacggctcccgcctttttttcttctcggcctccgtcagcgcgtttgacagcggctcgcgcacgcgcagtgctgcggcaacgtggggcgagggaccgttggcccttggccgcggaccgcgtgggccgagaactttgccagacgagacttgttttctctgggcagttggagggtctcgcggctcctacccttttttggaacggatcattttaaaagttctcgttagaaaccaattcggcgccggcaccctttgggtgaaacctaatcagcccgcgacgctgcctttctcactggtcacgggcaacagctaggctgctgttatttcgcaaggcagaagagaaaaggcatcctcgcgagcagatgaggaacctcggggataaatccttttgtggcttcaagtgtctaagtacattagagtcaggaacggcgctttccagcgtccgccatttttgtggcgtcaccgcgtcgct

SEQ ID NO: 1292 - DNA, 9582 bp, Homo sapiens
acagccttgcagcgtctccggaagtggaggcgggagcggcacggcagccactgcttggggtagcgggagggcagactctgggcgccactcccgggccggtcatgaacgggccggcggacggcgaagtggactacaaaaaaaaataccggaatctgaagcggaagctcaagttcctcatctacgtgagtgctgccgcgggaaggctgtgggggatgaggcctggcgcggacaagatctcagtttacccaggtgtaaagtgggtggggcgagcggccgctggttccggggcccttcacggaggaccgttggcccagcgcaccccttgcccgtgatacaggagcacgagtgcttccaggaggagctgaggaaagcgcaaaggaaattactgaaggtgtcccgggacaagaggtgaggcacgttgcaggggcggagggcgatgtgcttcctaggaaatctacattcggaccccatccccgagtagggccacaagtgcatgggctctttcaagtatccgatgggccagctgggagggacaggtacccaggaggacattgctgcgctggaaaatcactgtccgtgtctccttccctcccctcagtttcctcctagaccgacttctgcagtacgagaacgtggatgaagactcttcgggtgagcaaggtcttcaaaaattggtggagagcatggttcctggtacttagcaagcttcctgggcccccgccttttaggcagtggtggctgatgcagcccccagtggtccttaagcctagttgcttgccttccacctccaccgttctttcattcaggcacttactgagcacctattgtgtttcaggcactgtgcttggcacaggggatacagcagaggcagagataggcaaagcccttggcctcttgtaatttatattctagttgggaagaataagtaaatgaagacaatagactagaattttaggtcataggaaggacttgaaggtaatgaaaacagttatgcggtaatgattatagtagaacaggggttgatgaattgtttctgcaaagggccagatggtaagtaagctttttgcaacatacaatctttgaagcacctactgaactctgccattgtagtagcagccgtaccccataggcaaatacatgagtatggctatgtttctataaaactttataggcactgaaatttgaatttcatatttttccatatgaaaaatttttctttagttttttttttttccaaccgtttaaaagcttaaaagccattcttggccaggtgcagtggcccacgcctgtaatcccaacactttgggaggccgaggtgggcggatcacaaggtcgggagttcaagaccagcctgaccaacatggtgaaacctcgtctctactaaagatacaaaaattagtcgggtgtggtggcgtgcacctgtaatcccagctactggggaggctgaggcaggagaatcatttgaaccctggaggcagaggttgcagtgagccgagatcgctgccactgcattccagcctgggtgacagggcgagactccgtctcaaaaaaaaaaaaaaacgcccttcttagcttgcagaccacacaagcaggcagcaggcaacctctgaatggagtactcaagaaaggcctttcacagagtgacatttgagttgggaccagagaagaaaccagccttccatcctgggcaacatagtgagaccccatctcaattaaaaaaaaattagccatgtatagtggtgtatacatgtggtcccagctacttgggaggcagaaccaggaggatcccttgcctgaaaggtcaaggctgcagtgagccatgatagcaccgctgtgctccagcctgggtgacagagcaagactgtctcaaaagaaagaaaccccatcctggctaacacagtgaaaccctgtctctactaaaaatacaaaaagttagccggggatgttggtgggcacctgtagtcccagttactcgggaggctgaggcagaagaatggcgtgaacctgggaggtggagcttgcagtgagctgagattgcactactgcagtccagcctgggcaacagagccagactccatctcaaaaaaaaaaaaaaaacaaaaaccaatcttgtgaagaagtgggctagagctgtcccggcagaataatataaatgcagctaccctgaggtaagaacaggtcaggcttggttgaagagcagaggcatgaaagagagagaacactgttttcgtccttttatttgaatattgtctgcagttaactatattttacatcataaccagggccccacatgttaaacaaaacaaagtttaacgaaacatttttaagatcactgtatccaattcatcctgacactttttagactgcttttttccccttcttttaatgctggttgcaaaccaataaattgatttcatgacccactaatggcttgagacccacagtttgaaaaagccctaaggtaggcatttgtgggcctcttcctgggtgaggccctcgtaagccatgtcacgtagaatcacctctctccgtggtgcctttaaacattggtctgggccgggcacggtggctcacgcttgtaatcccagcactttgggaggccgaggcaggcagatcacgaggtcaggagatcgagaccgtcctggctaacatggtgaaaccccgtctctactaaaaatacataaaattagctgggtgtggtggcgggcgcctgtagtcccagctactcaggaggctgaggcagaagaatggtgtgaacccgggaggcggagcttgcagtgagccgagattacgccactgcactccagcctgggcaacagagcaagactccgtctcaaaaaaaaaaaaaagcacattggtctgaggcagggattggcatgtggcagccagccacgttttaggacgtagtgttttgtcagaacgcatgatacccatttgcttgttattataggaggattgtagataaggttggggaaataggcaggggcccactcaggtaggtcatagtaggagatttggcttttattgtagcctctcatcccctgcctcttccttccctaggggcttccagttaacatcctgtttgaggggaattcagggcaggaggtgggagagaacccagcatgttcatggccagagtgggttgcatctgaggaggaagagccagcgatgcgagccccactcccgtcctggaggcccacgccctggccagggagacactcgcaaacgacgcttttcagcacagtgtgagggcagccatgacgagagtagagcgttccaggagagcctgcagttaactgggcttgagggattctggaagacttcacagaggaggtggcatttaatctgcttcttaaagggtctgtctgagcagagacattggtaacggcttctataggtgtagcagtcgtttgttcgatgaaagatggcccttctaggcagaggcactgaactaggaaatacatttcttttttgacgaaataggtcagtgtgctttaaagaatacagttacgttagttgaccagaaaggtacattgaagccagattaagcagcaccatgaattcatgcaggtagtgggtgatgtcatcaggaaggatgtgaccaggtttgttttaggtcactctggggttgggggtggacagtgggtggcacggtgaggtgagactgcttagcaggtgattttgacgtgctggtggcctgacctgtgttagttggtgtggggagcagtggatgaaggggaggacttcaggggtagatgaacaggaccctggttatggggagtggggcagaggcaggagttgaagactgctcagctcagaggcaaggaaccagtggcatcaaacagccaaggagtcacagacctggcttggagtcttagcctcacaccttactttctgagcctcggtgacctcatgtgacaagtggaggtgctgcccttcccatccttccttggatctgatgacaaggagaggtggtgagtgggaaagagcctggcaccctggccatgcgtggcaggtgtgttacggaggaaccagagcgggcggggggctggggaggctggagaggctatgggcctccctgggacagctcgagtgtgtggtgcatgcgtgtgcccaccagctggtgagtcagattcccccggggcccttctgttaggttttggtttgtttcatttttttgaggcagggtcttgctctgtcacccaggctggcgtgcagtgttaaaatcacagctcactgcagtctcaatctccgagtagttctcctgcctcagcctcctgagtagctgggactacaagcacacgccaccatgctcggataattgtttttgtttttaatagagatgaggtcttgctaggttgtccaggctgctcttgaactcctggcctcaagcgatctggccacctcagcctctcacagtgctgggattccaggcgtgagcccccgcacctggtcttccagtgcccttctgtagtgtagaggaggttatacctttctgggatggactgggatccccccatccccactgaccagctgtccccatcacagactcagatgccactgcatcatcagataacagcgagacggaggggacacccaagttgtctgacacaccggcccctaagaggtgagaagaagatgcattcctctcgctggggagggtcaggtggggcgcctgggctcctagccacatctgacctcgccctgtcctttctccaggaagagaagccctccgctggggggcgccccctctccctccagcctctccctgcctccttcaacagggtttccccttcaggcctccggggtcccctccccatacctgagctcggtgagttggggtcagggatgggaagtgcttgggagtaaggtgggcgtcatttgggcagaagggctgggcctcggggcaaggccagcccaactttggggacatctgtctgggtgtggcccaagtgtcccgtggagggtgtgagtcggggctgcccccttctctctggtataggaacggggccaggcctgactgaggagagcaaagcccaggacagcatcctgctgctgcccggcccttctgtgctcgggagccccgggagccgcactcatcaccatctcttttgtttttccatcctccttctgtttgcatttcttcccccaccctcaccccggtccattccgcctcccatctccatccccgctcccgcccgcagctggcctcctcccgctaccccccattcccttctgactacctggccctgcagctgcccgagcccagtcccctgaggcccaagcgggagaaacggccccgcctgccccggaaactcaaggtaccctgacgtgggggtgctagggaggggcaggacggcaggaggacagtcacctgagggaggctgaaggcgggggcctgtcagagaaccatgaacagttaatttggggacccagtcagcacttagcactgaggggtggatcacagaagtctcggcttacaggcttgtatggagacaaatcagggcagaaccagccttggaggacccggtgtgcagatgccagggatcccgccctttcatggctgcagtgtagcggggccaggctcattttcccaggggggcgtgttgtgtgatgccaggtagccccagaccgggtcaggattatgggatctagagtcaagtcaagactgcctgttagaaaccacgtggccttgagcaggtctctgctaccctctaggcctcctaggcttggcacctatagggcgagtggtcctactcgatgtgaccagcaagcgcccctggagcgcctcctgttacacggcagtgcacaaagcagaccagtgcctgccctcacagagctcacagtctagcaagataggcagaaaacacaccagaaaagtaggtacttgtggagaagaacagagcgaggtccagagcatggggacgccagggggacgaggctgacacttagggcccagcagtctgggatgttcttgatcagagacttacaggaaatggcagcaagctgtgtggctcctgggcagtgtttctgtcgggcagagtctgtgtttgggagaaaagtaagcagggaattgggtcccggagcaggtcagagggggagctcatgaggtgccagtgtgcaggattcgctgtgaatgaagccttggagacagcagttccctggcggggcgcaggttgcaggtgtggagggggagtgatctaattgcatcttaacaaaattgcagacactggtggtcagagaacagactgagcggtggagtgagttgggacgggagtgaggaggccaccacggtaaaccaggccaagggcagagggtccagagggagctgcggacccatttcagagaatgagcatgggagttcctggaggacctggtgtgggctgtgcgggagagaggccaggatgcctccagggctttagtctgagcacgagtggagtctccctccctggagatgggagggctgtgggaccacaggcttggaggaaaactgagtctggccgcggatgtgtcagatgccatctggaaaggcagctagatagcggcccgtgaggggctgcgcatttggaagccgccaggctggcggtagatgcaagccttgggagagatggggatgggctgaggggcagagcggagtggggaccaactgggcggctcccagggttctggagccagaagcagaatgagaggccgcatttgcggtggtctggagtacaggatctggagctctaatcccaactctgccgttttctccgtgtgaccttggccctgtgaggcttcacctcttgagcctgagaagcagaggtgacagtactggccctggttcttagcaggggggtggcgggcagggtagggggtggcgcagcactggggggcactttgaggctttctggctgggtgctgagtcctgaagcagagtcatgtccgggagcaaagttgtagacattctggagagaaggtttgagagggtggcccaggtccatggctgtcgggggaggtggggagaagccaggaaaggcctcagcaaggagaacgtgtaagcccagggtgagtggatttggatattcctggctgaagccatagtgggaagggagacagggccacagggaaagcactgcctgggccagagcaggagtggtaagaaattggcaagaagaaccgggtggggtggggtcatggaaggcctggacagtggcctgaagtgggaatttgtctgttactgtcaggggagcgggagtccctgaagggccaggggagtgaggagatggaaggaagggagtccaagcagaggaaggatagctgtgaagacagaagcaggttggttctgtcaggcctgagttggacttggccagctttgaatcccagctcttccagtgctcaccatgcgacctcagcgttgtcatttcactctttaagccacagctctctttctccattcagtggcggcattgtgcggagaatgtgagtgaagggatgaaaatcgctcggcccgtgcctggcccctagtaagccacagagaaatgtgagccgctgccagtcaggctgagaggacgccactgaggaagtccaggccagggtgggacatgctgcgcacagtggggaaggagaggaggtggccagaggaggggatggtcctttccagtcatacacgcatgtctgcttgtgtgtgtacatgtgggggcctggtgcagggcgtgggggtgctgttcagagttggaccccccatcatccatcctgccagcctcctataccctgaggcctgacccaccctggcccccacaccaccccagcagcggagatgagggtaagtgagggctccttaggaagcagagaggaggccacagggccaaatgtgacactcagaagggccactggagaccacgcatggcgtttcctgccagcccactcagcatctagcccagggccagactggacactgccccgcaggacccagcaggcctaagcctcaggacctccatgtccacaccaggttcagcctcctctgctggcacgtgacttctccccgtttcccgccccccagtgtcctgaggctgggagggcattaacagaaaccacctgacacacagcaggtgcccagtttgtgcccacagacaaagcacggggactgcagaggagacccacagagctctctagggagggtttgtgaggacctggcagcgggggggagctgaagggttgagcagggcagaggccacttcccaccctcagaggacaaagcaggacttctgacaaatagagcaggatgcccagggggaggggctgcctgtcgtcccgcaggcggcactcccgccccgaggccccgagtggcacggtgacgcgctcaggtctgtgttttagagcgcgcgctctggctgccgtgcggaggagctggatctgggagaggctgcgggcagggagtccagttaggaggctgggaccgcagcccaggtgagctaagaggagggctgggcctaggccacagctgccgggaccccgaggaggggcccatccaagacataatacaagcttcttgggggcagataagccgctggggctcctggctcaggcagcctgcaataccctccaccgaaccagtgagtgccgcagaagagggagaggaggagtagggagaggaagctggtggcaggtggcacctccggggccggcaggcaggcaagcactccaggccgactccgcctctggcttaacccctgtctcagggcagcccaggcgcctccctggagagggcaggtgcccgggcctttccctcccggtttcctgtgagacacccccatcccctcatctcacctctatcaccacccccaggcacttgctggtttgaggctctcgaggggctgaggggggcaggccctgagtgcagcatgggttggcccagctgtgcccagggcctcttccccctccccagagctgccctggggggcaaagcctagtctcctgaggccccagtgcctccctgactagtccccctgtgtttcttccccctgctgcagatggcggtgggaccccccgactgccctgtgggagggccgctgaccttccctggccggggttctggggctggggtcgggacaaccctgacccccctcccaccccctaagatgcccccccccacgatcctgagcacggtccctcggcagatgttcagcgatgcaggtagcggggacgatgccttggatggagacgatgacctggtgatcgacatcccggagtgaccgtgacatcacgccatgcccaccacggccccgcccggcgccctccccgtgccagcacacacgagtccagcttcctcggaggtgtttattgatgcccagctgccatgctccggccactgacacaaccagaaaaggcgtaaacatgcacgggtgtcccccaggagggtggcaggggccctgccttcaaaccccggccccctccaggggacagttatttaaacgagtggccgggagcatctgccacctgctggggaggcagagaccctgcaatggccacctctttaaaagggcagctgtacagggctaggttttttcaatgaagtttctgtattaaaggagtggctctggg

SEQ ID NO: 1293 - DNA, 19885 bp, Homo sapiens
ttctcaacttaactttatttcaataatttaatagaaaattaaaataataaataatatgaaacagactgataacgctgagctgggcaggcccaggccagtctagtacaaagttaaggaggtagggaggatggtggggaggagggggcggactaccctgcaggacgcgggaggctgctcagactgtggtgatgtcaggaagggccgcacactttggcatggacgatgcactaaaaaaagagaaagggaattctaaatccctcttaaccagctggagagggaaggacgcagggccagggtggggacaagtgttggcttcggaaggctctgagtggtggggccggaatgtaccatgttgttagcaatggggttgggatgggtggagaagggccaaagtgagctgtgccatgcaatgaagggacagaggaggacccacgacttggccagcagagccggggcaaaagtctgggaaggggagggaaagagagagggactgggtcccaaggcaagaggaaggcagggggagggtcagaggtcagtccttgaagacaatttgttggccatgaggacgctcgtcgtgggtgatatggcgccggacatggatcctgcggacacggtgctctcggttctcttcatcctccccgcggccagccccaccagctccagctgctccccctgtggcctccaggagggctgggtctgggccccggggagtctcgtagatgaggatgttcagggtctcctcgaagatccgggcctctggaaattccacctgcaaaaggccagccggccccagctccttccttctggtgcagtcacgcagggccatccccctgcctagggcccctgcaccaacacacctcctagccctgcagtcaggtccttgggcctggcctggcctctctgccactcctttactcagcaaagtcatacttcaaggctcagctctgaagtcaggcaggcagaattatttgttttctctccttcatctccttccctgcctagcctcttggtatattttttcatttgacaaatactgagtgagtgcactgcaccaggtattgttctaggcactgcaaaaatagcagtgaacaaaacaagagttctgtcctcaggaggttacattctagtgggaggactcagtcatacacttaagaaaatataaactagcctggcgcagtgactcaggcctgtaatcccagcactttgggaggccaaggtgggaggacagcttgaggccaggagtttgagtctagtctgggcaacatggtgtaaccccatctctaccaaaaatacaaaaaattagctaggtgtggtggcccacacctgtgttcccagctactcgggagactgaggtgggaggatcacctgagcatgggaggtggaggttgcagtgagccaagattgtaccactgcactccaacctgggtgacagtgagaccccatctcaaaataaataaataaataaataaaataaaatataaatgcagtcaaatgatgatgtttaggaaacgatataagctgggtgtggtgtctcctgactgtaatcccagcacattgggaggctaaggcaggaacatcgttagagcccaggagttcaagttcaaagccagcctgggcaatgtagcaagacctcatctattaaaaaaaaaaaaagagagagagagagaaagagatacatcaggaaaagagatacatcaggaaaaggggatgtgatagccagagccaggagtgttacaactttaagaaggactccagggaaggcctcactgagaaggtgatatttgaccaaaggagtgggggaggggacaaggcacacagagcagaaagagcagcctggggagggccagggccagcgtgagagctgtgggtcaggagtgcacccagtgtcttactggaagatcaaaagggaggccaatgcaattgaggcagagatgagagggaatggaaagggatgaagtcgaagaggtgactggggtgttcccttgtgtggccttggaagcatctaacacagctcttagcaaactgtttttttaattttttatttttattttttattttttcctgagacagagtcttgctctgtcacccaggctggagcgcaatggcacaatctcagctcactgcaacctccacttcccaagttcaagcgattttcctgcttcaacctcccggagtagctgggattacaggcatgtgccattatgcccagctaatttttggatttttagtagagacagggtttcaccatgttgtacaggctggtctcgaactcctgacctcgtgatctgcccgcctcagcctcccaaagtgctgggattacaggtgtgagccaccatgcccggccttttttttttttttttaatcgttgtttgtttgtttctaagacaagatctcactctgttgcctaggctggagtgcagtggtgtgatcatgtatccctgcagcctcaacctcccgggctcaagtgatcctcccacctcagcttcctgagtacctgggtgtaccactatgtccagttaatttttttttattttttgtagagatggggtcttgctgtgttgcccaggctggcctcaaactcctggccttaatggtcccctgcctcagcctcctaaagtattgggattacaggtgtgagccatgcactctaattattggtttatcttcctatcttcccaatcagaggatgtttcttggaagctgggtcactgattcattcattcattcattcaataaatgtttcctagcttccactgtgtgaaaagggcccagctaatgggagataggaaagaaaaagacatggccctgccctcaaggaactaacacctcgctgctgatgcaaaccccctcccctccaccacacatgataaaacactgtctttagctatgaagggagtgtgaccaactttggggttgctggattgaaagttcatgagtgaaggtgacccaaagaaagtgatgcttagcttgagtcttaagattaagtacaagttcattaggcagatagaaggaaagaattccaagaggcaacagtgtgtgcagaggtaagaggtaagaaatagcactgagtgcttagagacttgtgatgactgtggtgtacctgaggcatgtggctcatagtaagctcggaagggaccagatgaggaagggcttgtattttgctcagcacttcattccccttgatttccagcccggtacagtacttagcacagagcaggggcttggggaatatcttgatgattgccacattaatgactcaggatctacaaactcagaggatgttctaagagacatctgattctgaggttttaagaatctatttttggcaatgggcctttctgagtttcccttttttttttttttaattagagttagggctcactctgtctcctaggatggagtgcagtggcatgatcatagctccctgctgcctcaaattcctgggctagggcgggcccggtggctcacacctataatccaagcactttgggaggccgaggagggcagatcacttgaggtcaggggttcaataccagcctgaccaacatggcgaagtctctactaaagagacttctctactacatttagtctctactaaaaaatacaaaaattagccgggcatggaggcgggtgcctgtagtgccagctacttgggaggctgaggcaggagaatcacttgaatctgggaggcagaggttaagtgagctgagatcacaccattgcactgcagcttgggcaacagagtgagactctgtctaaaaaaaaaaaaaaaaaaataggctgggggcagtggctcacgcttgtaatcccagcactttgggaggctgaggtgggtggatcacgaggtcaagagattgagaccatcctggccaacatggtgaaaccccgtttctactaaaaatacaaaaattagctgggcatggtggcacgtgcctgtagtcctagctactggggaggctgaggcagaagaatcgcttgaacctgggaggtagaggttgcggtgagcggagattgtgccactgcactacagcctggtgacacaacgagactccatctcaaataataataataataataataaataaataaattactgggctcaagcaatcctcctgccttagcttcctgagtagctgggattacaggtgcatgccatcatgtcaccaagccaccacacctggctaaattttttgacttcttacagagatcaggtcccacgatgttgcccaggctggtctcgaactcctgggctcaagtgatcctcctgccttggcctcccagagtcctggggttacaggcgtaagccactatgcctcaccccttctgagtttctaatggcaactatggaccccctatacagaaaaatgcatacacccccatttcaggagttgcaaacagccttgaaacccatccaacaggcctaggctaagcaccctgctctaacccgtgacccccatttcacagagaaacagagacccacagggatagggtggcttgcccactgttgtgcaccccagaccccaggatctggctcctgcctcctggtggtgggctccttcccctgccaacctgcttttgtccagggtcctggtcctggccacccccagcccccaacataggctctggagcccctctgaccttggtctgcttcttctccgtagcatagacaatggaggtgcagcacacctcggcgattttgcggccctgcccgtagaaagaccagcagcagatctcgtcccccaggacatccttgaggaagagtagccgcccgtggaagcgcagggccagcttgtcgaacagctcgatgttcttaagtaggttgtcatctgaagtgctggggaccaggggaccaggaggcctcagcgcagttggcacccctccctctgtacccccagaagacgggcctggatgcattcccagtcctctgctcctgcccagggctttggtgctcaacagagagcctcctccacccctggggccaggctaaacgggtctcagaagggaagccacatgcgctgagcaaatcccagcacagcacagcacagcagctccagtgagggaccgggagccaggccacctccccgggggtcctggtgtccccattttttaactgggtgacactaggcaagttacttcacctcttggtgtcccgacctcctcatctgtaaaatggagctcacaacagtactgacctcaagggggaggactctgccagttcctagaatgagagcacttgggataggctcgccactatcactttgtcctcacccaaacccatttactgatgactgagctgaagctgagaagcagaaaggacctgcctagagcgtcaggggtaagaggcgaagccgaatctgcgagcaggcacagatgttcttgtaggccccccgtgtggccgtggccctcgccttgggcagaagcagggctgtgctgcatcccagggtcccgcccagtgccccgcaccccggcggtcacctggtgtaggagtacttgttgttactgcggttgtgcaggagcttcaccacgggctggcgggggagagaggatggacgagaggggtgaggctgcagggagaggcccccccagtgagcctccaccctgcagggcttgggggcctcaccttggaggtgctggccaggagctgctgctcctcccggggagatgtcaccatggggatgaggcacagcggggacagcgtctcccttttttgctggggaagaagcggaaggtggttaacagcacaaccaaaggccacgtactcccccacttaaaagccttcaaaagctggttgggaacaactccagactcctcagtggtccgcagggctctgcaggctccaagctccgccagcctctctgccactctccctttgcttgctgggccttggtcccacggacaccttgctgcttcacacatccagcttgtgcctgccccggccactggctgtgcccctgcccgggatgcttctttgctcagctgtcagcgtggcgtgtccgtcatgccattcagatcgcaggtcacacagtgcctcctcagggccagccctccccagcccccctggctaaaacagcctcctctacatcctgccttttgtgttatcagttttctttttctttttttgagacagagtttcgcttgttgcccaggctggagtgcaatggcgccatctcggctcactgcaacctccacctcccgggttaaagcaattctcctgcctcagcctcctgagtagctgggattacaggcatgtgccaccacacccagctaattttgtatttttagtagagacgaggtttctccatgttggtcaggctggtcatgaactcccgaactcaggtgatcagcccgcctcagcctcccaaagtgctgggattacaggcgtgagccactgcaccaggcctatcagttcattttctacacagcagttagtgtctgactttttctaactttttgtatttgtttatgatctgtctcttcccacctaggaataactacctagtatacagctgatgctctgtatttgttgaatgaatgaacatatttgttgagtgaatgaacttcattgggtgggatgacgttggagaaagaaatctgaagcaaacccatgggcttctttctcttctgtcttctagaatcttcatgccaaaatccctctcacttctcccaaccttgaaaactcaatgcgcaattctaatacaaattccagatttgttttttgcagaaactcataagactctctaaaattaacagagaataataaaagtctacaattactgaggccattttttttttttttttttttttgagacagggtcttgctgtcatccaggctgagtgcagtggcatgaccacagcttacagcagccttgacctcctgggctcaagccatcctcccaaacttaggtcagtttttaaaaataagagcaaagaggaaaggccgaccctgccagatattaagataggctgcaaagccacaacagtgagaacggtatcagttcgggcacagaaacaaaaatacctgagaaacacaacagagcgatcagaaacagaccactgtgtatatgagaattggtatttttaaaaagacaccacaaatgtgcgaggggaattacggagtatgaattcgttatctatcactgtgtaacaaactgcccccaatttaggagcttaaattaacaatatttattacttctgtttctgagggtcaggatctcagcagtggctcggctgggtggctccggcacagggtctcttctgaggctgtggccaagatgtcagtggggctgtgggcatcaaaggcatgaccgcccctagaggatgcactctgagaaagcttgttcatgtggctggcaagttcgcactagctgctggcaggaaacaacaaatccctgccatgtagatctctccacagggttgcttgagtatcctcgcagcatggcaactggcttctccagagcaaataattccagagagggcaaggtggaagcctcattgtcttttttatttttgagatggagtctcactgtgtcgcccaggctggagtgcagtggcgtaatatcggctcactgcaacctccgcctcccaggttcaagtgattttcctgcctcaaccacccaagtagctgggattaccgaggtgtgccatcacgcccagctaatttttgtatttttagtagagacagggtttcaccatgttggccaggctggtctcaaactcccgacctcaggtgatccactcgcctcagcctcccaaagtgctgggattacagacgtgagccacagcgccgggcccctccattgtcttttatgacctaggtctgttggtcctatccagtgaggaaggagatgacacacaggaacgagcaccaggggacgagaatcatcaggctgccttggtggctggctccacaggccaccgctggctctcagtgatttcccccctcccacatgccaaatatactcaccaccttccaggatcccccatcatcccattacagcatcagctcaaagtacagaatctcatcatctcagtcaggtccaggtggggatgtggctctagcatgcagttccgtaactatggctccttaagtgcatttcttttttttttttttttttgaaatggagtcttgctctgtctcccaagctgaagtgcagagccaccaccatctcacctcactgaaaactctgcttcccaggttcaagtgattctcttgcctcagcatcccaagtagctgggactacaggcatgcaccaccatcccagctaattttctttagtagagacgggatttcaccatgttggccaggctcgtctttaactcctgacctcaggtgatccacttgccttggcctcccaaagtgttgggattacaggcgtgagccaccgcatccagcccttaagtgcatttcctatctgcagacctgtgagctaaagagacaggtcatctccacactcccagtgtgcagtggtagaggcaggcacaggataaccagtaaggacattcttgctcaaaagcaggggaagccgggcgtggtagcgtgtgcctgtcatcccagctactcaggaggccaaggtgggaggattacttgagcccaggagttcgagaccagcctgggcaacatagcaagactctgtctcaaaaaaaaaaaaaagtggggcaggggacaggaggcacatataagtcatacatataagtcactggtgtgtggaaattctgtaatccagttggagaaatgctaggaactctttgatgcctactcctgttcatgaatgattctccatggctctccctgagtcgtcccacctcttccatgaaagatgtttgcagctccacagtttcatctgcctgcttcctgcctgtaaaagtttgggtgtgcaaagccgtcttgtccttttgcactggctctgtccctttcagtccaagctggcagtgtctctgccaatataattctcttcataacttattgggtatcttgcatgtcttagggttcactacattagaaaaaagccacacctagaaatctctgcaagtggccaggcacagtggctcacgcctgtaatcccagcactttgggaggccgaggtgggtggatcacctgaggtcaggagtttgagactagcctgaccaacatggtgaaaccccatctctactaaaaatacaaaaattagctgggcgtggtggtgggcacctgtaatcgcagctactcaggaggctgagacaggagaatcacttgaacccaggaggaggaggttgcagtgagctatctcaaaaaaaaaaaaaagaaaagaaaaagaaaaaagaaaatctctgcaaggtaagcccttctctactttgggcttgtgctgagacgctgaaagacaacacctttaaccttctcagaagcgtgattattatttcattcgactggaagtcccctctgaggcatcttgttggtatttctgaggtcttaacaaaggactttttcatcacatcctcagcttgacctttagaccacatttccctgtatttaatgccttgtatttaatctttgcacggaagccatttgttaattttaacatcacttgttatctggaaaggctgggaattttcaaacccaacaatttcaggctctttttcatttaagtgttttttttctttaacttactctctcctcttcagttttactataagcagcaagaagccaggtggcaccttcaacattctgtctggaaagctccttagctagaccatccgttccttaggtatatttcctaccctccacactaatgcaggagacagtgttgctaaactttctgccgctacacaaggatctcctttccatcagtttccaatagcattttcctaactgttcttcaagcccttattgcagctgtcttaaaggtcactggactcttattaacagactttctcaccttttttcttttaatttttttagagacaaggtctcactatattgctcaggctggtctcgaactcctgaactcaagtgatcctcccaccttggcctccaaaagttatggtattacaagtgtgaaccactgtgcccagccaatactttttaacactccttaagcttttactaacaatctcctcaaagtccttccagcttcttcccacttctcagttgtaaagttacttctacatttgaggtttctgttatggcagacccccattccagaaaccaaagtctgttctctgttactgggtaacaaattactacaaactcagcagcttaaaacaacagtccaggtgtggaggctcatgcctgtaatctcagcattttgggaggccaaggctggaggactgcttgaggtcaggagttcgagaccagcctggccgacagagcaagactctgtctctatttaaaaataaataaataaaaataaacattatctcacatagtttctgtgggtcaggaatttgggatgggcttagctgggtggccctggcccagaatctgtcatgaagctgcagtctggattttggctagggctgcagtcatcagaaggtttgcctgggcctagaagctctggttctgagacaggtcaccactatggcggggagtctgtgcttgctgtcggcaggggcttcagttcctcaccaagtggacctctgcttagggatgcctgagtgtcctcacatagcattcacatagagtgagtgatctcaaagagaggcagaagctgtaatgtcttttatgacctagcttcaaagtcacatgctgtcatttctgcaatgtcctattggtcatacacaagggtctccttggtgaggatctgaaaaggtctgccctatttggtgtgggaggggactgaacaagagcctggaaaccaggaggcaagaacccctggtggctgtcttgggtgctggctacctctggactgtttaatacctggcactgggaaaactacctcaccctatggaagacaaaaatgagctaaatcccttcacaatcatatttacaaaagtgagttccatttagattaaaatacccatatatgaaaaaaatccatatttaaaactataggtcaggtatagcggatcacacctgtaatcccagcactttgggaggccgaagtgggcagatcgcttgagctcaggagtttgagaccagcttgaccaacatggcaaaaccccctttctacaaaaaatacaaaaattagacgggtgtggtggctcatgcttgtaatcccagcactttgggagaccaaggcgggcggatcacgaggtcaggagttcgagaccagtctggccaacgtcgtgaaaccccatctctgctaaaatacaaaaattagccaggcatggtggtgcacgcctgtaatcccagctactcaggaggttagggcaggagaatcgcttgaacccgggaggcagaggttgcagtgagccgagatcatgccactgcactccagtctgggcaatagagtgagactccatttagaaaaataaaaaataaaaaatcagccaggtgtcatggtgcacgcctgtaatcgcagctactcgggaggctgagacatgaaaattgtttgaacctgggaggtggaggttgcagtgagccgagatgacaccattgaactctaacctgggtgacagatcaagactctgcctcaaaaaataaaaataaaactacaaagctcacaggtaacagaaaatcagaaaaacatttttaaacaagaccataaggatacagcattaggcaaaaaatggtgaggaattggactacatccaaatcaagaatttttcaagttgacaatggaaagcatgactttacaaataatctcatgtaataatgttgaagagaaaagacttataggtattctgtggcacaaatgtaattactggttcaggtaaggattatcaatttgtgtgtcattgataggtaactgccttaatacagtggccaaataccatatgcattattttatagttagcaacaaggaaatgtaacaatgatagagaaatcaaaccaccatcccctagatccaggggccaattatgaacgtcattaatgacgagtcatattaacaatattatgggttgcttgatgtggcccaacgtgaaatacatacataatattacctaaaatgtattctaaacaaaatgtttaatatcagtcattttatttattttattatttattcatttattttgagacagagtcttgctctgttgaccaggctggagtgcagtggtgcaaccttgactcactgcaacctctgcctcccaggttcatataattcttctgcctcagcctcctgagtaactgggactacaggcacccaccaccactcccagctaatttttgtaattttttatttatttatttatttatttttgagatggagtctcgcactgttgcccaggctggagtgcagtggcacgatctcggctcactgcaacctctgcctccccaggttcaagcgattctcctgcctcagcctcctgagtagctgggattacagatgcccaccaccaggcctggctaatttttttgtatttttagtagatacagggtttcaccatgttggccaggctggtcttgaactcctgaccttgtgatccacctgcctcagcctcccaaagtgctgggattacaggcatgagccaccgcacctggcataatttttgtatttttaatagagatggggtttcaccatgctgaccaggctggtctcaaactcctgacctcaagtgatccacctgccttggcctcccaaagtgctgggattataggcgtgagccaccgtgcccacccaatatcagtcatttaaaatctacagtctggtttacaggaaattaaggataaggctgggtaataaaccaaacgataccgggagtaaacaaccaggcaaagttggaaagcgggtcattgtgcaggacaactggcagtctctttaacaagccagcatcgtgaggaaaaagggaccccttggattgtaataaagtaatgcttatggtattatttggcttatgtaataaagtaatgcttatggtattatttggcttatgtaataaagtaatgcttatggtattattatggtaactgtattaaggcagttacctatcaatgataatccttacctgaaccagtaattacattcgtgccatagaatacctataactcttatcatctcttcaacattattacatgaaactatttgtaaagtcatgctttccattgttaacttgcagataaccagatgcaacgtgaagatctagactggaccctggtttgatgaaccagctgtaaaaacacatttctggaacaactggagaaaccggagtatgccctggactggatattaaataaaaatttattgacatgtaaagatggcaattattaacaacaacaaaaaacagattataaaacatttcatacaacacgattgtattttggcaagcaaatacacacacacacacatactctcacacaggaaacgacctggaagaatatttggtgcttttattttttagattatttgtgtttctgaaatttctacaattaataaatactgctttaaaataatcaatggttatttgtaattttaaaaaatcaaggatttccattcaatgctagatgccacaagtgggtgacattctaagaaaaaatattggcgatatctacattgactagaaatttttatctagaacagactttttcaactgaagttcctcatctgaatctcaaaaaccagcaaatatggccaggcacggtggctcacgcctgaatcccagcactttgggaggccaaggcaggtggatcacttgaggtcaggagttcgagaccagcctggccaacatggcgaaactccatctctaccaaaaatatgataaaattagccaggcattgtagtgcacacatgtagtcccagctacccggaaagctgaggcaggagaatcacttgaaccccagagagggaggttgcagtgaggtaagatcgcgccactgcactccaccctgggcgacagagcaagactccacctcaaaaaaagaaaaacaaaaacaaaaacaaaaaaacagcaaataatttgagtgttttctgaactttgctgagaacagtaggtaaatagtcccatgctacaggcttagaggttaatttgttatgtatataatccatgccctagggaatgtataagacatacccatatgcagtagggcttaattatccctaggaactaaactaaaatatgcaaggatctcctgctaagcaacatgaaaaagaaaaaagcagaaaatctggtaaagaacatgaataagcaattcacaggaagggaaacaaaaaaacactagtgagtatatgaaaagatgctgaacctcattagtaatcagaggcatgcaaatgaaaatgagatcacgctacactcattggattggcaaaattagaaagctggatgatgccatgtcttgatgaggacatgcagaaatgtaatctcttatgcactgctcattatgaggataaagtattataaccattcgggagagcaattagatgatatttactaaaacgccgtttgcaggtgtcctgttatccagcaattctactcccagctacaatgacaggagactggcacagaatcagaagggagcatgtaccaggatgctcatggtgacacggtttgtaggggcaggaactggaaggcaatctaggtctccaacctcaggggaatgtatgaacaaaatatggtgaatgaacaccgcagatttctctgcagctgttagaagcaaagaactagatgtacttggagcagcatgaatagatcttgaaaaaaagtgctgaattaaaaaaacacaatgcaacagaaactgattcacagcttcaatgccatttatggacatttaaaatgcacacatatgcagaacaatgctttagcttttcgagcatatgtatcaaaacattaaaattggatgggtgcccctgggaaaaaggaaagtaggcaggggactgggaatgaagggaaagaaataaaactaaaagacaaaaggtttgcatagaccaatattgatgaagtgccacacactgaggagtgtgctgagctgcgtgaggtgcagagggaacctggaaaggagagagcaggagtatagaaaagtacagctcttgggaggctgaaggtcagatagtcaggtagcctggggtcaaatctgagctctgctgcttcccagctctttcaccttggacacgtcttccaagctccctcgcgtttctttttacgtcaaacaaggatacaagatgtatacacaagcagatagcagaattgctcctgacacacagtgggtacatgatgacattagtaaatttaaaactacaggccgggttttaaaactttagttttaacattagtaaatttaaaactacaggccggtggctcacgcctgtaatcccagcactttggggggccaaggcggatggatcacgtgaggtcaggagttcgacaccagcctaacaaacatggtgaaaccccgtctctactaaaaatacaaaaaagtagcaaagcgtggtagcaggcgcctgtaattctagctacttgggaggctgaggcaggagaattgcttgaacctgggaggcagaggttgcggtgagccaagatcacgccattgcactccagcctgggcgacagagagactctgtctcaaaacaaaacaaaaatgctacagagcaggaatgcacttccaagatctagtacaatgaatgtttctcaaatgcaagtggtaatttattaatgggtcatgaaataagtaatgggtcccaaacagcattaaaaagaaagattatcagagtacatttcactaaaagtatctttttatagaactgttatttcagttatatataatgagtactaaaatgcattttttccctatggcaggcaatcaaaaagtttgaaaaacatggatattgtccaaaggagttctacacctttgggcttcaagaaccagtaagtattccctgagacaaaagttgttcagggaggcaaccttttaatctataaagggcattcaaaaagaaacttttataatcttctcttactattgtaacataaaagaaaggacatttttaacattgtaaaaatagaacagaataacaggctttatgtaaaactcactactttgtacttatttttctcccttccctgtctttcggaacccgaggacagaatcccagaggtaggaatggactcactgaaggtcactgagtcagctgtgacagaggtgacacagaacccttatgtcctggcttcactttccaagctctgctcctcagaaccctaaggggtccacaaaagtggagcctagcaggtggggtctctagaatccccaaccctgttttactgggagtggccctgcttctgtgagatttcatttgaataaagaatttcactgtttaaaaaaaaaaaagaattagaaagctcctggggggcggaagccatgggagaatgctgcctcccaggatagggccagatcgcagaggttattatatttcaatttaaatttagatgtttttccctagtgacatgagggagctatttaggatttctaagcaagagagagaatagatcggggttgtgctgaaagataattactcaggtgcgagtgtaacagctggactggctgcataggaacagtgggaagtagagagcagctatttaaccattgcaaaggtcctggcatgaggctggggtgggggtgctgcctgaggcggcagggatgcagaagatggcacctcaaattctctggggttatggccagccaaagccaggctctccaagccataccccatatctccttttttctgctctaatacctgcttgggcagctctcccaggaacataggcatggggactccgaaggccctcacctgcagcgccagctggcagtcctcaatcaggccctgcaccaggtagtagcgtgcttcgcccagcagctcccccagttctctcgtactctccggcagtggcacagacccatcccgcaggtaattgaggattgtaccaaagtgacggccgctccggtcaatcagcacccaacctagtggggtggggagaggcagggggaaagatggctttgctgcgggacctggagctactaaattaaaaaaaaatttttgtagagatggagtctcactatgttgcccaggctggtcttgaactcctgggctcaagtgatcctcccatctcggcctcccaagtacttggattataggtgtgagccaccaaacctggcctaaattataagaaaaaaggattccagccaggcgcggtggctcatgcctataatcccagcaccttaggaggctgaggcaggcagatcacctgaggtcaggagtttgagactagcaggaccaacacggagaaaccccatctctactaaaaatacaaaattagctgggcttggtggctggtgccagctactcgggggggggcgaggcaggagaatcgcttgaagccgggaggtggagtttgcagtgagccgagatcgcgccattgcactccagcctgggtaataagagggaaactccgtctcaaaacaaaaaaataaaaaaagaaaagtaaagaaaagaaggccgggcacggtgactgacgcctgtaatcccagcactttgggaggccgaggtgggcggatcacctgaggtcaagagttcgagaccagcctgaccaacatggagaaatcccgtctttactaaaaacacaaaattagccgggcatggtggcgcatgcctgtaatcccagctactcaggaggctgaggcaggagaattgcttgaatccgggaggtgggggttgcggtgagccgagatcgtgccattgcactccagcctgggcaacaagagtgaaactccatctcaaaaaaaaagaaaagaaaagaaaagaaaagaaaaaggattccaaagccacaaaaaagtctgaatactgatctgtctcaaacctgtgccacagccaagaaatctctttaaaacatctccagcgagttctcccttaagtttttatacatattcaaccagataattaactcatccatatctggtctacagtcagaaggctctcaccatgagaaagttcttgcagaattaccttatcaataaactgttaacccccgaagttaattctcaccatcctatttaattaaaatgtctacctccccccgtccagttcactgccattttaacttttatattcttcatagagcttactatcaaaaaaagaaaaaagaaagaacttactactatctgcaattgcatatgcatatacattttgtttacttgcttattggtcttctgatctcccacttccctaaaaaaagggaatttccataattttgtcaggttcatttacctatctccagcactaactgatattttacaaatacttattggacaaatgaattcttcccttttttttttttttttttgagacagtctctctctgtcgcccaggctggagtgcagtggcgctgtctcggctcactgcaacctccgcctcccaggttcaagcgattctcctgtctcagcctcccgagtagctgggctacaggcgcacaccaccacgcccggctaatttttgtatttttagtagagacggggtttcgccatattggtcaggctggtctcgaactcctgacctcaggtgatccaccgcctcggcctcccaaagtgctgggattaaaggcgtgagccaccgcacctggccgaattcttcacctttgatacttgaaggcagatctccgcctctcaaatttttattctcctgctctcacagtcctcgttaacccctcccttaagactctcccactcccaaactccaaaacttcaaagtctcacttgggcacgaagggtccatacttgaatgcaacactccaagaaggtaaggttcacctgccaaggagacctgtccaccctccactctggtgtccctggcaaacccaaagcagcctccttctgcaatgtgtgtatacaggtggattcctagagtgtacagggacctgtgtcaggggaacacagaggcaaacaagatctcccagctctcctggctggctgtgagcagttctgaagcagagagggaaacaaaaggctgggcagtcggaagaaactgaggaaggctgccaggagtagtactgcaggcagcagggctagttcccaagtcttgagctgaggggtgaagggtgggagaggtggtcatgaggattatgaactgacacgttcaatcacttaccacagcgcctggcagttaggggttccgtaagtgttggttattgctgggggtaaaggattgggggaggagaagagaaattatgaatgagaaaggggaggagatgggatgtgggggctggagggagctgagaatgagttgactggacagtagcgggcagagagaaggggcatgaggagccccggtggtgagagactgcggggaacgggagttgggggtctggggtgggggcacggtaggggcgccgctcgtacctccggcatcggtcagcacctccacgcggccgctgaacatggctttgagcatggtgtcctgtcccgtgagggtgcgcagcgtggtgtagtgcaacgagccgcccacgttcagcttcacgtatttgctgttcggggtcagcggcttgagaccgtaggcggcggggccaggctcgagacccgagggcttgggggcttccagggacggggccgcggcggcagccgggcccgaggcctccgccgacatgccgggtagcagcggcggacggcgatcccaggatctctccgcgccctgcggcctgctcccgaagaccctcggccggcccccagcccttgggccagaccgctcggcgcacacgcccactcaccgcagctactctgcaagaccggccctccgccccatctcgctcgcaccacccggaagccggcgccgggcag

SEQ ID NO: 1294 - DNA, 4220 bp, Homo sapiens
gcagactccaagggttttatagcgtccggtagcgacacggagccggctcccccttttccagccttcctccccatctcccattctccatcccccacgacctataccagaggtccttaggcctccacgtctctccttttgccgagtagcccaaggtttccacccatctgccaggtctggggcgtcaagtcggctgcctcggcttgggaaggtgcttgggagggaagaaggaaggagaggcccaccaggcgaaggggtgaggggtagggggttgcgggagttccctctcactcccgaagatataaagcaacctttattattattattattttttcttgtgagagggaatgaggcagcgggatgtttcctctaaaggccttgtttaaacctgggcccggggaatggtggtggactgggttctgggggaaagcgggctggtttctcaggtcaactcaggcttcgactgttcccagggggatggcgtccactccgatggggaatgagggggagaagaagagcagctggccatctcaagctgcaccctccttgagaggaggtccggtgagcactgcagggaaccctagaggtgggaatgtaatgaagtgaaagcctcccaggcagaggcaccccgtgccaggtctgagccacgggccctgagactctagcctcaaccctgagtcctgaagccccgactcatagctctcagcactaggccctgactctaaacccccaccaaacccccctcccccaggtccagagctttctagctaaatctcaaggcccagtccttcaggagcaagctccttggacccacaggccccagcctgggaactcccacagccagcactcccatgtgggagctcccaggctgaacccctccggcttttcctttcccaggcttcgttatctcgttctgaggaatacctgtcccagatcagtgcagaactcatggaggaggctttgtgcactgcttgctgccacttgaaccctgtgcccatcaaaaaaaagcagtcacaagaccaagcgactcagatatccaaacgcggtaaccccctgcctcaggaccaccgtgtctagagaaccgctgcccccactatgcctggttacagtccctgacccctcccacccctagctgaactctccaggagtctgtgcccatctcatccatctcacagccagccctaggacctgtgaaatgcccctctcacccgctaacccagtacccactcctcactgctggccgagaatccccttagccccgtctgccctggccgcatctcttctggccacggggatagtcctttctctgactaggtcctctacttccagcattcttcaccaagacctgaggcacagacacctggtgagtgaggcttcaagggagatgctctttgtcctgggagagaggtgaggaacctggaggggagagagtgagggtttcacaatatcccagcagggtgggggaatttttgaaccgtgcacttccattctattctgccctgatcctcaaattctgaattctcagccctctcccctctcttccaccatctcctgctcggacagaaaccgtacctgcagcaaggcatacctcctgccaactcctggtgaaaaggtacatgcagggtccatggctgccaaggctattcgatattaaccaaaccttttgagtttgcactatatgttggtccctgtcttaggagcttgggacactgaaatgaatggtacagtctcagcccttgaagagttcacagttcagtgtggggacagacaaggaaatggccaattataatacagtctggataagtttccataatagaaatggacacagtgggatagtactcttatcccagcttcaattggacaggaaggacaggagccatggagcttcttctttttttttttgagacggagtcttgctctgttgcccaggctggagtgcagtggtgtgatctcagctcactgcaagctccacctcctgggttcacgccattctcctgcctcagcctcccaagtagctgggactacaggcacccgccaccacacccgactaatttttttgtatttttagtagagacggggtttcaccgtgttagccaggatggtcttgatctcctgacctcatgatccgccctccttggcctcccatagtgttgggattacaggctttggagcttcttgaaggaggtagcacctaaagaaataattttccaccaggtgcagtggctcacacctgtaatcccagcatttttgggaggctgaggtgggctgatcacttcagggcaggagtttgagaccagcctggtcaacatggtgacagaggttgcagtgagctgagatcataccactgcactccagcctgggcgacagtgagaccatctcaaaaaaaaaaagaaataattttccaggttaaaaaaaaaagaggttagtaggagtctttcaagcagttggggttgcatgaacaaaggcaaagagcagtcttcgcagagccagtgtgagcatctgtgtgtatttagggcagggagaagcagtttagcagctggagtctacaggcaaggtaagaggggactcaagagactttatgtgccttgtttagagccttacacactttcctggctgggtgtggtcgcttatgcctgtaatcccagcactttgggaagctgaagcaggaggatcgcttgcgtccaggagtttgagaccagcctgggcaacatggtgataccccaggcatgatggcatgtgcctgtgatcccagttacttgggaggtgggaggatcgcttgagcccaggagttcaagaatagcctgggcaacatagagagaccccatctctataaaaagttaaaaaaattagccaggtgtggtggcacgaacctgtggtctcagctacttgagaggcggaggccagaggatcacttgagcctaggaggttgaggctgcagtgaaccatgttcatgccaccgcattccagcctgagtgacagtgcaagaccctgtctcaaaaagaaaaatttaaaaaaaagaaaagaaagaaagaaatagtaggaggagctgggtgcggtggctcatacctgtaatcccagcactttgggaggccaaggcgggtggatcatgaggtcaggagttcaagatcagcctggccaacatagtgaaaccttgtcttaactaaaaatacaaacgttaggtcaggcgcggtggctcacacctgtaatctcagcactttgggaggcccaggcgggcagatcacctgaggtcaggagtttgagaccagcctggccaacatggggaaaccctgtctctactaaaaatacaaaaattagctgggttggtggtatgcacctctaatcccagctactcaggaggctgaggcaggagaatcgcttgaacccaggagttggaggttgcagtgagccgagatcacaccactgcactccagcctgggctgcagagcaagactctttctcaaaaaaaaaaaaaaaaaaaaaagccaggcattgtgtcacgcacctgtaatcccagctacttgagaagctgaggcagagacttgattgaacccgggaggtggaggttgcagtgagctgagattgcaccactgcactccagcctgggccacagatcgagactctgtctccaaaaaattaaataaataaaaattaagcacttactatgtgccagcactgctcgaggggctggggtgttgcagtgaacgaaacagagttcctgctatcaagaggtttaaaaaattagccgggtatggtggtgcacagctgtggtcccagctactcgggaggctgaggtgggaggatcattggagcccaggttgaggctgcaggaagatatgattacaccactgcactctagcctggctgacagagggagacctgtctcgagaaaaataaaaaagacatgagccttgggtctaaagagtgaaaaggctctgtctcttttatggagctcttcctaacagtcagtttggaagatgagcccacccctctttgatgctcttggcttctcatgcctccccctttttgtccctagaacatgcctcaaaactactcttttgccactcgttaaccacttccgtttgtggggacctcctggtcatgagcagcatcatcccgaagccttcaaagtgttctggattcatcacaggaccctccagcctcagccagcaaggataccaccaggaatgaaagtgctttaataaagagacagggtgtgcattgct

SEQ ID NO: 1295 - DNA, 4371 bp, Homo sapiens
aagcgtctggcgcttggggtcactgccctcaaggaggcacctggaggggtacggaggggaggctggaggagcaaacggggcgcgctaggaaattcctctgtctttagttctagaacccctgatctcctagcaacgaggctgcggaacctctgcagactccaagggttttatagcgtccggtagcgacacggagccggctcccccttttccagccttcctccccatctcccattctccatcccccacgacctataccagaggtccttaggcctccacgtctctccttttgccgagtagcccaaggtttccacccatctgccaggtctggggcgtcaagtcggctgcctcggcttgggaaggtgcttgggagggaagaaggaaggagaggcccaccaggcgaaggggtgaggggtagggggttgcgggagttccctctcactcccgaagatataaagcaacctttattattattattattttttcttgtgagagggaatgaggcagcgggatgtttcctctaaaggccttgtttaaacctgggcccggggaatggtggtggactgggttctgggggaaagcgggctggtttctcaggtcaactcaggcttcgactgttcccagggggatggcgtccactccgatggggaatgagggggagaagaagagcagctggccatctcaagctgcaccctccttgagaggaggtccggtgagcactgcagggaaccctagaggtgggaatgtaatgaagtgaaagcctcccaggcagaggcaccccgtgccaggtctgagccacgggccctgagactctagcctcaaccctgagtcctgaagccccgactcatagctctcagcactaggccctgactctaaacccccaccaaacccccctcccccaggtccagagctttctagctaaatctcaaggcccagtccttcaggagcaagctccttggacccacaggccccagcctgggaactcccacagccagcactcccatgtgggagctcccaggctgaacccctccggcttttcctttcccaggcttcgttatctcgttctgaggaatacctgtcccagatcagtgcagaactcatggaggaggctttgtgcactgcttgctgccacttgaaccctgtgcccatcaaaaaaaagcagtcacaagaccaagcgactcagatatccaaacgcggtaaccccctgcctcaggaccaccgtgtctagagaaccgctgcccccactatgcctggttacagtccctgacccctcccacccctagctgaactctccaggagtctgtgcccatctcatccatctcacagccagccctaggacctgtgaaatgcccctctcacccgctaacccagtacccactcctcactgctggccgagaatccccttagccccgtctgccctggccgcatctcttctggccacggggatagtcctttctctgactaggtcctctacttccagcattcttcaccaagacctgaggcacagacacctggtgagtgaggcttcaagggagatgctctttgtcctgggagagaggtgaggaacctggaggggagagagtgagggtttcacaatatcccagcagggtgggggaatttttgaaccgtgcacttccattctattctgccctgatcctcaaattctgaattctcagccctctcccctctcttccaccatctcctgctcggacagaaaccgtacctgcagcaaggcatacctcctgccaactcctggtgaaaaggtacatgcagggtccatggctgccaaggctattcgatattaaccaaaccttttgagtttgcactatatgttggtccctgtcttaggagcttgggacactgaaatgaatggtacagtctcagcccttgaagagttcacagttcagtgtggggacagacaaggaaatggccaattataatacagtctggataagtttccataatagaaatggacacagtgggatagtactcttatcccagcttcaattggacaggaaggacaggagccatggagcttcttctttttttttttgagacggagtcttgctctgttgcccaggctggagtgcagtggtgtgatctcagctcactgcaagctccacctcctgggttcacgccattctcctgcctcagcctcccaagtagctgggactacaggcacccgccaccacacccgactaatttttttgtatttttagtagagacggggtttcaccgtgttagccaggatggtcttgatctcctgacctcatgatccgccctccttggcctcccatagtgttgggattacaggctttggagcttcttgaaggaggtagcacctaaagaaataattttccaccaggtgcagtggctcacacctgtaatcccagcatttttgggaggctgaggtgggctgatcacttcagggcaggagtttgagaccagcctggtcaacatggtgacagaggttgcagtgagctgagatcataccactgcactccagcctgggcgacagtgagaccatctcaaaaaaaaaaagaaataattttccaggttaaaaaaaaaagaggttagtaggagtctttcaagcagttggggttgcatgaacaaaggcaaagagcagtcttcgcagagccagtgtgagcatctgtgtgtatttagggcagggagaagcagtttagcagctggagtctacaggcaaggtaagaggggactcaagagactttatgtgccttgtttagagccttacacactttcctggctgggtgtggtcgcttatgcctgtaatcccagcactttgggaagctgaagcaggaggatcgcttgcgtccaggagtttgagaccagcctgggcaacatggtgataccccaggcatgatggcatgtgcctgtgatcccagttacttgggaggtgggaggatcgcttgagcccaggagttcaagaatagcctgggcaacatagagagaccccatctctataaaaagttaaaaaaattagccaggtgtggtggcacgaacctgtggtctcagctacttgagaggcggaggccagaggatcacttgagcctaggaggttgaggctgcagtgaaccatgttcatgccaccgcattccagcctgagtgacagtgcaagaccctgtctcaaaaagaaaaatttaaaaaaaagaaaagaaagaaagaaatagtaggaggagctgggtgcggtggctcatacctgtaatcccagcactttgggaggccaaggcgggtggatcatgaggtcaggagttcaagatcagcctggccaacatagtgaaaccttgtcttaactaaaaatacaaacgttaggtcaggcgcggtggctcacacctgtaatctcagcactttgggaggcccaggcgggcagatcacctgaggtcaggagtttgagaccagcctggccaacatggggaaaccctgtctctactaaaaatacaaaaattagctgggttggtggtatgcacctctaatcccagctactcaggaggctgaggcaggagaatcgcttgaacccaggagttggaggttgcagtgagccgagatcacaccactgcactccagcctgggctgcagagcaagactctttctcaaaaaaaaaaaaaaaaaaaaaagccaggcattgtgtcacgcacctgtaatcccagctacttgagaagctgaggcagagacttgattgaacccgggaggtggaggttgcagtgagctgagattgcaccactgcactccagcctgggccacagatcgagactctgtctccaaaaaattaaataaataaaaattaagcacttactatgtgccagcactgctcgaggggctggggtgttgcagtgaacgaaacagagttcctgctatcaagaggtttaaaaaattagccgggtatggtggtgcacagctgtggtcccagctactcgggaggctgaggtgggaggatcattggagcccaggttgaggctgcaggaagatatgattacaccactgcactctagcctggctgacagagggagacctgtctcgagaaaaataaaaaagacatgagccttgggtctaaagagtgaaaaggctctgtctcttttatggagctcttcctaacagtcagtttggaagatgagcccacccctctttgatgctcttggcttctcatgcctccccctttttgtccctagaacatgcctcaaaactactcttttgccactcgttaaccacttccgtttgtggggacctcctggtcatgagcagcatcatcccgaagccttcaaagtgttctggattcatcacaggaccctccagcctcagccagcaaggataccaccaggaatgaaagtgctttaataaagagacagggtgtgcattgct

SEQ ID NO: 1296 - DNA, 4650 bp, Homo sapiens
ttcctccctcccgccggccggggtgcgcgggcggcggggcggcccgcgggccatgcgttcggcgcggcccagcccggccggccgggggcggcgccccgagcccgggccccgcgcggcccgcgcccccggcccccgctgagccccgggggccccgctgcggccgaggccatgttcccggtgtttccttgcacgctgctggccccccccttccccgtgctgggcctggactcccggggggtgggcggcctcatgaactccttcccgccacctcagggtcacgcccagaaccccctgcaggtcggggctgagctccagtcccgcttctttgcctcccagggctgcgcccagagtccattccaggtgagtagggccggccgcggcggcccgggctggggggggacgcccgcccgcacccgcggcccactcggcgccttgtctccgcaggccgcgccggcgcccccgcccacgccccaggccccggcggccgagcccctccaggtggacttgctcccggtgctcgccgccgcccaggagtccgccgcggctgctgcggccgctgccgccgctgctgccgccgtcgctgccgcgcccccggcccctgccgccgcctctacggtggacacagcggccctgaagcagcctccggcgccccctccgccacccccgccagtgtcggcgcccgcggccgaggccgcgccccccgcctccgccgccactatcgccgcggcggcggccaccgccgtcgtagccccaacctcgacggtcgccgtggccccggtcgcgtctgccttggagaagaagacaaagagcaaggggccctacatctgcgctctgtgcgccaaggagttcaagaacggctacaatctccggaggcacgaagccatccacacgggagccaaggccggccgggtcccctcgggtgctatgaagatgccgaccatggtgcccctgagcctcctgagcgtgccccagctgagcggagccggcgggggagggggagaggcgggtgccggcggcggcgctgccgcagtggccgccggtggcgtggtgaccacgaccgcctcggggaagcgcatccggaagaaccatgcctgcgagatgtgtggcaaggccttccgcgacgtctaccacctgaaccgacacaagctgtcgcactcggacgagaagccctaccagtgcccggtgtgccagcagcgcttcaagcgcaaggaccgcatgagctaccacgtgcgctcacatgacggcgctgtgcacaagccctacaactgctcccactgtggcaagagcttctcccggtgtgcacggggcctcggccgcccgctaggccgtggggagggagggacgcgacggaggtggcctggccgtggctggcggggagggaggcggctgctgaggctggggaaggggagccactcccagggcggagggaggaagcctctcccggttaccagggagcaaggggtggtcctttgtcgaggaggtgggccttggggttgacggaagcttcgcgtgggaggaggcggcggcggcggcagcggctgctgggctccaggggagggatttcctgcttaagtgtcgctgtgacggcctgggctccgggaggaggcgcagggatcctcggaaaggcctgtggtgcggtttggtggatttggggcgcaccacctccgccctaaccccaaccccaacgtgtccccaggccggatcacctcaacagtcacgtcagacaagtgcactcaacagaacggcccttcaaatgtgaggtaggaagcccgcctcctcctgtcttggttttcatgattttgatcctcatggtagctgtctgagtcagtctctcagaccccctttttctctctcttctttttgcctttttgctccattttctcatcccttcttcaaggcctcatcatgtcactcccatttcctacagatcaaagatccccaaggctctgattcctttaatctcttgctcccccctccccagcccaccaagctttaactctcctgtgacaccccccacgcccctcccccctcctcagaaatgtgaggcagctttcgccacgaaggatcggctgcgggcgcacacagtacgacacgaggagaaagtgccatgtcacgtgtgtggcaagatgctgagctcggcttatatttcggaccacatgaaggtgcacagccagggtcctcaccatgtctgtgagctctgcaacaaaggtacatgccgagggctgccgggagggccaggggcagagggtgggcgcctggccagacgccttgccacggatacgggttaagggtgctgtagccaagagctcgtggcgtctagattcctacaagaggtcaagggagcagcggggggacacctgaatgaacatcattagactctaagaagtcctggttggaagagatgatctgccagagaggttgaacctcctggtaatgtgtggggaaagcgggagtggaacttggctgctctggggaaggagtagtcaagaaagccagttccaggggtcacaaggcaaggtttccgctgcgcagccacaaggtcttgtctccagctcctggggcaggtggagtacacgggccgggctttaccagcacgcaccctgcacgggtagcagagaaagctgccttcagtcagactcaccggttaactgggttgagaccgcggggcactggagggaaggggacacagccgtctctgctgagggtcaaccctgcaagtggctaggagtcagtgtctcgtcatcctgggagaggtctcccggccatggagaatgagttctgtaggtaccaaggctgagaagcgggcaccacacaagccaggccccaggctcagggaggggctgtgtctaccagccccaacagagcagttggccccaggctaccaaggataccgtgggaggaggacagggccatctgaggagggcatcccccgcctaggagatcagccccgtctctggggtctccgcctggctgacccccgccccatcccaatccaccccccaataggcttcaccacggcagcatacctgcgcatccacgcggtgaaggaccacgggctccaggccccgcgggctgaccgcatcctgtgcaagctgtgcagcgtgcactgcaagacccctgcccagctggccggccacatgcagacccatctggggggggccgccccccctgtcccgggagacgccccccagccacagcccacctgctgagggggacccccgcacccaccaggcaaggcgtggggcatggctggggggcgggatggggggtgtgggggacaacggggctcaaagggcccaataggggatctcaggaaggcgagggatgcccatgtaccactcaggctagggagacttctgggcacagggaggatccttgagaactgctctgtctgggtgaggatgcaggctgaggcctctggggtccagataggaagtgagcaacggctgtgtcccaggggaagcaggctgggaaggtgtggggtgagggcaaggctcttgccattcagatcgcgctgtgatccgtggtgtttctcctgtgcaggtactggtgaggtttgtccaatggcggcggcagcggcagcggcggcagcggcagcagcggcagcagtagcagcccctcccacagctgtgggctccctctcgggggcggagggggtgcctgtgagctctcagccacttccctcccaaccctggtgagctccaagttggttgcgggggagaggggagaatggagtagagtcccttggtacaagctcctctcccccctcttttcccaccaactcctatttccctaccaaccaaggagcctccagaaggaaaggaggaagaaatgttttcttaggggaattcgctaggttttaacgatttgtttctcctgctcctcttctgtcagacctgaccccacacaaacctgtcccctcggttgtgttgaagtcccctggacagtgggcaggggtggcagaggacacgagcagccactgcccgtaccccctctcctctctgtaagcccatgccctgtcttcccagggacttgtgagcctcttccctcgacggtcctcttctctccttccagtcctctccccctgctgtctgcagcccctccccggggagttggtgctttcttttccttttttttttttttccagggggagggaggagaggaaggagggggatcagagctgtcccaaagagggaaagcggtgaggtttgaggaggggcagaagcagggccggcaaaggttgtaccttcataaggtggtatggggggttggggtcaggccctgaacatcgtcctacttgagaatctgtcaggggaaaaagtcaaggggagcaggaggaagagccaggagggccagaggcagagaagagatggagtcttaggggccagggtgagcgaggggtccagggcctagaggtgcttcctgggggcgggggaatgcagccagtgtccccctcccctcttccaccccagctccagccctggtcttgtcttttcatccctcttccccacgacagaagaagttgtggccctggccatgtcatcgtgttcctgtgtcccctgcatgtaccccaccctccaccccttccttttgcgcggaccccattacaataaattttaaataaaatcctgtttctggctctggattgaa

SEQ ID NO: 1297 - DNA, 4650 bp, Homo sapiens; identical to SEQ ID NO: 1296
